United States Patent 7,510,834 (GENE MAPPING METHOD USING MICROSATELLITE GENETIC POLYMORPHISM MARKERS) - sequence listing, part 4

SEQ ID NO: 16710 - DNA, 259 bp, Homo sapiens
  AL133355.12_124378
  Located on chromosome 10
  Distance between a terminus base of telomere on chromosomal short arm and 5'-terminus of this base sequence : 111031405
  Distance between 3'-terminus of neighbour sequence of sequence listing upward to telomere on chrosomal short arm and 5'-terminus of this base sequence : 6093
gatgtacaaggcagacacttaatattggaaggatgggaagaaggaaagaaggaagggagggagagagggagagagggagggaggaaaaggaaggaaggaaggaaggaaggaaggcaggaaggaaggaaggaaggaaggaaaccagagacatattttaccctgataagaattctcaaaaaacaaccaaatccccccaaactagagtgtgggtgtttggctatgtcaccctaggctgctgtcactaattaagaccatatgg

SEQ ID NO: 16711 - DNA, 236 bp, Homo sapiens
  AL138761.12_4629
  Located on chromosome 10
  Distance between a terminus base of telomere on chromosomal short arm and 5'-terminus of this base sequence : 111216952
  Distance between 3'-terminus of neighbour sequence of sequence listing upward to telomere on chrosomal short arm and 5'-terminus of this base sequence : 185288
ctaatattagtgacgttgagcatcttttcatgtgcttattggccatttgtatatcttcctgggagaaatacctgttcggctcctttgcctatttttgaattgggctagttgtgggttttttttgttgttgttgttgttgttgttgagttttaggagttgtctgtatattctggatattaatcctcatcagatacatgatttgtaaatattttctgtcactttataggttgccattt

SEQ ID NO: 16712 - DNA, 381 bp, Homo sapiens
  AL138761.12_61671
  Located on chromosome 10
  Distance between a terminus base of telomere on chromosomal short arm and 5'-terminus of this base sequence : 111274023
  Distance between 3'-terminus of neighbour sequence of sequence listing upward to telomere on chrosomal short arm and 5'-terminus of this base sequence : 56835
cagctatgagaaggctggtgttggggagctcataggcctgtaggcctggctctgcagggggaagacctgggcctggacacatagacacacatacacacacacacacacacacacacacacacacacacacacacacacacactcccactgccctacatcgtcccatgtctcttagcctcatttctgtgatgataccacagctcccttgcaaagagactgtatctccatgttcttgtccccacggcttgcggcggccagctactcactctgcatgtactcagagatgtactgctgaatctcctggccagagctgctgatagagcccggaggcccagggggcccagggggccctggcgggcctgacacgtacatggtacttga

SEQ ID NO: 16713 - DNA, 384 bp, Homo sapiens
  AL138761.12_63206
  Located on chromosome 10
  Distance between a terminus base of telomere on chromosomal short arm and 5'-terminus of this base sequence : 111275377
  Distance between 3'-terminus of neighbour sequence of sequence listing upward to telomere on chrosomal short arm and 5'-terminus of this base sequence : 973
aaggttgagtccgaaagaactggaccctggaagccaacaacacacacagtgcagtcagccagggtttggagaggctctggccagagccagaatggggcggggttcagcccttacctgaggttgagaaacctgggaggccttgctcgcctgaggaacacaccaagggagggacagtcagcctcacttttctcacccactaacagccctgtagagcctccccaagatccatgattgctggggctgcgttgccctttgggcagtacctagagatgccacacacacacacacacacacacacacacgcacacgcacacttgcactacacccatgcacacactcaaccattcctagagaaacactgctctactcttgcttatttgcacc

SEQ ID NO: 16714 - DNA, 359 bp, Homo sapiens
  AL138761.12_64010
  Located on chromosome 10
  Distance between a terminus base of telomere on chromosomal short arm and 5'-terminus of this base sequence : 111276308
  Distance between 3'-terminus of neighbour sequence of sequence listing upward to telomere on chrosomal short arm and 5'-terminus of this base sequence : 547
aatagtttgagtatggacactgatgtttgtgaagaagcagcactttgcacagcacctgacaacatagatgctcaatcaatacttgtcaaatagttggatgggtggatggatggatgaatgggtgggtggatgaatgggcgggtgggtggatggatggatggatggatggatggataggtggatggatggatggatggataggtggatgggtagatggatggataaatggatgggtggatggattttccactaggaacaggttctggcctaatgtttgctttaaagttatttccacaagtttctatgttgtacggtcggcacttacttcacgcgcatgtatcctgcctactttatcagac

SEQ ID NO: 16715 - DNA, 324 bp, Homo sapiens
  AL138761.12_78884
  Located on chromosome 10
  Distance between a terminus base of telomere on chromosomal short arm and 5'-terminus of this base sequence : 111291120
  Distance between 3'-terminus of neighbour sequence of sequence listing upward to telomere on chrosomal short arm and 5'-terminus of this base sequence : 14453
ccaacagataccataagatcattcagctcttcatccttccatttagaacaaagaaaaaggcttctaatctacccagaaaactcacttccaactgcaggaaatgaatcagagacaaggttcaatccatggcaatacctttagggccagggcttcctcggagatttcctgcaagaaaaagcaaatcctgagtcagcttcacatctcctgtcacacacacacacacacacacacacacacacacacacaataaggggatcatggtatgggaagaagaaactgaggcaaagactagagatcagattctaaatttggctagtccagtga

SEQ ID NO: 16716 - DNA, 392 bp, Homo sapiens
  AL138761.12_101139
  Located on chromosome 10
  Distance between a terminus base of telomere on chromosomal short arm and 5'-terminus of this base sequence : 111313305
  Distance between 3'-terminus of neighbour sequence of sequence listing upward to telomere on chrosomal short arm and 5'-terminus of this base sequence : 21861
ttgagtttatgtagccgctgctgccatgagtcaggctttgtttctccagccggctccctccaccaagagaggctgttttagcatagccattgctggtcccgccttctgccaggaacaaaagcaggtgataatttcagggtggagtcaggccagaggatcccctggtcccccaccctgtggaaggcttccctggtttttcaccaggaccttcttagtttggggttcctttcccacctacattataagatgcaagctgccatgctccagtttcgttggttttttgttttgttttgttttgttttgttttgttttgttttatacaaatatctagagtgagtattccacctgatttaaaagaaaagtctcctgggtggaatatagcaagttgcata

SEQ ID NO: 16717 - DNA, 482 bp, Homo sapiens
  AC016744.5_76819
  Located on chromosome 10
  Distance between a terminus base of telomere on chromosomal short arm and 5'-terminus of this base sequence : 111450655
  Distance between 3'-terminus of neighbour sequence of sequence listing upward to telomere on chrosomal short arm and 5'-terminus of this base sequence : 136958
catgtgagtactccatatggatctgggggtactgttctcatcgatgccaattgatcatttattgagtttttaaaattaaagtggtgccaggcgcggtggctcacgcctgtaatcccagcactttgggaggccaaagcgggtggatcacgaggtcaggagttcaagaccagcctggccaatatggtgaaacctgtctctactaaaaatacaaaaattagctgggtatggtggcacacgcctgtaatcccagctacttgggaggctgaggcaggagcatcgcttgaacctgggaggcggaggttgcagtgagccaagattgtgccactgcactccagcctgggcaacagagcaagactccatctcaaaaataaataaataaataaataaataaataaataaataaataaagtggtgtattttaaaatggatttattcatttacccatttaagagaatatcctgaactcctaccatgaacaaagt

SEQ ID NO: 16718 - DNA, 255 bp, Homo sapiens
  D10S540
  Located on chromosome 10
  Distance between a terminus base of telomere on chromosomal short arm and 5'-terminus of this base sequence : 111634954
  Distance between 3'-terminus of neighbour sequence of sequence listing upward to telomere on chrosomal short arm and 5'-terminus of this base sequence : 183817
aatgaagcccctgctacacatatatagaaaaatgatagaaatccctcaagggcacaactcagaataaacatgatgactgtaatgtgcattgctatttctttatgagtgtgtgtgtgtgtgtgtgtgtgtgttgtaagcttgttttgcttgtgagagtgatcaaactgtgttaaatgaaacatcagaggaaagagtaagaagcacaactgtacatctgaatccgggccctgtcgtcctggtttgtgctgtaacgaa

SEQ ID NO: 16719 - DNA, 436 bp, Homo sapiens
  AL161646.10_69623
  Located on chromosome 10
  Distance between a terminus base of telomere on chromosomal short arm and 5'-terminus of this base sequence : 111774670
  Distance between 3'-terminus of neighbour sequence of sequence listing upward to telomere on chrosomal short arm and 5'-terminus of this base sequence : 139461
cacagaataagtgctaagcaaaggtttgttgactgaaaaatgagtgaaataaatgcattgatgagaagaacctgctttagtgctctgtgcagcgagggtacatgatacccaggaaagcagcctttcccagcctccaagaaggcttattcctgccccctctctataactaaaatgtctgatgtgcccagcctctgtgtgtgtgtgtgtgtgtgtgtgtgtgtgtgtgtgtgtgtgtttaaggaggggccaatagggaaagcaattaaaatattaattaatacaagagtacaagactatgcagtttgttcttttcctcgattgttcattcatttatcaactaataagcacgtgccatatgccacaatgtattgggcaatgagagggattcacatatgaacaagacattgtcctgtcctgaaggaactcacagcatagt

SEQ ID NO: 16720 - DNA, 391 bp, Homo sapiens
  AL161646.10_118167
  Located on chromosome 10
  Distance between a terminus base of telomere on chromosomal short arm and 5'-terminus of this base sequence : 111823111
  Distance between 3'-terminus of neighbour sequence of sequence listing upward to telomere on chrosomal short arm and 5'-terminus of this base sequence : 48005
ggattacaaccacttgatagtcacaagtgacaggagcggtgcttgaagaataagccatttcttcactctgtgatcatttacccaacaaagggggagcagctgagggtcgcaagggtaacagatgagcaaggtacagcaatggctgtgaaggtgccgcctgtctggttgctattctggaggctgggtgttccaggatgtggtttttcactcaaggtctctgtactttccttttatctttctattaaattttttttgatagaatctttatatatgcgcgcgcgcgcgcgcgcgcgcgcacacacacacacacacacacacacacacacacacatatacattgatgcatttatttcaacgatttgttcgacacatacttattgagtgcctacca

SEQ ID NO: 16721 - DNA, 472 bp, Homo sapiens
  AL355350.3_98759
  Located on chromosome 10
  Distance between a terminus base of telomere on chromosomal short arm and 5'-terminus of this base sequence : 111850562
  Distance between 3'-terminus of neighbour sequence of sequence listing upward to telomere on chrosomal short arm and 5'-terminus of this base sequence : 27060
ctagcttagaccaggatcactcagcagtaataaatgaagacagaagacacggggatttctctctaaaaatttagggtgtgcaagaaccctagtgcttttgaacagcattagaaggcaggcttataggattatagaactgaatatcactccagcaatgtgggagagagttcagagaaaagtattgattaagagacataatattaatatatagacagagttatataatagctggaaagatgtttggctgtgccttcaggtattagtcacagttcttctgggaaacagaaccaaaagaatcagtcaatctatctaggtatctatgtctatctatctatctatctatctatctatctatctatctatctatctatctctctatccatccatccaatctttctgtctagagagatgctggaaacctgggagagccaatgaataactactgtctgagtctgagttggagctagagtct

SEQ ID NO: 16722 - DNA, 362 bp, Homo sapiens
  AL161646.10_151068
  Located on chromosome 10
  Distance between a terminus base of telomere on chromosomal short arm and 5'-terminus of this base sequence : 111856184
  Distance between 3'-terminus of neighbour sequence of sequence listing upward to telomere on chrosomal short arm and 5'-terminus of this base sequence : 5150
tgttctggctatttggaataactgtggtactgagacccaaatgggttgagtcttttcattcaggagcagccatgagctaagggaaagtccttctggcaaagctcttattggcataagacactttgtgtgtgtgtgtgtgtgtgtgtgtgtgtgtgtgtgtgtgtgtgtgttttcctggcattgttggggataagaaactcagtgatttagatgaaaactttccatgcaattaactttctccagactaaagcaggtgcggaagggagctactgggccagtctgcttagtaaatatctatccccagatggagagcaattcaatggaaataattacaccaggtcaattaagcagaactcagatct

SEQ ID NO: 16723 - DNA, 281 bp, Homo sapiens
  AL161646.10_182704
  Located on chromosome 10
  Distance between a terminus base of telomere on chromosomal short arm and 5'-terminus of this base sequence : 111887801
  Distance between 3'-terminus of neighbour sequence of sequence listing upward to telomere on chrosomal short arm and 5'-terminus of this base sequence : 31255
cactaccaatgactggtaggagttgatggataaatatctagcccccttgactactggggttggctaactctgagacatgtttctttcatggtttcccagagctccctgtgggattaaaccccagttttaaatatattttaaatgtgtgtgtgtgtgtgtgtgtgtgtgtgtgtgtgttttaaatgggtgcattattagtaaggagagagcctgcaagtatgatttaaaaaaatggaaaatgcttctttcaagcatgcctagatttggtcttacttcaagca

SEQ ID NO: 16724 - DNA, 143 bp, Homo sapiens
  DID22N_0004609
  Located on chromosome 10
  Distance between a terminus base of telomere on chromosomal short arm and 5'-terminus of this base sequence : 112030441
  Distance between 3'-terminus of neighbour sequence of sequence listing upward to telomere on chrosomal short arm and 5'-terminus of this base sequence : 142359
ggagggatatcaaggtagatagggtgtgtgtgtgtgtgtgagagagagagagggagggagagagagagagagagagagagagagagagagagagaatattatccagcatagtagaaaaggaagagatttagaaggttacttca

SEQ ID NO: 16725 - DNA, 175 bp, Homo sapiens
  DID22N_0004617
  Located on chromosome 10
  Distance between a terminus base of telomere on chromosomal short arm and 5'-terminus of this base sequence : 112193344
  Distance between 3'-terminus of neighbour sequence of sequence listing upward to telomere on chrosomal short arm and 5'-terminus of this base sequence : 162760
tgtgctgttctgtccttaataacaacaaaaagtttgcgagggtttgtgtggtattgttttctttctttctgcaataaggaaagaaaacacacacacacacacacacacacactcagacctgtcactgggacaaaatacaaaaccatcacatttgggctcctctgtttcttacctc

SEQ ID NO: 16726 - DNA, 130 bp, Homo sapiens
  D10S1264
  Located on chromosome 10
  Distance between a terminus base of telomere on chromosomal short arm and 5'-terminus of this base sequence : 112261672
  Distance between 3'-terminus of neighbour sequence of sequence listing upward to telomere on chrosomal short arm and 5'-terminus of this base sequence : 68153
atatccgatgcctgtactgctttataattatgtcttctcaaacacacacacacacacacacacacacacacacacacacacacacctgaagaacaagttaatgcatgcaaatcttgacaccctcacaact

SEQ ID NO: 16727 - DNA, 94 bp, Homo sapiens
  D10S1671
  Located on chromosome 10
  Distance between a terminus base of telomere on chromosomal short arm and 5'-terminus of this base sequence : 112328446
  Distance between 3'-terminus of neighbour sequence of sequence listing upward to telomere on chrosomal short arm and 5'-terminus of this base sequence : 66644
atgcaatgagtgctccctcacacttgtgcattcacaaacacacacacacacacacacacacacacacatctctaccatcatttgagcatcatca

SEQ ID NO: 16728 - DNA, 313 bp, Homo sapiens
  chr10.fa.O7frz.114926352
  Located on chromosome 10
  Distance between a terminus base of telomere on chromosomal short arm and 5'-terminus of this base sequence : 112399643
  Distance between 3'-terminus of neighbour sequence of sequence listing upward to telomere on chrosomal short arm and 5'-terminus of this base sequence : 71103
ggcaccgtataatttaggttacataatctgtaccattgggtcactcaactgcctggcactcaaaggacattctgacaagtttcaaacatacacacagacacacagttacgcacatacacacacacacacacacacacacacacacacacacaccagtttttctcaggctcctatgccagatttctccatatgtgtctactcttccactctttgcttccttcaggggacacctgtcaggagcaatgtgagagattattggtatacagactgaataattcaagagacctggactaatcgatattgtctttgactc

SEQ ID NO: 16729 - DNA, 214 bp, Homo sapiens
  AC023314.3_27338
  Located on chromosome 10
  Distance between a terminus base of telomere on chromosomal short arm and 5'-terminus of this base sequence : 112510785
  Distance between 3'-terminus of neighbour sequence of sequence listing upward to telomere on chrosomal short arm and 5'-terminus of this base sequence : 110829
tgaattacatcctgtcagctacctgctaaaatgcatggagcatcaaagccccagctcgtctctggatgtaccaactgtggtattttacctttgggtttttttttcttttcttttcttttcttttcttttcttttcttttcttttcttttcttttcttttctcagtgaacacacactaacagggtttgtctcttcattgtgatgtaggaatgatt

SEQ ID NO: 16730 - DNA, 239 bp, Homo sapiens
  chr10.fa.O7frz.115199260
  Located on chromosome 10
  Distance between a terminus base of telomere on chromosomal short arm and 5'-terminus of this base sequence : 112706697
  Distance between 3'-terminus of neighbour sequence of sequence listing upward to telomere on chrosomal short arm and 5'-terminus of this base sequence : 195698
tctacctccatactatgcacagcaggcaaaatcacaggcatctgacatgaacttaggccgataagttttccctgaatcttacacacacacacacacacacacacacacacacacacacatatccacaggtgaatatggaaaaaaataacaatgacaactttaaggaaatttttgtcatgctttctcttgatttattttcaatagttcaaatgaaacttattgagcacgttattcttatc

SEQ ID NO: 16731 - DNA, 371 bp, Homo sapiens
  chr10.fa.O7frz.115289911
  Located on chromosome 10
  Distance between a terminus base of telomere on chromosomal short arm and 5'-terminus of this base sequence : 112812682
  Distance between 3'-terminus of neighbour sequence of sequence listing upward to telomere on chrosomal short arm and 5'-terminus of this base sequence : 105746
agactcctatgattacctcgaccaattctgttctcctcagccccttcctaaaaatgatcaccactggaaattgtattattccataccttctcctatttatttacacacacacacacacacacacacactcactcaataagtggataaaataataatattttgagtaaattttcattctctctccaatttatttacacacacactcatgagtggataaaataaatattaataaatattttgagtaaatttttatcacaaaatatgtcatattttcttaaaactattctgaatattttattcaaaaatactaacacatatttctcaaaacataaagatctaagtttttttactgagttctgcagaatatttca

SEQ ID NO: 16732 - DNA, 406 bp, Homo sapiens
  chr10.fa.O7frz.115445427
  Located on chromosome 10
  Distance between a terminus base of telomere on chromosomal short arm and 5'-terminus of this base sequence : 112952359
  Distance between 3'-terminus of neighbour sequence of sequence listing upward to telomere on chrosomal short arm and 5'-terminus of this base sequence : 139306
ctcacttcatttggtctagtttatttccttctttatttctctttctttcttcctttctttcctttattttcttttgctttatcttttctttcttgctttctctctctttccttccctccctcccttctctttccttccttcctttctttctctttcttctttctttctctttttctttcattctctttcttttctttctttctccctctttctttcttttctttctctctttctctttcttttccttccttccttccttccttccttccttccttccttccttcttcccctccctccctcccttccttccttcctctttctttcttttacaattaaggtcttagattttagggtttgtcaagtgcctttttgatttgatgctctggaattctatagccttcatatt

SEQ ID NO: 16733 - DNA, 202 bp, Homo sapiens
  D10S530
  Located on chromosome 10
  Distance between a terminus base of telomere on chromosomal short arm and 5'-terminus of this base sequence : 112996922
  Distance between 3'-terminus of neighbour sequence of sequence listing upward to telomere on chrosomal short arm and 5'-terminus of this base sequence : 44157
ttgacaaggccatcaaaaccagacacagaagtttcatccaactgcatccatcacctttcctgatgggaacttcttgtttttctcttttctttgtgtgtgtgtgtgtgtgtgtgtgtgtgtgtgtgtgtgtgtgtgtgatgggaacctctttgacagggagttacttggttacttgaaaggagacacaactcttactgctaga

SEQ ID NO: 16734 - DNA, 259 bp, Homo sapiens
  AC025701.4_129398
  Located on chromosome 10
  Distance between a terminus base of telomere on chromosomal short arm and 5'-terminus of this base sequence : 113140378
  Distance between 3'-terminus of neighbour sequence of sequence listing upward to telomere on chrosomal short arm and 5'-terminus of this base sequence : 143254
ccataaacatcacttatctagcacacagaattgatgctttatccgtttgaccatatgtgactgggcacatgtgttggtgtgcatttttacacaaagctttgtataggccaagacctgggctacaagtaagacatttgggttctatctctggctattccacttactagatgaatatattactcaggataggctagattgtgctgcaataaaacaataagtgttaaaaataaaataaaataaacaatctccaggtcttagt

SEQ ID NO: 16735 - DNA, 394 bp, Homo sapiens
  chr10.fa.O7frz.115895100
  Located on chromosome 10
  Distance between a terminus base of telomere on chromosomal short arm and 5'-terminus of this base sequence : 113362015
  Distance between 3'-terminus of neighbour sequence of sequence listing upward to telomere on chrosomal short arm and 5'-terminus of this base sequence : 221378
acttacgtggaaacttgagttccttccattctctgacaaagacaaccttcattataggaacttgaattgttaaatctgaattcttgacaacccaatcaattttcctttgttaagaagcagataggcactcccaccttgactggatattatcatcactataatctgcatgaacccctccaaaaagccattctatgttccctctcattcatcttagtagaatcagaatttaaggggggtgtgtgtgtgtgtgggtgtatgcgtgtgtgtgtgtgtgtgtgtgtgtgtaacattaagcacctattacatcagccaattcctctagtagatttgtgatgttgacaggattgttctataatctttatcatacaaatagtaagctaaggctcctactgtt

SEQ ID NO: 16736 - DNA, 135 bp, Homo sapiens
  chr10.fa.O7frz.115977415
  Located on chromosome 10
  Distance between a terminus base of telomere on chromosomal short arm and 5'-terminus of this base sequence : 113444406
  Distance between 3'-terminus of neighbour sequence of sequence listing upward to telomere on chrosomal short arm and 5'-terminus of this base sequence : 81997
ccttcagatacaggttacatttactagaatcagtgaaataaaatattgattgagcactggccaaggacacacggggatttcaagtgtgtgtgtgtgtgtgtgtgtgtgtgtgtgtcacctaagttaccttccaat

SEQ ID NO: 16737 - DNA, 201 bp, Homo sapiens
  D10S566
  Located on chromosome 10
  Distance between a terminus base of telomere on chromosomal short arm and 5'-terminus of this base sequence : 113517215
  Distance between 3'-terminus of neighbour sequence of sequence listing upward to telomere on chrosomal short arm and 5'-terminus of this base sequence : 72674
ctgaggtagggggatggcttgagcccaggaggggaggctgcagtgagccatgatcaggccactgcattccagcctgggcaacagaatgagatcctgtctcaaacacacacacacacacacacacacacacacacacacacacacacaaaaataaaaccaaacaaaataaaaaataatagcaatatgtgatttttcacagct

SEQ ID NO: 16738 - DNA, 301 bp, Homo sapiens
  AL157710.13_77709
  Located on chromosome 10
  Distance between a terminus base of telomere on chromosomal short arm and 5'-terminus of this base sequence : 113608511
  Distance between 3'-terminus of neighbour sequence of sequence listing upward to telomere on chrosomal short arm and 5'-terminus of this base sequence : 91095
tataatcctagaatcatggatgagaagatgaaatagtataaacttactggtgttttcctaattaaaatattaaactaagctaatacaagttacattaaaatcccaatagtgtctttcatgaaactttatgagtatctatctatctatctatctatctatctatctatccatctatcactacaagatcaagagcagcaaagaaaattttaaagaataggaatgaagggaggaaacttacctactatataccaaaatttatgacattataattaaaatagtataactggcacatagacaaatt

SEQ ID NO: 16739 - DNA, 221 bp, Homo sapiens
  D10S1778
  Located on chromosome 10
  Distance between a terminus base of telomere on chromosomal short arm and 5'-terminus of this base sequence : 113656540
  Distance between 3'-terminus of neighbour sequence of sequence listing upward to telomere on chrosomal short arm and 5'-terminus of this base sequence : 47728
ctgctctggattgaatgtttctgtctccccacctcacgaatatgtatgttgaaactttaattcccaaagtgatgatatttgtaggtgaagcctttgggaagtaattagggttagattaggtaatgagtgtggggcactctttctctgtgtgtgtgtgtgtgtgtgtgcatgtgtgtgtgtgtatacacaccaaggaaagaccatgtgagatcataaccaag

SEQ ID NO: 16740 - DNA, 296 bp, Homo sapiens
  AL359847.17_68757
  Located on chromosome 10
  Distance between a terminus base of telomere on chromosomal short arm and 5'-terminus of this base sequence : 113768815
  Distance between 3'-terminus of neighbour sequence of sequence listing upward to telomere on chrosomal short arm and 5'-terminus of this base sequence : 112054
ggatagcgttaggagaaataactaatgtaaatgacgagatgatgggtgctgcaaaccaacatggcacatgtatacctatgtaataaatctgcacattgtgcacatgtatcctagaacttaaagtataataaaaataaataaataaataaataaataaataaataaataaataaataaaaatagcatcttggctattcttgacattagtcactttttcccatgtcaaatataagatctggagtgagatatcacttttctctccctagacataagtatcctgacataagtatcctgag

SEQ ID NO: 16741 - DNA, 261 bp, Homo sapiens
  chr10.fa.O7frz.116446408
  Located on chromosome 10
  Distance between a terminus base of telomere on chromosomal short arm and 5'-terminus of this base sequence : 113877610
  Distance between 3'-terminus of neighbour sequence of sequence listing upward to telomere on chrosomal short arm and 5'-terminus of this base sequence : 108499
tctttcagcataaccagaataccagtgatatgaagcaactaagaatactgagcttgcttgaaaaggttggcatttgaaataaatggaaaactgagagaaaattactttgtccaagctgtcagcaacacagcaaactcgcatatgcatgcatgcacacacacaaacacatacacacacacacacacacacatgaaccttttcccttctctttccttcctcctatctctccccatccccaggttgtctttcgattctaaatca

SEQ ID NO: 16742 - DNA, 400 bp, Homo sapiens
  AL357333.9_82944
  Located on chromosome 10
  Distance between a terminus base of telomere on chromosomal short arm and 5'-terminus of this base sequence : 114099940
  Distance between 3'-terminus of neighbour sequence of sequence listing upward to telomere on chrosomal short arm and 5'-terminus of this base sequence : 222069
tctagactggttacagagtgaaactctgtttccgaagagaaaataaaataaaataaaataaaataaaataaaataaaataaaataaaataaacctaacaaattgaaaatcttaacaatttagttgtaagaataatccttctacgtggtaaacagaaggaagaaacatcgcttaaccacaacaaaaattaaaacaaacacacacaacttaaattcaatcaataaagtaaaaagtttataaatatataccagaaccattacaaagaacaaaaacatatatacaattcataaaataaaagaaatgccaaatgtaagatgcttgaaaaaggaagacgagaatgtaatctaattttgaaatatttttcagtagaagataagcttcagttatctaggaaatccact

SEQ ID NO: 16743 - DNA, 409 bp, Homo sapiens
  AL160010.8_15317
  Located on chromosome 10
  Distance between a terminus base of telomere on chromosomal short arm and 5'-terminus of this base sequence : 114248098
  Distance between 3'-terminus of neighbour sequence of sequence listing upward to telomere on chrosomal short arm and 5'-terminus of this base sequence : 147758
tacctatggaggtttcctaaactcttgagtacgggcactgtgagctgttcaaaagtcctaccgaggtttcatatatgacacattatatattatattatattatattatattatattatactatgttatattatatattataatatgaagtattatacatatttttccaccttattctctgttttctaaattacattttcagtaaggtatgtgtcattcctattaaagtactaaaatgaccaggcgtggtggctcatgcttgtaatcctgagagtttgggaggctgaggtgggagggttacttgaacccaggagctcaaaaccagtttgagtaacaaagtgggaccctgtctctatcaaaataataataataaaaaattagcctagggtagtcgcaaatatttgtagtcc

SEQ ID NO: 16744 - DNA, 227 bp, Homo sapiens
  D10S1663
  Located on chromosome 10
  Distance between a terminus base of telomere on chromosomal short arm and 5'-terminus of this base sequence : 114282046
  Distance between 3'-terminus of neighbour sequence of sequence listing upward to telomere on chrosomal short arm and 5'-terminus of this base sequence : 33539
agccataccatagtcaaactgctaaaatattcattatttccataatttattttagacaagactgttacctaatatgaagttgattcttaagaatatatatacaaccgtgtgtgtgtgtgtgtgtgtgtgtgtgtgtgtgtgtgtctgtgagtgtgtaacttttttataccccatctctctctttcctcactggtactctatgtacacagattgtaaattgcttgata

SEQ ID NO: 16745 - DNA, 276 bp, Homo sapiens
  chr10.fa.O7frz.116990032
  Located on chromosome 10
  Distance between a terminus base of telomere on chromosomal short arm and 5'-terminus of this base sequence : 114386363
  Distance between 3'-terminus of neighbour sequence of sequence listing upward to telomere on chrosomal short arm and 5'-terminus of this base sequence : 104090
attgactatacgcataatttgaaccaaagcccttattttgataagcagatttctgaaagggttagccagtaagattctgagctgggatgtagaacccaagttattcccagtggaagtgatatagaaagagacgctgtcagaagcaacactggatctagaattgattgtccaatacagccaggtatctattctaaagtacacacacacacacacacacacacgtacacacacaattggtgagtgaaatgaaagaaaagatagccagtgacctagaag

SEQ ID NO: 16746 - DNA, 199 bp, Homo sapiens
  DISD22_0011431
  Located on chromosome 10
  Distance between a terminus base of telomere on chromosomal short arm and 5'-terminus of this base sequence : 114460830
  Distance between 3'-terminus of neighbour sequence of sequence listing upward to telomere on chrosomal short arm and 5'-terminus of this base sequence : 74191
catcttgaccttacccgcagcagagcctgtgtgtcccagcctggggggagatcccggaaaggcagcagcagagagtgatgtaattaaatgatctcgtgtgtgagtgtgtgtgtgtgtgtgtgtgtgtgtgtgttagtttgggggattttttttcccatcaattttaacgcttagatttctctcctaacctcctaaagca

SEQ ID NO: 16747 - DNA, 118 bp, Homo sapiens
  DISD22_0011433
  Located on chromosome 10
  Distance between a terminus base of telomere on chromosomal short arm and 5'-terminus of this base sequence : 114536357
  Distance between 3'-terminus of neighbour sequence of sequence listing upward to telomere on chrosomal short arm and 5'-terminus of this base sequence : 75328
aactgtacatatgtgctcaacaacaacaaaaacaaactccacacacacacacacacacacacacacacacacacacacacgtgtggatttggtccctgggttacagtttgcgtagtgc

SEQ ID NO: 16748 - DNA, 328 bp, Homo sapiens
  chr10.fa.O7frz.119081385
  Located on chromosome 10
  Distance between a terminus base of telomere on chromosomal short arm and 5'-terminus of this base sequence : 114693988
  Distance between 3'-terminus of neighbour sequence of sequence listing upward to telomere on chrosomal short arm and 5'-terminus of this base sequence : 157513
gaggtcaggagatcaagactatcctggctaacatggtgaaaccccatctctactaaaaatacaaaaaattagctgggcatggtggcgggtgcctgtagtccagctacttagggaggctgaggccggacaatggcgtgaacccaggaggcggagcttgcagagagatgagattgcaccactgcactccagcctggacatagagtgagactctgtctcaaacaaacaaacaaacaaacaaacaaacattccatgctcatggactgcaagaatcaaaattttgaaaatggccatactgccaaaagcaatctacagattcaatgctatccta

SEQ ID NO: 16749 - DNA, 230 bp, Homo sapiens
  D10S1245
  Located on chromosome 10
  Distance between a terminus base of telomere on chromosomal short arm and 5'-terminus of this base sequence : 114862057
  Distance between 3'-terminus of neighbour sequence of sequence listing upward to telomere on chrosomal short arm and 5'-terminus of this base sequence : 167741
ggtggtccccattatttctctctttaattcaccagtatgactcctcaaaaatccagatgagtagcaattgacattattagactactgtaaactgaactaatgagcagcttcaaatgcagctctatgccagatagatagatagatagatagatagatagatagatagatagatagattagtactgatcagcctggtctctggttcataaaatttggctcttgaaatgcttc

SEQ ID NO: 16750 - DNA, 250 bp, Homo sapiens
  D10S1741
  Located on chromosome 10
  Distance between a terminus base of telomere on chromosomal short arm and 5'-terminus of this base sequence : 114868970
  Distance between 3'-terminus of neighbour sequence of sequence listing upward to telomere on chrosomal short arm and 5'-terminus of this base sequence : 6683
agatgttcagttccttggctcctcccaccttattcctttatgtccataatacttttgatggctgtttcttccacagaaactgaactgatacaatcagtaaagatacagaagatgtaaaagtaacaagcttgaactaatttgtatatgtgtgtgtgtgtgtgtgtgtgtgtgtgtgtgtatacatgaagtataaagtatatactttaagtcttcctttgtaccttccccaaagggagccatgacactactc

SEQ ID NO: 16751 - DNA, 247 bp, Homo sapiens
  D10S534
  Located on chromosome 10
  Distance between a terminus base of telomere on chromosomal short arm and 5'-terminus of this base sequence : 114980129
  Distance between 3'-terminus of neighbour sequence of sequence listing upward to telomere on chrosomal short arm and 5'-terminus of this base sequence : 110909
tcacggaagacaatttttccatggactggaggtggaggcggaggcagaggcggtgtgtgtgtgtgtgtgtgtgtgtgtgtgtgtgtgtgtgtgtgtggtttctggatgaaactgttccacttcagatcatcaggcattagattctcataaggagtgcataacctaggtccctcacattcacagttcacaacagggttcgcactcctctgagactccaatgctctgttaatctgcaggaggcagagct

SEQ ID NO: 16752 - DNA, 214 bp, Homo sapiens
  D10S1795
  Located on chromosome 10
  Distance between a terminus base of telomere on chromosomal short arm and 5'-terminus of this base sequence : 115021545
  Distance between 3'-terminus of neighbour sequence of sequence listing upward to telomere on chrosomal short arm and 5'-terminus of this base sequence : 41169
gtcccacagggctctattgtcgtgacctaatcaccttccaaatgccctgcctccactccacacacccttacattagagattacatttcaaccaccgaatttaaggggaacacaaatattcaggctttagcaacacacacacacacacacacacacacacacacacacacacatttatatggacacattgaagaatcaccacctagagtaatgcc

SEQ ID NO: 16753 - DNA, 186 bp, Homo sapiens
  HUMUT5027
  Located on chromosome 10
  Distance between a terminus base of telomere on chromosomal short arm and 5'-terminus of this base sequence : 115110070
  Distance between 3'-terminus of neighbour sequence of sequence listing upward to telomere on chrosomal short arm and 5'-terminus of this base sequence : 88311
cctaccatcaatcaactgagcaagttacttgaaatctatctatctatctatctatctatctatctatctatctatctatcatctatctatctatctatctatctatctatctatctatctatctatctaaccatattatagagggagacagagagacatatcttattggttctgttttctctggag

SEQ ID NO: 16754 - DNA, 235 bp, Homo sapiens
  AC021039.5_43510
  Located on chromosome 10
  Distance between a terminus base of telomere on chromosomal short arm and 5'-terminus of this base sequence : 115123027
  Distance between 3'-terminus of neighbour sequence of sequence listing upward to telomere on chrosomal short arm and 5'-terminus of this base sequence : 12771
cttgatacaagtaggactatccattttatctgttgttttatctatcatctatctatctatctatctatctatctatctatctatctatctatctatctatctatctgtctaatctctgtccttgtcctaattatttctgctcctctctgcatgtcagctttattctcttctgatttcgataaacttttctacacagtgggaaagataactgctagaaattccaaatccagtatct

SEQ ID NO: 16755 - DNA, 340 bp, Homo sapiens
  chr10.fa.O7frz.117741954
  Located on chromosome 10
  Distance between a terminus base of telomere on chromosomal short arm and 5'-terminus of this base sequence : 115181866
  Distance between 3'-terminus of neighbour sequence of sequence listing upward to telomere on chrosomal short arm and 5'-terminus of this base sequence : 58604
ctaccaagtcatgaggaaactatgaattctgaagacagaagtaccaaattcaataaacaaaaagataagtgtttaaagaaacatacttgatagaataaattgaaatggaatagagaataaaaatataatactctcacaacaaattgaaagtcagtcattgtgtatgataagataccttagaatttacatttcttattgtcataaataatacataaggtcattacacacacacacacacacacacacacacacacacaatgacagaaaaacacatgcaatgccaatggaagagtgatagctattcaaaacacgtgtgaaaaattctgctcggatattaaag

SEQ ID NO: 16756 - DNA, 381 bp, Homo sapiens
  chr10.fa.O7frz.117882297
  Located on chromosome 10
  Distance between a terminus base of telomere on chromosomal short arm and 5'-terminus of this base sequence : 115314201
  Distance between 3'-terminus of neighbour sequence of sequence listing upward to telomere on chrosomal short arm and 5'-terminus of this base sequence : 131995
ctaatttctaggcctcagtcactttctaccatgtcattttgctgcttttcaaaatcaatttgcaatttaatggtgtgtgtgtgtgtgtgtgtgtgttttcatataataaaactccaggaaaggagatccatgtcttctccatgaaaagaacaagtggggcgggtgttaatcaaaggctgatatcaaacatatggcctcagtaataaaaactgcgttctgtaaacctcttttcaagaggaagaagcttcattgtgagtttctcaggccatgtgtgttacccccatgtcgttctaatttctaagcctcaacatattctttctttgccatctcaaattcaatttgcaatttaatgtcatggggtctatcaagtggtgaggtctt

SEQ ID NO: 16757 - DNA, 326 bp, Homo sapiens
  chr10.fa.O7frz.118099435
  Located on chromosome 10
  Distance between a terminus base of telomere on chromosomal short arm and 5'-terminus of this base sequence : 115366697
  Distance between 3'-terminus of neighbour sequence of sequence listing upward to telomere on chrosomal short arm and 5'-terminus of this base sequence : 52115
agtagcacctgaattagacagtacatagttacccttttacaactgaagtaagatgcattgtaaatgaaggttttcagaaacctgtgggttatataaggcaacacacacacacacacacacacacacacacacacacacacacacagttgtttttacgtttgcttaaagaagaaaacttttgtttctgcctggtgagcattcaacacctccctatctctgtttttatagcatttacataccctgttttattttttcagcactttgaatcttgaagctaagacgtgtctgaatcataccatccttttgtagaatcttagctgtagctc

SEQ ID NO: 16758 - DNA, 421 bp, Homo sapiens
  chr10.fa.O7frz.117972368
  Located on chromosome 10
  Distance between a terminus base of telomere on chromosomal short arm and 5'-terminus of this base sequence : 115433404
  Distance between 3'-terminus of neighbour sequence of sequence listing upward to telomere on chrosomal short arm and 5'-terminus of this base sequence : 66381
ttgtgacattaagaaagtcgattgatctctgtgaacaagtttgatctgttttattataaggaaaaaaagaaatgatatatttgtgtgtgtacacacacacacacacacacacacacatatataaataaaacaaagcctctacaatgactaatatacatgtcttaagatttttagcaattttcacaattgcgattgaaatcatctcagctaagcaaattaaaaaaaaacttttctcagttgttaagcttggattcacatttatcggaattttggcagcaaagagatccagctcaagtgatggaaaatggtggctgcaacataagaaacatattttcacacattgtcaatgaggctttagtagagctgggattcaagtttaaatttccctagaatttttctgttgttcagttaaggctaacct

SEQ ID NO: 16759 - DNA, 441 bp, Homo sapiens
  chr10.fa.O7frz.118202094
  Located on chromosome 10
  Distance between a terminus base of telomere on chromosomal short arm and 5'-terminus of this base sequence : 115626797
  Distance between 3'-terminus of neighbour sequence of sequence listing upward to telomere on chrosomal short arm and 5'-terminus of this base sequence : 192972
ccaagataaatgcataattgacttttcctctaacccttcttttcacatgtaaaatgtagatttactaggtgttgatcaaagccttacaagaatataactacttgccttactgcctaccctttcccacctttaaaataaatttctttcttcgcctctggtttgctctttctcctttaaatactgaagtcctcaaaaccctcttaggaaaaagcatggattacaaaagctccagtgatttgtgtttctttcccaggtgcaacctcaactttggcaaaataaacctctaaattgattgagacttgtttcaatcaatttttgctttacaatatgtgtgtgtgtgtgtgtgtgtgtgtgtgtgtgtgtgtgtaatttctcattttctcagctataattagctataatcatcagtcaaattcagaaaccagttaggtgattcttact

SEQ ID NO: 16760 - DNA, 389 bp, Homo sapiens
  chr10.fa.O7frz.118275974
  Located on chromosome 10
  Distance between a terminus base of telomere on chromosomal short arm and 5'-terminus of this base sequence : 115675000
  Distance between 3'-terminus of neighbour sequence of sequence listing upward to telomere on chrosomal short arm and 5'-terminus of this base sequence : 47762
tcttgtcagcttccataatcatgtgagccaattgagccaatgctttatagtaatcgtttctcttcgtttatatgtgcatacacacacacacacacacacacacattcttttacataaatattcactatttatctgagaattattcactattacattccattttagttgcttctctgatttttttgattcatgttttatgattttcaggatacagattctacacaagttttgttagacttatacctaagaagtttctatttgtgaagtattctaagtggtatttgaaaaatttgaaaaatattttcccattactcatttttcatatgtaagatacaattgttttttaattattgatcttctattctgtgacttcgatgaattaacatact

SEQ ID NO: 16761 - DNA, 270 bp, Homo sapiens
  D10S1750
  Located on chromosome 10
  Distance between a terminus base of telomere on chromosomal short arm and 5'-terminus of this base sequence : 115855225
  Distance between 3'-terminus of neighbour sequence of sequence listing upward to telomere on chrosomal short arm and 5'-terminus of this base sequence : 179836
cggcttaacttaatcattccatattctacaaatatataaaaatatcacataagtatttcattaatgtctacaattatgatttgccaactaaaatattgccaacaataaagaaaatgataaaatctaaatgaaaaacatgaataggacttaaaagaaaaatcgctatagaaatcaagtgtgtgtgtgtgtgtgtgtgtgtgtgtgcgcgcgcgcgcgcgtgcatgtgaatcaaagaaaaccaatgccaaatatcacttttggcctgtaaaa

SEQ ID NO: 16762 - DNA, 350 bp, Homo sapiens
  AL355384.6_76634
  Located on chromosome 10
  Distance between a terminus base of telomere on chromosomal short arm and 5'-terminus of this base sequence : 115913269
  Distance between 3'-terminus of neighbour sequence of sequence listing upward to telomere on chrosomal short arm and 5'-terminus of this base sequence : 57774
gttctggtagaaatctaccacaagatcagggaaactttcttcttctcattttcactatcatttttatcaacattatttactgcataaagcatctgccacagtaaagtctgtgtccatttaattgacattataatttttcttaattataaaaatctcacacacacacacacacacacacacttcaatgaaactgagtaaattacatctgttgttaaggacaaagtaacattaagaaaagcctcaattgttttgagaaaacattttatcaatttaattgatatgcctttttttcaaaaagctaggtagaatgtggtaaatggatatactaagacaagcaggtacatagatgt

SEQ ID NO: 16763 - DNA, 304 bp, Homo sapiens
  AL355384.6_96224
  Located on chromosome 10
  Distance between a terminus base of telomere on chromosomal short arm and 5'-terminus of this base sequence : 115932820
  Distance between 3'-terminus of neighbour sequence of sequence listing upward to telomere on chrosomal short arm and 5'-terminus of this base sequence : 19201
atccttgtctgccactgacacctcaagcaccactggatcttctgggtcatatggcccaagtggcagagcagtttgcacagagcaggcagtctcaatcagttgcagagccttctcctgttctggactccactcctggtaccaaaatctatattagtcagggttctcttagagggacaaaattaataggataggatacacacacacacacacacacacacacacacacacacacacacacacacacacacacacatatatacatatatgagtttactaagtattaacttataggatcacaaggtcc

SEQ ID NO: 16764 - DNA, 247 bp, Homo sapiens
  AL355384.6_129304
  Located on chromosome 10
  Distance between a terminus base of telomere on chromosomal short arm and 5'-terminus of this base sequence : 115965969
  Distance between 3'-terminus of neighbour sequence of sequence listing upward to telomere on chrosomal short arm and 5'-terminus of this base sequence : 32845
ctacctaggactgctcacagtgcacacacacacacacacacacacacacccctccctacactgggtcttttagaagatgctggagtgctggagtgccccgtccggaaatacacagacaagttctaaactaactaactaactaactaactaaataaataaataaataaataaataaataaataaataaaaacaaaaaactccacaaggaatacactaagggcatgtattgcagattacctgtaaattt

SEQ ID NO: 16765 - DNA, 420 bp, Homo sapiens
  AL353740.8_150436
  Located on chromosome 10
  Distance between a terminus base of telomere on chromosomal short arm and 5'-terminus of this base sequence : 115996712
  Distance between 3'-terminus of neighbour sequence of sequence listing upward to telomere on chrosomal short arm and 5'-terminus of this base sequence : 30496
gtgatttagattcactgagttgactaatgaaaaaaatgtaaaacaaaaaaatgaaggcaatgactcaaagttacaagtatttatcactttgccaatttgtttgtggaagacagtaggctctcctcccaactccaagttagcacaaatcaaagactgaccctgaggaatgttgcacacaaccatttgaaaaagaaaaaagagagaaagaaagaaagagagagagagagagagaaagaaaggaaggaaaggaaaggaaaggaaaggaaaggaaaggaaaggaaaggaaaggaaaggaaaggaaaggagtttttttaaaaaaggaaaaaaccaccttctaaataaaattgaaagattaaaaagaatagacctctctcagtcttggtactctgtcagccttggtaatctgactgcagtgatgac

SEQ ID NO: 16766 - DNA, 316 bp, Homo sapiens
  AL353740.8_88184
  Located on chromosome 10
  Distance between a terminus base of telomere on chromosomal short arm and 5'-terminus of this base sequence : 116061297
  Distance between 3'-terminus of neighbour sequence of sequence listing upward to telomere on chrosomal short arm and 5'-terminus of this base sequence : 64165
gcctatgttaagtgatcatttaaataaggatttactaccaaaaagagcccattctgatttgacactgagattaccactggtatttttttttgtcctaatttacttttcaccttatatttcctttagaaactggtagtccctacaaatgtgagtcaggatcaggatttaggaggcaagatagagaggtaggtaggtaggcaggtggattggtgggtgggtgggtagatagatagatagatagatagatagatagatatcaaaatatatacttttatctggtctttttttcaacaagaatttgaggtggatactagat

SEQ ID NO: 16767 - DNA, 250 bp, Homo sapiens
  Z67711
  Located on chromosome 10
  Distance between a terminus base of telomere on chromosomal short arm and 5'-terminus of this base sequence : 116063139
  Distance between 3'-terminus of neighbour sequence of sequence listing upward to telomere on chrosomal short arm and 5'-terminus of this base sequence : 1526
tgctgcttttggaagtatcaaagaggaaaattctcacaagaattttcaacacaatccaagctcagctagcaagactccagaagcagagtactaatttttataatgtctctgatgtttcatttagcttttggccaataagactagatacaaggccaccagctgattcattcatgttaaactgaatgcaaatacacacacacacacacacacacacacacaaacacacacacacacacgatacaggcacatt

SEQ ID NO: 16768 - DNA, 397 bp, Homo sapiens
  chr10.fa.O7frz.118988276
  Located on chromosome 10
  Distance between a terminus base of telomere on chromosomal short arm and 5'-terminus of this base sequence : 116394730
  Distance between 3'-terminus of neighbour sequence of sequence listing upward to telomere on chrosomal short arm and 5'-terminus of this base sequence : 331341
acttacagtgacatcttggtttaggaatctaaccatgccatgtcgcagtttctttttttgtaaaaatgagagtacaaataagacatgataaattggggcttttttgtaagaattaaatgagatgatgccttcaaagcttcgcttatacctttcaatacccatttaaaattggctattcctctttcagttaaaaacgaaagaccaaaaacataagttctacctcttcttctctcacttcctcctctgcttcccctgccaccctctctcactctcgctctcgcttactctctctctctctctctctctctctctctctctccctctctcactcctcacagaagtatctgtagttgtcaagaaaaacagattgacaggctaggttatgctgcaataacaa

SEQ ID NO: 16769 - DNA, 270 bp, Homo sapiens
  Z67215
  Located on chromosome 10
  Distance between a terminus base of telomere on chromosomal short arm and 5'-terminus of this base sequence : 116562654
  Distance between 3'-terminus of neighbour sequence of sequence listing upward to telomere on chrosomal short arm and 5'-terminus of this base sequence : 167527
tggagcctgaattcaaatgcaggcagcaagaggcttcaccactttgcatacagtagttgctttatatcttataggaatttgcaactgcatctacttaaggagggaagaaaattgtgtgtgtgtgagagagagagagacagagagtatgtgtgtgtgtgtgagtgtgtgtgtgtgtgtgtgaaagagagagagagagagagacaaagatgggggtggggagacagagacagagagaaagagaaagagaatgctctgactagccaaccagtg

SEQ ID NO: 16770 - DNA, 215 bp, Homo sapiens
  D10S1246
  Located on chromosome 10
  Distance between a terminus base of telomere on chromosomal short arm and 5'-terminus of this base sequence : 116681109
  Distance between 3'-terminus of neighbour sequence of sequence listing upward to telomere on chrosomal short arm and 5'-terminus of this base sequence : 118185
agcgttttctatagctctgacggaatttaaggtaaccatatagtcaggttgtgttttcataatttggagtttctcatctcatcaacgtcaccaaattggcattcctatttgttttctggaaggaaggaaggaaggaaggaaagaaggaaggaaggaaggaaggaaggaaggaaggaaggaaggaaggaagtccctagtcttcaatgagtccgtag

SEQ ID NO: 16771 - DNA, 134 bp, Homo sapiens
  DISO7_10002956
  Located on chromosome 10
  Distance between a terminus base of telomere on chromosomal short arm and 5'-terminus of this base sequence : 116755875
  Distance between 3'-terminus of neighbour sequence of sequence listing upward to telomere on chrosomal short arm and 5'-terminus of this base sequence : 74551
tcctgatctccatctccctctttcttcctttcttcctttcttttcttctctctttctctctttctctctctctctctctctctccctctcacacacacaggttttatgatccccccaaataacgcacagaagtt

SEQ ID NO: 16772 - DNA, 220 bp, Homo sapiens
  D10S597
  Located on chromosome 10
  Distance between a terminus base of telomere on chromosomal short arm and 5'-terminus of this base sequence : 116960636
  Distance between 3'-terminus of neighbour sequence of sequence listing upward to telomere on chrosomal short arm and 5'-terminus of this base sequence : 204627
gaatgaagacatccagaggggagatacatacacacacacacacacacacacacacaccacacacggagagagagagagagagagagagagggagggaggaaatatactggtgaatataaattgagcccctacatccatctgttctgaaatttagggttcaatacaataaattttttatgttcctataaaataaaattttagttgggtttctgatacttgc

SEQ ID NO: 16773 - DNA, 136 bp, Homo sapiens
  Z67172
  Located on chromosome 10
  Distance between a terminus base of telomere on chromosomal short arm and 5'-terminus of this base sequence : 117228581
  Distance between 3'-terminus of neighbour sequence of sequence listing upward to telomere on chrosomal short arm and 5'-terminus of this base sequence : 267725
ccctggtttcctatgcaatgtgtgtgtgtgtgtgtgtgtgtgtgtgttcacctatatgcattatgtctgtgcacatgcatgtgtgtatactcacggattatcacaaaagaggaagtgtctttgaacaacaggctca

SEQ ID NO: 16774 - DNA, 437 bp, Homo sapiens
  AL354951.1_147585
  Located on chromosome 10
  Distance between a terminus base of telomere on chromosomal short arm and 5'-terminus of this base sequence : 117314161
  Distance between 3'-terminus of neighbour sequence of sequence listing upward to telomere on chrosomal short arm and 5'-terminus of this base sequence : 85444
caggtaaagtcaagctcatcacactgaatgaaagcaactgtgctgtattcttcaccctctctcactgaccttctttctatatatattaatctatattggccaatagtctgctcaaagaaagattattcacgttctctctctctctctctctctctccccccccccccccatttgtgacccattcaaatagagaactagaaagagaaggcagaaagttccaaaagaaagaattgcctttaagattattggacttcaataactttcagtataaatatcacactggtaatttttccactagaattgaagatgtgagaagcaatgaaaataaagtgtttctgtgagtgtattgggtgaagagactggtcaaaggggctgttctctgaagagctagagtcagggaaattataaagatttggttggttcaatcctggtttact

SEQ ID NO: 16775 - DNA, 142 bp, Homo sapiens
  DISO7_10002959
  Located on chromosome 10
  Distance between a terminus base of telomere on chromosomal short arm and 5'-terminus of this base sequence : 117380128
  Distance between 3'-terminus of neighbour sequence of sequence listing upward to telomere on chrosomal short arm and 5'-terminus of this base sequence : 65530
ataacagccagcttcaaatgcctgcctttgtgtgtgtgtgtgtgtgtgtgtgtgtgtgtgtgtgtgtgtgtgagagagagagagagagagagagagagagagaaagggaaagagaaatcaactgcagcaacaggcaacaatc

SEQ ID NO: 16776 - DNA, 333 bp, Homo sapiens
  chr10.fa.O7frz.120405770
  Located on chromosome 10
  Distance between a terminus base of telomere on chromosomal short arm and 5'-terminus of this base sequence : 117433350
  Distance between 3'-terminus of neighbour sequence of sequence listing upward to telomere on chrosomal short arm and 5'-terminus of this base sequence : 53080
aaagctaaggcctcatcttacctctgagacaatgcctccccacttcatgaactgcttttctccgtacgccttctttgtctttgtgtgtgtgtgtgtgtgtgtgtgtgtgtgtgtgtgagacggagtctcgctctatcgcccaggctggagtgcagtggcacgatctcggcttgctgcaacctccacctcccgggttcaagcaattctcctgcctcagcctcccaagcagctgggactataggcacatgccaccacgcccagctaattttttgtatttttagtagagacggggtttcaccgtgtcagccaggatggtctcgatctcctgacctc

SEQ ID NO: 16777 - DNA, 449 bp, Homo sapiens
  AL354951.2_9331
  Located on chromosome 10
  Distance between a terminus base of telomere on chromosomal short arm and 5'-terminus of this base sequence : 117472823
  Distance between 3'-terminus of neighbour sequence of sequence listing upward to telomere on chrosomal short arm and 5'-terminus of this base sequence : 39140
gatagaatgcatcctgtacagtttgtattaaatagtctcattgttttaaacaattctgttctattttattttattttattttattttattttattttattttattttattttatttcaattcagggtcttactctgttacccaggctagagtgcgatggcgcaatctcggctcactgcagcctcaatctttcaggctcaggcaatcctcccgccttagcctgctgagtagctgggactacgggcgcgtgccaccacgcctggctaatttttgtatttttagtagagacggttttgccacattgcccaggctagtctggaactcctgggctcaagcaatctgcctgccttggcctcccaaattgctggttacaggtgtgagccaccacgcccagcctaaatagttattttaaatagtctcattagtcttatcatgcttctcagtcatagt

SEQ ID NO: 16778 - DNA, 143 bp, Homo sapiens
  D10S543
  Located on chromosome 10
  Distance between a terminus base of telomere on chromosomal short arm and 5'-terminus of this base sequence : 117568983
  Distance between 3'-terminus of neighbour sequence of sequence listing upward to telomere on chrosomal short arm and 5'-terminus of this base sequence : 95711
atccctcagccccactccccagaagggaatttatttttcaaaaaaatgatgagagagagagagagagagagagagagagagagagtgtgtgtgtgtgtgtgtgtgtgtgtgtgtgtgtgtgtgtgatctacctgaacatcttt

SEQ ID NO: 16779 - DNA, 204 bp, Homo sapiens
  U32515.1_2601
  Located on chromosome 10
  Distance between a terminus base of telomere on chromosomal short arm and 5'-terminus of this base sequence : 117768274
  Distance between 3'-terminus of neighbour sequence of sequence listing upward to telomere on chrosomal short arm and 5'-terminus of this base sequence : 199148
actgtaggatggctacagttgtagagaggtagggtgtgtgtgtgtgtgtgtgtgtgtgtgcccacacacgtgcaagcaagtaaaaggtgggaggggggaaatagaaacttgtgagcatattatattcccttggggtaccatagctgaaaacctctcctctcgcctgtggttttagttattcaagatcaaatacaattgtcctgg

SEQ ID NO: 16780 - DNA, 341 bp, Homo sapiens
  chr10.fa.O7frz.120972631
  Located on chromosome 10
  Distance between a terminus base of telomere on chromosomal short arm and 5'-terminus of this base sequence : 117953039
  Distance between 3'-terminus of neighbour sequence of sequence listing upward to telomere on chrosomal short arm and 5'-terminus of this base sequence : 184561
gccagtaattagaatggaagtagcttacatactttttatattccaaaattgtgtttaaattacacaaacgcataaaaatttcaagtgcaagagcacacagtgaaaaataattctccctccacctctgccctccctccctggaaaaaattctgttttctacacattctttttccagaaatattctcagcacacacacacacacacacacacacacacacacacacacacacacacacacacaattacatcctatttttaaacataaagataagatcacatatatactgtcttgtaccctttttcacacacacaaaaatatttcttgaagatcatgtcatatc

SEQ ID NO: 16781 - DNA, 126 bp, Homo sapiens
  G08785
  Located on chromosome 10
  Distance between a terminus base of telomere on chromosomal short arm and 5'-terminus of this base sequence : 118121658
  Distance between 3'-terminus of neighbour sequence of sequence listing upward to telomere on chrosomal short arm and 5'-terminus of this base sequence : 168278
gcttgtcattctctaggccaaagaggcctaaaacagcattgttcatgtcttcattgttctgatgatgatgatgatgatgatgatggtggtggtggtggtggtagaggtgctggttttgactgcttt

SEQ ID NO: 16782 - DNA, 386 bp, Homo sapiens
  chr10.fa.O7frz.121290550
  Located on chromosome 10
  Distance between a terminus base of telomere on chromosomal short arm and 5'-terminus of this base sequence : 118177579
  Distance between 3'-terminus of neighbour sequence of sequence listing upward to telomere on chrosomal short arm and 5'-terminus of this base sequence : 55795
gagtgctactcctaaatggttttgtgtgtgtgtgtgtgtgtgtgtgtgtgtgtgtgtgtgtgtatgtgtgtgtatgtgttttaaaaaggagagagagaaataatgagttgataatttttagaaatttggtggtctaacaaattaaaaatcaaatattattcatttggaatcctaataatccagtccacaattccttatctgcagttttgaaatacaaatagctctgaaaacagagaggtttttcttaaagttttgagcaaaagtatttggcaacaaaatctgacttgataggatgagaggctgtttgcagtctttatttttaatctcacatagtgtgactatttatgcattttactcaagaaatgttcatgtgtttaatgctatgg

SEQ ID NO: 16783 - DNA, 445 bp, Homo sapiens
  AL136368.9_55326
  Located on chromosome 10
  Distance between a terminus base of telomere on chromosomal short arm and 5'-terminus of this base sequence : 118281421
  Distance between 3'-terminus of neighbour sequence of sequence listing upward to telomere on chrosomal short arm and 5'-terminus of this base sequence : 103456
cttggtaattcaggctttagtcacacccctgcaacttagctctcttagagatgtgacctctgctggaaagttttcagtgcacctgtcttacgtgtggctccttggcactcagcagacagagcccatcaacaccttgacctgcccttctcccctacagtatgtcttttaaaatttatttttggtaacttttaatatatttcaaacttacagaaaagttaccaaaaaggtataaggaactcccatataacttttgtccagattaatttcactactcctttatattttgccccatttgctttgtcattttctctatcttcctctatctgtctatctatctatctatctatctatctatctatctatctatctatctatgtatccatcatttgatcagctgtgcattttcccctaaatcattatttttagagtaggttggtgacattgt

SEQ ID NO: 16784 - DNA, 366 bp, Homo sapiens
  chr10.fa.O7frz.121625753
  Located on chromosome 10
  Distance between a terminus base of telomere on chromosomal short arm and 5'-terminus of this base sequence : 118584485
  Distance between 3'-terminus of neighbour sequence of sequence listing upward to telomere on chrosomal short arm and 5'-terminus of this base sequence : 302619
ccacaaactagtatgttactccaccaaatcaatttttgtctttgaggagcaataatgccactattgagaatgtgtggtatacagaagtaataaccagttagttgatgcagtggatgagaaaatcccaattatgttagcaagaaaaacaaattacctaacaagaaatgttcaaaagctacatacacatatatagatacatatgtacacatactatatatatatacacacacatatatatacacacacacacacacatatatatatacacacacacacacacacatatatatatatatatatatacatgaacacactgtaaaatgcacctgaaggacaagtagacttgaacaatttgaaagataattc

SEQ ID NO: 16785 - DNA, 443 bp, Homo sapiens
  chr10.fa.O7frz.121751344
  Located on chromosome 10
  Distance between a terminus base of telomere on chromosomal short arm and 5'-terminus of this base sequence : 118758302
  Distance between 3'-terminus of neighbour sequence of sequence listing upward to telomere on chrosomal short arm and 5'-terminus of this base sequence : 173451
tcatagtcctatttgtttagcaacgacataaaaagcaccatcttctctacccccatcaaaatagaaaagagaagcagagaaaagctaagaagaaaagcaagggcttttgtttggacgttggagttactttttcatgggctgttctatccaacagtcctatttcctaatattctctctctctctctctctctctctcatttgctttttttctttaagttataaaatcacgagacccacttagatttgtgagtgtttttccctagctgtactgtgttgggtgggtcacttaatcttcctgctcttcgttgattttaccacaaatttcagatgacagtgataatccctgtcctaccttcatgacaacttaaaaaataaggattaaataaaataatgtataaattccttaaaaagaaattagttattgttattacctttcttaggag

SEQ ID NO: 16786 - DNA, 479 bp, Homo sapiens
  AL355863.10_72231
  Located on chromosome 10
  Distance between a terminus base of telomere on chromosomal short arm and 5'-terminus of this base sequence : 118763899
  Distance between 3'-terminus of neighbour sequence of sequence listing upward to telomere on chrosomal short arm and 5'-terminus of this base sequence : 5154
gctattgctatggtactctgatagtgattttctacttctcttattccttccacttttaaaaaagctggaatttttctattaaaaaattgtctcttctggccaggcatggtggctcacacctgtaatcccagcactttgggaggccaaggtgggtggatcatgaggtcaggagatcgagaaccatcctggctaacacagtgaaaccccatctcttctaaaaatacaaaaaatttagctgggcatggtggcacatgcttgtggtcccagctacttggaaggctgaggcaggagaattgcttgaaccctggaggtggaggttgcagttagccgaggtcgcaccacttcactctaggatgggaaacagagtgagactctgtctcaaaaacaaaacaaaacaaaacaaaacaaaaactgtcttttgtccctcatttattcactcattcattcatttaaatcagtatggattcgtgaatgtttac

SEQ ID NO: 16787 - DNA, 102 bp, Homo sapiens
  DISD22_0011436
  Located on chromosome 10
  Distance between a terminus base of telomere on chromosomal short arm and 5'-terminus of this base sequence : 118872310
  Distance between 3'-terminus of neighbour sequence of sequence listing upward to telomere on chrosomal short arm and 5'-terminus of this base sequence : 107932
aaggagaaagctatgaatacagaagtaggcataaacacacacacacacacacacacacacacacctgcattattagagtactataatggagccctaattagc

SEQ ID NO: 16788 - DNA, 103 bp, Homo sapiens
  DISD22_0000271
  Located on chromosome 10
  Distance between a terminus base of telomere on chromosomal short arm and 5'-terminus of this base sequence : 119080354
  Distance between 3'-terminus of neighbour sequence of sequence listing upward to telomere on chrosomal short arm and 5'-terminus of this base sequence : 207942
tgagcatggaataactttggaaaaattcattcattcattcattcattcaacaagtgtttactgagtgccctgatgcgccagcctgcaactgtgcctggcacta

SEQ ID NO: 16789 - DNA, 231 bp, Homo sapiens
  D10S1682
  Located on chromosome 10
  Distance between a terminus base of telomere on chromosomal short arm and 5'-terminus of this base sequence : 119205888
  Distance between 3'-terminus of neighbour sequence of sequence listing upward to telomere on chrosomal short arm and 5'-terminus of this base sequence : 125431
agctaatgagtccaagtccatctgattccaaaatcaagggcacacttttaagaactttgctataatgtcagtttatagaggcacaaaatcagaacatgaactaggttctatatctggcaaatagtgatagttatatttttagaatgtgaaaaattacaatccttataagatgcgtgtgtgtgtgtgtgtgtgtgtgtgtgtacttcctgaaggattagtgtaaactcttgg

SEQ ID NO: 16790 - DNA, 470 bp, Homo sapiens
  AC067743.5_170023
  Located on chromosome 10
  Distance between a terminus base of telomere on chromosomal short arm and 5'-terminus of this base sequence : 119277186
  Distance between 3'-terminus of neighbour sequence of sequence listing upward to telomere on chrosomal short arm and 5'-terminus of this base sequence : 71067
aactggtaagcaaactgaaagctcctggccatttgggttctgactttactaatttgtaaatgtagataatttatcttctgactagataataggtagattacaaatgttggccatgtgtaatatagcctgtgatttctaacagaaaagggacagtttaaacccttatagtttctaacagagaaagggcagtgtggtgtagcagttaagggcacagactgtggcatcggaacttggtggttcccctcctagctgctggctgtgcaagacaattgtcacatgaccttgggcaaattacttaactacttcatgcttcagtattttcagcggataacttaggaacaaaacagaatcccataggtgtttctaagaattaaatgagtatctgcctgcttatctatctatctatctatctatctatctatctatctgggaaatctatctaatctatctctatcaccttgtaagcaatg

SEQ ID NO: 16791 - DNA, 117 bp, Homo sapiens
  D10S1760
  Located on chromosome 10
  Distance between a terminus base of telomere on chromosomal short arm and 5'-terminus of this base sequence : 119595054
  Distance between 3'-terminus of neighbour sequence of sequence listing upward to telomere on chrosomal short arm and 5'-terminus of this base sequence : 317398
gcgagactccatctccatagatagatagatagatagatagacagacagacacacacacacacacacacacacacagaaaaaaaagaaaaataaatttttaagccacccactatatgg

SEQ ID NO: 16792 - DNA, 219 bp, Homo sapiens
  G09165
  Located on chromosome 10
  Distance between a terminus base of telomere on chromosomal short arm and 5'-terminus of this base sequence : 119725858
  Distance between 3'-terminus of neighbour sequence of sequence listing upward to telomere on chrosomal short arm and 5'-terminus of this base sequence : 130687
ctatgactgtgccactgcacgccagcctgggtgagactgtgagagaagagaaaagagaaaaggaaaggaggaaggaaggaaggaaggaaggaaggaaggaaaaaccacattgcatgagagtgaaacaacctcatctttatctagagtgtggacatgggctgaaacactggacttatgggtatttagagcagacggctaacaggagcctctgtaaatcca

SEQ ID NO: 16793 - DNA, 371 bp, Homo sapiens
  chr10.fa.O7frz.122744599
  Located on chromosome 10
  Distance between a terminus base of telomere on chromosomal short arm and 5'-terminus of this base sequence : 119910863
  Distance between 3'-terminus of neighbour sequence of sequence listing upward to telomere on chrosomal short arm and 5'-terminus of this base sequence : 184786
gatactgcctacatgttgaaagcaattcattttattgcataaaactggagaagtgcagaaaagcataaactacaagtaaaaattacccataatctctttgcccagagaaaataactgaagaagtgttaacattttgttgtagcttagataaacagatagatagatgtgtgtgtgtgtgtgtgtgtgtgtgtgtgtgtgtatataatttaaatttggaattatactatacacaatgttttgttacctattttttcattagacattacattatgggcagttttccatgtacttattccgaaaaattatagctttgttgttgttgttgttgtctcactctatcacccaggctggagtacagtggctcgatctca

SEQ ID NO: 16794 - DNA, 407 bp, Homo sapiens
  AL157786.6_27226
  Located on chromosome 10
  Distance between a terminus base of telomere on chromosomal short arm and 5'-terminus of this base sequence : 120035345
  Distance between 3'-terminus of neighbour sequence of sequence listing upward to telomere on chrosomal short arm and 5'-terminus of this base sequence : 124111
gctcgtaatagctttgttcacaatatcaaaagtagaaacaacccagatattcatcaactggtagatagataaatagatagatagatagatagatagatagatagatagatagatagagtgtagtctatccatacaatgggataacattgagccataaaaagaaacgaagtacagacatactaccccatcaatgaatcttaaaaattatactatgtaaaagaagtcagacacaaaaagtcacatatatggtttcatttatatgaaatatttagaatagataaatccatagcaacagaaagcagcctaatcctttctctagaggctgggcattgaagggtttgttaatgggttcagggtttcgtattttatggtgatgaaaatgttttggaactaaatagatgtaatgg

SEQ ID NO: 16795 - DNA, 255 bp, Homo sapiens
  G10133
  Located on chromosome 10
  Distance between a terminus base of telomere on chromosomal short arm and 5'-terminus of this base sequence : 120035345
  Distance between 3'-terminus of neighbour sequence of sequence listing upward to telomere on chrosomal short arm and 5'-terminus of this base sequence : -407
gctcgtaatagctttgttcacaatatcaaaagtagaaacaacccagatattcatcaactggtagatagataaatagatagatagatagatagatagatagatagatagatagatagagtgtagtctatccatacaatgggataacattgagccataaaaagaaacgaagtacagacatactaccccatcaatgaatcttaaaaattatactatgtaaaagaagtcagacacaaaaagtcacatatatggtttcat

SEQ ID NO: 16796 - DNA, 297 bp, Homo sapiens
  chr10.fa.O7frz.123014480
  Located on chromosome 10
  Distance between a terminus base of telomere on chromosomal short arm and 5'-terminus of this base sequence : 120175379
  Distance between 3'-terminus of neighbour sequence of sequence listing upward to telomere on chrosomal short arm and 5'-terminus of this base sequence : 139779
tattcgttatctgtatgcgaacagagacagcagtcgcgttatcagctttaaaaaaaattcggtagttctggggtcacgtgacacacctcacacacacacacacacacacacacacacacacacacacacgtgcgcacgtgcgcgcgcgcgcatgaaccctcacatgctctgcagtgcagttttgattttagtcacagcagaaggcttaaccacaagagattccactggttcaaaccagcgtaaaccagattttttcagcccacaaaggaacagattacctcttgtatcaaattctgc

SEQ ID NO: 16797 - DNA, 375 bp, Homo sapiens
  AL139120.6_36392
  Located on chromosome 10
  Distance between a terminus base of telomere on chromosomal short arm and 5'-terminus of this base sequence : 120264987
  Distance between 3'-terminus of neighbour sequence of sequence listing upward to telomere on chrosomal short arm and 5'-terminus of this base sequence : 89311
tccaagatcttagagcctgataggttgggataatgaaatatacaaatgattatattatatatatatatatatatatatatatatatatatagagagagagagagagagagagagtaaatgtcaaaaggtaatatcaacgggctgttaagaaggagcaataatgtttggcctaggggaaggaggaagggttgtcagaagagactttgtgaggtagatgacttttgagcctgaccttaaaatattggtatagttagaacatgcataccatagatagggaggacattaggccaaagtgttgctatatatacattttggcgtctgcctccattaggcagatatctaattattgaatattattaggacatccaaggtgaa

SEQ ID NO: 16798 - DNA, 245 bp, Homo sapiens
  AL139120.6_115734
  Located on chromosome 10
  Distance between a terminus base of telomere on chromosomal short arm and 5'-terminus of this base sequence : 120344342
  Distance between 3'-terminus of neighbour sequence of sequence listing upward to telomere on chrosomal short arm and 5'-terminus of this base sequence : 78980
atagctttgttccataacaagaagataaaatagaaaatagctgcctgaaattttgtttctctgtattagcatttacatgtgtgtgtgtgtgtgtgtgtgtgtgtgtgtgtgtgtgtgtattcttttcttcaccctgtagaaaagcattaatagcacattctgggttttgtctacttttattcttttttaagtgacatccagggttgtgtatttatattttaaactaagcaaatctatttgctttg

SEQ ID NO: 16799 - DNA, 350 bp, Homo sapiens
  AL139120.6_130342
  Located on chromosome 10
  Distance between a terminus base of telomere on chromosomal short arm and 5'-terminus of this base sequence : 120358932
  Distance between 3'-terminus of neighbour sequence of sequence listing upward to telomere on chrosomal short arm and 5'-terminus of this base sequence : 14345
cctaatgatttgtttctctgctaggcccacaatagaactcagtaactctatgtggtctaaatgatataatacagctaaatgagatcaactattatcacacacacacacacacacacacacacacacacacacattaaatgatataaatctagttaaacgtttactccagagggggaagaaaggtaaaagggtagaatacatgcagaggggtaggggcgtgaaactaagagaggcctttcccttcctaaagaatctttgcttacatgcaacacatgccctgataagaaaaagtgtgcattaggacagacttgcccaccctgattttccacttgtacttcactttccactgc

SEQ ID NO: 16800 - DNA, 401 bp, Homo sapiens
  AL139120.6_153979
  Located on chromosome 10
  Distance between a terminus base of telomere on chromosomal short arm and 5'-terminus of this base sequence : 120382498
  Distance between 3'-terminus of neighbour sequence of sequence listing upward to telomere on chrosomal short arm and 5'-terminus of this base sequence : 23216
gcaggtaaagtagaatttgcacatgactttgttctgagtggtgaaatttaaaatatacatatattttaaaacatattttatatttatatatagtatatgtttatatactgtataatatattttatatttttatatatagtatattttacatatatatgtgtgtgtgtatatatatatatatatatatatatatgtaaatgtataacttttttttcccaaatgctcttcctccagatcttcacttggctggctttttctttttcttcaaatttcagttgactgtcactcctcaaaaagactctctgtccaccttacctaatatctcatatttatttcctttcttcatttatttacttgattattgtgatataccaccactagattgtaagctatgcaaggac

SEQ ID NO: 16801 - DNA, 226 bp, Homo sapiens
  D10S1269
  Located on chromosome 10
  Distance between a terminus base of telomere on chromosomal short arm and 5'-terminus of this base sequence : 120408257
  Distance between 3'-terminus of neighbour sequence of sequence listing upward to telomere on chrosomal short arm and 5'-terminus of this base sequence : 25358
tgctgtatttattaccagtgcttgttctctttccctcctgctctccctcctctctctttctttctctgtgtgtgtgtgtgtgtgtgtgtgtgtgtatgtatatgaatatattaatatatgtatatgctgatcttgtatctttgtgtatctatacacgtagcaatcttgttcttgccataagaaactatcttattttgttttctgaatatctactccgcgatctgag

SEQ ID NO: 16802 - DNA, 275 bp, Homo sapiens
  Z66892
  Located on chromosome 10
  Distance between a terminus base of telomere on chromosomal short arm and 5'-terminus of this base sequence : 120518366
  Distance between 3'-terminus of neighbour sequence of sequence listing upward to telomere on chrosomal short arm and 5'-terminus of this base sequence : 109883
ccaaattgcaggacttttagcctccataaccacatgagccagttccatatatatatttatacttacataaatatatatacacacatatatacacacaatatgaatactgtgtacacacagtacatatatacacacaatatggaactggctcattgcttatatacatataaatacacgtatattatggtgtgtgtgtgtgtgtgtgtgtgtgtgtgttctgtttgctctgtttctctggagaatcctgactaatataatacctgtctggggccagg

SEQ ID NO: 16803 - DNA, 263 bp, Homo sapiens
  AJ270774.1_13407
  Located on chromosome 10
  Distance between a terminus base of telomere on chromosomal short arm and 5'-terminus of this base sequence : 120790562
  Distance between 3'-terminus of neighbour sequence of sequence listing upward to telomere on chrosomal short arm and 5'-terminus of this base sequence : 271921
gatggttagtaccacagtaaggagttccattttttaatttcctttttgtttcttacatgggcatgtttattatttattctgtgtgtgtgtctgtgtgtgtgtgtgtgtgtgtgtgtgtgtgtgtgtgtatgtgtgtgtgttagaagccagggttggggagggggctgcgggagggcacagaaaaggtgttgctgaggtgtcctgtgggaatacaggcaaatccacagccattcaggtggcttatgttactggcacttagcatt

SEQ ID NO: 16804 - DNA, 384 bp, Homo sapiens
  chr10.fa.O7frz.123889080
  Located on chromosome 10
  Distance between a terminus base of telomere on chromosomal short arm and 5'-terminus of this base sequence : 120896453
  Distance between 3'-terminus of neighbour sequence of sequence listing upward to telomere on chrosomal short arm and 5'-terminus of this base sequence : 105628
gctgatagatgagcgtgactcccaccaacgtccaaagccaagggcatgggggcagcttgtgagtgggagttttgaagagctctttttttaaaagaaggaccccagagctgaggacattgagaactgaacccctgagcctttcgccttcgtgttcaatttcaatgcgagatggctgcccctgtgcatatatatatatatatatatatatatatatatatatatatatatacatgataaagcaaaaccaaccagaaatgtctcttctctgagccacagagaacttttctgaacaccaaaatcaatggcttttccccccatcctggtgtgttgtatgcagacagacattttactgtgacaattataatagctcagttggaaattacc

SEQ ID NO: 16805 - DNA, 446 bp, Homo sapiens
  AL133482.7_101337
  Located on chromosome 10
  Distance between a terminus base of telomere on chromosomal short arm and 5'-terminus of this base sequence : 121101271
  Distance between 3'-terminus of neighbour sequence of sequence listing upward to telomere on chrosomal short arm and 5'-terminus of this base sequence : 204434
ctagaagatgttgctccaaataagcacacacagactgtgtgcatttgcattgccacatgctaagccgcctataccacccactcactgctaccccaggtgtgttatctgctttgggccagcctgaggtaaaactgtcaacactgaaaatcattacctttggcacctcccagctctccggaagttatctggtctgtagacaacaagtccctgagggaagtgggtggggcacagggcaggtaagttttgacagaaaaggaaactgggcacaaagtctaaggtgctacaacaacaacaacaacaacaacaacaacaacaaaaagatgggccctacaggagcctgctgagcacagagttactgagttgagctgttggaatcacagtggtaaggggccctccccgctggtgcaacaagacacaacagagtgtagttattgtgcacttggacc

SEQ ID NO: 16806 - DNA, 147 bp, Homo sapiens
  DISO7_10008303
  Located on chromosome 10
  Distance between a terminus base of telomere on chromosomal short arm and 5'-terminus of this base sequence : 121294912
  Distance between 3'-terminus of neighbour sequence of sequence listing upward to telomere on chrosomal short arm and 5'-terminus of this base sequence : 193195
gctttgtccattctgctctatagttttgtgtttgtaactttattttagtttctctctctctctctctctctctctctctctatatatatatatatatatatatgttgtaagtgttaatcttttttcaagacacctaatcctgttgat

SEQ ID NO: 16807 - DNA, 395 bp, Homo sapiens
  chr10.fa.O7frz.124469132
  Located on chromosome 10
  Distance between a terminus base of telomere on chromosomal short arm and 5'-terminus of this base sequence : 121489120
  Distance between 3'-terminus of neighbour sequence of sequence listing upward to telomere on chrosomal short arm and 5'-terminus of this base sequence : 194061
cagttaatattgacatggttgatattaatatcatttcttacagatacaaaatatatatactatgtgtatatatatgtacatgtgtacacacacacacacacacacacacacacacacacacacacacacagatacatgcaaatacaacagatccagttgggtctatctccatgcaatataacccagtgaaaaattaagctactatctatctatctatatttgatatgaaaagtaagcactttttcactaaaaatgtaataaactgcaaaagccaaagaaacatatttttcccaattttcagaattgttttgctagtcaactactagagaagagtaagaataacctttctcctataacaacccatgaggaaattcagaatcgtatcagaatagaac

SEQ ID NO: 16808 - DNA, 230 bp, Homo sapiens
  AC005870.2_45486
  Located on chromosome 10
  Distance between a terminus base of telomere on chromosomal short arm and 5'-terminus of this base sequence : 121597480
  Distance between 3'-terminus of neighbour sequence of sequence listing upward to telomere on chrosomal short arm and 5'-terminus of this base sequence : 107965
tgatagatggatagacaggtagacaaatgatagattggtagatagatagatagatagatagatagatagatagactggtagacatgatagatagatagataatggatacatagacatataggtagacagatgatagataaacagatagatatgtagatagatagatggacagatacagtaaatccatacaatagaatgttatcacaatattaccaatgatttctacaagc

SEQ ID NO: 16809 - DNA, 198 bp, Homo sapiens
  Z67702
  Located on chromosome 10
  Distance between a terminus base of telomere on chromosomal short arm and 5'-terminus of this base sequence : 121608337
  Distance between 3'-terminus of neighbour sequence of sequence listing upward to telomere on chrosomal short arm and 5'-terminus of this base sequence : 10627
cagtcccgcatagacaatctcatacagcttatgctcacgcagtcacacacacacacacacacacacacacacacactcactcactcacctctctctagaccaagctaagtaaactcagaagagacctgcttttaacccacaggcttgttgacgcctctttgtactaagagtgattagcaaccacaggagtgtctcagc

SEQ ID NO: 16810 - DNA, 401 bp, Homo sapiens
  AC005886.2_107076
  Located on chromosome 10
  Distance between a terminus base of telomere on chromosomal short arm and 5'-terminus of this base sequence : 121609763
  Distance between 3'-terminus of neighbour sequence of sequence listing upward to telomere on chrosomal short arm and 5'-terminus of this base sequence : 1228
gcacacctgtaaggctgaggcgagaggaccacttgagcccaggagtttgaggctgcagtgaactacttcacatcactgtactccagcctggatgacaaagtgagactcagtgtctctctctctctctctctctctatatatatatatatatgtatatatatatatatctatcttacaaaatgtttaaaataaaaaatgtttgggtcctaaacaggcaaaccctcatctctgtggaaaaactcatatatcaccatgacatattttgcaagagtcccaagtagcagagatttccccatatgcaattcataagcaattctcaagtgcctagtagctgtggggaattggttgcttttatatctttgaggacacatcagtccagactatggcaggacattagttgt

SEQ ID NO: 16811 - DNA, 360 bp, Homo sapiens
  AC005870.2_70842
  Located on chromosome 10
  Distance between a terminus base of telomere on chromosomal short arm and 5'-terminus of this base sequence : 121622749
  Distance between 3'-terminus of neighbour sequence of sequence listing upward to telomere on chrosomal short arm and 5'-terminus of this base sequence : 12585
ccactttaactagtttaggcaaagagaggaagtaggggaagggggaagggagggaagggaggagagagaaagagagagagaaagagagaaatgtgtgtgtatgtgtgtgtgtggtgtgtatgtgtgtttattagacctctctgaaccaaataataggaagagcaaaagcgagggtagaattgaccttaagcctgttgggaatgaaagctgtcaactttctctcagcctctcatccccacttctgatggattgatgttttaatctttccttcacctgacggaagacatggctgctggtggcacagcagttctgtgatcaggcagaagaaaaggatcactgtcttccagagctactgttaaa

SEQ ID NO: 16812 - DNA, 410 bp, Homo sapiens
  AL355543.11_66240
  Located on chromosome 10
  Distance between a terminus base of telomere on chromosomal short arm and 5'-terminus of this base sequence : 121721071
  Distance between 3'-terminus of neighbour sequence of sequence listing upward to telomere on chrosomal short arm and 5'-terminus of this base sequence : 97962
gcatgtctcagtagctcattactttttgttgctgagtagtgttccattgcacagatgtaccgaagtgtgtttatctatacacaaattgaaggacattaagtttgtctctacattttttgcatttacaaataaagctgctgaaagcattcacatgcaggttttttgtttgtctgtttgtttgtttgtttgtttttgagagagagtctccctctgttgctcagcctggagtgcaatggcgtgaccttggctcactgcaacctccgcctttcaggttcaagggattctcctgcctgagcctcccaagtagctgggattacaggcatgagccaccacggccggctaatttttgtatttttagtagaggcagggtttctccatgttggccaggctagtcttgaactcctgacctc

SEQ ID NO: 16813 - DNA, 265 bp, Homo sapiens
  AC005383.1_100507
  Located on chromosome 10
  Distance between a terminus base of telomere on chromosomal short arm and 5'-terminus of this base sequence : 121960358
  Distance between 3'-terminus of neighbour sequence of sequence listing upward to telomere on chrosomal short arm and 5'-terminus of this base sequence : 238877
aagcgttcttgtctttgaaaccaccagcagaggctatggggccaggggcctcaggaagagggcgtgagagtttggggagggaggctaggggccagggagaagatcggtggatttgagcagtcagaggaacagagcggggaactgggggcaagagcagagtgtgtgtgtgtgtgtgtgtgtgtgtgtgtgtgtgtgtgtgtgtgtgtacatatacatgcgcaatgcatgcatgagcaaaaatgtgtatgcaaatgtgcatacatgt

SEQ ID NO: 16814 - DNA, 247 bp, Homo sapiens
  D10S1681
  Located on chromosome 10
  Distance between a terminus base of telomere on chromosomal short arm and 5'-terminus of this base sequence : 121960381
  Distance between 3'-terminus of neighbour sequence of sequence listing upward to telomere on chrosomal short arm and 5'-terminus of this base sequence : -242
ccagcagaggctatggggccaggggcctcaggaagagggcgtgagagtttggggagggaggctaggggccagggagaagatcggtggatttgagcagtcagaggaacagagcggggaactgggggcaagagcagagtgtgtgtgtgtgtgtgtgtgtgtgtgtgtgtgtgtgtgtgtgtgtgtacatatacatgcgcaatgcatgcatgagcaaaaatgtgtatgcaaatgtgcatacatgtgcatt

SEQ ID NO: 16815 - DNA, 198 bp, Homo sapiens
  AC005383.1_115420
  Located on chromosome 10
  Distance between a terminus base of telomere on chromosomal short arm and 5'-terminus of this base sequence : 121975331
  Distance between 3'-terminus of neighbour sequence of sequence listing upward to telomere on chrosomal short arm and 5'-terminus of this base sequence : 14703
caaggagacagatcctcatctcacagggttaaggagaaaggactattattttgattattatcattatgatggtgaagaccgtgaattttatatatatttatatatatatatatatatatatatattttttttttaggcagagtctcactgtgttgcccaggctggagtatagtggtgtgatctcagttcactgcaact

SEQ ID NO: 16816 - DNA, 343 bp, Homo sapiens
  AL355302.7_115272
  Located on chromosome 10
  Distance between a terminus base of telomere on chromosomal short arm and 5'-terminus of this base sequence : 122112126
  Distance between 3'-terminus of neighbour sequence of sequence listing upward to telomere on chrosomal short arm and 5'-terminus of this base sequence : 136597
ttcatttagcatggctgagcttcttccacctctctcactcctgggtttcagaacaccactctctcctggtttacatgcctggctgcaacctcttccagctcctcagatcctgggtgaactctttatggaccccttttcccatggttggatggatggataaagtaacattttcagttatcttttttcttttatttatttattattattattattattattattattattattatactttaagttttagggtacatgtgcacaatgtgccagttagttacatatgtatacatgtgccatgctggtgtgctgcacccagtaactcgtcatttagcattaggtatac

SEQ ID NO: 16817 - DNA, 460 bp, Homo sapiens
  AL354873.13_88700
  Located on chromosome 10
  Distance between a terminus base of telomere on chromosomal short arm and 5'-terminus of this base sequence : 122347426
  Distance between 3'-terminus of neighbour sequence of sequence listing upward to telomere on chrosomal short arm and 5'-terminus of this base sequence : 234957
gaccttaggaaagtcatttacttctctggacctcagtctcttacttcctacaaaagtaaggtgttggctgggcacggtggctcacacctataaccccagtgctttgggaggccgaggcgggcaggtcatttgaggtcaggagttcaagaccagctttggccaacatggtgaaaccccatctctactaaaaatacaaaaatattagccaggcatggtggtgcatgcctgtaatcctagccacccagaaggcggaggcacagagaatcgctggaacccgggaggcagaggctgcagtgagccaagatcacaccagtgtgctccagcctgggtgacagagcaagactctgtcaaaataaataaataaataaataaataaataaataaataaataaataaataaataaaggtgttgatatcaaaggtttatttctacctttgagaaatatctagaatcctcgtg

SEQ ID NO: 16818 - DNA, 287 bp, Homo sapiens
  AC005881.3_172262
  Located on chromosome 10
  Distance between a terminus base of telomere on chromosomal short arm and 5'-terminus of this base sequence : 122402573
  Distance between 3'-terminus of neighbour sequence of sequence listing upward to telomere on chrosomal short arm and 5'-terminus of this base sequence : 54687
ggttagatcaacatggagtgacttttgaataatacagagaacctatgtctaaattcagctggccacctgccaacataatttatttggcatttgtgtgattaggcttttctagttagtgactcgaacaatctctctctctctctctgacactctatctctctctcgctctctctctctctctctctctctctctctctctctatatatatatatatatatatatatatatatatatatatatatatattgagcgcgttacatctgtgaggtatcttggaataacaaga

SEQ ID NO: 16819 - DNA, 255 bp, Homo sapiens
  AC005881.3_120392
  Located on chromosome 10
  Distance between a terminus base of telomere on chromosomal short arm and 5'-terminus of this base sequence : 122454293
  Distance between 3'-terminus of neighbour sequence of sequence listing upward to telomere on chrosomal short arm and 5'-terminus of this base sequence : 51433
atcctgtttagaaggtcgagacactctcagttataaattcacccatgtttttttctaggatttctattttttcacttattatacttaattatttaatccataggattaaatccatttattaaatacttaattatttaatccataggaattgtgagtgtgtttgtgagtgtgtgtgtgtgtgtgtgtgttctaaaagaagtaagaaaaggatgtagatttatcttttctaaatagttagctagttgctccaacatc

SEQ ID NO: 16820 - DNA, 286 bp, Homo sapiens
  AC005881.3_114494
  Located on chromosome 10
  Distance between a terminus base of telomere on chromosomal short arm and 5'-terminus of this base sequence : 122460133
  Distance between 3'-terminus of neighbour sequence of sequence listing upward to telomere on chrosomal short arm and 5'-terminus of this base sequence : 5585
acaggcttcctaggttcagtactcaccatgccacttcttttcatgcccttttccttggaaaggccttccctccatcctattcttttttacctggctaagtccaactcattcttcaagaaaacaactctactttctttaagaagcctcacctgatatggttgtcatgcccacagctaactcaatgccactctttggtattaccataattctcactctatcccatatgctctctctctctctctctctctctctcactcgctctctctttctccactcaggatatcct

SEQ ID NO: 16821 - DNA, 386 bp, Homo sapiens
  AL137025.3_176163
  Located on chromosome 10
  Distance between a terminus base of telomere on chromosomal short arm and 5'-terminus of this base sequence : 122467706
  Distance between 3'-terminus of neighbour sequence of sequence listing upward to telomere on chrosomal short arm and 5'-terminus of this base sequence : 7287
agactccatcgagataagaaagaaagaaaaagaaagaaagagagaaagagacagacaagaaagaaagaaaagaaagaaagaaagaaaagaaggaaagaaagaaagaaagaaagaaagaaagaaagaaagaaagaaagaaagaaagaaagagaaagaaagaaagggaaggaagagagagaaggaaggaagggaaggagaaaagaaaggaaggaaggaagaaagaaagagaagggaagaaagaaagaaagaaaagaaagagatgttctagttgttttctatgttggcactgcccaaatccatcctgatgtgatgggaattgtatggaattgtataatagttctgacaattcagaaatattaaaaaataggtgaacgtaattctttcag

SEQ ID NO: 16822 - DNA, 386 bp, Homo sapiens; identical to SEQ ID NO: 16821
  AC005881.3_107047
  Located on chromosome 10
  Distance between a terminus base of telomere on chromosomal short arm and 5'-terminus of this base sequence : 122467706
  Distance between 3'-terminus of neighbour sequence of sequence listing upward to telomere on chrosomal short arm and 5'-terminus of this base sequence : -386

SEQ ID NO: 16823 - DNA, 341 bp, Homo sapiens
  AC005881.3_97927
  Located on chromosome 10
  Distance between a terminus base of telomere on chromosomal short arm and 5'-terminus of this base sequence : 122476834
  Distance between 3'-terminus of neighbour sequence of sequence listing upward to telomere on chrosomal short arm and 5'-terminus of this base sequence : 8742
tctgatgctacataattaaggtcaccaatcgttgtcactgtctttccaaacctgttgttccttacttcctccggccattcttccttgtccccctcccattcatcatccagacacacacacacacacacacacacacacacacacacacacacacatacattttaacaataccaaactccttgtagttcccctaaatgaatcatgttgtttcccttacctgaaatgcccaatcccttttttattttcattgctaactcctctcatctttccagagtgttcacgtctaccaggagtgttcttgtccctcccattcctttctactctagctccactcacagttc

SEQ ID NO: 16824 - DNA, 415 bp, Homo sapiens
  AL137025.3_101943
  Located on chromosome 10
  Distance between a terminus base of telomere on chromosomal short arm and 5'-terminus of this base sequence : 122512234
  Distance between 3'-terminus of neighbour sequence of sequence listing upward to telomere on chrosomal short arm and 5'-terminus of this base sequence : 35059
actatacttcagcctaggcaacagactgagactctgtcttgaaaaataataataataataataataataataatgagatataacagatgaggcaaattaatctatggtgttagaagtcagaatatccaggtgagatgtggcacaaaaagagaaaaaataataaaatcaaaaaataaaaaatagggctgggcacaatggctcacacctgtaatcccaacactttcggaggctgaggtgggcgggtcacctgaggtcaggagttggagaccagcctggccaacatgatgaaaccccatctctactaaaaatacaaaaataaaaataaaaaataaagaagtcagaatagtggtaacccatggcaagcgtaattgaccaggaaggggcacaaagaggcttctaaggttgtggtatcctc

SEQ ID NO: 16825 - DNA, 185 bp, Homo sapiens
  D10S562
  Located on chromosome 10
  Distance between a terminus base of telomere on chromosomal short arm and 5'-terminus of this base sequence : 122578977
  Distance between 3'-terminus of neighbour sequence of sequence listing upward to telomere on chrosomal short arm and 5'-terminus of this base sequence : 66328
cctggcagatggaggttgcagtgagccgagatcacgccactgcactccagcctgggcaacagagtgagactccatgtcaacacacacacacacacacacacacacacacagattcctgggccccttcctaggaattcaatgtgttgcatgggtgtagatatctgtattttaaggaagcactccga

SEQ ID NO: 16826 - DNA, 446 bp, Homo sapiens
  AF222855.1_6974
  Located on chromosome 10
  Distance between a terminus base of telomere on chromosomal short arm and 5'-terminus of this base sequence : 122687806
  Distance between 3'-terminus of neighbour sequence of sequence listing upward to telomere on chrosomal short arm and 5'-terminus of this base sequence : 108644
gtctgttgaggacttgaatagaacaaaaggcaggggaaggttggaattgccccctctctgcttgagctgagacatctatcctgcccttggcactcctggttctcaggggttcagacctggattcctgggtctccaccttgcccatggcagactgtgggacttctcagcctcctatctaattaataaatctcttcatacacacacacacacacacacacacacacacacacacacacacacacaccctatgtatccttctgtttctctgcagaaccatatctaatacacctgcttttatgacgattacctatcgattctgtattctgccaaaactgaaaacagttcatttttccatctcttctcagagaggcttgtcagccattagttctctgatgggctcaagaagttatgcagttttttttttctcactgttaggatggaattga

SEQ ID NO: 16827 - DNA, 396 bp, Homo sapiens
  AF042484.1_51968
  Located on chromosome 10
  Distance between a terminus base of telomere on chromosomal short arm and 5'-terminus of this base sequence : 122733187
  Distance between 3'-terminus of neighbour sequence of sequence listing upward to telomere on chrosomal short arm and 5'-terminus of this base sequence : 44935
ttcaggtaactgcctaacagactgagaaaataaaatgctcacagagaaaaaagacccggaaagtctgacttctcagagctcagtgtttaggtgcagaactggattgtgaaaggatttttaaattttttatattcattgcagggaacattcatttattccatccttctccactcccacctgtctgtcgttgtctttgtctctgtctccccacctctctctctagacacacacacacacacacacacacacacacacacacacacacacacacacacacacacacacacacacacacccctattcattgccaacagtaatagagttgcttctttacttcttggagagaaaagcctcaatctgaggaagctgtgctgactagccttgctcttaatcatg

SEQ ID NO: 16828 - DNA, 449 bp, Homo sapiens
  AL355530.6_56358
  Located on chromosome 10
  Distance between a terminus base of telomere on chromosomal short arm and 5'-terminus of this base sequence : 122779000
  Distance between 3'-terminus of neighbour sequence of sequence listing upward to telomere on chrosomal short arm and 5'-terminus of this base sequence : 45417
tgaatctctactgcttagccagcaatatgactcaaaaactctccagtgtttgcttctctatgtctaatcaccagtagacagaaatctcttcatcttctactctatgtctccacgtcataagttgctactaatccagaagttcttcttactcataatttttaccttcttgtaactgttactcaggtctttttttgcccctccctatctaatgatctctctttttctgcataaatttttagccttagctcttgattttagttacttctttctgtgtgtgtgtgtgtgtgtgtgtgtgtgtgtgtgtgtgtgagagagagagagagagagacagagtctcgctctgtctcctaggctggagtgcagtggcacgatcggctcactgcaacctccacctcccaggttcaagcgattctcccaagtagcctctaaagtagctaggactacaggca

SEQ ID NO: 16829 - DNA, 303 bp, Homo sapiens
  chr10.fa.O7frz.126158623
  Located on chromosome 10
  Distance between a terminus base of telomere on chromosomal short arm and 5'-terminus of this base sequence : 122969230
  Distance between 3'-terminus of neighbour sequence of sequence listing upward to telomere on chrosomal short arm and 5'-terminus of this base sequence : 189781
tatgagcatcttatgttacatgatgagggaataagagaagaaagaaaacaaagatattacacacacacacacacacacacacacacacacacacacagatgtattcttagcaaaatgaggaggaaatacagtccttatttctgtaagtgatcatgtggttgtagctaatatttatacatatattcttttttttattatactttaagttctagggtacatgggcacaatgtgcaggtttgttacatatgtatacatgtgccatgttggtgtgctgcactcattaattcgtcatttacgttaggt

SEQ ID NO: 16830 - DNA, 384 bp, Homo sapiens
  AC025351.2_65672
  Located on chromosome 10
  Distance between a terminus base of telomere on chromosomal short arm and 5'-terminus of this base sequence : 123135279
  Distance between 3'-terminus of neighbour sequence of sequence listing upward to telomere on chrosomal short arm and 5'-terminus of this base sequence : 165746
gaatcttacttcattacgatgaatgatctttttaatatgttgttgaaatcagtttgctgaattttgttacagatttttgcatcttgttcatgagtgatattggcctgtagttttcttttcttgtgttttgttttgttttgttttgttttgtttgtgtttttgtttttaattgtgtctttgtctagttttggtatcaggataatgctggccagtaggatgaatttgagagtgttctctcatccttgactttgtagaatataataagtagaatttgttagttcttctgtaaatgatttgtagaattcagcagtgaaactatctgatattgggcttttctttgatgggagtctttattattgtttctgtttcataacttgctattgg

SEQ ID NO: 16831 - DNA, 213 bp, Homo sapiens
  chr10.fa.O7frz.126371071
  Located on chromosome 10
  Distance between a terminus base of telomere on chromosomal short arm and 5'-terminus of this base sequence : 123232421
  Distance between 3'-terminus of neighbour sequence of sequence listing upward to telomere on chrosomal short arm and 5'-terminus of this base sequence : 96758
aataagatatgttgcaagctagacttatttttgcagttgaaagtaatggcaaaaactgcaattacttttgctccaatgtaatagcgtgccaaccaacaacaacaacaacaacaacaacaacaacaacaacaagcataggtcctgatgaattcacagatgaattcaaccaagtgtacaaagaagagctggtactattcctacggaaactattcc

SEQ ID NO: 16832 - DNA, 335 bp, Homo sapiens
  chr10.fa.O7frz.126550230
  Located on chromosome 10
  Distance between a terminus base of telomere on chromosomal short arm and 5'-terminus of this base sequence : 123361101
  Distance between 3'-terminus of neighbour sequence of sequence listing upward to telomere on chrosomal short arm and 5'-terminus of this base sequence : 128467
ttggttaaatttattcctcagtagtttattctttttgatgacaatataaatggaatgttttcttaattgtgtatctaatagaccattgttgatacaaagaaatgcaactgatcttaccatgttgattttgtaccctactactttactgaatttatttgttctaacaggttgtgtgtgtgtgtgtgtgtgtgtgtgtgtgtgtgtgtgtgtgtagccttatagggtattttacatgtataatcattcagtctataagcagttataattttattcttccttttcaattttgatacctttaatttctttttcttgtctgattgctcctgctagtacta

SEQ ID NO: 16833 - DNA, 179 bp, Homo sapiens
  D10S1731
  Located on chromosome 10
  Distance between a terminus base of telomere on chromosomal short arm and 5'-terminus of this base sequence : 123361254
  Distance between 3'-terminus of neighbour sequence of sequence listing upward to telomere on chrosomal short arm and 5'-terminus of this base sequence : -182
atttgttctaacaggttgtgtgtgtgtgtgtgtgtgtgtgtgtgtgtgtgtgtgtgtgtagccttatagggtattttacatgtataatcattcagtctataagcagttataattttattcttccttttcaattttgatacctttaatttctttttcttgtctgattgctcctgctagta

SEQ ID NO: 16834 - DNA, 360 bp, Homo sapiens
  AC005873.3_169629
  Located on chromosome 10
  Distance between a terminus base of telomere on chromosomal short arm and 5'-terminus of this base sequence : 123477746
  Distance between 3'-terminus of neighbour sequence of sequence listing upward to telomere on chrosomal short arm and 5'-terminus of this base sequence : 116313
gttccttatctatgcctctttctatttgccattttctgttcctaaatataactttcctatttttcacttctactcccacagtctacacagacgcacacacacacacacacacacacacacacacacacttcccactgtatatcagtgtataaaaactagacctgtctcatgattggttgtgtttacaaatatgttcatatttatagtaataaattactgaaaaatatgggcatatatgaattcaaaaaataaaatgtttaatatataaaagcatgttctgaataggtacaatttattatagaaagactttggatgctctaacattatggaactaatgtggataagttctttggaagtaaa

SEQ ID NO: 16835 - DNA, 286 bp, Homo sapiens
  AC005873.3_166947
  Located on chromosome 10
  Distance between a terminus base of telomere on chromosomal short arm and 5'-terminus of this base sequence : 123480350
  Distance between 3'-terminus of neighbour sequence of sequence listing upward to telomere on chrosomal short arm and 5'-terminus of this base sequence : 2244
taatagcctgtatcagtccattttcacactgctataaagaactacttgagactgggtaatttatgatgaaaagaggtttaattgactcacagttccacatggctgagaggcttcaggaaacttataatcatggcagaaggcaaaggggaagcaggtacagtcatcacatatcagagcgagagagagagagagagagagagagagagcgagcgagctaggggggaaatgccacactttaaaaccatcagatctcatgagaacacagtcactatcaggagaacagcaa

SEQ ID NO: 16836 - DNA, 395 bp, Homo sapiens
  AC005873.3_150063
  Located on chromosome 10
  Distance between a terminus base of telomere on chromosomal short arm and 5'-terminus of this base sequence : 123497228
  Distance between 3'-terminus of neighbour sequence of sequence listing upward to telomere on chrosomal short arm and 5'-terminus of this base sequence : 16592
tagtgttggctacttaagcctaacactaaccatttaaagctcatgcacattctgtttatatatatatacacacacacacatatacacagtaaccatttaaaactcattcaggttctgttttctatctatctatctatctatctatctatctatctatctatcatctatctatctatctatctatctatctatctatctatctatctatctatagtctctccataagagattgaatgagccaagaaagctgtctagtcatcagttgctgaaggactggctaagacagaaatacacagatacctttctcagttgccccaagtttgggactcactcctcatatatgtgtacaaagtacaaaaattaaaattcaagttccgtaaatttagaacttgact

SEQ ID NO: 16837 - DNA, 428 bp, Homo sapiens
  AC005873.3_91216
  Located on chromosome 10
  Distance between a terminus base of telomere on chromosomal short arm and 5'-terminus of this base sequence : 123556080
  Distance between 3'-terminus of neighbour sequence of sequence listing upward to telomere on chrosomal short arm and 5'-terminus of this base sequence : 58457
atggttaacacctgttagatgaagctcaaaaatgaaaaagattttaatgaaaagcaaatgcagtaaatgctagcttttaactggtttcataaaagattgaatatatattcaatattctgtatatatatatatactgtataaatatacaaaatatatactctgtctgtgtgtgtgtgtgtgtgtgtgtgtgtgtgtgtgtgtgtgtgtattacacaaactctccttttccctggacaatttaagtacattttccctgtaagctaaaagccataagtatccctacagatattttttgcaagtgaaattgcttttcatttggcaaaaactaaacctgtgattcatagcagcttagagcactcaaggccaaagagtacatcttgcttgctttgactgacatttttgcaggctaaatcagacctgcatgattc

SEQ ID NO: 16838 - DNA, 337 bp, Homo sapiens
  AC005873.3_80600
  Located on chromosome 10
  Distance between a terminus base of telomere on chromosomal short arm and 5'-terminus of this base sequence : 123566766
  Distance between 3'-terminus of neighbour sequence of sequence listing upward to telomere on chrosomal short arm and 5'-terminus of this base sequence : 10258
ctaaagtctaatggcactgcagaggtgatggtgaattgttagcccttctcaatagtttatgaacaggatgaaaaactagaggctatggattcatatttgtctatatgatgccacacacacacacacacacacacacatttaagtgtgtattaagggcaggtagtaaagagaccaaaaaatgcttttaatgttctaaattagactgataaaaatccgtagacatatgggcctctgtcatgatcaaataaaaagagttcagatttggagatggaagtagaggttcaagtcccttagacttactagctaaataactgtgaacatatcatttaacctccat

SEQ ID NO: 16839 - DNA, 234 bp, Homo sapiens
  AC005873.3_48389
  Located on chromosome 10
  Distance between a terminus base of telomere on chromosomal short arm and 5'-terminus of this base sequence : 123599035
  Distance between 3'-terminus of neighbour sequence of sequence listing upward to telomere on chrosomal short arm and 5'-terminus of this base sequence : 31932
agatcaacacatccactggtatgtggtgtgtgtgtatgtgtgtgtgtgtgtgtgtgtgtgtgtgtgtgtgtgtgtgtgtattgtaatatagaatatgctaaattcataagtttccattgtgtttttttcagtacttttcttaaatcacaagttacacgaagcttaacaaacatccaaaaacactaacctaactggaaaatactctaccatctttaggtcaatgttagtggactg

SEQ ID NO: 16840 - DNA, 193 bp, Homo sapiens
  Z67283
  Located on chromosome 10
  Distance between a terminus base of telomere on chromosomal short arm and 5'-terminus of this base sequence : 123745213
  Distance between 3'-terminus of neighbour sequence of sequence listing upward to telomere on chrosomal short arm and 5'-terminus of this base sequence : 145944
tggaaataaaggaacattcagcactccctcactggtacatctgagccttgtggtgcaaccttttgccaatggcaaggactgatatatgaagtttagagtggctgtgtgtgtgtgtgtgtgtgtgtgtgcacgtgcacacgtgcactttaatgttccccttatttacatcgtcttggtgctgcccctctgaaaa

SEQ ID NO: 16841 - DNA, 159 bp, Homo sapiens
  Z67482
  Located on chromosome 10
  Distance between a terminus base of telomere on chromosomal short arm and 5'-terminus of this base sequence : 123841645
  Distance between 3'-terminus of neighbour sequence of sequence listing upward to telomere on chrosomal short arm and 5'-terminus of this base sequence : 96239
ggatcatatagccctccaatcattgtgtgtgtgtgtgtgtgtgtgtgtgtgtgtgtgtgtatgacagagagaaccacgctttattggcggagccttatgtgccagcgaactgagaaggtccagggtaccttcacctgcactgccacagtcacccggtct

SEQ ID NO: 16842 - DNA, 386 bp, Homo sapiens
  AC005384.2_39036
  Located on chromosome 10
  Distance between a terminus base of telomere on chromosomal short arm and 5'-terminus of this base sequence : 123868276
  Distance between 3'-terminus of neighbour sequence of sequence listing upward to telomere on chrosomal short arm and 5'-terminus of this base sequence : 26472
ccaatccttgttactctatttgaccacagaaatcagaggtcgacaaacaccacattaagatgtcttcactgtaagacaccagagttaagcagtgtacaatgatgcaaaatagagaatttttctaacgttccaaagatatttactttaaataagtaacacacacacacacacacacacacacacacacacacacacacacacacacagtccatttggtttaaatatcctgagctttttccagctaccagaccactccagtgcacggaagatgaagtaattgataggattattaatgtttctttgttttccatatgaccatttcatataagtaagtcgaaggaataggccaacaatagcacagcctgtgccatgcttgtcactaatat

SEQ ID NO: 16843 - DNA, 261 bp, Homo sapiens
  AF038416.1_65
  Located on chromosome 10
  Distance between a terminus base of telomere on chromosomal short arm and 5'-terminus of this base sequence : 123880352
  Distance between 3'-terminus of neighbour sequence of sequence listing upward to telomere on chrosomal short arm and 5'-terminus of this base sequence : 11690
gtcagcgtagttttcctttagacagctgctgacagaccttgactctggctggcagttggtaaaaaaatccgcaaggcgagatctacaataggaaaaaaggggtggggggtggaaatgtgctttaaaacatcctaagcctccggacagacatgttttctttattcctttgttgatatgcctttttctgcacacgcacacgcacacacacacacacacacatacacacaaaatacgtagaaaacgtgagctaagaaactgttg

SEQ ID NO: 16844 - DNA, 248 bp, Homo sapiens
  D10S1748
  Located on chromosome 10
  Distance between a terminus base of telomere on chromosomal short arm and 5'-terminus of this base sequence : 123949209
  Distance between 3'-terminus of neighbour sequence of sequence listing upward to telomere on chrosomal short arm and 5'-terminus of this base sequence : 68596
tgaattgctgttactctccaagctcaagaaaccttggccctcactgtgtacttatgaggtttctagttgttctgccttggtgtctctgtctctgtctctctctttcatgtgctctttctctcactctcacacacacacacacacacacactcacaagagagaaactcacattctctctcatgagggaaagagagagacagagagaggggcttgaagggagaggaaaataggaccttgtggcgatttat

SEQ ID NO: 16845 - DNA, 246 bp, Homo sapiens
  AC006095.1_93782
  Located on chromosome 10
  Distance between a terminus base of telomere on chromosomal short arm and 5'-terminus of this base sequence : 123960262
  Distance between 3'-terminus of neighbour sequence of sequence listing upward to telomere on chrosomal short arm and 5'-terminus of this base sequence : 10805
agcaccatgcttcctgtacagcccccagaaccatgtaaatatcttttctttataaattacccagcctcacatatttctttatagcaacacaagaatggcctaacacacccctttctccctccctccctccctccctccttccttccttccttccttccttcctcacaaccagcaatgttgggcctaccatggccaaggctttggagttaaaaagataagactctgtgacagtcctcaggaagttaa

SEQ ID NO: 16846 - DNA, 177 bp, Homo sapiens
  DISO7_10002967
  Located on chromosome 10
  Distance between a terminus base of telomere on chromosomal short arm and 5'-terminus of this base sequence : 124227386
  Distance between 3'-terminus of neighbour sequence of sequence listing upward to telomere on chrosomal short arm and 5'-terminus of this base sequence : 266878
agataggtactaatgcataggtgctaattactaatgtgtgtgtgtgtgtgtgtatgtgtgtgtgtgtgtgtgtgtatgtatgtgtgtgtgcatatatatatatatatatatatatatatatatatatatatatgggttaggacatacgtatatatatgggttaggacagagcttagc

SEQ ID NO: 16847 - DNA, 350 bp, Homo sapiens
  HUMUT2527
  Located on chromosome 10
  Distance between a terminus base of telomere on chromosomal short arm and 5'-terminus of this base sequence : 124356774
  Distance between 3'-terminus of neighbour sequence of sequence listing upward to telomere on chrosomal short arm and 5'-terminus of this base sequence : 129211
ggcgacagaaggagactccgtctcaaaaaaaagaaagaaagaaagaaagaaagaaagaaagaaagaaagaaagaaagaaagaaagaaagaaagaaagaaagaaagaaagaaagaaagaaagaaagaaagaaagaaagaaaggaaggaaggaaggaaggaaggaaggaaggaaggaaggaaggaaggaaggaaggaaggaaggaaggaagggaaagaaagagaaagttgaaagacagagtgaaaattgtaacttcaatagaaatctctcttagcctccacctagccaaatcattgttttcactcattttctccattgttacagtcaactccattcttacctctgagcctat

SEQ ID NO: 16848 - DNA, 123 bp, Homo sapiens
  DID22N_0004745
  Located on chromosome 10
  Distance between a terminus base of telomere on chromosomal short arm and 5'-terminus of this base sequence : 124441280
  Distance between 3'-terminus of neighbour sequence of sequence listing upward to telomere on chrosomal short arm and 5'-terminus of this base sequence : 84156
cacagccacctattcatttatctatataagtatgccatatgtctatatatatttgtgtgtgtgtgtgtgtgtgtgtgtgtagctactttcctgcaaaagtggtagaattgagtagttgtgaca

SEQ ID NO: 16849 - DNA, 348 bp, Homo sapiens
  AC005660.3_68155
  Located on chromosome 10
  Distance between a terminus base of telomere on chromosomal short arm and 5'-terminus of this base sequence : 124515823
  Distance between 3'-terminus of neighbour sequence of sequence listing upward to telomere on chrosomal short arm and 5'-terminus of this base sequence : 74420
gaggtcaggagttcgagaccagcctggccaacgtgatgaaacgccgtctctactaaaactacaaaattagctgggtgtggtggtgcatgcctgtaattgcagctattccagaggctgagacaggagaatcgtttgaacccgggaggcggaggctgcagtgagccaagatcaccctactgcactccagcctgggtgactccgtctcaaaaaaaacaaagaaagaaagaaagaaagaaagagacagagggaaagaaaactgccatgttcccaacactttcccctcctagacctagcagcaggtttaagttccaggaaccagccctggatcctcactgtaaagttaccttt

SEQ ID NO: 16850 - DNA, 296 bp, Homo sapiens
  D10S544
  Located on chromosome 10
  Distance between a terminus base of telomere on chromosomal short arm and 5'-terminus of this base sequence : 124524294
  Distance between 3'-terminus of neighbour sequence of sequence listing upward to telomere on chrosomal short arm and 5'-terminus of this base sequence : 8123
cggcacaccaggtatgggtgtccccatcctggacaggatttctcccagcaccgtgtgtgtgtgtgtgtgtgtgtgtgtgtgtgtgtgtgtctgtgtgtgtgtgtgtgtgtgcgtgtgtgtgtgtgttaggataggggtgctgaatttgatttacaagacaaaacagtgttgggaaaggtgtggggagtgggtacacattcctgcccacttctgatttgacaaatcctatgcccaaccttgtatttggtatcatcgcccaccctatcccagcatgagaggcaagaaactggctcagt

SEQ ID NO: 16851 - DNA, 462 bp, Homo sapiens
  AC016825.5_188425
  Located on chromosome 10
  Distance between a terminus base of telomere on chromosomal short arm and 5'-terminus of this base sequence : 124563890
  Distance between 3'-terminus of neighbour sequence of sequence listing upward to telomere on chrosomal short arm and 5'-terminus of this base sequence : 39300
cctggagctagtctaagatcacaagagttggtgtgtcttccctgtaggaagagggctctcccttgagtccaattcttaaccttcctgtttcatggactcttcggtcacctgaggaaatctatagagccctcctcagaacaatatttttatttatttttattttattatataataattattattattttgagacaaggtctctctctgtcacccaggctggagtgcagaggtgcagtcaccactcactgcagcctccacctcccacactcgagtgatcctcccacctcagcctcctgagtggctgggagcacaggtacgcaccaccacacccagctaattttttgatttattttattttattttattttattttatttttcgtagatatggtgtctacctatgttacccagactggaaaataatgtttttaaatgcataaaataaaccaggtaggattaccag

SEQ ID NO: 16852 - DNA, 360 bp, Homo sapiens
  AC005660.3_19951
  Located on chromosome 10
  Distance between a terminus base of telomere on chromosomal short arm and 5'-terminus of this base sequence : 124563992
  Distance between 3'-terminus of neighbour sequence of sequence listing upward to telomere on chrosomal short arm and 5'-terminus of this base sequence : -360
ggtcacctgaggaaatctatagagccctcctcagaacaatatttttatttatttttattttattatataataattattattattttgagacaaggtctctctctgtcacccaggctggagtgcagaggtgcagtcaccactcactgcagcctccacctcccacactcgagtgatcctcccacctcagcctcctgagtggctgggagcacaggtacgcaccaccacacccagctaattttttgatttattttattttattttattttattttatttttcgtagatatggtgtctacctatgttacccagactggaaaataatgtttttaaatgcataaaataaaccaggtaggattaccag

SEQ ID NO: 16853 - DNA, 467 bp, Homo sapiens
  chr10.fa.O7frz.128139904
  Located on chromosome 10
  Distance between a terminus base of telomere on chromosomal short arm and 5'-terminus of this base sequence : 124832211
  Distance between 3'-terminus of neighbour sequence of sequence listing upward to telomere on chrosomal short arm and 5'-terminus of this base sequence : 267859
ttactggcttgtagttacgaactttagttgtcacatttctgaaacaactaagtctactcagctgcctgttgggctggctatgtcatgatttgcagcttggaaagaaaactccttttcttggcactgaggagttagaaaatagaaaaccagcatgattcttgaaacacgtgctctgcctgatattctccttgttttctccaccatcttcctttttcttccattctatattgttatgttacagcccactttggctgtacattggaattacctggggctctcacttctaaatatatatatgtgtgtgtgtatgtgagtgtgtgtatatgcatgtatgtatgtatgtatgtatgtatgtatgtatgtatttatctatctatctatctatctatctatctatctatctatctatctatctatctggatgcccaggctctaccccagaatagttaaatcacaatcttgaagca

SEQ ID NO: 16854 - DNA, 316 bp, Homo sapiens
  AC005661.1_17677
  Located on chromosome 10
  Distance between a terminus base of telomere on chromosomal short arm and 5'-terminus of this base sequence : 124922501
  Distance between 3'-terminus of neighbour sequence of sequence listing upward to telomere on chrosomal short arm and 5'-terminus of this base sequence : 89823
ggccatataaccattccttaagagaggtttggggtcatgttttgttcaaatggagactagggaagttcttttagtcctgggatggaaaggagtggattttgttcctgatagatactcccacccccaccatttcctcataacctccgcttctccgctttctttctcgtgtgtgtgtgtgtgtgtgtgcacatgagtgcctatcagggagggggagggaaggcgccttccctgtacttagtaaacatttgtttctgagaagagactaccagctagcagaatgaactgcatggacgttactgcttaatctgatgctctt

SEQ ID NO: 16855 - DNA, 76 bp, Homo sapiens
  D10S187
  Located on chromosome 10
  Distance between a terminus base of telomere on chromosomal short arm and 5'-terminus of this base sequence : 124922631
  Distance between 3'-terminus of neighbour sequence of sequence listing upward to telomere on chrosomal short arm and 5'-terminus of this base sequence : -186
ttcctcataacctccgcttctccgctttctttctcgtgtgtgtgtgtgtgtgtgtgcacatgagtgcctatcaggg

SEQ ID NO: 16856 - DNA, 373 bp, Homo sapiens
  AC005661.1_7073
  Located on chromosome 10
  Distance between a terminus base of telomere on chromosomal short arm and 5'-terminus of this base sequence : 124933081
  Distance between 3'-terminus of neighbour sequence of sequence listing upward to telomere on chrosomal short arm and 5'-terminus of this base sequence : 10374
agtctcgaggataggtgagtaaactgctctgtgttgaagtcacactgctgacctggttattgtaataaatcacctctttggttaatttaatttagttattttgttattcattgtacatttttgctctggttttagtaatttaattataatttatatcactgttccagggcatagtctcatgatgtgtgtgtgtgtgtgtgtgtgtgtgtgtgtatttttcaaagggtatgtgaacacccagtcatgtttgttctgcctttcaaatgaattttccttccagtttctcctacccgttgcttgttgctaagcatcaggagaggcagtagcagccacaaactgtgacacagttcttccaacttagagtgataccaac

SEQ ID NO: 16857 - DNA, 234 bp, Homo sapiens
  D10S545
  Located on chromosome 10
  Distance between a terminus base of telomere on chromosomal short arm and 5'-terminus of this base sequence : 124940510
  Distance between 3'-terminus of neighbour sequence of sequence listing upward to telomere on chrosomal short arm and 5'-terminus of this base sequence : 7056
ctgctaaggattggctggatggatttttctgatatttctgataaacagaaaatggaaaaagaaagcctgcaagggctctagtcccttctcaacacccttatttttgttggtgagactatcatatgaaatgaaatgcttattttaaaattatacacatacatgtgcatgtgtgtgtgtgtgtgtgtgtgtgtgaccagcctggacaatgtggcaagaccccatctctacaaaaaa

SEQ ID NO: 16858 - DNA, 270 bp, Homo sapiens
  D10S1657
  Located on chromosome 10
  Distance between a terminus base of telomere on chromosomal short arm and 5'-terminus of this base sequence : 124952666
  Distance between 3'-terminus of neighbour sequence of sequence listing upward to telomere on chrosomal short arm and 5'-terminus of this base sequence : 11922
tcaggctaaatgcaatgtgggatcctggattggatcctagaacagaaaaaggacattagtggaaaaaccagtgaaatttgaatcaagtctggagttagttattagtagtgtaccattttggtttcttagttttgacaaatgtaccatgtaatatatcattaacattgggggaaactgggtgagaggtattccaaaataaaaggtgtgtgcgtgtgtgtgtgtgtgtgtgtgtgtgtgtgtgaagccccacagacaaggattgggtccctc

SEQ ID NO: 16859 - DNA, 337 bp, Homo sapiens
  AC005210.3_71414
  Located on chromosome 10
  Distance between a terminus base of telomere on chromosomal short arm and 5'-terminus of this base sequence : 124952740
  Distance between 3'-terminus of neighbour sequence of sequence listing upward to telomere on chrosomal short arm and 5'-terminus of this base sequence : -196
aatttgaatcaagtctggagttagttattagtagtgtaccattttggtttcttagttttgacaaatgtaccatgtaatatatcattaacattgggggaaactgggtgagaggtattccaaaataaaaggtgtgtgcgtgtgtgtgtgtgtgtgtgtgtgtgtgtgtgaagccccacagacaaggattgggtccctctcctggcctcagcccttccatatcactgtgcactgcccatttagaacatgatgggacaactggcgactcatacgcctgcgtctgtgactgcccctaagagggctgctctgccaggggcccttgtttgctcaacaccaggat

SEQ ID NO: 16860 - DNA, 306 bp, Homo sapiens
  AC005210.3_44827
  Located on chromosome 10
  Distance between a terminus base of telomere on chromosomal short arm and 5'-terminus of this base sequence : 124979216
  Distance between 3'-terminus of neighbour sequence of sequence listing upward to telomere on chrosomal short arm and 5'-terminus of this base sequence : 26139
atcagcaaatcctaaacaattaaggcatcaattcctccttcccaaaccaaggcccctgctacctcctagataaagatagtgtatacttctgtaaggagaaacgaagacccttccccaaatcacactggaccctatatgggtgtccctccaaattcatggcctctcagagaagaatggcatgggtgatgaagaaaagaatttctttctctgaacgaatagatgtaattttagggttgaaggagtttgtgtgtgtgtgtgtgtgtgtgtgtgtgtgtgtgttcggttcgtttaccacaattctacact

SEQ ID NO: 16861 - DNA, 194 bp, Homo sapiens
  D10S531
  Located on chromosome 10
  Distance between a terminus base of telomere on chromosomal short arm and 5'-terminus of this base sequence : 124979388
  Distance between 3'-terminus of neighbour sequence of sequence listing upward to telomere on chrosomal short arm and 5'-terminus of this base sequence : -134
aatggcatgggtgatgaagaaaagaatttctttctctgaacgaatagatgtaattttagggttgaaggagtttgtgtgtgtgtgtgtgtgtgtgtgtgtgtgtgtgttcggttcgtttaccacaattctacactaaaatcataccatatagcagggaagaaattctgtgtcttaaaaatccaccagtcacacca

SEQ ID NO: 16862 - DNA, 458 bp, Homo sapiens
  AC022283.5_158324
  Located on chromosome 10
  Distance between a terminus base of telomere on chromosomal short arm and 5'-terminus of this base sequence : 125202732
  Distance between 3'-terminus of neighbour sequence of sequence listing upward to telomere on chrosomal short arm and 5'-terminus of this base sequence : 223150
agcgctttacaaacattaactaattaaatcagcatgacttctggaagggaaaattgagcctctttaatctgtttgaattctcagaaaaagctaataaaattaaggtataatgttcatgaaaaggagtacacagaaccataaacagcttttgtaagggattaaatatcgaagtgtggtggtggcatttgatgagctcagaagctatttatggcgatgttatgtgactgctccaacatcaaccactgaagactgagttgcaaataccatgcaggctctctggaaggagcctgtggctggctgtggtcacctgtcataaggtgtttttttgtttgtttgtttgtttgtttctgggcaggaccctgagccctgggctgatggaagcaggaaggaggaggacatctgcctcgtgggccaaccaagctctattcaccatttttacagaaggagtcagctaaaga

SEQ ID NO: 16863 - DNA, 216 bp, Homo sapiens
  AC005661.1_60231
  Located on chromosome 10
  Distance between a terminus base of telomere on chromosomal short arm and 5'-terminus of this base sequence : 125236651
  Distance between 3'-terminus of neighbour sequence of sequence listing upward to telomere on chrosomal short arm and 5'-terminus of this base sequence : 33461
tattccttgcctagacaatcacccagggtgctggatggggcaaaagggaagtttctttcacaaagaggacatatatatatatatatatatatatatatgctttcacaaagaggaccatatatataaggtggggtagccagggttcttcagaaaaacagaaccaatgggatatataaagccatagaagaggagatttattgtcgagattagctcact

SEQ ID NO: 16864 - DNA, 379 bp, Homo sapiens
  AC005880.3_101913
  Located on chromosome 10
  Distance between a terminus base of telomere on chromosomal short arm and 5'-terminus of this base sequence : 125551205
  Distance between 3'-terminus of neighbour sequence of sequence listing upward to telomere on chrosomal short arm and 5'-terminus of this base sequence : 314338
ctgaggtcagaagttcgaaaccagcctggccaatatgctaaaaccccatctctactaaaaatacgaaacttagccagcatggtagtgcgtgccagtaatcccacctacttgggaggctgaggcacgagaattgcttgaatccgggaggcaagaggttgcagtgagcagagattgcaccactgcactccagcctgggcaacagagcaagactctgtctcaaaaacaaacaaacaaacaaacaaaatacacacacacacacacatatatacacacacatacacacacacacacacacacacacacacacacacacacacacacatatatggagagagagagagatattcttataggggtgcatttgaatagtacaaggaat

SEQ ID NO: 16865 - DNA, 351 bp, Homo sapiens
  AC005887.3_109373
  Located on chromosome 10
  Distance between a terminus base of telomere on chromosomal short arm and 5'-terminus of this base sequence : 125565253
  Distance between 3'-terminus of neighbour sequence of sequence listing upward to telomere on chrosomal short arm and 5'-terminus of this base sequence : 13669
tgaccaaatatgtacatgtagcagcaagagctatacatcttcaaaacagactgttgaatttaaaaacaaacaagatgcagaataatgctagtataccatcaactctgtaaaacacatacacacactaaagtgcaatataattgctcataaacacacacacacacacacacacacacacacacacacacacactcttcatctactaatgtgacctcaggcaaattatttaacttctctacgctaagcccaactcctcctctagaaactctgggcaaaaatagtacttacctctgagaactgttgtgagtaaaaggcaatgcacacaaggcatttagcatagtgcctagcaaa

SEQ ID NO: 16866 - DNA, 351 bp, Homo sapiens; identical to SEQ ID NO: 16865
  AC005880.3_115822
  Located on chromosome 10
  Distance between a terminus base of telomere on chromosomal short arm and 5'-terminus of this base sequence : 125565253
  Distance between 3'-terminus of neighbour sequence of sequence listing upward to telomere on chrosomal short arm and 5'-terminus of this base sequence : -351

SEQ ID NO: 16867 - DNA, 342 bp, Homo sapiens
  AC005880.3_138820
  Located on chromosome 10
  Distance between a terminus base of telomere on chromosomal short arm and 5'-terminus of this base sequence : 125588134
  Distance between 3'-terminus of neighbour sequence of sequence listing upward to telomere on chrosomal short arm and 5'-terminus of this base sequence : 22530
acctatgaattatccaggcattcatatgctcatcactaatattgttgtttttatggagaagtttgtgctgagttataaactgtaggttttaaaaaacttttaatttaaaacacaactcatactcctccattaaagctaaagaaaaagaaaatgaaagaaaattgggcttaaagccccgtggttttcaattcaccctacacattgtcactagccatgatatctacttgctcagaaagttttagtggcttcttactgaccacacaaacagatacacacacacacacacacacacacacacacacacatagtcaaaagttcttggtttcacatttaaggtccacc

SEQ ID NO: 16868 - DNA, 342 bp, Homo sapiens; identical to SEQ ID NO: 16867
  AC005887.3_86380
  Located on chromosome 10
  Distance between a terminus base of telomere on chromosomal short arm and 5'-terminus of this base sequence : 125588134
  Distance between 3'-terminus of neighbour sequence of sequence listing upward to telomere on chrosomal short arm and 5'-terminus of this base sequence : -342

SEQ ID NO: 16869 - DNA, 103 bp, Homo sapiens
  D10S221
  Located on chromosome 10
  Distance between a terminus base of telomere on chromosomal short arm and 5'-terminus of this base sequence : 125588370
  Distance between 3'-terminus of neighbour sequence of sequence listing upward to telomere on chrosomal short arm and 5'-terminus of this base sequence : -106
ttttagtggcttcttactgaccacacaaacagatacacacacacacacacacacacacacacacacacatagtcaaaagttcttggtttcacatttaaggtcc

SEQ ID NO: 16870 - DNA, 395 bp, Homo sapiens
  AC005887.3_62222
  Located on chromosome 10
  Distance between a terminus base of telomere on chromosomal short arm and 5'-terminus of this base sequence : 125612544
  Distance between 3'-terminus of neighbour sequence of sequence listing upward to telomere on chrosomal short arm and 5'-terminus of this base sequence : 24071
gtacataaggtctgtcactaccaccaccactaccaccaccaccactgtcaccaccattaccaccaccaccaccaccaccagtacttcttttaacaacgtcaaatataaagtttaagaatgtaaaaaccattcttaatgcaggggcctaacagcagctagtttgcagacccctgatttagagtaacagttggtttatctctgaagaaataatagagcatgagctctggaagtccaggaccttttacatttaggactttatatcactaatcctccgtaaatcgcatatttccacatctgtaaaactgagataccaacctctcccacataggagttttaactattgagattgcaactgcatggaaatgcccacacagtgcctaatgaatacttagcaa

SEQ ID NO: 16871 - DNA, 309 bp, Homo sapiens
  AC005887.3_57885
  Located on chromosome 10
  Distance between a terminus base of telomere on chromosomal short arm and 5'-terminus of this base sequence : 125616743
  Distance between 3'-terminus of neighbour sequence of sequence listing upward to telomere on chrosomal short arm and 5'-terminus of this base sequence : 3804
caaagatttagcctcatgatttacttttaaaaggatcctctaaaatgaccaatttaagaaaaaaaaatcagctttatagtcatactcttctcaagagttctaggttagtttggaaagatatcccacatatttactatatcgatggcatgcttttaaaaaataaatcacttaagaacaacatagtttgtgtgtgtgtgtgtgtgtgtgtgtgtgtgtgtgtttaaaggtggcctggccttatcagagctgcgtttcaacacttgaaagctgtgtgactttaagcaagttatttaactactccgagctcca

SEQ ID NO: 16872 - DNA, 179 bp, Homo sapiens
  G08809
  Located on chromosome 10
  Distance between a terminus base of telomere on chromosomal short arm and 5'-terminus of this base sequence : 125692323
  Distance between 3'-terminus of neighbour sequence of sequence listing upward to telomere on chrosomal short arm and 5'-terminus of this base sequence : 75271
ttgaattgttctggtacctctgtcaaacatcagttaaccacactgttttaattgctgtagttttccaagtaagtcatctatctatctatctatctatctatctatctatctatctatctatcatctatctatctatgacctgtataacttatatagtaagaaatcaagtaacgcaactc

SEQ ID NO: 16873 - DNA, 317 bp, Homo sapiens
  AC005659.3_113874
  Located on chromosome 10
  Distance between a terminus base of telomere on chromosomal short arm and 5'-terminus of this base sequence : 125692342
  Distance between 3'-terminus of neighbour sequence of sequence listing upward to telomere on chrosomal short arm and 5'-terminus of this base sequence : -160
ctgtcaaacatcagttaaccacactgttttaattgctgtagttttccaagtaagtcatctatctatctatctatctatctatctatctatctatctatctatcatctatctatctatgacctgtataacttatatagtaagaaatcaagtaacgcaactccttttcttttttcctcttggtcaacattctttaggctattcaaagttctttgcatttccgtgtcagttttaatcgtcagcatttcaatttctacaaagaagcctgtgaggaattgcatggaattgcattaaatctataatttggagtgaatcaacat

SEQ ID NO: 16874 - DNA, 330 bp, Homo sapiens
  AC005658.3_41331
  Located on chromosome 10
  Distance between a terminus base of telomere on chromosomal short arm and 5'-terminus of this base sequence : 125723797
  Distance between 3'-terminus of neighbour sequence of sequence listing upward to telomere on chrosomal short arm and 5'-terminus of this base sequence : 31138
caatcagtggacctttaggatatttttctccttttgactattgcaaataatgttgccatgagcattggtgtatagatatctcagtctctgctatctgtcatctatctatctatctatctatctatctatctatctatctatctatcatctatctatgtatctatgtatctatctatctatcaccaattatctatcatctatcaatctccctaatcaatcatctattatctatcgatcatctatcttatcaatctatcatctattatctgtctatctacctacctacctacctacctatcttatgaatatacctagaagtgaaattgctag

SEQ ID NO: 16875 - DNA, 275 bp, Homo sapiens
  D10S610
  Located on chromosome 10
  Distance between a terminus base of telomere on chromosomal short arm and 5'-terminus of this base sequence : 125768089
  Distance between 3'-terminus of neighbour sequence of sequence listing upward to telomere on chrosomal short arm and 5'-terminus of this base sequence : 43962
ctctccgtttgtggagacacacacacaaacatacacacatgcagttttccatatatgtcaatattcatgaatggacttccatctatctatctatctatctatccatctatctatctatctatctatctatctatctatctatctaattacttatctatatctacctctctacttatcttctttctcagtctctcgttccatcaatcaaccaatcaaccaatcaatcaatcaatagatagatagattgatagataatgtgtggaagtccatttgtg

SEQ ID NO: 16876 - DNA, 379 bp, Homo sapiens
  AC006110.1_38827
  Located on chromosome 10
  Distance between a terminus base of telomere on chromosomal short arm and 5'-terminus of this base sequence : 125768153
  Distance between 3'-terminus of neighbour sequence of sequence listing upward to telomere on chrosomal short arm and 5'-terminus of this base sequence : -211
tcatgaatggacttccatctatctatctatctatctatccatctatctatctatctatctatctatctatctatctatctaattacttatctatatctacctctctacttatcttctttctcagtctctcgttccatcaatcaaccaatcaaccaatcaatcaatcaatagatagatagattgatagataatgtgtggaagtccatttgtgaaaaacaaatcatatgaatgatgcttgttacttttaacataaagacttgaagttgatttttcttaaatttcaaaaaagaaaaagaagctaaaggcaagtggaatgaatggttgaacttttcaccacaagatacattctcttctaaaaggtctaaggttaagacaggag

SEQ ID NO: 16877 - DNA, 217 bp, Homo sapiens
  AC005659.3_28501
  Located on chromosome 10
  Distance between a terminus base of telomere on chromosomal short arm and 5'-terminus of this base sequence : 125777673
  Distance between 3'-terminus of neighbour sequence of sequence listing upward to telomere on chrosomal short arm and 5'-terminus of this base sequence : 9141
aattgactcaaggttctgcaggctgtacaggagagtagagctgccatctgctctgcttctggggaggcctcagggagtttttacttatggcagaaggcaaagtgggaacaggcatgtcacatggcgaaagcaggagcaggtaagcaagagagagagagagagagagagagaaggtgggggcaggtgccacacactcttaaactatcagattgcctgt

SEQ ID NO: 16878 - DNA, 239 bp, Homo sapiens
  D10S1693
  Located on chromosome 10
  Distance between a terminus base of telomere on chromosomal short arm and 5'-terminus of this base sequence : 125797074
  Distance between 3'-terminus of neighbour sequence of sequence listing upward to telomere on chrosomal short arm and 5'-terminus of this base sequence : 19184
acccggtgggttgcagtcccccgacctgtcatgtctaaggatgtgcgcacatacacacacacacacacacacacacacacacaccagtgttcccacagactctcaccacctttaccccactttctcagactcttcaaatacttctcactcgtgtgccccactctactctgtccacagacacccatgccctgtcaacacacactcattcacaaaaatcctgctccctaccacacatgcca

SEQ ID NO: 16879 - DNA, 407 bp, Homo sapiens
  chr10.fa.O7frz.129411970
  Located on chromosome 10
  Distance between a terminus base of telomere on chromosomal short arm and 5'-terminus of this base sequence : 125927823
  Distance between 3'-terminus of neighbour sequence of sequence listing upward to telomere on chrosomal short arm and 5'-terminus of this base sequence : 130510
cacctgtctacatgatcgttattattattattattattattattattattattattattgagatggagtttgctcttgttgcccaggctggagtgcaatggtgcaatcttggctcactgcaacttccgcctcccgggttcaagcgattctcctgcctcagtctcccgagtagctgggattataggcatgcaccaccacgcccagctaattttgtatttttagtagagacggagtttcttcatgttggtcaggctggtctcgaactcccaacctcaggtgatgcacctgccttggtctcccaaagtgctgggattacaggcgtgagccaccgcacccggcagattgtaattatttctttacctgccttttttcccttctgaactgggggatacttggcattcagccta

SEQ ID NO: 16880 - DNA, 102 bp, Homo sapiens
  DISD22_0000292
  Located on chromosome 10
  Distance between a terminus base of telomere on chromosomal short arm and 5'-terminus of this base sequence : 126110594
  Distance between 3'-terminus of neighbour sequence of sequence listing upward to telomere on chrosomal short arm and 5'-terminus of this base sequence : 182364
aggattgaattggcatttgggtttaagcccatcacttttattttttaattaaatacacacacacacacacacacacacacactctcactgcctgagtccttt

SEQ ID NO: 16881 - DNA, 101 bp, Homo sapiens
  DISD22_0000295
  Located on chromosome 10
  Distance between a terminus base of telomere on chromosomal short arm and 5'-terminus of this base sequence : 126190081
  Distance between 3'-terminus of neighbour sequence of sequence listing upward to telomere on chrosomal short arm and 5'-terminus of this base sequence : 79385
tattgggatggacagagtagagtagagagagagagagagagagagagaatgtgtgtgtgtatgcacgtgtgtggtgcagcaggcaagacagatggcagctg

SEQ ID NO: 16882 - DNA, 257 bp, Homo sapiens
  chr10.fa.O7frz.137503739
  Located on chromosome 10
  Distance between a terminus base of telomere on chromosomal short arm and 5'-terminus of this base sequence : 126276256
  Distance between 3'-terminus of neighbour sequence of sequence listing upward to telomere on chrosomal short arm and 5'-terminus of this base sequence : 86074
ttaacttacagaaacctggtagacctgcagtctgaccttttgataaagtaactcttaatgttttgcataactgatgaccgtacatcattatcctcatttctaccccttgggcctcatttttatctttatctctcctctttctttctgctagatcactgagaaccactttttctgtgtgtgtgtgtgtgtgtgtgtgtgtgtgtgtatgtggttgtggtggtggtcttaaaataagactgatttaattgtattccttg

SEQ ID NO: 16883 - DNA, 196 bp, Homo sapiens
  DISD22_0000302
  Located on chromosome 10
  Distance between a terminus base of telomere on chromosomal short arm and 5'-terminus of this base sequence : 126424634
  Distance between 3'-terminus of neighbour sequence of sequence listing upward to telomere on chrosomal short arm and 5'-terminus of this base sequence : 148121
  misc_feature (1)...(196): n = A,T,G or C
gaggtaatcatcttctacaaagtccccacaaataccaaattagcanatatttattgaacaaatattttatatatatatagttaattcattaacatatatatatatatatatatatatatatatatatatatatatatatagntaattcattaacataaactcatggccaaaagcactatacctcatgcctaaatga

SEQ ID NO: 16884 - DNA, 212 bp, Homo sapiens
  DISD22_0000306
  Located on chromosome 10
  Distance between a terminus base of telomere on chromosomal short arm and 5'-terminus of this base sequence : 126548192
  Distance between 3'-terminus of neighbour sequence of sequence listing upward to telomere on chrosomal short arm and 5'-terminus of this base sequence : 123362
gtcctaattccagcacgggctttatgcccccagctctgagccccagacccccatctgatgatgatgggcctccctgcagcagagggtggtgtgtggggtgtgtgtgtgtgtgtgtgtgtgtgtgcatgcgtgcatgcatttgtgtgtgtgtgtgagagtgcctggcaggtggggcctcactggcctgccttttccttgcctgttcacaccag

SEQ ID NO: 16885 - DNA, 284 bp, Homo sapiens
  DISD22_0000313
  Located on chromosome 10
  Distance between a terminus base of telomere on chromosomal short arm and 5'-terminus of this base sequence : 126634700
  Distance between 3'-terminus of neighbour sequence of sequence listing upward to telomere on chrosomal short arm and 5'-terminus of this base sequence : 86296
ctccatagaaacactgtgcacttttgcaccattgtgaaaagatatgaagtggtcacaagttttattcaagtcaaatggtcccaatatgagatgaaattacagtatacccatatatgatgaaatactaattatttgagaataagacggaaaaacatccaaaatactctgttcaggtaaaaaaaaaaaaaaagaaagaaagaaaaaagaaaaagttgcagaacaccacatataaaaaggataactttaaaaaaatgataaatattagtatatgcacagagaacgcg

SEQ ID NO: 16886 - DNA, 125 bp, Homo sapiens
  DISD22_0000317
  Located on chromosome 10
  Distance between a terminus base of telomere on chromosomal short arm and 5'-terminus of this base sequence : 126709829
  Distance between 3'-terminus of neighbour sequence of sequence listing upward to telomere on chrosomal short arm and 5'-terminus of this base sequence : 74845
gtaccatccagccctagggacacaggtccctgggagtagcagcaatagtaacaacaacaacaacaacaacaacaacaacaacaataataataatgtaggctgtgggcctgggctggaacttcatc

SEQ ID NO: 16887 - DNA, 455 bp, Homo sapiens
  chr10.fa.O7frz.137061363
  Located on chromosome 10
  Distance between a terminus base of telomere on chromosomal short arm and 5'-terminus of this base sequence : 126901551
  Distance between 3'-terminus of neighbour sequence of sequence listing upward to telomere on chrosomal short arm and 5'-terminus of this base sequence : 191597
tgtcatccttgcttactaagtatcatcaatggaggagctgatgtgcccaatggggaagaatccaggcctcctgcctcagtttgtgagttcgttcgtccgtccatccatccatccatccacccacccacacacccacccacccatccatccatccatccatccatccatccatccatccatccatccatccatgtattcaataaatttttagagggtgggcacagtagctcacatctgtaatcccagtgctttcggaggctcaggcaggaggatggcttgaggccaggagttcaagactagcctaagcaacatagcaagaccctgtctctacaaaaaattaaaagacttaaaaattagcctggcatactggcatgcatctgtagtcccagctacttgggaggctgaggtgggaggatcacttgagcccaggagttcaaggttatagttagctacga

SEQ ID NO: 16888 - DNA, 420 bp, Homo sapiens
  chr10.fa.O7frz.137252522
  Located on chromosome 10
  Distance between a terminus base of telomere on chromosomal short arm and 5'-terminus of this base sequence : 127092666
  Distance between 3'-terminus of neighbour sequence of sequence listing upward to telomere on chrosomal short arm and 5'-terminus of this base sequence : 190660
attcagtaaggtgattcctgaccaggtgcggtggctcacacctgtaatcccagcactttgggaggctgaggcaggtggattgcttgagctcaggagttcgagaccagcctgggcaatgtggtgaaaccccatctctacaaaatacacacacacacaaattagccgggcatggtggcgcatgcctgaaatcccagtttactcaggaggctgaggcatgagaatcgcttgaaccttggaggcggatgttgcagtgagccaagatcctgccactaccctccagcttgggcaacagaacaagactctgtctcaaataagtaaatacatacatacatacatacatacatacatacatacatacatacaaagatattttctctagatttcttgtttggcagatattctatcagactgaggatgttt

SEQ ID NO: 16889 - DNA, 114 bp, Homo sapiens
  DISO7_10002981
  Located on chromosome 10
  Distance between a terminus base of telomere on chromosomal short arm and 5'-terminus of this base sequence : 127123238
  Distance between 3'-terminus of neighbour sequence of sequence listing upward to telomere on chrosomal short arm and 5'-terminus of this base sequence : 30152
gaagagacagaggagagtgaaagaaagagaaaggaagagagagagagagagagaaagagagaaagaatcagtattatttttgtctgatttttattctcctagagaagtgggcct

SEQ ID NO: 16890 - DNA, 108 bp, Homo sapiens
  DISO7_10008308
  Located on chromosome 10
  Distance between a terminus base of telomere on chromosomal short arm and 5'-terminus of this base sequence : 127272725
  Distance between 3'-terminus of neighbour sequence of sequence listing upward to telomere on chrosomal short arm and 5'-terminus of this base sequence : 149373
tgtatacgtgcacaggtgagtacacacacacacacacacaaacacacacacagaggactgtacaatttcagggaatccttagaaagccctgctattcggagtctctga

SEQ ID NO: 16891 - DNA, 233 bp, Homo sapiens
  AC005879.3_10282
  Located on chromosome 10
  Distance between a terminus base of telomere on chromosomal short arm and 5'-terminus of this base sequence : 127415549
  Distance between 3'-terminus of neighbour sequence of sequence listing upward to telomere on chrosomal short arm and 5'-terminus of this base sequence : 142716
ggagattcagaaacataaggacaacaagaaacttccccaaggtatcattatagtctttagacttcagacacacaccacacctcaaatatatacacaactgaaaggtatgtaaaattcatatatatgtacatatgacaaagccccagagttatattggagatacatagatagatgatagatagatagatagatagatagatagatagatagatagatcaatctccttgtaatcg

SEQ ID NO: 16892 - DNA, 259 bp, Homo sapiens
  AC005879.3_21936
  Located on chromosome 10
  Distance between a terminus base of telomere on chromosomal short arm and 5'-terminus of this base sequence : 127427198
  Distance between 3'-terminus of neighbour sequence of sequence listing upward to telomere on chrosomal short arm and 5'-terminus of this base sequence : 11416
ctccagtaacaatgtctccactacagaattttagctactatttaaggcacagttgctctgccaaatatttgttgtgaagaataagcaaatatttcccaaaatgttcaggcaagcatattaccactgcaaacacgtttttcactgtgaagtttttctcttattttcatatttatatgtatgtgtgtgtgtgtgtgtgtgtgtgtgtgtgtgtgtgtgtgtatgtatatagcagtgtctcaactgcatcagaaataaagat

SEQ ID NO: 16893 - DNA, 342 bp, Homo sapiens
  AC005879.3_29025
  Located on chromosome 10
  Distance between a terminus base of telomere on chromosomal short arm and 5'-terminus of this base sequence : 127434360
  Distance between 3'-terminus of neighbour sequence of sequence listing upward to telomere on chrosomal short arm and 5'-terminus of this base sequence : 6903
gcacatgtaccgtagaacttaaagtataataaatatatatgtatttatatatagatatgtatttatatatatatgtgtgtgtgtgtatatgtatgtgtgtgtgtgtatatatatatatatatatatatatatatatatatatatatatatatataaagtgagaaaacaaaaccttctgttcaggaggaatttctgagtcttccatcaccatcctttctctgccttcccccttccccctatttgctgtggtcacttctgtgattgtcttttatttcacattgtcgttctttccctttcttcactttttccttttgctcatcatttatgtaatccgtacaatga

SEQ ID NO: 16894 - DNA, 425 bp, Homo sapiens
  AC005879.3_42317
  Located on chromosome 10
  Distance between a terminus base of telomere on chromosomal short arm and 5'-terminus of this base sequence : 127447405
  Distance between 3'-terminus of neighbour sequence of sequence listing upward to telomere on chrosomal short arm and 5'-terminus of this base sequence : 12703
tttactgagtcttagaggcactacaccaaagtggttaggagtgtggactccagagaccccactgtgatctaacttttgattccaccactgactaaatgtgtgatcttgggcaagtcaatatctctgcacctcaatttcctcatctgcaaaatggagtcagaaatagggcatatctctcagagtagttgtgagaattacttccattgatatatatcgtatatataaagcccttagaacagagcctgacacaagataagcaccatgtatgccctgtattagctattattgctataattatcaagtttctaaaggggagataaagcagtcagtctttcccagtcttacctatttgtccatccatccatccatccatccatccatccatccatccatccaattctcttctgaccaatataaacagcctg

SEQ ID NO: 16895 - DNA, 308 bp, Homo sapiens
  AC005879.3_42394
  Located on chromosome 10
  Distance between a terminus base of telomere on chromosomal short arm and 5'-terminus of this base sequence : 127447590
  Distance between 3'-terminus of neighbour sequence of sequence listing upward to telomere on chrosomal short arm and 5'-terminus of this base sequence : -240
ttgtgagaattacttccattgatatatatcgtatatataaagcccttagaacagagcctgacacaagataagcaccatgtatgccctgtattagctattattgctataattatcaagtttctaaaggggagataaagcagtcagtctttcccagtcttacctatttgtccatccatccatccatccatccatccatccatccatccatccaattctcttctgaccaatataaacagcctgaagtgagagagagagagagagagagagagtttgaaaagtaactaaaaattgcatcctcgtttgtatta

SEQ ID NO: 16896 - DNA, 211 bp, Homo sapiens
  D10S190
  Located on chromosome 10
  Distance between a terminus base of telomere on chromosomal short arm and 5'-terminus of this base sequence : 127452276
  Distance between 3'-terminus of neighbour sequence of sequence listing upward to telomere on chrosomal short arm and 5'-terminus of this base sequence : 4378
aggcaaagcaggagcaggcatgtcacacagcaaaagcaggagcgagaaagagtgtgtgtgtgtgtgtgtgtgtgtgtgtgtgtgtgtgtgtgtgtgtgttgggagcaggggaaggaaccatacacttaaacaaccagatcttgtgagaactctttcactatcatgagaacagcaccaagccacgagggattcatctccatgacccaaacac

SEQ ID NO: 16897 - DNA, 453 bp, Homo sapiens
  chr10.fa.O7frz.129919507
  Located on chromosome 10
  Distance between a terminus base of telomere on chromosomal short arm and 5'-terminus of this base sequence : 127548393
  Distance between 3'-terminus of neighbour sequence of sequence listing upward to telomere on chrosomal short arm and 5'-terminus of this base sequence : 95906
tctagacagtgctgaggaaactccaccctagtgacaccctcaaatcgcccatgtggcttcgctcttgcttcattccatactggacctgagcctttctcctcggggaatccttttactgttaactgtgtaatacatttacttcatattcatcagtgcccatgtgtcatttatcctgatacttacataaataactggttggggggatgttttatatccccaaattctagcacagaggttggctcaaggctggtctcaaatgacagatggatggatgtatggatggatgagtggatgggtgaatggatgggtgggtggatggatgagtggatggatggatggatggatggagggatggacggatggttggatggatggatggatggatggatggatggatggatggatgaattgattcaatgaatgattcttcatcctgattagtaccttcacatt

SEQ ID NO: 16898 - DNA, 467 bp, Homo sapiens
  AL354863.11_153678
  Located on chromosome 10
  Distance between a terminus base of telomere on chromosomal short arm and 5'-terminus of this base sequence : 127639840
  Distance between 3'-terminus of neighbour sequence of sequence listing upward to telomere on chrosomal short arm and 5'-terminus of this base sequence : 90994
gatagatggataaataggcagacggatggatggatggatagatagatagatagatagatagatagatagatagatgatagatatagatagatccatagatacatagatagacacatagataggtggatggatggatagataaattaatagatgataggtggatagagagatgggtgataggcagacagatggtaggagagatagagctggatagatggatgatggatagatagatagatagataacaatagtgtgtcagaagataacaagtgctgtgaaaaaacaaaacaaaacaaaaacagaggtgctcctagagccacagtggggtgtaatatagaacaaggtggtcagaatgggcctcactgagattggggtcatttgagtacaggcctgaagcaggggaggagtcgggctgacagagggaaaaccaagtgcaaagccctcgattcaggagatcgttatgaata

SEQ ID NO: 16899 - DNA, 467 bp, Homo sapiens
  chr10.fa.O7frz.130341704
  Located on chromosome 10
  Distance between a terminus base of telomere on chromosomal short arm and 5'-terminus of this base sequence : 127948899
  Distance between 3'-terminus of neighbour sequence of sequence listing upward to telomere on chrosomal short arm and 5'-terminus of this base sequence : 308592
acctaggccaatttgctactagaattctggttcaataacacacggatgtgtctcctagcaagattgatttttttgttttgttttgttttgttttgttttgttttgttttgttttgttttgtgacagggtctcaatttgtcacccaggctggagttcagtggcatgatcatggctcactgcatcctctgcctcccaggttcaagcgatccacctgcctcagcctcccgagtagctgggattacaggcatgcaccatcatgtcgggctaatttttgtatttttagtagagatggggtttcaccatgttggccaggatggtctcgaactcctgacctcaagtaatccaccggacttggcctcccaaattgctgggattacagacatgagccaccacgcccggccaagcttgttatttttaacatgttcactacatcaacatttttttaattgattaccaaacatgacatt

SEQ ID NO: 16900 - DNA, 119 bp, Homo sapiens
  D10S1785
  Located on chromosome 10
  Distance between a terminus base of telomere on chromosomal short arm and 5'-terminus of this base sequence : 128236057
  Distance between 3'-terminus of neighbour sequence of sequence listing upward to telomere on chrosomal short arm and 5'-terminus of this base sequence : 286691
aagaatgtgtccctgcactccagcctgggtgacagagcaagaccctgtctcacacacacacacacacacacacacacacacacacacacaaagccagtttttgcagttcttaattccca

SEQ ID NO: 16901 - DNA, 228 bp, Homo sapiens
  D10S542
  Located on chromosome 10
  Distance between a terminus base of telomere on chromosomal short arm and 5'-terminus of this base sequence : 128358926
  Distance between 3'-terminus of neighbour sequence of sequence listing upward to telomere on chrosomal short arm and 5'-terminus of this base sequence : 122750
ttctggtggtcacaaatccctttgtgaatctgatgaaagcaatgaacactctttctagggaacatgaacacacacacacacacacacacatacacacgtaagcacaatttaacctataatttaggagcctatagaccccatgtgaagatctctgacctaaatcccacctaaggctcccaactctcacgttctatgattctatcaacaaccaaccaaacaatgaagcat

SEQ ID NO: 16902 - DNA, 286 bp, Homo sapiens
  Z23314.1_71
  Located on chromosome 10
  Distance between a terminus base of telomere on chromosomal short arm and 5'-terminus of this base sequence : 128358960
  Distance between 3'-terminus of neighbour sequence of sequence listing upward to telomere on chrosomal short arm and 5'-terminus of this base sequence : -194
gaaagcaatgaacactctttctagggaacatgaacacacacacacacacacacacatacacacgtaagcacaatttaacctataatttaggagcctatagaccccatgtgaagatctctgacctaaatcccacctaaggctcccaactctcacgttctatgattctatcaacaaccaaccaaacaatgaagcatcttctgtcacctcagaccctcaaactcatgaaccaacgttttggtaccagccccctaatgtctgtaaaattgcaaataccaagactaatgtt

SEQ ID NO: 16903 - DNA, 396 bp, Homo sapiens
  AL133550.5_121721
  Located on chromosome 10
  Distance between a terminus base of telomere on chromosomal short arm and 5'-terminus of this base sequence : 128554151
  Distance between 3'-terminus of neighbour sequence of sequence listing upward to telomere on chrosomal short arm and 5'-terminus of this base sequence : 194905
cgagtagctaggattacaatcacgtgccaccatgccaggtttttttgttttgttttgttttgttttgtttgtttgttttagtagagatggggttttaccatgttggccaggtcaactcctgacctcaattgatctgccgatctcggcctcccaaagtgctgggattacaggcgtgagccaccatgcccagcccttttcctcctttcattcaggagtgaggggtgaggaatttgtgcaaacgctgatccccaaacaggctcaaattaggctcttctggaagccacagggacatgcaggcaaggaaagaaaggtactgggaatctacctgttcagggcagcttaacctcttctgccttgaggcacctgctgggtctgggctgtgctttgactcaggaa

SEQ ID NO: 16904 - DNA, 444 bp, Homo sapiens
  chr10.fa.O7frz.130992520
  Located on chromosome 10
  Distance between a terminus base of telomere on chromosomal short arm and 5'-terminus of this base sequence : 128590275
  Distance between 3'-terminus of neighbour sequence of sequence listing upward to telomere on chrosomal short arm and 5'-terminus of this base sequence : 35728
ccaagtaacagacataaccaaccttaggataggatttattagcaggtgggaatgatgttgttgctaacatctggcaaagctcaaggcttcataacttgccagaagtgagatccagtcacccactatttatttattaatttattatttatttatttatttatttatttatttatttattgagacggagtgttgctctgtcgcccaggctggagtgcaatggcacgatctcggctcactgcaaccttctgcctcccaggttcaagcggttctcttgcctcagcgccccgagtagctgggattacaggcgcccgccaccatgcccggctaacttttgcatttttttttagtagagatggggtttcaccatgttggtcaggctggtctcgaacttctgacctcaggttatccaactgccttggccttacaaagtgctaggattacagg

SEQ ID NO: 16905 - DNA, 101 bp, Homo sapiens
  DISD22_0000326
  Located on chromosome 10
  Distance between a terminus base of telomere on chromosomal short arm and 5'-terminus of this base sequence : 128690396
  Distance between 3'-terminus of neighbour sequence of sequence listing upward to telomere on chrosomal short arm and 5'-terminus of this base sequence : 99677
aggcaaagaggcattcagtagatgggtgtgtgtgtgtgtgtgtgtgtgtgtgtgtgtgtgtgcccaaaataggtgtgaggcttgaggtgacttctgcccaa

SEQ ID NO: 16906 - DNA, 144 bp, Homo sapiens
  DISO7_10002969
  Located on chromosome 10
  Distance between a terminus base of telomere on chromosomal short arm and 5'-terminus of this base sequence : 128917515
  Distance between 3'-terminus of neighbour sequence of sequence listing upward to telomere on chrosomal short arm and 5'-terminus of this base sequence : 227018
tgttagaggagagctcctgaccacacacacatacacacacacacacacacacacacacacacaccccctatacaaagttttcttatttaggggaaaaactcatactgcacattatttttcacttgagatattcattatttgagg

SEQ ID NO: 16907 - DNA, 254 bp, Homo sapiens
  AC005874.3_5627
  Located on chromosome 10
  Distance between a terminus base of telomere on chromosomal short arm and 5'-terminus of this base sequence : 129030055
  Distance between 3'-terminus of neighbour sequence of sequence listing upward to telomere on chrosomal short arm and 5'-terminus of this base sequence : 112396
ctgaaggactttctgatgctaaaaatgatggtgaagggcaaacgtacacccagttactcccagggcactccctttcctgtacttgaatactgggctggctagactcagatacacatgcacggacaaacatacacacacacacacacacacacacactcctgttccatatctttgggtctctgcttgctcttacccttgcttcgaatatcctttccaccttacttcacacagctgactgttgcttaattatggag

SEQ ID NO: 16908 - DNA, 155 bp, Homo sapiens
  D10S1792
  Located on chromosome 10
  Distance between a terminus base of telomere on chromosomal short arm and 5'-terminus of this base sequence : 129030086
  Distance between 3'-terminus of neighbour sequence of sequence listing upward to telomere on chrosomal short arm and 5'-terminus of this base sequence : -223
tgaagggcaaacgtacacccagttactcccagggcactccctttcctgtacttgaatactgggctggctagactcagatacacatgcacggacaaacatacacacacacacacacacacacacactcctgttccatatctttgggtctctgcttg

SEQ ID NO: 16909 - DNA, 207 bp, Homo sapiens
  AC005874.3_33555
  Located on chromosome 10
  Distance between a terminus base of telomere on chromosomal short arm and 5'-terminus of this base sequence : 129058067
  Distance between 3'-terminus of neighbour sequence of sequence listing upward to telomere on chrosomal short arm and 5'-terminus of this base sequence : 27826
gtttacgtgaccaactgcttacgcacacacacagacacacacacatacacacacacacacacacacacacaaagattagagtctgggagatccatcaggaggccgtgccaagatccagatgacaggcaaaggtaacctggacgggttggtggcactaaagacagacaggagttcacaatcaaggaatatctaggaagtggaatccac

SEQ ID NO: 16910 - DNA, 302 bp, Homo sapiens
  AC005874.3_80261
  Located on chromosome 10
  Distance between a terminus base of telomere on chromosomal short arm and 5'-terminus of this base sequence : 129104693
  Distance between 3'-terminus of neighbour sequence of sequence listing upward to telomere on chrosomal short arm and 5'-terminus of this base sequence : 46419
cgactttctgtatctgctcaacctcaccccagacctcttacccaagatgctgaaggataattggcctcatggaaacctggaataggggctgcaaactcatcaggatgggctcctcctcctttctaccctgccctctcctccctcatctgtgtgtgtgtgtgtgtgtgtgtgtgtgtgtgtgtgtgtgtgtgtgtgtgtctgcttctctctgaccatctctgccatttccaccactctctacttacccatcctacaccatcccataatgaacactccagcttcagtcaacttcaggatcttta

SEQ ID NO: 16911 - DNA, 224 bp, Homo sapiens
  AC005874.3_104853
  Located on chromosome 10
  Distance between a terminus base of telomere on chromosomal short arm and 5'-terminus of this base sequence : 129129350
  Distance between 3'-terminus of neighbour sequence of sequence listing upward to telomere on chrosomal short arm and 5'-terminus of this base sequence : 24355
gatccttaggtaatacattgcctaaaaatatgtttttatgtgtggtagaggaatgatttgtgtgtatatatatatatatacacacacacacacacacacacacacgcatatatatatacacacatgcatatatatatatacacacacttaattagctttttaagatttaaaacattaaaagcacatggttttttaaaaaatcaagagcatacagctgtatcaag

SEQ ID NO: 16912 - DNA, 368 bp, Homo sapiens
  AC005874.3_125822
  Located on chromosome 10
  Distance between a terminus base of telomere on chromosomal short arm and 5'-terminus of this base sequence : 129150157
  Distance between 3'-terminus of neighbour sequence of sequence listing upward to telomere on chrosomal short arm and 5'-terminus of this base sequence : 20583
acatggttattctttgcagaaggatagtatgagcccgctggccattttctctgccattccagtgccttctgcccccagagtagccattaatatgatcagtaggatatctactactaagggcatttgctgcatatgcctggaataatactgtctacacatgtcctctgtacagacagactctttaatgccaacttgttttatttctttagtgaagagccacagattttaaatacacacacacacacacacacacacacacattttgaagtgtcagctgtatgccaggcgctataccaggcagcgaagtcagagcagctcgacacaacacacacagtctcccttcttgtgtcagttacagtacctgcttc

SEQ ID NO: 16913 - DNA, 302 bp, Homo sapiens
  chr10.fa.O7frz.132739648
  Located on chromosome 10
  Distance between a terminus base of telomere on chromosomal short arm and 5'-terminus of this base sequence : 129232958
  Distance between 3'-terminus of neighbour sequence of sequence listing upward to telomere on chrosomal short arm and 5'-terminus of this base sequence : 82433
actaatgaccacgtatcattgtttgcattactatagtgaagtttttcctcactgttaggtattaaattacttacaattttttgttactaccaatgatgcagttgtctttatgcaataacgtgtgtgtgtgtgtgtgtgtgtgcatgtgcctgcgcacttctttggttacaagggtatgatgaattatgacttttgtggtttgttgtcagattgatctccagaaagactctcaatgaacagtgctagtagcaaaatacaagcacctgtttcctcacaccttaccagaattgttctaatttgta

SEQ ID NO: 16914 - DNA, 433 bp, Homo sapiens
  AL355273.13_141070
  Located on chromosome 10
  Distance between a terminus base of telomere on chromosomal short arm and 5'-terminus of this base sequence : 129466295
  Distance between 3'-terminus of neighbour sequence of sequence listing upward to telomere on chrosomal short arm and 5'-terminus of this base sequence : 233035
tgaagtaactcttacattctccagcacccacatggtccagtctcgagccattgtgcagctggagaagcacagtccagtgtgtttttcttctgtttccccagcactctgaaggagagcccaacaccaagttctaataatttattaatttttttatttttaatgcatttttattttattttattttattttattttattttattttattttattttattttagaaggagtcactctgttgcccaggctggagtgcagtggtgcaatctcagctcactgcaacctctgcctcctgggttcaagcaattctcttgcctcagcctcctgagtagctgggattacaggcatgtgccaccacacccagctaattttttgtatttttagtagagacagggtttcaccatgttggccaggctggtttcgaactcctgacctc

SEQ ID NO: 16915 - DNA, 298 bp, Homo sapiens
  DISO7_10002972
  Located on chromosome 10
  Distance between a terminus base of telomere on chromosomal short arm and 5'-terminus of this base sequence : 129647867
  Distance between 3'-terminus of neighbour sequence of sequence listing upward to telomere on chrosomal short arm and 5'-terminus of this base sequence : 181139
cctcattatccagagatgcagatagccaggcatggtgactcatgcctgcagtccagctactttggaggctgaggcaggaggatcacttgagcccaggagttcaagtccagccttggtaacatagtgagactttgtgtcaaaaaaatgtatacacatatgtgtgtgtgtgtgtgtgtgtgtgtatttttatatatatatatatatacatacatacatatgaaatatataaaattatatattttatacatattatatatatatgtatatatatcttgcttttgtgagccagaaatcagca

SEQ ID NO: 16916 - DNA, 109 bp, Homo sapiens
  DISD22_0000332
  Located on chromosome 10
  Distance between a terminus base of telomere on chromosomal short arm and 5'-terminus of this base sequence : 129767762
  Distance between 3'-terminus of neighbour sequence of sequence listing upward to telomere on chrosomal short arm and 5'-terminus of this base sequence : 119597
actgagatgttgggattgtgtgttactgcagcatatctctctctctctgtgtgtgtgtgtgtgtgtgtgtgtgcgcgcacacttttttgttggaacttggtatcagagc

SEQ ID NO: 16917 - DNA, 384 bp, Homo sapiens
  chr10.fa.O7frz.132223431
  Located on chromosome 10
  Distance between a terminus base of telomere on chromosomal short arm and 5'-terminus of this base sequence : 129917936
  Distance between 3'-terminus of neighbour sequence of sequence listing upward to telomere on chrosomal short arm and 5'-terminus of this base sequence : 150065
gcaactgagactcatagtcttaagtcacccaagaatattccttggaggcaaatgtggagcttcctctccccaacttcttcttccttttgaagtggagaatgcctctgcccaatcctggacctctcttaggctagccattctagggatatatttacatttttattttctgcttcctgaagcctggagacttcatcattaaacatttggcttgggaaaggataaaatgcctttatcagtcaaggctctccagggaacagaagtagtaggggatgtatgtatgtgtatgtacgcacacacacacacacacacacacacacacacacacacacacacacacacataatacctccccaacaacacctaggctagaatttgactgaataa

SEQ ID NO: 16918 - DNA, 221 bp, Homo sapiens
  D10S1722
  Located on chromosome 10
  Distance between a terminus base of telomere on chromosomal short arm and 5'-terminus of this base sequence : 129937959
  Distance between 3'-terminus of neighbour sequence of sequence listing upward to telomere on chrosomal short arm and 5'-terminus of this base sequence : 19639
ttagtacctgttaattgagaatggatataataaaaaatgatatggataattcgaggaatacttttaaagtagtgtgtgtgtgtgtgtgtgtgtgtgtgtgtgtgtactataaggctacagaaaccaaaacagcatggtacttgtctaaaaacagacaagtagaccaagagaacaggacagagaacccagaaataaagctacacacctacagccatctgatc

SEQ ID NO: 16919 - DNA, 375 bp, Homo sapiens
  chr10.fa.O7frz.132294104
  Located on chromosome 10
  Distance between a terminus base of telomere on chromosomal short arm and 5'-terminus of this base sequence : 129988626
  Distance between 3'-terminus of neighbour sequence of sequence listing upward to telomere on chrosomal short arm and 5'-terminus of this base sequence : 50446
agtaactaaatgacataggctgagtcaaattttttatgaataatcaaatgtattttggagacgtttaagtatagactggatattggataatgttatgggattattgttgatttttcttaggtttaatagtggtattgttgttatgtaggaaaaaatccttaggagattcatgctgaagttttgggggttaaaatgtcataatgttgtcaatatattttcaaatgattcaggaaagaaatatatatggacatagatacacacacatacatgcacaggtgtgtgtgtgtgtgtgtgtatatatatagtgagagagagagaaagaagaaagaaagaggagaatgtggcaaaagtgttaatacttggtgcatctaggta

SEQ ID NO: 16920 - DNA, 215 bp, Homo sapiens
  D10S1757
  Located on chromosome 10
  Distance between a terminus base of telomere on chromosomal short arm and 5'-terminus of this base sequence : 130118799
  Distance between 3'-terminus of neighbour sequence of sequence listing upward to telomere on chrosomal short arm and 5'-terminus of this base sequence : 129798
agtatctttgcttagcattccctcgtgtatcagccttacaactttctgcctaaaacatatcccttacatttcctttgatttgtttgtgtggtgtgtgtgtgtgtgtgtgtgtgtgtgtgtgtgtgtgtgtgtgtgtgctgtatgctctgtgtttttgaatttcctaaattgtctttgatttcattcttggaagatggccttattcaatatggaat

SEQ ID NO: 16921 - DNA, 204 bp, Homo sapiens
  D10S209
  Located on chromosome 10
  Distance between a terminus base of telomere on chromosomal short arm and 5'-terminus of this base sequence : 130124647
  Distance between 3'-terminus of neighbour sequence of sequence listing upward to telomere on chrosomal short arm and 5'-terminus of this base sequence : 5633
cccatcagtagtaaaggggcgtgtgtgtgtgtgtgtgtgtgtgtgtgtgtgtgtgtgtggtctgtgtgtctccaactctggagagcaaatgaacaagtttgtccaggacaagtagactctgaatatcctctcatcccactggctcaggagttttctacttatatttctgttgttggtaatgttagcaggatatgagcacatttg

SEQ ID NO: 16922 - DNA, 421 bp, Homo sapiens
  chr10.fa.O7frz.132626544
  Located on chromosome 10
  Distance between a terminus base of telomere on chromosomal short arm and 5'-terminus of this base sequence : 130159254
  Distance between 3'-terminus of neighbour sequence of sequence listing upward to telomere on chrosomal short arm and 5'-terminus of this base sequence : 34403
caagctttgtcatttcagtaagaaacaaaaacctttgaaatttttacaattatcttcacactcatatctccttgtcccctacaccagctaaaagatgagtgaatagcgctgagtgctcgttggctggtccatggagggaaggatcatttattgagatattaattcaggttctatctttgctgctgaaagagaatcaaaaagaatgagaagctttgctgtcctgtgctctgggtctctccctcccccaggccctcagctgggcaaggaggcagggagggcctattatacatgcttttatacacacacacacacacacacacacacacacacacacacacacagaaatacataagcttaatctcttcttttggttgaaaaagtatagctgagtgggtgagagtaatagctccagaattatgca

SEQ ID NO: 16923 - DNA, 456 bp, Homo sapiens
  chr10.fa.O7frz.132530934
  Located on chromosome 10
  Distance between a terminus base of telomere on chromosomal short arm and 5'-terminus of this base sequence : 130260295
  Distance between 3'-terminus of neighbour sequence of sequence listing upward to telomere on chrosomal short arm and 5'-terminus of this base sequence : 100620
gtttgatcataatgtgcctagatgtagtttgctttgtatttatttatctttcttgagttggtaagctttttttttattattatactttaagttttagggtacatgtacacgatgtgcaggtttttaaattaattggttcataccttccatcaattttggaaaattatcaattgtctatttatctatcatccgtctgtctgtctgtctgtctgtctgtctgtctgtctatctatctatctatctgcaaaattttctggcctattctctctctctctttctgatcctgccatgagatctctgttggactatttaatattattccacagacacgggatgctccctttcaggtgttttatttttcctttccttttctctttgtgtttcattttagaccatttctatggacctatcttgagtttcactaatcctccgatgtgctcactactgtcaaaccta

SEQ ID NO: 16924 - DNA, 101 bp, Homo sapiens
  DISO7_10002977
  Located on chromosome 10
  Distance between a terminus base of telomere on chromosomal short arm and 5'-terminus of this base sequence : 130297441
  Distance between 3'-terminus of neighbour sequence of sequence listing upward to telomere on chrosomal short arm and 5'-terminus of this base sequence : 36690
atccgcttctaatgtcattatgagaaacacacacacacacacacacacacacacacacacacacacacaaaatgaggtacatagtaatcagggtccgagca

SEQ ID NO: 16925 - DNA, 360 bp, Homo sapiens
  chr10.fa.O7frz.133140528
  Located on chromosome 10
  Distance between a terminus base of telomere on chromosomal short arm and 5'-terminus of this base sequence : 130438773
  Distance between 3'-terminus of neighbour sequence of sequence listing upward to telomere on chrosomal short arm and 5'-terminus of this base sequence : 141231
gtattacgtagcatgcagaaacaggaggaagaggacttaaatacagtggaaagagtaagaaacaggatgaagtatatatatatatatacacacacacacacacacacacacatataaacacaatactatttaggtaaattagataataactacatgttaagaacttatacatatgcgaggatattggactaaaaggctttacaataggtggaatataaaagaatatataaataaaacaagtgattttggaggaatctatggatgataaaggaccctggttcgagaactgtgattgtcttatcgtgtgcacataagagatgggggaggagacgaggaataggcaatactatcattgaattc

SEQ ID NO: 16926 - DNA, 433 bp, Homo sapiens
  chr10.fa.O7frz.133333262
  Located on chromosome 10
  Distance between a terminus base of telomere on chromosomal short arm and 5'-terminus of this base sequence : 130673455
  Distance between 3'-terminus of neighbour sequence of sequence listing upward to telomere on chrosomal short arm and 5'-terminus of this base sequence : 234322
ggtagtttggttcctaacaaaggtctttctggccccaaagctcatgctttttccagaaaaccatgaagtcatccacctgccaactcactaaatatagttcattatgtcaataaagattaaccctttacatggacacttaactgcaatggtcttggtgctgcataacgaagctgtggacttgggcaactcttcatgacccaacttgctacttctgagttgcctccctctctagagtttgtctccttcagcctattcaatgcagcacctattcattcattcattcattcattcattcattccacaaattttctggaagtatctaccatatgctagatgctagagatacaaaaatgagtccaacagctcctgccttcaaggacactagaattcatcacagtatattagtcgcctatgtgactaccttaaggacaga

SEQ ID NO: 16927 - DNA, 444 bp, Homo sapiens
  chr10.fa.O7frz.133450289
  Located on chromosome 10
  Distance between a terminus base of telomere on chromosomal short arm and 5'-terminus of this base sequence : 130809381
  Distance between 3'-terminus of neighbour sequence of sequence listing upward to telomere on chrosomal short arm and 5'-terminus of this base sequence : 135493
ggatcaccttaggtcaccttaggccagccaacatggtgaaaccccatctctactaaccacacacacacacacacacacacacacacacacacacacaagaattagttaagtgtggtggcgggcacctgtaatcccaactacttgggaggctgaggcaggagaattgcttgaacccaggaggcagaagttgcagtgagctgagatcatgccactgcactccagcctgggcgacggagcacgactctgtctcaaataataattataattattattattatttataattgataataaccactaaaatgaagccaacagccaagacactcaaaaaaacaaattatatttcacgcccacttgcaatctaattatttcactatctatcactatagaattggaagaagttattctcatgaacaccctgaaggaaactttccattatggtat

SEQ ID NO: 16928 - DNA, 439 bp, Homo sapiens
  AC009989.8_26992
  Located on chromosome 10
  Distance between a terminus base of telomere on chromosomal short arm and 5'-terminus of this base sequence : 131230866
  Distance between 3'-terminus of neighbour sequence of sequence listing upward to telomere on chrosomal short arm and 5'-terminus of this base sequence : 421041
ctatgattaaatgtttgaggaaactccaaactgtctccatagtggctgcactattttacattcccagcagtagtgtgtgagggttccaattctccatatcctcaccaacactttttttctttttttattattattattattattattattattattattattgccatcctagtggatatgaagtagttcctcattgtggttttatttttgagacagagtctaactctgttgcccaggctggagtgcagtagtgcgatcttggctcactgcaacctctgcctcccaggttcaagccattctcctgccccagcctcccgagtagctgggactacaggtgcatgccaccacagccggctaatgtttgtttgtttgtttgtttgtttttagtaaatatggggtttcactatgttggctaggttggtttcgaactcctgacctc

SEQ ID NO: 16929 - DNA, 444 bp, Homo sapiens
  AC009989.8_114829
  Located on chromosome 10
  Distance between a terminus base of telomere on chromosomal short arm and 5'-terminus of this base sequence : 131263747
  Distance between 3'-terminus of neighbour sequence of sequence listing upward to telomere on chrosomal short arm and 5'-terminus of this base sequence : 32442
ccagtaagaataagcatgataaaggaaataaataagaggacccagaaagaaagaaagaaagaaagaaagaaagaaagaaagaaagaaagaaagaaagagaaagaaagaaagaaagaaagaaagaaaaaagaaaagagaaagaaagacagactatagtagtaaggtaggtggctttaaatagcaagagcagagaaggtctttggcatgagcctaaaggataaggaggagaccatcagccgtgcaaagatctgagcaaagtgccttccaggctgagctgtttgccttgagcagaaacactaagaagggaatgagcttggctcaaagaacagagggatgtaatgaaccaggagagacagctggaagaaaagtcaaagaggaagctagaggctttgctggccgtggaaaggactacagaaattactcttaagtcagtggttctcacta

SEQ ID NO: 16930 - DNA, 207 bp, Homo sapiens
  D10S1679
  Located on chromosome 10
  Distance between a terminus base of telomere on chromosomal short arm and 5'-terminus of this base sequence : 131268266
  Distance between 3'-terminus of neighbour sequence of sequence listing upward to telomere on chrosomal short arm and 5'-terminus of this base sequence : 4075
agtattttaccatgagggtactatagaaagttggccaaaactgatgatttgagttttagcatactgacactgacctgtatcttcctgcccgtaacttagagtacatgttctctgcgtgcgtgtgtgtgtgtgtgtgtgtgtgtgcgtgcacgcgcgcacatgcgtctgaccatctccagacttaggtctagatcagcacaagcctca

SEQ ID NO: 16931 - DNA, 365 bp, Homo sapiens
  AC009989.8_79981
  Located on chromosome 10
  Distance between a terminus base of telomere on chromosomal short arm and 5'-terminus of this base sequence : 131337641
  Distance between 3'-terminus of neighbour sequence of sequence listing upward to telomere on chrosomal short arm and 5'-terminus of this base sequence : 69168
gcaatgaaccaagatgaagccactgcactccagcctgggtgacagagcaagagtctgtctcaaatgataataataataataataataagcattttcatatagcatgatccataaattaagccaactacttcacctggtgctcaacacacacacacacacacacacacacacaaacataaaactgtgatcagttccaacaccagaggaaaaactggctgaaaagaactttttgagagactacatagtactgtattttatgggtgatttttgaaggatttttaaggataattttgaccatatgtgactctcacttcatgtgatggctttacactctagcctctgagttaaatgtgactccactgtaa

SEQ ID NO: 16932 - DNA, 349 bp, Homo sapiens
  AC009988.8_173026
  Located on chromosome 10
  Distance between a terminus base of telomere on chromosomal short arm and 5'-terminus of this base sequence : 131404904
  Distance between 3'-terminus of neighbour sequence of sequence listing upward to telomere on chrosomal short arm and 5'-terminus of this base sequence : 66898
tcatcttggtcctattcctaacgtccccaggaatatgccatttgcctcaaaagtattgctacaaaaggtagccttcactgcccttgatttattttattttattttattttattttattttatttgtgtgagacggagtatcactctgtcaccaaggctggagtgcagtggcgcgatctcagctcactgcaacctctacctcctgggttctagtgattctcctgccttagtttcccaagtagctgagactacaggcatgcatcaccacacccagctaatttttgtattttttagtggagatggggtttcactatatgttggccaggctggtctagaactcctgactgcag

SEQ ID NO: 16933 - DNA, 276 bp, Homo sapiens
  chr10.fa.O7frz.133868946
  Located on chromosome 10
  Distance between a terminus base of telomere on chromosomal short arm and 5'-terminus of this base sequence : 131484919
  Distance between 3'-terminus of neighbour sequence of sequence listing upward to telomere on chrosomal short arm and 5'-terminus of this base sequence : 79666
tagttctaatcatggagaactgatggacaggggcacaggcacgcacgcacgcacgcgcactcgcgcacacacacacacacacacacacgcactctctctctctctctctcttccaattcaccagcacagagcctaaacctgagcccattttcagctgttaaaaactcctttctcatctataattcaatgaccttcctaatcacctctgacaccaaagcgaactcctgcaacagaagaactggtcttagggctcaaatcagtggccagtattagact

SEQ ID NO: 16934 - DNA, 470 bp, Homo sapiens
  chr10.fa.O7frz.133941235
  Located on chromosome 10
  Distance between a terminus base of telomere on chromosomal short arm and 5'-terminus of this base sequence : 131613704
  Distance between 3'-terminus of neighbour sequence of sequence listing upward to telomere on chrosomal short arm and 5'-terminus of this base sequence : 128509
acattcctacaatgtgatggactagctattgccatttcatcttatacaaagacctcctaaaggaatacactctgatcaaagatatccagagaaggatctccctacacacacacacacacacacacacacacacacacacacacaaccctctaggacaggtgcacatgtggggagaagggtattacaatgacaattgttaaattctaacaccctcctttttaccatcaaactctaaacactcacactttcctcttttgggagtccttattgctagagaaattaatgtatatttcagagaatagtagcacagatgacattttcaagaggctgaattcagtcttccacttggaggtgtcacataaggtatgacggctcacacagaccctcagaggccttccttccaccctcagcccattaactttttttctgaccatttctctagtctctcttgttactgttaggtttcttgt

SEQ ID NO: 16935 - DNA, 427 bp, Homo sapiens
  chr10.fa.O7frz.134287740
  Located on chromosome 10
  Distance between a terminus base of telomere on chromosomal short arm and 5'-terminus of this base sequence : 131932253
  Distance between 3'-terminus of neighbour sequence of sequence listing upward to telomere on chrosomal short arm and 5'-terminus of this base sequence : 318079
ttacattcaaccttatgattcaacctggaagatacaaggaagttaataactgataaggcagtgattcttctaacactcaatattttctaatgagggatcatcttccaaatgaacataaaaaataaatggaagtgattaattttaaatgcatgcagatttttacgttctctgagcatgtgattgtgtgtgtgtgcgtgtgtgtgtgtctacagcaaaaggcaagaaaggattaaggtatcatatccttttgattgaagggttaggagtgaaagaattgaatgctgtggtgacgtcactcagttttcttagtttggaggcattttaattgggcctgtttgaaccacttccattttattttccagtgatggttcagtacgcatagtgcagggtggctacgcaatcagtgttgcttaaatgaataagcaag

SEQ ID NO: 16936 - DNA, 419 bp, Homo sapiens
  chr10.fa.O7frz.134385454
  Located on chromosome 10
  Distance between a terminus base of telomere on chromosomal short arm and 5'-terminus of this base sequence : 132041400
  Distance between 3'-terminus of neighbour sequence of sequence listing upward to telomere on chrosomal short arm and 5'-terminus of this base sequence : 108720
ctagctggcattgtactgtaagggggggctttcccttcttccccatttgttcatgactttatttaggtctaaatggattcatagattattacttttattccatgggttataatccagaactgtgtgtgtgtgtgtgtgtgtgtgtgtgtgtttgatgttcaaatagtcccagatttgacagtggcagccccttttaggtggttcttatgtcctttgacgcgactcccccagctgggaagtaggtacgtgtatgtacacatgcatgtgtgcacacagccctccacaactagttctggatttgtctgattcctctgattgcagccctgccctgagggatctctggagtccaaccaccttctgtatatgcaagctcctctctgattgtgagaacctggctcctattatccttgatactggat

SEQ ID NO: 16937 - DNA, 289 bp, Homo sapiens
  chr10.fa.O7frz.134553287
  Located on chromosome 10
  Distance between a terminus base of telomere on chromosomal short arm and 5'-terminus of this base sequence : 132188368
  Distance between 3'-terminus of neighbour sequence of sequence listing upward to telomere on chrosomal short arm and 5'-terminus of this base sequence : 146549
gacataactataccacttggaagactatttcatagaaataaaaacagcaacacaaagatatatatatatatatatatatatacacacatacatacatatatatacagatgcagatataggtaacatgtatagatatatgtatacacacatgtacacaaactgccataataatgtgtatgcatattgttcccattgtttttattatgggaataaaatataggaaataacctcaatgacttggcagaggaatattttaataaataatgatgcattcactgtatgaaatatt

SEQ ID NO: 16938 - DNA, 370 bp, Homo sapiens
  chr10.fa.O7frz.134689803
  Located on chromosome 10
  Distance between a terminus base of telomere on chromosomal short arm and 5'-terminus of this base sequence : 132344316
  Distance between 3'-terminus of neighbour sequence of sequence listing upward to telomere on chrosomal short arm and 5'-terminus of this base sequence : 155659
taattcctagtgttgactgagaatatactcttaaataaaatgatacagctgggaggttctcttttaaacacagttcagttgcagctggaacactgtatttcagtttaggttggctgaatcttcaaagtgtcataggctgccaaattcagctttggtgacggaactggtttcctagtggaaatggtttttggctatcattgctttaaactcacctctaaaaacgcgttgctttgggaaagaacttgcacatttatgctgcatggcttctgctgctgcctttgtgtgtgtgtgtgtgtgtgtgtgtgtgtgtgtgtgttttatttgtttttcagagaatcaagtctcacactgagttactaacctggtcatg

SEQ ID NO: 16939 - DNA, 329 bp, Homo sapiens
  chr10.fa.O7frz.135192259
  Located on chromosome 10
  Distance between a terminus base of telomere on chromosomal short arm and 5'-terminus of this base sequence : 132859403
  Distance between 3'-terminus of neighbour sequence of sequence listing upward to telomere on chrosomal short arm and 5'-terminus of this base sequence : 514717
gagtgaatggtagtgaatacagactttcttcatacatatatatacatacatatatatatatatatatatatgtccacacagaaacttgtacactaatattcatcacattagtctatatataatatacagttatatatattgttagatatatttatatatatataaaacattggtctatatatagagactatatatatagactatataaagactatatatagactatagagagactatatatatagagagactatatataaatatatatatatatagagagagggacagacagagtctcactctgttacctatactggattgagatggca

SEQ ID NO: 16940 - DNA, 132 bp, Homo sapiens
  DISD22_0000368
  Located on chromosome 10
  Distance between a terminus base of telomere on chromosomal short arm and 5'-terminus of this base sequence : 133129001
  Distance between 3'-terminus of neighbour sequence of sequence listing upward to telomere on chrosomal short arm and 5'-terminus of this base sequence : 269269
cttgtcttagagtggctgtctcttcattttactggttccatatatatatatatatatacatacatatatatatatgtatatatatatatgtatgtatatatatatatcattactataaattgcttccatagg

SEQ ID NO: 16941 - DNA, 234 bp, Homo sapiens
  AB045320.1_71836
  Located on chromosome 10
  Distance between a terminus base of telomere on chromosomal short arm and 5'-terminus of this base sequence : 133305519
  Distance between 3'-terminus of neighbour sequence of sequence listing upward to telomere on chrosomal short arm and 5'-terminus of this base sequence : 176386
ccgctaaacgacatctatacagagcctttctgctgacacgggccagcaagtggttaatatcaaaaagcagacatctgaagaggcactgacaccctcccactcacagaaggtaagacagtgtgtgtgtgtgtgtgtgtgtgtgtgtgtgtgtgtgtgtttcaacccaaagaaaggaagggctgagtgaaagccatgaatctggtcctgttattcttctcaatgagcttccaggag

SEQ ID NO: 16942 - DNA, 200 bp, Homo sapiens
  Z24180.1_70
  Located on chromosome 10
  Distance between a terminus base of telomere on chromosomal short arm and 5'-terminus of this base sequence : 133305519
  Distance between 3'-terminus of neighbour sequence of sequence listing upward to telomere on chrosomal short arm and 5'-terminus of this base sequence : -234
ccgctaaacgacatctatacagagcctttctgctgacacgggccagcaagtggttaatatcaaaaagcagacatctgaagaggcactgacaccctcccactcacagaaggtaagacagtgtgtgtgtgtgtgtgtgtgtgtgtgtgtgtgtgtgtgtttcaacccaaagaaaggaagggctgagtgaaagccatgaatct

SEQ ID NO: 16943 - DNA, 476 bp, Homo sapiens
  AL359386.2_16133
  Located on chromosome 10
  Distance between a terminus base of telomere on chromosomal short arm and 5'-terminus of this base sequence : 133347715
  Distance between 3'-terminus of neighbour sequence of sequence listing upward to telomere on chrosomal short arm and 5'-terminus of this base sequence : 41996
tcatcttgatttgctatttgagaattaatttttataatttcaaggggcttccttgcagagggaatgctgcttctctcaccaaacagacttctgtgctcatgagaccaggatggggcctaccccagccttgcctcaccccagacccgaagcctgctttatcagcattggtaggaatccagtaactaatccatctactcacatatccatccacccacatccatccatccatccatccatccatccaaccatccaaccatccaaccatctatcctccctccctccctcccacccttccacatatccacccatccacccaccaacccatccatccatccatccatctttacccatccatctgcacatccactcaccattccgcaatacttattgaatttctctgttgaatgctggttccccaaataacatcaacacaagctgttgataacacaaagctgtttattgctcactgtggtaag

SEQ ID NO: 16944 - DNA, 412 bp, Homo sapiens
  AL357127.5_111323
  Located on chromosome 10
  Distance between a terminus base of telomere on chromosomal short arm and 5'-terminus of this base sequence : 133486128
  Distance between 3'-terminus of neighbour sequence of sequence listing upward to telomere on chrosomal short arm and 5'-terminus of this base sequence : 137937
cgaatctgtacttggacgtgccagtctttccttagacttctggttggtagccctgtgacttcagctgtgatgggtcaggaaaaggtgtgagtttgcagactgcctgcatttgttgttgttgttgttgttgttgttttgttatgaggttaggaacaatggtcttcccagctctctgcatcccatgtggaaaccaggagtcctgcaggtgaaattttaagtatgtggacttttgaaccctggtttattattacacaaaattaaagagtattgccctctatctcagggtattcagaaaagaacaggtgagatctgctggaagattgctttgtcacttcatcattcactcagtttttattaaacctctttgagccaagggctgagtgaggtgctggagtgtgaatagtgaattaag

SEQ ID NO: 16945 - DNA, 368 bp, Homo sapiens
  AL357127.5_146630
  Located on chromosome 10
  Distance between a terminus base of telomere on chromosomal short arm and 5'-terminus of this base sequence : 133503631
  Distance between 3'-terminus of neighbour sequence of sequence listing upward to telomere on chrosomal short arm and 5'-terminus of this base sequence : 17091
tcattgtttattagccattcatatatcttctattatgagttgtctcttcaaatcttttgcatgttaaatttggggtgtgttttattattatttcgtaggtgtcctggaagcaagaattttgtcagatatataatcataaacattttctctcagtcagtggttgcttttttattttctttttttgtgtttttttctttctttctttcttttctttctttccttctttcttctttctttctttctttctttctttctttctttctttctttctttctttctttctttctttctttctttttctccccttccttccttccttccttcgacagaatctcactcttattgccgaagctggagtgcatttgtac

SEQ ID NO: 16946 - DNA, 112 bp, Homo sapiens
  D10S1213
  Located on chromosome 10
  Distance between a terminus base of telomere on chromosomal short arm and 5'-terminus of this base sequence : 133523632
  Distance between 3'-terminus of neighbour sequence of sequence listing upward to telomere on chrosomal short arm and 5'-terminus of this base sequence : 19633
agagagaaggaaagaaacaaaggaaggaaggaaggaaggaaggaaggaaggaaggaaggaaggaaggaagagaaagcagctggacaaatcccgccagtgggtttgtctgtag

SEQ ID NO: 16947 - DNA, 415 bp, Homo sapiens
  AC068058.5_79506
  Located on chromosome 10
  Distance between a terminus base of telomere on chromosomal short arm and 5'-terminus of this base sequence : 133688689
  Distance between 3'-terminus of neighbour sequence of sequence listing upward to telomere on chrosomal short arm and 5'-terminus of this base sequence : 164945
agtgtacaactagtttctggtgacatcaaaacaaatgcttaaaaccatcagtgggtttgtgagcaagtaaagaaactctccaattgggcaaacaaaaacaacaacaacaacaacaacaacaacaacaaccagctgttagctgaaaaaaagaatagtgagtaatgcacaaacacaaaagccagggtcgccccagggaaaatgcatctaacagtgccaggatcagagtactaagcctgaggaccatcgaaagctagggaagctgaacttgagacttttccaggactctcaaaagtggctaaaagatctcagcacagtggtatccactggttcctaacagaagcacacatgaatcccctcaaaagaaaagaatcttcaacataggctcttggaggtttcagcaggtacaattaagtaa

SEQ ID NO: 16948 - DNA, 415 bp, Homo sapiens; identical to SEQ ID NO: 16947
  AC009987.7_7721
  Located on chromosome 10
  Distance between a terminus base of telomere on chromosomal short arm and 5'-terminus of this base sequence : 133688689
  Distance between 3'-terminus of neighbour sequence of sequence listing upward to telomere on chrosomal short arm and 5'-terminus of this base sequence : -415

SEQ ID NO: 16949 - DNA, 213 bp, Homo sapiens
  D10S216
  Located on chromosome 10
  Distance between a terminus base of telomere on chromosomal short arm and 5'-terminus of this base sequence : 133711164
  Distance between 3'-terminus of neighbour sequence of sequence listing upward to telomere on chrosomal short arm and 5'-terminus of this base sequence : 22060
agctgctgggaataatatgcaaaaaaaaaatgaaaatgttatcttatgtctacaataagcatgggtgcacacaacacttgaaacatgagtatgcactcatctctctctctctctctctctgtgtgtgtgtgtgtgtgtgtgtgtgtgtgtgtgtgtctttctctctctctttctttgctggaactctaatcatgtagttaaatggctctgcca

SEQ ID NO: 16950 - DNA, 227 bp, Homo sapiens
  AC068058.5_143295
  Located on chromosome 10
  Distance between a terminus base of telomere on chromosomal short arm and 5'-terminus of this base sequence : 133761564
  Distance between 3'-terminus of neighbour sequence of sequence listing upward to telomere on chrosomal short arm and 5'-terminus of this base sequence : 50187
ctccgtttagccttcagttcatgcttcttcctcaccagaactgtgtactatgttgttccttctcctggagcacccttctcttcccttcccttcccttcccttcccttccctttacgctcaagctaattagctcctactgatcctgaacatctcagctctggcatcgcctccttaaactttcccgacctccccaccaaatcaaatccactttgatggaagttgatagc

SEQ ID NO: 16951 - DNA, 294 bp, Homo sapiens
  DISD22_0000374
  Located on chromosome 10
  Distance between a terminus base of telomere on chromosomal short arm and 5'-terminus of this base sequence : 133868267
  Distance between 3'-terminus of neighbour sequence of sequence listing upward to telomere on chrosomal short arm and 5'-terminus of this base sequence : 106476
gacagagcataagcaacggctggcggcaggaggacgagggcgtgtggaaggagtggccatcctgctgagctgcagctgggtacgggctgtgtatacgtgtttgtgtgtgtgtgtttgtgtgtgcatgtatatatgtttttgtgtgtgtatgagtatctgtgtgtgcgtatgtatatatgtatgtatgtgcaaatgtttgtgtatgcatgtgtgtttatacgtgcatgtatatgtgtgtgtgtgtgtgtgtgtgtgttgttgttgttgtgggggatggaagaggttgaaagcgga

SEQ ID NO: 16952 - DNA, 250 bp, Homo sapiens
  chr10.fa.O7frz.138319535
  Located on chromosome 10
  Distance between a terminus base of telomere on chromosomal short arm and 5'-terminus of this base sequence : 134024138
  Distance between 3'-terminus of neighbour sequence of sequence listing upward to telomere on chrosomal short arm and 5'-terminus of this base sequence : 155577
tttcaaagtctacgattgtatttcctgcttcctttttgaggggaagatgctgggtttatttaaaacacatgcaacatgttggacacacacacacacacacacacacacactgccttcaacctttcaccaccaaatatttagaaataaatttttactgtgttctctgaacatataattactgctttgaggctagttaatgaaaatatacttttctttgaaacatgttggctttactaaatgagcctgtcct

SEQ ID NO: 16953 - DNA, 171 bp, Homo sapiens
  DISD22_0001361
  Located on chromosome 10
  Distance between a terminus base of telomere on chromosomal short arm and 5'-terminus of this base sequence : 134243829
  Distance between 3'-terminus of neighbour sequence of sequence listing upward to telomere on chrosomal short arm and 5'-terminus of this base sequence : 219441
gatcatcattacctccatttctccattttatttttgtttcctttttattggcaccaccaaagtgtgtgtgtgtgtgtgtgtgtgtgtgtgtgtgtgtgtgtgtgtttttgagattaaaactttagggaaagaaacagctctcttaaaaatgtcagcaacttcaattcattg

SEQ ID NO: 16954 - DNA, 203 bp, Homo sapiens
  DISO7_00027529
  Located on chromosome 10
  Distance between a terminus base of telomere on chromosomal short arm and 5'-terminus of this base sequence : 134329998
  Distance between 3'-terminus of neighbour sequence of sequence listing upward to telomere on chrosomal short arm and 5'-terminus of this base sequence : 85998
gctatggcccagttctgtgttgggagtgtggctgcctgtgatggacttcaccctctgtggtggacttcactctctgtggtagatgtattcttggagaaatcaagcaaatcagagtgagtgcgcgcgcgcgcgcgtgtgtgtgtgtgtgtgtgaaccaaactaagtcatcttttcaatgtccccagaagttcacccaggagttg

SEQ ID NO: 16955 - DNA, 131 bp, Homo sapiens
  DISO7_10002984
  Located on chromosome 10
  Distance between a terminus base of telomere on chromosomal short arm and 5'-terminus of this base sequence : 134370636
  Distance between 3'-terminus of neighbour sequence of sequence listing upward to telomere on chrosomal short arm and 5'-terminus of this base sequence : 40435
cttctgtgtagaccagtggggagcaactctgtgtgtgtgagtgtatgtgtgtgtgtgtgtgtgtgtgtgtgtgtaggtcattcaggacaagttaaaacacttatgggtgtgtgtgtaggccattcaggaca

SEQ ID NO: 16956 - DNA, 101 bp, Homo sapiens
  DISD22_0001365
  Located on chromosome 10
  Distance between a terminus base of telomere on chromosomal short arm and 5'-terminus of this base sequence : 134451322
  Distance between 3'-terminus of neighbour sequence of sequence listing upward to telomere on chrosomal short arm and 5'-terminus of this base sequence : 80555
ttagatgaggcctcctgcagggatgagtgtgtggtggtgaccaggggtgtgtgtgtgtgtgtgtgtgtgtgtgttgggggagtgatcctggccatttcact

SEQ ID NO: 16957 - DNA, 153 bp, Homo sapiens
  DISD22_0001372
  Located on chromosome 10
  Distance between a terminus base of telomere on chromosomal short arm and 5'-terminus of this base sequence : 134695409
  Distance between 3'-terminus of neighbour sequence of sequence listing upward to telomere on chrosomal short arm and 5'-terminus of this base sequence : 243986
gagctaatactaaatctcctgcccacctttttagtgggttatgggtcttcctcattatacatacacacaaatacacacacacacacacacacacacacacacacacacacacacacctgcacgcacacaagctgcatgagatatactcaaaga

SEQ ID NO: 16958 - DNA, 113 bp, Homo sapiens
  DISD22_0001373
  Located on chromosome 10
  Distance between a terminus base of telomere on chromosomal short arm and 5'-terminus of this base sequence : 134799784
  Distance between 3'-terminus of neighbour sequence of sequence listing upward to telomere on chrosomal short arm and 5'-terminus of this base sequence : 104222
ttgtgacatacatttgccgaaaacttgcctggtagagttttgtgtgtgtgtgtgtgtgtgtgtgtgtgtgtgtgtgtgtgtgtgtgtgtgtcaagagtaaagcacttccattg

SEQ ID NO: 16959 - DNA, 262 bp, Homo sapiens
  chr10.fa.O7frz.139089433
  Located on chromosome 10
  Distance between a terminus base of telomere on chromosomal short arm and 5'-terminus of this base sequence : 134892441
  Distance between 3'-terminus of neighbour sequence of sequence listing upward to telomere on chrosomal short arm and 5'-terminus of this base sequence : 92544
cactttggaaactgcagtataggtcttattttatagggcaatgtttcccaaagtttgcgccagggactgcctgcatagaaaccacctagagtgaatgagtgagtgagagagagagagagagagagagagagagagagtgtgtgtgtgtgtgttggtggggaggacatgttaaaaatgcagatttctagacctctccttccttgggcctaggttgctcaggatctatggggataaagcctagaatttgtatctttcaccagct

SEQ ID NO: 16960 - DNA, 176 bp, Homo sapiens
  DISO7_10002987
  Located on chromosome 10
  Distance between a terminus base of telomere on chromosomal short arm and 5'-terminus of this base sequence : 134990210
  Distance between 3'-terminus of neighbour sequence of sequence listing upward to telomere on chrosomal short arm and 5'-terminus of this base sequence : 97507
tgtcatgacatggaactgctaaaagatacaaaggaaaacctaaaaatacatacatgcatacatacatacatacatacatacatacatacatttgattgcagcactaaaaaaagaaaagactgtctgaaatatgatccttaaatttaacaatttcatctgtgaattgaaggagacca

SEQ ID NO: 16961 - DNA, 134 bp, Homo sapiens
  DISO7_10002988
  Located on chromosome 10
  Distance between a terminus base of telomere on chromosomal short arm and 5'-terminus of this base sequence : 135033351
  Distance between 3'-terminus of neighbour sequence of sequence listing upward to telomere on chrosomal short arm and 5'-terminus of this base sequence : 42965
cattaagtaacaaacactgaagtgctttggtttggatcacagatgatatctctctctctctctgtctctgtctctctctctctctctctctctctctctctctctctcccccccccccagcaattcacaatgga

SEQ ID NO: 16962 - DNA, 349 bp, Homo sapiens
  chr10.fa.O7frz.139265535
  Located on chromosome 10
  Distance between a terminus base of telomere on chromosomal short arm and 5'-terminus of this base sequence : 135089210
  Distance between 3'-terminus of neighbour sequence of sequence listing upward to telomere on chrosomal short arm and 5'-terminus of this base sequence : 55725
tctgagccaatcaagacttaggttctgctggctctggatgcagcctcagaatcctcaatcacttacccaggcagacacagccagtgagccagaactggcacagaaagaactcaatctgttgccatcccgagtctagacaaggaggcagggaaagcctcgtactgactttgtttttatcccccttggggccacaggaaacggtctcaacactattcatttgcctgcctttgccttaagttctcacctgcattcaaataaataaataaataaataaataaataagccaaatcttcttatcaaaagcaaatagagcttgggaatgctctaatccaaatgtcctaatctttct

SEQ ID NO: 16963 - DNA, 107 bp, Homo sapiens
  DISD22_0001381
  Located on chromosome 10
  Distance between a terminus base of telomere on chromosomal short arm and 5'-terminus of this base sequence : 135210997
  Distance between 3'-terminus of neighbour sequence of sequence listing upward to telomere on chrosomal short arm and 5'-terminus of this base sequence : 121438
caagacctgagaaacagcccatgagccactcctggtacacacacacacacacacacacacacacacacacacaaacacacacacacccaggacatccaagtaactct

SEQ ID NO: 16964 - DNA, 155 bp, Homo sapiens
  D10S186
  Located on chromosome 10
  Distance between a terminus base of telomere on chromosomal short arm and 5'-terminus of this base sequence : 135363639
  Distance between 3'-terminus of neighbour sequence of sequence listing upward to telomere on chrosomal short arm and 5'-terminus of this base sequence : 152535
acaaacacaggcacacagacccccccaacacagacacacacacacacacacacacacacagacagacacagacacacacacacagacacacacacacacacagttctacacatgatttcaggtggggaggtctcccaccctgtcctcatagatgc

SEQ ID NO: 16965 - DNA, 447 bp, Homo sapiens
  AL359094.4_68185
  Located on chromosome 10
  Distance between a terminus base of telomere on chromosomal short arm and 5'-terminus of this base sequence : 135406638
  Distance between 3'-terminus of neighbour sequence of sequence listing upward to telomere on chrosomal short arm and 5'-terminus of this base sequence : 42844
ttcacttagaaatgaagacatgttgcccaggtgcagtggctcacatctgtaatcccagcactttgggaggctgaggcgtgaggttcacatgagcccaggaggttaagaccagcctgggcaacatggcgagtccctgtctctactaaaaattagctgtgcatggtggcgtgcacctgtagccccagcaacttgggaggctgtggtgggaggattgcttgagcctgggagttagaggctgcattgagctgtggttgtgctcctgcaccccagcctgtatgacagagtgagaccctgtctcaaaaataaataaataaataaataaataaataaataaataaataaaaaagagtagagtgctcaattcgtcatcctctcctgggatgactgctgccatttgtgctttggactaggcattctgctaagtgctttctacacgtcatgtcagtt

SEQ ID NO: 16966 - DNA, 374 bp, Homo sapiens
  chr10.fa.O7frz.139623738
  Located on chromosome 10
  Distance between a terminus base of telomere on chromosomal short arm and 5'-terminus of this base sequence : 135492298
  Distance between 3'-terminus of neighbour sequence of sequence listing upward to telomere on chrosomal short arm and 5'-terminus of this base sequence : 85213
gttgtccataggaagataggagattcctcttccttggctgccagagacagctgttcatgctttaagataggtcattgtagggtatatgtatatgtgtgtgtgtgtgtgtgtgtctatctgtccgtctgtctgtccatctgtctgtttttgtagtatacgttcctcagtgctcttgatttgctatcttaagacaaaattcaagagtcttactgttacttaaaacgtgtactcccaccacttcttgaaaaaacctatctgtagacagaaatatagagtaagagaagtcccttaaaaaatgaggttttaagaaatttatgtttttgcttttggggaaggcagctgagtggctactgtactggatagtgcagctgtaa

SEQ ID NO: 16967 - DNA, 263 bp, Homo sapiens
  D10S1782
  Located on chromosome 10
  Distance between a terminus base of telomere on chromosomal short arm and 5'-terminus of this base sequence : 135659604
  Distance between 3'-terminus of neighbour sequence of sequence listing upward to telomere on chrosomal short arm and 5'-terminus of this base sequence : 166932
acatgatgtcttgttgctttgtatgtatatataaaatatataataatttgtaatatacagcataatatagaatacatagtatatactatactatgtatatatttcacacacacacacacacacacacacacacacacataaaatagtttcagaataacaataccaattgttactttaaaagtttgttttctccttaggatatatcctgcagacatacacaatcaagtcatgtttctcaggcacttgagatgaatccttgcatg

SEQ ID NO: 16968 - DNA, 453 bp, Homo sapiens
  AL157711.4_58906
  Located on chromosome 10
  Distance between a terminus base of telomere on chromosomal short arm and 5'-terminus of this base sequence : 135752562
  Distance between 3'-terminus of neighbour sequence of sequence listing upward to telomere on chrosomal short arm and 5'-terminus of this base sequence : 92695
ctgacagcaagttagagattctacaattccttgttcaggactacaggactccaggatggtggagaacaatatcaagaaggaattttcctggtagaacagctaagagataggatgagacatacccctaattgtcttagtaaagagttagggaccagatcatgacttttcactctatcagttcacgttgagacctcctgctagtgctctctgcctgattcttctaaggagtgttgctcctagcacaagtctggcatgacaactgtctactcttagtggttcttttattactcagatagcttcagacattgactttctttgtttacagtgacgtatggatggatggatggatggatggatggatggatggatggacaaattgctatacagcctctagttttatatttcacaacctcagtaagttattagatgatcttgctcatgacatccttataa

SEQ ID NO: 16969 - DNA, 271 bp, Homo sapiens
  D10S1727
  Located on chromosome 10
  Distance between a terminus base of telomere on chromosomal short arm and 5'-terminus of this base sequence : 135899306
  Distance between 3'-terminus of neighbour sequence of sequence listing upward to telomere on chrosomal short arm and 5'-terminus of this base sequence : 146291
accaaatgtggcctgcttcccacatcagcagaaaaaattcctcctcctagtttctaatgcttatgacagtgaagcattatgaagtgtgtgtgtgtgtgtgtgtgtgtgtgtgtgtgatcaaccactttgctatggaaatagggagttagagaggtcctaggtccttattagagattgccagaatgtttggataaactgcaattttgtggatttagttgactttgaaaagtacatcacattttcaaagaactgtcagattgtcatcacatga

SEQ ID NO: 16970 - DNA, 374 bp, Homo sapiens
  AL355316.4_106114
  Located on chromosome 10
  Distance between a terminus base of telomere on chromosomal short arm and 5'-terminus of this base sequence : 135913244
  Distance between 3'-terminus of neighbour sequence of sequence listing upward to telomere on chrosomal short arm and 5'-terminus of this base sequence : 13667
caatgagtaaatggtagactgaacgcctcttgagctaaacattgtgattgattcacatggcataggttactttcaaaggcaggaggtgttcctgtgggcaggcccaggccttgaaaacttaattttattatttatttatttatttatttatttatttatttatttatttatttgtattttggtaggtctttggggaacaggtggtgtttggttacatgaataagttcttcagtggtgatttctgagattttggtgcacccatcacttaagcagtgtacagctgcttcctgtgcactcagtgtgtagtcttgtacccttcactttgtcccaaactttccctcaagtcctcaaagtccattgtatcattcttatgc

SEQ ID NO: 16971 - DNA, 197 bp, Homo sapiens
  chr10.fa.O7frz.140186992
  Located on chromosome 10
  Distance between a terminus base of telomere on chromosomal short arm and 5'-terminus of this base sequence : 136015758
  Distance between 3'-terminus of neighbour sequence of sequence listing upward to telomere on chrosomal short arm and 5'-terminus of this base sequence : 102140
acctatacagttggccttctagatctggatctgtatccatagataaaaccaaccatggattaaaaaaaactgtatatatatatatatatatagttttaaattacatccattctgaacacttacagaccttttcttataattattctctaaactatacagcataacaactacttacatagcacttacattaggcattg

SEQ ID NO: 16972 - DNA, 192 bp, Homo sapiens
  D10S217
  Located on chromosome 10
  Distance between a terminus base of telomere on chromosomal short arm and 5'-terminus of this base sequence : 136112899
  Distance between 3'-terminus of neighbour sequence of sequence listing upward to telomere on chrosomal short arm and 5'-terminus of this base sequence : 96944
ccaggtggctaggagggtgctctaaccccggggttctgagcccactgtggcactcagatcccatctgctcccctgccctgtcttgtgtgtgtgtgtgtgtgtgtgtgtgtgtgtgtttgaaatcgtgaatcctgcagacaattccaaaagtaactgtgaaacttcaatgaaaggaaaacctctgcatcgtgg

SEQ ID NO: 16973 - DNA, 212 bp, Homo sapiens
  chr10.fa.O7frz.140387890
  Located on chromosome 10
  Distance between a terminus base of telomere on chromosomal short arm and 5'-terminus of this base sequence : 136215393
  Distance between 3'-terminus of neighbour sequence of sequence listing upward to telomere on chrosomal short arm and 5'-terminus of this base sequence : 102302
atactgtctcacaagtgcagacacagcagcatgcccatgctgggttctcacctccgagtgagccacacatgtgcatggtacacgcacacacacacacacacacacacgggtaatggcagcgggtgctgatgcccagcagtgcagtcccccaaccagagcttctctggcaaggtgctgttccgctgggagctgtcttagtcctgaggcagctt

SEQ ID NO: 16974 - DNA, 258 bp, Homo sapiens
  AL158166.7_81813
  Located on chromosome 10
  Distance between a terminus base of telomere on chromosomal short arm and 5'-terminus of this base sequence : 136326138
  Distance between 3'-terminus of neighbour sequence of sequence listing upward to telomere on chrosomal short arm and 5'-terminus of this base sequence : 110533
caggaatgaaggtttaggtaactccagataaagaaccatgactatcatatgatgcagagaataaatacatgtgtacatacatacatacatacatacatacatacatacatatatacatacacacataaaatcatgaccagtgaggtgcttatcgaaggcaaagagaatacagaatgggtagtagaagacggcagtttatcaataccagctatgcccatgtaaccagttacagaaacagactgttatgagtatttcctc

SEQ ID NO: 16975 - DNA, 266 bp, Homo sapiens
  AL355529.5_107652
  Located on chromosome 10
  Distance between a terminus base of telomere on chromosomal short arm and 5'-terminus of this base sequence : 136504272
  Distance between 3'-terminus of neighbour sequence of sequence listing upward to telomere on chrosomal short arm and 5'-terminus of this base sequence : 177876
gtgcataacaggtcgtatgtactcaaaatattttgctggatgagacattctgtgaaaaactttgctacctcctctttctttctttctttcttttctttctttctttccttctttctttctctctctctctctctctctttccttctttctttctttctttctttctttctttctttctttctttctttctttctttctttctttcttctttctttttagctaaatgtgtttatctttatgtggctgtttggtaagtagcttccatg

SEQ ID NO: 16976 - DNA, 164 bp, Homo sapiens
  D10S1676
  Located on chromosome 10
  Distance between a terminus base of telomere on chromosomal short arm and 5'-terminus of this base sequence : 136578884
  Distance between 3'-terminus of neighbour sequence of sequence listing upward to telomere on chrosomal short arm and 5'-terminus of this base sequence : 74346
ccaccactcagaggtaaggatagtgcatatcacggcaactataccagttacttccacatactatacaatactagaaataaaaattacctcctggaatgcacacacacacacacacacacacacacacacactcatttatatgacaaagttgggatcatacaatt

SEQ ID NO: 16977 - DNA, 443 bp, Homo sapiens
  AL355529.5_10423
  Located on chromosome 10
  Distance between a terminus base of telomere on chromosomal short arm and 5'-terminus of this base sequence : 136621568
  Distance between 3'-terminus of neighbour sequence of sequence listing upward to telomere on chrosomal short arm and 5'-terminus of this base sequence : 42520
agtacttgtggtacaggttatcattcacatttccaaagtccattcccatcaggaatgagggtgcctatttcatagaaaccctgtgaacaatggtgctataattaaaatacaaccaaccaaccaaccaaccaaccaaccaaccaactaatcaacaacaaaaaatcttcacagatgtgacagatgtgtttattagaactgaagctccatgaagacagagatatttgtcttcttttggtttgttttttcatcaatatatccaagttacctaaaattagcacagagtaggtgccccacaaattcttgtagaatggaatccattttccaatgtgtcccttgtgtaggggaggaagcgcacatgcctcttgcctgatgcactgggatctggatcaagcctgccctttacaagtccttgttgaggtgtagttcagttaatgctttattgg

SEQ ID NO: 16978 - DNA, 393 bp, Homo sapiens
  AL358092.12_138892
  Located on chromosome 10
  Distance between a terminus base of telomere on chromosomal short arm and 5'-terminus of this base sequence : 136818154
  Distance between 3'-terminus of neighbour sequence of sequence listing upward to telomere on chrosomal short arm and 5'-terminus of this base sequence : 196143
agattagtcttgccagtgagtaatgcatcttataaaatttttcaaagaaccaatttttggctttgtttatcctctctattaaatcttccttccttccttctttccttccttccttccttccttccttccttccttccttccttccctccttctttctttttgtctcactctgtcacccaggctggagtgcagtggcacaatctcagacctatttctttaatttctgcccttacctttattatttacttccttatattttctatgagtttaacttgtgggtcttcaaaaaactttttagttaaaaactcagatggttaatatgtaggctcactttttttctaacgcattaagttaaagctatgaattttcctgtagtcataaccttagatgcat

SEQ ID NO: 16979 - DNA, 438 bp, Homo sapiens
  chr10.fa.O7frz.140971973
  Located on chromosome 10
  Distance between a terminus base of telomere on chromosomal short arm and 5'-terminus of this base sequence : 136850803
  Distance between 3'-terminus of neighbour sequence of sequence listing upward to telomere on chrosomal short arm and 5'-terminus of this base sequence : 32256
aggtggacttttcactacagactgggaggtctgagtacctgcttccatctggatcgccagggacttggtaggattctatctgcatgggcgaggcacgcacgtgtgtgtgtgtgtgtgtgtgtgtgtgtgtgtgtgtgtgtgaagtttggcatgcaaccctccagaattgggtgagattttggagtgcttggaaggcctggatctcccagcagcaggctctgcactcagggctttgctgttagcattgggagaacccagaaacaaagatgcttttgctgcagcacagggcgcacggtgtgtgctttgcttttagctgtgttatgtgtggacaggaggatcatcatggtctgcttaggcctttgaagttcttaatccagtcctggtgattgggaaatatttaatcaatccattgctgacaatctatagaagctgcagtta

SEQ ID NO: 16980 - DNA, 185 bp, Homo sapiens
  G10192
  Located on chromosome 10
  Distance between a terminus base of telomere on chromosomal short arm and 5'-terminus of this base sequence : 137165791
  Distance between 3'-terminus of neighbour sequence of sequence listing upward to telomere on chrosomal short arm and 5'-terminus of this base sequence : 314550
tcaggtcaggggacttaacagtagctgcaactcagacaacgtcagtgacataaacaaacaatcaaaggatagatgaaagaatgaaaggatggatggatggatggatggatggatggatggatggatgaaaggatggctggctagctgctgggcccagcaaagtgccaggcagagggagatcttta

SEQ ID NO: 16981 - DNA, 395 bp, Homo sapiens
  chr10.fa.O7frz.141270389
  Located on chromosome 10
  Distance between a terminus base of telomere on chromosomal short arm and 5'-terminus of this base sequence : 137165824
  Distance between 3'-terminus of neighbour sequence of sequence listing upward to telomere on chrosomal short arm and 5'-terminus of this base sequence : -152
agacaacgtcagtgacataaacaaacaatcaaaggatagatgaaagaatgaaaggatggatggatggatggatggatggatggatggatggatgaaaggatggctggctagctgctgggcccagcaaagtgccaggcagagggagatctttaaatatttgtccactggtgaataatgtgccataacattttatctgttgttaaaaaagtgatatggctaagattgcttctatatattttttcatatgtgagtgcatccttcttcaggagatcccataggatgaaaaatcttacaaacgtgtactttccaagtgttattgttttacgaaaggactcaccattggcaattcattctctaactctcaaatctgttggaagcgtagtcaatttatgaca

SEQ ID NO: 16982 - DNA, 337 bp, Homo sapiens
  AL355537.11_129308
  Located on chromosome 10
  Distance between a terminus base of telomere on chromosomal short arm and 5'-terminus of this base sequence : 137294428
  Distance between 3'-terminus of neighbour sequence of sequence listing upward to telomere on chrosomal short arm and 5'-terminus of this base sequence : 128209
gctgattcctttagtcagtttcaatcaagaaacctgagcctaaggaagaaggaaagtcccccatacccccaaccaggagcaaatagtagcctggggcccagtggtcacagacagcaaaggatgtaggggtagcagcatctttgatgatggctgggcagtgctacatggagctggctggttagcttggttcctgaaaattggagcctatttatcatctatctatctatctatctatctatctatctatctatctatctatctatcactaactagctatcttatctatgcagtcctcctttcactctctctctttctctatctttgcttctatctcctt

SEQ ID NO: 16983 - DNA, 350 bp, Homo sapiens
  AL355537.11_29237
  Located on chromosome 10
  Distance between a terminus base of telomere on chromosomal short arm and 5'-terminus of this base sequence : 137394529
  Distance between 3'-terminus of neighbour sequence of sequence listing upward to telomere on chrosomal short arm and 5'-terminus of this base sequence : 99764
acatacacttcacagacgcataaagaaggaaacaaaacaaagattaaaataaaagacaaataaaataagtatatatagctgttccttaaatgaactaaaccaagggcattctaaatatttatatgttaaataaaatccattttctaaatagaaaagaaactgataatcttaccttgttgttaacagcaaaataggtgtgtgtgtgtgtgtgtgtgtgtgtgtgtgtgtgtgtgttttcatatttcagtttgtttctgccgacatggcttttaaggaaatatactgatgcagaaaatgaaagaagaatttcaaggcgtatatgaaaggacctgtcctgaagctattaaatt

SEQ ID NO: 16984 - DNA, 420 bp, Homo sapiens
  AL355537.11_16103
  Located on chromosome 10
  Distance between a terminus base of telomere on chromosomal short arm and 5'-terminus of this base sequence : 137407651
  Distance between 3'-terminus of neighbour sequence of sequence listing upward to telomere on chrosomal short arm and 5'-terminus of this base sequence : 12772
ctctagccagacttgctgtactcgccaagtcacgccccagcccctacagtgtgcagggctctgcggaaggaaacacgtaagagtcctgcactcataagcttgtggtttgcttgggagacgtgtgagcctaaagttaactatctctattatatttattttacatgtagataatatttatatgcatggaatattttcttacattatgtatgtgtgtatatacacaagtgtgtgtgtgtgtgtgtgtgtatatatatatatatatatagaaagagagaggtagggatggaataggcatggatgtggaacgtgtgtatggcagtagtggtgggaagtaggagcaggtcaggacgctcagggcacacggatctgaccacacatggatcacccagcagtgacacagatactcaggtgatcaaaccg

SEQ ID NO: 16985 - DNA, 248 bp, Homo sapiens
  D10S1655
  Located on chromosome 10
  Distance between a terminus base of telomere on chromosomal short arm and 5'-terminus of this base sequence : 137528587
  Distance between 3'-terminus of neighbour sequence of sequence listing upward to telomere on chrosomal short arm and 5'-terminus of this base sequence : 120516
tgccagactccatgatggtatgaaccaattccttatgataaacctctttctgtgtgtgtacacacacacacacacacacacacacacatcctattggttctgtctctctggagaacattgactaatgttctaacattgactaatacatttactaaatgtaagaaagtagggtttgtcttttttgcttactactttaccaccagtacctaaagcagtgcttggttggggctgtgctcagatgtttgtta

SEQ ID NO: 16986 - DNA, 243 bp, Homo sapiens
  D10S1248
  Located on chromosome 10
  Distance between a terminus base of telomere on chromosomal short arm and 5'-terminus of this base sequence : 137665113
  Distance between 3'-terminus of neighbour sequence of sequence listing upward to telomere on chrosomal short arm and 5'-terminus of this base sequence : 136278
accaatctggtcacaaacatattaatgaattgaacaaatgagtgagtggaaggaaggaaggaaggaaggaaggaaggaaggaaggaaggaaggaaggaaatgaagacaatacaaccagagttgttcctttaataacaagacaagggaaaaagagaactgtcagaataagtgttaattataatatccaggggtgggatacagaggttttagcatctgctctttgccaagcactgcacttattcc

SEQ ID NO: 16987 - DNA, 384 bp, Homo sapiens
  chr10.fa.O7frz.141788062
  Located on chromosome 10
  Distance between a terminus base of telomere on chromosomal short arm and 5'-terminus of this base sequence : 137676772
  Distance between 3'-terminus of neighbour sequence of sequence listing upward to telomere on chrosomal short arm and 5'-terminus of this base sequence : 11416
gtttagtttcaaacatgatacgacagttgtatttttaagtctcagtaacttatggttttgatagacttgaataaaatactaattgctatgacaaagtgtactaattcgaagagagaatcaaaacattaatttttaccaatccccagcaatacgtaattctaaaaagaaacacacacacacacacacacacacacacacacacacacacacacacacgagatagatcaattcaaaagggacctccaacgcatgtattttctgaaagaacagatctagtcataaaatatcctccaccacaaatgtgagccaaacccatgtttcatttattttgaatatttgaatgctccaacgtttggctcatcatcaagcctctcagaaatactt

SEQ ID NO: 16988 - DNA, 321 bp, Homo sapiens
  chr10.fa.O7frz.141970278
  Located on chromosome 10
  Distance between a terminus base of telomere on chromosomal short arm and 5'-terminus of this base sequence : 137858773
  Distance between 3'-terminus of neighbour sequence of sequence listing upward to telomere on chrosomal short arm and 5'-terminus of this base sequence : 181617
aagttggatcctagacattgagagactgtgtgtgtgtatatatataccatataggggtgtgtgtgtgtgtgtgtgtgtgtatatatatacacacacaaacacacataggtgtatacgcaggtatacacacacacacacacataggtatacacacacacacacacacacacacacacacacacacatgaatatacctatatggttagtagtgggaagccaagctgtttctcactgtcagatggttaagttttgaaattttctctcattctactcaagggtagaatgattggagtgtcagtgttcaatgctacaggacaataa

SEQ ID NO: 16989 - DNA, 398 bp, Homo sapiens
  chr10.fa.O7frz.142274788
  Located on chromosome 10
  Distance between a terminus base of telomere on chromosomal short arm and 5'-terminus of this base sequence : 138028459
  Distance between 3'-terminus of neighbour sequence of sequence listing upward to telomere on chrosomal short arm and 5'-terminus of this base sequence : 169365
gtcttggagaattctaaagcagggaggagggatggggtgagttttaaatgtggtgactgctgaagaaatggcctctgacagcctggaggaggagctggagctgggggggggacaggctggccagctcctccaacacacacacacacacacacacacacacacacgcacacacacacacacacacaccccctctcccccaaggacccacaaggactgcggcctcttagcgtgtgtggagtcatcacactgacccttagcagtgtggcctgacttcatgaggcccccgttgtcatggagatgctgggaatgggaggatttgccaccctccagtgaggagcccccatcccatgagtgcaaagcctgaaccggcccttccctaattggcacctctatcctat

SEQ ID NO: 16990 - DNA, 143 bp, Homo sapiens
  DISO7_10002991
  Located on chromosome 10
  Distance between a terminus base of telomere on chromosomal short arm and 5'-terminus of this base sequence : 138412640
  Distance between 3'-terminus of neighbour sequence of sequence listing upward to telomere on chrosomal short arm and 5'-terminus of this base sequence : 383783
ctgatgaaatgtgtccataggaaacactttcaggacaaattaagtgaaaaaaacttgtaggacttttatgtataattttaataagctctgcacacacacacacacacacatgcatgtacacacatgcacccatgtgcatactc

SEQ ID NO: 16991 - DNA, 366 bp, Homo sapiens
  AL139408.4_17626
  Located on chromosome 10
  Distance between a terminus base of telomere on chromosomal short arm and 5'-terminus of this base sequence : 138470309
  Distance between 3'-terminus of neighbour sequence of sequence listing upward to telomere on chrosomal short arm and 5'-terminus of this base sequence : 57526
atcagctggttatttactaggttctcacggcaaagatcttactcagcagatgagctataaaatctgcaaccaatggggtaaaacaaagatatttaactctgaatcttcttcttttatttttatttatttatttatttatttatttatttatttatttattttgagacacagtctcactctgtcgcccaggctagagtgcagaggcatgatctcggctcagtgcaacctctgcctcgtgggtttaagtgattctcctgcctcagcctcctgcatagctggggactacagccgtgtgacaccatttttgtattttttggtggagacggggtttcaccatgttgcccaggttggtcttgaactcctgac

SEQ ID NO: 16992 - DNA, 447 bp, Homo sapiens
  AL157712.8_122181
  Located on chromosome 10
  Distance between a terminus base of telomere on chromosomal short arm and 5'-terminus of this base sequence : 138703772
  Distance between 3'-terminus of neighbour sequence of sequence listing upward to telomere on chrosomal short arm and 5'-terminus of this base sequence : 233097
atcaaaagcagttgtactagtcagggtactccagagaaacaggaccaatgggatgtctctgtctttctgtctatctatctattatctatctatctatctatctatctgtcatctatctatcatctatctttagctatgtacctacctacctacctatcatctatctacctacccacctattatctatctatatctatcatctatcatctgtctattatctatcatctatttatatctatctattatctatcatctccctgtctattaactatatcatctatctatatctctctattatctctctattatctatctatctatctatctatctatctatctatctatctatcatctagctatctatcatctatctattatctatctatctatctatctatctatctatctatctatctatctatccatcttaaggaattggctcatcag

SEQ ID NO: 16993 - DNA, 277 bp, Homo sapiens
  D10S1201
  Located on chromosome 10
  Distance between a terminus base of telomere on chromosomal short arm and 5'-terminus of this base sequence : 138789170
  Distance between 3'-terminus of neighbour sequence of sequence listing upward to telomere on chrosomal short arm and 5'-terminus of this base sequence : 84951
tagcactgattgatgccgagccttttctgtatcaaagaagattggaatgcacagcgttggttcacaaggtgactcccagcaaggctggtcagcctggcctctgggaagtggaccaacactggtttgtttttctttttgtaattgccttttgggagccatggggacattgacagtcactgtcaattttcctagggcaggaatttgtggcacgttgcagcagattcctctctctctctctgtgtgtgtgtgtgtgtgtgcgtgtgtacgcatggtggga

SEQ ID NO: 16994 - DNA, 313 bp, Homo sapiens
  chr10.fa.O7frz.143284978
  Located on chromosome 10
  Distance between a terminus base of telomere on chromosomal short arm and 5'-terminus of this base sequence : 138909727
  Distance between 3'-terminus of neighbour sequence of sequence listing upward to telomere on chrosomal short arm and 5'-terminus of this base sequence : 120280
catagccattactagcattgagggcttcaaaaattattttatttgaacattattttcctatgggaatgtgtgtgtgtgtgtgtgtgtgtgtgtgcacctgtgcatacatgcttgtgtatgaatgcatgtacatattatcagaatgaataattttttgcttattatatttttaaaaatgtaagttaagcatgaaaaatgtaatgaaatacctgaataagagtaacattttattgcctcttgtgttccaaatttattgatttttgacttgcattatttggcacatgtaccactgtttaaatgacacctatgtgat

SEQ ID NO: 16995 - DNA, 452 bp, Homo sapiens
  chr10.fa.O7frz.143506691
  Located on chromosome 10
  Distance between a terminus base of telomere on chromosomal short arm and 5'-terminus of this base sequence : 139112199
  Distance between 3'-terminus of neighbour sequence of sequence listing upward to telomere on chrosomal short arm and 5'-terminus of this base sequence : 202159
caaacgcagtttggtagagggccaacgagagcagggagatttcactgcacggggcgccagtaccatgggctgcctttagctgaaaggagtcattgctgacaaagcaaatgtgtgtgtgtgtgtgtgtgtgtgtgtgtgtaagacagagagcacatgggtgagggtgtgtgtgtaaaagtatcaaagatttttaatttggggggtggtgtggggaccacagacgtctttaaaattcggttaatactgtggatattcttccagaaaacatgcacatgcacccagaggaaaagagttttgtgttgggctttgatgttttcaccatcaggccgagaacttcagacccacgataacacgtagagagcttccattggttctcaaagtgcagcagacacgaggcagcaagcagagcttcaggaagggctgtggagatgtttcatggaaacctaggatag

SEQ ID NO: 16996 - DNA, 206 bp, Homo sapiens
  D10S1770
  Located on chromosome 10
  Distance between a terminus base of telomere on chromosomal short arm and 5'-terminus of this base sequence : 139280688
  Distance between 3'-terminus of neighbour sequence of sequence listing upward to telomere on chrosomal short arm and 5'-terminus of this base sequence : 168037
aacaggctgtggcctctccaggaagtctcttcttcctccctgtgcttgtttgtgtgtgtgtgtgtgtgtgtgtgtgtgtgtgtgtgtgtgagagagagagagagagagagagaggatggatggatggatggatgggtggatggatggatggatggatgaagggatagtgatatagtttagatattcatccccactcaaatctcatg

SEQ ID NO: 16997 - DNA, 196 bp, Homo sapiens
  D10S1651
  Located on chromosome 10
  Distance between a terminus base of telomere on chromosomal short arm and 5'-terminus of this base sequence : 139287487
  Distance between 3'-terminus of neighbour sequence of sequence listing upward to telomere on chrosomal short arm and 5'-terminus of this base sequence : 6593
tcgatttgacgcaagtttttcatcacacacacacacacacacacatacacacacacacacacacacacacacacgttttgtttatgaaaaaagaagaatgccaaacaatgagcagacccgaatataccagaggaacgtgagaggcagaatcaggagagacctcattattccaatggttcgagaagtcctgggtgct

SEQ ID NO: 16998 - DNA, 202 bp, Homo sapiens
  chr10.fa.O7frz.143878994
  Located on chromosome 10
  Distance between a terminus base of telomere on chromosomal short arm and 5'-terminus of this base sequence : 139472695
  Distance between 3'-terminus of neighbour sequence of sequence listing upward to telomere on chrosomal short arm and 5'-terminus of this base sequence : 185012
ctttcatagttgtgcgatagatacagctactagctccctctcctaagagtcctgggttgatgtgccggtgagacataagctgaaatttggctaagacagcgaaaaaacatttgccattcacagttcctaaagtctgacacacacacacacacacacacatacacacacacacgctccaaactgaccacaaagtcaatacaat

SEQ ID NO: 16999 - DNA, 436 bp, Homo sapiens
  chr10.fa.O7frz.143993077
  Located on chromosome 10
  Distance between a terminus base of telomere on chromosomal short arm and 5'-terminus of this base sequence : 139702622
  Distance between 3'-terminus of neighbour sequence of sequence listing upward to telomere on chrosomal short arm and 5'-terminus of this base sequence : 229725
gaggtcaggagttcgagaccagcctggccaacatggtgaaaccctgtctctactaaaaatacaaaaattacctgggcatgggggtgtgcacctgtaatcgtagctacaggggagactgaggcaggagaatcacttgaacccaggaggcagaggttgcaatgagccgagaccgcaccactgcactctcagcctgggcgacagatcgagactccatctcaagaaaaagaaagagagaaagacaaagaaggaaggaagggaaggaagggagggaggaagagaaagaaggaaggaaggaaggaaggaaggaaggaaggaaggaaggaaggaaggaaggaaggaaagaaagaaagaaagaaagaaagaaagaaagaaagaaagaaagaaagaaagaaaagaaagaaagaaaaaaaaaaagttctgtgagtaagtggaacag

SEQ ID NO: 17000 - DNA, 308 bp, Homo sapiens
  chr10.fa.O7frz.144071581
  Located on chromosome 10
  Distance between a terminus base of telomere on chromosomal short arm and 5'-terminus of this base sequence : 139868644
  Distance between 3'-terminus of neighbour sequence of sequence listing upward to telomere on chrosomal short arm and 5'-terminus of this base sequence : 165586
ttgtctgataaaggctgttattactgttatttttgttatcagtgtgttactgtagcatatctggaaaatactgcggagcattatgagtcagaacccctcagggagaagcagtgctaacctttcggtgacctctgtacaatcattttttctcctcacttctctctctctctaacgtgtatacgtgtgtatgtgtgtgtgtgtgtgtgtgtagtatgaataatatattgcatcttgtaatacagtattacattttatattaaattgcattttctaataaatagctttaatgcagcctgtactatatgtaa

SEQ ID NO: 17001 - DNA, 245 bp, Homo sapiens
  D10S590
  Located on chromosome 10
  Distance between a terminus base of telomere on chromosomal short arm and 5'-terminus of this base sequence : 140106942
  Distance between 3'-terminus of neighbour sequence of sequence listing upward to telomere on chrosomal short arm and 5'-terminus of this base sequence : 237990
gcacagtctgctgcatctctgtgtttctctaaagaaggaatggttctgctctgtttgctgctggctgtgtgtgtgtgtgtgtgtgtgtgtgtgtgtgtctgtccccgagtttctgtatttgctgatgctggattctgagattcatcccaaatgagcctcatctgcccctgggcaacaagtttaattggagagaggtcacacccacccacttcacattgtcaaccactaggtgtggcagagaccac

SEQ ID NO: 17002 - DNA, 250 bp, Homo sapiens
  DID22N_0004942
  Located on chromosome 10
  Distance between a terminus base of telomere on chromosomal short arm and 5'-terminus of this base sequence : 140484940
  Distance between 3'-terminus of neighbour sequence of sequence listing upward to telomere on chrosomal short arm and 5'-terminus of this base sequence : 377753
caaagtgacaggaacactgacaatataaaagagcacaggaaggccgggcacgtgactcacacctgtaatcctaaccctctgggaggctgaggcaggcagatcacttgagactaggagttcgaggcttgcagtcagctatgatcgcgccactgcactccagcctaggcaacagagcgagacctgtttcttcacacacacacacacacacacacacacacacacacacacgaggaagcaatctagaatgtcc

SEQ ID NO: 17003 - DNA, 307 bp, Homo sapiens
  chr10.fa.O7frz.144411295
  Located on chromosome 10
  Distance between a terminus base of telomere on chromosomal short arm and 5'-terminus of this base sequence : 140590043
  Distance between 3'-terminus of neighbour sequence of sequence listing upward to telomere on chrosomal short arm and 5'-terminus of this base sequence : 104853
tagaattttaatgcatttgcaggtgattcagaacctaagcttcctatcacagagattgcccttccttccttccttccttttattttcttcccttccccttccccttccccttccccttcccctttccttccccttcccctttccctttcccatcccctttccctttccttccttttctccccttccccttccccttccccttcccctccttccttttttttttctttcttctttttcttttctctttctttttttgagacaaggtcttcctctgttgtccaggtgggagtgcagtgacatgatcaca

SEQ ID NO: 17004 - DNA, 246 bp, Homo sapiens
  HUMUT7993
  Located on chromosome 10
  Distance between a terminus base of telomere on chromosomal short arm and 5'-terminus of this base sequence : 140696245
  Distance between 3'-terminus of neighbour sequence of sequence listing upward to telomere on chrosomal short arm and 5'-terminus of this base sequence : 105895
caatggagatgtgctcccatggagtctctggcactagtcagagagggagagagtttagggactgaaaaactcaccactgtcatcaccatcaccatcaccaccatcatcgccatcaccaccaccatcaccactgcaaccatcatcactctcatcaccgtcatcactataatcaacacaatcactattgtcaccaccattaccaccaccaccacgaccacaatcactgttatcaccatcaccaccacc

SEQ ID NO: 17005 - DNA, 163 bp, Homo sapiens
  DISD22_0001397
  Located on chromosome 10
  Distance between a terminus base of telomere on chromosomal short arm and 5'-terminus of this base sequence : 140825311
  Distance between 3'-terminus of neighbour sequence of sequence listing upward to telomere on chrosomal short arm and 5'-terminus of this base sequence : 128820
aactacattctgtgatcatggcactgcactccatgatcatgccactgcactccatcctggacaacagagcaagacctatctttaaacacacacacgtgatcctcgtggacacacacacacacacacacacacacacacacacaggtgcatagacagagtgacc

SEQ ID NO: 17006 - DNA, 146 bp, Homo sapiens
  DISD22_0001403
  Located on chromosome 10
  Distance between a terminus base of telomere on chromosomal short arm and 5'-terminus of this base sequence : 141100996
  Distance between 3'-terminus of neighbour sequence of sequence listing upward to telomere on chrosomal short arm and 5'-terminus of this base sequence : 275522
gatgcctgctctactggggtgcaggagtcccctcagcactccgggaggagacagacggggcaggcacacacacacacacacacacacacacacacacacacacctgcatgtgtgcacagacttttgctcacatacacatccgtatg

SEQ ID NO: 17007 - DNA, 227 bp, Homo sapiens
  Z16862.1_113
  Located on chromosome 10
  Distance between a terminus base of telomere on chromosomal short arm and 5'-terminus of this base sequence : 141230923
  Distance between 3'-terminus of neighbour sequence of sequence listing upward to telomere on chrosomal short arm and 5'-terminus of this base sequence : 129781
aatcttgaaatcacataggtttctatatggcatgtattccatctgtgtacgttgaaaatcccagttggaaatattatttcaaaaaaatgctttattggataaacaaaatgtgtgtgtgtgtgtgtgtgtgtgtattttctataccacacacatatatgcaatgtaatattcggccataaaaagaatgaaatcgtcttttgcagcaacgtggatagaacttgctttac

SEQ ID NO: 17008 - DNA, 189 bp, Homo sapiens
  D10S212
  Located on chromosome 10
  Distance between a terminus base of telomere on chromosomal short arm and 5'-terminus of this base sequence : 141230964
  Distance between 3'-terminus of neighbour sequence of sequence listing upward to telomere on chrosomal short arm and 5'-terminus of this base sequence : -186
tctgtgtacgttgaaaatcccagttggaaatattatttcaaaaaaatgctttattggataaacaaaatgtgtgtgtgtgtgtgtgtgtgtgtattttctataccacacacatatatgcaatgtaatattcggccataaaaagaatgaaatcgtcttttgcagcaacgtggatagaacttgctttacttc

SEQ ID NO: 17009 - DNA, 188 bp, Homo sapiens
  chr10.fa.O7frz.144912761
  Located on chromosome 10
  Distance between a terminus base of telomere on chromosomal short arm and 5'-terminus of this base sequence : 141430447
  Distance between 3'-terminus of neighbour sequence of sequence listing upward to telomere on chrosomal short arm and 5'-terminus of this base sequence : 199294
tatttaactccactgtggtcagagaacctactgtgggtaatttggaccctttcatatttttgaggcttgttttatggctcaacttagggtatatcttgtcaaatgttctgtgtgtgtgtgtgtgtgtgtgtgtgtaaagtgtacattcttctgccgtggggggaatgttacatcaatgtccgttactg

SEQ ID NO: 17010 - DNA, 178 bp, Homo sapiens
  D10S1711
  Located on chromosome 10
  Distance between a terminus base of telomere on chromosomal short arm and 5'-terminus of this base sequence : 141691871
  Distance between 3'-terminus of neighbour sequence of sequence listing upward to telomere on chrosomal short arm and 5'-terminus of this base sequence : 261236
atgctaccatgcctggctacttgtgtgtgtgtgtgtgtgtgtgtgtgtgtgtgtgtggagaccgactctcactatgttgcccaggctggtctcgaactcttggcctcagcaaacctcctgcctaggcctcccaaagcactaggattacaggtgtgagccactgccctcagcatcatag

SEQ ID NO: 17011 - DNA, 380 bp, Homo sapiens
  AL161645.5_161845
  Located on chromosome 10
  Distance between a terminus base of telomere on chromosomal short arm and 5'-terminus of this base sequence : 141962588
  Distance between 3'-terminus of neighbour sequence of sequence listing upward to telomere on chrosomal short arm and 5'-terminus of this base sequence : 270539
agttcagtgtatactgctcaggagatgcgtgtacctcaaatttcacaaatcaccactaaagattggttgatatttatgatcaactagtttgacgttgggaagaagctacagaaccaaagggatagcctataattactactggttttctttctctccctttctttctttctttctttctttctttcttttctttctttctttctttctttctttctttctttctttctttctttcttttctttctttctttctttctttctctttctttctttctttccttttctttccctttctctctctttttttcttttgtttctttctttctttttctttctttctttctctttttttgagacggagtcttgttctttcaccaagct

SEQ ID NO: 17012 - DNA, 461 bp, Homo sapiens
  AF015416.1_50210
  Located on chromosome 11
  Distance between a terminus base of telomere on chromosomal short arm and 5'-terminus of this base sequence : 204960
  Distance between 3'-terminus of neighbour sequence of sequence listing upward to telomere on chrosomal short arm and 5'-terminus of this base sequence : 0
agcatagacgaaatttccttagtcttatctgtaataaacaaacagggctgggcaaggaggctcacacctgtaattccagcactttgggaagccgaggcaggcagatcacctgaggtcaggagttcaagaccagcctgaccaacatggagaaaccctgtctctactaaaaattcaaaattagccggacctggtggtgcatgcctgtaatcccagctacttgggaggctgcggcaagagaattgtttgaatccaggaggtggaggttgcggtgagccgagatcacaccattgcactccagcctgggcaacaagagcaaaactccatctcaaataataataataataataaagaaaaataaataaataaggtctgaagcaaacatcacagtaaaagctgaaatattgaaagcctttcatcttagaatgagaatgaagcaagaatatctactgtcaccaattcaa

SEQ ID NO: 17013 - DNA, 193 bp, Homo sapiens
  D11S4046
  Located on chromosome 11
  Distance between a terminus base of telomere on chromosomal short arm and 5'-terminus of this base sequence : 532450
  Distance between 3'-terminus of neighbour sequence of sequence listing upward to telomere on chrosomal short arm and 5'-terminus of this base sequence : 327029
  misc_feature (1)...(193): n = A,T,G or C
tgatagacacacccattgccccaaaatttttctcgtgccctgtgtggctccccatcccatcctggatttcccagtctcaagcaagcaatgtcctggtcggtttctgcttttnngtatgtgtgtgtgtgtgtgtgtgtgtgtgtgtgtgtgtgtgtgttttgagacggtctcactctgtttcccaggctggagt

SEQ ID NO: 17014 - DNA, 289 bp, Homo sapiens
  DISD22_0001441
  Located on chromosome 11
  Distance between a terminus base of telomere on chromosomal short arm and 5'-terminus of this base sequence : 612186
  Distance between 3'-terminus of neighbour sequence of sequence listing upward to telomere on chrosomal short arm and 5'-terminus of this base sequence : 79543
ctcacagggtcaacatgcgtgtggggctggaacctggaccctccctcccctccttgagctgcagccccctcatctgaacactgggggtttgggtccgttctgggagtgcagctgcctctcccagcctgccagggagtggggcattgatgctgtgtgcgcgtgcgtgtgtgtgtgtgtgtgtgtgtgtgtgtgtgtgtgtgtgtgtgtgtgtctggagtcatggcagggtccctttctgtctgtctccttgctctgccccagactggggggctgcagaggtgagggtatc

SEQ ID NO: 17015 - DNA, 350 bp, Homo sapiens
  chr11.fa.O7frz.305873
  Located on chromosome 11
  Distance between a terminus base of telomere on chromosomal short arm and 5'-terminus of this base sequence : 1157614
  Distance between 3'-terminus of neighbour sequence of sequence listing upward to telomere on chrosomal short arm and 5'-terminus of this base sequence : 545139
caacctagaattctataggcaacaaaaatatccttcaaaaataaaagcaaagaccatttcagaccagccaggctgttgcaggaaacactcaagggagatttttgtgctgaaaaaaaattgtcccagatagaatgcggaacttcaaaacagaatacagtgtcctggaaaggctgagtaagtatgcaagtcactacatggaaaaagagaaagagaaagagagagagagagagagagagactgcgtatttaaaacaaagagattacagatgtttataacatatatagaggtaaaatataaaatgacaatagcacaaagggcaggaggaggtagacatggttaaattcctgtaa

SEQ ID NO: 17016 - DNA, 184 bp, Homo sapiens
  D11S4177
  Located on chromosome 11
  Distance between a terminus base of telomere on chromosomal short arm and 5'-terminus of this base sequence : 1500608
  Distance between 3'-terminus of neighbour sequence of sequence listing upward to telomere on chrosomal short arm and 5'-terminus of this base sequence : 342644
tgtcagcacagaggcagagttgggacccacagaaggagttcccaggccttgctgggacggaggaagtgtacccagctggattttggatttcttgggagcagcgacacaagcaccttgcagctttctctgtgtgtcacgtgtgtgtgtgtgtgtatgcacatataaatgactgggtttcaccgtc

SEQ ID NO: 17017 - DNA, 190 bp, Homo sapiens
  DISO7_10245116
  Located on chromosome 11
  Distance between a terminus base of telomere on chromosomal short arm and 5'-terminus of this base sequence : 1517299
  Distance between 3'-terminus of neighbour sequence of sequence listing upward to telomere on chrosomal short arm and 5'-terminus of this base sequence : 16507
tctgagagtgagtcaggtggggtgtgtgtgtgtgcacatctgcctgtgcaggggtatgtgtgtgcacgtctgcctgtgcaggggtgtgtgtgtgtgtttggctgtgcaagggtgtgtgtttgcctgtgctggtgtgtgtgtgtgtgtgtgtgtggctgtgctggggtgtgtgtgcatatctgcctgtaca

SEQ ID NO: 17018 - DNA, 467 bp, Homo sapiens
  AC016765.2_68257
  Located on chromosome 11
  Distance between a terminus base of telomere on chromosomal short arm and 5'-terminus of this base sequence : 1680053
  Distance between 3'-terminus of neighbour sequence of sequence listing upward to telomere on chrosomal short arm and 5'-terminus of this base sequence : 162564
atcgtagctgcagtcttgacctcctgggctcaagcgattctcctgagtagcttttcctgagtagctgggagtacagatgtgcaccaccaagcctggcttgagggccattttaaacagtgaaatcacaaacacacacacacacacacacacaccaaaaatggggaaaatgtgctattgaatagaacttgaacagaacgtatatttacagtgacagctgaattgacctcagtgggaaggagtgtgttggaattttccccaccccatgcatatttacaagtgaccccaaaagtgccattgatttgggggatacaaatacattttaacaagtagatggatttgcagatacagaatccgagaataataagaatcgactctgctggtaaaacaatcatgaaattgtgtatatccagtaacactccttcaaaactgaaaaagcaaacactgacttagctacatggtgaaatcta

SEQ ID NO: 17019 - DNA, 350 bp, Homo sapiens
  HUMUT6724B
  Located on chromosome 11
  Distance between a terminus base of telomere on chromosomal short arm and 5'-terminus of this base sequence : 2042730
  Distance between 3'-terminus of neighbour sequence of sequence listing upward to telomere on chrosomal short arm and 5'-terminus of this base sequence : 362210
gctttagctactcatccaagcctgcttgctccctctccctccctcccttacctccacccttccttccttccttccttccttccttccttgtctccttccatccatctacccatccacctatccatcatttctcaatctacccatccacctatccatcatttccccatcagctcacccacccagccgtctctttatccagccttcccttccctccatctccccatccatccattcattcaccactcatccatccatccacccacccatctcttcatttccccatccatccatccacccacccaccatccttttattcagctctccttccctccatttatctatccacctct

SEQ ID NO: 17020 - DNA, 261 bp, Homo sapiens
  AC003675.1_46359
  Located on chromosome 11
  Distance between a terminus base of telomere on chromosomal short arm and 5'-terminus of this base sequence : 2057828
  Distance between 3'-terminus of neighbour sequence of sequence listing upward to telomere on chrosomal short arm and 5'-terminus of this base sequence : 14748
ttggctgtcttggatacaacatatacacaccacactcacacacacaaacaccacacacacgatacatgcagacacaacacacaccacactcacacgtagaagacacaccacatacaacaaaacacacacactgccctcacatacaaacacaccacaccacacatgccaacacacactgtgtccaggcatgcaagcatgctacacaccacaccacacacacacacacacacacacacactcgaacttacagctacagaagtt

SEQ ID NO: 17021 - DNA, 291 bp, Homo sapiens
  U90095.1_33636
  Located on chromosome 11
  Distance between a terminus base of telomere on chromosomal short arm and 5'-terminus of this base sequence : 2123350
  Distance between 3'-terminus of neighbour sequence of sequence listing upward to telomere on chrosomal short arm and 5'-terminus of this base sequence : 65261
cctgaagactcaagaggattaagcagggaagaggagagcgtgtgcatgtttcgggggtggtgcgcctggcagggcaggggaacagcgggcgcgaaggccctgaagtaggggggagagagaaagagcgagagagagagagagagagagagagagagagagagagagagagtgtgtgtgtgagtgtgtgtgtgtgtgtgtgtgtgtggaaggcctgaagtccccctcctgcccgctagacccctctccactgcctctgccctccaggaggctctatagcttcagatctgaggc

SEQ ID NO: 17022 - DNA, 216 bp, Homo sapiens
  D11S4088
  Located on chromosome 11
  Distance between a terminus base of telomere on chromosomal short arm and 5'-terminus of this base sequence : 2123393
  Distance between 3'-terminus of neighbour sequence of sequence listing upward to telomere on chrosomal short arm and 5'-terminus of this base sequence : -248
gcatgtttcgggggtggtgcgcctggcagggcaggggaacagcgggcgcgaaggccctgaagtaggggggagagagaaagagcgagagagagagagagagagagagagagagagagagagagagagtgtgtgtgtgagtgtgtgtgtgtgtgtgtgtgtgtggaaggcctgaagtccccctcctgcccgctagacccctctccactgcctctgccc

SEQ ID NO: 17023 - DNA, 475 bp, Homo sapiens
  chr11.fa.O7frz.1959863
  Located on chromosome 11
  Distance between a terminus base of telomere on chromosomal short arm and 5'-terminus of this base sequence : 2413602
  Distance between 3'-terminus of neighbour sequence of sequence listing upward to telomere on chrosomal short arm and 5'-terminus of this base sequence : 289993
atgttcaacctcatttataacaagaaaaatgcaaatgaaaagtacactctgataccactgcttgcttatcagattggcaaaaatccagacttttgatggcaactctgtgggagaggcagcaggcacaggtgcactcctcatcactggtagaaaagagacctagcgatattactaaatgtatcatttgacacagaaaccccacttctaggaaataacccaaagatatgtaggaaaaatagaaaagtacatatacataatgatagtcaaaacagcattttttatattagcaaaagtctagagacaatcacaatgtccttcaatcgcttcagctgtgctgtggtacagtcacacgatggagtgccatgatcaatatgatcactaatactcaaccaaaggatcccaaagaactctgtgtgtgtgtgtgtgtgtgtgtgtgtgtgtgtgtgtgtgtgtgtatcaaagaatgatgctaaat

SEQ ID NO: 17024 - DNA, 316 bp, Homo sapiens
  AC002536.1_125344
  Located on chromosome 11
  Distance between a terminus base of telomere on chromosomal short arm and 5'-terminus of this base sequence : 2484901
  Distance between 3'-terminus of neighbour sequence of sequence listing upward to telomere on chrosomal short arm and 5'-terminus of this base sequence : 70824
cagcaattccagtcctagatatacgtgtgtgtgtgtgtgtgtgtgtgtgtgtgtgtgtgtgtgtgtgtgtatccaagagaaatgaaagcatatgtctgtataacaatatgcacatgcatgttcatagcagtactggtttgttttgttttgttttgttttgttttttgagacagagtcttggtctgttgcccaggctggagtgcagtggcgcgatcttggctcactgcaacctctgccccccggattcaagagattcccctgcctcagcctcctgagtagctgagattacaggcacgcatgaccgtgtctggctaat

SEQ ID NO: 17025 - DNA, 123 bp, Homo sapiens
  D11S1318
  Located on chromosome 11
  Distance between a terminus base of telomere on chromosomal short arm and 5'-terminus of this base sequence : 2550326
  Distance between 3'-terminus of neighbour sequence of sequence listing upward to telomere on chrosomal short arm and 5'-terminus of this base sequence : 65109
cccgtatggcaacaggggcaggtgaagaccggtgacagatacttacacacacacacacacacacacacagaggcacctgcacacgcacacacacatgcacacacacactcatgcacatgcaca

SEQ ID NO: 17026 - DNA, 222 bp, Homo sapiens
  DISD22_0002393
  Located on chromosome 11
  Distance between a terminus base of telomere on chromosomal short arm and 5'-terminus of this base sequence : 2760509
  Distance between 3'-terminus of neighbour sequence of sequence listing upward to telomere on chrosomal short arm and 5'-terminus of this base sequence : 210060
ttcccatagattactgtgcagtaaagatgagatgagatgatgatgagatgagatgagatgagatgagatgagatgagatgagatgagatgagatgatgagatgagatgatgagatgagatgagatgagatgagatgagatgagatgagatgatgagatgagatgagatgatgagatgagatgatgtctggggaggggtgggaactatcctggtgtggtggtt

SEQ ID NO: 17027 - DNA, 234 bp, Homo sapiens
  AC018888.3_129526
  Located on chromosome 11
  Distance between a terminus base of telomere on chromosomal short arm and 5'-terminus of this base sequence : 3151889
  Distance between 3'-terminus of neighbour sequence of sequence listing upward to telomere on chrosomal short arm and 5'-terminus of this base sequence : 391158
cttctacttgtaggtggcaatatgtgatgtttgattttctgtttctcagttgtttcacttcagatagcggcctccagttccatccacgttgctgcaaaagacatgatttcattcttcttttatggctgagtagtattgtgtgtgtgtgtgtgtgtgtgtgtgtgtgtataaaaataatattttctttatgcagtcatccattgatggacactaaagttgattctatgtcttgct

SEQ ID NO: 17028 - DNA, 456 bp, Homo sapiens
  chr11.fa.O7frz.3213084
  Located on chromosome 11
  Distance between a terminus base of telomere on chromosomal short arm and 5'-terminus of this base sequence : 3212672
  Distance between 3'-terminus of neighbour sequence of sequence listing upward to telomere on chrosomal short arm and 5'-terminus of this base sequence : 60549
tgagtcactaatgtcagcctatattaaaggggagggaaatccacctttaacgggaggattatcaaacaatttgtggacatgttttaaaaccattacagtcggccgggtatggtggctcacacctgtaatcctagcactttcggagaccgagatgggtggattgcctgagctcaagagtttgagaccagcctgggcaatggtgaaaccctatctttactgaaatacaaagagttagctgggtcgggtggcacacacctgtaatcccagctactcaggaggctgagacaagagaattgcttgaacttcggaggtggaggttgcagtgagctgaaattgcgccactgcactccagcctgggtgacgagcgagactctgtctcaagacaaacaaacaaacaaacaaacaaacaaacaaccatcacagtaaattaacctgtctaaacctaatgtaatttgg

SEQ ID NO: 17029 - DNA, 233 bp, Homo sapiens
  Z66941
  Located on chromosome 11
  Distance between a terminus base of telomere on chromosomal short arm and 5'-terminus of this base sequence : 3400281
  Distance between 3'-terminus of neighbour sequence of sequence listing upward to telomere on chrosomal short arm and 5'-terminus of this base sequence : 187153
ccaaattttaagcatttttagttagagattaaaaaaataagcacagtgatctagaaaccaaatatactgattatgtaactatcatatcaaagtacagacattcttcatatgctacaaggttagcatctctctcacacacacacacacacacacacacagacacacacacacagagtctctctctctctcattctctctctcactcttcctcagccatacaacacccctccagg

SEQ ID NO: 17030 - DNA, 409 bp, Homo sapiens
  AC025249.5_8790
  Located on chromosome 11
  Distance between a terminus base of telomere on chromosomal short arm and 5'-terminus of this base sequence : 3618871
  Distance between 3'-terminus of neighbour sequence of sequence listing upward to telomere on chrosomal short arm and 5'-terminus of this base sequence : 218357
cttgtgaacaagaaataagcagtggccataacccctcccttttaattcaccaccttttaaacttcaatcatattttcctgagacaacattggaaactggcctttctgttggcattccttcttcagtgcatagatcagtcattttaggctcacttcaaacctatttgaatcccacgtcccctgctcaccatgctacctttctttttactgtcctccaatcttagtcttggtactactgtgtgtgtgtgagagagagagagagagagaaaaaaaaaaaaagaaagaaagaaagaacagagacagcaagagagagagagaagagagacagtgagagagagagagagagagaagagagacagcaagagagagagagaacgagaacccagttcttaagcttcaagtttctaggc

SEQ ID NO: 17031 - DNA, 466 bp, Homo sapiens
  chr11.fa.O7frz.3835840
  Located on chromosome 11
  Distance between a terminus base of telomere on chromosomal short arm and 5'-terminus of this base sequence : 3640094
  Distance between 3'-terminus of neighbour sequence of sequence listing upward to telomere on chrosomal short arm and 5'-terminus of this base sequence : 20814
ctccactttagctcctatcaaccagaaacacttagttcagttcaaactgaactaaactatacatatatatacgtgtatatatatatatacacacacatatatatatatacacacacacatatatacgtatatatatatacacacacacatacatatatatatacacacacacacacacacacacacatatgcagggagctgagcttgctgtgtcaagagtctagggactcttactgaaaataaaaaatgactaattttaaatatctactacatgccagacagcgtctatcagcagtaacagaaacaaacagataaatgctactagttgtagagtgtataaggataggatgtatctaattgataaggcagaagagataatagtgtggagtggcagatttggagtgtgtgcatacatgaatgtgtctgtgtgtgtcaagaagaactagttccaagaatgttaacagaa

SEQ ID NO: 17032 - DNA, 118 bp, Homo sapiens
  DISD22_0002407
  Located on chromosome 11
  Distance between a terminus base of telomere on chromosomal short arm and 5'-terminus of this base sequence : 3771024
  Distance between 3'-terminus of neighbour sequence of sequence listing upward to telomere on chrosomal short arm and 5'-terminus of this base sequence : 130464
ccatttaagatgccaataagctacacacacacacacacacacacacacacacacacacacacacacacaaaataacagtatgttcaactttctcttgtcccagctttctctggacact

SEQ ID NO: 17033 - DNA, 159 bp, Homo sapiens
  DISD22_0002410
  Located on chromosome 11
  Distance between a terminus base of telomere on chromosomal short arm and 5'-terminus of this base sequence : 3913445
  Distance between 3'-terminus of neighbour sequence of sequence listing upward to telomere on chrosomal short arm and 5'-terminus of this base sequence : 142303
ctcctatttatgccacaacttctaaaacatgtaagacagtgaacataggaaaaataagagctttcaaatcagacctacctgggtcaaattccagctctgccagctgaaaatacacacacacacacacacacacacactcttccattcaggtgcatattt

SEQ ID NO: 17034 - DNA, 356 bp, Homo sapiens
  AC011711.3_91329
  Located on chromosome 11
  Distance between a terminus base of telomere on chromosomal short arm and 5'-terminus of this base sequence : 4089684
  Distance between 3'-terminus of neighbour sequence of sequence listing upward to telomere on chrosomal short arm and 5'-terminus of this base sequence : 176080
tatttccttggcttctctaaacatttgaacttatgatccctgttatgaattctcaatatctccctcccccctctctctctcttcctctctctttctgacacacacacacacacacacacacacacacacatacacacacgagtaacattctggttgctatcctggagagctttgtttatcaagtagaccaacccagagatctggcttttgcaaggcttttcccgatctgcagttttatccaccttctgtgtaccactgttacactttgtaaatgtgcttgctaatactttctcccctctgtgtgctgttaagaaatttttttttccccttaacttatcagtcaagttaacgtgatt

SEQ ID NO: 17035 - DNA, 473 bp, Homo sapiens
  chr11.fa.O7frz.4339655
  Located on chromosome 11
  Distance between a terminus base of telomere on chromosomal short arm and 5'-terminus of this base sequence : 4151571
  Distance between 3'-terminus of neighbour sequence of sequence listing upward to telomere on chrosomal short arm and 5'-terminus of this base sequence : 61531
ttgctagtaatagtatggccacactgaccatatatattcatatgcataatgtatctttttatatccctttactcatgacctatccttatatttaaagtatatgtatacacacacacacacacagacacacacacacacacacgctgattttttgtttattttttttggatggagtctcactctgtcgcccggctggagtgcagcggcaggatctcggctcactgcaacctccagctctctggttcaagcaattctcctgcctcagcctcctgagtaactgggattacagacacatgccaccacgcccagctaatttttgtatttttagtagagacaaggtttcaccatgttggccaggatggtctccatctcctgacctcgtgatttgcccgcctcagtctcccaaagtgttgggattacaggcataagccatcatgcccggcctatatttttaatccattgtgacaagtgct

SEQ ID NO: 17036 - DNA, 446 bp, Homo sapiens
  AC020597.4_131423
  Located on chromosome 11
  Distance between a terminus base of telomere on chromosomal short arm and 5'-terminus of this base sequence : 4252425
  Distance between 3'-terminus of neighbour sequence of sequence listing upward to telomere on chrosomal short arm and 5'-terminus of this base sequence : 100381
ctaaattctggattgtcatgagttcacagaagtaggtgcaagtgggtcagaaaattaagaaccacttaatattttgattgatgatcttttaaaaatgatattaaaagcatcgtttggaaacagaaatcaatcaatcaaaaaaatcaatagaaataaagtggaaaagtacctcttttactgaaaacatgtaatagataactgttaaatgcattgttctcattttgtggaagagcagaaagggaaatgtctttaatggactttcgtagttatattgtgatgttatggcctaaagatttattttcaaactatttaaactcttatttcacaaacacacacacacacacacacacacacacacacacacacacacgcatatacactcacacactatatatatagtttttttaccgtgaatttttttttaggtcaggaatagttgctatact

SEQ ID NO: 17037 - DNA, 456 bp, Homo sapiens
  AC020597.4_75011
  Located on chromosome 11
  Distance between a terminus base of telomere on chromosomal short arm and 5'-terminus of this base sequence : 4322668
  Distance between 3'-terminus of neighbour sequence of sequence listing upward to telomere on chrosomal short arm and 5'-terminus of this base sequence : 69797
ttaagttagctaaaccaaactcacaaagaagaaatctgaatataggattctgtcacatctctttcaccagtctcctcaattccaacaccacatcttgcatatagtcaccactgatgaaattaggatagttttccaaatagttatttttttctgagttactcctcttctgtttcccaatttgcttgttttggaataattatcttaactcaatttccttttcttctccctatacctgatcaatttctactttctaagatttcttaagaaatttgcccaacacccaagctgcagtgcacccttccaagacatacacacacacacacacacacacacacacacacacactagtgtgtgaaagagtttttaatcacagtgtgcttgaccacagttttataaagataagatacatcatagcaacacttaatatagcaagacaaatgctagactcactatcag

SEQ ID NO: 17038 - DNA, 301 bp, Homo sapiens
  chr11.fa.O7frz.4576099
  Located on chromosome 11
  Distance between a terminus base of telomere on chromosomal short arm and 5'-terminus of this base sequence : 4341980
  Distance between 3'-terminus of neighbour sequence of sequence listing upward to telomere on chrosomal short arm and 5'-terminus of this base sequence : 18856
ttgaaagaatttcactaagtacctgccctaattctgtctacctagcttttttttttctcctctctcagttacacaacatagctactgaaaagaatgagaattgactctctctctctgtgtgtgtgtgtgtgtgtgtgtgtgtgtgtgtgtgtgtgtacacatatatatctttggccaggctcactctctgttacttttttttttaattgacaaataaaaatggtgtatcttcatggtgcacaacatgatgtactatatatatatatgtaaatatgttgtggaatagatgtattaggctaca

SEQ ID NO: 17039 - DNA, 131 bp, Homo sapiens
  DISD22_0002413
  Located on chromosome 11
  Distance between a terminus base of telomere on chromosomal short arm and 5'-terminus of this base sequence : 4431326
  Distance between 3'-terminus of neighbour sequence of sequence listing upward to telomere on chrosomal short arm and 5'-terminus of this base sequence : 89045
gatgcctgagacagaatgtgacatattctagaatatattatttcctgaatatatatatatatatatatacacatatacgtatatatatatatatatatatatttgttgttatcaattgccatagaatgatt

SEQ ID NO: 17040 - DNA, 82 bp, Homo sapiens
  D11S1760
  Located on chromosome 11
  Distance between a terminus base of telomere on chromosomal short arm and 5'-terminus of this base sequence : 4616187
  Distance between 3'-terminus of neighbour sequence of sequence listing upward to telomere on chrosomal short arm and 5'-terminus of this base sequence : 184730
gatctcaagtgtttccccacaacgaacccagtcacacacacacacacacacacacacactggtgagtggacagacattgttt

SEQ ID NO: 17041 - DNA, 408 bp, Homo sapiens
  chr11.fa.O7frz.4877734
  Located on chromosome 11
  Distance between a terminus base of telomere on chromosomal short arm and 5'-terminus of this base sequence : 4691962
  Distance between 3'-terminus of neighbour sequence of sequence listing upward to telomere on chrosomal short arm and 5'-terminus of this base sequence : 75693
aagttccattgacaaatttctcttgcctaaccatctcagtatgacaatcaactgttctttctctctctctcgtcctctctctctctctctctcttccagttctatttgcctgaatgggagccctaaagttggagtttgcctgaattttcaatgtcaagtagtttggcatgacaggaggtaggaattgagggaaaagaaggaaagcacaatatgggattatgactgtggggtggctggaaattgtgtatcaaattctcctctgaagctatttctgtcttccacctgcactgtctcatggagatattaaggttataaatctactctacttcccttcaccaacaataccatatgcttaattgtgatacactgagtttcccactttaaaagtcattcacaagtttacttcag

SEQ ID NO: 17042 - DNA, 150 bp, Homo sapiens
  Z67693
  Located on chromosome 11
  Distance between a terminus base of telomere on chromosomal short arm and 5'-terminus of this base sequence : 4831895
  Distance between 3'-terminus of neighbour sequence of sequence listing upward to telomere on chrosomal short arm and 5'-terminus of this base sequence : 139525
atgctttccagtatgagcagagaaaagagaaagcagggagggggagacagagagagagacagagagagagagagagtgtgtgtgtgtgtgtgtgtgtgtgttagttgcatgaatctttcaggcaacgggcagttattatccttaatcaag

SEQ ID NO: 17043 - DNA, 418 bp, Homo sapiens
  AC026090.5_14767
  Located on chromosome 11
  Distance between a terminus base of telomere on chromosomal short arm and 5'-terminus of this base sequence : 4980547
  Distance between 3'-terminus of neighbour sequence of sequence listing upward to telomere on chrosomal short arm and 5'-terminus of this base sequence : 148502
agctatctagaagctaagccttatgttttatattttgtctcagggttggcctagataagacagtttgaggtcattgttttggtaggtactgaaaggaaaatagtaggaaaaaatagcttccctccaagtacctctattgcttctactcccttgctgatttgaactccctgaaaaaaaaaatcgatatatagataatacaaatatatatatacagataatataaatacacacacacacacacacacacacacacacacacacacatatatatatatatatatttccctactggctcctaatcccttgcacaataggccttagcctgacaaacttactacaactctctcttgtccatccttgcagtatcaggtacaaactgagagacaaaggatacaaacagaatttgatcagcttagaa

SEQ ID NO: 17044 - DNA, 424 bp, Homo sapiens
  chr11.fa.O7frz.5327809
  Located on chromosome 11
  Distance between a terminus base of telomere on chromosomal short arm and 5'-terminus of this base sequence : 5015159
  Distance between 3'-terminus of neighbour sequence of sequence listing upward to telomere on chrosomal short arm and 5'-terminus of this base sequence : 34194
ttgctttcagtcacagtgagagggaaccaaaaattaatagacaccataatgaggccgggcatggtggctcacacctataatcctagcactttgggaggtaaagtgggcagatcgcctgagcccagggcttcgggatccgcctgggcaacatagtgaaaccctgtctctaccaaaaatacaaaaaataaccagggcgtggtggtgcgtgactgtagtcccagctactcaggaggctgaggtggaaggatgaaccctggagatggaggttgcagtgagccgagatcgtgccattgcactccagcttgggtgacagagacaaaccctgtctcaaaacaaacaaacaaacaaacaaacaaacaaacaaaaaagcccaacaccataatggattaccccttacatgctagaaatgagtgaagctattcaa

SEQ ID NO: 17045 - DNA, 476 bp, Homo sapiens
  chr11.fa.O7frz.5454421
  Located on chromosome 11
  Distance between a terminus base of telomere on chromosomal short arm and 5'-terminus of this base sequence : 5057040
  Distance between 3'-terminus of neighbour sequence of sequence listing upward to telomere on chrosomal short arm and 5'-terminus of this base sequence : 41457
atgtgctcatgtctacctgtctgtgtgtaatcttgggaaggtcttcccctctgtgtaatcttgggaaggtcttcacttcaacgatgttcgctttcttacttttaaaatgcaataattaaccccatgctttctacctcttaaaaatgaatataaaattagataaaataataatgcttttgtttgtttgtttgtttgtttgtttgttttgagatggggtctcactctgttatccaggctggagtgtagtggcgcgacctcggctcactgcaacctctgcctcccaggttcaagccattctcctgcctcagcctcccaagtagctgggattacaggtgcctgctaccacatccggctaatttttttgtacttttagtagagacagggtttcaccatgttggccaggctggttttgaacttctgacctcaagtgatccgcctgcctcggcttcccaaagtgctagcattgtaggcgtgac

SEQ ID NO: 17046 - DNA, 272 bp, Homo sapiens
  chr11.fa.O7frz.5573834
  Located on chromosome 11
  Distance between a terminus base of telomere on chromosomal short arm and 5'-terminus of this base sequence : 5165649
  Distance between 3'-terminus of neighbour sequence of sequence listing upward to telomere on chrosomal short arm and 5'-terminus of this base sequence : 108133
gatttccactgattaatggttaaaaaaaactctgtagaaaactctaggttaaatcccatcacagcgatagagacagacggacacacacacacacacacacacacacacacacacacacagagaaagagagagagagagagaagcaatcaaaattagaactttgaagaaggagattaacatataacagaagataatataaaataatttgttaaactgcaatgatatggaaaaatgaataattcaatttggtaatctaaagcaaccaataactg

SEQ ID NO: 17047 - DNA, 435 bp, Homo sapiens
  chr11.fa.O7frz.5654592
  Located on chromosome 11
  Distance between a terminus base of telomere on chromosomal short arm and 5'-terminus of this base sequence : 5266592
  Distance between 3'-terminus of neighbour sequence of sequence listing upward to telomere on chrosomal short arm and 5'-terminus of this base sequence : 100671
atgaggtggctagtatctgttttgttatgtgtattttgctggaattgaaaatgttaattcatttccccacgtagcccattgggcaacatcttgcaaaattgagaatattttctccatggcttcatcaaacagaattttcttttgtaaagtggcttgaccctcacagctatggcacagatagcagggtcatcaaaagctgctccattcttctggaagctacagagaaagggaacctggaaacctggtatgctggcaaaaagggtaagaaattcttaccagccaagtttctcgtctcattctctctctctctctctccctctgtgtgtgtgtgtgtgtgtctctctctctatctctctctgactctctctctctattctctctctctgactctgtgtgtgtgtgtgtgtgtataaatggtaaacgtcactatttgtc

SEQ ID NO: 17048 - DNA, 267 bp, Homo sapiens
  D11S1338
  Located on chromosome 11
  Distance between a terminus base of telomere on chromosomal short arm and 5'-terminus of this base sequence : 5316542
  Distance between 3'-terminus of neighbour sequence of sequence listing upward to telomere on chrosomal short arm and 5'-terminus of this base sequence : 49515
taatgctacttatttggagtgtgaatttcttatagttttttttcctagtgatttttacatcttaaaatgactcatatttatgtgtgtgtgtgtgtgtgtgtgtgtgtgtgtgtgtgtgttgctttaagtgaatctgtgtgtccttttttaagatatattttaccaacttctgacttcatactatcctacctgacttttccatcagatttctgacaccatcttattcctactctttcctatttgtcttagatatacagttaaaccgtc

SEQ ID NO: 17049 - DNA, 205 bp, Homo sapiens
  D11S1323
  Located on chromosome 11
  Distance between a terminus base of telomere on chromosomal short arm and 5'-terminus of this base sequence : 5546837
  Distance between 3'-terminus of neighbour sequence of sequence listing upward to telomere on chrosomal short arm and 5'-terminus of this base sequence : 230028
ctctatgaagttggagtctaggttgagagtgaagaatgctctgtgtctctgtgtgtgtgtgtgtgtgtgtgtgtgtgtgtgtcagggtgggagaagaaattagagattttatgagacgagaaaatttaaaaacaatattgtgtaaaatgagagaaagaaggtaatcagggaaatttggtaagacatctactcattctaagcagca

SEQ ID NO: 17050 - DNA, 204 bp, Homo sapiens
  D11S1997
  Located on chromosome 11
  Distance between a terminus base of telomere on chromosomal short arm and 5'-terminus of this base sequence : 5628233
  Distance between 3'-terminus of neighbour sequence of sequence listing upward to telomere on chrosomal short arm and 5'-terminus of this base sequence : 81191
tttgttttcctaagaaagataaagcaccagtaagaaatgaatcatacttgcaatgagatagatagatagatagatagatagatagatagatagatagatagacagaaaaaaataagctaaatttaaagtcaaaaatccactgtcaattggataagaaattgatgtttgagtctaaaaagtaaagctggtctttattttgtccag

SEQ ID NO: 17051 - DNA, 436 bp, Homo sapiens
  AC009796.4_61451
  Located on chromosome 11
  Distance between a terminus base of telomere on chromosomal short arm and 5'-terminus of this base sequence : 5869950
  Distance between 3'-terminus of neighbour sequence of sequence listing upward to telomere on chrosomal short arm and 5'-terminus of this base sequence : 241513
ggttgatagaatttgacagtaaagccatctgggcctggagtttttttgttttgatgtgtgtgtgtgtgtgtgtgtgtgtgtgtgtgtgtgtgtgtgtgtgagagagagagagaggtttttaatgacaaattctatttctttagtagatacaaggctatcagattttccacttctttctgagtccattgtggtattttcaaaaattttatcttagatagaacgtaagtttttgaagttactggtataagttgttcataatagtcccttattatccttttaatgtctgtaggatctatagggatgtccctgctttcattcatattttcagtcttcgtatttttgatcagtctaaataaaagatttgtcaattctattgatcctttcagagaattagctttgtgtttcattgattttctctattggttctccagtttct

SEQ ID NO: 17052 - DNA, 388 bp, Homo sapiens
  chr11.fa.O7frz.6316475
  Located on chromosome 11
  Distance between a terminus base of telomere on chromosomal short arm and 5'-terminus of this base sequence : 5896509
  Distance between 3'-terminus of neighbour sequence of sequence listing upward to telomere on chrosomal short arm and 5'-terminus of this base sequence : 26123
gttaaggtgacaatacagcaaggtggaaatgttgagtgtgttgttggttatgcagatttgcaattcaggggaggaatctgacttggagacacagatttgagagctatcagcatatagatagcatatatatatcatatatatagatgatacttgaagacgtggttgtgaaggagaacgtctcaggagagtggaaggcaagaggtcaggggacaggaagcctgcacgacagaaaaggagcaaccgcaagttgaaaaagaaataggaaaatgtgtgagtaaagcttacagaagagaatgttttaatgaaggggaggtagtcaacggcagtacaggctactgagagatcaaagaacattaatattttaaagtagccattgaatttacagttg

SEQ ID NO: 17053 - DNA, 475 bp, Homo sapiens
  chr11.fa.O7frz.6430038
  Located on chromosome 11
  Distance between a terminus base of telomere on chromosomal short arm and 5'-terminus of this base sequence : 5983132
  Distance between 3'-terminus of neighbour sequence of sequence listing upward to telomere on chrosomal short arm and 5'-terminus of this base sequence : 86235
tttcagaaaattctgagtcattattactttacatatttatttgcttgcttgctttctctctttccttttctccttccttccttcccttccttctctctctctcttccttccttcctccctcccttcctccctccttctctccctcgctttctctccttccttccttcctttctttccctcctcctcctccttcttctcctcctcctcttcttccttcttctttccttctttcttcctctctttctctctttctttccttccttctttcctccctccctctttctttctttctttcttccttccttccttttttctttctttcttttctttcctcttctttctttttctctctttctttcttttttttctctctctctttctttctttcttttctttatttttttctgatattcccattacacatatgttacaccttttgttattgtcccacagttcttggatagtctgtttcatt

SEQ ID NO: 17054 - DNA, 378 bp, Homo sapiens
  AC017103.5_30666
  Located on chromosome 11
  Distance between a terminus base of telomere on chromosomal short arm and 5'-terminus of this base sequence : 6203907
  Distance between 3'-terminus of neighbour sequence of sequence listing upward to telomere on chrosomal short arm and 5'-terminus of this base sequence : 220300
aatctggtatttaaagaaatggagaccataaaaatagtagtaatataagtaaatatatttaaaaatttacttagtatccaaatttttttttaccagaaacaacattatttaatgataaaaaagtcaatttaccaggaagatatgacaattataagagagaaatagaaaacaacacaacaatagtaggagatttcaatatcccactacatctatacacacacacacacacacacacacacacacacacacacatattaagttctgggatacatgtacagaacgtgcaggtttgttacataggtatacacgtgccatggtggtttgctgtggccatcaaccagtcatctacattaggtatttctcctaatgctatccttc

SEQ ID NO: 17055 - DNA, 101 bp, Homo sapiens
  DISD22_0002420
  Located on chromosome 11
  Distance between a terminus base of telomere on chromosomal short arm and 5'-terminus of this base sequence : 6382004
  Distance between 3'-terminus of neighbour sequence of sequence listing upward to telomere on chrosomal short arm and 5'-terminus of this base sequence : 177719
gatacggtgaggtgcaaaggagataatagatatgaatattatatatatacatatatatatataactctaaagccttgtatacgcgtaaggaattctagagg

SEQ ID NO: 17056 - DNA, 101 bp, Homo sapiens
  DISD22_0002421
  Located on chromosome 11
  Distance between a terminus base of telomere on chromosomal short arm and 5'-terminus of this base sequence : 6452459
  Distance between 3'-terminus of neighbour sequence of sequence listing upward to telomere on chrosomal short arm and 5'-terminus of this base sequence : 70354
gagcagcttgatggatgagatgaagacatatatatatatatatatatatatatatatatacacaaaaatgtgccaggaggaaggtggtcatggagtagttt

SEQ ID NO: 17057 - DNA, 199 bp, Homo sapiens
  D11S1331
  Located on chromosome 11
  Distance between a terminus base of telomere on chromosomal short arm and 5'-terminus of this base sequence : 6604788
  Distance between 3'-terminus of neighbour sequence of sequence listing upward to telomere on chrosomal short arm and 5'-terminus of this base sequence : 152228
gctgcttccatgagaggatactgactttgatgtttagatgcacaagacacagacacacacacacacacacacacacacacacacacacacacataatgtggagagagtgtcatcaggtgtggagagtttttgcaggtaactgcaaagcctaataaatgtaaaagtgagaaagacgaaggaagactgcaaagggctctgc

SEQ ID NO: 17058 - DNA, 305 bp, Homo sapiens
  Z23980.1_54
  Located on chromosome 11
  Distance between a terminus base of telomere on chromosomal short arm and 5'-terminus of this base sequence : 6604808
  Distance between 3'-terminus of neighbour sequence of sequence listing upward to telomere on chrosomal short arm and 5'-terminus of this base sequence : -179
ctgactttgatgtttagatgcacaagacacagacacacacacacacacacacacacacacacacacacacacataatgtggagagagtgtcatcaggtgtggagagtttttgcaggtaactgcaaagcctaataaatgtaaaagtgagaaagacgaaggaagactgcaaagggctctgcctctaagaactgtgcttctgcttggagagggaagacttatataaataaaggaatctgaagcataatagtcactattatttggctggtgaagtagcctttcttttctcacatctgcgaatgttaact

SEQ ID NO: 17059 - DNA, 465 bp, Homo sapiens
  AC060799.3_27749
  Located on chromosome 11
  Distance between a terminus base of telomere on chromosomal short arm and 5'-terminus of this base sequence : 6717922
  Distance between 3'-terminus of neighbour sequence of sequence listing upward to telomere on chrosomal short arm and 5'-terminus of this base sequence : 112809
tcttcagaaatactttcagctactttgtttctttttaaatatgcttccatattttatataaaatgttagatttgacttgatttttaattttatatttctattgaattttattatggaagatgaagatttagctcttaaattcactagccacacacacacacacacacacacacacacaccctcacaccttacttccctctcccattttctcaaaatcgttatacacttgtggagataattattcatgtttgtatcattattgttatgtaaacatgatgtatagctgaaccatgtatgtctctgtggttacattcttttttcctcccaggagttggtaatttgtatctctaacctgaatcttcccctgatttccattctcttatatctaattggctactcagcatctgcatttggatgtctaataggcatctcacaattaatgtatgtgaaactgagttcttgatc

SEQ ID NO: 17060 - DNA, 173 bp, Homo sapiens
  DISD22_0002427
  Located on chromosome 11
  Distance between a terminus base of telomere on chromosomal short arm and 5'-terminus of this base sequence : 6817185
  Distance between 3'-terminus of neighbour sequence of sequence listing upward to telomere on chrosomal short arm and 5'-terminus of this base sequence : 98798
acagagctgaggacctggaccctgaaaagcaccttgggactctctgcctgggatgccagctgcctgccctcaaacctatatatatatatatatacacacacatacatacatatgtgtgtgtgtgtgtgtgtgtgtgtgtgtgtgtgtgtattacggttcttaaatccagcttc

SEQ ID NO: 17061 - DNA, 111 bp, Homo sapiens
  DISD22_0002431
  Located on chromosome 11
  Distance between a terminus base of telomere on chromosomal short arm and 5'-terminus of this base sequence : 6914724
  Distance between 3'-terminus of neighbour sequence of sequence listing upward to telomere on chrosomal short arm and 5'-terminus of this base sequence : 97366
tctagaagccttgctgggcagctgagatgcctgggaaaggaggtccgtttggcgctattccagcacacacacacacacacacagggcggcggggagtgaactggaggccat

SEQ ID NO: 17062 - DNA, 428 bp, Homo sapiens
  chr11.fa.O7frz.7448241
  Located on chromosome 11
  Distance between a terminus base of telomere on chromosomal short arm and 5'-terminus of this base sequence : 7117405
  Distance between 3'-terminus of neighbour sequence of sequence listing upward to telomere on chrosomal short arm and 5'-terminus of this base sequence : 202570
gctcttggaggttgataaataatcagaggtcatagtgttcagagagcatcaatgttgtgcccgacagagatggatctgacctgtcctgagctccagaagcctggagagagaggccgtgtgtgtgtgcatgcatgtgtgtaggtgtgtgtaggtgtgcgtgtgtgtgtgcatgtgtgtaggggtgtgtgtgtgtgcactacatgaactgtgattggccaaaaggaggctgagggtaagtgctgtagacccagaccttttgtgtgtgaatgctagcttcatcattgaccagctgtgtgactttgggcaagatccttgccttctctgtgactcagttcctctgctgtgaaatgggtatgctaatggtgcctaccttctagggtggctatgaggattaaacgaattataatatgtacgtagcacctaacaca

SEQ ID NO: 17063 - DNA, 272 bp, Homo sapiens
  chr11.fa.O7frz.7537457
  Located on chromosome 11
  Distance between a terminus base of telomere on chromosomal short arm and 5'-terminus of this base sequence : 7168828
  Distance between 3'-terminus of neighbour sequence of sequence listing upward to telomere on chrosomal short arm and 5'-terminus of this base sequence : 50995
accacgtaagctacgttaaagattctgtgctttttcaaaatcaaaagggacctgttgaaggattaaaacaaaagagataatctgtttggaaaacagaaagaaaaccgaaaggaggcaaaatcagagaaatcacatgagatagttatgacctgtatcaaaaataggcattcattcattcactcactcactcactcactcactcactcactcttctacttcatctaacacttttttggagccttttatgtgcctgtgctaagctctacagctaa

SEQ ID NO: 17064 - DNA, 474 bp, Homo sapiens
  AC074005.1_195932
  Located on chromosome 11
  Distance between a terminus base of telomere on chromosomal short arm and 5'-terminus of this base sequence : 7202262
  Distance between 3'-terminus of neighbour sequence of sequence listing upward to telomere on chrosomal short arm and 5'-terminus of this base sequence : 33162
tgtttctttgctcagtatttcttctacctagaatgcccttctttttcatctggattatttaaacacacacacacacacacacacacacacacacacacacatacacacacacacacacaccccaaaacactttaagaactgcctcctcaatttagccaaggaaggtaaagctgggttaacatctaaatttcaattaatgtaatatgccacatcagtaaaggacaaaactcacataatcatctcataatcatctcaacagacatagaaaaaaagtatttgataaaattcaataccccttcataatgaaaaacactcagcaaactaagaatacaagggaacttcctcaacctgaaaacaggcatctacgaaatgcccccagataacattacatatgctagtaaagcatacttcttaagatcaaggacaagaaaggatgtttgttcttaccacttctattcaacattgcactaaagg

SEQ ID NO: 17065 - DNA, 150 bp, Homo sapiens
  D11S932
  Located on chromosome 11
  Distance between a terminus base of telomere on chromosomal short arm and 5'-terminus of this base sequence : 7408263
  Distance between 3'-terminus of neighbour sequence of sequence listing upward to telomere on chrosomal short arm and 5'-terminus of this base sequence : 205527
cttatcatctctgggtagtgaagtcactttttttttaccttctatttttacagttttctgtggtgtttgggtttttactctgtgtgtgtgtgtgtgtgtgtgtgtgtgtgtgtgtataatcagaaaatccagccaaggtgtgctatacga

SEQ ID NO: 17066 - DNA, 433 bp, Homo sapiens
  chr11.fa.O7frz.7755945
  Located on chromosome 11
  Distance between a terminus base of telomere on chromosomal short arm and 5'-terminus of this base sequence : 7500379
  Distance between 3'-terminus of neighbour sequence of sequence listing upward to telomere on chrosomal short arm and 5'-terminus of this base sequence : 91966
acaactatctgatctttgacaaacctgagaaaaacaagcaatggggaaaggattctctatttaataaatggtgctgggaaaactggctagccatatgtagaaagctgaaactggatcccttccttacaccttatacaaaaatcaattcaagatggattaaagacttaaacgttagacctaaaaccatgactgttttattttatctcatttctttctttctttctttctttctttttagatggagtctcactgtgttgcccaggctggagtgcagtggtgtgatctcagctcactgcaacctctgcctcccaggttcaagcgattctcctgccttagcctcccaagtagctgggattacaggcatgtaccatcacacccaactaatttttgtatttttagtagagacagggtttcaccatgtttctggtttcaa

SEQ ID NO: 17067 - DNA, 403 bp, Homo sapiens
  chr11.fa.O7frz.7873690
  Located on chromosome 11
  Distance between a terminus base of telomere on chromosomal short arm and 5'-terminus of this base sequence : 7618922
  Distance between 3'-terminus of neighbour sequence of sequence listing upward to telomere on chrosomal short arm and 5'-terminus of this base sequence : 118110
ctacctgttatgagctgaatgtgtcccttcaaaaaatcacacgttgaagctctaacccccaatgtgatggaatttgaaagtgaggcctttgggaagtaattttgtttctattagatcatgatggtaggatcctggtgatttgatggtattagcgcccttataagaaggaaactgatctctctctctctctctctctctctctctatctctctctctctcaagcttgcaccaaagaaaagccctaggaggacatagtaagaaggtgactgcctacaagccaggaagtgagccttcctgagacaccaaatctgccagtatcttgactttggacttcacagtctccagaactgtgaactgtgaataataacagattaacaggttaatctatccagtctacggtatt

SEQ ID NO: 17068 - DNA, 366 bp, Homo sapiens
  chr11.fa.O7frz.9366349
  Located on chromosome 11
  Distance between a terminus base of telomere on chromosomal short arm and 5'-terminus of this base sequence : 7874206
  Distance between 3'-terminus of neighbour sequence of sequence listing upward to telomere on chrosomal short arm and 5'-terminus of this base sequence : 254881
ttaggagacatctaacatctgaaggcaagatctctctctctctctctgtctctgtctctctttgtctgtctgtctctctctctttccgtctctctccctgtttctccctcagttaaccaggcaggccaggaagtaacagtgcagagccgagtgtagaatctcattgcctattattttttcatacatacatatatatatatatgtgtgtgtgtgtgtgtgtgtgtgtgtgtgtatatatgtatatatgtatatatatgtgtgtgtatatatatgtatatatatatataatcaaatcaaaacaagacaacagcaaaacaaagaaaaactttttgttttttttcttcctcaatttatgtccttggaagt

SEQ ID NO: 17069 - DNA, 454 bp, Homo sapiens
  AC016718.4_123115
  Located on chromosome 11
  Distance between a terminus base of telomere on chromosomal short arm and 5'-terminus of this base sequence : 7892574
  Distance between 3'-terminus of neighbour sequence of sequence listing upward to telomere on chrosomal short arm and 5'-terminus of this base sequence : 18002
gaaatcgttcactgaatctagtcacagaatttgcccttgtcatagacatgtggccatagagcaactggaactttaaaaattccatatttaaagattttaagtagagttaacaaatacaaataatggcttaaagggaaatattagttaattttcaatcatttggagacagattgctcagtgttagtaatctgtacattctttcttctgtttaatcttttgacccctttttgttgcctttcatctctttaacactaggcagaggaaaaaggaggaaatgaaattccatttgcttttagtagtcataaaagtgtgtgtgtgtgtgtgtgtgtgtgtgtgtgtgtgtgtaggtgtaggtatgtgtaggtgggagagattgaaacttttctaaaataaaaacgcaccttttgcataggaggcactctgcagctgtgtaacattaggcaagtcacttaat

SEQ ID NO: 17070 - DNA, 101 bp, Homo sapiens
  DISD22_0002448
  Located on chromosome 11
  Distance between a terminus base of telomere on chromosomal short arm and 5'-terminus of this base sequence : 8537450
  Distance between 3'-terminus of neighbour sequence of sequence listing upward to telomere on chrosomal short arm and 5'-terminus of this base sequence : 644422
tattgcctgacctgaggcatgtacacacacacacagacacacacacagacacacacacacacagccatatccctcaccccagtcttgtacctaagcaaagg

SEQ ID NO: 17071 - DNA, 120 bp, Homo sapiens
  D11S909
  Located on chromosome 11
  Distance between a terminus base of telomere on chromosomal short arm and 5'-terminus of this base sequence : 8665939
  Distance between 3'-terminus of neighbour sequence of sequence listing upward to telomere on chrosomal short arm and 5'-terminus of this base sequence : 128388
gatataacaccaaaagcgcgcgcgcacacacacacacacacacacacacacacacacacacacaaaggacatgaattgtactatgtcaaagaaaagaacttttgtgctgtaagcaatacc

SEQ ID NO: 17072 - DNA, 223 bp, Homo sapiens
  AJ400877.1_157692
  Located on chromosome 11
  Distance between a terminus base of telomere on chromosomal short arm and 5'-terminus of this base sequence : 8866536
  Distance between 3'-terminus of neighbour sequence of sequence listing upward to telomere on chrosomal short arm and 5'-terminus of this base sequence : 200477
tggactaagtcaatttctggacatttttgaataaacgaatattaaaacaaaaaggagaccatgaagcaatttatacagattatgccaactatatacacacacacacacacacacacacacgctatatatatatatatatataaacatatataatgtacacacgtgtgtgtgtgtgtgtgtgagagatttaaagacaggaagagaatctggagtgatggtagtc

SEQ ID NO: 17073 - DNA, 121 bp, Homo sapiens
  D11S4188
  Located on chromosome 11
  Distance between a terminus base of telomere on chromosomal short arm and 5'-terminus of this base sequence : 8959871
  Distance between 3'-terminus of neighbour sequence of sequence listing upward to telomere on chrosomal short arm and 5'-terminus of this base sequence : 93112
taacaccatcaaatagaccaggactagaagacagacagacagacagacacacacacacacacacacacacacacacacacacacagccttgtctatgccacatgctgccttctggataaaa

SEQ ID NO: 17074 - DNA, 356 bp, Homo sapiens
  AJ400877.1_64392
  Located on chromosome 11
  Distance between a terminus base of telomere on chromosomal short arm and 5'-terminus of this base sequence : 8959877
  Distance between 3'-terminus of neighbour sequence of sequence listing upward to telomere on chrosomal short arm and 5'-terminus of this base sequence : -115
catcaaatagaccaggactagaagacagacagacagacagacacacacacacacacacacacacacacacacacacacagccttgtctatgccacatgctgccttctggataaaaagcctttctaattaacacacctgacacttctttacacccacttcctccctcagcagcaagagggaatgtcactggtaactgcttgagccgttttctctgcatggtaaaatcttcaacattgctgtcagacctggacctgatttgatgctgtgagggctacagaattcatccagtgtttgggagctcctgagacaagacacattggctcccctagaaacaaatcaaacctaatttagcatga

SEQ ID NO: 17075 - DNA, 425 bp, Homo sapiens
  chr11.fa.O7frz.10079153
  Located on chromosome 11
  Distance between a terminus base of telomere on chromosomal short arm and 5'-terminus of this base sequence : 9425579
  Distance between 3'-terminus of neighbour sequence of sequence listing upward to telomere on chrosomal short arm and 5'-terminus of this base sequence : 465346
gtcatattcatggctaagatttactgcaacaagaagacacagagcaaagtggccaggcatggtggctctcacctgtaatcgcagcactttgggaggtcgacgtgggtggatcacttgagctcaggagttcaagaccagcccaggcaacatggcaaaaccctgtctctacaaaaaatgtaaacattaactgggcgtggtggtatgcacctgtagtcccagctaatcgggaggctgaagtgggagaatcacttgaacccgggaggcagagcttgcagtgagctgagatcgcatcactgcactccagcctgggtgacagagcactccagcctgggcaacagagcgagattcatctcaaaaaacaaaacaaaacaaaacaaaacaaaacaaaagaaaacaaaaggctaaccttggaagcagacctttct

SEQ ID NO: 17076 - DNA, 366 bp, Homo sapiens
  chr11.fa.O7frz.10381205
  Located on chromosome 11
  Distance between a terminus base of telomere on chromosomal short arm and 5'-terminus of this base sequence : 9794403
  Distance between 3'-terminus of neighbour sequence of sequence listing upward to telomere on chrosomal short arm and 5'-terminus of this base sequence : 368399
aaccagacctagtatcttccaggccaatgacagcctctctctcataaaaataaatacacaaacaaacaaacaaacaaacaaacaaacaaacatctaatcttctgccatggtaaaggagaggcagctggctgtttacaccgaattaagaaaggaactgggagggggatccaacagaatcttaagcagctttcaaccaatcctctattttttatgttttagcctcaccttgtccttctgctcgcagagatacctgatgttactaattcctgagccttttggggttttgtaaactgggctgcctcaaggcttttcccgctgctacttgggaaaaggctttctcgggtctgctaagtaaagatcactcat

SEQ ID NO: 17077 - DNA, 262 bp, Homo sapiens
  chr11.fa.O7frz.10482337
  Located on chromosome 11
  Distance between a terminus base of telomere on chromosomal short arm and 5'-terminus of this base sequence : 9855964
  Distance between 3'-terminus of neighbour sequence of sequence listing upward to telomere on chrosomal short arm and 5'-terminus of this base sequence : 61195
tactgataatttctgcctgaatagatctttactataatgattataattttccaaatgcagcactcactctgtatttcccagtcagcacttggcattctacatagcagagtcctccttttcctctacttacttgctcattcattcattcattcattatcagtgtggactcataaatatctactttttcctaacagtctgtaagtcactactgtccttaatttttctggtgctaaacatgtcctagatttatgcagtaggagcc

SEQ ID NO: 17078 - DNA, 463 bp, Homo sapiens
  AC018539.4_114043
  Located on chromosome 11
  Distance between a terminus base of telomere on chromosomal short arm and 5'-terminus of this base sequence : 9967668
  Distance between 3'-terminus of neighbour sequence of sequence listing upward to telomere on chrosomal short arm and 5'-terminus of this base sequence : 111442
caggttgagccatagatgttaggggatcacattgggaagccagaccggaggagaagcagagagatgccagagacaacaccactaagagtcaagaagagagctgggaacatgctggaggtcacgagaggtcctggagcaggtctgaacacaggccagccttgttctccccaggccaggagagcagagaagaatttgggcaaaaaagcaaagaagaaaagctgcccagttcattttatgaggttatcataaccctgataacaaaacctgtcaagaacagcacatacacacacacacacacacacacacacacacacacacacacacacacacacacacacaaagaccagtctcacttttgaatggggacagaaaaacatctggaaaaaaattagcaaatttaattgaagcacatcaaaaaatcatccatgatagtcaaggagggtttaacaacgtaaggatggtt

SEQ ID NO: 17079 - DNA, 409 bp, Homo sapiens
  HUMUT737B
  Located on chromosome 11
  Distance between a terminus base of telomere on chromosomal short arm and 5'-terminus of this base sequence : 9967830
  Distance between 3'-terminus of neighbour sequence of sequence listing upward to telomere on chrosomal short arm and 5'-terminus of this base sequence : -301
tctccccaggccaggagagcagagaagaatttgggcaaaaaagcaaagaagaaaagctgcccagttcattttatgaggttatcataaccctgataacaaaacctgtcaagaacagcacatacacacacacacacacacacacacacacacacacacacacacacacacacacacacaaagaccagtctcacttttgaatggggacagaaaaacatctggaaaaaaattagcaaatttaattgaagcacatcaaaaaatcatccatgatagtcaaggagggtttaacaacgtaaggatggtttgacattaggaaatgtattaaaattatacagttcatccttaagaaaataaatcacccaaacctatattctgaaaagcacttgataaagttccacatccatttctggtg

SEQ ID NO: 17080 - DNA, 103 bp, Homo sapiens
  DISO7_10003003
  Located on chromosome 11
  Distance between a terminus base of telomere on chromosomal short arm and 5'-terminus of this base sequence : 10140423
  Distance between 3'-terminus of neighbour sequence of sequence listing upward to telomere on chrosomal short arm and 5'-terminus of this base sequence : 172184
aaagttaggttcagtgtggtattcattttgtaggaaaaaaaaaaaaaaatatatatatatatatatatttatgcaagaaacctaggaataaatggatagtcca

SEQ ID NO: 17081 - DNA, 167 bp, Homo sapiens
  DISO7_10003002
  Located on chromosome 11
  Distance between a terminus base of telomere on chromosomal short arm and 5'-terminus of this base sequence : 10159790
  Distance between 3'-terminus of neighbour sequence of sequence listing upward to telomere on chrosomal short arm and 5'-terminus of this base sequence : 19264
agctgcagtgaaatggaacccggaaacctggtatgccggcaaaaagggtaagaaattcttaccagtcaaaagtttctggtgtgtctctctctctcgctctgtgtgtgtgtgtgtgtgtgtgtgtgtgtgtgtacatggtaaatgtcaatatttatctcctctgcaag

SEQ ID NO: 17082 - DNA, 132 bp, Homo sapiens
  D11S1999
  Located on chromosome 11
  Distance between a terminus base of telomere on chromosomal short arm and 5'-terminus of this base sequence : 10381913
  Distance between 3'-terminus of neighbour sequence of sequence listing upward to telomere on chrosomal short arm and 5'-terminus of this base sequence : 221956
tacatggcagcaggcatatacacatacacatctatatctatctatctatctatctatctatctatctatctatctatctatctatctatctatctctccatctatctgcctatctagcaatcttgtttactc

SEQ ID NO: 17083 - DNA, 261 bp, Homo sapiens
  D11S1329
  Located on chromosome 11
  Distance between a terminus base of telomere on chromosomal short arm and 5'-terminus of this base sequence : 10384893
  Distance between 3'-terminus of neighbour sequence of sequence listing upward to telomere on chrosomal short arm and 5'-terminus of this base sequence : 2848
tgtggaacatcaagcaagttgttttacttcttccagcctcagtttccttttgaaggaaaggcgtagacacttgtgaggatagagtgcttttatgtaaatcatctaatctaatgctaggaatatagtaggtactcaatatgatatatgattttgaactctctctctctctctctcacacacacacacacacacacacacacacacacacagccagccctaagttccatttcaacttctgattttgattgtccctgtagtgcc

SEQ ID NO: 17084 - DNA, 180 bp, Homo sapiens
  Z23920.1_231
  Located on chromosome 11
  Distance between a terminus base of telomere on chromosomal short arm and 5'-terminus of this base sequence : 10384953
  Distance between 3'-terminus of neighbour sequence of sequence listing upward to telomere on chrosomal short arm and 5'-terminus of this base sequence : -201
gcgtagacacttgtgaggatagagtgcttttatgtaaatcatctaatctaatgctaggaatatagtaggtactcaatatgatatatgattttgaactctctctctctctctctcacacacacacacacacacacacacacacacacacagccagccctaagttccatttcaacttctgat

SEQ ID NO: 17085 - DNA, 305 bp, Homo sapiens
  AC009532.2_63930
  Located on chromosome 11
  Distance between a terminus base of telomere on chromosomal short arm and 5'-terminus of this base sequence : 10395684
  Distance between 3'-terminus of neighbour sequence of sequence listing upward to telomere on chrosomal short arm and 5'-terminus of this base sequence : 10551
aaggctatgttggctaacttaagagaaagtaggatttattataaggtatttgagaaaatcaaaggaaaaggtaggtagccagcaatgcctcaggaaggcaggacccagggcagctttcagatcccagcagcaggaacttgccagccttttctctttattattattattattattattattattattattattattattatactttaagttttagggtacatgtgtacaatatgcaggttagttacatatgtatacatgtgccatgctggtgtgctgcacccattaactcgtcatttagcattagg

SEQ ID NO: 17086 - DNA, 150 bp, Homo sapiens
  G08896
  Located on chromosome 11
  Distance between a terminus base of telomere on chromosomal short arm and 5'-terminus of this base sequence : 10523678
  Distance between 3'-terminus of neighbour sequence of sequence listing upward to telomere on chrosomal short arm and 5'-terminus of this base sequence : 127689
tagcccaaatatcatgtgcaaacatactgataagaatgtaacttccatgattatggaaggaaggaaggaaggaaggaaggaaggaaggaaggaaggaaggaaggaagggtgggctggctgatttatggagcatctactaagtgacagtca

SEQ ID NO: 17087 - DNA, 233 bp, Homo sapiens
  chr11.fa.O7frz.11009005
  Located on chromosome 11
  Distance between a terminus base of telomere on chromosomal short arm and 5'-terminus of this base sequence : 10630094
  Distance between 3'-terminus of neighbour sequence of sequence listing upward to telomere on chrosomal short arm and 5'-terminus of this base sequence : 106266
cttctggtcacttggatacacacacacacacacacacacacacacacacacactccctcgccaaccgtccactcttccaggcgtccttctggtcacttggatcacctacacacacacacacacacacacacacacacacacacacacacacacaccacgtgcacacgctccctctccaaccctcctcgctctgccttcacctgcccctcaaagtcctgaatgacctcctagtt

SEQ ID NO: 17088 - DNA, 281 bp, Homo sapiens
  D11S1346
  Located on chromosome 11
  Distance between a terminus base of telomere on chromosomal short arm and 5'-terminus of this base sequence : 10859257
  Distance between 3'-terminus of neighbour sequence of sequence listing upward to telomere on chrosomal short arm and 5'-terminus of this base sequence : 228930
cccagggttgttgtgaagaataaatgagataatgtatgtaaatagtgtaaactggtgtgtgtgtgtgtgtgtgtgtgtgtgtgtgtgtgtgtgtgtggaatgcttattgtgcttattgtgtgtcaggcactatgttagtcattacacttacatacgatgcatatatatatgtatgtatgtatctcattactcttatacagaaatgagtagggcttctgggtgacgtgagtattgtctacacgacagaacccaaagtcaatcttaacgcctcttaatttggc

SEQ ID NO: 17089 - DNA, 110 bp, Homo sapiens
  DISD22_0002461
  Located on chromosome 11
  Distance between a terminus base of telomere on chromosomal short arm and 5'-terminus of this base sequence : 11007854
  Distance between 3'-terminus of neighbour sequence of sequence listing upward to telomere on chrosomal short arm and 5'-terminus of this base sequence : 148316
gacagctataggttgtatttggcccacagttgtggtgtgtgtgtgtgtgtgtgtgtgtgtgtgtgtgtgtgtgtgacacagtgtttgtttttccattggtatgtgcttgc

SEQ ID NO: 17090 - DNA, 424 bp, Homo sapiens
  AC023946.2_27932
  Located on chromosome 11
  Distance between a terminus base of telomere on chromosomal short arm and 5'-terminus of this base sequence : 11126322
  Distance between 3'-terminus of neighbour sequence of sequence listing upward to telomere on chrosomal short arm and 5'-terminus of this base sequence : 118358
cataaagtcttgctccataagacccataaagtccctgctcttaaggagccccattctaaggggtgtgtgtgtgtgtgtgtgtgtgtgtgtgtgtgtgtgtgtgtgtgtgtgtgtgttggagacaggagccccaacataaataataagtaggataattttaagtaatggtatatgctatgaggaaaacaggacacaaggctttggtagagggactgacaagggtcagttgagggtgctgatgttggctggttggggaaggttgtcctgtggcaagcaatgattgagctgagacttgcatgacaagaagggtctggccctgggtcacagcatcccatactgaagaaacagcaggtgcaaaggccctgaggtgggaatgagcctggaagcaggaaggcccatgtggctctagcagagtgagcaagag

SEQ ID NO: 17091 - DNA, 102 bp, Homo sapiens
  DISD22_0002469
  Located on chromosome 11
  Distance between a terminus base of telomere on chromosomal short arm and 5'-terminus of this base sequence : 11210019
  Distance between 3'-terminus of neighbour sequence of sequence listing upward to telomere on chrosomal short arm and 5'-terminus of this base sequence : 83273
ttcccagtgagagtggtggaatgtgtgtgtgtctgtgtgtgcatgtgtgtgtgtatgtgtgtgtgtgtgcatgcatgtgcacgagtatgcacagataacata

SEQ ID NO: 17092 - DNA, 280 bp, Homo sapiens
  D11S1349
  Located on chromosome 11
  Distance between a terminus base of telomere on chromosomal short arm and 5'-terminus of this base sequence : 11428596
  Distance between 3'-terminus of neighbour sequence of sequence listing upward to telomere on chrosomal short arm and 5'-terminus of this base sequence : 218475
ggacttttcatcccaaatctttcattctctctctgatctgtgtgtgtgtgtgtgtgtgtgtgtgtgtgtgtgtgtgtgtgtgtgtgtgtgtaatatagatagattctcctattggttctgtttctctggagaaccctggctaatacatctgctagggtggtattggaggttgttgaggatcagaagagagtagaggatgagaagagggagaaaagagaggtcacaaagaaggaaaagtacctgaatctctcctcttctctccttcactcaagtgctctct

SEQ ID NO: 17093 - DNA, 418 bp, Homo sapiens
  chr11.fa.O7frz.12183112
  Located on chromosome 11
  Distance between a terminus base of telomere on chromosomal short arm and 5'-terminus of this base sequence : 11520019
  Distance between 3'-terminus of neighbour sequence of sequence listing upward to telomere on chrosomal short arm and 5'-terminus of this base sequence : 91143
taacatttaataggccaggaacggtggctcacacctgtaatcctagcactttgggaggccaaagcaggcggatgacctgagctcaggaattcgagaccaacctgggtaacacggtgaaaccccgtctgcactaaaatacaaaataaattagccaggcgtggcagcatgcacctgtagtcccagctactcgggaggctgaggcaggagaattgcttaaacctgggaagtggaggttgccgtgagctgagatcgcgccactggactccagccttggtgacagagcaagactccgtctctacacacacacacacacacacacacacacacacatacacacacacacacactttaataaaggaaagtttgttctttcaatacttatcccaggcaccacctcctacttccaggaaatctttcc

SEQ ID NO: 17094 - DNA, 474 bp, Homo sapiens
  chr11.fa.O7frz.12393342
  Located on chromosome 11
  Distance between a terminus base of telomere on chromosomal short arm and 5'-terminus of this base sequence : 11647883
  Distance between 3'-terminus of neighbour sequence of sequence listing upward to telomere on chrosomal short arm and 5'-terminus of this base sequence : 127446
cttctatgaagcattgcataagactagtgttttttgtttgtttgtttgtttgtttgtttgtttgtcttttgacacagagtcttgctctgtcgcccaggctggagtacagttgcgatgatctcggctcactgcaacctccgcctcccaggttcaagtgattctcctgcctcagcctccctgagtagctgggactacaggtgcgtgccaccatgcccagctaatttttgtagttttagtagagacggggtttcgccatgttggccaggctggtctcgagctcctgatctcaggtgatccgcccgccttggcctcccaaagtgctgggaatataggcataagccaccgtgcctggccttttttttttttcttttttttgacagtctcactctgtcacccaggctggaatgcagtggcatgatctcagctcactgcaacctctgcttccaggttcaagtgattctcctacctcagttt

SEQ ID NO: 17095 - DNA, 136 bp, Homo sapiens
  DISO7_10003006
  Located on chromosome 11
  Distance between a terminus base of telomere on chromosomal short arm and 5'-terminus of this base sequence : 11942461
  Distance between 3'-terminus of neighbour sequence of sequence listing upward to telomere on chrosomal short arm and 5'-terminus of this base sequence : 294104
ctgaagatagtgcgcaggccctggagaagctgctgcagcctttcaaaagcacctccctgcgccaggcagctcctcctcctcctcctcctcctcctcctcctcctcctcctcctacagcgggaggtgcaggtaagtg

SEQ ID NO: 17096 - DNA, 117 bp, Homo sapiens
  DISO7_10003005
  Located on chromosome 11
  Distance between a terminus base of telomere on chromosomal short arm and 5'-terminus of this base sequence : 12007897
  Distance between 3'-terminus of neighbour sequence of sequence listing upward to telomere on chrosomal short arm and 5'-terminus of this base sequence : 65300
ttaggcaatatgaggaggcacctacctacctgcctacctatgaaaactgtaccacttctggatatttatctatttttatttatttgtgtattggtgagaattgataatatcatttcc

SEQ ID NO: 17097 - DNA, 192 bp, Homo sapiens
  chr11.fa.O7frz.13044687
  Located on chromosome 11
  Distance between a terminus base of telomere on chromosomal short arm and 5'-terminus of this base sequence : 12104690
  Distance between 3'-terminus of neighbour sequence of sequence listing upward to telomere on chrosomal short arm and 5'-terminus of this base sequence : 96676
ccatagtatttgttctaactccagcacagggccttgtacatagagggcactgattaatgaaataaacaagaaagaggataagttgatgggagaagtgtggacagatggatggatggatggatggacggacggacggacgagtttctaacatgcttaaccttttctcagagaataagctagttacctgagtga

SEQ ID NO: 17098 - DNA, 132 bp, Homo sapiens
  D11S1307
  Located on chromosome 11
  Distance between a terminus base of telomere on chromosomal short arm and 5'-terminus of this base sequence : 12331744
  Distance between 3'-terminus of neighbour sequence of sequence listing upward to telomere on chrosomal short arm and 5'-terminus of this base sequence : 226862
agaggccagcctgtgtgtgtgtgtctgtctgtctgtctgtgtgtccgtgtgtgtgtgtgtgtgtgtgtgtgtgtgtgtgtgtgttctcaaattcctagaacggacaccctttagtgtctgccacaacacaaa

SEQ ID NO: 17099 - DNA, 325 bp, Homo sapiens
  chr11.fa.O7frz.14888734
  Located on chromosome 11
  Distance between a terminus base of telomere on chromosomal short arm and 5'-terminus of this base sequence : 12342353
  Distance between 3'-terminus of neighbour sequence of sequence listing upward to telomere on chrosomal short arm and 5'-terminus of this base sequence : 10477
aatggtaatgtaggttccaaactatacttgtggagttatacatttgatcttggccaaaaggccaagaagcaatattgtgtgtgtgtgtgtgtgtgtgtgtgtgtgtgtgtgtgtgtgtgtgtagttatatattacaaaagcaaaatcactatatcagctgggacctgtaaaccagaatttaactgtaaagcaaggtgaatctgcatggccagctaacttggcagccaccttcactccacccacattgattttattttctagtgaaatatttcttcaagagcaaacagactgtcatcagacagtatctcattaccaggatctgata

SEQ ID NO: 17100 - DNA, 180 bp, Homo sapiens
  D11S4170
  Located on chromosome 11
  Distance between a terminus base of telomere on chromosomal short arm and 5'-terminus of this base sequence : 12448359
  Distance between 3'-terminus of neighbour sequence of sequence listing upward to telomere on chrosomal short arm and 5'-terminus of this base sequence : 105681
cacacatcattcctcagaagggccttcccaggccaccctatataaaatataaaatagcagctctgtttggtcttccaaataagttttagaatcagctagaaaaattaaacacacacacacacacacacacacacacacacacacacacattcagaatattgattgggattgcattaaatt

SEQ ID NO: 17101 - DNA, 460 bp, Homo sapiens
  chr11.fa.O7frz.15230862
  Located on chromosome 11
  Distance between a terminus base of telomere on chromosomal short arm and 5'-terminus of this base sequence : 12694334
  Distance between 3'-terminus of neighbour sequence of sequence listing upward to telomere on chrosomal short arm and 5'-terminus of this base sequence : 245795
  misc_feature (1)...(460): n = A,T,G or C
ctgaaagtacatactcaggcagaagaaatgaatgagatcaagaaggtatactaatgataaatataggtaaaactaaacaaacactgttattataagacattattaacaatgtcttctaagagaacagactagaactaaagtgctagaaaacaatagcatttacattggaaagaagaaattagaagagtatgttaaaaagttatatttcaaggggagggctaagagtttgactttaaatcttgtttatatatacacagcagctgtctacacacacacacacacacacacacacacacacacacacacacacagagctagtgcaactgctgaaagagtagatattgtgtgaatggcttccaaacaaatagaggtgacaaaagaattgagggaaaaaaggagaccaaatnaattaatatcagagaaaaaaggaggtcaaaaaaggaaacttagcgaacaggac

SEQ ID NO: 17102 - DNA, 448 bp, Homo sapiens
  AC018795.5_135193
  Located on chromosome 11
  Distance between a terminus base of telomere on chromosomal short arm and 5'-terminus of this base sequence : 12775665
  Distance between 3'-terminus of neighbour sequence of sequence listing upward to telomere on chrosomal short arm and 5'-terminus of this base sequence : 80871
atttagtctggatgaatcacataggggataatgacagtgaggaagagaacacggaagcatatttagagtcctcacaaaaaatctggatgtgctgggaataataggttgtgtgtgtgtgtgtgtgtgtgtgtgtgtgtgtgtgtgactccttattgttgattgacacagtggaacaatgaaggaagatagtagaagacaagtaatctagttttacctgtgctcttctctcttgcaaggtagaaggctaagcctttgatccaggctggaggccctgaaactgggattgataggatgggcttattactgtggccctgaactgaagcccagttgagggcggcctgggaagcaaggcatgaacacagccttgataaacaaaatgagtaaaggatgcacagttaagagccaaaaagagaatagcctgaacgtgtagaaggaaactaaagctaca

SEQ ID NO: 17103 - DNA, 275 bp, Homo sapiens
  AC025730.6_54044
  Located on chromosome 11
  Distance between a terminus base of telomere on chromosomal short arm and 5'-terminus of this base sequence : 12946178
  Distance between 3'-terminus of neighbour sequence of sequence listing upward to telomere on chrosomal short arm and 5'-terminus of this base sequence : 170065
tctacgttcaggtgaagctacggagctcagtccctacagacagccggagccttgggctgtgtacctgtcattaaatgttcctgggactaggaacgtgcagagcaagtgtgtatgtgtgtgtgtgtgtgtgtgtgtgtgtgtgtgtgtgtctgggctattgaaataacgaccttgccccgggaaagataaccccagctgtctaagtgcctaaggagggagacagtgagcctgccttcttcagccatattgggcagaaagccttcatggtagactag

SEQ ID NO: 17104 - DNA, 460 bp, Homo sapiens
  chr11.fa.O7frz.15529510
  Located on chromosome 11
  Distance between a terminus base of telomere on chromosomal short arm and 5'-terminus of this base sequence : 13016485
  Distance between 3'-terminus of neighbour sequence of sequence listing upward to telomere on chrosomal short arm and 5'-terminus of this base sequence : 70032
tacagcctggtgactatagttaacatatgcttgaaatttgcaaagagagtagatctcaagagctctaagcgcacacacacacacacacacacaggaaactatgtgaggtaatgatatgttaattaacttgattgttgcaatcatttcacaaagtatacatgtatcaaaatatcatattgtataccttaaaaataaaaacctttaatatggaaataaaagtgaaaaaaaaaaagagtgagagacagctgaaattccccagtgggaattttgctgaagactttagaagaggggcatctgtataaatactgaagaggatatcaatgttttactaataacctagatatagaattatctaaaagatgttgcatgtgcagtaagtatgaaaagtcatataaatcatattaaattgaaacaaagaaaagatattataaatattataactaccatcaactaagttcca

SEQ ID NO: 17105 - DNA, 228 bp, Homo sapiens
  Z67364
  Located on chromosome 11
  Distance between a terminus base of telomere on chromosomal short arm and 5'-terminus of this base sequence : 13242364
  Distance between 3'-terminus of neighbour sequence of sequence listing upward to telomere on chrosomal short arm and 5'-terminus of this base sequence : 225419
agctgcgatgattgtttttaaaagggttatatcacacacacacacacacacacacacacacacacacacaaacaggagtaaacgagtgaaaatgatgatgtgaatttaggctgaattattttacccatccggacttcagtttttttgatcaaaaaatgggaggaaatggtagtactaatataaatgaaacattttttttgcctgcctcctgcagcagttggaagaatc

SEQ ID NO: 17106 - DNA, 112 bp, Homo sapiens
  D11S4121
  Located on chromosome 11
  Distance between a terminus base of telomere on chromosomal short arm and 5'-terminus of this base sequence : 13323523
  Distance between 3'-terminus of neighbour sequence of sequence listing upward to telomere on chrosomal short arm and 5'-terminus of this base sequence : 80931
tcagttgttctcagtgtagtttatgtgtgtgtgtgtgtgtgtgtgtgtgtgtgtgtgtgtgtgtatgtgtgtgttcttgttccagaggatggatccatctggggtgggaggt

SEQ ID NO: 17107 - DNA, 290 bp, Homo sapiens
  HUMUT5042
  Located on chromosome 11
  Distance between a terminus base of telomere on chromosomal short arm and 5'-terminus of this base sequence : 13484845
  Distance between 3'-terminus of neighbour sequence of sequence listing upward to telomere on chrosomal short arm and 5'-terminus of this base sequence : 161210
cacactatcctccttactgtttattattgttgctatacaataagtcttaaaattgagtagtgtgatttcctccaacttcattattctttttcagtattactttagctattctagttcctttgtctctctatatataaatttgagaattagcttatctatctatctatctatctgtctatctatctatctatctatctatctatctatctatctataaaactgccattttggccaggcacagtggctcacacttgtaatccccacactttgagaggccaagaagggagaat

SEQ ID NO: 17108 - DNA, 102 bp, Homo sapiens
  DISD22_0002475
  Located on chromosome 11
  Distance between a terminus base of telomere on chromosomal short arm and 5'-terminus of this base sequence : 13635979
  Distance between 3'-terminus of neighbour sequence of sequence listing upward to telomere on chrosomal short arm and 5'-terminus of this base sequence : 150844
ttgtcattgttataagcctgtgtgtgtgcgcgcacacacacacacacacacacacacacacacacacaccaggattctaccacacaagacagcacctgactt

SEQ ID NO: 17109 - DNA, 284 bp, Homo sapiens
  chr11.fa.O7frz.14397809
  Located on chromosome 11
  Distance between a terminus base of telomere on chromosomal short arm and 5'-terminus of this base sequence : 13809908
  Distance between 3'-terminus of neighbour sequence of sequence listing upward to telomere on chrosomal short arm and 5'-terminus of this base sequence : 173827
gagtgataccatatggaccatagcccttctttctcaatctaactgcagaaacaaaattaaacattatattacagttctccagagaaacagaccaacaggagatagataaatgagagactagatagatagatagatagatagatagatagatagatagatagataatacatttttttttgaggaattggctcacatgattatggaggctgagaagttccacaatctgccatctgcaaaccggagacccaggagacccagtggtgtagttctagttgaattccaaa

SEQ ID NO: 17110 - DNA, 442 bp, Homo sapiens
  AC022878.3_60997
  Located on chromosome 11
  Distance between a terminus base of telomere on chromosomal short arm and 5'-terminus of this base sequence : 14018464
  Distance between 3'-terminus of neighbour sequence of sequence listing upward to telomere on chrosomal short arm and 5'-terminus of this base sequence : 208272
ttactaggccatgacatactttagccactccatgaagagtatacattggtaaagcctttttggaggtcattaagtaatagcagtcaatatttaaatgtaggtaccctttaactcagcaacttcctctctagacattggttcacgaagatacacataggaggtgaaaaactggaaactacctaaacggtctattaaagagggactataatagatcaacacaatagaacactacagaagttttaaaaaatgaaggagcttttctttactgacacggagagacttctaacatacaatgtttagtgaaatgaaggcaagtcacagacacacacacacacacacacacacacacactcatccattcacaaatatacacaggaaaatgcatgtcagaaagcctggaaggacctatgagaaaatgttaacagtggttaccaaattactt

SEQ ID NO: 17111 - DNA, 309 bp, Homo sapiens
  chr11.fa.O7frz.13624305
  Located on chromosome 11
  Distance between a terminus base of telomere on chromosomal short arm and 5'-terminus of this base sequence : 14097298
  Distance between 3'-terminus of neighbour sequence of sequence listing upward to telomere on chrosomal short arm and 5'-terminus of this base sequence : 78392
tgacagctgataagtggtagatccaggcttaaaataaggccatgggagctctcgaccactggcactggacttggctgtttcccagcagtctctagatgcaggatttgggtttgattggggattttcttttttctttctttctttctttctttttttttcttttttttttttttgtgatggacactgagattgggggttttagagtcatgagctggaaataggcaaggctctatttagcccactctttcattttgcagttggggaaactcagtgaggttaagtggcaagtcggagtttacctagtgagtc

SEQ ID NO: 17112 - DNA, 129 bp, Homo sapiens
  D11S926
  Located on chromosome 11
  Distance between a terminus base of telomere on chromosomal short arm and 5'-terminus of this base sequence : 14239950
  Distance between 3'-terminus of neighbour sequence of sequence listing upward to telomere on chrosomal short arm and 5'-terminus of this base sequence : 142343
tgagtgtgatgtatatgctcattatcctaattatggtaaggttttatggagatacatacacacacacacacacacacacacacacagatatatatatatagcaaattgtacaccagaattgacctcttg

SEQ ID NO: 17113 - DNA, 295 bp, Homo sapiens
  AC026843.2_110187
  Located on chromosome 11
  Distance between a terminus base of telomere on chromosomal short arm and 5'-terminus of this base sequence : 14430275
  Distance between 3'-terminus of neighbour sequence of sequence listing upward to telomere on chrosomal short arm and 5'-terminus of this base sequence : 190196
tgtaatgatactttaaccttgaagaagaaaggggccttaaaaagggagaaaacaatctcatggtcttttgcttattaacatacagtgcagcgagatacatatgttttatatatatatatatatatatatatttctcacatttagtttctatatgagatatataacatagtaatgtctttaagaaaatatactgatgtattatatgctttaatatattaaaataaagacactaatatattaataaagagctaacatttattgagggcttaatatgtgctagatgctgttctaagaa

SEQ ID NO: 17114 - DNA, 325 bp, Homo sapiens
  chr11.fa.O7frz.14073180
  Located on chromosome 11
  Distance between a terminus base of telomere on chromosomal short arm and 5'-terminus of this base sequence : 14459244
  Distance between 3'-terminus of neighbour sequence of sequence listing upward to telomere on chrosomal short arm and 5'-terminus of this base sequence : 28674
attacagatacttgctgccacacctggcctatcctttattttctgtcagtttaattttatctataccatccttctcttcctcctcctcctcctcctcctccttctccttctgtcttgccctgagcccaggctggagtgcagtggagccatcatatctcactgtaacctgaaactcctgggctcaagcactgctcccatctcaggctcccgagtagcaaggactacaggcatgtgtcaccatgcctgactaattttgcttatttgtttatttgttttttttagagatggggtcttgctttgttacctatactagtctcaaactcgg

SEQ ID NO: 17115 - DNA, 310 bp, Homo sapiens
  AC074374.3_115089
  Located on chromosome 11
  Distance between a terminus base of telomere on chromosomal short arm and 5'-terminus of this base sequence : 14531657
  Distance between 3'-terminus of neighbour sequence of sequence listing upward to telomere on chrosomal short arm and 5'-terminus of this base sequence : 72088
tttcaccatgttagccaagctgctggtctggaactcctgacctcaggtgatctgcccacctcagcctccccaagtgctgggattacaggcgtgagccatcacacccggcacagttctctatttaaaccccatgttgagatactcttttgttcatttagtttttatttagatttctccctctctctctctctctatatatatatatatatataaaatatgtatatatgtataccaatatctgtgctttcagattttctccttatgatcttctttctgcctgaaatatattcagcatacctagaatatgttt

SEQ ID NO: 17116 - DNA, 207 bp, Homo sapiens
  D11S4116
  Located on chromosome 11
  Distance between a terminus base of telomere on chromosomal short arm and 5'-terminus of this base sequence : 14811063
  Distance between 3'-terminus of neighbour sequence of sequence listing upward to telomere on chrosomal short arm and 5'-terminus of this base sequence : 279096
aactggtcctttagacagacaaaataaactcttcacacaattaaaaaggagaaaaaggaaaagtggcaagaccacaattacagtacaaattagaagatacataagagattatttcacataaccctaaacacacacacacacacacacacacacacacacacacacacacggcgaagcaaagaaaacacagcagatagagatgctttc

SEQ ID NO: 17117 - DNA, 136 bp, Homo sapiens
  D11S1334
  Located on chromosome 11
  Distance between a terminus base of telomere on chromosomal short arm and 5'-terminus of this base sequence : 14882772
  Distance between 3'-terminus of neighbour sequence of sequence listing upward to telomere on chrosomal short arm and 5'-terminus of this base sequence : 71502
tgcagcatagtcctgttgcagccatgatcttctaacacacacacacacacacacacacacacacacacagagacagagagagagagatgcttgattcagtaaacctgatgctacaaaaatgactttcaataaagct

SEQ ID NO: 17118 - DNA, 158 bp, Homo sapiens
  D11S1315
  Located on chromosome 11
  Distance between a terminus base of telomere on chromosomal short arm and 5'-terminus of this base sequence : 14957226
  Distance between 3'-terminus of neighbour sequence of sequence listing upward to telomere on chrosomal short arm and 5'-terminus of this base sequence : 74318
aaaagcgcaaaaactaaaactctggcctttgtcatacagtgatttaaaaagaaagtgcgcgcacacacacacacacacacacacacacacacacacaaagtcttacctggtttagtgacttctagacacaaaaactctggcttttatcacactgacgg

SEQ ID NO: 17119 - DNA, 256 bp, Homo sapiens
  D11S1791
  Located on chromosome 11
  Distance between a terminus base of telomere on chromosomal short arm and 5'-terminus of this base sequence : 15055244
  Distance between 3'-terminus of neighbour sequence of sequence listing upward to telomere on chrosomal short arm and 5'-terminus of this base sequence : 97860
tctcagatgcctcacagtgtgtgtgtgtgtgtgtgtgtgtgtgtgtgtgtgtaatgcatcttcattgtgggtatagagcctcttgaatctgtgggatgatagttttctttagttttgaaaaactcttagccagtattgcttcaaatactgcttcttccaaattatctttcctctctttatgacacaacaaattcttctatgctagatctttttgaaacttcccaatatattttttcatggggtcattacttttcat

SEQ ID NO: 17120 - DNA, 211 bp, Homo sapiens
  AC073172.1_64640
  Located on chromosome 11
  Distance between a terminus base of telomere on chromosomal short arm and 5'-terminus of this base sequence : 15191429
  Distance between 3'-terminus of neighbour sequence of sequence listing upward to telomere on chrosomal short arm and 5'-terminus of this base sequence : 135929
tcagctttcaagctacatttactataataaaaaaggaaaaaaaaatctccaagtgcacacaggtgaaaaaagtcaccctctcatggaaactggcctcaatacagaaaaagagatacacacacacacacacacacacacccctgcttgcacaatccatggatgagtctccagagtcctttcttttgtatagaaaagttctacgatcttatgg

SEQ ID NO: 17121 - DNA, 427 bp, Homo sapiens
  chr11.fa.O7frz.16312105
  Located on chromosome 11
  Distance between a terminus base of telomere on chromosomal short arm and 5'-terminus of this base sequence : 15379323
  Distance between 3'-terminus of neighbour sequence of sequence listing upward to telomere on chrosomal short arm and 5'-terminus of this base sequence : 187683
cataaatagccaataggtcctctccataccccacaaagaacttagaaacgaatcatccttctggtaattgcattaaccgaatgtttttgtttgtttgtttaatttaagagttaaaacagaatgaccttgtctttgaaattgtgaaataacaattagaagttatttgcttatatttatatttagaattaaaggatattcatatgaacaagtacaaaacaggggtgatggggttggcaagggaatgagggccttcatagagatggattattgttcattcaactgtaatgattaacaattaaaaatccactcttgcagttccccatgtcaggggaaggatagaagtttttgttgttgttttttttgttttttttttttttggtgttttgttttgttttgttttgttttgtctgaaacaataagtaacctc

SEQ ID NO: 17122 - DNA, 263 bp, Homo sapiens
  chr11.fa.O7frz.16424673
  Located on chromosome 11
  Distance between a terminus base of telomere on chromosomal short arm and 5'-terminus of this base sequence : 15492118
  Distance between 3'-terminus of neighbour sequence of sequence listing upward to telomere on chrosomal short arm and 5'-terminus of this base sequence : 112368
ctagatccagcaagtttaacatctgaatattatatgtttctgagaacaatatagagatacctagcacagcacaatgtgtaaacatatacacaccaagacacatcattatgaaattttaatacactggaggcaacaagactctacgagttatgagagagaaagagagagagagagagagagacagagacagagagagaaatattgcaaaccaaggaacaagaatcagaatggcatcatacatttcattagctacactgtaagct

SEQ ID NO: 17123 - DNA, 442 bp, Homo sapiens
  AC009869.4_19462
  Located on chromosome 11
  Distance between a terminus base of telomere on chromosomal short arm and 5'-terminus of this base sequence : 15517398
  Distance between 3'-terminus of neighbour sequence of sequence listing upward to telomere on chrosomal short arm and 5'-terminus of this base sequence : 25017
tatgagtctagaatttaggagcaaagggctcactggagatataaatatatatctatatataatatagatattatatataacatatcagcattatatataatatatattatatataacatataagcattatatataatatatattatatataatatatataagcattatatattatatattatatataaaataagcatatataatgcttattttatatatatgagcatatatataagcatatatacatgcttattttatatatataactgcttattttatatatattttacatatatatatatatatatatataaaactgcttatttgatttggatttctaaatgctgtctcaacctcataggtgcagaacttaaagtcctgatcattctcccacatacctgcccctctcatggccatcctgttcttggttaatgattacttc

SEQ ID NO: 17124 - DNA, 391 bp, Homo sapiens
  AC068405.2_28675
  Located on chromosome 11
  Distance between a terminus base of telomere on chromosomal short arm and 5'-terminus of this base sequence : 15697259
  Distance between 3'-terminus of neighbour sequence of sequence listing upward to telomere on chrosomal short arm and 5'-terminus of this base sequence : 179419
aaagatcttggtgaatgtgatatgggaattgatataaaattttgctctatgtgaactgactcatcattattattatgactacacactttttcaatttatatttgccaaagtatttctctacacattaactctaataattcttgcattagtcctatgtgcttgaagttacaggtgtgtgtgtgtgtgtgtgtgtgtgtgtgtgtatctgtgtgtttgttatctttttacagaaaagtctcacaaaggttaaatgattcatccaagatcacatgccaaatagatagcagagccagactttgaaattattattttcaccattttccatctcctttctttgcaggagaaagacaatgcaaatagtcccaataagctcaccttatacctaaatcat

SEQ ID NO: 17125 - DNA, 144 bp, Homo sapiens
  D11S1397
  Located on chromosome 11
  Distance between a terminus base of telomere on chromosomal short arm and 5'-terminus of this base sequence : 15714584
  Distance between 3'-terminus of neighbour sequence of sequence listing upward to telomere on chrosomal short arm and 5'-terminus of this base sequence : 16934
aggtatactccaaccctcaggatggatggatggacggacagacggacggacggatggatggatggatggatggatggatggatggatggatgagacagagagagagagagagagagattcaacctaaatctaaacaacttagca

SEQ ID NO: 17126 - DNA, 457 bp, Homo sapiens
  chr11.fa.O7frz.16818435
  Located on chromosome 11
  Distance between a terminus base of telomere on chromosomal short arm and 5'-terminus of this base sequence : 15912212
  Distance between 3'-terminus of neighbour sequence of sequence listing upward to telomere on chrosomal short arm and 5'-terminus of this base sequence : 197484
ttctggttgatatgtgcttaactctaatccttaagaataaaagtaaacaacaaatacattgaataaacacatatgtgtatacatattatatgttctgaacattattaggtcataaccatgctgaaatgaaaagaaagggggagggagggagggagagaggaaggaaggaaggaaggaaggaaggaaggaaggaaggaaggaaggaaggaaggaaggaaggaagggagggagggaggaagggagggagaaggggaagggagggagaaggggaagggaagaaggaaggaagctaacttatctttattaatacagaaatgtagccctcagtatagctaataaatactcaaggctgtacatcattgacccatctttaactcaatacagttactacagcttccatgcagatattatctcaaaatattatgctatatcatactgacttaagtcataaagccaa

SEQ ID NO: 17127 - DNA, 161 bp, Homo sapiens
  D11S1981
  Located on chromosome 11
  Distance between a terminus base of telomere on chromosomal short arm and 5'-terminus of this base sequence : 16066207
  Distance between 3'-terminus of neighbour sequence of sequence listing upward to telomere on chrosomal short arm and 5'-terminus of this base sequence : 153538
gattcctttactccagaaagggaagaagaagagatggatacataggtaggtaggtaggtaggtaggtaggtaggtaggtaggtagatagatagatagatagatagatagatagatagatagatagagattcctgagctctgtctgggaaagcagaaatctg

SEQ ID NO: 17128 - DNA, 386 bp, Homo sapiens
  chr11.fa.O7frz.17055872
  Located on chromosome 11
  Distance between a terminus base of telomere on chromosomal short arm and 5'-terminus of this base sequence : 16167598
  Distance between 3'-terminus of neighbour sequence of sequence listing upward to telomere on chrosomal short arm and 5'-terminus of this base sequence : 101230
tacataggaaagttctttagtggtgatttgtgagattttggtgcacccatcacctaagcagtatacaccgcaccacatgtgtagtcttttatccctcatccccctctcacacttccccgcaaatccccgaagtccatcatatcattcttatgcctttgcatcctcataatttagctcccacatatcagtgagaacagatgatgtttggttttccattcctgagttacttcacttagaataatagtctccaatctcagccaggtcactgcaaatgctgttaattcattcctttttatggctgagtagtattccatacacacacacacacacacacacacacacacacacacacacacaccacagtttctttaaccactcattgagtg

SEQ ID NO: 17129 - DNA, 453 bp, Homo sapiens
  chr11.fa.O7frz.17140471
  Located on chromosome 11
  Distance between a terminus base of telomere on chromosomal short arm and 5'-terminus of this base sequence : 16237636
  Distance between 3'-terminus of neighbour sequence of sequence listing upward to telomere on chrosomal short arm and 5'-terminus of this base sequence : 69652
acatccttggctacttctagacactttggccagggttggagaattggtaggggccatgacaccacttcaggctctatggctgttccctccccagaagaagcacacctggccaggagcaccacccagacacacagtggcctctgcactgggggagaaatggtactgggtgaattgtgaaggcacaaggcacacacaagcaggtgagctgtgagtggaaggaggagcctgcggtctccttcctggctgagagaaagagcagcccttttatacacagacacacacacatacacacagtcacacacacacagacacacagacacacatacacacacacatagacacacattgagacacacggacacacacacacccacacacacacgttctcatcccatggtgttatttttttccaattggactgcaaagtcccactttccaagtcctgtactttct

SEQ ID NO: 17130 - DNA, 178 bp, Homo sapiens
  D11S4099
  Located on chromosome 11
  Distance between a terminus base of telomere on chromosomal short arm and 5'-terminus of this base sequence : 16348153
  Distance between 3'-terminus of neighbour sequence of sequence listing upward to telomere on chrosomal short arm and 5'-terminus of this base sequence : 110064
cagagcaatggctaaaaacttatagccaactcccagaagcctagcagcaagagtaggtggtcacagccatgcaggagaggttgttttattttgtgtgtgtgtgtgtgtgtgtgtgtgtgttttgttttgttttgttttgttttgttttgagataaagtatcactctgtcacccaggat

SEQ ID NO: 17131 - DNA, 164 bp, Homo sapiens
  D11S1890
  Located on chromosome 11
  Distance between a terminus base of telomere on chromosomal short arm and 5'-terminus of this base sequence : 16438908
  Distance between 3'-terminus of neighbour sequence of sequence listing upward to telomere on chrosomal short arm and 5'-terminus of this base sequence : 90577
cctctcagacttcacctccctcactatcccctacacacacacacacacacacacacacacacacggagaaagagagacagagagagagagggagagagagagagagaaactcccaactactccagagatactgaactatctaggattcctggactccacacact

SEQ ID NO: 17132 - DNA, 249 bp, Homo sapiens
  D11S4160
  Located on chromosome 11
  Distance between a terminus base of telomere on chromosomal short arm and 5'-terminus of this base sequence : 16480405
  Distance between 3'-terminus of neighbour sequence of sequence listing upward to telomere on chrosomal short arm and 5'-terminus of this base sequence : 41333
cttttggcataggaggctcctcttcctctccccataccccaacacacacacacacacacacacacacacacacacatccaacacatgccttgctcacaccctccaatggctcttggactaatttcttcaggagggggagaaaaaagttaagaggcccaaacacttctttttttgttttgttttacttttgaggcagggtctttctctgtcccctaggctggagtacagtggtgccatatcagctcgctg

SEQ ID NO: 17133 - DNA, 369 bp, Homo sapiens
  chr11.fa.O7frz.17505992
  Located on chromosome 11
  Distance between a terminus base of telomere on chromosomal short arm and 5'-terminus of this base sequence : 16575259
  Distance between 3'-terminus of neighbour sequence of sequence listing upward to telomere on chrosomal short arm and 5'-terminus of this base sequence : 94605
gatcctatccatgtggtatgtagagatgtgggtttctttttttctacttttttatgtgcttctttttagaaacttatacacacacacacacacacacacacacacacacacatatatgaaattacttgaaggtgatcaactaccatggacctaattttgtctgaggcttctatttattttacccatttgatggataaaggagcagacaatagatgggagaggagtcagtttagataattataagcacttttttgagtcaccaaccaagtggtaataaatacagttctagatttttttctttaaggatattcttatgttgttttagagcaactaatggaaaaatactgtacttgtcacttctagatttca

SEQ ID NO: 17134 - DNA, 271 bp, Homo sapiens
  Z67656
  Located on chromosome 11
  Distance between a terminus base of telomere on chromosomal short arm and 5'-terminus of this base sequence : 16750605
  Distance between 3'-terminus of neighbour sequence of sequence listing upward to telomere on chrosomal short arm and 5'-terminus of this base sequence : 174977
gtcacgccacagcactctagccagggtgacagagtgagaacatgtctcaaaaaataaaatttccattcatacacagaggcagatttcttagctactgatttatacccatagttatacagattaagtttgctttgtgtgtgtgtgtgtgtgtgtgtgtgtgtgtgtacgcacacgtgcgcgcatgtatgtgtgatggtttcctgttttgattgttgggcaagatatcctggaagtggttaaaaaaaattaccatagataaccagggtgaaaa

SEQ ID NO: 17135 - DNA, 147 bp, Homo sapiens
  D11S902
  Located on chromosome 11
  Distance between a terminus base of telomere on chromosomal short arm and 5'-terminus of this base sequence : 16988503
  Distance between 3'-terminus of neighbour sequence of sequence listing upward to telomere on chrosomal short arm and 5'-terminus of this base sequence : 237627
cccggctgtgaatatacttaatgccacagaacactatacttaaaaacagttaagatgataaattttatgttaaacatgttaaaccacacacacacacacacacacacacacacacacacacacacacaacttcccattgctgttggg

SEQ ID NO: 17136 - DNA, 366 bp, Homo sapiens
  chr11.fa.O7frz.17935326
  Located on chromosome 11
  Distance between a terminus base of telomere on chromosomal short arm and 5'-terminus of this base sequence : 17068030
  Distance between 3'-terminus of neighbour sequence of sequence listing upward to telomere on chrosomal short arm and 5'-terminus of this base sequence : 79380
tttaccactatatgcctagaacagtgcatggcatggaatcaatgccaaacaaatttgttgagtgaatgaatgaatgaatgaatgaatgaatgcatctcaaatctatacccttgcctagaagtctactggggccaataccaccacgaccaccaccaccaccatcatcatcatcctctgtaagacctagcatctagttggtgttccctaagtgatgacgaagtgaatgatgtacagattccccaggtgctcagtcccatgtttttgccattttaaaattcctcctgggcagacagtggacctcgttcacacatataaagttgttttgtcaaagtttggccttgatggtggcaataacataggagtatg

SEQ ID NO: 17137 - DNA, 205 bp, Homo sapiens
  D11S4138
  Located on chromosome 11
  Distance between a terminus base of telomere on chromosomal short arm and 5'-terminus of this base sequence : 17239182
  Distance between 3'-terminus of neighbour sequence of sequence listing upward to telomere on chrosomal short arm and 5'-terminus of this base sequence : 170786
ccaaaggggttaataggggtccaggattgattgttagtggagggcgtagaggataacgtggtgtgtgtgtgtgtgtgtgtgtgtgtgtgtgtgtgtgtgtgtgtgtgttggggttcatgcaagacattacccatggaaggaacatggggcctccaggttccgcgagaagggtcggtattaaaggattccttggagcggtcagcac

SEQ ID NO: 17138 - DNA, 275 bp, Homo sapiens
  D11S4130
  Located on chromosome 11
  Distance between a terminus base of telomere on chromosomal short arm and 5'-terminus of this base sequence : 17244652
  Distance between 3'-terminus of neighbour sequence of sequence listing upward to telomere on chrosomal short arm and 5'-terminus of this base sequence : 5265
agctcatgtgtgagtctgtgtgtgtgtgtgtgtgtgtgtgtgtacatgcgtgtacacataaggcaggaggctgtgtggggtgggggtccctgtgtgtgacagactgtatgtgaaggtgtgtgtaagacagagattgtgtgtgaaatcctgtgtgtgacagtgtacgtgatgtgtgtgagaacccacgtgtgtgtcagtgtgctgtgtgtatgtgagagagaggtcctgtgcatcccgagtgtgtgtgtgcttgaggaagatgagattccagagct

SEQ ID NO: 17139 - DNA, 221 bp, Homo sapiens
  D11S1888
  Located on chromosome 11
  Distance between a terminus base of telomere on chromosomal short arm and 5'-terminus of this base sequence : 17261380
  Distance between 3'-terminus of neighbour sequence of sequence listing upward to telomere on chrosomal short arm and 5'-terminus of this base sequence : 16453
acccagtaccctgtataggcctggaataagatgtaaatatttgttagagggacacaggtgggcagtcaactgtggtcccacctgggttttgtccattaccctccctgagccatttttattcccttccctccaaacacacacacacacacacacacacacacacacacacacgcatgtacattgggagtcaggacccctgactcgatacaaacacacaagtg

SEQ ID NO: 17140 - DNA, 212 bp, Homo sapiens
  chr11.fa.O7frz.18530169
  Located on chromosome 11
  Distance between a terminus base of telomere on chromosomal short arm and 5'-terminus of this base sequence : 17378523
  Distance between 3'-terminus of neighbour sequence of sequence listing upward to telomere on chrosomal short arm and 5'-terminus of this base sequence : 116922
aaggttagatgttctgccatacatattataaaggtacaatggttcaacagttgaaaatcatctgtgaaatgaaaaaaaaatccatgcatatattatagctccaatttagtaaaagaactggctctgcttggaggaggaggaggaggaggaggaggaggaggaggcatcacactttcctgccaataaccaaccctttaacaatgcctgtctgg

SEQ ID NO: 17141 - DNA, 362 bp, Homo sapiens
  AC068212.2_140406
  Located on chromosome 11
  Distance between a terminus base of telomere on chromosomal short arm and 5'-terminus of this base sequence : 17393514
  Distance between 3'-terminus of neighbour sequence of sequence listing upward to telomere on chrosomal short arm and 5'-terminus of this base sequence : 14779
tcactgtagttgaaggaaacacaaatatagaatgagagaaggcaaagagaaaccctgtggatatcaggttagaattagagttatcagtatgaactcacagttttacacacacacacacacacacacacacacacacacacacacacacacacacgcattgagttaaaccaacatgaaattgcccagcagcactgacaccccagcagcaatgagtttacttggtgcacagaccctggcttttaaataccattcaactaagagggatcagagctcctcggagaaaaggctgattctagggttgggatgaggaaagaacagtttgagcctggaacatgtatttgtaccacgaagtaagaaagtga

SEQ ID NO: 17142 - DNA, 209 bp, Homo sapiens
  D11S1310
  Located on chromosome 11
  Distance between a terminus base of telomere on chromosomal short arm and 5'-terminus of this base sequence : 17423096
  Distance between 3'-terminus of neighbour sequence of sequence listing upward to telomere on chrosomal short arm and 5'-terminus of this base sequence : 29220
ggcctgggaaacatccattcattccctcattcaaagatttactgcctcctatggaaaaggtgctgtgccaggtgctgtaggtgaaaatgtccccatgacttaaggaattcataatcagtaagataaataaagcaggaacagacacacacacacacatacacacacactctctctctctctctctttctctccccctacctactggaagt

SEQ ID NO: 17143 - DNA, 302 bp, Homo sapiens
  AC055860.2_1323
  Located on chromosome 11
  Distance between a terminus base of telomere on chromosomal short arm and 5'-terminus of this base sequence : 17515470
  Distance between 3'-terminus of neighbour sequence of sequence listing upward to telomere on chrosomal short arm and 5'-terminus of this base sequence : 92165
ctgaggttcaaattacggtaccaatttttgtaacactgtgagaggccctaaatccaggataaagcaagacgaagggaaatttaacacaacctattacaactgttgtttgcctttcttcctcacaaacactccagacatatcacacgtgcacatgcacacatacacacacacacacacacacacacacacacacacacacacccctaacaaggtaaatccccttcctgtgaaccgaactttattcccccaaaattcacgtgttgaagccctaacctttagtaccttactgtatttggaaagaa

SEQ ID NO: 17144 - DNA, 343 bp, Homo sapiens
  chr11.fa.O7frz.18769024
  Located on chromosome 11
  Distance between a terminus base of telomere on chromosomal short arm and 5'-terminus of this base sequence : 17710306
  Distance between 3'-terminus of neighbour sequence of sequence listing upward to telomere on chrosomal short arm and 5'-terminus of this base sequence : 194534
atacgtactaggcactgtttaaatgtactaatgaattggtttccatcatttagtcctatgatgcaagcagcattatcccttaacagagaagctaacacacacacacacacacacacactaacacacacacacacacacacacacacacaaaccccaagatacgtaaagaagttccaaagcagagcaggattaacccaggcagtcttgctctgcagaacttgctcttaatcaaggtactctgctgctttcaaaacaagagtttcggatttgtgaacacatagctcatcctttatctaagaaatggcaaataggatgtggtgcctttggaaggtaagtctagctc

SEQ ID NO: 17145 - DNA, 189 bp, Homo sapiens
  DISD22_0003486
  Located on chromosome 11
  Distance between a terminus base of telomere on chromosomal short arm and 5'-terminus of this base sequence : 17850093
  Distance between 3'-terminus of neighbour sequence of sequence listing upward to telomere on chrosomal short arm and 5'-terminus of this base sequence : 139444
aaagtaccaggcacagtggtaaaaataagacaagtaaaataattccagaagtcagtcagtttataatacggaggaaaagacaaataccacacacacacacacacacacacacacacacacacacacatcttataagggaaacataagcaaactgctttgttagaactttacaggacagagggatcacat

SEQ ID NO: 17146 - DNA, 125 bp, Homo sapiens
  DISD22_0003489
  Located on chromosome 11
  Distance between a terminus base of telomere on chromosomal short arm and 5'-terminus of this base sequence : 17931301
  Distance between 3'-terminus of neighbour sequence of sequence listing upward to telomere on chrosomal short arm and 5'-terminus of this base sequence : 81019
ttgttaagtgtaaagctgtctctgcttaaaaacaagtccccctaccaccaccaccacacacacacacacacacacacacacacacacacacacacacacacacacacgaaattgcctgttcctgg

SEQ ID NO: 17147 - DNA, 471 bp, Homo sapiens
  chr11.fa.O7frz.19267251
  Located on chromosome 11
  Distance between a terminus base of telomere on chromosomal short arm and 5'-terminus of this base sequence : 18211981
  Distance between 3'-terminus of neighbour sequence of sequence listing upward to telomere on chrosomal short arm and 5'-terminus of this base sequence : 280555
cagtacaacggaagtttaggtgcttgttgcaggggctgtgtgtgtgtgtgtgtgtgtgtgtgtgtgtgtgtgtgtgtctagtaataagcagaaaggtcgatttttcacttctagacggatggggaacctctctgcatcctcaccttgaggttgggagccatcagggcttgggatagggaaaggaatatggtcacaattccagcttttttgtttactgtttaaaccctattgtaatacatgagtgttatacactcccaaagccccgtcttctctgaatgggaggcaggaagccaaggaaagggttgggagagggccgaggtaacacaaatcaaataactctcctgaccactgcacagggtgcctcaacctcattgccttttgctccgcttctggtctgttgggaggaatccccctgaaggcctggcaagctctcgctgtccctgcccatttttctggtcttgcgagattgta

SEQ ID NO: 17148 - DNA, 310 bp, Homo sapiens
  chr11.fa.O7frz.19594352
  Located on chromosome 11
  Distance between a terminus base of telomere on chromosomal short arm and 5'-terminus of this base sequence : 18501958
  Distance between 3'-terminus of neighbour sequence of sequence listing upward to telomere on chrosomal short arm and 5'-terminus of this base sequence : 289506
aacagtcctcaatgtatcattaagtaaactttttatagcaatatcactcactcactcactcactcattctctgttcactgtataaaaacatactgagcatgtatttgtggaacctggaattcaaagagattgctgtgatgctccttctttatgattgtgtggaatggactggacagaaatattgtcaatgcacaaatgctggctatagatgcagaagggatttgcttgttgttatctagcagtaacaacagagtacagaagaagagatctccatactcatgcccataatattggtacaattgtcctgaat

SEQ ID NO: 17149 - DNA, 116 bp, Homo sapiens
  DISD22_0003498
  Located on chromosome 11
  Distance between a terminus base of telomere on chromosomal short arm and 5'-terminus of this base sequence : 18733996
  Distance between 3'-terminus of neighbour sequence of sequence listing upward to telomere on chrosomal short arm and 5'-terminus of this base sequence : 231728
tgcatccctgagtcttcccaaatgacatcagggaagtgtgtgtgtgtgtgtgtgtgtgtgtgtgtgtgtgtgtttgtgggcgcgcgcgttggcagggggtgggttaaggcaggaga

SEQ ID NO: 17150 - DNA, 192 bp, Homo sapiens
  HUMUT7232
  Located on chromosome 11
  Distance between a terminus base of telomere on chromosomal short arm and 5'-terminus of this base sequence : 18804832
  Distance between 3'-terminus of neighbour sequence of sequence listing upward to telomere on chrosomal short arm and 5'-terminus of this base sequence : 70720
tgaagtgggtaggatagggattattctcttattttacaatgaggtgcaagaatgtctgtctgtctatcttttatctatctatctgtctgtctatctatctatctatctatctatctatctatctatctatctatctatctatctatctatctatccatccacccatctaactcatccatccatccatccacc

SEQ ID NO: 17151 - DNA, 467 bp, Homo sapiens
  chr11.fa.O7frz.20053835
  Located on chromosome 11
  Distance between a terminus base of telomere on chromosomal short arm and 5'-terminus of this base sequence : 18896913
  Distance between 3'-terminus of neighbour sequence of sequence listing upward to telomere on chrosomal short arm and 5'-terminus of this base sequence : 91889
tcctgagtctcaaagattgactcttcccagtgtgaaatacacatggagatgaaaactgtccttctgactcttccctatgattttatgtggctctctctgtgagtgtgtgtgtgtgtgtgtgtgtgtgtgtgtatgaaaaaggattttgtattgcattttctctgactttccaaggataaaaataatcaaaaataaacattttataaatattgactccattcctaacaaaaaattcaatttctgaaactgctgtcgctataatttgggaagaatgcccactatcttgggaacctagataagtgggatttgttttgtggtgtttgatttattaagtgtataacctactagacctgtctactcctatttctacggaagctttcagagagataggagaaaaatcaataatagttgtgaacagaacccaggattgattgcatttgactaagtattagccaagtttggtatcc

SEQ ID NO: 17152 - DNA, 87 bp, Homo sapiens
  D11S899
  Located on chromosome 11
  Distance between a terminus base of telomere on chromosomal short arm and 5'-terminus of this base sequence : 18942416
  Distance between 3'-terminus of neighbour sequence of sequence listing upward to telomere on chrosomal short arm and 5'-terminus of this base sequence : 45036
gaattggattctctggggagtgtgtgtgtgtgtgtgtgtgtgcgcgcatgtgtgtgtagggaatactgttcttgtgtctgcctcctg

SEQ ID NO: 17153 - DNA, 381 bp, Homo sapiens
  chr11.fa.O7frz.20254943
  Located on chromosome 11
  Distance between a terminus base of telomere on chromosomal short arm and 5'-terminus of this base sequence : 19096795
  Distance between 3'-terminus of neighbour sequence of sequence listing upward to telomere on chrosomal short arm and 5'-terminus of this base sequence : 154292
ctttcagaatagtgcatttcacgtgtggagcataccaacttccagaatggttatcctggatgggatttatttgccttccttttcctagcctttctttcctctttactctgctccttcccctccttctcctctcctctcctcttctctctctctctctctctctctctttctccacatctcctctcctttcaagaggacattagctccctgactgcaaccctggggtcttggggcttctgaggcctgcaggctcccttccctttgtctgaggaggacgggggaggcagtgaattattgatgaggcctgtgctctatggatgcccagggctgagactggggtggcctgggcccctggagaaggcagcaagactggtcagtttg

SEQ ID NO: 17154 - DNA, 237 bp, Homo sapiens
  D11S1308
  Located on chromosome 11
  Distance between a terminus base of telomere on chromosomal short arm and 5'-terminus of this base sequence : 19174453
  Distance between 3'-terminus of neighbour sequence of sequence listing upward to telomere on chrosomal short arm and 5'-terminus of this base sequence : 77277
cctaaaaggcagaagtggtttcagacagtatttgatgtcagcgacatttttcttacgcacttgcgcacacacacacacgtacagacacacacactctttgcctctttctttttttctctctctctctgacacacacacacacacacacacacacacacacacacagcctaggagaattaatttcctgtttcctactctcctcccactccccctcccatctttggacagttgctggaa

SEQ ID NO: 17155 - DNA, 188 bp, Homo sapiens
  Z23452.1_172
  Located on chromosome 11
  Distance between a terminus base of telomere on chromosomal short arm and 5'-terminus of this base sequence : 19174465
  Distance between 3'-terminus of neighbour sequence of sequence listing upward to telomere on chrosomal short arm and 5'-terminus of this base sequence : -225
aagtggtttcagacagtatttgatgtcagcgacatttttcttacgcacttgcgcacacacacacacgtacagacacacacactctttgcctctttctttttttctctctctctctgacacacacacacacacacacacacacacacacacacagcctaggagaattaatttcctgtttcctactctcc

SEQ ID NO: 17156 - DNA, 276 bp, Homo sapiens
  AC009549.3_156226
  Located on chromosome 11
  Distance between a terminus base of telomere on chromosomal short arm and 5'-terminus of this base sequence : 19286601
  Distance between 3'-terminus of neighbour sequence of sequence listing upward to telomere on chrosomal short arm and 5'-terminus of this base sequence : 111948
ggcttatttcacttagcctaatgtcctgcagtttcatccatgttgatgcaaatggcatgatttccttctttgtaaaagttgaataatatttcattgtgtatgtatgtatcatgtgtgtgtgtgtatatatatatatatatatatatatatatatatatatatatcacaatttatttatccatttatccgttgatagacatttatgttgtttccatatcttagcaattgcaaataatgctgcaacaaataggggagtgcagatatgtctatgaggtg

SEQ ID NO: 17157 - DNA, 165 bp, Homo sapiens
  DISO7_10003010
  Located on chromosome 11
  Distance between a terminus base of telomere on chromosomal short arm and 5'-terminus of this base sequence : 19345659
  Distance between 3'-terminus of neighbour sequence of sequence listing upward to telomere on chrosomal short arm and 5'-terminus of this base sequence : 58782
agcttggcgattatttgcttttccaaaaagagagaaaaaaaggagaatgggtgtgtgtgtgtgtgtgtgtgtgtgtgtgtgtgtttgtatgcatgtgtgtatagatacatatgtgtatgtgtgtgtgtcttttgggaacttttgtgctttcattacaccatgatt

SEQ ID NO: 17158 - DNA, 269 bp, Homo sapiens
  D11S4106
  Located on chromosome 11
  Distance between a terminus base of telomere on chromosomal short arm and 5'-terminus of this base sequence : 19501314
  Distance between 3'-terminus of neighbour sequence of sequence listing upward to telomere on chrosomal short arm and 5'-terminus of this base sequence : 155490
caattcggacacaatctacctagagttagcctagacgccacaggttaagggctcagttccacaagattaccacacccccgacacacatacacacacacacacacacacacacacacacgctctctctctctctctctatctctccagatgccaatcacaagtcataggtcccaaggttacccacacttctgtccaacttggctgcaaatcaggagttcccatgacctcccttacattcagaaatttgctagaatggctcagagaactca

SEQ ID NO: 17159 - DNA, 322 bp, Homo sapiens
  chr11.fa.O7frz.20701259
  Located on chromosome 11
  Distance between a terminus base of telomere on chromosomal short arm and 5'-terminus of this base sequence : 19568368
  Distance between 3'-terminus of neighbour sequence of sequence listing upward to telomere on chrosomal short arm and 5'-terminus of this base sequence : 66785
ttgatcacctagctgtcttaagtcgttattccggacttttcagctggtgggggcagtacagaggggtgagccggaaaaaggcagtgtggccccaggcaagggctgcttgtggttcagagggccctgattaaaaagacttgcagttggaggttttgtttggaatttaaggatcctggtgaacttgtggttgtgtttatacagcaaattgctgggtgtgtgtgtgtgtgtgtgtgtgtgtgtgtgtgtgtaaactaggctccaggagagatggcatgggaggtttaagcataaggacttttcttgctaccttatgacctataga

SEQ ID NO: 17160 - DNA, 281 bp, Homo sapiens
  D11S928
  Located on chromosome 11
  Distance between a terminus base of telomere on chromosomal short arm and 5'-terminus of this base sequence : 19680343
  Distance between 3'-terminus of neighbour sequence of sequence listing upward to telomere on chrosomal short arm and 5'-terminus of this base sequence : 111653
gcctctgagaattagtgtctgtcattaggatagaggcgtgtgtgtgtgtgtgtggtgtgtgtgtgtgtgtgtgtgtgtgtatgtgtgtgcttgatgaaatttgattcaacatctgctaacaagacagttgggagaatgaagagatgaactcccacttgtgaagactagatttggaagcactcttcctggacttcactgaagaatttaggacattaggccaggtgcggtggttcacgcctataatcccagcactttgagaggccaaggcaggtggatcactt

SEQ ID NO: 17161 - DNA, 257 bp, Homo sapiens
  AC068860.2_74751
  Located on chromosome 11
  Distance between a terminus base of telomere on chromosomal short arm and 5'-terminus of this base sequence : 19730961
  Distance between 3'-terminus of neighbour sequence of sequence listing upward to telomere on chrosomal short arm and 5'-terminus of this base sequence : 50337
ggcattctttgaagttaaagacttttggctccacccaagttaggatgtcaactgagaggaaaaccattactaagaaagttataggattgtatttttgttttgtgtgtgtgtgtgtgtgtgtgtgtgtgtgtgtgtgtgtgtgtgtgtgtgttttggaagcaaagaggggcatacaaatagtaagcattcagtattatttatagtatatcaagttttagatttatgaatatataactgagccatcctaatataacttg

SEQ ID NO: 17162 - DNA, 259 bp, Homo sapiens
  D11S1755
  Located on chromosome 11
  Distance between a terminus base of telomere on chromosomal short arm and 5'-terminus of this base sequence : 19776944
  Distance between 3'-terminus of neighbour sequence of sequence listing upward to telomere on chrosomal short arm and 5'-terminus of this base sequence : 45726
aagagcccagagtgaaaataaaagccctctccccctctttgatgctctccaaagtaactactgatatactttcctctgtatcctttcaggcattctttctgggtgcacacgcacaggcacacacacacacacacacacacacacacacactctctctctctctctctctctctcccccccacttcttaaaacatttttttaatttttaatttttctggttatatagtaattgtacatatatatggggtacatgcaaaga

SEQ ID NO: 17163 - DNA, 462 bp, Homo sapiens
  AC025972.3_157154
  Located on chromosome 11
  Distance between a terminus base of telomere on chromosomal short arm and 5'-terminus of this base sequence : 19866589
  Distance between 3'-terminus of neighbour sequence of sequence listing upward to telomere on chrosomal short arm and 5'-terminus of this base sequence : 89386
ctaagcaactccactcatgtttttcaactgatcttctcttgtctttcaggcatattgccactcaaggagctataagtcttaagtgcaaagagtcagaataattcagaaagataaacataatggtcaagttcttctaaaggagctgagtgtgtgtgtgtgtgtgtgtgtgtgtgtgtgtgtgtgtgtgtgtgacagaatgtatttgtgtgaaggataaagaaataacagctaaataatgtgagagttggttggtagagaataagaataccaatagtgtatgggaatagaatatctatagcaactggatttactactgttttaaattttctgattatatgctcctcttaatataaggctaaagacattgtagcttcaatttttgaaaattttgatgtttgttgtatggtggtaattgttgaatcgttttctcaaaaaccagtatcaccagctatgtgataacat

SEQ ID NO: 17164 - DNA, 461 bp, Homo sapiens
  chr11.fa.O7frz.21135826
  Located on chromosome 11
  Distance between a terminus base of telomere on chromosomal short arm and 5'-terminus of this base sequence : 20019414
  Distance between 3'-terminus of neighbour sequence of sequence listing upward to telomere on chrosomal short arm and 5'-terminus of this base sequence : 152363
gtggtaataaagaatgcaatgtagccagacgtggtggcgcatgcctgtaatcccagctactcaggaggctgaggcaagagaaccacttgaatccgggaggcggagattgcggtgaggtgagatcgcaccattgcattccagcctgggcaacaagagcggaactctgtctcaaacaaacaaacaaacaaacaaacaaaagaatgcaatgactattagtatagtttggtgccttgatctgtgctaaggggccagcaagtttacctaccattgctgttgcaccatcagtgccaatgttgatacagtgaaaaaggcaaacaatgtgttagtactatgccaaaaatagtttttctttcctgactgccagcaagggtttttgggaactgccagagtctgtgtattattttgtgcacagagtctgtgcatgattttgagaatcagtgatctaggtggaagacaatgat

SEQ ID NO: 17165 - DNA, 248 bp, Homo sapiens
  D11S4114
  Located on chromosome 11
  Distance between a terminus base of telomere on chromosomal short arm and 5'-terminus of this base sequence : 20198803
  Distance between 3'-terminus of neighbour sequence of sequence listing upward to telomere on chrosomal short arm and 5'-terminus of this base sequence : 178928
atggaactaggacactatttaacccttcaagtatattaagggcaaaaatatgaattcttccctctcgcagacccagagagatgacatttttttctgcattttctgccatgaacatgtgtttatagtctctctctctgtctgtctgtctgtctctctctctctctctctctctctctctctctctctgtgtgtgtgtgtgtgtgtgtgtgtgtgtgtgtttaaagcaggctgagcatgttgactggatc

SEQ ID NO: 17166 - DNA, 298 bp, Homo sapiens
  chr11.fa.O7frz.21667225
  Located on chromosome 11
  Distance between a terminus base of telomere on chromosomal short arm and 5'-terminus of this base sequence : 20554912
  Distance between 3'-terminus of neighbour sequence of sequence listing upward to telomere on chrosomal short arm and 5'-terminus of this base sequence : 355861
agatgaacctggacagttagacagaacaggtgacaatggacctagtttggacttgatcttaatggagatgagaattcattgaagctctctcttctctctctgtctctctctctctctctctctctctctctctctgtgtgtgtgtgtgtgtgtgtgtgcatgcacgtgtgtatgtcacgagcagctgtgcatttccaaaggtcactgtgattgcaatgggaggagtgattggaggagcaccagattaatttgaataattgtaagaaatgacctaaggttatgattgaaggcagtgata

SEQ ID NO: 17167 - DNA, 437 bp, Homo sapiens
  AC019137.4_177214
  Located on chromosome 11
  Distance between a terminus base of telomere on chromosomal short arm and 5'-terminus of this base sequence : 20776947
  Distance between 3'-terminus of neighbour sequence of sequence listing upward to telomere on chrosomal short arm and 5'-terminus of this base sequence : 221737
tagctcagctacaaatggtaaggtcacctttttttactccctgcatgtaatactgcaatctctttaagatataggtctttttagtcctaacattctgattttaaataacttacttaatttaaacatgtagagttcttatggacttgttaccttaactatggttttaacctcttgctagcctttatacacacacacacacacacacacacacacacacacacacacacatttattagtattagtaacattttaaaaattcatttagaaatatttaagataaactaaaaagtatcaggaacaataccacgaagagctcatctcaaagcaccttccactctgctttctgaccctctgtgatcaaagaatctcttcccttgcatctgggctattatttatttcttttggtcatcatttctctgtcatttagaactgccatc

SEQ ID NO: 17168 - DNA, 291 bp, Homo sapiens
  chr11.fa.O7frz.22027316
  Located on chromosome 11
  Distance between a terminus base of telomere on chromosomal short arm and 5'-terminus of this base sequence : 20929424
  Distance between 3'-terminus of neighbour sequence of sequence listing upward to telomere on chrosomal short arm and 5'-terminus of this base sequence : 152040
accataaagtctacagtgcctaaaatgtttactatctgaccctttacatatgcacagattgctcaccctgacctaaaacagtgtctaacttattacaggtgaccaatctaccaatttatatgggtccaaaaaataaacacacacacacacacacacacacacacacacacacacacacacacacacacatataagacaataaaatgttgaaatttcccaggacccagacacaggcaatatctaatcaggactactttttcccatgaaaagtcaattaagcacaagtttctg

SEQ ID NO: 17169 - DNA, 296 bp, Homo sapiens
  chr11.fa.O7frz.22149576
  Located on chromosome 11
  Distance between a terminus base of telomere on chromosomal short arm and 5'-terminus of this base sequence : 21011132
  Distance between 3'-terminus of neighbour sequence of sequence listing upward to telomere on chrosomal short arm and 5'-terminus of this base sequence : 81417
taagaactcgtggtctagatgtagcattttaaaaagtctttttaaaaaatatgcatatatatgtatatatatatatatatattatagataatcatgtctcagtgttatttgataataatatgaaaattataagctttttttgacaagaaaaacacttaataatctcttgaacatttttagaagtacttagggtttactgtgattagaaaatgcttaaccattcaagagccagagactggatgatatccatcatgtgctatgagaggcacaccttcttacagtcttaggaaccaggt

SEQ ID NO: 17170 - DNA, 148 bp, Homo sapiens
  DISD22_0003505
  Located on chromosome 11
  Distance between a terminus base of telomere on chromosomal short arm and 5'-terminus of this base sequence : 21174359
  Distance between 3'-terminus of neighbour sequence of sequence listing upward to telomere on chrosomal short arm and 5'-terminus of this base sequence : 162931
atgttcccttgaagcagggcacagagccatttgcattagtgtgtgtgtgtgtgtgtgtgtgtgtgtgtgtgtgtgtgtgtgaaacatacacacaatgagcttaaaaacagacaaataacaaatccagatgacataataattccagtaa

SEQ ID NO: 17171 - DNA, 351 bp, Homo sapiens
  chr11.fa.O7frz.22378272
  Located on chromosome 11
  Distance between a terminus base of telomere on chromosomal short arm and 5'-terminus of this base sequence : 21348271
  Distance between 3'-terminus of neighbour sequence of sequence listing upward to telomere on chrosomal short arm and 5'-terminus of this base sequence : 173764
gtgatggttacatgaatctacatctctgatgaaaatgcatagaatatagacacacacacacacacacacacataaataaatgagtgcatataaaacttgtaaaatctgaataaaggcaatggattacaccaatgttaattttctggtttgatattgtagtatagttatacaaaatgctgccactggaggacattgactgacaagtgcataggaactccctgtacattatttttatatccttctgtgaatctataaatattccagatttaaagttttaaaacatagatgataaactagaattttcaatgtaaaaaaataaaatacaaggaaactggattgtcctattaaagt

SEQ ID NO: 17172 - DNA, 218 bp, Homo sapiens
  D11S1759
  Located on chromosome 11
  Distance between a terminus base of telomere on chromosomal short arm and 5'-terminus of this base sequence : 21541750
  Distance between 3'-terminus of neighbour sequence of sequence listing upward to telomere on chrosomal short arm and 5'-terminus of this base sequence : 193128
agtttcctgagattagcccctgagtccataaaccccaaatattggttaaaggttgtgcttcagccccattggtcagttaaattttcaccactcattacctctggatatgtgtgtgtgtgtgtgtgtgtgtgtgtgtgtgtgtgtgtgtgtgtgtgtgtgtggcttggatattgctttcataattcaggaagtttatgtttcacattcaaccagggact

SEQ ID NO: 17173 - DNA, 471 bp, Homo sapiens
  chr11.fa.O7frz.22607570
  Located on chromosome 11
  Distance between a terminus base of telomere on chromosomal short arm and 5'-terminus of this base sequence : 21651718
  Distance between 3'-terminus of neighbour sequence of sequence listing upward to telomere on chrosomal short arm and 5'-terminus of this base sequence : 109750
ttaagaattgcagtgactgaaggctagttagtaaagttagaatgaaaaaaaaaaaaaaaagaaaagaaatgaatctgttactctggctaggatttagggcctaaggcactagatgactttggtcacttattttcttaagaaaaaagatggaatttaattcttattaaggacaacagaaagcacccactaagcacccacctacatgcacacacgcacgcgcacgcgcgcgcacacacacacacacacacacacacacacacattgagtaacaaagatggtttgggccttataaaatgaagggacataaattccatatggatttccagacatctcttcctagtgtattatattagctaaatcttgatgcttcacttctcaattttccttaagaaaaaggggatcgatgtagcccatcttaacataaaataaggacataagagacacgatcagaatgaccatgctagaaacttt

SEQ ID NO: 17174 - DNA, 451 bp, Homo sapiens
  chr11.fa.O7frz.22955685
  Located on chromosome 11
  Distance between a terminus base of telomere on chromosomal short arm and 5'-terminus of this base sequence : 21877991
  Distance between 3'-terminus of neighbour sequence of sequence listing upward to telomere on chrosomal short arm and 5'-terminus of this base sequence : 225802
agtaaccgagctaaaggaatacttttcttacttggtataaacattatagaagtgtttgtttgtttgtttgtttgtttgttttttgagacagaatctcacactgttgcccgcccaggatgcaatggtgcgatcttggttcactgcaacctctgcctcctgggttcacgcaattctcctgcctcagcctcctgagtagctgggattacaggcgcacaccaccacaaccagctaattatttgtattttgtgtagtagagatggggtttcactatgttggccagactggttttgagatcctgaccttgtgatccgctcgcctcggcctcccgaagaagtgctggggtttacaggagtgagccactgcacccgaccagaagatttttttttctttttttaacgaaggaatggaatttttacttgtagatggataaaagctttagcattacgtttct

SEQ ID NO: 17175 - DNA, 214 bp, Homo sapiens
  D11S1359
  Located on chromosome 11
  Distance between a terminus base of telomere on chromosomal short arm and 5'-terminus of this base sequence : 21938071
  Distance between 3'-terminus of neighbour sequence of sequence listing upward to telomere on chrosomal short arm and 5'-terminus of this base sequence : 59629
gcttcaagtctcgtatatctggatcttctacttacagaaagatagtaactagaaatttggaagacacatgcacacacacacacacacacacacacacacatacacacacacacacccaaagagagagagagagaggagagagaggatttagagaattggcttagatgattatggaggctggaaaatttgaaatttgtagggtaagccagcaggc

SEQ ID NO: 17176 - DNA, 411 bp, Homo sapiens
  AC055878.2_17501
  Located on chromosome 11
  Distance between a terminus base of telomere on chromosomal short arm and 5'-terminus of this base sequence : 22021250
  Distance between 3'-terminus of neighbour sequence of sequence listing upward to telomere on chrosomal short arm and 5'-terminus of this base sequence : 82965
ggactttggttctactatggaccaatcattcataaaagattttaaatttattaagtctcagagaaaataagcaaaacaacatcaaacaaactgaaaaattttaaatgtttttacatgcatacatacacacacacactaacacacacacacacacacacactataaaacaagaataagacccagatttatttgataacaaaacccatactcttcccaccgtatcttgcttacaaaggaataagggctacgacaacaaagggcagagaagagtataatttattacctggagaatatcaataactaattgttttctactttttaatttctccaatgtttaaaacctacattcagagcagtatttactaaaatacattttgaaaaattctagtacttcaacttagtagccaatga

SEQ ID NO: 17177 - DNA, 443 bp, Homo sapiens
  chr11.fa.O7frz.23165192
  Located on chromosome 11
  Distance between a terminus base of telomere on chromosomal short arm and 5'-terminus of this base sequence : 22042548
  Distance between 3'-terminus of neighbour sequence of sequence listing upward to telomere on chrosomal short arm and 5'-terminus of this base sequence : 20887
cttatgatcacagttggaaagtggcagatccaaggccaaaactgagatcatattttttcaaaatcatactctttttattttttaataggacctgggaggtttcattttacttaatatagtaacataaaagtcatcacattataaacttagtgaacatagtatctgacaaacagtagagatatgatacatgttaaatatacaactaagaaataataggaagtagtggtgatgaaaggcaagagccacattaataaattccaaaaatatttatttaaaattttatatgactgagaaatggtttatgttttatttatttatttatttatttattattatactttaagttttagggtacatgtgcacattgtgcaggttagttacatacgtatacatgtgccatgctggtgtgctgcacccactaactcgtcatctagcattaggta

SEQ ID NO: 17178 - DNA, 268 bp, Homo sapiens
  AC055878.2_96689
  Located on chromosome 11
  Distance between a terminus base of telomere on chromosomal short arm and 5'-terminus of this base sequence : 22089746
  Distance between 3'-terminus of neighbour sequence of sequence listing upward to telomere on chrosomal short arm and 5'-terminus of this base sequence : 46755
gacctcctagtttaaatttcaaaccttgtctatgtacaatcttcatgctaagttacttaatctctctgagcctcaactaactttctttctctctctctctcttcctctgtgtgtgtgtgtgtgtgtgtgtgtgtgtgtgtgtgtgtgtgaaatagagataatagttcctacttcacaggatttttaaggtaattaaatataataacacatactgatactcagtacatttcctggcacaaagaaaaactcagtaaatgctaaccattga

SEQ ID NO: 17179 - DNA, 322 bp, Homo sapiens
  chr11.fa.O7frz.23287440
  Located on chromosome 11
  Distance between a terminus base of telomere on chromosomal short arm and 5'-terminus of this base sequence : 22139718
  Distance between 3'-terminus of neighbour sequence of sequence listing upward to telomere on chrosomal short arm and 5'-terminus of this base sequence : 49704
tgatagtgagttctcgtgagacctgatgagttaaaagtgtgccacttcctccttctctctctctctctctctctctctctctctctctcctacagccttgtaaggaaggtacttgcttcttcttcaccttctgccatgattgtaaatttcctgaggcctgccaggccatgtggaactgtgagtcaattaaacctctttcctttacaaattaccctgtcttgggaagttctttatagcagtgtaaaaatggactaatacagtgtcctttgaatttagcatcatgcaggtgattggtgagcttgacaagacttatttcagagaa

SEQ ID NO: 17180 - DNA, 397 bp, Homo sapiens
  chr11.fa.O7frz.23398656
  Located on chromosome 11
  Distance between a terminus base of telomere on chromosomal short arm and 5'-terminus of this base sequence : 22326714
  Distance between 3'-terminus of neighbour sequence of sequence listing upward to telomere on chrosomal short arm and 5'-terminus of this base sequence : 186674
gcacatactgatttactgtgagtaaaaagtagcatggttcaaatttcatatttttcctagtgatgaaaaatgggctgttgtgtgaaaatgtaaaggagttttaaacaactagcaaagaagttaaaacctccatttatccttagtggaaatgctgcagaagcagccattactcagcagctgaaagtcaacaattcatttaaaaaaatacacatacacacacacacacacacacacacacacacacacgtcatctaatttagcaatgtatgagaatagtggatgccattttaaaattatattaatgcctagatttgtttctagggggaaaatatggccgtgtttgcttctgatgtatataaaatctcagacatttatagtgctctaagccatagtaaga

SEQ ID NO: 17181 - DNA, 266 bp, Homo sapiens
  chr11.fa.O7frz.23523571
  Located on chromosome 11
  Distance between a terminus base of telomere on chromosomal short arm and 5'-terminus of this base sequence : 22450651
  Distance between 3'-terminus of neighbour sequence of sequence listing upward to telomere on chrosomal short arm and 5'-terminus of this base sequence : 123540
gtttagttgccttctaagctattatgtgtcacttttgcatccaccccaaccataaaaattttctgcttactatagaattaaaggaaattctttactaacaggataaaaatattttgtaacaaagcctcctgggtataatactaccaatcatgagttgtgaagatcgatcgatctatctatctatctatctatctatctatctatgtaactatatttttcagaagaatgcttatgtttggtatataaggctaactgttacaagtctg

SEQ ID NO: 17182 - DNA, 229 bp, Homo sapiens
  chr11.fa.O7frz.23674674
  Located on chromosome 11
  Distance between a terminus base of telomere on chromosomal short arm and 5'-terminus of this base sequence : 22566653
  Distance between 3'-terminus of neighbour sequence of sequence listing upward to telomere on chrosomal short arm and 5'-terminus of this base sequence : 115736
taacatcactatggcgtcttattttacacacacacacacacacacacacacaaacacaccaaatatttataggtctgtttagcatcaattatcccacacttcttgagaaagaacagcaaaaggactaaactgtcaagaaattcaatttctaggcatcttgagtttctgaactttagggaaagggagtcatttactttatatttctctgtggctgatctatgattagtca

SEQ ID NO: 17183 - DNA, 473 bp, Homo sapiens
  chr11.fa.O7frz.23856386
  Located on chromosome 11
  Distance between a terminus base of telomere on chromosomal short arm and 5'-terminus of this base sequence : 22708715
  Distance between 3'-terminus of neighbour sequence of sequence listing upward to telomere on chrosomal short arm and 5'-terminus of this base sequence : 141833
ttctattcaacatagttctggaagtccttgccagagcaatgaggcaacagaaagaaacaaaatgaatccagatagaaaagggggaagccaaactctctctcttcactgacaatatgattctatacctagaaaaacctatagatgccaccaaaaagctcctggaactgataaatgatgaatgataaataaactggtaaaagtttcaggatataaaaatcaatgtataaaaatcagtagcatttctataaaccaataatattcaagctgagagtcaaatcaaaaatgcaattccattcacagtagccacacacacacacacacacacacaaataaaatatctaggaatacacccaacaaaggagatgaaagatctctacaaaaaaacccccaaaacaccactgagagaaatcagaaataacacaacccaatgaaaaaacattccatgctcatggattcgaggaatcaatactgtt

SEQ ID NO: 17184 - DNA, 252 bp, Homo sapiens
  chr11.fa.O7frz.23754676
  Located on chromosome 11
  Distance between a terminus base of telomere on chromosomal short arm and 5'-terminus of this base sequence : 22806375
  Distance between 3'-terminus of neighbour sequence of sequence listing upward to telomere on chrosomal short arm and 5'-terminus of this base sequence : 97187
  misc_feature (1)...(252): n = A,T,G or C
gcaagaggatggaaagtactaattccctcaaatgagccttcattttagagctgtgtatggcatcattctcactagaaactaatcactaagagtggggaagaaatatagaaatgtgttcctgaaagaaaaccatgtgaatagatattcacccagtgagtggccaaaacacacancacacacacacacacacacacacacacacacacaatgtcaattagaaaggctaaaccctgtaggttcacaatcaaatgt

SEQ ID NO: 17185 - DNA, 476 bp, Homo sapiens
  AC009868.3_58428
  Located on chromosome 11
  Distance between a terminus base of telomere on chromosomal short arm and 5'-terminus of this base sequence : 22806375
  Distance between 3'-terminus of neighbour sequence of sequence listing upward to telomere on chrosomal short arm and 5'-terminus of this base sequence : -252
  misc_feature (1)...(476): n = A,T,G or C
gcaagaggatggaaagtactaattccctcaaatgagccttcattttagagctgtgtatggcatcattctcactagaaactaatcactaagagtggggaagaaatatagaaatgtgttcctgaaagaaaaccatgtgaatagatattcacccagtgagtggccaaaacacacancacacacacacacacacacacacacacacacacaatgtcaattagaaaggctaaaccctgtaggttcacaatcaaatgtcagttggctctttctcacaacatctttcactgtaataatgttatcactcgacatgaaggcctagcactaccaaagtgtcttcagcttatttctgcttttgactctccatatttaaacatttgctaagttcaataaagtctactgcttcagtgaccaatttatttcagcatgattatagttctgtatctcattgctgcttgcttagattattgaagtgcctcatc

SEQ ID NO: 17186 - DNA, 459 bp, Homo sapiens
  chr11.fa.O7frz.24084740
  Located on chromosome 11
  Distance between a terminus base of telomere on chromosomal short arm and 5'-terminus of this base sequence : 22957786
  Distance between 3'-terminus of neighbour sequence of sequence listing upward to telomere on chrosomal short arm and 5'-terminus of this base sequence : 150935
aatccacgtataatgttcaaataaaaagaggccaggagcggtggctcaggcctgtaatcccaacactttgggaggctgaggcgggcagatcacctgaggtcaggagtttgagaccagcctggccaacatggtgaaaacccatctctactaaaaatacaaaaattagccgggcttggtggcgcgagcctgtaatcgcagctactggagagactgaggcaggagaatctcttgaacctgggaggtggaggtttcagtgagccgagattgcgccattgcactccaacctgggtgacaagagcaagagtctgtctaaaaacaaaaacaaaacaaacaaacaaacaaacaagaaaacattgcattggaagggctagtggagtggtcaggaaggcgctccactgtcagtctctgtgatagaatcgggatgttgctattcccaaccagattatggaagtctagttt

SEQ ID NO: 17187 - DNA, 266 bp, Homo sapiens
  D11S915
  Located on chromosome 11
  Distance between a terminus base of telomere on chromosomal short arm and 5'-terminus of this base sequence : 23151416
  Distance between 3'-terminus of neighbour sequence of sequence listing upward to telomere on chrosomal short arm and 5'-terminus of this base sequence : 193171
ctaggacaaagcaaaacttccatatatgtgtgtgtgtgtgtgtgtgtgtgtgtgtgtgtgtgtgtctgtatacataatacaaagtcatatatatttttcatagaaaacacaaatgaacaatctcaacgattattatatttctggattcccaaaatgaaccagttttacctgagaggtaagttgttactaaactagttttagaggagaaaattgagatagagtaggaaatgttgacaaaattttcatcactgctaattgttacacca

SEQ ID NO: 17188 - DNA, 474 bp, Homo sapiens
  AC021853.3_137308
  Located on chromosome 11
  Distance between a terminus base of telomere on chromosomal short arm and 5'-terminus of this base sequence : 23263645
  Distance between 3'-terminus of neighbour sequence of sequence listing upward to telomere on chrosomal short arm and 5'-terminus of this base sequence : 111963
agacaagtctagaaggatctgaacaatcataagaatagaaagtgagtttttgggtggcaggatgttaggcaatatgttttgctctactccataacagtcagctaacaattgattcagagagatgcatgaagctaaaattaaatacatacacatatatgtaaatgtgtgtgtgtgtgtgtgtgtgtgtgtgtgtgtgtgtgtatatatatataaaataacctcttcagtttctaagcatcattaatatcaactatttgaatggacagcagcagggtgtggagaggttatatgagaaagcagcattgcaagagacaatcacatttttgtcttaaaatctcattttaccctttaatattccaagtaatcaagaaagtagctattcagcaccacatattaagcttttctgaatcctaaattttagaaaaaagaattctgctgtatttttcaacttcagccttatttagaaagagccta

SEQ ID NO: 17189 - DNA, 262 bp, Homo sapiens
  chr11.fa.O7frz.24173673
  Located on chromosome 11
  Distance between a terminus base of telomere on chromosomal short arm and 5'-terminus of this base sequence : 23319864
  Distance between 3'-terminus of neighbour sequence of sequence listing upward to telomere on chrosomal short arm and 5'-terminus of this base sequence : 55745
aagatgcttcatataatgtctgagagtgagaattaaccttaagataccaaagtaacgatatttgtaattagtacgtgtgtgtgtgtgtgtgtgtgtgcatgtgaatgtgtcctgggcttgtgtgtatgtgaatgggccaagtaacagcattaatcgaatttgatgtttccttagagattaatttaagcactctgaaaatcatgttgattgatcagcagtcaggagacttttaattgaagtgcttaattcatttagctaatgt

SEQ ID NO: 17190 - DNA, 183 bp, Homo sapiens
  DISD22_0003519
  Located on chromosome 11
  Distance between a terminus base of telomere on chromosomal short arm and 5'-terminus of this base sequence : 23505740
  Distance between 3'-terminus of neighbour sequence of sequence listing upward to telomere on chrosomal short arm and 5'-terminus of this base sequence : 185614
  misc_feature (1)...(183): n = A,T,G or C
gctctgcttggactttccccaacacacacacacacacacacacacacacacacacacacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccagagtttcacgcatgct

SEQ ID NO: 17191 - DNA, 278 bp, Homo sapiens
  chr11.fa.O7frz.24629658
  Located on chromosome 11
  Distance between a terminus base of telomere on chromosomal short arm and 5'-terminus of this base sequence : 23745022
  Distance between 3'-terminus of neighbour sequence of sequence listing upward to telomere on chrosomal short arm and 5'-terminus of this base sequence : 239099
cacagctagtatcatattgaatgagaaaaaagactttcctttaagatctggaagaaaagaaagatgcccacattcaacattgtcgtttattatagtactgggagttcttgctagagcaatttagaaaaagaaagaaaaataaataaataaataaataaataaataaataaataaataaataaataaagagagagagaaggaatgaaggaaggaaggaaggaaggaaggagcatccaaattggaaaggtagaaatcatattacacttgtttgcagatga

SEQ ID NO: 17192 - DNA, 150 bp, Homo sapiens
  D11S4084
  Located on chromosome 11
  Distance between a terminus base of telomere on chromosomal short arm and 5'-terminus of this base sequence : 23890253
  Distance between 3'-terminus of neighbour sequence of sequence listing upward to telomere on chrosomal short arm and 5'-terminus of this base sequence : 144953
aacaggtttagactttattgtcctttaatagacagactatatatacacacacacacacacacacacacacgtgtgttagactaaaaaaatacattttaataatttttttcaaatttgaaggatgtcaagagtgatgattacaaagcataa

SEQ ID NO: 17193 - DNA, 312 bp, Homo sapiens
  chr11.fa.O7frz.24905231
  Located on chromosome 11
  Distance between a terminus base of telomere on chromosomal short arm and 5'-terminus of this base sequence : 24121166
  Distance between 3'-terminus of neighbour sequence of sequence listing upward to telomere on chrosomal short arm and 5'-terminus of this base sequence : 230763
gctgttctcatgatagtgagtaagtgagtgagttatcatgatatttggttgtttgaaagtttgtagcacctctctctctctctctctctctctctcggtcctactcctgccatgtaagatgcctgctcctgctttgccttccaccatgagtaaaagctccctgaagcctccccagaagcagatactgccatgcttcctgtacagcctgcagaactatgaggcaattaaacctcttttctttacaaatgacccagtctcagattatttctttatagggctgtgagaatggactaatacaggcttgtttagcag

SEQ ID NO: 17194 - DNA, 312 bp, Homo sapiens
  AC015772.5_21349
  Located on chromosome 11
  Distance between a terminus base of telomere on chromosomal short arm and 5'-terminus of this base sequence : 24258743
  Distance between 3'-terminus of neighbour sequence of sequence listing upward to telomere on chrosomal short arm and 5'-terminus of this base sequence : 137265
cttcagtaaagtttctggatacaaaaattaatgtaaaaaaaatcagttctctacagcaataactttcaagctagcagccaaataaagccacacacacgcacacacacacacacacacacacacacacacacacacaacctagaaatacatctaaccaaggatctacaagaggagctacaaaacactgctgaaagagatcataaattacacaaataaatggaaaaatatttcatgctcatggattgggagaattaatatcatcaaagtggtcacacctcccaaagcaatctacagattcaacgctattcatat

SEQ ID NO: 17195 - DNA, 384 bp, Homo sapiens
  AC015772.5_120605
  Located on chromosome 11
  Distance between a terminus base of telomere on chromosomal short arm and 5'-terminus of this base sequence : 24320685
  Distance between 3'-terminus of neighbour sequence of sequence listing upward to telomere on chrosomal short arm and 5'-terminus of this base sequence : 61630
ccagataatcaagtttgaacacaaagtatgatctagaaacagcatgtaaaagcaaagaaaatgaactcatctaggtctcatttcagaactgagtatagaactcctatactttggtccaccagaatttatcaagaaaaaaccttcaacctttacattttgtgatatgtgaagagaaagctggaaactaagaacctaattctctccctctctctctctacacacacacatacacacacacacacacacacacacacacacatacatagagggcacaaagtgatattatgatatatgcatacagtgtggaattattaagtcaagttaattaacatattcatcttgtcaaatacttgtctttttgtggtaagaacatttgaaatttac

SEQ ID NO: 17196 - DNA, 259 bp, Homo sapiens
  AC036209.2_84514
  Located on chromosome 11
  Distance between a terminus base of telomere on chromosomal short arm and 5'-terminus of this base sequence : 24500918
  Distance between 3'-terminus of neighbour sequence of sequence listing upward to telomere on chrosomal short arm and 5'-terminus of this base sequence : 179849
taaatatttcaggccatagtacattaatgctaacaaaagtgtgagaatctccttttagtattgttaaataagaatctctctctctctctctcacacacacacacacacacacacacacacacatttatttgttggcatcttctagaaatttctttgtgttctttcagtttctttattcttcagttccacccctgcctcccacacacaaaccccacttaatccagccttgagaaaatcagactttacactgagcatgttc

SEQ ID NO: 17197 - DNA, 201 bp, Homo sapiens
  chr11.fa.O7frz.25533446
  Located on chromosome 11
  Distance between a terminus base of telomere on chromosomal short arm and 5'-terminus of this base sequence : 24672190
  Distance between 3'-terminus of neighbour sequence of sequence listing upward to telomere on chrosomal short arm and 5'-terminus of this base sequence : 171013
gtgtttcactcagtgcttgttgaagatttgagtgtttgggataacatgtaggtccttccttccttccttccttccttccttccttccttccttccttccttccttctcagtagagatagtatagtaactctttatagtttgagcatatagacactaaaacacaatttcactacccctctatgcatttgttatctgtcataa

SEQ ID NO: 17198 - DNA, 286 bp, Homo sapiens
  AC023869.3_49079
  Located on chromosome 11
  Distance between a terminus base of telomere on chromosomal short arm and 5'-terminus of this base sequence : 24806113
  Distance between 3'-terminus of neighbour sequence of sequence listing upward to telomere on chrosomal short arm and 5'-terminus of this base sequence : 133722
cagcttcaatgtaatcctaagtattgtttctctgcccagcctcctgagtttccatgagtcctacctgttttccaatcatagttctccagttattctgtatctattgaaatctatgagcacaccagttcctacacacacacacacacacagacacacacacacacacacacacttccttgtgatactgagagcattatttctattacttgtgactaagaaatctgtctcttaaatgtgtaattcccaggttttagagtaaggacttgagtaaagaaacttgcaataa

SEQ ID NO: 17199 - DNA, 217 bp, Homo sapiens
  D11S4163
  Located on chromosome 11
  Distance between a terminus base of telomere on chromosomal short arm and 5'-terminus of this base sequence : 24974988
  Distance between 3'-terminus of neighbour sequence of sequence listing upward to telomere on chrosomal short arm and 5'-terminus of this base sequence : 168589
tcaaggtcacggctaaaggtgattcaaagaagggaaccttttcaagatgtgaactgaagggcaataggaaagtttgaagggcaataggaaagttttttcttattttgtcaggcagtttataattttagccttcagtaacacacacacacacacacacacacacacacacacacacacacacaccatacacagtcattcacaatgccattttatgaaa

SEQ ID NO: 17200 - DNA, 334 bp, Homo sapiens
  chr11.fa.O7frz.25732838
  Located on chromosome 11
  Distance between a terminus base of telomere on chromosomal short arm and 5'-terminus of this base sequence : 25052289
  Distance between 3'-terminus of neighbour sequence of sequence listing upward to telomere on chrosomal short arm and 5'-terminus of this base sequence : 77084
tacaattccaaagctatgaaaccaaactaagtgaacatcaactgataagtggataaagaaaatgtggtacacacagacacaaacacacacatatgtaacacgtgtgtttgtatatatatacacatactgcaccatatataggtacacccacaccatgatatgtatgtgtgtatatatatacatatatatgtatatataccatggaatactatgcagccttaaaaagaatggaataatatattttgcagcaacttgggtgaaactggaggtcattactctaagtgaagtaacccaggaatggaaaataaaataacttaggttctcaattgtagct

SEQ ID NO: 17201 - DNA, 167 bp, Homo sapiens
  D11S4086
  Located on chromosome 11
  Distance between a terminus base of telomere on chromosomal short arm and 5'-terminus of this base sequence : 25162341
  Distance between 3'-terminus of neighbour sequence of sequence listing upward to telomere on chrosomal short arm and 5'-terminus of this base sequence : 109718
gtggcaatgaacccagtaaccagtatgaaactttggaatgtaaggttgttgttttttttttccccgccatatataaacacacacacacacacacacactctctctctctctctctctctctctctctctctctgtctctctctctctctgtcttatgggctgagagg

SEQ ID NO: 17202 - DNA, 128 bp, Homo sapiens
  Z67253
  Located on chromosome 11
  Distance between a terminus base of telomere on chromosomal short arm and 5'-terminus of this base sequence : 25165297
  Distance between 3'-terminus of neighbour sequence of sequence listing upward to telomere on chrosomal short arm and 5'-terminus of this base sequence : 2789
cacaggatacaagttaggtctcttgtatgtatttgtgtgtgtctgtgtgtgtgtgtgtgtgtgtgtgtattacttattatgatctatacatttcctgtaatataaagaataatttgacaacattttaa

SEQ ID NO: 17203 - DNA, 239 bp, Homo sapiens
  DISD22_0003529
  Located on chromosome 11
  Distance between a terminus base of telomere on chromosomal short arm and 5'-terminus of this base sequence : 25306870
  Distance between 3'-terminus of neighbour sequence of sequence listing upward to telomere on chrosomal short arm and 5'-terminus of this base sequence : 141445
atatgccatttatccagatccccacctctgtctttctctttgtctctctctctctctctcactcagtctctctctctctctcacacgcacacacacacacacacacacacacatttatggttaacattatctattttaaaaacctattgtaaggatttggagtatattttactggctagaaaacagatttatcaaagacatttgtttggacatggcaaaatgcctcccttggtatcttg

SEQ ID NO: 17204 - DNA, 454 bp, Homo sapiens
  AC024341.3_128392
  Located on chromosome 11
  Distance between a terminus base of telomere on chromosomal short arm and 5'-terminus of this base sequence : 25530823
  Distance between 3'-terminus of neighbour sequence of sequence listing upward to telomere on chrosomal short arm and 5'-terminus of this base sequence : 223714
tgtatagaaggaatgtacctcaacacaattaaaggccatatgacaaacccacagctaagatattcaaagataaaaatttgaatttttttcctctaagatcagggtaaaaaccaggattcccttttgccacttctaatcaacaaagtactatatgaagtcctagatggagcaattaggcaagagaaataaaggtatccaaactgtaatggaagaagttaaattgtctcaatttgcagatgacataatcacacacacacacacacacacacacacacacacacacatatacacacacacacatatatggactccaccaaaaaatgattagaactaaaagagaagtaaagttgaaggatacaatatcaacatataaatataattggcatttctatatactaacagtgaactatccaaaaatgaaatcatgaaaacaatcatgtttacaatagctaca

SEQ ID NO: 17205 - DNA, 344 bp, Homo sapiens
  chr11.fa.O7frz.27015619
  Located on chromosome 11
  Distance between a terminus base of telomere on chromosomal short arm and 5'-terminus of this base sequence : 25540450
  Distance between 3'-terminus of neighbour sequence of sequence listing upward to telomere on chrosomal short arm and 5'-terminus of this base sequence : 9173
caagtcatgtgatttcctgtagaaaagcacatctagcagaggaaaaagcaagcatgaacatctggaggcaggagaatccctggtttgaggaggaggtcaatgttgatagaacaggtgatccagagagagagagacagagagagagagagagagagagagagaaggaggaggaagaggaggagagacaataagaaaaggtaatggtggcaccaggtgaagtaggttcttttgaatcagcatgagaacttaaccttttactccaactgagattgaaaaccttgaaaattcctgaacaaagaagtgacattaccttatttattttgtaacagactcagtctgtcagg

SEQ ID NO: 17206 - DNA, 366 bp, Homo sapiens
  AC016682.2_188955
  Located on chromosome 11
  Distance between a terminus base of telomere on chromosomal short arm and 5'-terminus of this base sequence : 25721211
  Distance between 3'-terminus of neighbour sequence of sequence listing upward to telomere on chrosomal short arm and 5'-terminus of this base sequence : 180417
tgctatggaaatcagtgttaacctaaattattctataactcaattcctttttcctactttcttgtttttccagcaaatttgaaaatctcaagggcagagacaactgtaattcctcattaaatattttctgccaagatcgcgccattacactccagcctgggcaacgagagtgaaactctgacacacacacacacacacacacacacacacacacacacacacacacacgaagaaaggaaaacaaatattttctgcatctaaacagtaacatgcagggataaaatgagataatctgctaaaactgttttgtgaaccacaaagtaccacgcaaatgttccatattatgactatgcatcaataaggcac

SEQ ID NO: 17207 - DNA, 455 bp, Homo sapiens
  AC016682.2_246944
  Located on chromosome 11
  Distance between a terminus base of telomere on chromosomal short arm and 5'-terminus of this base sequence : 25759205
  Distance between 3'-terminus of neighbour sequence of sequence listing upward to telomere on chrosomal short arm and 5'-terminus of this base sequence : 37628
accttgttacaatacagctagaaggcccttccaagatcagccccttggtcttagacttgccagacactggaaccatgagtcaaataaatttctgtttatgataaattactcatgtattctgttataagcacaacacacacacacacacacacacacacacacacacacacacacacacacaaatgggtacaaggaagtgggatcattgccataaaaaaaaaatctgaaaatgtgcaggtagttcggcaactgggtaataggtagaggctggaagaatttgaagggtactctggaagaaacccagattttcataaatggggagtattaagggcaattctggtgagagcacagaggaaaattagagctgcagggggagcgcaaatcttgttaggaactacaagctgtgatcagaatgtcagtagaaatatggacagtcaaggccattctaattagat

SEQ ID NO: 17208 - DNA, 232 bp, Homo sapiens
  D11S929
  Located on chromosome 11
  Distance between a terminus base of telomere on chromosomal short arm and 5'-terminus of this base sequence : 25759227
  Distance between 3'-terminus of neighbour sequence of sequence listing upward to telomere on chrosomal short arm and 5'-terminus of this base sequence : -433
aggcccttccaagatcagccccttggtcttagacttgccagacactggaaccatgagtcaaataaatttctgtttatgataaattactcatgtattctgttataagcacaacacacacacacacacacacacacacacacacacacacacacacacacaaatgggtacaaggaagtgggatcattgccataaaaaaaaaatctgaaaatgtgcaggtagttcggcaactggg

SEQ ID NO: 17209 - DNA, 446 bp, Homo sapiens
  AC025235.4_96981
  Located on chromosome 11
  Distance between a terminus base of telomere on chromosomal short arm and 5'-terminus of this base sequence : 25849434
  Distance between 3'-terminus of neighbour sequence of sequence listing upward to telomere on chrosomal short arm and 5'-terminus of this base sequence : 89975
atcaccatggaggtaagaatagtctaacaaatgatgctggaaaaacctgaagatcacatgtgaacagataaaagtgggccttatcttacacaaaacacaaaactagagtcaaaatgtactgaagacttaaatgtaaaaccttaaactgtaaaattctggaaaaacacataggggaaaatctttatcacagtctatttacaataatatcttggctatgacaccatataacatagcgaacgtaaaagcaaacatagacaagtagaaccgtgtgtgtgtgtgtgtgtgtgtgtgtgcgtgcacgcttaattttaaagttctgcagaaatctgtttaatatgctgatgtcttctcttttgaatatatacctagcagtgggattactggatcatatgcttgttctatttttaatttttgaaggacctccatactgttatccatagtggctg

SEQ ID NO: 17210 - DNA, 421 bp, Homo sapiens
  AC025235.4_135400
  Located on chromosome 11
  Distance between a terminus base of telomere on chromosomal short arm and 5'-terminus of this base sequence : 25909731
  Distance between 3'-terminus of neighbour sequence of sequence listing upward to telomere on chrosomal short arm and 5'-terminus of this base sequence : 59851
ctttagaacattatgaccttgaactgcattgttcaatttttttcaaaaaagattcttattgcttcattccatcatgaggctcagatgcagatttcctcagtatgctcaggaagtgtgtgtgtgtgtgtgtgtgtgtgtgtgtgtgtggttttcttgactcctaccctgtttgcattttcattcccagaccactatgtttactgaaacaagtaccaggttcgagtcatatttttgactttggttctctataatttcttctcatttgcaacaaaaatataattttagaagaattttatgttgctagtgtgaccagttcatagtttttgtttacaaaatgaatgatcaaatagctttgattgaaattagcttggatcttcagtcccccttagagtttaaggaattcaatcacttcatgtttaac

SEQ ID NO: 17211 - DNA, 130 bp, Homo sapiens
  D11S4080
  Located on chromosome 11
  Distance between a terminus base of telomere on chromosomal short arm and 5'-terminus of this base sequence : 25909805
  Distance between 3'-terminus of neighbour sequence of sequence listing upward to telomere on chrosomal short arm and 5'-terminus of this base sequence : -347
tgaggctcagatgcagatttcctcagtatgctcaggaagtgtgtgtgtgtgtgtgtgtgtgtgtgtgtgtgtggttttcttgactcctaccctgtttgcattttcattcccagaccactatgtttactga

SEQ ID NO: 17212 - DNA, 188 bp, Homo sapiens
  D11S4204
  Located on chromosome 11
  Distance between a terminus base of telomere on chromosomal short arm and 5'-terminus of this base sequence : 26030878
  Distance between 3'-terminus of neighbour sequence of sequence listing upward to telomere on chrosomal short arm and 5'-terminus of this base sequence : 120943
tgggcaacaagagcaaaactccatcaaaaaagaaaaaaaaacacatatatatatacacacacacacatatatatatacacacatacacacacacacacacacacacacacatatatatatttgactcactgactgactggctgaggaactgaaacaccgctctcttcatttccctcaatgcagacacc

SEQ ID NO: 17213 - DNA, 233 bp, Homo sapiens
  D11S930
  Located on chromosome 11
  Distance between a terminus base of telomere on chromosomal short arm and 5'-terminus of this base sequence : 26113706
  Distance between 3'-terminus of neighbour sequence of sequence listing upward to telomere on chrosomal short arm and 5'-terminus of this base sequence : 82640
aaagagattgtggatatggcacacacacacacacacacacacacacacacacacacacacaaattctgtcgggggaaggtaaaggatttcaagatgtgaatcttggagaaattcaaaaacaaatagacatcacacgagaggagttaaccgaagatgacttgatggagatgactgcttccaaaccagtgccagatcatgaggaagaagacatggaggaagcagtgtcagaaaac

SEQ ID NO: 17214 - DNA, 405 bp, Homo sapiens
  AC021698.4_192156
  Located on chromosome 11
  Distance between a terminus base of telomere on chromosomal short arm and 5'-terminus of this base sequence : 26123237
  Distance between 3'-terminus of neighbour sequence of sequence listing upward to telomere on chrosomal short arm and 5'-terminus of this base sequence : 9298
cagattactgtcaaatatggaaagtcttctttcaatttcctttcttatacaaggtatatgatgtcattgcatgtcacattttttcgtgtaggagctactctctaatcctctttgaatgaatgtcacattcaccaatctgttagcataaccatatcttaccaaaataaacaaataaataaatatatatatatatatatatatatatatatatatatatatatatagcgagcattttttctgttcttagaaggtccaggggaaacgagtaactctgggctttgggtttatttgcttcactgcaaatctgctctccaagcctgagaagacaaaccacactattggttaattatgtaaaacattcaacaatcagtacaacatgaaaagtagttcataatcacgaccaga

SEQ ID NO: 17215 - DNA, 457 bp, Homo sapiens
  chr11.fa.O7frz.27297431
  Located on chromosome 11
  Distance between a terminus base of telomere on chromosomal short arm and 5'-terminus of this base sequence : 26172237
  Distance between 3'-terminus of neighbour sequence of sequence listing upward to telomere on chrosomal short arm and 5'-terminus of this base sequence : 48595
tagctttccttaatgaggctacttgctatccattcttaaactgtccacaatggaaatgtcagtccatcaaaatgcttccttttaccccaacacagaatttttattttgagttaaaaaagagggcttttgctcaaactcttctttctacacttccaaaacgtactttctttctttacacacacacacacacacacacacacacacacagagagagagagagagagaggaatctttttctctttgcactgcctttctataaagcagatggtgcttcaaatttcctcggcccctcacaaagctgttcctctagcaacctcccctaaaagactgattttaaaacaagcaaagatgttctttgaatcccctgctagtcaatctggcagtccaacctaaaatgtttctaattttaagaaaagtaattaactttatgacaagatagtttaatcatagctgcacc

SEQ ID NO: 17216 - DNA, 287 bp, Homo sapiens
  AC021698.4_12033
  Located on chromosome 11
  Distance between a terminus base of telomere on chromosomal short arm and 5'-terminus of this base sequence : 26255860
  Distance between 3'-terminus of neighbour sequence of sequence listing upward to telomere on chrosomal short arm and 5'-terminus of this base sequence : 83166
ttaagcatattaggtgctattcaggttcaaaagaaagccacttttaagggcagagaaaggaaagtgtgtgtgtgtgtgtgtgtgtgtgtgtgtgtgtatgtatgcattattgggtaaagtaaagatagtaactcagaactgtatttctcatattcctttttactgtgaattgaatacctggtttcattttgctccccattaatctctgaagtcatcagtgtagccagggaaatctccatgtgtttctgtaaatgaatttttaggggataactattgttccagaagcc

SEQ ID NO: 17217 - DNA, 433 bp, Homo sapiens
  chr11.fa.O7frz.27224641
  Located on chromosome 11
  Distance between a terminus base of telomere on chromosomal short arm and 5'-terminus of this base sequence : 26257989
  Distance between 3'-terminus of neighbour sequence of sequence listing upward to telomere on chrosomal short arm and 5'-terminus of this base sequence : 1842
caggattgtcaatgatcattataatctggccaatttgtttgttttaattccgaaaaattgttcatgatttagtggatgacttctttcgtcctgagccactcacctctctccctaccaccactatacttgtgacaatgtagaagtatccatgggtaccatagcggagccagattgtataaaagttattggtgtgtatgtgtgtgtgtgtgtgtgtgtgtgtgtgtgtgtttgggagtgagtgtgagacagttcaataccttgatattagtaggcctacctagaatctctttagaagctcctcaatattcccagacttgtcctaaggccactgtgttgttggcatatgaaaaaatgccatatattagacctgctaggaatttcagaagacagtgtgttcttctaaaaacgagagtgctattgaaacctatccatt

SEQ ID NO: 17218 - DNA, 122 bp, Homo sapiens
  G08862
  Located on chromosome 11
  Distance between a terminus base of telomere on chromosomal short arm and 5'-terminus of this base sequence : 26308354
  Distance between 3'-terminus of neighbour sequence of sequence listing upward to telomere on chrosomal short arm and 5'-terminus of this base sequence : 49932
tgtgtcctacaaatagaaacttcctatggttcaaatgaacctatttagatagatagatagatagatagatagatagatagatagatagatagttaaattatatggctgaagatgtgtgcctt

SEQ ID NO: 17219 - DNA, 410 bp, Homo sapiens
  AC025248.3_58805
  Located on chromosome 11
  Distance between a terminus base of telomere on chromosomal short arm and 5'-terminus of this base sequence : 26325435
  Distance between 3'-terminus of neighbour sequence of sequence listing upward to telomere on chrosomal short arm and 5'-terminus of this base sequence : 16959
cttgaatcatgtggaatatgatggagattagttttgtgatttgggactgattttgttgaatacttacaaatctaacattttaatttttccattttgcagtaatttgaacacagatatatgtgtgtgtgtgtgtgtgtgtgtgtgtgtgtgtgtgtgtgtgtgtgtatctttaaaaagtcctacttagaaattatctgacttgagatgttttcacctctgtgtaagggaaattcataatatatataatagagtttcatttgtatttatttcattatattgtgtaaaagtatatttaacattatctttgtttatttgtatagatttaaggggtacaagagcagttttgctacatggatatattgctagtggtgaagcctgggctattagtgtatccatgacctgaatagtat

SEQ ID NO: 17220 - DNA, 374 bp, Homo sapiens
  AC025248.3_109557
  Located on chromosome 11
  Distance between a terminus base of telomere on chromosomal short arm and 5'-terminus of this base sequence : 26381479
  Distance between 3'-terminus of neighbour sequence of sequence listing upward to telomere on chrosomal short arm and 5'-terminus of this base sequence : 55634
  misc_feature (1)...(374): n = A,T,G or C
atttgattaaggatagttcacaattctaggcttcctttttccttttccttaatgcaggagacaagtgccaatctcttatttttaccagtggtcgaggtttgttttttacttacagaaaggacagtggctagagggaagaagaagaaatgtcttgtggagtttggtgtgaaaaggaaaaataaagggaaaaagagaaantnacacnacacacacacacacacacacacacaagagtttgtccaagatattgatagaatttataatcctatcaattatgaatagtggaaagagaggaaatgtgtgtaggtcagaggaggccagtcatggggatggcagggaccactgagtgtacgtaatacttcagaaaggcatga

SEQ ID NO: 17221 - DNA, 309 bp, Homo sapiens
  chr11.fa.O7frz.27437029
  Located on chromosome 11
  Distance between a terminus base of telomere on chromosomal short arm and 5'-terminus of this base sequence : 26457966
  Distance between 3'-terminus of neighbour sequence of sequence listing upward to telomere on chrosomal short arm and 5'-terminus of this base sequence : 76113
atacaagtagcaacattaggtcactttttgagttttgtcttttgccaagtgaagaaaagatttatcagtggctgcagcatcccagcacatatacaccctattccttctgttctcatgtgtggttccctctctcccctggctttcgcaatactgtctaagcttctgtcagtttatatatatatatatatatattttttttttttcagttcctcaatggtgtcttcacaaaaacacgggactttggacacaggcaaagcagaaatttcctacttgacctgtgtaacgctggtcataccacataacatctat

SEQ ID NO: 17222 - DNA, 165 bp, Homo sapiens
  D11S1750
  Located on chromosome 11
  Distance between a terminus base of telomere on chromosomal short arm and 5'-terminus of this base sequence : 26681265
  Distance between 3'-terminus of neighbour sequence of sequence listing upward to telomere on chrosomal short arm and 5'-terminus of this base sequence : 222990
agctgttttagttccattactctgtgtgtgtgtgtgtgtgtgtgtgtgtgtgtgtgtgttcatgtactttctaattaagttcactttttgaagaaaaatttttaattcagatacactcaggtctctggagagtgattatgagactcgctaaaatgcacaataagc

SEQ ID NO: 17223 - DNA, 129 bp, Homo sapiens
  DISO7_10003011
  Located on chromosome 11
  Distance between a terminus base of telomere on chromosomal short arm and 5'-terminus of this base sequence : 26698401
  Distance between 3'-terminus of neighbour sequence of sequence listing upward to telomere on chrosomal short arm and 5'-terminus of this base sequence : 16971
tgaggtagatcctggagatataaagatatacatataaatacatacatatatatatatatatatatatatatatatatatatatatatatatgaaagtttctatatccaaggaggtaaataatgtaatga

SEQ ID NO: 17224 - DNA, 197 bp, Homo sapiens
  DISO7_10003013
  Located on chromosome 11
  Distance between a terminus base of telomere on chromosomal short arm and 5'-terminus of this base sequence : 26864921
  Distance between 3'-terminus of neighbour sequence of sequence listing upward to telomere on chrosomal short arm and 5'-terminus of this base sequence : 166391
agcacttggcaaatagccagatatatatatatatatatatatataaaatttagtcttcataacaactatgagttaattattatcattattgtcaattcacaaaagagaaaactgagaccggcagaggtaaatcacagaaccttgcccaaggttcccagctagtaaatgtcaataattgactgcctgctaaagccagt

SEQ ID NO: 17225 - DNA, 182 bp, Homo sapiens
  DISO7_10003015
  Located on chromosome 11
  Distance between a terminus base of telomere on chromosomal short arm and 5'-terminus of this base sequence : 26967758
  Distance between 3'-terminus of neighbour sequence of sequence listing upward to telomere on chrosomal short arm and 5'-terminus of this base sequence : 102640
tcttaatgttgcataaagtcttcccataatctcaagaaggacagggagcaattttatcttacttgtcactaaatcccccagtgcctattgcagtgcctggaagggattttataagctgtgtgtgtgtgtgtctgtgtgtgtgtgtgtgtgtgtgtgtgtgtgcgtgcacatgtgtacatgca

SEQ ID NO: 17226 - DNA, 169 bp, Homo sapiens
  DISO7_10003017
  Located on chromosome 11
  Distance between a terminus base of telomere on chromosomal short arm and 5'-terminus of this base sequence : 27017458
  Distance between 3'-terminus of neighbour sequence of sequence listing upward to telomere on chrosomal short arm and 5'-terminus of this base sequence : 49518
ctgcctgtctgtaggtatgctatttttctacttatcctgggtttttctcttaaaataattttgagtttaaaccttgattttgttgttgttgtttttgttgttgttgttgctaattttacgttaaacttgttttccttaactattaaaaggagacatgattcagaaacct

SEQ ID NO: 17227 - DNA, 180 bp, Homo sapiens
  DISO7_10003019
  Located on chromosome 11
  Distance between a terminus base of telomere on chromosomal short arm and 5'-terminus of this base sequence : 27111588
  Distance between 3'-terminus of neighbour sequence of sequence listing upward to telomere on chrosomal short arm and 5'-terminus of this base sequence : 93961
atgccagcacactttctgtctctctttttctgtctctctctgtctctctctctttctttctggtgatacacacacacacacacacacacacacacacacacacacacacacacacagccacagatccccgtaagaatgataaaagcaatggctaaagcaaagtgacaaacagccttcctg

SEQ ID NO: 17228 - DNA, 115 bp, Homo sapiens
  DISO7_10003020
  Located on chromosome 11
  Distance between a terminus base of telomere on chromosomal short arm and 5'-terminus of this base sequence : 27115303
  Distance between 3'-terminus of neighbour sequence of sequence listing upward to telomere on chrosomal short arm and 5'-terminus of this base sequence : 3535
gaagtgtcttcctgcctctctaccacttcctgcctcctctgcccatactccccctcagtccacacacacacacacacacacacacagaggctggcctctgtctttgctgccatgt

SEQ ID NO: 17229 - DNA, 319 bp, Homo sapiens
  AC022205.2_9212
  Located on chromosome 11
  Distance between a terminus base of telomere on chromosomal short arm and 5'-terminus of this base sequence : 27262755
  Distance between 3'-terminus of neighbour sequence of sequence listing upward to telomere on chrosomal short arm and 5'-terminus of this base sequence : 147337
gagtgattaaaggaatgatcatagcttcacacatactgcgtgtttgtgcagtaattacgctttacaattggttctgccattaatgccaaagattcttttttagaatgtgataaacctttttggctctaacataccagttccaaacattccttggctttttttgtgcttaatgatggagttttaaaagcctatttttgtatagctctgtgtgtgcgtgcgcacgtgtgtgtgtgtgtgtgtgtattggggccgtggatagggctggggataaaggagaaaaaaagagaaaacggagcttgaaggactgacagtattttaa

SEQ ID NO: 17230 - DNA, 118 bp, Homo sapiens
  D11S4152
  Located on chromosome 11
  Distance between a terminus base of telomere on chromosomal short arm and 5'-terminus of this base sequence : 27555483
  Distance between 3'-terminus of neighbour sequence of sequence listing upward to telomere on chrosomal short arm and 5'-terminus of this base sequence : 292409
tcagccagccagattgccctccagaatactcttctatccttttggttttgaaatacgtgtgtgtgtgtgtgtgtgtgtgtgtgtgtgtgtgtgtgtgtgttattctctactgctaagg

SEQ ID NO: 17231 - DNA, 391 bp, Homo sapiens
  chr11.fa.O7frz.28618598
  Located on chromosome 11
  Distance between a terminus base of telomere on chromosomal short arm and 5'-terminus of this base sequence : 27567253
  Distance between 3'-terminus of neighbour sequence of sequence listing upward to telomere on chrosomal short arm and 5'-terminus of this base sequence : 11652
taaactccataaggacaggaacatttcccctttatttccctgctgtatttcagtgtttagaacagtacctggtatattgtagttgctcaatagatagttgttgaatgaaggaatgaataaattttaaaaatctgatctgattcttttgaggatgttcaggagttagtgcagtgctaggcatagagtaaatgcctaatgaatgtttactaattagtatgaatgaatgaatgaatgaataagcaattgagtgaacaagtaaaagaatttcctaaaggatattgtcaaactagatcaatataatgctgcacagaaatttaatttatgctgtgtttatagcaactctagcgatgatattttagataagatggcctgagcatagtggcattataac

SEQ ID NO: 17232 - DNA, 287 bp, Homo sapiens
  X66427.1_111
  Located on chromosome 11
  Distance between a terminus base of telomere on chromosomal short arm and 5'-terminus of this base sequence : 27616501
  Distance between 3'-terminus of neighbour sequence of sequence listing upward to telomere on chrosomal short arm and 5'-terminus of this base sequence : 48857
acatctagctaagaaagctcaacttttctttttactagagatgttctctctgtgtgtgtgtgtgtgtgtgcgcgcgcgcgtgtgcgcgcgctctgagtttatcctacttttaaaaagctgagtggtgttttacacattttggaataggcagctagtgcttctttttctgcttttgaagtttcctgggaagtcccttaaaagcataccacaaaattaatctcttcctgtttgccagagggttgctctactctaaatttggctctacatctacaagcatgctctaggaa

SEQ ID NO: 17233 - DNA, 189 bp, Homo sapiens
  D11S4115
  Located on chromosome 11
  Distance between a terminus base of telomere on chromosomal short arm and 5'-terminus of this base sequence : 27673287
  Distance between 3'-terminus of neighbour sequence of sequence listing upward to telomere on chrosomal short arm and 5'-terminus of this base sequence : 56499
tggcatgtaaatttaagagactcactgcttgttaaattcccactagaaaacacacacagagacacacacgcccatacacacacacacacagacacacacacacacacacacacacacacagcagtagcagatcagcagagaaagacaccagccaaagaaagataatttgagatacttctgaggtagcag

SEQ ID NO: 17234 - DNA, 277 bp, Homo sapiens
  AC068488.2_67628
  Located on chromosome 11
  Distance between a terminus base of telomere on chromosomal short arm and 5'-terminus of this base sequence : 27674670
  Distance between 3'-terminus of neighbour sequence of sequence listing upward to telomere on chrosomal short arm and 5'-terminus of this base sequence : 1194
ctgaagagctctttgtaaatacacataaacagtgaatatcaggtgcaccatttttaaagtgctattcatttccacaacagtttaggtgaaaccatgtcatcttacaagttgagtgtgtgtgtgtgtgtgtgtgtgtgtgtgtgtagaggatgacgtgacacttttgaggtttatttaagttgttaaagacctcaaggttacaagacttagactgttaagcatttttcctcccagagacacgaaatctacaattttctcgattcaactgtcaactaaa

SEQ ID NO: 17235 - DNA, 404 bp, Homo sapiens
  AC024731.6_61856
  Located on chromosome 11
  Distance between a terminus base of telomere on chromosomal short arm and 5'-terminus of this base sequence : 27763353
  Distance between 3'-terminus of neighbour sequence of sequence listing upward to telomere on chrosomal short arm and 5'-terminus of this base sequence : 88406
gattggctgtctataagactgaggcacccaactctccatttttctactgtttttttttttttaaatatgctttccataaaacaagaattaaaatggggctaagtcaagaagtctcctcattaatgaagtcctagattcccagatacagatacaaagaagagtcaaacataaagcgcctctgtaaaacatctaacagaaataaacaattttattaaggaagctgacctggggagtgtgtgtggatgtgtgtgtgtgtgtgtgtgtgcgtgtgtgtgtgtgtatgcggagtgaggggtgtattcccaaatatcaaaactgagaggccataggagagatgtgttttctagaaaatcaaactagaagttcagctcccagaagataagatcaaagttctaatgctggat

SEQ ID NO: 17236 - DNA, 359 bp, Homo sapiens
  chr11.fa.O7frz.28742636
  Located on chromosome 11
  Distance between a terminus base of telomere on chromosomal short arm and 5'-terminus of this base sequence : 27780578
  Distance between 3'-terminus of neighbour sequence of sequence listing upward to telomere on chrosomal short arm and 5'-terminus of this base sequence : 16821
aagtactcaatgagtattagccaccattgtcatcatcatatcattgtcatcattatcatcatcatcatcatcatcatcatcatcacaaagtctgttgaattttattgttcaaggaaggacaaatcaatttcagagtctttccctgtgggttctcattctccattacctatgagctcacaattgagacaccatgaacgtccaggcacctgaagtgatccaagattatacccatttaaaaatttcacatgccttaccaacatgtcagatattctaatacttttatttcattttgcaatttacaatttgtctcttcatccagcttacactgctcttcatcattaagctaatccttacttctg

SEQ ID NO: 17237 - DNA, 340 bp, Homo sapiens
  AC073329.1_135520
  Located on chromosome 11
  Distance between a terminus base of telomere on chromosomal short arm and 5'-terminus of this base sequence : 27888198
  Distance between 3'-terminus of neighbour sequence of sequence listing upward to telomere on chrosomal short arm and 5'-terminus of this base sequence : 107261
tcagattcagtctggaatctataccattgattctgtggctctcaggcatatgaactacatcactggctgccctgggtttccagcttgcacacaacagatcatgaaacttctgtctcctttattatatgagccaataccttataatagataaatacacaaatctctctctttagagatatatatatatatatctctttatatattacatgtatatatatgtgtgtgtgtgtgtgtgtgtgtgtgtatatgtatgtgtatatatatatatatatatatatatatatatatataattggtactgtgtctctggagaaccctgactaatacagttaccttctgg

SEQ ID NO: 17238 - DNA, 334 bp, Homo sapiens
  chr11.fa.O7frz.29199254
  Located on chromosome 11
  Distance between a terminus base of telomere on chromosomal short arm and 5'-terminus of this base sequence : 28029222
  Distance between 3'-terminus of neighbour sequence of sequence listing upward to telomere on chrosomal short arm and 5'-terminus of this base sequence : 140684
tgctatagtttccttctgaagtagatattcttaatcttgtgtcaatggaagggctttaggaaacccaatgacttaggaaatatgcaaaattgtataaatttgacctccccaatctcccagctggaagaaaatctacacagctttgaacagattctcaaaggcatctatgacccccaaaaaggtcagaatcattgttctggaagagaaattatattatattatattatattatattatattatattatattatattatatgatgcagttaactctgttgttaactatgtacacttttctttgtacaacttgcttggatattgatgtctatgctat

SEQ ID NO: 17239 - DNA, 449 bp, Homo sapiens
  chr11.fa.O7frz.29105396
  Located on chromosome 11
  Distance between a terminus base of telomere on chromosomal short arm and 5'-terminus of this base sequence : 28053565
  Distance between 3'-terminus of neighbour sequence of sequence listing upward to telomere on chrosomal short arm and 5'-terminus of this base sequence : 24009
atctagtttctcaggagtggagtctattgagtagaataatatgacattaaatgttcaagcagatttttgaaagaaaagctcactcattgggaggctgaggcaggcagatcttgagccccagagtttgagaccagcctgaataacatggtgaactcccgctttctaccaaaaatacaaaaattagccagtctcatagcccggtcacaaaataaataaataaataaataaataaatacatacatacatacatacatacatacatacatacgtagattaaaatttaaaaataaaatttaaaaaatgtttttaaaaagttcactctattttaaaagaaaacaaaataagactaaaaatataccctaatcatttaaattctgtacctcattagttttttttctcaaacaggatggaaagtaagtgcatggctggtgaaaatagcttaatagtca

SEQ ID NO: 17240 - DNA, 461 bp, Homo sapiens
  chr11.fa.O7frz.29301211
  Located on chromosome 11
  Distance between a terminus base of telomere on chromosomal short arm and 5'-terminus of this base sequence : 28084609
  Distance between 3'-terminus of neighbour sequence of sequence listing upward to telomere on chrosomal short arm and 5'-terminus of this base sequence : 30595
gagtcaaagtaaatgcagaactactagacaacaattaaatgttgaattcttatatttgatcatttaataaattgtatatgatatttttagttaataaaagttatagtttattaaaactgtaatgtgtattaactccatcttactcactcaaagtatcaagtttagaaattcctcttacagagtcttggtgtgaggagtgtgggaatatgaatcctacaggtaaatttaacatttttttaaaatgagaatgtttatggattatattttttataaaatgctttgttcatatcatgttataaaatgtgaaaaactgatgcagaaattagttttcttggttatctcttcaaatcctagtatatagatgtgtgtatatgtgtgtgtgtgtgtgtgtgtgtgtgtgtgtgtgtgtgtatatatatatatatatagtcttttaggtaaatgaggtagttatgcctaaa

SEQ ID NO: 17241 - DNA, 396 bp, Homo sapiens
  chr11.fa.O7frz.29569193
  Located on chromosome 11
  Distance between a terminus base of telomere on chromosomal short arm and 5'-terminus of this base sequence : 28321015
  Distance between 3'-terminus of neighbour sequence of sequence listing upward to telomere on chrosomal short arm and 5'-terminus of this base sequence : 235945
taatgatcacctaatgctcatatcttcatttgaaatactgaaatgaacaaagactccttgaagaaatgactgaatccagggctgaggctgagaatgtgatgagcctggaacacctttcataatagaaagaaaggaaatactcaaagaatgcagacatattaaaagaacacagaagtaagcttgaaggaactggctcccagtggccaaagtacaattgaaacattaaataatgctaaaagagcaaattataacccattgaataatctagtaccccaatgatataaatacatacatacatacatacatacatacatacatacatacatacatacatacataaatggatagacaaagttcagtggtggctcatgcctgtatgtaatttcagcactttgg

SEQ ID NO: 17242 - DNA, 127 bp, Homo sapiens
  DISD22_0003539
  Located on chromosome 11
  Distance between a terminus base of telomere on chromosomal short arm and 5'-terminus of this base sequence : 28475405
  Distance between 3'-terminus of neighbour sequence of sequence listing upward to telomere on chrosomal short arm and 5'-terminus of this base sequence : 153994
tgacttcgtattcttgctgtgtggaaatgtcagaaattgataaattttagaaaaggcaactggagccacacacacacacacacacacacacatacacacacacaacattgaatgctgacttattcct

SEQ ID NO: 17243 - DNA, 166 bp, Homo sapiens
  DISD22_0003545
  Located on chromosome 11
  Distance between a terminus base of telomere on chromosomal short arm and 5'-terminus of this base sequence : 28553433
  Distance between 3'-terminus of neighbour sequence of sequence listing upward to telomere on chrosomal short arm and 5'-terminus of this base sequence : 77901
tatgcatatgtgggcctgtatgcatacacaaacacacaaagacatcctcacacagacacacacacacacacacacacacacaccacacacacacacacacacacacacacacatatatatatgctgaaactatgtacttgggcagcccaagcacttcaaactcatc

SEQ ID NO: 17244 - DNA, 160 bp, Homo sapiens
  DISD22_0003549
  Located on chromosome 11
  Distance between a terminus base of telomere on chromosomal short arm and 5'-terminus of this base sequence : 28690439
  Distance between 3'-terminus of neighbour sequence of sequence listing upward to telomere on chrosomal short arm and 5'-terminus of this base sequence : 136840
atcccagcaaccttcatccaaaatatctatctatctatctatctatctatctatctatctatctatctatctatccccagaagaaaaaaacttatttacgaagtctatacaagtatacacaccgaattttctacaggacacgcttggccacagaggaaag

SEQ ID NO: 17245 - DNA, 466 bp, Homo sapiens
  AC068859.2_10230
  Located on chromosome 11
  Distance between a terminus base of telomere on chromosomal short arm and 5'-terminus of this base sequence : 28852297
  Distance between 3'-terminus of neighbour sequence of sequence listing upward to telomere on chrosomal short arm and 5'-terminus of this base sequence : 161698
taggctattggtaattaaggtttcctgagccaaaagttttatgtgaacttttgacagtgcagggagtgggcacccccaacctctgcattgttcaagggtccacatatatgtatgcatatatacatatgaggagattaatatgggaattgcctcatgtgattatggaggctgagaagtctcacgattgtctgcaaattggaaaaacaagaaaggcagtggtgtaatttagtccaaaattgaaggtctgagaagaaagggggccataggtgtaagtaccaagccccaagaaccgggaactctaatgtctgagggcaggagaatatggatgtctcagctcagaaagagagagagagagagagagagagaacttacccctcctccacttatttgttcgatcagaggccctccacagattagatggtgcccacccatgttagtgagggtatgtctgattcaaatgctaatc

SEQ ID NO: 17246 - DNA, 298 bp, Homo sapiens
  AC068859.2_18925
  Located on chromosome 11
  Distance between a terminus base of telomere on chromosomal short arm and 5'-terminus of this base sequence : 28869319
  Distance between 3'-terminus of neighbour sequence of sequence listing upward to telomere on chrosomal short arm and 5'-terminus of this base sequence : 16556
tgatacataagtgaaggtaatcaacaacacaagggaggtatatatttaaaggaaaatggtggcttttccaaagagtctgatttagaaagtcttggatgggcccatgaatgcgtattttcagaatgttcccaagcgggttctgatgccaggtcagatttgaaagttaccactctcctttcaatgtattgagctagaaattacacacacacacacacacacacacacacacacacacacacacaaattttcccttccaagagtgctttcacatattatctaatgacagccagagtaacag

SEQ ID NO: 17247 - DNA, 206 bp, Homo sapiens
  chr11.fa.O7frz.29838679
  Located on chromosome 11
  Distance between a terminus base of telomere on chromosomal short arm and 5'-terminus of this base sequence : 28879485
  Distance between 3'-terminus of neighbour sequence of sequence listing upward to telomere on chrosomal short arm and 5'-terminus of this base sequence : 9868
ttaacattctgcaagcatacttggggaagtttttttttttctttttctgactgcatgtgctctaaagaccaagaccaccatggggccttttgctaatgagagagagagagagagagagagagagaggagagagagaggttatatgaacactcaaaggctaacagagttaagagagaaagccttagtgccattctataaacacttga

SEQ ID NO: 17248 - DNA, 473 bp, Homo sapiens
  AC067990.2_93089
  Located on chromosome 11
  Distance between a terminus base of telomere on chromosomal short arm and 5'-terminus of this base sequence : 28929082
  Distance between 3'-terminus of neighbour sequence of sequence listing upward to telomere on chrosomal short arm and 5'-terminus of this base sequence : 49391
ttcattagtctatccaaagcagctaactgaagcagctactaggagaagctaaccaaagccatgagaaaacaggaaaagaatacataaagatagatagatagatgattgatagatagatagatagatagatagatagatagatagatagatagatgatagatagataggtggtgtattagtctactctgcttgtcaaaacaatatactacagactggttggcttaaacaacagaaatttattttctcacggttccgtaggctgaaagtccaagatgaaagtgttggcaggtttgttttctggtgaggcctctcttcctggcttttatatggcagcctttctgctgtgtcctacctggccttttgtctgtgcacacacgggaggcaggggtgttgggagacgaagagagctctggtgtcttctttttcttataggaatactaattctgtcagattaaagtctcatccttatcacc

SEQ ID NO: 17249 - DNA, 406 bp, Homo sapiens
  chr11.fa.O7frz.29745080
  Located on chromosome 11
  Distance between a terminus base of telomere on chromosomal short arm and 5'-terminus of this base sequence : 28940827
  Distance between 3'-terminus of neighbour sequence of sequence listing upward to telomere on chrosomal short arm and 5'-terminus of this base sequence : 11272
ctcaactcactgatttgcttacaattttccaaacattttatgcttttttttggtctccctgcttttacacatgctcttttctatgcccgaaaccacccttcatctcttggccctcggcccaaactctacatgtcttttaagacacatatcaagtattctctccccataaaagcagttcctgactctccctgcttcacttagaggatcctcctttgttttctcataatatacattcttctcgtctagtctgtatttcaaaattaatagtttgtgtgtgtgtgtgtgtgtgtgtgtgtgtgtgtgtgtgtgtcttgctaaaaaataagcatcctgagggcaggaactatgttttatctcttcatatatgactcctaacactatactctgcataacagaaattatcgag

SEQ ID NO: 17250 - DNA, 207 bp, Homo sapiens
  AC026865.4_27461
  Located on chromosome 11
  Distance between a terminus base of telomere on chromosomal short arm and 5'-terminus of this base sequence : 29112805
  Distance between 3'-terminus of neighbour sequence of sequence listing upward to telomere on chrosomal short arm and 5'-terminus of this base sequence : 171572
cctacatttgcagttctgtaacacatttttggcaatcacacattgccagactatgctaagttcagcatagtcattctccaaaagtggacacacacacacacacacacacacaacacatacacacatatcccctattgaatacacaaaatagagttctgcacacaaacagccacatttctagtgttgtatgtacacttgcagttccag

SEQ ID NO: 17251 - DNA, 425 bp, Homo sapiens
  AC024728.3_140256
  Located on chromosome 11
  Distance between a terminus base of telomere on chromosomal short arm and 5'-terminus of this base sequence : 29288145
  Distance between 3'-terminus of neighbour sequence of sequence listing upward to telomere on chrosomal short arm and 5'-terminus of this base sequence : 175133
ttacttaagtcaaaggagtttcagtaaaatccaaatgcaggaatatagccaggcctagaagccaagcactggccagttggtcagttgtcacatctgttcccgcttttatctgtttcttttaaaaatcatctctctctctctctctctctctttctctctctctctctctctctctctctccccctccctccctctccttctctcccccatcccagactactttgatgtatgaatttatttttgcttatggtacataagatgtcttgggcaagatacggctgcccatgacagcaatacataaaatttgtatgtcattatttgaatcatataaaacttaatttgctatctcttagttccaattccaaaatccagggagagagcttatcagccagcaatttttttcaggctatcattaatttatgatt

SEQ ID NO: 17252 - DNA, 319 bp, Homo sapiens
  chr11.fa.O7frz.30808687
  Located on chromosome 11
  Distance between a terminus base of telomere on chromosomal short arm and 5'-terminus of this base sequence : 29295723
  Distance between 3'-terminus of neighbour sequence of sequence listing upward to telomere on chrosomal short arm and 5'-terminus of this base sequence : 7153
gatatacctaatgtcaatgacgagttaatgggtgcagcacaccaacatggcacatatatacttacgtaacaaacctgcacattgtgtacatgtaccctagaacttaaagtataataaaaaaaaaggaaaagaaaaacaaaagacaagaaataaataaataaataaataaagcaacaatcaagagctaacaggggaacctttataagtggacaactgtgtggtcacacagagccctgaaatcagaaggcctttgcacttggtttagcgttctgctgttaccaccttgaaattcttaatgatttgatcttcgaacttgaat

SEQ ID NO: 17253 - DNA, 126 bp, Homo sapiens
  D11S1324
  Located on chromosome 11
  Distance between a terminus base of telomere on chromosomal short arm and 5'-terminus of this base sequence : 29449168
  Distance between 3'-terminus of neighbour sequence of sequence listing upward to telomere on chrosomal short arm and 5'-terminus of this base sequence : 153126
ggcacaaggggaacttaacttactggcctgtttctatgtgtgtgtgtgtgtgtgtgtgtgtgtgtgtgtgtgtgtgtgtgtgtacagggagggagcagtgattttgcaagtttttagggtgagggg

SEQ ID NO: 17254 - DNA, 101 bp, Homo sapiens
  DISO7_10003024
  Located on chromosome 11
  Distance between a terminus base of telomere on chromosomal short arm and 5'-terminus of this base sequence : 29556421
  Distance between 3'-terminus of neighbour sequence of sequence listing upward to telomere on chrosomal short arm and 5'-terminus of this base sequence : 107127
attgtttcatctccttgatcctcaggagtgtgtgtatgtgtgtgtgtgtgtgtgtgtgtatctaacatggggatattgggctacattattacttggttcct

SEQ ID NO: 17255 - DNA, 153 bp, Homo sapiens
  DISO7_10003023
  Located on chromosome 11
  Distance between a terminus base of telomere on chromosomal short arm and 5'-terminus of this base sequence : 29581221
  Distance between 3'-terminus of neighbour sequence of sequence listing upward to telomere on chrosomal short arm and 5'-terminus of this base sequence : 24699
catggatgaggtagtacaagtttctgtgtgctgcacatatatatatgtgtgcgtatatatatatttcctgtgttgcatatatatatatgtgtgtgtgtgcatatatatatatatatatatatatgtatgctacagggaattataatctgtagc

SEQ ID NO: 17256 - DNA, 260 bp, Homo sapiens
  D11S4156
  Located on chromosome 11
  Distance between a terminus base of telomere on chromosomal short arm and 5'-terminus of this base sequence : 29643602
  Distance between 3'-terminus of neighbour sequence of sequence listing upward to telomere on chrosomal short arm and 5'-terminus of this base sequence : 62228
tgaatgtctttctatctggatgtcctcagtgaggaaaaatagaattagtgattagaagcatcaaagaaatgcttaagatttttgattgcttgcaacatttctcatttcgctctcacacatacacacacacacacacacacacacacacacacacacacacacatttttttttttcttttttttgagacagggtctcagtctgtcattcagactggagtgcagtggtgtgatgatggcccactgcagcctcaacctcctcg

SEQ ID NO: 17257 - DNA, 249 bp, Homo sapiens
  AL135933.11_86004
  Located on chromosome 11
  Distance between a terminus base of telomere on chromosomal short arm and 5'-terminus of this base sequence : 29784881
  Distance between 3'-terminus of neighbour sequence of sequence listing upward to telomere on chrosomal short arm and 5'-terminus of this base sequence : 141019
taagaaatgacctggtctcagactcctcactgccatttggtgctgtgcaaatttcataccttttggtgttagtgccaggtccaaaggaatgtatgtgtgtgcatgtttgcatgtgtgtgtgtgtgtgtgtgtgtgtgtgatgactttagcctcccatcatctcaattaaccatgccctgcatttttgacacgggaaaaagatatttttttcagttttcttcaaagtactatgtgtcagtgcaacttcaa

SEQ ID NO: 17258 - DNA, 201 bp, Homo sapiens
  AL138813.8_43603
  Located on chromosome 11
  Distance between a terminus base of telomere on chromosomal short arm and 5'-terminus of this base sequence : 30028134
  Distance between 3'-terminus of neighbour sequence of sequence listing upward to telomere on chrosomal short arm and 5'-terminus of this base sequence : 243004
gaaagacaaggctaccactttctctccactccccacaatcctctctctctcacacacacacacacacacacacacacacacacagtccaccaacacaatagtaccagaaaggaatataaggtagtggaatggttggtcttgattacagtcactggcagggtttttgcaatggaagtggattataagttaggccttgaaagg

SEQ ID NO: 17259 - DNA, 219 bp, Homo sapiens
  D11S4201
  Located on chromosome 11
  Distance between a terminus base of telomere on chromosomal short arm and 5'-terminus of this base sequence : 30064328
  Distance between 3'-terminus of neighbour sequence of sequence listing upward to telomere on chrosomal short arm and 5'-terminus of this base sequence : 35993
gccaatcagaaactcactttctaacgtgtgtgtgtgtgtgtgtgtgtatgtgtgtgtgtgtatatatatatatatatatatatatataatcagtcattttgggaatctcaatttagtcagataactttatgatacacttactgtgtattgtgttataattactgtgtatctttgtcaatgtagtctgtttcactactactgtccattggctcatttctc

SEQ ID NO: 17260 - DNA, 472 bp, Homo sapiens
  chr11.fa.O7frz.30327475
  Located on chromosome 11
  Distance between a terminus base of telomere on chromosomal short arm and 5'-terminus of this base sequence : 30148349
  Distance between 3'-terminus of neighbour sequence of sequence listing upward to telomere on chrosomal short arm and 5'-terminus of this base sequence : 83802
tacctaatgtagatggtaggctaatgggtgcagcaaagcaccatggcacgtgtatacgtatgtgtgtgtgtatatatatatatgtgtgtgtgtgtatatatatatatatatatatatgattacccttgcacctgaaacactgcaaaattagaaaaatacatgaaacaatgattttcaagacactatactggggatggaaggatagagatttctgagaaatgagaaattaataaagtgaaagctaaggttgccacagttttctgcctggagagaatattcagtaatggcatatgaatgatgaaaccaagtggagtctggcagattttctgaattgagaagccaaagataactataactttaggcaagaatttgcagagaagactgcgagagagaacagaactaggcatacagagatgtttttccagagaattctagacatcattctcagctgtttggtatggttcaatttatg

SEQ ID NO: 17261 - DNA, 321 bp, Homo sapiens
  AL356497.3_28847
  Located on chromosome 11
  Distance between a terminus base of telomere on chromosomal short arm and 5'-terminus of this base sequence : 30273154
  Distance between 3'-terminus of neighbour sequence of sequence listing upward to telomere on chrosomal short arm and 5'-terminus of this base sequence : 124333
aaactggtatgatcaccttatcattaactatcctacagatatatttgaaatcagttagggtaaaatatctattaattgaatgtgactttcattcataagtatttaaaaattggtactaagtaatttttccccagaagaaaaccccaaaataatagcaatactaatttcagaactaaaacataagagaataagtgaattcctctttctctgtgtacacacacacacacacacacacacacactcattttatttctgaaaattattcctccccattttgtatataaactctaaaagcaattcgttcattctgagaagcaggac

SEQ ID NO: 17262 - DNA, 205 bp, Homo sapiens
  DISO7_10003028
  Located on chromosome 11
  Distance between a terminus base of telomere on chromosomal short arm and 5'-terminus of this base sequence : 30469482
  Distance between 3'-terminus of neighbour sequence of sequence listing upward to telomere on chrosomal short arm and 5'-terminus of this base sequence : 196007
atacccagatcacaatcttctgttaaaatacgcaaaacagctttgttatttagtactttaagtttttgcctggaggagtgtgtgtgtgtgtgtgtgtgtgagagagagagagagagagagagagagagagagagagagagagagagaatttccctaaataaaatttcctccttctttctgtctgaaagtggctcagggaatcact

SEQ ID NO: 17263 - DNA, 377 bp, Homo sapiens
  chr11.fa.O7frz.31599317
  Located on chromosome 11
  Distance between a terminus base of telomere on chromosomal short arm and 5'-terminus of this base sequence : 30508076
  Distance between 3'-terminus of neighbour sequence of sequence listing upward to telomere on chrosomal short arm and 5'-terminus of this base sequence : 38389
ttccgttagtaaagaaatggtaatctcaagttctctctgtctctctctctctgtgtgtgtgtgtgtgtgtgtgtgtgtgtgtgtgtgtgtgtgtgtgtgtgttggtatctctctctctctctctctgtctctctttcccctcaagaaaataactcagaattttacttcaagaatgaagaaaagctactagactgtctttagcaggggactgatgtgatcagatttactctcttaagggattcccttagctgtttggagagaataaacttatagagtatattagtcagggttctcctgagaaacagaatccacagggtgtgtgtgtgcatgtgtgcatatgtgcataaggagacttctaagaaattggctctgaaagt

SEQ ID NO: 17264 - DNA, 400 bp, Homo sapiens
  chr11.fa.O7frz.31699850
  Located on chromosome 11
  Distance between a terminus base of telomere on chromosomal short arm and 5'-terminus of this base sequence : 30599571
  Distance between 3'-terminus of neighbour sequence of sequence listing upward to telomere on chrosomal short arm and 5'-terminus of this base sequence : 91118
gttacttagtgcaccaattcaaatgttaatgtcatccagaaacacttacaaatgtatgctaaataatttttaatcaaatatctgggcaccctgtggccctgtcaagccaacacataaaattaaccattattctatctatctgtctatctatctatctatcatctatctatctatctatctatctgtctatctatctatctatctaatttgtctacgtgatctatctagaaccatgattttatgctgatccctctaatttcaattaaactacaatgttcattctagccttttccattgtcttacttgtaaccatttctctgatagtgagggacctggtattcattatccacaatatatttgcttatttgttcaatcctggagcatacatgaagtgtttcag

SEQ ID NO: 17265 - DNA, 248 bp, Homo sapiens
  AC021202.5_120695
  Located on chromosome 11
  Distance between a terminus base of telomere on chromosomal short arm and 5'-terminus of this base sequence : 30696481
  Distance between 3'-terminus of neighbour sequence of sequence listing upward to telomere on chrosomal short arm and 5'-terminus of this base sequence : 96510
gagtcatgattcattagctacatctgtgtaccacctgtactaatatttactaagtatttctctacatatggtatcacttttattacttaaataaatttatcctcatcctaaacaagaatatccatgaaatcacaaatatggcatactatacacacacacacacacacacacacacactctctctctctctctctctctctttcaatatgcatgcaataaatacataattactaaagaacaaatgtgca

SEQ ID NO: 17266 - DNA, 403 bp, Homo sapiens
  AL136088.10_76527
  Located on chromosome 11
  Distance between a terminus base of telomere on chromosomal short arm and 5'-terminus of this base sequence : 30837899
  Distance between 3'-terminus of neighbour sequence of sequence listing upward to telomere on chrosomal short arm and 5'-terminus of this base sequence : 141170
tgcataatgaatccataggttatcatcacccagcttcaacaattatcaatactctgttattcttatttcacctatacctccatccaatccctactccctcaccaaaatattataatttctatagttttttatagtaaaattttacacatgaaaatatacaaatatatatacatatatgtgtatatgtgtgtgtgtgtgtgtgtgtgtgtgtatatatatatttaatagagacaaggtgtcgctctgtcactcaggttagagtgcactggtgcaatcatagctcactgtaaccttgaacctctggcctcaagaaatcctcccatctcaggctcccaaagtgctgggatctgccacacccagcctaaaataaacaaaccttagttgtacaagtttgactaatgga

SEQ ID NO: 17267 - DNA, 321 bp, Homo sapiens
  AL136088.10_32110
  Located on chromosome 11
  Distance between a terminus base of telomere on chromosomal short arm and 5'-terminus of this base sequence : 30882365
  Distance between 3'-terminus of neighbour sequence of sequence listing upward to telomere on chrosomal short arm and 5'-terminus of this base sequence : 44063
ttggtaggcttctgatcaatagtaggctattagcagttaagtttttgtggagtcaaaacttatatgtggattttcaactgcatagggggttggtgcccctaacctccatgttgcttaagtgtcaactgtgtgtgtgtgtgtgtgtgtgtgtgtgtgtgtgtgaaaaaacatgagattgggagataatgagtttggttttgtttgtatgtgtttgaagtgctctgagaaagccaagggatgaagtgagtaaggcggttacatataggacttcagaggtgttatcaatgtagaagtcaactgtatgaaggttgaaatggtagt

SEQ ID NO: 17268 - DNA, 148 bp, Homo sapiens
  D11S4154
  Located on chromosome 11
  Distance between a terminus base of telomere on chromosomal short arm and 5'-terminus of this base sequence : 30882456
  Distance between 3'-terminus of neighbour sequence of sequence listing upward to telomere on chrosomal short arm and 5'-terminus of this base sequence : -230
ggtgcccctaacctccatgttgcttaagtgtcaactgtgtgtgtgtgtgtgtgtgtgtgtgtgtgtgtgtgaaaaaacatgagattgggagataatgagtttggttttgtttgtatgtgtttgaagtgctctgagaaagccaagggat

SEQ ID NO: 17269 - DNA, 359 bp, Homo sapiens
  AL122014.27_88685
  Located on chromosome 11
  Distance between a terminus base of telomere on chromosomal short arm and 5'-terminus of this base sequence : 30946628
  Distance between 3'-terminus of neighbour sequence of sequence listing upward to telomere on chrosomal short arm and 5'-terminus of this base sequence : 64024
gcgatctgaaatagttcacaactaaattttttttccattttcacatctaaaaggaagcccaccactgaatcccatctcccagaaagaatcacttttatcatgttgtatatttctgtatacccctctagacttttttttcactatacacacacacacacacacacacacactcacacacacatatagacataaataaacatttgtggcgtatatagtaaagaaaaatatgttcaatataataataattaaatacacaaaatatatattaaatattagattatgctataataccagtttgcaacatgctttaaaaaattccaagatttaaatatgaatatttgattaaattcatggactca

SEQ ID NO: 17270 - DNA, 347 bp, Homo sapiens
  AL122014.27_52674
  Located on chromosome 11
  Distance between a terminus base of telomere on chromosomal short arm and 5'-terminus of this base sequence : 30982750
  Distance between 3'-terminus of neighbour sequence of sequence listing upward to telomere on chrosomal short arm and 5'-terminus of this base sequence : 35763
tggcactgtcacagctataattttaccgtgtgtgtgtgtgtgtgtgtgtgtgtgtgtgtatgtatgtatgtatgtttacattcattcagagaattaaattttttcccctaattagaaagttaagttccacaaggactgtgccttgcatctgttttctgctttcaatattttccccagcagtgtgttcccctggcacagagcaggccctcaatttatatttgatgaataaatgaatgaatagttaattgactgaaaactatcgcctggtataaatgtagtagaaatcacaaccaggcatttttcttgaacactttgaaaaaagacagtgcataagcagacaagaatct

SEQ ID NO: 17271 - DNA, 311 bp, Homo sapiens
  AL133296.11_1652
  Located on chromosome 11
  Distance between a terminus base of telomere on chromosomal short arm and 5'-terminus of this base sequence : 31060711
  Distance between 3'-terminus of neighbour sequence of sequence listing upward to telomere on chrosomal short arm and 5'-terminus of this base sequence : 77614
gttaagcacaagcattgaaattacttttaactcacaacaacggaaaaatcttttaatgaaaatagtatccaccaaaggttaaaaagttaaggtttgtcacagaggaaaatgagaccggcatgatcaaaatgcaatgcatgttgcccttagagagatctggcagtccccggatctgttttgtctctaatctctctctctctctctctctctctctctcatctttctctttctctctctctctttttgctagtaatctactaaagaagtgtcaaaaacttatattttactgatgattcattatcaagtttggc

SEQ ID NO: 17272 - DNA, 184 bp, Homo sapiens
  DISD22_0003557
  Located on chromosome 11
  Distance between a terminus base of telomere on chromosomal short arm and 5'-terminus of this base sequence : 31370834
  Distance between 3'-terminus of neighbour sequence of sequence listing upward to telomere on chrosomal short arm and 5'-terminus of this base sequence : 309812
aaggttgattcttgggactatcaaatggagttttcaaaggatgtgtgtgtgtgtatgtgtgtgtgtgtgtgtgtgtatacacatatgcttcttttatttatctctattacacatataagttcatagagaaggtgtattttaggataatagaatttctttaaagaatgactttatgtgctcaaca

SEQ ID NO: 17273 - DNA, 136 bp, Homo sapiens
  DISD22_0003561
  Located on chromosome 11
  Distance between a terminus base of telomere on chromosomal short arm and 5'-terminus of this base sequence : 31441465
  Distance between 3'-terminus of neighbour sequence of sequence listing upward to telomere on chrosomal short arm and 5'-terminus of this base sequence : 70447
tggtgaaactgtgtcatcttctatataaagcccagcctctctctctctctctctctctctctctctctctctctctctctctctctctctctctctctgctttctttaccagggcagtggtttgctgtcctccaag

SEQ ID NO: 17274 - DNA, 141 bp, Homo sapiens
  D11S2001
  Located on chromosome 11
  Distance between a terminus base of telomere on chromosomal short arm and 5'-terminus of this base sequence : 31569756
  Distance between 3'-terminus of neighbour sequence of sequence listing upward to telomere on chrosomal short arm and 5'-terminus of this base sequence : 128155
ttggttaagaatggaaattccagttttatagatagatagatagatagatagatagatagatagatagatagatagatagatagacatgtgttgcttaacaacggggatacgttctgagaaacccaccattaggtgatttca

SEQ ID NO: 17275 - DNA, 276 bp, Homo sapiens
  D11S914
  Located on chromosome 11
  Distance between a terminus base of telomere on chromosomal short arm and 5'-terminus of this base sequence : 31570143
  Distance between 3'-terminus of neighbour sequence of sequence listing upward to telomere on chrosomal short arm and 5'-terminus of this base sequence : 246
atctcatgggagtaccgttgtaaatgtagtccatccttaagcaaaacactcttatgcaatgcatgactatacacacacacacacacacacacacacacacacattttttttggtctgtttctctgtagaaccctgactaatataccctctttcaaagaccatgttgccttgcaaggctgaggtggaactggtgccagaaaaactttcctgaagcaaggaccaatagcgcctgtcaggtgatggatgccaatgagatcagtaatggtgatgtgggtc

SEQ ID NO: 17276 - DNA, 224 bp, Homo sapiens
  D11S1322
  Located on chromosome 11
  Distance between a terminus base of telomere on chromosomal short arm and 5'-terminus of this base sequence : 31762511
  Distance between 3'-terminus of neighbour sequence of sequence listing upward to telomere on chrosomal short arm and 5'-terminus of this base sequence : 192092
cccggccagttaagagttgttagtagtatgactcgtggaatgacattagcatggaggaagtaatcaaatcccacaaatactttgatactttgctaatacgtttcactggattataaggatggggagagaggtggattggtgtgtgtgtgtgtgtgtgtgtgtgtatgagagcgagagagagagaaagaggagatattggggataaattctggctttctgaaaac

SEQ ID NO: 17277 - DNA, 238 bp, Homo sapiens
  AL390768.1_50887
  Located on chromosome 11
  Distance between a terminus base of telomere on chromosomal short arm and 5'-terminus of this base sequence : 31762538
  Distance between 3'-terminus of neighbour sequence of sequence listing upward to telomere on chrosomal short arm and 5'-terminus of this base sequence : -197
atgactcgtggaatgacattagcatggaggaagtaatcaaatcccacaaatactttgatactttgctaatacgtttcactggattataaggatggggagagaggtggattggtgtgtgtgtgtgtgtgtgtgtgtgtatgagagcgagagagagagaaagaggagatattggggataaattctggctttctgaaaactgaaagagggccacatttggtgcaagaaaatgagttactgg

SEQ ID NO: 17278 - DNA, 202 bp, Homo sapiens
  Z23802.1_176
  Located on chromosome 11
  Distance between a terminus base of telomere on chromosomal short arm and 5'-terminus of this base sequence : 31762607
  Distance between 3'-terminus of neighbour sequence of sequence listing upward to telomere on chrosomal short arm and 5'-terminus of this base sequence : -169
tacgtttcactggattataaggatggggagagaggtggattggtgtgtgtgtgtgtgtgtgtgtgtgtatgagagcgagagagagagaaagaggagatattggggataaattctggctttctgaaaactgaaagagggccacatttggtgcaagaaaatgagttactgggtttcatcttgggcatgttggacctgaagcatc

SEQ ID NO: 17279 - DNA, 371 bp, Homo sapiens
  AL390768.1_31416
  Located on chromosome 11
  Distance between a terminus base of telomere on chromosomal short arm and 5'-terminus of this base sequence : 31781971
  Distance between 3'-terminus of neighbour sequence of sequence listing upward to telomere on chrosomal short arm and 5'-terminus of this base sequence : 19162
aatggaccttgactagaactacactattaactgtccgaggtctccagcctgccaacttatcctgcaggtctttggatttgcccacatctataattatatgagacagtttcttacaataaatctctttgcacacacaaacacacacacacacacacacacacacacacacacacaccctattggttcagtttctctagagagccttaaataatacagtttttaatgttttaaagcaggggcccccaacccccagccatggatcagtactggaacagggcctcacagcaggaggtgagcagcaggcaactaaacaaagcttcatctgtatttacagctgctccccattgcttgtattactgcctgagctctac

SEQ ID NO: 17280 - DNA, 159 bp, Homo sapiens
  Z86001.1_14415
  Located on chromosome 11
  Distance between a terminus base of telomere on chromosomal short arm and 5'-terminus of this base sequence : 31827785
  Distance between 3'-terminus of neighbour sequence of sequence listing upward to telomere on chrosomal short arm and 5'-terminus of this base sequence : 45443
aatgatttgccaagactgataggctttgatgatcactcgtcattatctgctttataaatctaggctttactttgcctttctcattttaatacacacacacacacacacacacacacacacacacacacacaaaacctggctgtattagttcattctcac

SEQ ID NO: 17281 - DNA, 251 bp, Homo sapiens
  AL390767.1_8700
  Located on chromosome 11
  Distance between a terminus base of telomere on chromosomal short arm and 5'-terminus of this base sequence : 31851536
  Distance between 3'-terminus of neighbour sequence of sequence listing upward to telomere on chrosomal short arm and 5'-terminus of this base sequence : 23592
tgttgaatgtttggaaacattaataaagaagccaggatcatatttttaactgggtttacttcttgccaactcctgttttatcagtgcctacactactaaacacacacacaagagtaagcatcctcaaaagtaaaggattttagtaacaaaccaaaattttagatgacaatagaagatatttattttcagcaaatatatatatatatatatatatatataaaaaactagaaacattgctggcaaagaaacat

SEQ ID NO: 17282 - DNA, 404 bp, Homo sapiens
  AL390767.1_3617
  Located on chromosome 11
  Distance between a terminus base of telomere on chromosomal short arm and 5'-terminus of this base sequence : 31856670
  Distance between 3'-terminus of neighbour sequence of sequence listing upward to telomere on chrosomal short arm and 5'-terminus of this base sequence : 4883
aacaggcatgtcataacagttccaatggtacagtgtgcagagctgctcttcttgcaggatgatgatgacacatcttctgagagtaagaaattttatagaatcccaaaagcaaaggtaatagcaaaaggaatacacacacacacacacacacacacacacacacacacagatataccttaagaatccttaataagtaagctagtataggaatagagtaaaacatttgttttcttagttgtttattcgatgatgaaaacactattttcaaaaaacaatttttttttcacagaaattgatagacaccaaactggagctggtttggctttctgaaccagagattctataattaatgacttttataaagattaaacagggttcaggtagacattcctatggtgaatacc

SEQ ID NO: 17283 - DNA, 164 bp, Homo sapiens
  Z83308.1_11410
  Located on chromosome 11
  Distance between a terminus base of telomere on chromosomal short arm and 5'-terminus of this base sequence : 31897010
  Distance between 3'-terminus of neighbour sequence of sequence listing upward to telomere on chrosomal short arm and 5'-terminus of this base sequence : 39936
ggaatgaaatttcctttggtaccatgtgtgtgtgtgtgtgtgtgtgtgtgtgtgtgtgtgtgtgtgtgtgtgtgtgtgtgtgtgtgtgtgtaagaaccctatagagagaaaaataagaaatctgtcagatttttaatttcctgacctaggatgaagctgtttct

SEQ ID NO: 17284 - DNA, 261 bp, Homo sapiens
  Z66772
  Located on chromosome 11
  Distance between a terminus base of telomere on chromosomal short arm and 5'-terminus of this base sequence : 31906806
  Distance between 3'-terminus of neighbour sequence of sequence listing upward to telomere on chrosomal short arm and 5'-terminus of this base sequence : 9632
aggtgacatatcaagaccctgtctcaaaattaataaataattgttattatttattgcatacatatatgtatatgtgtgtgtgtgtgtgtgtgtgtgtgtgtgtgtgtgtatatgtgcattttatgttctcctatgtctttctctggcttgataactcatttcttttagtgctaaataatattgcattgtgtgggtgtaccatagtttgtttattcgttcacttactaaagaacatcttggttgcttccaagttttggcaat

SEQ ID NO: 17285 - DNA, 314 bp, Homo sapiens
  Z83306.1_18322
  Located on chromosome 11
  Distance between a terminus base of telomere on chromosomal short arm and 5'-terminus of this base sequence : 31959908
  Distance between 3'-terminus of neighbour sequence of sequence listing upward to telomere on chrosomal short arm and 5'-terminus of this base sequence : 52841
gacttatggtacaccattaagcaggtgtgtgtgtgtgtgtgtgtgtgtgtgtgtgtgtagtctgtgaagaagagagaaaaaaggaggcagaaagcttctttaaagaaatagtggaaacaactccccaaatctggggctggaaatgtatatccaaattcaagaagcccagtggatcccaaagaagatgaatccaatgaagtcaacactaagacacattataatcaaactgtcagaaataaaagacagaattttgaaacaacaaaagaaaactgaatcatcacaaacaagggaaacttcataagactatcggtgga

SEQ ID NO: 17286 - DNA, 353 bp, Homo sapiens
  Z83307.1_9735
  Located on chromosome 11
  Distance between a terminus base of telomere on chromosomal short arm and 5'-terminus of this base sequence : 32022604
  Distance between 3'-terminus of neighbour sequence of sequence listing upward to telomere on chrosomal short arm and 5'-terminus of this base sequence : 62382
ttctagtgttgactgtacttggaagaactttcccaccagaaccaagttaaattttctttggaatggcattcagtgacctttctgtggcctgaaatagccaaatcatcatttttccttataagtcagacatttagtctttgaattactggtagatgaaaagaagaaacacacacacacacaccacacacacacacacacacacacacacacacacacacacacacacacacacacacacactgaaaagatgcccagagaaataaaaagacagaaaaaaggaaatcttttcattcttctatgcaaagggccctggctaaatttagctctttgtactgaagatgtggcatttactt

SEQ ID NO: 17287 - DNA, 183 bp, Homo sapiens
  Z83307.1_6207
  Located on chromosome 11
  Distance between a terminus base of telomere on chromosomal short arm and 5'-terminus of this base sequence : 32026255
  Distance between 3'-terminus of neighbour sequence of sequence listing upward to telomere on chrosomal short arm and 5'-terminus of this base sequence : 3298
taatccgtgagaaagcgagtgaaagcgcctcccattatcccagccccaggaccatctgacgatgggaataggatttgtttcctggaaggaggtgagagagagagagagagagagagacagagagagagttgctgggaaataaaatcattccttagtttcttagtgtcttaatcagtgaggcgg

SEQ ID NO: 17288 - DNA, 248 bp, Homo sapiens
  AL049635.8_94554
  Located on chromosome 11
  Distance between a terminus base of telomere on chromosomal short arm and 5'-terminus of this base sequence : 32056969
  Distance between 3'-terminus of neighbour sequence of sequence listing upward to telomere on chrosomal short arm and 5'-terminus of this base sequence : 30531
ctgttaatgtcagttgaggttattttagggcctggatgctctaggaagaccacctaaaatgtgtttatttctctgcccaattcacctatagtgtaaggagcattttattttattttattttattttattttattttattatactttaagttttagggtacatgtgcacaatgtgcaggtttgttacatgtgtatacttgtgccatgttggtgtgatgcacccattaactcgtcatttagcattaggta

SEQ ID NO: 17289 - DNA, 304 bp, Homo sapiens
  AL035078.32_59584
  Located on chromosome 11
  Distance between a terminus base of telomere on chromosomal short arm and 5'-terminus of this base sequence : 32243162
  Distance between 3'-terminus of neighbour sequence of sequence listing upward to telomere on chrosomal short arm and 5'-terminus of this base sequence : 185945
ttggcattgctaccataaatagaaaatcaataacctttgcttgctataaatggaagctaattataaagacaaatagagttccaaactactaaattcaacacacacacacacacacacacacacacacacacacacacacacacaagagacagagatagagataaacagttttgaaaacagggtgggctgagtctgaatcctgcattctttgttcaaaagggcggttagcaagtgttagaggatgataaagaaaaatggagattttctttgggataatcagaaggcttaaaggagaattatgaag

SEQ ID NO: 17290 - DNA, 266 bp, Homo sapiens
  AL035078.32_52805
  Located on chromosome 11
  Distance between a terminus base of telomere on chromosomal short arm and 5'-terminus of this base sequence : 32249932
  Distance between 3'-terminus of neighbour sequence of sequence listing upward to telomere on chrosomal short arm and 5'-terminus of this base sequence : 6466
tacctaatgctaaatgacgagttaatgggtgcagcacaccagcatggcacatgtatacatatgtaactaacctgcacattgtgcacatgtaccctaaaacttaaagtataataataataataataataataataataataataataataataaaaagaaaaaccctatgataggtcaagactatttttaaagaaagttgattattttctatttctttcccctttctgccggctggagtggggacgtggtgctgagacagctttgac

SEQ ID NO: 17291 - DNA, 226 bp, Homo sapiens
  AL035078.32_47762
  Located on chromosome 11
  Distance between a terminus base of telomere on chromosomal short arm and 5'-terminus of this base sequence : 32255054
  Distance between 3'-terminus of neighbour sequence of sequence listing upward to telomere on chrosomal short arm and 5'-terminus of this base sequence : 4856
tttaagaaaaggtgagtaatgcagttggtctgacatggtctagggtgtggcatgtgtgtgtgtgtgtgtgtgtgcgcacacatgttcttttgtgcacattagggagaacaggagataagattggtgaaagggtttgaggtgagttatgacaacccctgaatgtcatgctcaggaatttgaactttattttgtaggaaatgggaagtcactgagagcgtttcagtag

SEQ ID NO: 17292 - DNA, 270 bp, Homo sapiens
  Z67040
  Located on chromosome 11
  Distance between a terminus base of telomere on chromosomal short arm and 5'-terminus of this base sequence : 32258939
  Distance between 3'-terminus of neighbour sequence of sequence listing upward to telomere on chrosomal short arm and 5'-terminus of this base sequence : 3659
gctctctatgtgtttgggtggagagatgcattaatggagagaggcaggaaaataaggggtttggagaagaaacgaaacacctgaaaacaagtcatcttttagggttcagatgctcctgaaattttaagagtgaagtgaaaaatgacatgattttcagggactggattttctcttccctctaggactcctcacacacacacacacacacacacacacacaaacacacacacacacagacacacacgcaggaccatccactagcgtactctt

SEQ ID NO: 17293 - DNA, 328 bp, Homo sapiens
  AL035078.32_37889
  Located on chromosome 11
  Distance between a terminus base of telomere on chromosomal short arm and 5'-terminus of this base sequence : 32264696
  Distance between 3'-terminus of neighbour sequence of sequence listing upward to telomere on chrosomal short arm and 5'-terminus of this base sequence : 5487
aggtagcacaactaaacggtaacagcacctggacttgaatccaggtctggctctcttcaaagcctccattttgaccactacactgcatcctggggactgcacttcatatttttctgctggatttgataccaatttaaaataaggaagagcaggggcaagccagaggccaaactagaaatttaaatataaaggtcagtaaataattgaactattctcaagagatagcctaggtattggcaagactattacctccttagactcatacacagcttcttacacacacacacacacacacacacacacactcacttggactaattacctgtct

SEQ ID NO: 17294 - DNA, 435 bp, Homo sapiens
  AL035078.32_13832
  Located on chromosome 11
  Distance between a terminus base of telomere on chromosomal short arm and 5'-terminus of this base sequence : 32288788
  Distance between 3'-terminus of neighbour sequence of sequence listing upward to telomere on chrosomal short arm and 5'-terminus of this base sequence : 23764
atcatgaggtcaggagtttaagaccagcctgaacaacatggtgaaactctgtctctactaaaaatacaaaaattagccgggcgtggtggtgagtgcctgtaatcccaggtacttaggagggaggctgaggcaggagaatcgcttgaacccaggaggcaaaggttgcagtgagctgagatcgcaccattgcactccagcctgggcgacagagtaagactccatctcaaaaaaaaaaaaaaaagaaaagaaaagaaaagaaaagaaaagaaagaaagaataatggccttcagttccatccatgtttctgcaaaggacatgatctcattactttttatggcttcagagtattgcatggtatatatgtacattttctttatccagtttattattgatggggatttaggttgattccatatctttgctattgcgaatagt

SEQ ID NO: 17295 - DNA, 346 bp, Homo sapiens
  AL078612.8_36907
  Located on chromosome 11
  Distance between a terminus base of telomere on chromosomal short arm and 5'-terminus of this base sequence : 32360141
  Distance between 3'-terminus of neighbour sequence of sequence listing upward to telomere on chrosomal short arm and 5'-terminus of this base sequence : 70918
cttaaagcagaactaccatttgacccagcaagcccactactggatatatattcaaaagcaaataaatcatcctgccacaaacacacatgtactcatatattcatcccagcactattcacaataccaaagacatggaattatcctagatgcccatcaacaatagactgaataaagaaaatgtgatatatatatatatatatatatatatatatatatatatatatatatatatatatatacacacactgtggaatagtatgcagccataaaaagaatgaaatcatgtcctttaaagccacatggatgcagctagaggccattatcctaagcaagttaatgcaggaac

SEQ ID NO: 17296 - DNA, 229 bp, Homo sapiens
  AL109624.11_42020
  Located on chromosome 11
  Distance between a terminus base of telomere on chromosomal short arm and 5'-terminus of this base sequence : 32434221
  Distance between 3'-terminus of neighbour sequence of sequence listing upward to telomere on chrosomal short arm and 5'-terminus of this base sequence : 73734
aaatgtcctaacctcttggaaggtggctcagacaggaggtgatgctgtctatatctgtgacacacagccacatagcatctcagagtgggagattaagaccagatccttgggaaagttcatcaggaacaccacacatacaaatgtgcacaggtgtgcatgcacacacacacacacacacacacagatgcacacatgaacgtgctcatgaacagacggcacagatttccta

SEQ ID NO: 17297 - DNA, 175 bp, Homo sapiens
  AL109624.11_41250
  Located on chromosome 11
  Distance between a terminus base of telomere on chromosomal short arm and 5'-terminus of this base sequence : 32435057
  Distance between 3'-terminus of neighbour sequence of sequence listing upward to telomere on chrosomal short arm and 5'-terminus of this base sequence : 607
gacacgagctagtaaggacagtagctggggtggaaacctgagtcccaattctgattctgaggcctgtgcccctaatctgtgtgtgtgtgtgtgtgtgtgtgtgtgtgtgtgtgtgtgggtgtgtgtgtgtatagatgacttaacataaaaagtaagacaccttgagcaattaact

SEQ ID NO: 17298 - DNA, 405 bp, Homo sapiens
  AL079340.7_66255
  Located on chromosome 11
  Distance between a terminus base of telomere on chromosomal short arm and 5'-terminus of this base sequence : 32523796
  Distance between 3'-terminus of neighbour sequence of sequence listing upward to telomere on chrosomal short arm and 5'-terminus of this base sequence : 88564
ttaagtgatgtgagacttaccgtatataaatctgattttataaaagctttccacaaagcatctataaaatgttcatggtatgtgaacatacacagtaaactcagccaggatgtagtatggcattttaaggcaggggagtggggacaggaggcagcaacatgaagcagcctgtgtttacattgttagtatgcagaaacccactaactcactttacaatttaaattaagctgattacacacaaacacacacacacacacacacacacacacacacagacttattaatgtagggtcttcctgaatggcatctgtttcagttatctatttctacatagcaaaatgacacaaaattgagtggcttaaaataataagaattggccatttctccagtttctgtactttgctg

SEQ ID NO: 17299 - DNA, 229 bp, Homo sapiens
  Z66999
  Located on chromosome 11
  Distance between a terminus base of telomere on chromosomal short arm and 5'-terminus of this base sequence : 32711169
  Distance between 3'-terminus of neighbour sequence of sequence listing upward to telomere on chrosomal short arm and 5'-terminus of this base sequence : 186968
tgcaaatagtatgccacctgtactagtcagggttcttcaaagaaacagaaccaacaagatgcttatgtgtgtgtgtgtgtgtgtgtgtgtgtgtgtcgcagggggcagggttgtgtacatgtttatatgtgtatatatacatgtgagaagagagattttaagcaattgggtcacataattgtggaggccattaactccaaaatttgcactgcagactgctggctggaga

SEQ ID NO: 17300 - DNA, 387 bp, Homo sapiens
  AL049692.13_6540
  Located on chromosome 11
  Distance between a terminus base of telomere on chromosomal short arm and 5'-terminus of this base sequence : 32711170
  Distance between 3'-terminus of neighbour sequence of sequence listing upward to telomere on chrosomal short arm and 5'-terminus of this base sequence : -228
gcaaatagtatgccacctgtactagtcagggttcttcaaagaaacagaaccaacaagatgcttatgtgtgtgtgtgtgtgtgtgtgtgtgtgtgtcgcagggggcagggttgtgtacatgtttatatgtgtatatatacatgtgagaagagagattttaagcaattgggtcacataattgtggaggccattaactccaaaatttgcactgcagactgctggctggagacctagggaaaaggtgcagtttgagttcaaaggcagtctgctggcagaattctttcttcctcgggggaggtcggcctttatttatttattttttttttaaagctgattggatgaagtccactcacattatggaaggtcatctgctttactcaaagtctgc

SEQ ID NO: 17301 - DNA, 247 bp, Homo sapiens
  chr11.fa.O7frz.33904780
  Located on chromosome 11
  Distance between a terminus base of telomere on chromosomal short arm and 5'-terminus of this base sequence : 33050805
  Distance between 3'-terminus of neighbour sequence of sequence listing upward to telomere on chrosomal short arm and 5'-terminus of this base sequence : 339248
cctaatgttaaatgacgagttaatgggtgcagcacaccaaaatggcacatgtatacatatgtaacaaacctgcgcgttgtgcacatgtaccctaaaacttaaagtataatagaaaaaaaataaaataaaataaaataaaataaaatgctccttacactataggtgaattgggcagagaaataaacacattttaggtggtcttcctagagcatccaggccctaaaataacctcaactgacattaacag

SEQ ID NO: 17302 - DNA, 202 bp, Homo sapiens
  AL078477.5_83917
  Located on chromosome 11
  Distance between a terminus base of telomere on chromosomal short arm and 5'-terminus of this base sequence : 33151604
  Distance between 3'-terminus of neighbour sequence of sequence listing upward to telomere on chrosomal short arm and 5'-terminus of this base sequence : 100552
cacaagattcatcctgacctaggtgaggacaggcatttcctactcaaatgttgcatttcccaagactactcgggcctaccacacctccatcctgtgtgtgtgtgtgtgtgtgtgtgtgtgtgtttattttgaatgaatgaaagtttaaagttttaaataactgaggacaggcatttccgcatttcctactcaaatgttgcat

SEQ ID NO: 17303 - DNA, 478 bp, Homo sapiens
  AL078477.5_83761
  Located on chromosome 11
  Distance between a terminus base of telomere on chromosomal short arm and 5'-terminus of this base sequence : 33151604
  Distance between 3'-terminus of neighbour sequence of sequence listing upward to telomere on chrosomal short arm and 5'-terminus of this base sequence : -202
cacaagattcatcctgacctaggtgaggacaggcatttcctactcaaatgttgcatttcccaagactactcgggcctaccacacctccatcctgtgtgtgtgtgtgtgtgtgtgtgtgtgtgtttattttgaatgaatgaaagtttaaagttttaaataactgaggacaggcatttccgcatttcctactcaaatgttgcatttcccaagactactcgggcctaccacacctccatcgtgtgtgtgtgtgtgtgtgtgtgtgtgtgtgtgtgtgtgtgtttattttgaatgaatgaaagtttaaagttttaaataactgtccatatcctctctcaagaatttccctgggtgttcttttacttcacaaggatcacagaatgaaaaaaaaaataacaatagtaaaaaagagacaagtcttttaaatatttgataaaatggtattgtattgttgagtttgtattcctcgaactttgcaata

SEQ ID NO: 17304 - DNA, 372 bp, Homo sapiens
  AL035400.13_67637
  Located on chromosome 11
  Distance between a terminus base of telomere on chromosomal short arm and 5'-terminus of this base sequence : 33407871
  Distance between 3'-terminus of neighbour sequence of sequence listing upward to telomere on chrosomal short arm and 5'-terminus of this base sequence : 255789
ctgtgataatctggcatagtcttgaaaaatgttaactaactgagatgatgatgatgatgatgatgatgatgatgatgattattattattattattattattattattattattattatctggagacggagtcgcccaggctggagtgcagtggagcaatctcggctcactgcaacctccacctcccgggttcaagccattctcctgcctcagcctcccaagcagctgggactacaggcacatgccaccacgcctggctaattttttgtattttagtagagacagggtttcaccatgttgcccaggctggtctcaaacacctgagctcaggcagtccatctccatcggcctaacaaagtgctaggattacagg

SEQ ID NO: 17305 - DNA, 423 bp, Homo sapiens
  chr11.fa.O7frz.34543626
  Located on chromosome 11
  Distance between a terminus base of telomere on chromosomal short arm and 5'-terminus of this base sequence : 33495649
  Distance between 3'-terminus of neighbour sequence of sequence listing upward to telomere on chrosomal short arm and 5'-terminus of this base sequence : 87406
gtaatgaaattgatgacaacctagatcttttaaaagggctaaagatttgaataaacttcactagagaagctaaaagaatagccttacaaacatacagaaaaatgcacctcctcgtatgttatcagagaaatgcaaattaagcccagtgatactccactgaacccacctagaatggctaaaattaagaagactgaaaagatcaagtattgacaaagatgcaaaactactggaatgttgatacatcgcttttttatttatttatttatttatttatttatttatttattttttgcagacagagtcttgttctgtcacccaggctggagtgcaatggtgcaatctcagctcactgcaacgtctgcctcctgggttcaagtgattctcgtgcctcaacctccagagtagctgaaattcgagacctat

SEQ ID NO: 17306 - DNA, 150 bp, Homo sapiens
  G10063
  Located on chromosome 11
  Distance between a terminus base of telomere on chromosomal short arm and 5'-terminus of this base sequence : 33650889
  Distance between 3'-terminus of neighbour sequence of sequence listing upward to telomere on chrosomal short arm and 5'-terminus of this base sequence : 154817
ggcagtatggcagtagaggacatgattgattgctttttaacgatagatagatagatagatagatagatagatagatataaaaaatggaatattaaaagtttactactttatttcttgaaatgtaacatttttctgaagttacccagcagg

SEQ ID NO: 17307 - DNA, 125 bp, Homo sapiens
  G08893
  Located on chromosome 11
  Distance between a terminus base of telomere on chromosomal short arm and 5'-terminus of this base sequence : 33650893
  Distance between 3'-terminus of neighbour sequence of sequence listing upward to telomere on chrosomal short arm and 5'-terminus of this base sequence : -146
gtatggcagtagaggacatgattgattgctttttaacgatagatagatagatagatagatagatagatagatataaaaaatggaatattaaaagtttactactttatttcttgaaatgtaacatt

SEQ ID NO: 17308 - DNA, 208 bp, Homo sapiens
  DISO7_10003029
  Located on chromosome 11
  Distance between a terminus base of telomere on chromosomal short arm and 5'-terminus of this base sequence : 33797357
  Distance between 3'-terminus of neighbour sequence of sequence listing upward to telomere on chrosomal short arm and 5'-terminus of this base sequence : 146339
cacattcagttccatggctttatttatttatttatttatttatttattttagtagagatgaggccttgctatgttgccaaggctggtctcgaactcctggcctcaagtgatcctcccagctcagcctcccaaagtgctgggattacaggggtgaaccaccatgcctggcctccgttccatgctttcaaatgccagctatacactaact

SEQ ID NO: 17309 - DNA, 267 bp, Homo sapiens
  D11S4101
  Located on chromosome 11
  Distance between a terminus base of telomere on chromosomal short arm and 5'-terminus of this base sequence : 33963516
  Distance between 3'-terminus of neighbour sequence of sequence listing upward to telomere on chrosomal short arm and 5'-terminus of this base sequence : 165951
ggacacctggaatctaattctgtttctcctgtttgctgtatcattgtaggctagcctgtttacttatttcagccttagtagaaggaaatagcctgaatagataatatattggccatttctaactctaatatattttgattctgaaggattatttgattttgtgtgtgtgtgtgtgtgtgtgtgtgtgtgtgtgtgtgtgtgtctttttttgagatagtgtcttgctctgttgcccaggctagagtgtggtagcacgatcttggctca

SEQ ID NO: 17310 - DNA, 254 bp, Homo sapiens
  Z67351
  Located on chromosome 11
  Distance between a terminus base of telomere on chromosomal short arm and 5'-terminus of this base sequence : 34141063
  Distance between 3'-terminus of neighbour sequence of sequence listing upward to telomere on chrosomal short arm and 5'-terminus of this base sequence : 177280
tccattagacccagaaaggcaattggtggacatacaccccccacccccaacacacacacacacacacacacacacacacacacacacacacacacacacacacactccctctctctccccctctctcgtaattgttttttcttgttttgtcttggttgggtgaaaactttgcatcaaggattgaagtttgaactggcattcagaaaccttgcattgagtgttttgtttttaaaaagtaacatctcagcctggtg

SEQ ID NO: 17311 - DNA, 171 bp, Homo sapiens
  D11S1776
  Located on chromosome 11
  Distance between a terminus base of telomere on chromosomal short arm and 5'-terminus of this base sequence : 34141077
  Distance between 3'-terminus of neighbour sequence of sequence listing upward to telomere on chrosomal short arm and 5'-terminus of this base sequence : -240
aaaggcaattggtggacatacaccccccacccccaacacacacacacacacacacacacacacacacacacacacacacacacacacacactccctctctctccccctctctcgtaattgttttttcttgttttgtcttggttgggtgaaaactttgcatcaaggattgaa

SEQ ID NO: 17312 - DNA, 293 bp, Homo sapiens
  AL049575.7_64803
  Located on chromosome 11
  Distance between a terminus base of telomere on chromosomal short arm and 5'-terminus of this base sequence : 34173049
  Distance between 3'-terminus of neighbour sequence of sequence listing upward to telomere on chrosomal short arm and 5'-terminus of this base sequence : 31801
tattccagttgccttagtttagacacatgccaacacacacacacacacacacacacacacacacacacacacacacacacacatgcgttttatattgaagtctttactatgtgccaggaactgtgctaagtgttttacaaatattttcctacctaatacttaagacatccttctgaggtattcttactcccatttcacagaagagagaactgagaggctaagaaacttccagaaggtcacacggtaaagaatggaagaaggacctgagtcaatccactacaccatactcacgt

SEQ ID NO: 17313 - DNA, 402 bp, Homo sapiens
  AL049575.7_19278
  Located on chromosome 11
  Distance between a terminus base of telomere on chromosomal short arm and 5'-terminus of this base sequence : 34218429
  Distance between 3'-terminus of neighbour sequence of sequence listing upward to telomere on chrosomal short arm and 5'-terminus of this base sequence : 45087
gtacacagtaggtgatcctggtggggagctcttggggggcatggggtgctatcttagagtctccacatatgtatatgtctggcacagagtagatgaatgaaacgtatttcctgaatgaacaaatagctcaaaatcaaaatgttaagtgggtagcagttgccacagttagagagttagagagagaatgtttgtgtgtgtgtgtgtgtgtgtgtgtgtgtgtgtgtgtgtcagagtgaagcccctagtgatggggtattatgcaaagaataaggcatagttgagtttttgctacagaaatttgcttattgatgcctttccttggagtgagaagagcagcccgaaaactgaaaattggaaacggaatgttttgtagtcaaagtctatgtggtaaagacaatagcc

SEQ ID NO: 17314 - DNA, 324 bp, Homo sapiens
  chr11.fa.O7frz.35799882
  Located on chromosome 11
  Distance between a terminus base of telomere on chromosomal short arm and 5'-terminus of this base sequence : 34291950
  Distance between 3'-terminus of neighbour sequence of sequence listing upward to telomere on chrosomal short arm and 5'-terminus of this base sequence : 73119
aaggacatgtaatgtctgagtaatcttgatggaagaaaggaaatagatctgtgattaaaacacacacacacacacacacacacacacacacacaccctacttcggagagagaatgtagaatggaggaggtgaggaatttaactaatagagatgctttttctaacaggcagaaattagagaaatggatcaaaagatttaaacattgattacatataaacgagtttcctttttttctacatagcacacaggtgctcaacatttaatgaataatataacagatactgtcttaaaagtttaaaaacaggatttgtacttaatcctaaa

SEQ ID NO: 17315 - DNA, 333 bp, Homo sapiens
  AC069193.3_59163
  Located on chromosome 11
  Distance between a terminus base of telomere on chromosomal short arm and 5'-terminus of this base sequence : 34357447
  Distance between 3'-terminus of neighbour sequence of sequence listing upward to telomere on chrosomal short arm and 5'-terminus of this base sequence : 65173
tctatcaacttagctggtagctactgttccccagcagccaccagaggcagggacagaagagcaagaccaggggatccgcctgcatgagtctgtcccttcagggtggcctcgcctcagggactggattgtaggcatggtttcaataacacagcggtgtgaaagtttaagagtttttagtacttacggaccctgggtggtacacagcttgcctagaggacacacacacacacacacacacacacacacacacacacacggagatcagggagaacagggagagggaagggaggaacggacctttgggccagcaactttatccagttaggtttcctc

SEQ ID NO: 17316 - DNA, 449 bp, Homo sapiens
  AC069193.3_105117
  Located on chromosome 11
  Distance between a terminus base of telomere on chromosomal short arm and 5'-terminus of this base sequence : 34403382
  Distance between 3'-terminus of neighbour sequence of sequence listing upward to telomere on chrosomal short arm and 5'-terminus of this base sequence : 45602
agatctttggttatagaacctcagggctaaaaagaggagccaccactggctggtgctccatgggctccctgagggcctaatgctctgctctctcaagagaggtcccacgaagttggcgttgagatctctgaaagaggacacctcacagctggtgcttgtatctcatggcaggtaacacacagcagatgctcaaaaccttgaaggtagggttgccagatttagtgcacacacacacacacacacagacacagacacacacacacacacaggcacacacaggctcacacaccaccactgccatcagcattaccaccaccaacaaaaaacaagggaaataactgaactaaaatggaaaaaaaaccccaaaaaaattaaatttgaattatttgtacttgcctatgcatatatactttgaaataaaataagaataccacataaagcatgataaa

SEQ ID NO: 17317 - DNA, 226 bp, Homo sapiens
  G09189
  Located on chromosome 11
  Distance between a terminus base of telomere on chromosomal short arm and 5'-terminus of this base sequence : 34692049
  Distance between 3'-terminus of neighbour sequence of sequence listing upward to telomere on chrosomal short arm and 5'-terminus of this base sequence : 288218
ctgttcaggcctcaatatatacctgtatttattcttttcaggcctttatctcattcattacatagatagatagatagatagatagatagatagatagatagatagatagatagatcttctattagttctgtttctccagagagccctcatatgtcccctttacagataaggaaaatgacaccccagcccttctgattaatatatcccaaaccccacctatcctctt

SEQ ID NO: 17318 - DNA, 421 bp, Homo sapiens
  chr11.fa.O7frz.36358869
  Located on chromosome 11
  Distance between a terminus base of telomere on chromosomal short arm and 5'-terminus of this base sequence : 34711734
  Distance between 3'-terminus of neighbour sequence of sequence listing upward to telomere on chrosomal short arm and 5'-terminus of this base sequence : 19459
cataatcctaatgctatgaggtaggtatgactatccccatttataattttctaaaacagctttattgaggccaggcacggtggctcatgcctgtgatcccagcacttcaggaagtcaaggcgggtggatcacctgaggtcaggagtttgagaccagcctgtccaacatggcaaatccccgtctccccattgctactaaaaatacaaaaattacccgggcatggtggcgggcacctgcaatcccaggaacttgggaggctggggtaggagaatgaattgaacccaggaggcagaggtttcagtgagccaagatcggccactgcattccatcctgggtaacagagactccatctcaatcaatcaatcaatcaatcaatcaataaaacagttttattgagatgtaattgacatgcaataactgc

SEQ ID NO: 17319 - DNA, 383 bp, Homo sapiens
  AL049652.22_88873
  Located on chromosome 11
  Distance between a terminus base of telomere on chromosomal short arm and 5'-terminus of this base sequence : 34955782
  Distance between 3'-terminus of neighbour sequence of sequence listing upward to telomere on chrosomal short arm and 5'-terminus of this base sequence : 243627
acttcagaacacatgttagcatttagctgtgtttgctgcatctcatcacacatctcacacacacacacacacacacacacacacacacacacacacgtgcgcgcgcaaatacaggacttcagctctaaagaatctgtgaagttctgtgtcctctcccagaggcatccctattaggaatttggtacatatccagtctgtgttcttcagctcttcccgctaatatccacattcctaaactgtagagtgttgctttgtgtcttcaaaatgcacacctttctataagacaccaagtgtctgggtcacgggtgactgggtccctgctgctccttcatcttctgcttctctgttggttgtcttttgtagctatttaatgaagttcagga

SEQ ID NO: 17320 - DNA, 319 bp, Homo sapiens
  AL049652.22_15862
  Located on chromosome 11
  Distance between a terminus base of telomere on chromosomal short arm and 5'-terminus of this base sequence : 35028306
  Distance between 3'-terminus of neighbour sequence of sequence listing upward to telomere on chrosomal short arm and 5'-terminus of this base sequence : 72141
gtcatacgctgtccttgacccgcagtgggtgagcacactaattcctgtaagccaatgacaacacagagccacttttctattaaggcagcacattcaaaacacacacacacacacacacacacacacacacacacacacaaagtaaatggagaaattaaggatggagatgaagcagtcgtagactcagtaccttaaatatcagccttcttctcaacagccactaaaagagtggttcgcttgatgctagggtcataaaaatgctttctgccctactatgctttccaaactttttataatgaatatggcttactggcatagg

SEQ ID NO: 17321 - DNA, 104 bp, Homo sapiens
  DISO7_10003031
  Located on chromosome 11
  Distance between a terminus base of telomere on chromosomal short arm and 5'-terminus of this base sequence : 35088803
  Distance between 3'-terminus of neighbour sequence of sequence listing upward to telomere on chrosomal short arm and 5'-terminus of this base sequence : 60178
tgcgttaagtagtggattggaatatacacacacacacacacacacgcgtgtgtgtgtatgtatatatttttttcttttttttaaaggcacacctcagctggata

SEQ ID NO: 17322 - DNA, 158 bp, Homo sapiens
  DISO7_10003030
  Located on chromosome 11
  Distance between a terminus base of telomere on chromosomal short arm and 5'-terminus of this base sequence : 35174703
  Distance between 3'-terminus of neighbour sequence of sequence listing upward to telomere on chrosomal short arm and 5'-terminus of this base sequence : 85796
actggcagtaccaagtaaacccagaatgtgtctgtgtttgtgttttgtgtgatatgggaaaaagaataggaggaagatagatagagatgaatatatatatatatatatatatatatatatatatatatatatatccagccatcttagaatgaaccaat

SEQ ID NO: 17323 - DNA, 201 bp, Homo sapiens
  D11S1392
  Located on chromosome 11
  Distance between a terminus base of telomere on chromosomal short arm and 5'-terminus of this base sequence : 35432784
  Distance between 3'-terminus of neighbour sequence of sequence listing upward to telomere on chrosomal short arm and 5'-terminus of this base sequence : 257923
atatctgagacttgtagtagaaggccttgagacatccatctcatcccatcattatctatctatcatctatctatctatctatctatctatctatctatctatctatctatcatctatctatctatcgccagtactgtcttgttgaagttggcagtagggtgaaagacctcaaactccaaaggactttccgtatggatgcaa

SEQ ID NO: 17324 - DNA, 131 bp, Homo sapiens
  D11S2008
  Located on chromosome 11
  Distance between a terminus base of telomere on chromosomal short arm and 5'-terminus of this base sequence : 35432816
  Distance between 3'-terminus of neighbour sequence of sequence listing upward to telomere on chrosomal short arm and 5'-terminus of this base sequence : -169
catccatctcatcccatcattatctatctatcatctatctatctatctatctatctatctatctatctatctatctatcatctatctatctatcgccagtactgtcttgttgaagttggcagtagggtgaa

SEQ ID NO: 17325 - DNA, 235 bp, Homo sapiens
  AL157952.8_76395
  Located on chromosome 11
  Distance between a terminus base of telomere on chromosomal short arm and 5'-terminus of this base sequence : 35441263
  Distance between 3'-terminus of neighbour sequence of sequence listing upward to telomere on chrosomal short arm and 5'-terminus of this base sequence : 8316
aatttgtggaatgaacatcaagggaagtcttcaatttgggtgttttcagtgagtttctgttgggtcagagtgaatggatattaaattctgggattttggtttgtgtgtgtgtgtgtgtgtgtgtgtgtgtgtgtggcgatcaacattggttcttcactgtgaccttaggaaagaaatgcaatagggtttttattgggaaggtgggtagcagggagatgcatgaaccatattaagg

SEQ ID NO: 17326 - DNA, 269 bp, Homo sapiens
  AL157952.8_60436
  Located on chromosome 11
  Distance between a terminus base of telomere on chromosomal short arm and 5'-terminus of this base sequence : 35457296
  Distance between 3'-terminus of neighbour sequence of sequence listing upward to telomere on chrosomal short arm and 5'-terminus of this base sequence : 15798
ggatatcaagataggctaggagagaaagggtatgtgtgtgtgtgtgtgtgtgtgtgtgtgtatgtgcgcgtgcatggaggttaggaaggagagggttatagcagttcaatctttcttttttcgtcttccagtggcctctctttgcaaggggagaggagatttgtaaggagaacaggtgttctccctagagctttaatctagaacacgtctattagaagaagaggggacctggtggtggggcgtatagagggtttggtgatcaagcctgt

SEQ ID NO: 17327 - DNA, 137 bp, Homo sapiens
  Z66768
  Located on chromosome 11
  Distance between a terminus base of telomere on chromosomal short arm and 5'-terminus of this base sequence : 35490622
  Distance between 3'-terminus of neighbour sequence of sequence listing upward to telomere on chrosomal short arm and 5'-terminus of this base sequence : 33057
aggtctttcatgcagagtggaaatctgaatgtgtgtgtgtgtgtgtgtgtgagtgtgtgtgtgtgtttagggatctatcacttacctttccttccagggcaatagtgctcatccttggctactatattaccttgata

SEQ ID NO: 17328 - DNA, 394 bp, Homo sapiens
  AL157952.8_17777
  Located on chromosome 11
  Distance between a terminus base of telomere on chromosomal short arm and 5'-terminus of this base sequence : 35499855
  Distance between 3'-terminus of neighbour sequence of sequence listing upward to telomere on chrosomal short arm and 5'-terminus of this base sequence : 9096
tgagatagttatctgcatagtccagaaaaatcacttttccaccaaacattctaaatgattgatggagaaacaaattttccaattacgctaactttcattgttattactaaagaattaagtgctacaccacacacacacacacacacacacacacacacacagtcacacaatattcagataaaaagaaagcctaattattttatattcagaaaaaaatgaattggcctttctgaacaaccacaacgatgaaaaaggaaaagaaatctgttaaaactttaattttagttttccttttagattttaaaataattgtgaaatatttcaaacatagaaaatatatagagtttttctttctttttgggaaacagagttacaatgaaagatacaattggag

SEQ ID NO: 17329 - DNA, 357 bp, Homo sapiens
  chr11.fa.O7frz.36820620
  Located on chromosome 11
  Distance between a terminus base of telomere on chromosomal short arm and 5'-terminus of this base sequence : 35602780
  Distance between 3'-terminus of neighbour sequence of sequence listing upward to telomere on chrosomal short arm and 5'-terminus of this base sequence : 102531
tacaaggaccagatggttaatatttgtaaagtgcttgaaagagtacctggcatatagtagggcctgtgtaactggtttgttaaataaattgacctgtttgggttgatttcaggtattaatttcctgtggcacagttctgagacatctgagcagtgcttgcgatcatgtgtgaggtacagatgtttgcttttgggtgtcagcatttggggatgacaacacagccagatgggcatcttggaaattgtgttccaagaagacctagagttccattgtgtgtgtgtgtgtgtgtgtgtgtgtgtgtgtgtgtgtgtgtgtgtgtgtgtgtgttttgaagtgaaaaggacagatagtaaacaa

SEQ ID NO: 17330 - DNA, 404 bp, Homo sapiens
  chr11.fa.O7frz.37092432
  Located on chromosome 11
  Distance between a terminus base of telomere on chromosomal short arm and 5'-terminus of this base sequence : 35857082
  Distance between 3'-terminus of neighbour sequence of sequence listing upward to telomere on chrosomal short arm and 5'-terminus of this base sequence : 253945
gtatgctcctagactcctgaagtatactattcccagcctgtggctatgaatagcctctgggaagtctcagagttactgcaagagatctgcaaatatacacacatgcccaacattgcctgtagcctgaatacataatatgtctaaatatattgaataatatgtgtgctatttttcaaatatataaataacaattcactaaaatagtttttctaatactgcatttttagatcagtgggtgctaatagtaccagacacacgtgtgcacaggcaagcgcacacacacacacacacacaccacacatacatccaagaaaagcttttgctttgaagagatatgttaaaagggctgtgaaccattgtttcacatgtgaccctcttgtcttcatacattaacggatactttc

SEQ ID NO: 17331 - DNA, 428 bp, Homo sapiens
  AL356215.10_48986
  Located on chromosome 11
  Distance between a terminus base of telomere on chromosomal short arm and 5'-terminus of this base sequence : 35941779
  Distance between 3'-terminus of neighbour sequence of sequence listing upward to telomere on chrosomal short arm and 5'-terminus of this base sequence : 84293
cttctaatgcagatgtatcgagtccacctagcatgtgttgaaaactgtcctcaggacaagggtgtttccatagaggtgatctcagagccactcaacatgtgtgtgtgtgtgtgtgtgtgtgtgtgtgtgatgtttactgaatcttaatgtttttaaaataatattgctcaattcaaaagtaatatacatatttttataatacatgtacaaagccactagtagaaagagtttaaaattaccaataatgtaataatagtattgtggttaaataagggtttaaaagcccttatcttttagagatacatactgaatatttacagataagtgtatatgatgtttggaatttgtttcaaaataatccagcagttggggaggaggtaggaggtacagacagataacaagggctatgagtggataattgtagaagc

SEQ ID NO: 17332 - DNA, 365 bp, Homo sapiens
  AL133330.14_140171
  Located on chromosome 11
  Distance between a terminus base of telomere on chromosomal short arm and 5'-terminus of this base sequence : 36025432
  Distance between 3'-terminus of neighbour sequence of sequence listing upward to telomere on chrosomal short arm and 5'-terminus of this base sequence : 83225
aatgtcaatcgttccttatcaggtaatttggcatttattatctagtttgctttctctatatagagaaacaatatatagtttcatattacagaggacattttctgtgtagtctgggattggactagtttgtgatatggaaatatctttcattattggttatcaattctagtgcaaataaacttgggtatattttagataaaagaatgcttccttttgccagtgttttttccatttgtctgtgtttgcatgtgtgtgtgtgtgtgtgtgtgtgtgtgtgttgtgtgtacaagttggctgttatgatggaattgctttctttgtcttatcttgtgatatatgaagttgaaccacatgaaactgatatt

SEQ ID NO: 17333 - DNA, 355 bp, Homo sapiens
  AL133330.14_67765
  Located on chromosome 11
  Distance between a terminus base of telomere on chromosomal short arm and 5'-terminus of this base sequence : 36097924
  Distance between 3'-terminus of neighbour sequence of sequence listing upward to telomere on chrosomal short arm and 5'-terminus of this base sequence : 72127
agaagctaacatttattgactggtgcctggctcatactcataagagactataagccaggcaccatgttctcagccaccctagaatttgttattgttcccattacgcagatgaggaaactgaggctcccttatagtatataattcatagggtggttgtgaagattttattatatatatatatatatatatataaattattattttgcaacccaacagtatagtatagtggaggcagtgtgtgtaatggttaaaaacacaaaccccagagtaaggtggcctgggttcaaatcccatttctgcctgttacaaacagcatgattctggcccagttacctcaacttactgtgcctcattt

SEQ ID NO: 17334 - DNA, 420 bp, Homo sapiens
  AL133330.14_67308
  Located on chromosome 11
  Distance between a terminus base of telomere on chromosomal short arm and 5'-terminus of this base sequence : 36098321
  Distance between 3'-terminus of neighbour sequence of sequence listing upward to telomere on chrosomal short arm and 5'-terminus of this base sequence : 42
gctgtttctaggatcacaagttaaataaatggaagcatatgccagcatttggaaacttaaattatagttgttcctctagacggctgtgtgtgatctattctctgagcctctgtttccttatctatgtataaggtgagataatttagcaagagaaccactgggagacatttcagatgatacattctagctgattaaataaatgtgattgttatttcatgttttcatattgtgtgtgtgtgtgtgtgtgtgtgtattaaacatggtgaattttttcttttctctatttgctgactgagttgctaaagtgaactcagatgcatatgggatattcactaaatcttctggaatggttagaaggagagaggagaaagctgtgttttaacaaaaatgtccttgagctggttgaatacctcagagcta

SEQ ID NO: 17335 - DNA, 425 bp, Homo sapiens
  chr11.fa.O7frz.37748465
  Located on chromosome 11
  Distance between a terminus base of telomere on chromosomal short arm and 5'-terminus of this base sequence : 36406885
  Distance between 3'-terminus of neighbour sequence of sequence listing upward to telomere on chrosomal short arm and 5'-terminus of this base sequence : 308144
tgacagagcaagactccatctcaaaacaacaacagcaccaacagcaaaaaaaaaaaaatatatatatatatatatatatataaaatatatatatataaatatttatatttatatatttagataaaaaatatttatattatatatatatatatatagctacaaatgcctcccatccctgtatatatgcccccggcaatgtggggttgctactgttcccatcacttgccttggccaatggaaagaagcagaatgatgttaagcaatttctgagccaaggtctaagtcaagcaacctctgcattctttctcaaaattcacctaccaagtgaagaagcccaggctagctaaaccagtggaatggccatgtggataaaaaccaaagtgccccagctgacacttcagccaactgctaggcctgtaaattac

SEQ ID NO: 17336 - DNA, 224 bp, Homo sapiens
  AL136146.9_9037
  Located on chromosome 11
  Distance between a terminus base of telomere on chromosomal short arm and 5'-terminus of this base sequence : 36762313
  Distance between 3'-terminus of neighbour sequence of sequence listing upward to telomere on chrosomal short arm and 5'-terminus of this base sequence : 355003
aatatttaggaaatgcttggaccattctaaccatgcagttttgttgttgttttgccagtgcctctacctgacaaccagggagatttttaagttggctgatcgtgtgtgtgtgtgtgtgtgtgtgtgtgtgtgtgcacatgcacacatgtgcatatgtatgtaactgccttcttctattgttgtgaaaaaatctactcacttggatgctaaggagtaccttgaag

SEQ ID NO: 17337 - DNA, 263 bp, Homo sapiens
  AL136146.9_52467
  Located on chromosome 11
  Distance between a terminus base of telomere on chromosomal short arm and 5'-terminus of this base sequence : 36805686
  Distance between 3'-terminus of neighbour sequence of sequence listing upward to telomere on chrosomal short arm and 5'-terminus of this base sequence : 43149
ttggttacatggctgttaatagctaaattattaatgcaggtttgctggtggagggagctgcttttgaccattgcctctcttcttacatcagcttttcgatagctacaattgtaggagtcacattgcatgcagagcagttcataaattgaatggttgtttgtgtgtgtgtgtgtgtgtgtgtgtgtgtgtgtgtgtagcaggggaggctcagagttttggcctctggctgtatggctgtatgcttgtgagtatcctttgtctga

SEQ ID NO: 17338 - DNA, 178 bp, Homo sapiens
  Z17148.1_140
  Located on chromosome 11
  Distance between a terminus base of telomere on chromosomal short arm and 5'-terminus of this base sequence : 36815673
  Distance between 3'-terminus of neighbour sequence of sequence listing upward to telomere on chrosomal short arm and 5'-terminus of this base sequence : 9724
tcaccagtaatcctatcattcagaaaatgttggcatagtattctttcagttatattgtatacgtgtgtgtgtgtgtgtgtgtgtgtgtgtgtgtgtgcacataatttgtaacgttctttttaaattttatatacagcggacatttttctattcattaaaagcatttctaacttggttt

SEQ ID NO: 17339 - DNA, 204 bp, Homo sapiens
  D11S935
  Located on chromosome 11
  Distance between a terminus base of telomere on chromosomal short arm and 5'-terminus of this base sequence : 36815685
  Distance between 3'-terminus of neighbour sequence of sequence listing upward to telomere on chrosomal short arm and 5'-terminus of this base sequence : -166
ctatcattcagaaaatgttggcatagtattctttcagttatattgtatacgtgtgtgtgtgtgtgtgtgtgtgtgtgtgtgtgtgcacataatttgtaacgttctttttaaattttatatacagcggacatttttctattcattaaaagcatttctaacttggttttcactcagacttttttaccccaactcttttggttagta

SEQ ID NO: 17340 - DNA, 141 bp, Homo sapiens
  D11S4185
  Located on chromosome 11
  Distance between a terminus base of telomere on chromosomal short arm and 5'-terminus of this base sequence : 36844373
  Distance between 3'-terminus of neighbour sequence of sequence listing upward to telomere on chrosomal short arm and 5'-terminus of this base sequence : 28484
agccgctcactcactggcctgtgcctgtgcatggagtgtgtgtgtgtgtgtgtgtgtgtgtgtgtgtacgtttgaagaagacagtcacggaaaacagacagtggccttcagtggcctcatgacactatgtttgttggcact

SEQ ID NO: 17341 - DNA, 471 bp, Homo sapiens
  chr11.fa.O7frz.38424377
  Located on chromosome 11
  Distance between a terminus base of telomere on chromosomal short arm and 5'-terminus of this base sequence : 37089477
  Distance between 3'-terminus of neighbour sequence of sequence listing upward to telomere on chrosomal short arm and 5'-terminus of this base sequence : 244963
acttgttctcagtcatcttgtaagctgggagatgtgttgatacagtggctaaatttagtggcaaaataaaacttccctggtctgaagcccaggttgtatatgtctaccaatgtatcttaccgctcttctgtaagaggaatttgccgggactgaagtggagttggcctctgaagattgttgtactccatccatccatccatccatccatccatcccaaaatgaatcaacagaatgtagactccacaagggtagggatttttatctgtttcccccacatttataaacacatctacagatatgtatttagaaatatatctacaggtatgtatttataaatacatcatatatttatatgatggcctgtctgctatttgtaaaagtttgtatctcaccctgctagcaggaagcagttgccagagcctgatttctacttggaacaaaatcactctgaagttccatttcctcatttag

SEQ ID NO: 17342 - DNA, 446 bp, Homo sapiens
  AC026269.3_164581
  Located on chromosome 11
  Distance between a terminus base of telomere on chromosomal short arm and 5'-terminus of this base sequence : 37137984
  Distance between 3'-terminus of neighbour sequence of sequence listing upward to telomere on chrosomal short arm and 5'-terminus of this base sequence : 48036
aataattacctaggagcacgaggggtgagcaggcaatgcaattgaagtagataaagcatccttctttgccttatccgaaaggtactactaatgtgaaaaataattaatggaaatgtgacaaaatcctagctggttttaattctgggtgctgttgagctttctctctctctctctctctctctctctctctctctctctctctccgtgtgggggtgtgcgtgtgtgtctgtattttaaaaaatggttccatccaaaatggagatatgcgtggtactagccctgcttcctgtatgggctgtcatggggattcgatggcagtaatatatgtgaaaatgctctgtcaactaggaagcaatgcaaaggcaggataatgtttatttaataagaataatcacctatcgagtttttctttggtccttggctaagtagctttgtagcatttggag

SEQ ID NO: 17343 - DNA, 289 bp, Homo sapiens
  AC016754.5_141794
  Located on chromosome 11
  Distance between a terminus base of telomere on chromosomal short arm and 5'-terminus of this base sequence : 37320061
  Distance between 3'-terminus of neighbour sequence of sequence listing upward to telomere on chrosomal short arm and 5'-terminus of this base sequence : 181631
ttagaatagtgaacctctgcatacccatcacccagctttaataattatcagcatttttctgattttatttaatctgtgtcccttcatcctccaatatacaccctttcctcccaggtgtatttaaagtaaactgcaaatgttataactttttatccctaaacactttagtgtgtctccccaatagatacacacacacacacacacacacacacacacacacaggcaaaccattattgctatcactcacaattaaattaacaaccatctatgattcaattctaactggatc

SEQ ID NO: 17344 - DNA, 444 bp, Homo sapiens
  chr11.fa.O7frz.38526253
  Located on chromosome 11
  Distance between a terminus base of telomere on chromosomal short arm and 5'-terminus of this base sequence : 37366811
  Distance between 3'-terminus of neighbour sequence of sequence listing upward to telomere on chrosomal short arm and 5'-terminus of this base sequence : 46461
  misc_feature (1)...(444): n = A,T,G or C
caaacaatgttgacctcataaggttcaaacaatacaatctaatatagaacatttaacgagcccacagccagtgtgcagcttttagaatctagagttcagataaagtcacaaacttcagcttttgctctgcctaatagttgtgtgtgtgtgtgtgtgtgtgtgtgtgtgttcacattcctgaaatgtaatcttactggtgaagtgtactttttggggccaaaattttcacagcacaaatctatggattggatgcacctgggttaggtgcccacccttagtcttaaagggggctgcctanagggatagctactctttcaacaggagccttgattggactgacttccatttcagaggttgtggacatggcaagctgtgtatatatctnaataaagacctagaatttcctcctcataaattaatgtttaactagaatgaccaacactg

SEQ ID NO: 17345 - DNA, 186 bp, Homo sapiens
  D11S4083
  Located on chromosome 11
  Distance between a terminus base of telomere on chromosomal short arm and 5'-terminus of this base sequence : 37465837
  Distance between 3'-terminus of neighbour sequence of sequence listing upward to telomere on chrosomal short arm and 5'-terminus of this base sequence : 98582
tttaacccaagggcaggacattctgcagggactcttggaactctggactgaaaaagatactctgaaaaaggtagtctgcctgtctctctctctctctctctctctctctttcacacacacacacacacacacacacacacacacacacacacttctttgtaaatactctgcccttgggtacacatg

SEQ ID NO: 17346 - DNA, 218 bp, Homo sapiens
  G10015
  Located on chromosome 11
  Distance between a terminus base of telomere on chromosomal short arm and 5'-terminus of this base sequence : 37604634
  Distance between 3'-terminus of neighbour sequence of sequence listing upward to telomere on chrosomal short arm and 5'-terminus of this base sequence : 138611
ggcaggggtagtttttgagtaaaagaggaataataatagtacttctctcaaaggttgagaaacgttaattgagataatccatgtgaaactcttagtgtagtgactaatacataataagtacttactgaatgttaggtatttgtattgctgttgtgatgctgctgctgctgctgctgctgttgtggtttctgtagaatggaaacaaccctttagactgg

SEQ ID NO: 17347 - DNA, 162 bp, Homo sapiens
  D11S4102
  Located on chromosome 11
  Distance between a terminus base of telomere on chromosomal short arm and 5'-terminus of this base sequence : 37748475
  Distance between 3'-terminus of neighbour sequence of sequence listing upward to telomere on chrosomal short arm and 5'-terminus of this base sequence : 143623
gctaaatcctggaaagccctgggcaaaccagcatgaggtggttaatctagggattttaggagggatgactctgcgtgtgtgtgtgtgtgtgtgtgtgtgtgtgtgtgtgtgtgtctgtgtgtggcagggtgaataaggtgaggatggcagtacccagtggtg

SEQ ID NO: 17348 - DNA, 389 bp, Homo sapiens
  AC079073.2_162702
  Located on chromosome 11
  Distance between a terminus base of telomere on chromosomal short arm and 5'-terminus of this base sequence : 37863509
  Distance between 3'-terminus of neighbour sequence of sequence listing upward to telomere on chrosomal short arm and 5'-terminus of this base sequence : 114872
gctcagtgcaaatctcaaggcctgagaacctgggggctgctggtataagccttgaagttcaaaggctggagagcttatatccgagcgtaggagaagagagatgtatctcagcctcaggagagggagagatggagggggtgggaggggagagagatagagagagagagagagagagagagagagagagagagagataaattcatctttcctgtttgttctatcaaggccttctgctaatgagttggtgcctgcccccattgggggtggatgtttccccaacttagtctacccatactcaattgccaatctcctcaggaaacaccctcacagatgcacccaaacataatactttaccaaatttctaggtatttctaatccagtcaagttga

SEQ ID NO: 17349 - DNA, 443 bp, Homo sapiens
  chr11.fa.O7frz.39192351
  Located on chromosome 11
  Distance between a terminus base of telomere on chromosomal short arm and 5'-terminus of this base sequence : 37899849
  Distance between 3'-terminus of neighbour sequence of sequence listing upward to telomere on chrosomal short arm and 5'-terminus of this base sequence : 35951
acttcactgtcatcttatttcaagaaattgccatagccatcccagccttcagcaaccaccaccctgaccagtctggagccatcaacattgagtcaagaccctccgccagcaaaaaggattatgagtaactgaagactcagatgatgatcagcattttttttacctacatagtattttctaattaaagtctgcacattggttttttaggcataatactattgcacacttaatcacatactgttatatggtaaacataaattgtgtatgcactggcaaaccaaaataattttgtgtgacttactttattgcaagtgagaaggagaggagaagagagaaaagtatgtgtgtgtgtgtgtgtgtgtgtgtgtgtgtgtttgtgtgggtgagagagagaggctgttgagactgtttgaacttttagatccaactgtaagtgtaactct

SEQ ID NO: 17350 - DNA, 418 bp, Homo sapiens
  chr11.fa.O7frz.39417043
  Located on chromosome 11
  Distance between a terminus base of telomere on chromosomal short arm and 5'-terminus of this base sequence : 38124658
  Distance between 3'-terminus of neighbour sequence of sequence listing upward to telomere on chrosomal short arm and 5'-terminus of this base sequence : 224366
tgctgtttagacagtaggaaatcagaaccaacgtaagtgtccaaatataaaggctagatttaataaattatgatgtaaacatataatgcaattatatgaagctattaaaatgatgtgattgaaattttgtaacatgcacatatattcataactatcaaaataacagcctacaaaagtgtatgtattattgattcccaacttggttttaaaatgttttaactgaaacacatagcacacacacacacacacacacacacacacacacacacctctgaatagtaaaactactgtttatctaatttcaggattttctggttgcacataacccaaaataaagttaaataggttttaaaataaaagtagtgtattggcttctaaaatagaaaacctaaaagtggagtgctatctaacatagttg

SEQ ID NO: 17351 - DNA, 453 bp, Homo sapiens
  chr11.fa.O7frz.39731419
  Located on chromosome 11
  Distance between a terminus base of telomere on chromosomal short arm and 5'-terminus of this base sequence : 38437335
  Distance between 3'-terminus of neighbour sequence of sequence listing upward to telomere on chrosomal short arm and 5'-terminus of this base sequence : 312259
tatgtacctaatgtttgtcaggttccagaccctgttcaagcactttacctctattaatgcacataatcttttttattttattttattttattttattttattttattttattttattttattttattttattttactttgagacggagtctctctctgtcgcccaggctagagtgcagtggtgcagtctcggttcactacaacctctgcctcctgggttcaagcgattctcctgcctctgcctcccaagtagctgggattacaggcacttgccaacacgccaggctttatttttgtatttctagtagagtcggggtttcaccgtgttagccaggatggtctagatctcctgacctcaagatccgcctgccttggcgtcccaaagtgctgggattacaggcgtgagccagcacgccctgccaatgagacaatctttacatgagcactatgtggt

SEQ ID NO: 17352 - DNA, 410 bp, Homo sapiens
  chr11.fa.O7frz.40080724
  Located on chromosome 11
  Distance between a terminus base of telomere on chromosomal short arm and 5'-terminus of this base sequence : 38757931
  Distance between 3'-terminus of neighbour sequence of sequence listing upward to telomere on chrosomal short arm and 5'-terminus of this base sequence : 320143
ccaaagtgaatttactgtgaacagaatataactagattgtgcttataaagtcaattttgcccatctctgtctctttttccaggggtggggagtgtcagggtttactctgtgacccaggccagagtctaatggcatgatttcaactcattgcaacttccacctcctgggctcaagcagtcctcccacctcagcctcctgagcagttgagactataagcatgtgccaccatgcacagataattgtattattattattattattattattattattattattattgtagatatggggtatttctatgttgctcaggttggtctcaaactcttaggctcaaatgattcacctgcctcagtctcccaaactatctgtatcttttgattggagagtttgatcgctctacatttaaa

SEQ ID NO: 17353 - DNA, 241 bp, Homo sapiens
  chr11.fa.O7frz.40168448
  Located on chromosome 11
  Distance between a terminus base of telomere on chromosomal short arm and 5'-terminus of this base sequence : 38845147
  Distance between 3'-terminus of neighbour sequence of sequence listing upward to telomere on chrosomal short arm and 5'-terminus of this base sequence : 86806
tacataaatgtctcagcctagaattcaagactttaccctactagtctgatttatattatacagacacacacacacacacacacacacacacacactgtttttactataaataggatgaatattaattgcactgtccactaaagccaactattctaatgactctcactcaaaaatatctgcaaatttctggcttaggaatcttacttcacattgttcactttacctagattcctcagcttac

SEQ ID NO: 17354 - DNA, 470 bp, Homo sapiens
  chr11.fa.O7frz.40257815
  Located on chromosome 11
  Distance between a terminus base of telomere on chromosomal short arm and 5'-terminus of this base sequence : 38934311
  Distance between 3'-terminus of neighbour sequence of sequence listing upward to telomere on chrosomal short arm and 5'-terminus of this base sequence : 88923
acattggaccaaataggtaatttgtcatccctcactcccttcctttcctttcaccttttagattctcaaatgtcttttattctactctgtatgtccatatttacctattatttatctcacacttagaagtgagaacatgcagtgtttgactttctgtttctgagttatttcacttagtataatggaactgaaggcagttccatccatgttgctgcaaaagacacattttattcttttttatggcagattactagtccattttatatatacacacacacacacacacacacacacacaccactttttttcctattatcctttgataaacatctgagtgcaggtgtcttttatatagtgatttcttttcctttggatatatgtaagcagtagtgagattactgggtcaaatgacagttccacttttagctctttgagaaatttccatattgtctttccatagaggttgtacc

SEQ ID NO: 17355 - DNA, 234 bp, Homo sapiens
  Z66776
  Located on chromosome 11
  Distance between a terminus base of telomere on chromosomal short arm and 5'-terminus of this base sequence : 39018560
  Distance between 3'-terminus of neighbour sequence of sequence listing upward to telomere on chrosomal short arm and 5'-terminus of this base sequence : 83779
taaatggaatacgcatctaataaattaagaaacaatagatatataataatatgaacaataaaatagagcagttatattaaactgttcattaagtatttgttaggacagtttgctttctgtgtgtgtgtgtgtgtgtgtgtgtgtgtgtgtgttttgggttacaatataaaacatattctttatcatacttttgtcccagtttgtttaataaattacccagacttagtggcttaa

SEQ ID NO: 17356 - DNA, 174 bp, Homo sapiens
  chr11.fa.O7frz.40681094
  Located on chromosome 11
  Distance between a terminus base of telomere on chromosomal short arm and 5'-terminus of this base sequence : 39210659
  Distance between 3'-terminus of neighbour sequence of sequence listing upward to telomere on chrosomal short arm and 5'-terminus of this base sequence : 191865
ttagagtgagctatgaccacacctctacactccagcctgggtaacagaacaagacactctttctaaacaacaacaacaacaacaacaacaacaacaacaacaacaacaacaaaaacaaagacttacatttttgaatcatgttgtagaagtcagtttagttctcatagctggacc

SEQ ID NO: 17357 - DNA, 478 bp, Homo sapiens
  chr11.fa.O7frz.40821866
  Located on chromosome 11
  Distance between a terminus base of telomere on chromosomal short arm and 5'-terminus of this base sequence : 39331127
  Distance between 3'-terminus of neighbour sequence of sequence listing upward to telomere on chrosomal short arm and 5'-terminus of this base sequence : 120294
atgtgctcactttgagtgttacagaaagttagtggtggcaagtcttcaacaattgaggtttgtgatggttaaaaaaggaagattcggccaggcacagtggctcaagcctgtaatcccagcactttaggaggccgaggtgagcggatcacaaggtcaggagtttgagaccagcctggccaacatggtgaaaccctgtctctactaaaaaaatacaaaattagctgggcgtggtggtgagtgcctgtaatcccagctactggggaggctgaggcaggagaatggcttgaacccacgagtcagaggttgcagtgagctgagatcgtactactgcactccagcctgggtgacagagcaagacttcatctcaaaaaaaagaaagaaaagaaaagaaaagaaaagaaaagaaaagaaaagaaaagaaaagaaaagaaagagaaagagaaagagagaaaggaaaattcaggaattgcagaaatat

SEQ ID NO: 17358 - DNA, 246 bp, Homo sapiens
  chr11.fa.O7frz.40926675
  Located on chromosome 11
  Distance between a terminus base of telomere on chromosomal short arm and 5'-terminus of this base sequence : 39542914
  Distance between 3'-terminus of neighbour sequence of sequence listing upward to telomere on chrosomal short arm and 5'-terminus of this base sequence : 211309
taacttcagattcaagaatggtacttcagacgctaaaaacaaatctgcttttaaagaagtacaaacagctaaaagttttttggattaaaaacaaaacaaaacaaaacaaaacaaaacaaaacaaaaatctttgtgtttaagataaccagcatttggacttagtaattcagtaagagactggcttaaagttttgtcagtgtctctaaggtgtttttatcttgtgtcaactttaagctacagctgtat

SEQ ID NO: 17359 - DNA, 172 bp, Homo sapiens
  chr11.fa.O7frz.41014451
  Located on chromosome 11
  Distance between a terminus base of telomere on chromosomal short arm and 5'-terminus of this base sequence : 39552358
  Distance between 3'-terminus of neighbour sequence of sequence listing upward to telomere on chrosomal short arm and 5'-terminus of this base sequence : 9198
atagtgcttaggatctggtgtcctttgagtgtttaaagtgaccaaaaaagtattatattgtagttcataactctctgagctcaaatatcatcatttaggaggaggaggaggaagatgaggaggaggatgaggagggggagggggagaaaacttctagtgatctggaagcttc

SEQ ID NO: 17360 - DNA, 150 bp, Homo sapiens
  DISO7_10003032
  Located on chromosome 11
  Distance between a terminus base of telomere on chromosomal short arm and 5'-terminus of this base sequence : 39659850
  Distance between 3'-terminus of neighbour sequence of sequence listing upward to telomere on chrosomal short arm and 5'-terminus of this base sequence : 107320
tgttactaatgaccagggaggggaaaaacacctggaaaagttttccataaatattaatatcttataacatgttatgctatttctctatcacacacacacacacacacacacacaagcacacatacacacacattcgatatgcttaccatt

SEQ ID NO: 17361 - DNA, 115 bp, Homo sapiens
  DISO7_10003033
  Located on chromosome 11
  Distance between a terminus base of telomere on chromosomal short arm and 5'-terminus of this base sequence : 39679165
  Distance between 3'-terminus of neighbour sequence of sequence listing upward to telomere on chrosomal short arm and 5'-terminus of this base sequence : 19165
ctgtttctagctctcgctctcttgctttctctcttcctctttgtgtgtgtgtgtgtgtgtgtgtgtgtgtgtgtgtgtgtgtgttttgaacaggggcttgttgaatttctcctaa

SEQ ID NO: 17362 - DNA, 119 bp, Homo sapiens
  DISO7_10003035
  Located on chromosome 11
  Distance between a terminus base of telomere on chromosomal short arm and 5'-terminus of this base sequence : 39698824
  Distance between 3'-terminus of neighbour sequence of sequence listing upward to telomere on chrosomal short arm and 5'-terminus of this base sequence : 19544
tccctgaagttcatatgttgtccacacaaacacacatgcacgttcacacgcactcacacacacacacacacacacacacacacacacacagtttttcttgtgatccagtaaataaccaa

SEQ ID NO: 17363 - DNA, 212 bp, Homo sapiens
  DISO7_10003037
  Located on chromosome 11
  Distance between a terminus base of telomere on chromosomal short arm and 5'-terminus of this base sequence : 39719963
  Distance between 3'-terminus of neighbour sequence of sequence listing upward to telomere on chrosomal short arm and 5'-terminus of this base sequence : 21020
caattcaatctttgaaggattcaaagaaaaatttcacaccacacacacacacacacacacacacacacacacacacacacaccacaggacttctaaatttgaactttatatttgtatatagtgtattttatatctgaattatatttctctcaagcaaagaaatacatatttgcatacactcaactatactaataaactggtggaattctgtc

SEQ ID NO: 17364 - DNA, 229 bp, Homo sapiens
  DISO7_10003038
  Located on chromosome 11
  Distance between a terminus base of telomere on chromosomal short arm and 5'-terminus of this base sequence : 39785561
  Distance between 3'-terminus of neighbour sequence of sequence listing upward to telomere on chrosomal short arm and 5'-terminus of this base sequence : 65386
attatgtctagaattgcggtttactttcccttttttattacttcaactcttaaaaaagaaagtctttctacatggttctttatatatatatgtatatatatatatacatacatatatatgcatatatatatacatacatatatatgcatatatatatatatacatacatatatatgcatatatatatgcacatacatatatatatatgctctgaaattccttgattggc

SEQ ID NO: 17365 - DNA, 115 bp, Homo sapiens
  DISO7_10003041
  Located on chromosome 11
  Distance between a terminus base of telomere on chromosomal short arm and 5'-terminus of this base sequence : 39819789
  Distance between 3'-terminus of neighbour sequence of sequence listing upward to telomere on chrosomal short arm and 5'-terminus of this base sequence : 33999
cctctattccttgcatccccttttccattaggctgtaggacacacacacagacacacacacacacacacacacacacacacacatatacacacaccacagtggcaagggatcatt

SEQ ID NO: 17366 - DNA, 160 bp, Homo sapiens
  DISO7_10003044
  Located on chromosome 11
  Distance between a terminus base of telomere on chromosomal short arm and 5'-terminus of this base sequence : 39871614
  Distance between 3'-terminus of neighbour sequence of sequence listing upward to telomere on chrosomal short arm and 5'-terminus of this base sequence : 51710
tcatactatgcagctgttaggggctcttttcttagtcttctagtcagagctagaagatttttcttagagggttttttctgtttgtgtgtgtgtgtgtgtgtgtgtgtgtgtgtggtgtgtgtgtctgtacctagtttctagttctataagttgggccaac

SEQ ID NO: 17367 - DNA, 137 bp, Homo sapiens
  DISO7_10003045
  Located on chromosome 11
  Distance between a terminus base of telomere on chromosomal short arm and 5'-terminus of this base sequence : 39909221
  Distance between 3'-terminus of neighbour sequence of sequence listing upward to telomere on chrosomal short arm and 5'-terminus of this base sequence : 37447
gatggctagaggaggttattgtattatactgcaatagtactaacatagatatagatatagatatagatataaatatagatatatagagatagatatcttactacctaagtatgttcacatatctaagatccatatgc

SEQ ID NO: 17368 - DNA, 455 bp, Homo sapiens
  chr11.fa.O7frz.41886034
  Located on chromosome 11
  Distance between a terminus base of telomere on chromosomal short arm and 5'-terminus of this base sequence : 40100862
  Distance between 3'-terminus of neighbour sequence of sequence listing upward to telomere on chrosomal short arm and 5'-terminus of this base sequence : 191504
aaactcaggatctggtcataagctttaattgttggtgcttttctaggagataagaatgcatttattttctcatcatattctttaggctctagtaactttgaatcttagaaggatctgcagtcattacaatggctaatcatattttttgaaaatgtaaaaatcaatccaattctgaaattaatgtagtgttgtttggatctctttatatcagtgcaggaaacatagttccttaagaatcaaaaagagagaaaatgggcaaaacggcacaggctccaggtacatagagtttgtctaatttgagaaaggagctatcagataaatatataataaaaaatatataaatatataataaaaaagatcacacacacacacacacacacacacacacacactgaagttggaatagtgagagagaaccctgtccaaggatcctcagtgtatctgaaacagtatcc

SEQ ID NO: 17369 - DNA, 182 bp, Homo sapiens
  D11S4148
  Located on chromosome 11
  Distance between a terminus base of telomere on chromosomal short arm and 5'-terminus of this base sequence : 40117291
  Distance between 3'-terminus of neighbour sequence of sequence listing upward to telomere on chrosomal short arm and 5'-terminus of this base sequence : 15974
agcttagacgacagagtgagactctgtctcaaaacacacacacacacacacacacacacacacacacacacacacagaaaataaataaaaaatgaaagaagaaaattatggatgtgaagtccatcagtaagtgagaggggatgggatccagtgtacatccctgaaatgggagtaagtacgct

SEQ ID NO: 17370 - DNA, 189 bp, Homo sapiens
  chr11.fa.O7frz.41663771
  Located on chromosome 11
  Distance between a terminus base of telomere on chromosomal short arm and 5'-terminus of this base sequence : 40231679
  Distance between 3'-terminus of neighbour sequence of sequence listing upward to telomere on chrosomal short arm and 5'-terminus of this base sequence : 114206
ttaggattgataaagtttaaccagaggagattaccttctccaaatgttacttcttgtgtgtgtgtgtgtgtgtgtgtgtgtgtgtgtgtgtgtggtaagccatgtaaaaagatttacctgctttgtttttttctctctacatagaatgagagctgtatattatatattaaactcaactaaagttggtgc

SEQ ID NO: 17371 - DNA, 175 bp, Homo sapiens
  DISD22_0003580
  Located on chromosome 11
  Distance between a terminus base of telomere on chromosomal short arm and 5'-terminus of this base sequence : 40514652
  Distance between 3'-terminus of neighbour sequence of sequence listing upward to telomere on chrosomal short arm and 5'-terminus of this base sequence : 282784
ggactggattattcctccccaactcttcctaattcttcatctctctccacacacatgcatacacatacacacacacacacacacacacacacacacattattatatgctattggcatggctggcctctttttctcatctctttgattttagcgttaatgacatatacaacctagt

SEQ ID NO: 17372 - DNA, 456 bp, Homo sapiens
  chr11.fa.O7frz.42149536
  Located on chromosome 11
  Distance between a terminus base of telomere on chromosomal short arm and 5'-terminus of this base sequence : 40727407
  Distance between 3'-terminus of neighbour sequence of sequence listing upward to telomere on chrosomal short arm and 5'-terminus of this base sequence : 212580
tgctattactatgagatcattgaagaaaaagacagcaaaaatcaatcccagaatattgcagtttacttcctgacattgccactttttagttatgaaaatttggactttatttaacctctgaaagtcattatgtcatgatttgaaaaacttaaaaatatatattaattgaactactctttactccagaatattctgtgtacttcaagacaaggtttatttgacagatagatagatgatagatagatagatagatagatagatagatagatagatagacagacagatagatagatatagaattatttgcccacatttaaactcaagctatttgaggaaaatatctaggtttctggcttcttttagatgaaaatgagtagaatgttgtcttcagtttggtacaggcttgctacttatggtctcaaaattcatggcatactttcctatgtaggtgactga

SEQ ID NO: 17373 - DNA, 304 bp, Homo sapiens
  chr11.fa.O7frz.42469923
  Located on chromosome 11
  Distance between a terminus base of telomere on chromosomal short arm and 5'-terminus of this base sequence : 40925242
  Distance between 3'-terminus of neighbour sequence of sequence listing upward to telomere on chrosomal short arm and 5'-terminus of this base sequence : 197379
tgcattatatccaggtttacattacattcagttatgtagagtaattcatttttattattagctgcatctttgagctttctgcagcgtggcccagtctctttgctccgtgtgtgtgtgtgtgtgtgtgtgtgtgtgtgtgtgtgtgtgtgtgtagtggggggaaatctaggggttgagaagacatcaaaaatgcctatgacacaaaaagtgatcatatattttcaggtaagtcatggattcctttccattttttttttttctattcctttctttggtagctcagtttaatttctccaaatggaag

SEQ ID NO: 17374 - DNA, 426 bp, Homo sapiens
  chr11.fa.O7frz.42652792
  Located on chromosome 11
  Distance between a terminus base of telomere on chromosomal short arm and 5'-terminus of this base sequence : 41166181
  Distance between 3'-terminus of neighbour sequence of sequence listing upward to telomere on chrosomal short arm and 5'-terminus of this base sequence : 240635
gttctgtttctagatatcgttgagggtaaaagatgcctagagctgctgcagccatcttgtggccaagaggggaggcagcctgaggacaaagctgataagaaagaaaaaatgaaaaaatggaaagaacttatatctttgatatttgtgataagcagctgaattaatgaaccctgtaactgtttttcctctggacttcttattatgtaaaataatatattacagtataaacagttattatttttctggttacatgcagccaaacctatcctcacacgtttatgttcatttcttctctctctctctctctccttatttcctcagccaatagcaaagaagaggggaacattttattattttattttcctatacctttataaatatgagacctttcaaaggaaacaagttaaggtaaagcaacatgatatc

SEQ ID NO: 17375 - DNA, 277 bp, Homo sapiens
  D11S4173
  Located on chromosome 11
  Distance between a terminus base of telomere on chromosomal short arm and 5'-terminus of this base sequence : 41328154
  Distance between 3'-terminus of neighbour sequence of sequence listing upward to telomere on chrosomal short arm and 5'-terminus of this base sequence : 161547
ggaagcaacttaatgtcactgtatgtgtgtgtgtgtgtgtgtgtgtgtgtgtgtgtgtgtattccatcagtatactcgttggcttttgttactaagcttctataaattccccaaagccaggcttctggtatatatgtgcgtgcctgcgtgtgtttgcatacactcttgtatgtgcatgcatttgagttatttagaggaggtgtttctcagacgaagttcattcaagcagtatttattgcatgcatactacttgccagccattcttctgaggtgctga

SEQ ID NO: 17376 - DNA, 181 bp, Homo sapiens
  Z23927.1_97
  Located on chromosome 11
  Distance between a terminus base of telomere on chromosomal short arm and 5'-terminus of this base sequence : 41417555
  Distance between 3'-terminus of neighbour sequence of sequence listing upward to telomere on chrosomal short arm and 5'-terminus of this base sequence : 89124
ttgaagtgagcagaggaatttgcaagtgttccttagcacccagagacaaaaccagggacagtgtaagcatatcaatgtgtgtgcttatgtgtgtgtgtgtgtgtgtgtgtgtatgtgtatgtgtatctggagtgggggagttaaatgtgtctactacctacatagtggtccgtatccttag

SEQ ID NO: 17377 - DNA, 156 bp, Homo sapiens
  D11S1330
  Located on chromosome 11
  Distance between a terminus base of telomere on chromosomal short arm and 5'-terminus of this base sequence : 41417606
  Distance between 3'-terminus of neighbour sequence of sequence listing upward to telomere on chrosomal short arm and 5'-terminus of this base sequence : -130
ccagggacagtgtaagcatatcaatgtgtgtgcttatgtgtgtgtgtgtgtgtgtgtgtgtatgtgtatgtgtatctggagtgggggagttaaatgtgtctactacctacatagtggtccgtatccttagactagcctgcaataaaaacttgtagc

SEQ ID NO: 17378 - DNA, 463 bp, Homo sapiens
  AC013488.3_133257
  Located on chromosome 11
  Distance between a terminus base of telomere on chromosomal short arm and 5'-terminus of this base sequence : 41541158
  Distance between 3'-terminus of neighbour sequence of sequence listing upward to telomere on chrosomal short arm and 5'-terminus of this base sequence : 123396
gcatcctcaacataagatgtatggattataatgccaatggcataagattgttagaagaattaaggtaaagtatctagaccacataacctaatgtctgatatatatatatatatatatatacacacacacacacacacacacacacacacacacacacacattatatatatatacacattatatatatataatctattgttcaataaagaacatttataattatttaaatatatgcatgtgtattagtccattttcatgctgtctttcaaaaagacatacctgagactgggaagaaaaatcagtttaatggtgtcacagttccacgtggctcaggaggcctcacaatcatggtgggaggcaaaaggcacgtttaacatggtggcagcaagagagaatgaggcagaagtgaaagctgaaacccctgataaaaccatgagatctcatgagacttattcagtaccac

SEQ ID NO: 17379 - DNA, 379 bp, Homo sapiens
  chr11.fa.O7frz.43092627
  Located on chromosome 11
  Distance between a terminus base of telomere on chromosomal short arm and 5'-terminus of this base sequence : 41601376
  Distance between 3'-terminus of neighbour sequence of sequence listing upward to telomere on chrosomal short arm and 5'-terminus of this base sequence : 59755
attaggtagatccattgacctaaccaaccaatgatgtgtgtgcctgtgtttgtgtgtgtgtgtgtgtgtgtgtgtgttatctgtattctaagacccagtgaaagttcaattttcttttttcccatattttcccactttatttgcgtgattatatttgatgtagaaatgcaactgggaaacttactgataactacttctatttgaaaaaaataagaagagggattattttgagaaaaggaaaggcaatttgaaactgaaagagctgtgtttgggctctagttttaccatttataatgtatgtaagtatatgtgatatcattcattctgaaagttcagagatgatcattctaatctgatctaacttctgtcaatcagatgc

SEQ ID NO: 17380 - DNA, 479 bp, Homo sapiens
  AC025564.4_60162
  Located on chromosome 11
  Distance between a terminus base of telomere on chromosomal short arm and 5'-terminus of this base sequence : 41712319
  Distance between 3'-terminus of neighbour sequence of sequence listing upward to telomere on chrosomal short arm and 5'-terminus of this base sequence : 110564
ggacagaaattaacgtcagagtttagccacagaaataggaatttaataaacttaattaaaggattgggaagcagatagagaaaagttgcttctaatatctcagcccctactattctttatcttatgcattttgttgcagcatcattggccatctttcactttctatatagcacaagtttatttatgcctaaggatctttgcaattctctctgtctggaactctcttacccaatgccgcttaatgtctcattccttcattcttgtccttattcagtgtgtgtgtgtgtgtgtgtgtgtgtgtgtgtgtgtgtgtgtgtgtagtatatatatatgtgtgtgtgtatatatatagtaatatatgtaaatagtaatatataattatctcaaataaccctcatcttcataatccttgtctcttatccatccctctttataattactctgttttatattttcatcgtgcctatcactatctaaga

SEQ ID NO: 17381 - DNA, 233 bp, Homo sapiens
  DISO7_10003047
  Located on chromosome 11
  Distance between a terminus base of telomere on chromosomal short arm and 5'-terminus of this base sequence : 41940262
  Distance between 3'-terminus of neighbour sequence of sequence listing upward to telomere on chrosomal short arm and 5'-terminus of this base sequence : 227464
taggaacttagataagagcacaaagaaataatttccttccttccttcctttcttccttccttccttccttcattccctccctccctccctccctcttcttcctttctcctatccttcagtgtgtgtgtgtgtgtgtgtgtgtatatatataatatatatatgcatatatatgtatgtgtataatctatcatgataaatgtatataaaatctatcatatcccaggcatactaat

SEQ ID NO: 17382 - DNA, 276 bp, Homo sapiens
  D11S1785
  Located on chromosome 11
  Distance between a terminus base of telomere on chromosomal short arm and 5'-terminus of this base sequence : 41986056
  Distance between 3'-terminus of neighbour sequence of sequence listing upward to telomere on chrosomal short arm and 5'-terminus of this base sequence : 45561
ttctggaccagtacattggtagacagtctttgtatcaccagtgagtagagaagatgagggcctgagagagaaaaagtgtgtgtgtgtgtgtgtgtgtgtgtgtgtgtgtgtttgtgacagagagagagagagagagagagagaaatgatactaaaggaatgtgggcagcctgcactttcacttcttggcaaggacatagatgttttccctggtagaaaggacactgtagaagacagtgtgctaaaagtacattgagagttccctaaatgagcagct

SEQ ID NO: 17383 - DNA, 473 bp, Homo sapiens
  AC060831.5_5243
  Located on chromosome 11
  Distance between a terminus base of telomere on chromosomal short arm and 5'-terminus of this base sequence : 42332296
  Distance between 3'-terminus of neighbour sequence of sequence listing upward to telomere on chrosomal short arm and 5'-terminus of this base sequence : 345964
tacagaattagaagcagataggagcatggaagcaagaaatgtatccagggtaaatctcaaggttagtgaatgatgttgggcagagtatgctaattgctaacacataaatacacacacacacacacacacacacacacacacagagacactctctacaatggtttaaaataaaaatctctttattcttatctattagaatcctatttagattgggcataggaaggagtttggtttcacacagatactgaataacttgggctttttctatcaaatgattcctgccattccttagaccccagtgccattccttacaccccagagtgttttgcgggatcctctgcatctggccatctgatgaatgatgaaagagaatgaaaggatctcctgacaacttttaaagccagggtctaagatggcatgcttcacttcttcccacattccatggctcagtattctgtaacatagaagcacct

SEQ ID NO: 17384 - DNA, 439 bp, Homo sapiens
  AC060831.5_97499
  Located on chromosome 11
  Distance between a terminus base of telomere on chromosomal short arm and 5'-terminus of this base sequence : 42423965
  Distance between 3'-terminus of neighbour sequence of sequence listing upward to telomere on chrosomal short arm and 5'-terminus of this base sequence : 91196
ttgtctacctagaatgttgcattctttaacaacatgtctcaaaatcctccttcccaccctataactctggtaacaaccattctactctgattctatgagttcaaagttttaagatttcatatataagtgagataatgcagtatttaaatacctttctccgtctggcttatttcacatagcataatatcttccaggtttttcatccacgttgtgacaaatgatagaatttttttaaagctgaatagtattccactgtgtatatgtatgtgtgtgtgtgtgtgtgtgtgtgtgtgtgtgtatcacattttctttatccactcatttgttcaaagacacttagtttgattctatatcctgacatttctaatacccattaataaaaatttgagacttttatacgatgtcattaaattaaatgaaacagtgacctatatttcac

SEQ ID NO: 17385 - DNA, 277 bp, Homo sapiens
  D11S1779
  Located on chromosome 11
  Distance between a terminus base of telomere on chromosomal short arm and 5'-terminus of this base sequence : 42499450
  Distance between 3'-terminus of neighbour sequence of sequence listing upward to telomere on chrosomal short arm and 5'-terminus of this base sequence : 75046
ttggtagccatagttttatgtgtacatatatatgtgtgtgtgtgtgtgtgtgtgtgtgtgcatatatatacatacacacacaaacatcaaattgtacacactaaaataagtgcatattattattaatttcattctactgcacagatatactttttctagttcttttctacatatatatgtatatgcagaaaaagttatataactatatatcgttaatttttaaaaatcagatcagataggtgtaggggtgtgtccataatctcagcactttgggaag

SEQ ID NO: 17386 - DNA, 384 bp, Homo sapiens
  AC020710.4_72570
  Located on chromosome 11
  Distance between a terminus base of telomere on chromosomal short arm and 5'-terminus of this base sequence : 42513117
  Distance between 3'-terminus of neighbour sequence of sequence listing upward to telomere on chrosomal short arm and 5'-terminus of this base sequence : 13390
atgcattatggtcaagtacaactataaggataataacacatggcagaatatatagcctttgggactaatcaagaatggtgacagcattgtattctatcaatttagttcaattaatgtttatctattttttcattcattcattcattcattatttcatttatactatttccattcagcaatcattttaagcactatgcaagtcaatggaaatttagagataaagaattcatggagttcaaagcttatcgtggtcaacaaagcatacacacacacacacacacacacacaaacacatatacacatatgtaatttatacacacacaattacacagcatatttatatacatatgcagtaattgcataatggtgacaactaccatttac

SEQ ID NO: 17387 - DNA, 151 bp, Homo sapiens
  chr11.fa.O7frz.44063729
  Located on chromosome 11
  Distance between a terminus base of telomere on chromosomal short arm and 5'-terminus of this base sequence : 42672888
  Distance between 3'-terminus of neighbour sequence of sequence listing upward to telomere on chrosomal short arm and 5'-terminus of this base sequence : 159387
cagttctggaatgaagacatacagagtaatatagggctggagaaggattttcttaaaaaaatcctaagaatacacacgcgcacacacacacacacacacacacacacacacactagttaaaaggaggatgaaggaacattctaaacaggag

SEQ ID NO: 17388 - DNA, 431 bp, Homo sapiens
  chr11.fa.O7frz.43315568
  Located on chromosome 11
  Distance between a terminus base of telomere on chromosomal short arm and 5'-terminus of this base sequence : 42818948
  Distance between 3'-terminus of neighbour sequence of sequence listing upward to telomere on chrosomal short arm and 5'-terminus of this base sequence : 145909
tgcagttaatcaaggaacatactcaattccagcaagtgtgtttacttctgtcattgtttgatcattacacatcatttttgaaaggcgcagaaaatttgactttttatttgtatttctccaagccaagaggagcttgggttctttcttctgggttgtttcttccagggagagagcaaatgtgctatgcctggaacttagttatttgaggatttagtgaccagcgggaggagccatccccaaatatttctctctctctctctctctctctttcctgtgtatcatatttacatcttcttctttgcttcccctgtcaatcttcttcattcaataaaaacccatgtgattatgttgggctacccaattttattttcccaccctcaagccctcatgaagcttcattcataaattgctttgacaagtgatgtatgagc

SEQ ID NO: 17389 - DNA, 214 bp, Homo sapiens
  D11S905
  Located on chromosome 11
  Distance between a terminus base of telomere on chromosomal short arm and 5'-terminus of this base sequence : 42846820
  Distance between 3'-terminus of neighbour sequence of sequence listing upward to telomere on chrosomal short arm and 5'-terminus of this base sequence : 27441
caggcatctgaaacttcttgtacttgtgaatcactggtttatttaaggcttcactgaataactctcctgtccctcacacacacctctgtctatttccaaacacacacacacacacacacacacacacacacacactctctctctctctctctctctctctctctttctctcttttcttttgtccaggtctttgaaacctatttggcccctgtat

SEQ ID NO: 17390 - DNA, 294 bp, Homo sapiens
  chr11.fa.O7frz.43562238
  Located on chromosome 11
  Distance between a terminus base of telomere on chromosomal short arm and 5'-terminus of this base sequence : 42915684
  Distance between 3'-terminus of neighbour sequence of sequence listing upward to telomere on chrosomal short arm and 5'-terminus of this base sequence : 68650
tatctccatggtgctagtacagtgctgagtacacagtatatggtgagataatccatgttgacttgaatcgatattcaccatttcttatctggactctctccataggaatgtcttcctgaatgcttatgctaactttaattttatgagcttacaattttgttttatatatatatatatatatatatgtatatatctactgacagcaatttatcttactgaatatacagaacatataagtgtatatatatgatcagaacatgtagaaggaaactatcaagattaacattggttgac

SEQ ID NO: 17391 - DNA, 447 bp, Homo sapiens
  chr11.fa.O7frz.43416085
  Located on chromosome 11
  Distance between a terminus base of telomere on chromosomal short arm and 5'-terminus of this base sequence : 43095879
  Distance between 3'-terminus of neighbour sequence of sequence listing upward to telomere on chrosomal short arm and 5'-terminus of this base sequence : 179901
cacattggttatgtttgcttacatgcatttttaggggagttctaaactggatttctgcaagcacccaggatgcttttggctgctctacacacacacacatacacacacacaaacacacacacacacacacacacacaagtccagcaaatgcagtgtagtttttagggaaaagtggaaagtaaagtttagttttgaccatcagtcctcctaggagcctccttgcctcactcgtaatgcctcattattttactccctgccccacctccagaacttattgatgtcctctttggaacaccggctcttccttgactggacaatgtccagttctttattttctctctgataaactagacagcactagtaggctgatggaaagcccccaaatactaagtttagagtagagatggtcttgtccaaatgggtttctgctaacattgactcaacttt

SEQ ID NO: 17392 - DNA, 225 bp, Homo sapiens
  chr11.fa.O7frz.43749854
  Located on chromosome 11
  Distance between a terminus base of telomere on chromosomal short arm and 5'-terminus of this base sequence : 43331431
  Distance between 3'-terminus of neighbour sequence of sequence listing upward to telomere on chrosomal short arm and 5'-terminus of this base sequence : 235105
ctctgaaatcttgctatcatttaccttttccaatattatctccaaactttcactgccttcttttccaaccacaaaacctctctcttgctcattaagacacacacgcacacacacaaacgcgcgcgcgcgcgcacacacacacacacacacaccagttgcaggaacattcctctaaaccaaggatttaatgtggatttagtgcttcaaagataggaacagttcatg

SEQ ID NO: 17393 - DNA, 111 bp, Homo sapiens
  DISD22_0003591
  Located on chromosome 11
  Distance between a terminus base of telomere on chromosomal short arm and 5'-terminus of this base sequence : 43425181
  Distance between 3'-terminus of neighbour sequence of sequence listing upward to telomere on chrosomal short arm and 5'-terminus of this base sequence : 93525
aacaatgccttacacatgagagagggaagataattgtttgattttttttcttttctttctttttttttctttttttttttttttttagtaggcaagaagagatagaattca

SEQ ID NO: 17394 - DNA, 141 bp, Homo sapiens
  D11S1355
  Located on chromosome 11
  Distance between a terminus base of telomere on chromosomal short arm and 5'-terminus of this base sequence : 43554286
  Distance between 3'-terminus of neighbour sequence of sequence listing upward to telomere on chrosomal short arm and 5'-terminus of this base sequence : 128994
attattgcacttatcactttgtgctaaaatgtatttttatttatgtttatatatatgaaatatatatatatttcacatacatacatacacacacacacacacacacacacacacacatcctctactccaagaaggctgaga

SEQ ID NO: 17395 - DNA, 375 bp, Homo sapiens
  chr11.fa.O7frz.45511842
  Located on chromosome 11
  Distance between a terminus base of telomere on chromosomal short arm and 5'-terminus of this base sequence : 43600171
  Distance between 3'-terminus of neighbour sequence of sequence listing upward to telomere on chrosomal short arm and 5'-terminus of this base sequence : 45744
ggcacatgtatacgtatgtaactaacctgcacaatgtgcacatgtaccgtaaaacttaaagtataataataaataaataaataaataaaaggaaaaataaataaacattaatatcaaataaacattagaatctgtggtgagggaattaaaatgagaatgggcaaaagagataaaagaaattaatgaattaaataaaaatgagaaagggcttgtgcagaccaatggcaatgattttccttaaagtgacagtcatacttaacccaaccctctgtacttgaaatatgaaagaaaagaggaattttctcttctgattcaagcctctttatgtagggcactgaaattcatgcagaggagtttgaacttgctgaagtacat

SEQ ID NO: 17396 - DNA, 272 bp, Homo sapiens
  DISO7_10003051
  Located on chromosome 11
  Distance between a terminus base of telomere on chromosomal short arm and 5'-terminus of this base sequence : 43923698
  Distance between 3'-terminus of neighbour sequence of sequence listing upward to telomere on chrosomal short arm and 5'-terminus of this base sequence : 323152
agcaagcaaacaagcatgcaagaaagaaagaaagagggagggaaagaaggaaggaaggaaagaaggagagagagagacaaaagaaagaaagaaaaagaaagaaagagaaagaaagaaagaaagagagagagaaagaaagagagagaaagagagaaagaaagaaagaaaagaaagaaagaaagaaagaaagagaaggaaagaaagaaagagagaaggaaggaaagaaagaaagagagaaagaaagaaagaaagacagtcttggtcctcagagg

SEQ ID NO: 17397 - DNA, 228 bp, Homo sapiens
  DISO7_10003049
  Located on chromosome 11
  Distance between a terminus base of telomere on chromosomal short arm and 5'-terminus of this base sequence : 43931447
  Distance between 3'-terminus of neighbour sequence of sequence listing upward to telomere on chrosomal short arm and 5'-terminus of this base sequence : 7477
acatgttaatggtaacagcaatctaatactttcatttttgttttttttgtttgtttgtttgtttgtttgtctttttcctttttctggagaacggggtctcgctatattgcccaggcagatctcgaactcctgggctcaagctatcctccagcctcttgcctccctgagagctgggattacaggtgtgagccaccgcgcccagccgaagcaatctaatactctcatcca

SEQ ID NO: 17398 - DNA, 380 bp, Homo sapiens
  AC023085.2_151526
  Located on chromosome 11
  Distance between a terminus base of telomere on chromosomal short arm and 5'-terminus of this base sequence : 44122337
  Distance between 3'-terminus of neighbour sequence of sequence listing upward to telomere on chrosomal short arm and 5'-terminus of this base sequence : 190662
atagaagtggaggcaaattaacaacctctgtcctgtcataggagaatctggagaaagaaagcaactaccattgctcatggcttctttcccattagccctccatgggcggggacacacacacacacacacacacacacacacacacacacacacacacacacacacacacacacactctcatggcctctttcccattagcccttcatgggtgggcacacacacacaccacattcagtcttttacaagttgtacttttcactgctcccaaacacaaatgagaattcctgtgcctgttgctttgcccaacacattattcttccttgcctagaatgctgccttccctactgatcggcggggggaagcctagaagccttgtaata

SEQ ID NO: 17399 - DNA, 333 bp, Homo sapiens
  chr11.fa.O7frz.45741318
  Located on chromosome 11
  Distance between a terminus base of telomere on chromosomal short arm and 5'-terminus of this base sequence : 44132958
  Distance between 3'-terminus of neighbour sequence of sequence listing upward to telomere on chrosomal short arm and 5'-terminus of this base sequence : 10241
agtatttcagtaaaatacgtgcagcgtacataggcagttcaccaaatacatacacacacacacacacacacacacacacacacacacagatggccgctaaacttgagaagatattcaacctcatcagcaatcagaggagcgcagacataaacagtaagataccagttttgattatcaaattgtttttaaatgtgtaacacacattttatttaactgaagtgaattttgcggcagtctgactagacgcatcagaaaatttaaaaatataccagttattctacttctagtaatttaccctaagtaaatcatcttacaagtgccatagatgtaagt

SEQ ID NO: 17400 - DNA, 274 bp, Homo sapiens
  DISO7_00000004
  Located on chromosome 11
  Distance between a terminus base of telomere on chromosomal short arm and 5'-terminus of this base sequence : 44241908
  Distance between 3'-terminus of neighbour sequence of sequence listing upward to telomere on chrosomal short arm and 5'-terminus of this base sequence : 108617
atccacctaggcatttgcagctctgccagcacttcggcatcttgtccgtgatctaatcatgcacgaggtcagggggtttttatacagtctagggatttgactgtgaatggcagaaatttcttcctaccaggattttgcacgcttccgagctgaaacctcctggagcaaggaagcagggcaaagtgtgtgtgtgtgtgtgtgtgtgtgtgtgtgtgtgtgtgtgtgtgtgtgtgtgtgtgtcaggggagaggggcagaataaaggcatgttctaa

SEQ ID NO: 17401 - DNA, 468 bp, Homo sapiens
  chr11.fa.O7frz.45956384
  Located on chromosome 11
  Distance between a terminus base of telomere on chromosomal short arm and 5'-terminus of this base sequence : 44295838
  Distance between 3'-terminus of neighbour sequence of sequence listing upward to telomere on chrosomal short arm and 5'-terminus of this base sequence : 53656
aatttgaggtaaggagtttgagaccagcctggccaacatggtgaaaccctgtctctactaaaaatacaaaaattagctgggcataatggcgggcacctgtaaccccagctaattgggaggctgaggaaggagaatcacttgaacctgggaggcggaggttgtagtcaactgagattgcgccattgcactccagactgggcggtaagagcgggaaaaaaaagaaaagaaagagttaacattcatccctaagtcttgggccttagaaagggggtaaatgatggtatcattaatagaaataggaatgaaaagaggaagagggtgtgtgtgtgtgtgtgtgtgtgtgtgtatgtgttaagcgtagagttctattctaaacatgttaagtttgaaatgtttattttatatctgagtagagatgcgaataggcaggtggatatatatactgtatagaagtctggacctctaagc

SEQ ID NO: 17402 - DNA, 367 bp, Homo sapiens
  AC068205.3_95391
  Located on chromosome 11
  Distance between a terminus base of telomere on chromosomal short arm and 5'-terminus of this base sequence : 44310229
  Distance between 3'-terminus of neighbour sequence of sequence listing upward to telomere on chrosomal short arm and 5'-terminus of this base sequence : 13923
gcacctagaacaatgtctgtacacagtaagtgccaatgtacctttgttgaattaatggaaatatctgttaagtaaggtattcatacatatatatatatatatatatatatatatatatatatatatatatttttttttttttttttctgagacagggtctcactatattgcccaggctggcctcaaactcctgggctcaagcaatcctcctgccttagcctcctgagttgctgggactataggcatgtgtcccagctgtgtctggcttccagtctttttaatattaagggataatgatttttgtgaattatcttctctttttacattctcttatcagctacaaatctaacaaatattagcggtttcc

SEQ ID NO: 17403 - DNA, 371 bp, Homo sapiens
  AC068205.3_150359
  Located on chromosome 11
  Distance between a terminus base of telomere on chromosomal short arm and 5'-terminus of this base sequence : 44342687
  Distance between 3'-terminus of neighbour sequence of sequence listing upward to telomere on chrosomal short arm and 5'-terminus of this base sequence : 32091
tgcttcaattctaagatctaacagattttcagatcacccagttcattcatctatctgcatctgcttacacatctctacttattgtctgatatgagaagctgttatagatcactaagctgaaggcaaggaaaagagaattgcatgcattggggattctcttcatgggtccagtcagtttttgactgccttctccatatatgtttttatatatttatgtgtatgctctgtgtgtgtgtgtgtgtgtgtgtgtgtgtgtgtgtgtgtgttttcgtttatttacttgtcttacccaacaagggactggcataaaatattttgcataaaaaaaatagctgcctaagggcctaggggttaccatatgtggcagaaag

SEQ ID NO: 17404 - DNA, 388 bp, Homo sapiens
  chr11.fa.O7frz.46072222
  Located on chromosome 11
  Distance between a terminus base of telomere on chromosomal short arm and 5'-terminus of this base sequence : 44568908
  Distance between 3'-terminus of neighbour sequence of sequence listing upward to telomere on chrosomal short arm and 5'-terminus of this base sequence : 225850
gaggtcaggagttcgagaccagcctggccaacatggtgaaaccccatctctactaataatacaaaaattagctgggcatggtggcacacgcctgtaatcccagctacttgggaggctgagacaggagagttgcttgaaccccgaaggtggaggttgcagtgagccaagatcgcaccactgcactccagcctgggtgacaaagcaagactccatctcaaaaaaaacaaacaaacaacaacaacaacaacaacaacaacaaaacatacttacctccctcacaatttgccctcgaggaagggcctcaagatctttaccctaaaacaattctgttgaattgagctgatgtgagctgattggcaatgtgagctgatagtttacattgaaagtc

SEQ ID NO: 17405 - DNA, 200 bp, Homo sapiens
  D11S1393
  Located on chromosome 11
  Distance between a terminus base of telomere on chromosomal short arm and 5'-terminus of this base sequence : 44592662
  Distance between 3'-terminus of neighbour sequence of sequence listing upward to telomere on chrosomal short arm and 5'-terminus of this base sequence : 23366
attccatatgcaaatacatcatgtattttttaaatgcagatgctctgttctttggttttgagatatctatctatctatctatctatctatctatctatctatctatctcctggaaaagaaaccttagtacatgtaataatagtttgcaaagtcatactgcttaatcaaataccatccccatcttcttactggtctaacca

SEQ ID NO: 17406 - DNA, 423 bp, Homo sapiens
  U73628.1_29801
  Located on chromosome 11
  Distance between a terminus base of telomere on chromosomal short arm and 5'-terminus of this base sequence : 44708716
  Distance between 3'-terminus of neighbour sequence of sequence listing upward to telomere on chrosomal short arm and 5'-terminus of this base sequence : 115854
ttcttaattctttaaggaaccatcatactgttttccattgcagttgcactattttacagtcctgccaacagtgcacaggggttccagtttctccatgttctcactagcacatgtttctgtttgttgttgttgttgttgttgttgttgttttaagatggggtcttgctctgttgcccaggctggagtgcagtggcatgatcttggctcaccgcaacctctgcatcccaggctcaagagattctccagcctcagcctcccaagtagctgggattacaggcacgcatcaccatacctggctaatttttgtattttagtagagatgaggtttcaccatgttggctaggctagtcttgaactgttgacctcaagtgatttgcccacctcagcctcccaaactgctggaattacctcactggccttata

SEQ ID NO: 17407 - DNA, 102 bp, Homo sapiens
  D11S903
  Located on chromosome 11
  Distance between a terminus base of telomere on chromosomal short arm and 5'-terminus of this base sequence : 44743700
  Distance between 3'-terminus of neighbour sequence of sequence listing upward to telomere on chrosomal short arm and 5'-terminus of this base sequence : 34561
aacacttcgatgttccttccaaattatcagtttctctcctacacacacacacacacacacacacacacacacacacacaatttatagcatgcgctctcagct

SEQ ID NO: 17408 - DNA, 219 bp, Homo sapiens
  HUMUT1529
  Located on chromosome 11
  Distance between a terminus base of telomere on chromosomal short arm and 5'-terminus of this base sequence : 44806202
  Distance between 3'-terminus of neighbour sequence of sequence listing upward to telomere on chrosomal short arm and 5'-terminus of this base sequence : 62400
attaaggccattgcaaaggacatttggaatcaaacctgagctcaaaaccatttattagcttgaccttgtacaaaatttccttccttccttccttcgtaccttccatccatcgttccttccttccttccttccttccttccctccttacctcctccctcaatccgtccctccctccctcccttctgcagcggcacaatcatagctccctacagccttgac

SEQ ID NO: 17409 - DNA, 434 bp, Homo sapiens
  chr11.fa.O7frz.46560816
  Located on chromosome 11
  Distance between a terminus base of telomere on chromosomal short arm and 5'-terminus of this base sequence : 44915050
  Distance between 3'-terminus of neighbour sequence of sequence listing upward to telomere on chrosomal short arm and 5'-terminus of this base sequence : 108629
gagtctaggagttcaagaccagcctgggcagcatggagaaaccctgtctctactaaaaatacaaaagttaactgggcgtggtgacgagcctgtagtcccagctacttgggaggctgaggtgggaggatcacttaagcctgggaggcagaggttgcagtgagctgagattgcgccactgcactccagcctgggtgaccgagtgagaccttgtctcaaaaaataataaaataaaataaaataaaataaaaagctctcttcagctgtgcccctgccattcctcagcccacctcaccggcatgcatcatgcccctgcactccacacacttgcttcatgttcttcccttacccgaagacttagtttgtgctgtttcctgagtctagagggcctctttcatctccttcagctggtgagctcctattcaactttcaaggtc

SEQ ID NO: 17410 - DNA, 146 bp, Homo sapiens
  chr11.fa.O7frz.46684561
  Located on chromosome 11
  Distance between a terminus base of telomere on chromosomal short arm and 5'-terminus of this base sequence : 45103059
  Distance between 3'-terminus of neighbour sequence of sequence listing upward to telomere on chrosomal short arm and 5'-terminus of this base sequence : 187575
aactctggatttagtcctgtcttcatccccatacttcccagttgtattagctaatttctattttattccattatcttattctattctattctattctattctattctattctattctattctattctatactcagtgcattcaact

SEQ ID NO: 17411 - DNA, 359 bp, Homo sapiens
  chr11.fa.O7frz.46834775
  Located on chromosome 11
  Distance between a terminus base of telomere on chromosomal short arm and 5'-terminus of this base sequence : 45193561
  Distance between 3'-terminus of neighbour sequence of sequence listing upward to telomere on chrosomal short arm and 5'-terminus of this base sequence : 90356
tgagccaagattgtaccactgcactccagcctgggcgacagagtgagaatctgtctcaaaaataataataataataataataataaataaaataaaatatttgtctttgtgcatagttcatattatgcaaaatggctaataaaatagtacatacatatctattataaacaaatgacatatattgggatgtatataaccctaccatgggtttaagctgatgcctaaaaagaaaaataaacgggtagaacagggaatttggggagggggggacatgatttaatagtttcaaagacttacccaagtgccacagttgtaagataaatataaataagctttagaatatgtaaagtgctacgcaa

SEQ ID NO: 17412 - DNA, 104 bp, Homo sapiens
  DISD22_0005072
  Located on chromosome 11
  Distance between a terminus base of telomere on chromosomal short arm and 5'-terminus of this base sequence : 45369856
  Distance between 3'-terminus of neighbour sequence of sequence listing upward to telomere on chrosomal short arm and 5'-terminus of this base sequence : 175936
ttgtgccctgtgaatctggggtccagcggctcttctgtcctgccccttctctctctctctctctctctctctcgtcctctgactccgcaggctttagccttgtc

SEQ ID NO: 17413 - DNA, 194 bp, Homo sapiens
  D11S4103
  Located on chromosome 11
  Distance between a terminus base of telomere on chromosomal short arm and 5'-terminus of this base sequence : 45674623
  Distance between 3'-terminus of neighbour sequence of sequence listing upward to telomere on chrosomal short arm and 5'-terminus of this base sequence : 304663
aaatccctctggctgctgcatggagaatggattattggagcaaaagtaggagccagagaccagagaagatagaagtcagggctgcctccccagcccccactggatggagcagatgggagtggggggctgggaagcactgcacacacacacacacacacacacacacagcctctggcagggtgggctcaagaact

SEQ ID NO: 17414 - DNA, 211 bp, Homo sapiens
  Z24638.1_128
  Located on chromosome 11
  Distance between a terminus base of telomere on chromosomal short arm and 5'-terminus of this base sequence : 45796204
  Distance between 3'-terminus of neighbour sequence of sequence listing upward to telomere on chrosomal short arm and 5'-terminus of this base sequence : 121387
tgtcaaagtcaatttcatgctctggaagagatgtgctgcttctcctgtccccttctggggttgtgtgtgtgtgtgtgtgtgtgtgtgtgtgtgattatattgcagtgacacccaactctatgctcagacactttccaccactcaggatatgctaagagagcggcacagagagacggacggtaatccttggtaatcctaacaggcattgaga

SEQ ID NO: 17415 - DNA, 206 bp, Homo sapiens
  D11S1361
  Located on chromosome 11
  Distance between a terminus base of telomere on chromosomal short arm and 5'-terminus of this base sequence : 45796210
  Distance between 3'-terminus of neighbour sequence of sequence listing upward to telomere on chrosomal short arm and 5'-terminus of this base sequence : -205
agtcaatttcatgctctggaagagatgtgctgcttctcctgtccccttctggggttgtgtgtgtgtgtgtgtgtgtgtgtgtgtgtgattatattgcagtgacacccaactctatgctcagacactttccaccactcaggatatgctaagagagcggcacagagagacggacggtaatccttggtaatcctaacaggcattgagat

SEQ ID NO: 17416 - DNA, 364 bp, Homo sapiens
  HUMUT692
  Located on chromosome 11
  Distance between a terminus base of telomere on chromosomal short arm and 5'-terminus of this base sequence : 45877804
  Distance between 3'-terminus of neighbour sequence of sequence listing upward to telomere on chrosomal short arm and 5'-terminus of this base sequence : 81388
tacaatttcgcttcagcctgaacatcttattatctgaatctgctagcaataaattctggttttatccaaaaatatctttttcttttcttttcttttctttctttcttttcttttcttttcttttctttctttctttctttctttctttctttctttctttctttctttctttctttcttccttctttctttctttctttctttttctttctttctctttctttctttccttttttttctcgagacagggtctcattctgtcgcccagactggactgcagtgacatggcttcagctcactgcaacctctacctccagggttcaagcaattctcaggcctcagcctcccaagccactgggattaca

SEQ ID NO: 17417 - DNA, 387 bp, Homo sapiens
  AC024031.3_119796
  Located on chromosome 11
  Distance between a terminus base of telomere on chromosomal short arm and 5'-terminus of this base sequence : 45953430
  Distance between 3'-terminus of neighbour sequence of sequence listing upward to telomere on chrosomal short arm and 5'-terminus of this base sequence : 75262
gaattgcattgaatctgtagattgctttgggcagtatggtcatcttcacaatattgattcttcctatccatgagcatgggatgtgtttccatttgtttgtgttatctatgatttctttcagcagtgttttgtaattttccttgtagagatctttcacctctttggttaagtatattcctaaattatttatttatttattattttgcagctgttgtaaaagggagtgagttcatgattgaatttcagcttggttgttgttggtgtataagagtgctactgatttgtgtgtgtgtgtgtgtgtgtgtgtgtgttttgtttttttttttttttacaaaaaatcacattgattttgtatcctgaggctctactggatttgtttatcagatc

SEQ ID NO: 17418 - DNA, 406 bp, Homo sapiens
  chr11.fa.O7frz.47313914
  Located on chromosome 11
  Distance between a terminus base of telomere on chromosomal short arm and 5'-terminus of this base sequence : 45968977
  Distance between 3'-terminus of neighbour sequence of sequence listing upward to telomere on chrosomal short arm and 5'-terminus of this base sequence : 15160
aacatcctatgtgaagctctaacccccaatgtgatgatatttggagacggggcctttgggaagtacttaagtttgatgagttaataagggtggggcccccacgatggaattggtgtccttgtaagaccagaggaagagatgctggaactaactaactctctctctctctctctctctccccctcccatgtgaggtcatagtgagaagatggctgtctacaatcaggaagagagctcttaccaggaaccaaatctgccagaaccttgatcatggacttccagactttagaaatatgagaattcctgttgtttaagccacctagtctatggtattttattatgacagccagaactgactaagatgagtcccttggtcccaagaactctggactagaatagacatgttc

SEQ ID NO: 17419 - DNA, 279 bp, Homo sapiens
  D11S4174
  Located on chromosome 11
  Distance between a terminus base of telomere on chromosomal short arm and 5'-terminus of this base sequence : 46106315
  Distance between 3'-terminus of neighbour sequence of sequence listing upward to telomere on chrosomal short arm and 5'-terminus of this base sequence : 136932
gatagctttcccagatggttacatgactgaactcttctcctcttttaggtctcatctaaaatgcagcctcaaaggggtctttcctggccagcctatctaaactgtataattactctgtgtgtgtgtgtgtgtgtgtgtgtgtgtgtgtgtgagagagagagagagagagagagagacagacagagagagatagagaaagacagagattgttttatgtccgtcttccccttccatatggtaacacccacaagggaaaagctacatagtgggcatttaatc

SEQ ID NO: 17420 - DNA, 357 bp, Homo sapiens
  chr11.fa.O7frz.47992508
  Located on chromosome 11
  Distance between a terminus base of telomere on chromosomal short arm and 5'-terminus of this base sequence : 46303525
  Distance between 3'-terminus of neighbour sequence of sequence listing upward to telomere on chrosomal short arm and 5'-terminus of this base sequence : 196931
agaatctgagctaagattggaccttcctctgtgtgggcacttatgtgtgcatgcgtgtgcattttgtaagggagatgggagcacgcatgtgggtgtatgaggggagtgtgtaagcacaggtgagggtgggtgggtgtgtaggcaggtgggcatgcggtgggactacatgagattgtgtatgaaagtgggtgtgtgaacatttgtgtgagggttgatgtttgagcatatgtgagcaggagtgtgtgtgtgtgtgtgtgtgtgtgcacagcagggtagcccaggcagattctgcccttgtctctctctctgcccccctctttactgctcccttcacctacttattctccttgctcaatc

SEQ ID NO: 17421 - DNA, 161 bp, Homo sapiens
  DISO7_10016297
  Located on chromosome 11
  Distance between a terminus base of telomere on chromosomal short arm and 5'-terminus of this base sequence : 46417195
  Distance between 3'-terminus of neighbour sequence of sequence listing upward to telomere on chrosomal short arm and 5'-terminus of this base sequence : 113313
ggaaattaactagtggtcaatggggtagcaaatctactcctgggtttgtaaaacatgaacatacacacacatacatacctacacacatacacacagtcacatacacacacacactcacatacacacacacacacacacagcccctgtaaccaggttatcct

SEQ ID NO: 17422 - DNA, 107 bp, Homo sapiens
  DISO7_10003055
  Located on chromosome 11
  Distance between a terminus base of telomere on chromosomal short arm and 5'-terminus of this base sequence : 46503280
  Distance between 3'-terminus of neighbour sequence of sequence listing upward to telomere on chrosomal short arm and 5'-terminus of this base sequence : 85924
tccagtgcctgcacatacttgaatgaatgaatgaatgaatgaatgaatgaatgaatgaatccatcactagacagggctttcctctgaaagctccagccagctttatt

SEQ ID NO: 17423 - DNA, 420 bp, Homo sapiens
  chr11.fa.O7frz.47732663
  Located on chromosome 11
  Distance between a terminus base of telomere on chromosomal short arm and 5'-terminus of this base sequence : 46564405
  Distance between 3'-terminus of neighbour sequence of sequence listing upward to telomere on chrosomal short arm and 5'-terminus of this base sequence : 61018
ttgaccttaaccttgcttaaggcacccatcaactccttctcgcttagtggcaattattctctctctctctctctctctctctctgtctctcccaccaactgtttagattcccctgctgggcctgtttaagtcaatcagaaggaaagccttaatttgcctttaaatctgtattttcagagctcctgcattctttcccttcacaaagcaaaacagagcagcaagggtgcagagccatctgtatccaacccctcccgccatgagggtttatctgccagtttgcctctgtttggctctctagagacaatccctctcctggctcagtctttgcctgtataaccagcactatgccaggtagggcctctccacccccagtcaatctccacacccaaatgttatccctgatgtatgactgagatccac

SEQ ID NO: 17424 - DNA, 103 bp, Homo sapiens
  DISO7_10003054
  Located on chromosome 11
  Distance between a terminus base of telomere on chromosomal short arm and 5'-terminus of this base sequence : 46613047
  Distance between 3'-terminus of neighbour sequence of sequence listing upward to telomere on chrosomal short arm and 5'-terminus of this base sequence : 48222
aagggacagctgatgagcaggggcggtagagacccaggcagaggcagaggcagaggcagaggcagaggcggagggagcgtggggggaggagatgggcagaaga

SEQ ID NO: 17425 - DNA, 101 bp, Homo sapiens
  DISO7_10003059
  Located on chromosome 11
  Distance between a terminus base of telomere on chromosomal short arm and 5'-terminus of this base sequence : 46736273
  Distance between 3'-terminus of neighbour sequence of sequence listing upward to telomere on chrosomal short arm and 5'-terminus of this base sequence : 123123
tcttccttccaccctgtggcctgcacttgagccacaaagtgtgtgtgtgtgtgtgcgtgtgtggtacgtgtgtgtgtgtgtggctatgaggctgattcctg

SEQ ID NO: 17426 - DNA, 178 bp, Homo sapiens
  DISO7_10003061
  Located on chromosome 11
  Distance between a terminus base of telomere on chromosomal short arm and 5'-terminus of this base sequence : 46809303
  Distance between 3'-terminus of neighbour sequence of sequence listing upward to telomere on chrosomal short arm and 5'-terminus of this base sequence : 72929
cgagaatcactcaagtctttctctctccaacacacacacacacacacacacactttttaatcaaaaaggacacatttcctccataaaacaaaacaccagtgggaaagtagtttacagtgacattttaaagtcctggatgcccagaaatcttattttcatgtctctttgaataggaagg

SEQ ID NO: 17427 - DNA, 193 bp, Homo sapiens
  D11S1319
  Located on chromosome 11
  Distance between a terminus base of telomere on chromosomal short arm and 5'-terminus of this base sequence : 46884823
  Distance between 3'-terminus of neighbour sequence of sequence listing upward to telomere on chrosomal short arm and 5'-terminus of this base sequence : 75342
  misc_feature (1)...(193): n = A,T,G or C
aaatctcacatttgcattcaaatattttatgttcccattcaactatatttacttcagtttttttttaatttgtaactttaagaaggtgacgatcatttcttctaaaccacatantgtgtgtgtgtgcgtgtgtgtgcgtgtgtgtgtgtgtgtgtgtgtgtgtgtgtgtgtgngtgtttccagtagcaatttc

SEQ ID NO: 17428 - DNA, 317 bp, Homo sapiens
  chr11.fa.O7frz.48485188
  Located on chromosome 11
  Distance between a terminus base of telomere on chromosomal short arm and 5'-terminus of this base sequence : 46953487
  Distance between 3'-terminus of neighbour sequence of sequence listing upward to telomere on chrosomal short arm and 5'-terminus of this base sequence : 68471
cagataaatggacagtgatcacaagctgccgaggatgagcaaaactaactaaataaaaattatagcaccttattgtgttccatcctgcctcacttctcaatatagcactgctgtactcactaggctggaaaatgagcaggtgcctttcaggctatagaaaaattagacacacacacacacacacacacacacacacacacacacaccctaaacacaaacacaaacacaaagggaatgatactctttcacttgaaggggcttaaaaaatgcaaggctttgctgcaggcctagaaaactcagagtaggccttaccgaag

SEQ ID NO: 17429 - DNA, 281 bp, Homo sapiens
  D11S1344
  Located on chromosome 11
  Distance between a terminus base of telomere on chromosomal short arm and 5'-terminus of this base sequence : 47001342
  Distance between 3'-terminus of neighbour sequence of sequence listing upward to telomere on chrosomal short arm and 5'-terminus of this base sequence : 47538
ccctgaacttctgcattcacagaccacctccacaatttttatcataaccaaaggcctcctgttctgttatttcacttaaatcaacgtgctattttgttttcactcacttctgactttagccttgtgctgaactgtgtatccacacagtcatgttcacgtggcagttatggttgtcttcttacacatgaaaataaatgcataactgtttaaatacacacacacacacacacacacacacacacacacacacacacacatatatatatgtacaagccaggcgc

SEQ ID NO: 17430 - DNA, 268 bp, Homo sapiens
  chr11.fa.O7frz.49633972
  Located on chromosome 11
  Distance between a terminus base of telomere on chromosomal short arm and 5'-terminus of this base sequence : 47224092
  Distance between 3'-terminus of neighbour sequence of sequence listing upward to telomere on chrosomal short arm and 5'-terminus of this base sequence : 222469
cttggtaacttgtctacagcttattattattattattattattattattattattattatttgagacggagcctcgctctgttgcccaggctggaatgcagtgacgcaatctcagctcactgcaagctccgcctcccaggttcacgccattctcttgccttagcctcctgagtagctgggactacaggcacccgccaccatgcccggctaatttattttttatttttagtagagatggggtttcactctgttagccaggatagtatta

SEQ ID NO: 17431 - DNA, 388 bp, Homo sapiens
  chr11.fa.O7frz.49754764
  Located on chromosome 11
  Distance between a terminus base of telomere on chromosomal short arm and 5'-terminus of this base sequence : 47319926
  Distance between 3'-terminus of neighbour sequence of sequence listing upward to telomere on chrosomal short arm and 5'-terminus of this base sequence : 95566
tttatgcaaaccaagtgataagcagccctggatctgagaacacatgttcatgtgccttgggtacgtatctgaaaggcctctgacaggacagcctccagaatggaaaagacagcagcacgtgtcctcaatacacacacacacacacacacacacactcttccaggtgttgtggtgctgagaaatgtgcccaggtagctaaatggtactcttccagaatggcctagctatggtcctgaggtcaaatgggccttttacagacatggaactggttcaggtttgaggcacggcactgactgccctgtggcagctgcattaggaacctcctacacccttcctgtaggactcaactccaaatgtaaggaactcgttaaggctccttaaatctttg

SEQ ID NO: 17432 - DNA, 345 bp, Homo sapiens
  AC024293.2_87894
  Located on chromosome 11
  Distance between a terminus base of telomere on chromosomal short arm and 5'-terminus of this base sequence : 47325265
  Distance between 3'-terminus of neighbour sequence of sequence listing upward to telomere on chrosomal short arm and 5'-terminus of this base sequence : 4951
tcttgaacttctgtgtctttctacatctcaaaggaaatggtctaatgagttctagagattcaccttggataagacaatgcttctgtatcttttgcttgatccatttgtgtgtgtgtgtgtgtgtgtgtgtgtgtgtgtgtgtgtgtaagaagtagtatttctctgttcaggacagggattatattaaatactttcagtttttacaaatatatgaattgattttccaattcttgaaaaaaaggatgttttgcctttcactttttaaactatctactgggaacctctcatcatgtctcagtgctggaactagaacctggagaaactcactgatatcggttagaactg

SEQ ID NO: 17433 - DNA, 241 bp, Homo sapiens
  G12395
  Located on chromosome 11
  Distance between a terminus base of telomere on chromosomal short arm and 5'-terminus of this base sequence : 47741483
  Distance between 3'-terminus of neighbour sequence of sequence listing upward to telomere on chrosomal short arm and 5'-terminus of this base sequence : 415873
taaggttggtaatatggaaacttgattcaaagtattttttaggcctggcatggtggctcatgcctgtaatcccaatactttgggaggctgacgtaggaggattgcttgaggtcaggagttcaagaccagactggatgatagagtgagaccctgcctctaaaatgcatagatagatagatagatagatagatagatagatagatagataggtagatgtttttagtgaaaagcctaccccttt

SEQ ID NO: 17434 - DNA, 111 bp, Homo sapiens
  DISD22_0005086
  Located on chromosome 11
  Distance between a terminus base of telomere on chromosomal short arm and 5'-terminus of this base sequence : 47789569
  Distance between 3'-terminus of neighbour sequence of sequence listing upward to telomere on chrosomal short arm and 5'-terminus of this base sequence : 47845
tttcatgtcaagtctcaatagttgattttctaaaccacacaccatctataggataatatccccattcattcattcattcattcattcattcatctgctatgggctaggcac

SEQ ID NO: 17435 - DNA, 101 bp, Homo sapiens
  DISD22_0005091
  Located on chromosome 11
  Distance between a terminus base of telomere on chromosomal short arm and 5'-terminus of this base sequence : 47863488
  Distance between 3'-terminus of neighbour sequence of sequence listing upward to telomere on chrosomal short arm and 5'-terminus of this base sequence : 73808
atgcatatgtaaatgtgtatgtgagatacacacacacacacacacacacacacacacacatacaaaaaaggaattagacttcatatactgtcttgcaaatt

SEQ ID NO: 17436 - DNA, 231 bp, Homo sapiens
  AC024045.4_149508
  Located on chromosome 11
  Distance between a terminus base of telomere on chromosomal short arm and 5'-terminus of this base sequence : 48032747
  Distance between 3'-terminus of neighbour sequence of sequence listing upward to telomere on chrosomal short arm and 5'-terminus of this base sequence : 169158
tggaagcaagtacttgaagtacatgagttagaataatatcaaaaacctgaagagggcctagggtctagaaaccaggaagctaatgttgactcctagcattgtctttcttaattaagtaactctctctctctctctctctcattttttcattttccttcattctgttatcttcccaaggatattttgtaggtaatttgggggataaatgtaagttcctatgaaacactctga

SEQ ID NO: 17437 - DNA, 193 bp, Homo sapiens
  DISO7_00031114
  Located on chromosome 11
  Distance between a terminus base of telomere on chromosomal short arm and 5'-terminus of this base sequence : 48140805
  Distance between 3'-terminus of neighbour sequence of sequence listing upward to telomere on chrosomal short arm and 5'-terminus of this base sequence : 107827
agatgttcgggttgaagcgctgcatcccgttgggagggaagagtccagccaggttggcctcagcactcatgagagtccggtcaaagtctgtgcttcgcacataaacctgcagcgatagcaacacaagtcgtgtgtgtgtgtgtgtgtgtgtgtgtgttggggaagttttggtcaccctgaagtggagccttgt

SEQ ID NO: 17438 - DNA, 454 bp, Homo sapiens
  chr11.fa.O7frz.50365011
  Located on chromosome 11
  Distance between a terminus base of telomere on chromosomal short arm and 5'-terminus of this base sequence : 48249484
  Distance between 3'-terminus of neighbour sequence of sequence listing upward to telomere on chrosomal short arm and 5'-terminus of this base sequence : 108486
aggttggcagatactaattgaccagaatatcaaatgttgttgctggtcatggtcatcatcatcatcatcatcatcatcatgagttcaaacctcatcaaggcttaaaaacaacaactatcaggagtagagagcttttaaataggatctgctctcctaatcacaattgaggacttgttctttccaccaaactctaactcctgttcaggcgctctgtgtcattggtcctcatgttcccagggtccagcattgggtacagtcctcggtaaacacccgatggacaaatgacaaaaagagacgtcgcagcacacaggggccaaaagagatacacaacaaattttaaaagagactctgtgctgcaagaggatggattgagaataactttacttgttttttgggaggaggttaatgggtgggaggggtgagaggggagatctgatttacatacggacttgag

SEQ ID NO: 17439 - DNA, 425 bp, Homo sapiens
  chr11.fa.O7frz.50463872
  Located on chromosome 11
  Distance between a terminus base of telomere on chromosomal short arm and 5'-terminus of this base sequence : 48390422
  Distance between 3'-terminus of neighbour sequence of sequence listing upward to telomere on chrosomal short arm and 5'-terminus of this base sequence : 140484
atgttcatgttaatctcttgatctccgccaggcgcagtggctcacacctgtaaacccagcactttgggaggccaagacaggtggatcacctgaggtcgtgagttcgagaccagcctggccaacacagtgaaagcccatccctactagaaatacaaaaattagctgggtgtgatggtgtgtgtctgtagtcccagctacttgggaagttgaggcaggagaatcacttgaacccgaggtggaggttgcagtaagccaagattgtgccactgcactctagcctgggtgacagagtgagtgagactccgtctcaaaaaataaataaataaataaataaataaagcaaaaaaagaaaaaaaatctcttgatctctcaagtccgctgaaagaaacatttatcatactctttaggaaagactcaataaggat

SEQ ID NO: 17440 - DNA, 404 bp, Homo sapiens
  AC067943.4_5205
  Located on chromosome 11
  Distance between a terminus base of telomere on chromosomal short arm and 5'-terminus of this base sequence : 48433992
  Distance between 3'-terminus of neighbour sequence of sequence listing upward to telomere on chrosomal short arm and 5'-terminus of this base sequence : 43145
gaccagatcttgtttcctagatcttgagaggctaagaacccaggctctgggtcgcaaggagtgcgcaaggagtgggcacagagctaagggcacgacttgcaggcagtgtgtgtgtgagagtgtgtgtgtgtgtgtgtgtgtgtgtgtgtgtgtgtggagatcaggggtcagggttgagaagtgtgttcaagagatgctgaagggaagctgccccaagtaaggcctggtcagaccttccaactcctaccctggcagtctgtgacaggtcctgtggaattcacaggaatcctctaggtgctgagcatccccttttaggcacaaccaaggatttggggtctctgagcctccaagttcccatctgggttgggagaatcgactttttgagttctgtcagttggaagagt

SEQ ID NO: 17441 - DNA, 171 bp, Homo sapiens
  D11S4109
  Located on chromosome 11
  Distance between a terminus base of telomere on chromosomal short arm and 5'-terminus of this base sequence : 48585204
  Distance between 3'-terminus of neighbour sequence of sequence listing upward to telomere on chrosomal short arm and 5'-terminus of this base sequence : 150808
ttgaagatccctcacagactctctctctccttaaaagtgtgtgtgtgtgtgtgtgtgtgtcaatgagaaaactgaggcccaggtgtgtgtgtgtgtgtgtgtgtgtgtgtgtgtgtgtgtgtcaatgagaaaacccaggaaaggagaaatgccaggtctcctaactcccag

SEQ ID NO: 17442 - DNA, 479 bp, Homo sapiens
  chr11.fa.O7frz.50896981
  Located on chromosome 11
  Distance between a terminus base of telomere on chromosomal short arm and 5'-terminus of this base sequence : 48683434
  Distance between 3'-terminus of neighbour sequence of sequence listing upward to telomere on chrosomal short arm and 5'-terminus of this base sequence : 98059
agtaaacgaagctggtttctacaccatctatggtattcattttatgactcacatgtaaaagaaatggaaccagtaataataggtattatatgcaaacaaaacaaaacaaaacaaaacaaacagcaataaactctcacaagtagggaaatgaagtagagagaacaacatggaaaaatctcatattgcctaatgattttgaccaactctcctaaaccagatttgcccccaagtagtaaatctgactaacagtcattcaagtttccttccttctactgagatgataaaatgaccaaaatgaaggagaaaaacaacagttttagtaatcagcatatgattttggcttttagacaaaagccaagtgccagtagttaactggaacaataaataactaccaccaataaactcttgggattaagagtgcagtaatattcaatttaagatttttgaagtatgttttctactcctgcaaatagtcattg

SEQ ID NO: 17443 - DNA, 250 bp, Homo sapiens
  D11S4117
  Located on chromosome 11
  Distance between a terminus base of telomere on chromosomal short arm and 5'-terminus of this base sequence : 48874007
  Distance between 3'-terminus of neighbour sequence of sequence listing upward to telomere on chrosomal short arm and 5'-terminus of this base sequence : 190094
ctacttgggaggctgagtcaggagaattgcttgaacctgggaggcggaggttgcagtgagcaagagatcacgccactgcactccagcctgggtgacagagcgagactccatctaaaaaatatctctctctctctctctctgtgtgtgtgtgtgtgtgtgtgtgtgtgtgtatgtggaaggaagattagaaagaagacaaaatttaaaaaaagaaggaaaagaggctttttttgtgtagggaacaggaagc

SEQ ID NO: 17444 - DNA, 138 bp, Homo sapiens
  D11S1784
  Located on chromosome 11
  Distance between a terminus base of telomere on chromosomal short arm and 5'-terminus of this base sequence : 48963555
  Distance between 3'-terminus of neighbour sequence of sequence listing upward to telomere on chrosomal short arm and 5'-terminus of this base sequence : 89298
  misc_feature (1)...(138): n = A,T,G or C
ccccatatcacttcttattatctcataatattcttaccttttgcagtgacagccccaaagtgtgtgtgtgtgtgtgtgtgtgtgtgtgtgtgtgtttnggggtggggatcataataatcctgcaggtggggtttagct

SEQ ID NO: 17445 - DNA, 244 bp, Homo sapiens
  chr11.fa.O7frz.50984637
  Located on chromosome 11
  Distance between a terminus base of telomere on chromosomal short arm and 5'-terminus of this base sequence : 49052906
  Distance between 3'-terminus of neighbour sequence of sequence listing upward to telomere on chrosomal short arm and 5'-terminus of this base sequence : 89213
ttctggtacaatgttgaaagacagtggtgagagcggacagccttgcctcattcctgatcttagcaggaaagtttcaagtttttcaccacgtcagtatgatgctggttggggggtttttagagatgttcttttatttacttatttatttatttatttatttatttatttatttaatttttgagattgagtctcactctgttgcccaggctggagtgcagtggcacatttggttcactacaaactc

SEQ ID NO: 17446 - DNA, 218 bp, Homo sapiens
  D11S4183
  Located on chromosome 11
  Distance between a terminus base of telomere on chromosomal short arm and 5'-terminus of this base sequence : 49179660
  Distance between 3'-terminus of neighbour sequence of sequence listing upward to telomere on chrosomal short arm and 5'-terminus of this base sequence : 126510
tagcattccaaaatcatgtgtatatgtaaatatacatatacgtgtgtgtgtgtgtgtgtgtatacacatttttttttcttgtggtggtggatattgggttgatttcttttttcttttttttgctgttatgaatagaagctgctagaaacttttacattcccatttttttctacttttattttaggttctgggggtacgtgttggggcttgttacatag

SEQ ID NO: 17447 - DNA, 189 bp, Homo sapiens
  D11S1350
  Located on chromosome 11
  Distance between a terminus base of telomere on chromosomal short arm and 5'-terminus of this base sequence : 49193360
  Distance between 3'-terminus of neighbour sequence of sequence listing upward to telomere on chrosomal short arm and 5'-terminus of this base sequence : 13482
cattctggggtctttgatttctataaagttggtgggcagatgtgaacagaaataaccaggaaacacctgctctccaagaatatctgaatacccatttggcaaatgaccacacacacacacacacacacacacacacacacacacaccccacatacacacacacacacacaccccacatacacacacacg

SEQ ID NO: 17448 - DNA, 329 bp, Homo sapiens
  chr11.fa.O7frz.51528866
  Located on chromosome 11
  Distance between a terminus base of telomere on chromosomal short arm and 5'-terminus of this base sequence : 49499909
  Distance between 3'-terminus of neighbour sequence of sequence listing upward to telomere on chrosomal short arm and 5'-terminus of this base sequence : 306360
ctaagttgtaaggcaatactgaagaaaattatacaattatacactaaggggatgccaaaaacttgtgaactccaatatgaactaggtcttcaaaacttcctgagcaaaatttctggctatcatagacaggtccttctttctacacattcttgtttgtttgtttgtttgtttgtttgtttgtttttgtaagtggtttatttcacagcaatagataactgaaatgggcaaaggtggaaaacagatgcaggacaccagtgggccagcttttgtggtcatttagggaagaaatgacagactcgtgcagaccagtggaggtgaggatagtaagt

SEQ ID NO: 17449 - DNA, 475 bp, Homo sapiens
  chr11.fa.O7frz.51979098
  Located on chromosome 11
  Distance between a terminus base of telomere on chromosomal short arm and 5'-terminus of this base sequence : 52754576
  Distance between 3'-terminus of neighbour sequence of sequence listing upward to telomere on chrosomal short arm and 5'-terminus of this base sequence : 3254338
tcagcttattttatgtttaaccacatacaaatcatggagaaaatgtatctatggttatgtgcaatagtcctccttatccatagtttttcatatatatatatatatatatatatatatatatatatataaaattatacttaacgttctagggtgcatgtgcaatgagaacacactttttctttttgaggtttgagttaccagggatcaaaatttcgccaaaaaatattaagttaaaaaatctacaaacagtttttaagttccctgctgctctgaatattatgatgaaatctttttcagtcctactttgtccgccctaggacatgatttataccagcacaatcatcagtaacctctcagatatcaatttattcaactgccatggtatggcagtgcttgtgttgaagtaattcatttcttactcaataatgcccccaaatcacacaagtagtgatgctggtcattcaaatatgctaaa

SEQ ID NO: 17450 - DNA, 343 bp, Homo sapiens
  AF007544.1_71067
  Located on chromosome 11
  Distance between a terminus base of telomere on chromosomal short arm and 5'-terminus of this base sequence : 53003947
  Distance between 3'-terminus of neighbour sequence of sequence listing upward to telomere on chrosomal short arm and 5'-terminus of this base sequence : 248896
acaatggtgtcatacagtctagaagagaaagtgttaatgaaggaattagcaattaactttgttaaactctctgagtgtctgcactgacggtttttttatatccttgaggacaggtttatacacagaaaactcttcagagttttactttaatttttataatcaatatttaactgattgaagctacatttaaaaaaaccctgttctttagcttcttgatattccatatatatatatatatatatatctttgttgggagcaggcccccaaaaatctggccataaactggccccaaaactggccataaacaaaatctctgcagcactgtaacatgttcataatggcc

SEQ ID NO: 17451 - DNA, 249 bp, Homo sapiens
  D11S1326
  Located on chromosome 11
  Distance between a terminus base of telomere on chromosomal short arm and 5'-terminus of this base sequence : 53116275
  Distance between 3'-terminus of neighbour sequence of sequence listing upward to telomere on chrosomal short arm and 5'-terminus of this base sequence : 111985
tgccaagaacagcaaaactgtttgattgggctggcctgaagaactttactgtatagtaacaacattcactactctaaggacctagagcatggtacagttatgtccacttgaatgttatgacaagagaagggattaacgacatttatttgcctggtgttaggaccctaaattataagcagccccattccaacacacacacacacacacacacacacacacacaatctgatttttgtttattttgaacccc

SEQ ID NO: 17452 - DNA, 440 bp, Homo sapiens
  chr11.fa.O7frz.52769519
  Located on chromosome 11
  Distance between a terminus base of telomere on chromosomal short arm and 5'-terminus of this base sequence : 53326893
  Distance between 3'-terminus of neighbour sequence of sequence listing upward to telomere on chrosomal short arm and 5'-terminus of this base sequence : 210369
ttcttagtatgcagatcttgaaacacatacatagacactacggcatgggaccttcgtgtccccaaatgcagaagatcctctacattgttcaatagagaaactgagtacatgaaggttaaggggcttgttcaaggtcatgtttctctagagatctgcccaggaactacctagggtagaaatgaatgaacgcagtgatgccaaacccgatcaccctgttcttgttccttctactaccccactcagcctattcagtcatattcagctcccttctctttcctgtattcatttctttcatattctctctctctctctctctctctctctctgtgtgtgtgtgtgtgtgtgtgtgtgtgtgtgtgtgtgtgagagagagagagagagagattatttttgccaaagttccataaaggaaccaagagtaaacatgtcttcctagctcc

SEQ ID NO: 17453 - DNA, 284 bp, Homo sapiens
  AC026078.3_86892
  Located on chromosome 11
  Distance between a terminus base of telomere on chromosomal short arm and 5'-terminus of this base sequence : 53351930
  Distance between 3'-terminus of neighbour sequence of sequence listing upward to telomere on chrosomal short arm and 5'-terminus of this base sequence : 24597
atatgagtgaagcatgcagtatttttctttcagtgtcttatttcacttaacataatatcatccaggctcatttatgttgctgcaaattacagcatttaattcatcttatggtggatagtgttccattgtgtgtgtgtgtgtgtgtgtgtatatctgcagatacagtgttccattgtttgtgtgtgtgtgtgtaacattttctttgtatattcatttgctgatggatactcatgtggattttatgtcatggctattgtgaatagtgctgcagtaaagttgtactc

SEQ ID NO: 17454 - DNA, 431 bp, Homo sapiens
  AC026078.3_102986
  Located on chromosome 11
  Distance between a terminus base of telomere on chromosomal short arm and 5'-terminus of this base sequence : 53407094
  Distance between 3'-terminus of neighbour sequence of sequence listing upward to telomere on chrosomal short arm and 5'-terminus of this base sequence : 54880
tcttcagacaagctaaagtgagactattagacaaaagtttaccttcaacattcctcaaatattgttcttttatcccaacagacaatgagaacacctctggtcaaccaggagtgtgtgtgtgtgtgtgtgtgtgtgtgtgtgtgtgtgtgtgtacacatacattggcgaaaagaccaacaagtcatgattgttctgaagttccctttatcatgttgtcccctaatctctactaccagtaagcctttgtgttatcttaggatgaggcatgggtggttcagtgtttataataagacgagtctaaaatggacaataaagggattttagttatatattattttattttttgtcttaaattttccttgtcatgtagtccagtgtgtctggtcagaggatataggacaaccaacactatgaggtggaatgaaagtatt

SEQ ID NO: 17455 - DNA, 394 bp, Homo sapiens
  U73642.1_10256
  Located on chromosome 11
  Distance between a terminus base of telomere on chromosomal short arm and 5'-terminus of this base sequence : 53643272
  Distance between 3'-terminus of neighbour sequence of sequence listing upward to telomere on chrosomal short arm and 5'-terminus of this base sequence : 235747
atcagcaacataaattaataggctgggtgcagtggctcacgtctgtaatttcggctctgtgagaaaatgaggcaaaagaatcacttgagtctagcagtttaaggctgctgtgagctgtgattgcaccatcgcactccagcctaggctacagaaccagaatatatatatatatgtgtgtgtgtgtgtgtgtgtgtgtatatatatatatatgtgtgtgtgtgtatctatacataatatatataaaatacatattattatatattatagataaaatacatacattatatattatatatgtataaaatatattacatatatataaattgacagtactacattaaaacctgaaatcaagcttcaaaagcaacacctaagtgcatttccagtctagttc

SEQ ID NO: 17456 - DNA, 102 bp, Homo sapiens
  DID22N_0005543
  Located on chromosome 11
  Distance between a terminus base of telomere on chromosomal short arm and 5'-terminus of this base sequence : 53969481
  Distance between 3'-terminus of neighbour sequence of sequence listing upward to telomere on chrosomal short arm and 5'-terminus of this base sequence : 325815
gaagacagctcagtccagctgtgtgtgtgtgtgtgtgtgtgtgtgtgtgtgtgtgtgtgtgagagagagagagagtatgtgtgtgctgtctcatgtgcacct

SEQ ID NO: 17457 - DNA, 231 bp, Homo sapiens
  D11S1395
  Located on chromosome 11
  Distance between a terminus base of telomere on chromosomal short arm and 5'-terminus of this base sequence : 54085305
  Distance between 3'-terminus of neighbour sequence of sequence listing upward to telomere on chrosomal short arm and 5'-terminus of this base sequence : 115722
acaaaaacagagggcaaaaatacaaattttcatttttgttggatgaagtaatactggtgatgtaaggtacagcataatgtctgttgtcaataataccatatattatgtgagtataagtgtgcatgtgtacattagatagatagatgattgatgatagatagatagatagatagatagatagatagatagatagatagatgtcacattgcctctattcattcatctattgat

SEQ ID NO: 17458 - DNA, 261 bp, Homo sapiens
  HUMUT2075
  Located on chromosome 11
  Distance between a terminus base of telomere on chromosomal short arm and 5'-terminus of this base sequence : 54085341
  Distance between 3'-terminus of neighbour sequence of sequence listing upward to telomere on chrosomal short arm and 5'-terminus of this base sequence : -195
tgttggatgaagtaatactggtgatgtaaggtacagcataatgtctgttgtcaataataccatatattatgtgagtataagtgtgcatgtgtacattagatagatagatgattgatgatagatagatagatagatagatagatagatagatagatagatagatgtcacattgcctctattcattcatctattgatggatatgtaagttgtttccatatcttggtgattatgaataatgctgcagttcatatgggagtgcag

SEQ ID NO: 17459 - DNA, 261 bp, Homo sapiens
  DISD22_0005112
  Located on chromosome 11
  Distance between a terminus base of telomere on chromosomal short arm and 5'-terminus of this base sequence : 54191559
  Distance between 3'-terminus of neighbour sequence of sequence listing upward to telomere on chrosomal short arm and 5'-terminus of this base sequence : 105957
cttcattagtaaccagagaaatgcaaatttaaaatatttatactaagcaacttttaatttttattgacaaattataattgtacatatttatggggtaaatagtgacattttgatacacataatgtatagtactaattcagggtaattagcatatccattatctcagacatttatcatttctttggaaaaatgcaactttctaaacacacacacacacacacacacacacaagcaaaacctgaataacatacatgtgctaaa

SEQ ID NO: 17460 - DNA, 424 bp, Homo sapiens
  chr11.fa.O7frz.48727293
  Located on chromosome 11
  Distance between a terminus base of telomere on chromosomal short arm and 5'-terminus of this base sequence : 54319383
  Distance between 3'-terminus of neighbour sequence of sequence listing upward to telomere on chrosomal short arm and 5'-terminus of this base sequence : 127563
cttcactatcatagtaatggttcactcccctattccttcaagcagatgacttcgtattttgtccaccttttctagttatcttcagcaggggatttctcccaaagtatcaatttcattatcactagaagagcaagtttcttattctctttaacttaataagtgtaaggctatattatgatgcaattaccatggagctagcctatcctgacgctagcagcaaacttgtttaatacttagatgtatctatctatctatctatctatctatctatctatctatctatctctctctactttaaaaagaaatttataaaaagagatggggtttcaccatgttgccccacgctggtcttgaactcctgggctcaagagatccaactgcctcttcctcccaaagtgctgggcttacaagagtgagccaccta

SEQ ID NO: 17461 - DNA, 109 bp, Homo sapiens
  DISO7_10003063
  Located on chromosome 11
  Distance between a terminus base of telomere on chromosomal short arm and 5'-terminus of this base sequence : 54414024
  Distance between 3'-terminus of neighbour sequence of sequence listing upward to telomere on chrosomal short arm and 5'-terminus of this base sequence : 94217
gttacagagtgaaatggacctgtttgcttttaaagttttgtttgtttgtttgtttgtttgtttagtttgtaatttagaacggtttgaaacaacgtttctcagagtgtgc

SEQ ID NO: 17462 - DNA, 105 bp, Homo sapiens
  DISO7_10003062
  Located on chromosome 11
  Distance between a terminus base of telomere on chromosomal short arm and 5'-terminus of this base sequence : 54424350
  Distance between 3'-terminus of neighbour sequence of sequence listing upward to telomere on chrosomal short arm and 5'-terminus of this base sequence : 10217
gagacatcagtgagacaatcatcattaagagtgtgtgtgtgtttgtgtgtgtgtgtgtgtgtgtgtaatgtatttttatgtgcatggatgtgtatttatactcaa

SEQ ID NO: 17463 - DNA, 196 bp, Homo sapiens
  DISD22_0005117
  Located on chromosome 11
  Distance between a terminus base of telomere on chromosomal short arm and 5'-terminus of this base sequence : 54646790
  Distance between 3'-terminus of neighbour sequence of sequence listing upward to telomere on chrosomal short arm and 5'-terminus of this base sequence : 222335
gaaggagacctgggaagccctggcatttccagatgccctgaaattgaattggtaagtttttaaaaatcccttctatttatttatttatttatttatttatgagaaagggtctagctctgtgacccaggccggaggacagtggcatgatcatagctcactgcagcctcgaactgagcaccagctgctttcagctcct

SEQ ID NO: 17464 - DNA, 203 bp, Homo sapiens
  D11S4095
  Located on chromosome 11
  Distance between a terminus base of telomere on chromosomal short arm and 5'-terminus of this base sequence : 54729838
  Distance between 3'-terminus of neighbour sequence of sequence listing upward to telomere on chrosomal short arm and 5'-terminus of this base sequence : 82852
cttgactgggtccacgggagagtgacctcagcaatgccagtggggttggctgccccgggagaccctgcagggaactgcatattagtcagggttctccagagaaacagaacccagagggtgcgtgtgcgtgtgtgtgtgtgtgtgtgtgtgtgtgtgtgcgcgtgcgtgcgcacagagagagagagattcaagatagccaggga

SEQ ID NO: 17465 - DNA, 226 bp, Homo sapiens
  DISO7_10003080
  Located on chromosome 11
  Distance between a terminus base of telomere on chromosomal short arm and 5'-terminus of this base sequence : 54902167
  Distance between 3'-terminus of neighbour sequence of sequence listing upward to telomere on chrosomal short arm and 5'-terminus of this base sequence : 172126
aggtgtaccctgcaggagcagagagggggtaggaagcctcggctgtggatattatttatccctcccctaccccaccccactactccatccctccctccctcacgctatcctgcttccaccccacccctcctgattttccacatttctctctctctctctctcacacacacacacacgtgcacacacacagacacacacacacagagtttgtcttctcagtagcctt

SEQ ID NO: 17466 - DNA, 114 bp, Homo sapiens
  DISO7_10003081
  Located on chromosome 11
  Distance between a terminus base of telomere on chromosomal short arm and 5'-terminus of this base sequence : 54929142
  Distance between 3'-terminus of neighbour sequence of sequence listing upward to telomere on chrosomal short arm and 5'-terminus of this base sequence : 26749
gaggatgttcataaggccagtatgatttataaatgcaatctccccttgatttaaacacacagatacacacacacacacacacacacacaaaccttctgcctttgatgttacaga

SEQ ID NO: 17467 - DNA, 341 bp, Homo sapiens
  chr11.fa.O7frz.74801566
  Located on chromosome 11
  Distance between a terminus base of telomere on chromosomal short arm and 5'-terminus of this base sequence : 54992564
  Distance between 3'-terminus of neighbour sequence of sequence listing upward to telomere on chrosomal short arm and 5'-terminus of this base sequence : 63308
tactaatgagaggcaccgtatagctgaaggccctcttgaggccagactctgtgtgtgtgtgtgtgtgtgtgtgcatgcttgtgtgtgtgtgtgcacatttggttatatgtacgcatgtgccattgtgtacatttgtgtgagtgcatgtgctcatgtgtgcacatgtgtgtgcgtgagtatacacaaacgcgtgctcatgtgtgtgtgcacatttgagtatgtgtacgtatgtgccattgtgtacatttgtgtgagtgcatgtgctcatatgtgcacatgtgtgtgcatgagtatacacaaatgtgtgctcatgtgtgtatgcgtgtgctgcgtagttcttg

SEQ ID NO: 17468 - DNA, 240 bp, Homo sapiens
  HUMUT802B
  Located on chromosome 11
  Distance between a terminus base of telomere on chromosomal short arm and 5'-terminus of this base sequence : 55042767
  Distance between 3'-terminus of neighbour sequence of sequence listing upward to telomere on chrosomal short arm and 5'-terminus of this base sequence : 49862
gaggtgctgttgtgccaggcaacagcgagactctgacaaaaaaaaaaaagaaaaaaaaaaaagaaaaaagtaaggaaagaaggaaggaaggagaaagagaaagaaagaaagaaagaaagaaaaagaaagaaaagaaagaaagaaagaaagaaagaaagaaagaaagaaagaaagaaagaaagagaaagaaagaaagaaggaaagagagagagaggctgggcgcagtggctcacacctgta

SEQ ID NO: 17469 - DNA, 190 bp, Homo sapiens
  D11S4136
  Located on chromosome 11
  Distance between a terminus base of telomere on chromosomal short arm and 5'-terminus of this base sequence : 55077369
  Distance between 3'-terminus of neighbour sequence of sequence listing upward to telomere on chrosomal short arm and 5'-terminus of this base sequence : 34362
gaatcgcttgaacccaggaggcggaggctgcagtgaagtgagatggtgccactgcactccagcctgagtgacagtctcgctctatgtctcactcactcacacacacacacacacacacacacacacacacacacaccctaagacgaaaaacatggaatcaaggaatcaagatcccgttaagaccacctgg

SEQ ID NO: 17470 - DNA, 349 bp, Homo sapiens
  X14445.1_10325
  Located on chromosome 11
  Distance between a terminus base of telomere on chromosomal short arm and 5'-terminus of this base sequence : 55085772
  Distance between 3'-terminus of neighbour sequence of sequence listing upward to telomere on chrosomal short arm and 5'-terminus of this base sequence : 8213
cctcaccttcttaggtaaagacagggtgcatgggccccaagagcaggttgtaaggataaaggaagtttctgtgctgcctgacctgacacagttgctctaaagggtccctggagaagcacacagcttccagagggagaggctttttagagttttcaaagaaagtaacctctctctctctctccacacacacacacacacacacacacacacacacagacacacacacatcacacattcagacacacccagaaacacacacacacatacatgtcctcacacaggtaccactaacacaagatcacacatacccacatgcacactcacgctttcagaaatacacgatccttct

SEQ ID NO: 17471 - DNA, 201 bp, Homo sapiens
  DISO7_10003084
  Located on chromosome 11
  Distance between a terminus base of telomere on chromosomal short arm and 5'-terminus of this base sequence : 55148138
  Distance between 3'-terminus of neighbour sequence of sequence listing upward to telomere on chrosomal short arm and 5'-terminus of this base sequence : 62017
gcttagcacagagctggggcttaataaattgttggtggatggatgggtggatggatggatggatggatggatggatggatggatggatggatggatggataaatgggtagatgaatggaatgggtggatggataggtaattgtattgatggagaggatggagtaaataaaacagatgtttaccacttgatcaaatcactcc

SEQ ID NO: 17472 - DNA, 103 bp, Homo sapiens
  DISO7_10003087
  Located on chromosome 11
  Distance between a terminus base of telomere on chromosomal short arm and 5'-terminus of this base sequence : 55163781
  Distance between 3'-terminus of neighbour sequence of sequence listing upward to telomere on chrosomal short arm and 5'-terminus of this base sequence : 15442
tgtgctgttctcctgcaccttgggatgcaggggagggaaagaagaacccccccacacacacacacacacacattcactcccccgtctatggactcacaaccca

SEQ ID NO: 17473 - DNA, 153 bp, Homo sapiens
  DISO7_10003088
  Located on chromosome 11
  Distance between a terminus base of telomere on chromosomal short arm and 5'-terminus of this base sequence : 55187047
  Distance between 3'-terminus of neighbour sequence of sequence listing upward to telomere on chrosomal short arm and 5'-terminus of this base sequence : 23163
gatgttgcattcatgcatgcgtgcgtatgcacgcacacacacacatacatatacacagagagagagagagagagagagagattgagagattgagagagagagagagagagagaaatctgcagagaggtgcccttaagtctttggctgagtact

SEQ ID NO: 17474 - DNA, 119 bp, Homo sapiens
  HUMUT6360
  Located on chromosome 11
  Distance between a terminus base of telomere on chromosomal short arm and 5'-terminus of this base sequence : 55372733
  Distance between 3'-terminus of neighbour sequence of sequence listing upward to telomere on chrosomal short arm and 5'-terminus of this base sequence : 185533
agcctgggtgactgagtgacattctgtcaaaaaaaaaaaaaagagagagagagagagagagaaaggaaggaaggaaggaaggaagattgacaggagggtgtccggtctttcagcttctc

SEQ ID NO: 17475 - DNA, 111 bp, Homo sapiens
  D11S1975
  Located on chromosome 11
  Distance between a terminus base of telomere on chromosomal short arm and 5'-terminus of this base sequence : 55701711
  Distance between 3'-terminus of neighbour sequence of sequence listing upward to telomere on chrosomal short arm and 5'-terminus of this base sequence : 328859
accaggcattgcactaaaagcctcattcattcattcattcattcattcattcattcattcacctcttcactcaatatttaccaagtgcctcctagatgcaggctgtgtcct

SEQ ID NO: 17476 - DNA, 240 bp, Homo sapiens
  DISO7_00031637
  Located on chromosome 11
  Distance between a terminus base of telomere on chromosomal short arm and 5'-terminus of this base sequence : 55775873
  Distance between 3'-terminus of neighbour sequence of sequence listing upward to telomere on chrosomal short arm and 5'-terminus of this base sequence : 74051
aacttagaattgtacaagtggcacatttagctagaatctgggaggagcctgctgggggccgtgccattctgagggttcccggagttacacacacacacacacacacacacacacacacacccacacaacctccctcccacctgccttctccaaataaaaccatgtccctggtccttttctcttggtatccaccttctccatcatggaggaggtctcagctcctaatccactcggcaaagt

SEQ ID NO: 17477 - DNA, 149 bp, Homo sapiens
  D11S4139
  Located on chromosome 11
  Distance between a terminus base of telomere on chromosomal short arm and 5'-terminus of this base sequence : 55802730
  Distance between 3'-terminus of neighbour sequence of sequence listing upward to telomere on chrosomal short arm and 5'-terminus of this base sequence : 26617
tatagacttcagccctgctgctaggcccaaggccacgcccccccaacacacacacacacacacacacacacacacacacacagacacacacacacacacagacacacacacacgaaggggactcacatcccaactgcatcctacagagg

SEQ ID NO: 17478 - DNA, 202 bp, Homo sapiens
  D11S4196
  Located on chromosome 11
  Distance between a terminus base of telomere on chromosomal short arm and 5'-terminus of this base sequence : 55806000
  Distance between 3'-terminus of neighbour sequence of sequence listing upward to telomere on chrosomal short arm and 5'-terminus of this base sequence : 3121
gaacgtttttcatgcaggcgtatacacacacacacacacacacacaaacatgggaacatattcaggctcagagcggctgctcttacctttggcccctcgaagcacgaatccaaagccctcattgtcttttttctgcaggaccaccgtcttctcctcaataatgcagtcactgtagagagaattccggggacagcgaccatta

SEQ ID NO: 17479 - DNA, 340 bp, Homo sapiens
  DISO7_00031626
  Located on chromosome 11
  Distance between a terminus base of telomere on chromosomal short arm and 5'-terminus of this base sequence : 55885702
  Distance between 3'-terminus of neighbour sequence of sequence listing upward to telomere on chrosomal short arm and 5'-terminus of this base sequence : 79500
acattcatgcatttaaccatgcatccatccatccatccatccatccatccatccatccatccatccatccattcatccatccgtgcatccaactatccatccatccatgcatccaactacccatctatctatccatccatccatccatccatccatccatccctccatccatcccacccatacattcattcgctgttcactgagcaccaacaggtatcttcttctaccttcagacccacttagcttcccagaggcattgcatagtcactcatccatctgcccacccatccaccccatgtatctgtctgtacctcactgagtacctaccaggtaccttccc

SEQ ID NO: 17480 - DNA, 310 bp, Homo sapiens
  DISO7_00031620
  Located on chromosome 11
  Distance between a terminus base of telomere on chromosomal short arm and 5'-terminus of this base sequence : 55921938
  Distance between 3'-terminus of neighbour sequence of sequence listing upward to telomere on chrosomal short arm and 5'-terminus of this base sequence : 35896
tccttccaaccctgctagcccattcatccatctgatcacccacccatccatcctcccacctacctatccattcatccatccatccatccatccatccatccatcagaagtactttctcagcccctactccatgccaggcactgtgtgaggtgcagagaatactgatgtgagtcaactgtatcctcctgattcttggctctcatggagggtagtaaaccttgatcaattgaccccacaaacaggcgtttacaaattaattaacctccaggtccttgccttcagtcctcttggcttgcaccatttgcactta

SEQ ID NO: 17481 - DNA, 202 bp, Homo sapiens
  DISO7_10003082
  Located on chromosome 11
  Distance between a terminus base of telomere on chromosomal short arm and 5'-terminus of this base sequence : 56031075
  Distance between 3'-terminus of neighbour sequence of sequence listing upward to telomere on chrosomal short arm and 5'-terminus of this base sequence : 108827
gcaggtagtatctagcaaacaggtatatttttaaaggatcatggctcaaaatcagcctgaattttactttcacacacacaatcacacaatcacacacacacacacacacacacccctaacatattacattaagcaatctgtttgaaaacaccaccctctattcatcatctatacatatctaaagcataattatacaggcacc

SEQ ID NO: 17482 - DNA, 265 bp, Homo sapiens
  D11S4162
  Located on chromosome 11
  Distance between a terminus base of telomere on chromosomal short arm and 5'-terminus of this base sequence : 56092157
  Distance between 3'-terminus of neighbour sequence of sequence listing upward to telomere on chrosomal short arm and 5'-terminus of this base sequence : 60880
gttctccagagagacagcaccaacagtgtacatttacacacactcacacacacacacacacacacagagggagaaagagagagaacgagagagtgagcaagcatgagagccagagaggggcttcgttatgggaattggattagactatgatggaggctgagaagtctcaggacctcctgtgcaagcgggagaaccagggaagtcgatagcatggctcaccccaagccaaaggcctcagaaccaggggggcaatagtgttgctctc

SEQ ID NO: 17483 - DNA, 164 bp, Homo sapiens
  HUMUT2336
  Located on chromosome 11
  Distance between a terminus base of telomere on chromosomal short arm and 5'-terminus of this base sequence : 56346475
  Distance between 3'-terminus of neighbour sequence of sequence listing upward to telomere on chrosomal short arm and 5'-terminus of this base sequence : 254053
cctgtttgctactcaaaccacaccccctcctggcagccctacttcccttccttccttccttccttccttccttccttccttccttccttccttccttccctccttccttccttgctgtccttctttttttcagatggagtctcgctctattgcccaggctggag

SEQ ID NO: 17484 - DNA, 374 bp, Homo sapiens
  AP000867.2_8116
  Located on chromosome 11
  Distance between a terminus base of telomere on chromosomal short arm and 5'-terminus of this base sequence : 56525138
  Distance between 3'-terminus of neighbour sequence of sequence listing upward to telomere on chrosomal short arm and 5'-terminus of this base sequence : 178499
gcaggaattagagttgtcaataatctctgaagttctctgagaaagaagtattacttccattctctctatgtccctgagggtgtgtgtgtgtgtgtgtgtgtgtgtgtgtgtgtgtgtctgtgtgtgtttattttttaactacaataggtcttctacagggacctaatatggagattatctcagctactcaggtatctcctcccactacctattccctgtgaggaggcagccatgggattggcccacaggctcactggacccaccgtaaggaagactaaagccaagcccccatccccctcccaacttacaaaggctcccactctgagaataggctcctctcgtgtgatctttccctaaggattagcatccattga

SEQ ID NO: 17485 - DNA, 159 bp, Homo sapiens
  DISD22_0005125
  Located on chromosome 11
  Distance between a terminus base of telomere on chromosomal short arm and 5'-terminus of this base sequence : 56674106
  Distance between 3'-terminus of neighbour sequence of sequence listing upward to telomere on chrosomal short arm and 5'-terminus of this base sequence : 148594
aaggagaaacactggagaggggtggtaactaggcaaaaatgtgtgtgtatatgtgtgtgtgtgtgtgtgtgtgtgtgtatatatgttttctttttgttttgtaaatatgagccagaaaactatgaagtcaaatttagttaatgtgataggtcctggaga

SEQ ID NO: 17486 - DNA, 160 bp, Homo sapiens
  DISD22_0005128
  Located on chromosome 11
  Distance between a terminus base of telomere on chromosomal short arm and 5'-terminus of this base sequence : 56810932
  Distance between 3'-terminus of neighbour sequence of sequence listing upward to telomere on chrosomal short arm and 5'-terminus of this base sequence : 136667
aaggagaaacactggagaggggtggtaactaggcaaaaatgtgtgtgtatatgtgtgtgtgtgtgtgtgtgtgtgtgtgtgtatatgttttctttttgttttgtaaatatgagccagaaaactatgaagtcaaatttagttaatgtgataggtccttgga

SEQ ID NO: 17487 - DNA, 427 bp, Homo sapiens
  chr11.fa.O7frz.71465096
  Located on chromosome 11
  Distance between a terminus base of telomere on chromosomal short arm and 5'-terminus of this base sequence : 57058295
  Distance between 3'-terminus of neighbour sequence of sequence listing upward to telomere on chrosomal short arm and 5'-terminus of this base sequence : 247203
cacactcagctaatgtttaagttattatcattattattattattattattattattattattattattttgagacagagtcttgctctctcgcccaggctggagtgcagtggcgcgatctccactcactgcaaactccgcctcccgggttcacaccattctcctgcctcagcctcccgagtagctgggactacaggcacgtgtcaccacacccagctaattttttgtatttttagtagagacggggtttcaccatgttagccaggatggtctcgatctcctgacctcgtgatccgcccacctcggcctcccaaagtgctgggattacaggcgtgagccaccgcgcccggccttttaaattattttttgtagagacagggtgttgctttcttcgctagtctggtttctaactagcttcaagcagtcct

SEQ ID NO: 17488 - DNA, 362 bp, Homo sapiens
  chr11.fa.O7frz.70942927
  Located on chromosome 11
  Distance between a terminus base of telomere on chromosomal short arm and 5'-terminus of this base sequence : 57297039
  Distance between 3'-terminus of neighbour sequence of sequence listing upward to telomere on chrosomal short arm and 5'-terminus of this base sequence : 238317
ggaggtagaaatcgtggacattggctttttgggtttttttgtttgtttgtttgtttgagatggagttttgctctgtcgctctggctaaagtgcagtggtgccatctcggctcacagcaaccttcgcctcccagttcaagtgattctcctgcctcagcctcccgagtagctgggactacaggtgtgcaccaccacacctggctaatttttgtgttactagtagagacggggtttccccatgttggccaggctggtctcaaactcccgacctcaggtgatccgcccgccttggcctcccaaagtactgggattacaggcgtgagctaccacacccagccagacattgactttcagatgagcagt

SEQ ID NO: 17489 - DNA, 223 bp, Homo sapiens
  D11S913
  Located on chromosome 11
  Distance between a terminus base of telomere on chromosomal short arm and 5'-terminus of this base sequence : 57485240
  Distance between 3'-terminus of neighbour sequence of sequence listing upward to telomere on chrosomal short arm and 5'-terminus of this base sequence : 187839
catttgggaaatccagaagaattctcattattaggattaatgagagattaaccaggttgctagatttctgaaactcaaatgcatttctaaacaccagcaacaaagaatttaaaaatgtaaaattaaaaaatgtaaatgtgtgtaaatgtatacacacacacacacacacacacacacatatatatatatactatttaggaagcaacaaaaaataagacaccta

SEQ ID NO: 17490 - DNA, 269 bp, Homo sapiens
  chr11.fa.O7frz.70454537
  Located on chromosome 11
  Distance between a terminus base of telomere on chromosomal short arm and 5'-terminus of this base sequence : 57936360
  Distance between 3'-terminus of neighbour sequence of sequence listing upward to telomere on chrosomal short arm and 5'-terminus of this base sequence : 450897
agatgcttaggcatttgaactctcattcatttctttatttatccattcaccaaacttttggatcatccatccgtccatccatccatccatccatccatccatccacccacccatccatccatctatccaactactgataacatccactcaaccattcatccatctctctcaatacctggccaattatctattgatacaaccacttttatttcccatcttttgttccatccatccattaaattattaactaagtgattaatgcaacgttt

SEQ ID NO: 17491 - DNA, 451 bp, Homo sapiens
  AC022488.2_48014
  Located on chromosome 11
  Distance between a terminus base of telomere on chromosomal short arm and 5'-terminus of this base sequence : 58043082
  Distance between 3'-terminus of neighbour sequence of sequence listing upward to telomere on chrosomal short arm and 5'-terminus of this base sequence : 106453
caaagtgccgagattacaggcatgagccactgtgccggcccatatctattgtttatgacactgaaaccggcatcgtgagttcttttgttctactgtgtcctgagtcagggactggagtgggagggtcacaggacaacaggaaatctgtgtgtgtgtgtgtgtgtctgtgtgtgtgtgtgtgtgtgtgtctgtgtgtttgtgcgtctgtgtgtgtctgtgtgtgtgtgtgtgtgagctgtgatgtaatctcacactgtgttctcctgtttgggtgtctgttagaatcgggttgaggggagtgagggagggtggaagtcgggcggggaacagcgctgatgcttgattttggaccctggcaggggtggagagagatttgggaggtaaaagaggcctgagatagggggagagtctgagagtggggaggaatatgtcttgagaataggtaagccat

SEQ ID NO: 17492 - DNA, 184 bp, Homo sapiens
  HUMUT2269
  Located on chromosome 11
  Distance between a terminus base of telomere on chromosomal short arm and 5'-terminus of this base sequence : 58345929
  Distance between 3'-terminus of neighbour sequence of sequence listing upward to telomere on chrosomal short arm and 5'-terminus of this base sequence : 302396
ggcagggagcagtaattccctagacacactgtggcctttctccatccatccatccacccatccaaccatccttcatccatccatccatccatctatccatccatccatccatccatccatccatccatccatccatccttctatccatccatccttccattcatccttccactcacccacccat

SEQ ID NO: 17493 - DNA, 169 bp, Homo sapiens
  chr11.fa.O7frz.69963054
  Located on chromosome 11
  Distance between a terminus base of telomere on chromosomal short arm and 5'-terminus of this base sequence : 58396568
  Distance between 3'-terminus of neighbour sequence of sequence listing upward to telomere on chrosomal short arm and 5'-terminus of this base sequence : 50455
gactcaatgaatacattggaatagtatcttttttggaatttataacacacacacacacacacacacacacaaccagaatactgaaaagctcccacaggaacagatcattccacaggaacagatcattccacaggaacagaacggatttagacttgacgtaaattcgaat

SEQ ID NO: 17494 - DNA, 351 bp, Homo sapiens
  chr11.fa.O7frz.69766847
  Located on chromosome 11
  Distance between a terminus base of telomere on chromosomal short arm and 5'-terminus of this base sequence : 58604778
  Distance between 3'-terminus of neighbour sequence of sequence listing upward to telomere on chrosomal short arm and 5'-terminus of this base sequence : 208041
gttacagaagtcagccatcacacctggccaccttgaaataaataaattctatctatctatctatctatctatctatctatctatctatctatctagtgtcttactctttcacccatgctgaagtgcagtggcatgatcacggcttactgtagccttgacttcccaggctcaagtgatccccgcacctcagcctcctgagcagctgggaccacaggcacatgccaccatgccgagctaattttttttttttttttgtagagacaggttttcgccatattgcccaggctggtctcaaactcctgggctcaagtgatcttcccacctcagccctgtgaagtgctgaaattatgt

SEQ ID NO: 17495 - DNA, 354 bp, Homo sapiens
  chr11.fa.O7frz.68864733
  Located on chromosome 11
  Distance between a terminus base of telomere on chromosomal short arm and 5'-terminus of this base sequence : 58819398
  Distance between 3'-terminus of neighbour sequence of sequence listing upward to telomere on chrosomal short arm and 5'-terminus of this base sequence : 214269
gccaggagttggagactagcctggccaatgtggagaaaccccgtctctgctaaaaatacaaaaattttgctgggtgtggtggtgcctgcctatagtcccagctacttaggaggctgagccaggagaatcgcttgaacccaggaggcagagattgcagtgagctgagatcccaccactgcactttagcctgggtacagagcaagactccatcgaaagaaagaaagaaagaaagaaagaaagaaagaaagagagagagagagagaaaggagggagggagggagggaaacacaagcctgttgttacgtgaataaaaattaatcagatatgtattgagtgcctttgttaagtttaaca

SEQ ID NO: 17496 - DNA, 396 bp, Homo sapiens
  chr11.fa.O7frz.68738065
  Located on chromosome 11
  Distance between a terminus base of telomere on chromosomal short arm and 5'-terminus of this base sequence : 58836743
  Distance between 3'-terminus of neighbour sequence of sequence listing upward to telomere on chrosomal short arm and 5'-terminus of this base sequence : 16991
gaggtcaagagttcgagactagcctggccaacatggcaaaacaccgtctctactaaaaatacaaaaattagccaggtgtggtggcaggaacctgtgatcccagctactcaggaggcagaggcacaagaatcacttgaacctgggaggtggaggttgcagtaagccgagatcgcgccagtgcactccagcctgggtgacagagcgagactcagtctcaataaaataaataaaataaaataaaataaaataaaataaaataaaataaaataaaataaaatataaaataaaatataaaataaaatataaaataaaatataaaataaaataaaataaaataaaataaaataaaataaaataaaataaaatgagtggtcaacgtcagttcaataggaagag

SEQ ID NO: 17497 - DNA, 393 bp, Homo sapiens
  chr11.fa.O7frz.68151966
  Located on chromosome 11
  Distance between a terminus base of telomere on chromosomal short arm and 5'-terminus of this base sequence : 58947615
  Distance between 3'-terminus of neighbour sequence of sequence listing upward to telomere on chrosomal short arm and 5'-terminus of this base sequence : 110476
tgtaatcctagcactttaggataccaaggtgggcaaatcacctgaggtcaggagtttgagaccaggctggtcaacatggtgaaaccccatctctactaaaaatacaaaaattagccgggcatagtggcgcatgcctgcaatcccagctactcgggaggctgaggcaggagaatcgcttgaacccgggaggtggagattgtggtgagccgagattgtgccattgcagtccagcctgagcaacaagagcgaaactctgtctcaaaaaaaaagaaagaagaaagaaagaaagaaagaaagaaagaaagaaagaaagaaaaaagaaagaaagaaaagaaagaaagaaaagaaagaaagaaagagcagctttgaggctagaacaagacgaaggttctt

SEQ ID NO: 17498 - DNA, 278 bp, Homo sapiens
  AC012153.10_116141
  Located on chromosome 11
  Distance between a terminus base of telomere on chromosomal short arm and 5'-terminus of this base sequence : 59035283
  Distance between 3'-terminus of neighbour sequence of sequence listing upward to telomere on chrosomal short arm and 5'-terminus of this base sequence : 87275
ggctcatcttcctactttaataacgaaagcattttaaagtgctaacatttcctgtgagtattggtttttgaggattcacacagatttcgggatgaaacgtcctttattattattattattattattacttgcaggataatatgccgttgtaaaacttcctatttgagctaggtgtaagctaggaatgtgtctcttaattttgaagttgtaaacatttttgggttatctctgtagtaattattcccaattgttttggattatgtttacaggatttgctg

SEQ ID NO: 17499 - DNA, 316 bp, Homo sapiens
  AC012153.10_33122
  Located on chromosome 11
  Distance between a terminus base of telomere on chromosomal short arm and 5'-terminus of this base sequence : 59118126
  Distance between 3'-terminus of neighbour sequence of sequence listing upward to telomere on chrosomal short arm and 5'-terminus of this base sequence : 82565
catttagcaagttgaatccaactatgcatgtatatatatttacatatgtgtgtgtagttttatattttatatataggtgtgtgtgtgcatatatatatatatatatagagagagagagagagagagagtgcaatacatcatgaccaagtggactttatcccatgaatacaaagttagttttacatttaaaatcaaggttaacaaaccaaattatgaacaagccaaaacagaaaagccatatgtcatccaaataaacaaagaaagatcgtttgacaaaattcaacagccattcctgatcattaatattcagcaaacc

SEQ ID NO: 17500 - DNA, 323 bp, Homo sapiens
  chr11.fa.O7frz.69270234
  Located on chromosome 11
  Distance between a terminus base of telomere on chromosomal short arm and 5'-terminus of this base sequence : 59269733
  Distance between 3'-terminus of neighbour sequence of sequence listing upward to telomere on chrosomal short arm and 5'-terminus of this base sequence : 151291
atacaatgtgaagctcagacaccaaattcagacacatgcaaccatgaagaccgctacttgtcacatcccgggcaggcagacctggacacacatatgcatgcatgcatacacacacacacacacacacacacacacacaccaggaagaggccagactggaactggagggtagtgacgagaggagccaagaggaaccgactgggctgcagggatggaggcagcacaggaggcaggcggcacaggagcgagctgctcttcacaacacaatcgccgtctgttgttatagcaactcagcccccaaatcgtgaaacggatattacagcc

SEQ ID NO: 17501 - DNA, 128 bp, Homo sapiens
  DISO7_10017975
  Located on chromosome 11
  Distance between a terminus base of telomere on chromosomal short arm and 5'-terminus of this base sequence : 59483098
  Distance between 3'-terminus of neighbour sequence of sequence listing upward to telomere on chrosomal short arm and 5'-terminus of this base sequence : 213042
agaattgcaatgggatggcagagagagagagagacagagagagacatttgctaactgtcctttgcaaacacaacctagattcagaggggagaatggaaatgtttggtaaccaaatcatctgaatggct

SEQ ID NO: 17502 - DNA, 144 bp, Homo sapiens
  DISO7_00031436
  Located on chromosome 11
  Distance between a terminus base of telomere on chromosomal short arm and 5'-terminus of this base sequence : 59742058
  Distance between 3'-terminus of neighbour sequence of sequence listing upward to telomere on chrosomal short arm and 5'-terminus of this base sequence : 258832
gtcttccaagaattcggggaacccaggagctttggcctggagtgggatctagactacagatcccagcatgccctgtgagacacacacacacacacacacacacacacgcctggagtgggatctagactacagatcccagcatgc

SEQ ID NO: 17503 - DNA, 442 bp, Homo sapiens
  chr11.fa.O7frz.67836001
  Located on chromosome 11
  Distance between a terminus base of telomere on chromosomal short arm and 5'-terminus of this base sequence : 59975682
  Distance between 3'-terminus of neighbour sequence of sequence listing upward to telomere on chrosomal short arm and 5'-terminus of this base sequence : 233480
aaccttgaggaataaacttgacctctgtgacttcattttattttattttattttattttattttttcaagatggagtctcgctctgtcccctaggctggagtgcagtggtgtgatctcagttcgctgcaacttccacctcctgggttcaagcgattctcctgcctcagcctcctgagtagctgggattacaggtgtacgccaccacgcccagctaatttttgtatgtttagtagtagcggtgggtttcaccatgttggctaggctggtctcaaactcctgacctcaagtggtctgcccgcctcggcctcccaaagtgctgggattacaggtgtgagccaccgtgctccgctatctgtgacttcattttatttgtttttgttgactctattttagatagtgttttgacggtttgagtatttctcaattgtaactcatgagtgg

SEQ ID NO: 17504 - DNA, 403 bp, Homo sapiens
  AC026285.4_16771
  Located on chromosome 11
  Distance between a terminus base of telomere on chromosomal short arm and 5'-terminus of this base sequence : 59988938
  Distance between 3'-terminus of neighbour sequence of sequence listing upward to telomere on chrosomal short arm and 5'-terminus of this base sequence : 12814
cacctaagaaatgaagtccaccaaaaaggaagaccagagaaggctggccccttagaggaaaggcttctagctgaagatccagccccagtgggacagacacacacacacacacacacacacacacacacacacagacagacacatacacgcccattgggctttgcacaaacaagggagctggaggggatgagccagaaaagctgcacaatgacaacaggctttgtcttcccaggaagccaggcaccatttaaaggtacagaagcacacgaggagtccagctgaggcacacaaaacctaccacagggcagccagccgggcgctcttctccacacctccacccagtgccagtggaggcatgagcccaggcaggagggaaggcacaatgaatttctgaagtaaagtt

SEQ ID NO: 17505 - DNA, 331 bp, Homo sapiens
  U73647.1_2067
  Located on chromosome 11
  Distance between a terminus base of telomere on chromosomal short arm and 5'-terminus of this base sequence : 60264784
  Distance between 3'-terminus of neighbour sequence of sequence listing upward to telomere on chrosomal short arm and 5'-terminus of this base sequence : 275443
tacttgaggacaggcgttaactgtgggcccaaggaaggccctcatttttaaagccatttgccctgagtgggccaatgtggcctcttagccctgcctgtttgtactgggggcacggagggcaggccttgtgctgatgcccaatcagaggcagtcttcatccctttaagatggcagagagaggagggccacacagacttggttaagcagatggaggagagtaagagccagaaaaggggagttagtgatggaggcaggacacaggacacagacacacacacacacacacacacacacagcgggctcaacgcctaccttctggcaaacctgaaag

SEQ ID NO: 17506 - DNA, 300 bp, Homo sapiens
  U73647.1_6502
  Located on chromosome 11
  Distance between a terminus base of telomere on chromosomal short arm and 5'-terminus of this base sequence : 60269267
  Distance between 3'-terminus of neighbour sequence of sequence listing upward to telomere on chrosomal short arm and 5'-terminus of this base sequence : 4152
agaacacatgtccagactcaagtccactcccctcaacacagagcaatatgggcctataccaagtgtcaccaggtgcctcttaaggatcccaccaccagagggagagcagggcagggaggctgggagttcatgtggggatactcagatgatgaacaaaacccaaatgggcagaagaacaatcacaaagtctccagatccacagacgggaagacggacacatacacacacacacacacacacacacacacacagatacacacacccaaacataaagcactagacagaagcaacagactcaat

SEQ ID NO: 17507 - DNA, 377 bp, Homo sapiens
  chr11.fa.O7frz.71915476
  Located on chromosome 11
  Distance between a terminus base of telomere on chromosomal short arm and 5'-terminus of this base sequence : 60692681
  Distance between 3'-terminus of neighbour sequence of sequence listing upward to telomere on chrosomal short arm and 5'-terminus of this base sequence : 423114
ctcacctatgtatttggtgtttactctatgctaggcattgtttgaggcacaggggatttctttctttctttctttccttccttccttccttccttccttccttccttccttccttccttccttccttccttccttccttcctttctttctttttttttttgagacggagtctcgctctgtcgcccaggctggagtgcaatggcgcaatctcagctcactgcaacctccgcctctggggttcaagaaattctcctgcctcagcctcccgagtagctgggactacaggcgcctgccacgacgctcggctaattttttctatttttagtagatacgggatttccccatgttggccaggctggtctcgaactcctgacctc

SEQ ID NO: 17508 - DNA, 418 bp, Homo sapiens
  AP001885.2_36145
  Located on chromosome 11
  Distance between a terminus base of telomere on chromosomal short arm and 5'-terminus of this base sequence : 60882212
  Distance between 3'-terminus of neighbour sequence of sequence listing upward to telomere on chrosomal short arm and 5'-terminus of this base sequence : 189154
tagcattgttcgtaagtcatttaaattttattggtaatgccatgagaacttttgcccctaagattgttcctttcccccatttagaggaataaaggcaaatagcagactctgtgggtgtgtgtatgtgtgtgtgtgtgtgtgtgtgtgtgagagagagagagaaagaaagagatttgagattgagatttctgtaatcagccttagaagaaaagagccctgggttgaatctgcacattaggctgtaccattcatctcattaattctgtattagcaaatcatttttatgccacttggttcacatctgagaaatgaaggcaattacctgataatattcactaactggtgtagaaaagtgaagaagcaataataaagttttactgtcatatgtagaactgtatgagaagtaacacttgtcacc

SEQ ID NO: 17509 - DNA, 207 bp, Homo sapiens
  DISO7_10003077
  Located on chromosome 11
  Distance between a terminus base of telomere on chromosomal short arm and 5'-terminus of this base sequence : 60894636
  Distance between 3'-terminus of neighbour sequence of sequence listing upward to telomere on chrosomal short arm and 5'-terminus of this base sequence : 12006
cattccatagcagatgtttaatgatttcagttcagtaagaatatttaagttatttaacttttgtagaatcagatttttttttggctagcaaaacaaaagcatttttaattttatatatcagtgagactataggattacagtgccagagtgtgtgtgtgtgtgtgtgtgtgtgtgtgtgtgtgttgtcaggaatccctcttatagtgt

SEQ ID NO: 17510 - DNA, 414 bp, Homo sapiens
  AC005849.1_125977
  Located on chromosome 11
  Distance between a terminus base of telomere on chromosomal short arm and 5'-terminus of this base sequence : 60994830
  Distance between 3'-terminus of neighbour sequence of sequence listing upward to telomere on chrosomal short arm and 5'-terminus of this base sequence : 99987
cctggagtagctgtattaacataaaagtaggtgaaattatttataattaaataaaatgaagtctccaggaagatgtgccacatgtggcttatggctgctttcaggtacccctgatacatctactataccacctcactcagtttgaacagcacttcagaaatactaaaaagcatatatatatatatatatatatttttttttttttttttttttttttgaaaaagggtcttgctctgttgcccaagctggagcacagtggtgcaatcatggctcactgcagcctcaaactcccaggttcaagccatcttcctgccttggtctcccaagtaactgggactataggcacgtgtcatacacagctaattaaaaaaaaatttttttttttttttagagagatagtcctgctatgttgcc

SEQ ID NO: 17511 - DNA, 183 bp, Homo sapiens
  D11S1889
  Located on chromosome 11
  Distance between a terminus base of telomere on chromosomal short arm and 5'-terminus of this base sequence : 61131438
  Distance between 3'-terminus of neighbour sequence of sequence listing upward to telomere on chrosomal short arm and 5'-terminus of this base sequence : 136194
agctggactctcacagaatggaaccaggcacctaaaaactgcaccgccacctctctctctttctctctctctctctctctctctctctcacacacacacacacacacacacacacctgctccactctctcagccataacctacatcacagtccacttcagattcaccttctaccagcctcttg

SEQ ID NO: 17512 - DNA, 226 bp, Homo sapiens
  D11S4155
  Located on chromosome 11
  Distance between a terminus base of telomere on chromosomal short arm and 5'-terminus of this base sequence : 61315158
  Distance between 3'-terminus of neighbour sequence of sequence listing upward to telomere on chrosomal short arm and 5'-terminus of this base sequence : 183537
cccgagatgctggtgagctcgtgggaggcttggctgcaccccctggggctcagttttccttgacaatcctcctccccaaggctgtggccccagaaatcaccccccaccacacacacacacacacacacacctgcagctgaggatgcacagtgcctgccaggtgcccggcctcggtgcgggggaagtccacgacgcccacgggtctataggcttccatctcaaaggc

SEQ ID NO: 17513 - DNA, 209 bp, Homo sapiens
  chr11.fa.O7frz.73169426
  Located on chromosome 11
  Distance between a terminus base of telomere on chromosomal short arm and 5'-terminus of this base sequence : 61548864
  Distance between 3'-terminus of neighbour sequence of sequence listing upward to telomere on chrosomal short arm and 5'-terminus of this base sequence : 233480
ggaactttacttctaggctgagtctgaagttatctttctggggagtgggagattacaaatctttgagctccactcaagagatggttttgctaacaatggcagggcgacggtggtggtggtggtggtggtggtggtggtggtggtggtggtggtgggaaactggtatcatgaattctaattgggcttctgttatcctagccgagaaagtt

SEQ ID NO: 17514 - DNA, 358 bp, Homo sapiens
  HUMUT979
  Located on chromosome 11
  Distance between a terminus base of telomere on chromosomal short arm and 5'-terminus of this base sequence : 61899511
  Distance between 3'-terminus of neighbour sequence of sequence listing upward to telomere on chrosomal short arm and 5'-terminus of this base sequence : 350438
gtgctgggattacaggtgtgagccaccacgctcggcctctttgttccttctttactcccactgcttcacttggactagaaaaagaagaaaaagaaaaaaatcaatgtgtattagggttctccaaaaaacagaagcaaagatagatagaaacatacatacatacagatagatacaaagatagatagatggctacatacatacatatatacagatagatacatacgcagacacatgataggtagatagatagatagatagatagatagatagatagataatagattgactatgggaattcactgacatgattatggaagacgagaagttccacaatgtgctgtctgcaaactggggaatg

SEQ ID NO: 17515 - DNA, 215 bp, Homo sapiens
  HUMUT5620
  Located on chromosome 11
  Distance between a terminus base of telomere on chromosomal short arm and 5'-terminus of this base sequence : 62041333
  Distance between 3'-terminus of neighbour sequence of sequence listing upward to telomere on chrosomal short arm and 5'-terminus of this base sequence : 141464
aagtcgaggctgcaaggagctatgattgtgtcaccgcattccagcctgggcaacagagtgagattctatctctaaagatgaatacataaatacatacatacatacatacatacatacatacattccattatcttaattaaaaccataagcactggcttctgtttctccaactttcagcctcaccttcagcaaccttactgaaaggaacacagggc

SEQ ID NO: 17516 - DNA, 393 bp, Homo sapiens
  AP000807.3_122046
  Located on chromosome 11
  Distance between a terminus base of telomere on chromosomal short arm and 5'-terminus of this base sequence : 62202597
  Distance between 3'-terminus of neighbour sequence of sequence listing upward to telomere on chrosomal short arm and 5'-terminus of this base sequence : 161049
acaggttcagttccagactatcgcaaaaaagcaaatgtcacaataaagtaagtcacacgaatatattggtttcccatatgcaaacattatttttacactattaagtgtgcaataccattatgtcttaaaaaaaaaaaagcacagactttaattataagtattttaccaataaaaaaatgctaatgaagtgagcacatgcaacgggaaaaatggcgctgatacccgggcaaatacggggttgccataaaccttcaatttgttcacttaaaacacacacacacacacacacacacacacacacagtatctgcaaagtgaaagaaagtgagccacaataaaacgaggtataatacctgtatgtgcactacctctgtagtgttatttgaaagtggac

SEQ ID NO: 17517 - DNA, 252 bp, Homo sapiens
  D11S4178
  Located on chromosome 11
  Distance between a terminus base of telomere on chromosomal short arm and 5'-terminus of this base sequence : 62220397
  Distance between 3'-terminus of neighbour sequence of sequence listing upward to telomere on chrosomal short arm and 5'-terminus of this base sequence : 17407
cgtgtccagatgaaagtgatgatgtctttgcagctgcccagcaaggctgtgtgtgtgtgtgtgtgtgtgtgtgtgtgtgtgtgtggtgtgtgtgtggtgtgtgtgtgtgtatgggggagggaggcaccctttccatctgggggtgtgtgtgtgtggggtgtgtgtgtgtgtgtgcgcgtgtgtgtggtgtgtggtgtgtgtgtgtgtatgggggaggcaccctttccatctgggtccaagagactgggcctg

SEQ ID NO: 17518 - DNA, 101 bp, Homo sapiens
  DISD22_0003136
  Located on chromosome 11
  Distance between a terminus base of telomere on chromosomal short arm and 5'-terminus of this base sequence : 62543551
  Distance between 3'-terminus of neighbour sequence of sequence listing upward to telomere on chrosomal short arm and 5'-terminus of this base sequence : 322902
caggtctgcagagttcactctgagcctttcctgtgtgtgtgtgtgtgtgtgtgtagctataactttatcctccaaatacaaatacaactccaattgaacat

SEQ ID NO: 17519 - DNA, 285 bp, Homo sapiens
  chr11.fa.O7frz.74262070
  Located on chromosome 11
  Distance between a terminus base of telomere on chromosomal short arm and 5'-terminus of this base sequence : 62646471
  Distance between 3'-terminus of neighbour sequence of sequence listing upward to telomere on chrosomal short arm and 5'-terminus of this base sequence : 102819
attaccaatacggtagtttcctttcgcctgttctacactgtacatcctgtaccacaattcccatgccttttgcttccttctttccctcctttcctatcttccctcctttcctaccttccctctgtccctcccctttcccctccctcctttcctctttcctttcctccccttctcctccccttctcctccccttctcctctcctctcctctcctctcctctcctctcctctcctctcctctcctctccttccttccttcccttctgtctgcatttggtcagttact

SEQ ID NO: 17520 - DNA, 226 bp, Homo sapiens
  D11S4113
  Located on chromosome 11
  Distance between a terminus base of telomere on chromosomal short arm and 5'-terminus of this base sequence : 62830071
  Distance between 3'-terminus of neighbour sequence of sequence listing upward to telomere on chrosomal short arm and 5'-terminus of this base sequence : 183315
acctcacggtgtcatcccaccaggacccagccaattgcatatgtaaaggcaggtatttgcaacaagcctctttgcctctttcaggtattagtttctccactggtcaggaatctttgttgcaaatgacaaaaaccccattgaaacacacacacacacacacacacacacacacacagaatgcactggctcctattactaaaaagtccaggcaaagatgggcttcaag

SEQ ID NO: 17521 - DNA, 207 bp, Homo sapiens
  AP000808.3_100426
  Located on chromosome 11
  Distance between a terminus base of telomere on chromosomal short arm and 5'-terminus of this base sequence : 62830153
  Distance between 3'-terminus of neighbour sequence of sequence listing upward to telomere on chrosomal short arm and 5'-terminus of this base sequence : -144
aggtattagtttctccactggtcaggaatctttgttgcaaatgacaaaaaccccattgaaacacacacacacacacacacacacacacacacagaatgcactggctcctattactaaaaagtccaggcaaagatgggcttcaagaacagctggatccaggtgcctggatctggggactctgtcaatcaactagcaattagtcaagaa

SEQ ID NO: 17522 - DNA, 274 bp, Homo sapiens
  chr11.fa.O7frz.76741720
  Located on chromosome 11
  Distance between a terminus base of telomere on chromosomal short arm and 5'-terminus of this base sequence : 62874116
  Distance between 3'-terminus of neighbour sequence of sequence listing upward to telomere on chrosomal short arm and 5'-terminus of this base sequence : 43756
ccaacaagaatgtttgtcatagactacaaagagggaagtagggagtttggatagatatttggggaatgtttggatggatggatggatggatggatggatggatggatggatggatggatggatggatggatgtttggatggatggatggatggatggatggatggatggatggatgtttggatggatgtttggatggatggatggatggatggacagatggatgtttggatggacggatggatgtctggatggatggataaatgcttagatgga

SEQ ID NO: 17523 - DNA, 469 bp, Homo sapiens
  chr2.fa.O7frz.173345762
  Located on chromosome 11
  Distance between a terminus base of telomere on chromosomal short arm and 5'-terminus of this base sequence : 63228450
  Distance between 3'-terminus of neighbour sequence of sequence listing upward to telomere on chrosomal short arm and 5'-terminus of this base sequence : 354060
tggattcatagatgtttcaaacaaaactcagttctcttggtaaggaagaaggaaggaaagatatgtggcaggcaaataacaatttcggcctcaatattaacagcccaattaatcagcctgaagtgattataaacttgttttacactttccagaggatttagtattgtgggtatgtgtgtgtgtgtgagacagagaaagagagagagacatacacacacacacacacacagagagagagagagagagagagagaggaaacaatggaagagacttgatattataagaaaattggggatggagaggacaaagaataagctctagaaaaagacaatttcagaatattttgagataaaccccaaataaacgatgaaggatattctagaataatggagaaatagattacagttcaatagaaacacaaagtggtctgaaaaatatatcactggagcaggtatgtttatgattagtg

SEQ ID NO: 17524 - DNA, 426 bp, Homo sapiens
  chr2.fa.O7frz.173259620
  Located on chromosome 11
  Distance between a terminus base of telomere on chromosomal short arm and 5'-terminus of this base sequence : 63287587
  Distance between 3'-terminus of neighbour sequence of sequence listing upward to telomere on chrosomal short arm and 5'-terminus of this base sequence : 58668
ccatgaacaattatacaccaacaaattggataacttagaaggaataggtaaattccaaaaatatacaacctaccaagactgaatcatgaggaaatagaataactgaatagacaaattgaaccaataataataataataataataataataataataatgataatgatagtaactcccaaaaaagaaatgtacaggaccagacggcttctctggagaagtccaaccaaacatttaaagaagaaacaacattaattcttctcaaactctcttaaaactttgaagaggaaagaacacttcgaaagtcattttatggggccagaattattctcatatcaaagccagacaaagacactgtaagaaaagaaaattacagcttttgaaggaagtgacttcagcaacattgtggaataggaggtttatgactat

SEQ ID NO: 17525 - DNA, 450 bp, Homo sapiens
  chr14.fa.O7frz.72186734
  Located on chromosome 11
  Distance between a terminus base of telomere on chromosomal short arm and 5'-terminus of this base sequence : 63727389
  Distance between 3'-terminus of neighbour sequence of sequence listing upward to telomere on chrosomal short arm and 5'-terminus of this base sequence : 439376
ccaacaatgatagacttgattaagaaaatgtggcacatatacaccatggaatactaggcagccataaaaaatgatgagctcatgtcctttgtagggacatgggtgaaattggaaatcatcattctcagtaaactatcacaagaaccaaaaaccaaacaccgcatattctcactcataggttggaattgaacaatgtgaacacaaggacacaggaaggggaacatcacactctggggactgttgtggggtggggggaaggggggagggatagaattaggagatatacctaatgctaaatgatgagttaattggtgcagcacaccagagtggcacatgtatacatatgcaactaaccagcacattgtgcacatgtacccttaaacttaaagtataataataataaaataaaataaaataaagaaaagaaagatttaactgtgcgagttgaat

SEQ ID NO: 17526 - DNA, 180 bp, Homo sapiens
  DISD22_0003151
  Located on chromosome 11
  Distance between a terminus base of telomere on chromosomal short arm and 5'-terminus of this base sequence : 64112785
  Distance between 3'-terminus of neighbour sequence of sequence listing upward to telomere on chrosomal short arm and 5'-terminus of this base sequence : 384946
ttgctctgtcacgtttgtgtaccatatttccttcccctccttccctccctccctccctccctccctctctccctctctctctctctctctccctttctttctttctttctctctttctttctttctttctttcttttgttcttctttctctctttttattcagagtcttgctctgtcacg

SEQ ID NO: 17527 - DNA, 159 bp, Homo sapiens
  DISO7_10795100
  Located on chromosome 11
  Distance between a terminus base of telomere on chromosomal short arm and 5'-terminus of this base sequence : 64190670
  Distance between 3'-terminus of neighbour sequence of sequence listing upward to telomere on chrosomal short arm and 5'-terminus of this base sequence : 77705
caaatgtattgattacaaggagtgatatatatatatatatatataattgaagaaataaaaataagtgtattttttacataataattacaataaatggattctacaaattttctaagtggtctacatttaacttaatctgaataatgaatatctgttgcc

SEQ ID NO: 17528 - DNA, 178 bp, Homo sapiens
  DISO7_10016655
  Located on chromosome 11
  Distance between a terminus base of telomere on chromosomal short arm and 5'-terminus of this base sequence : 64246595
  Distance between 3'-terminus of neighbour sequence of sequence listing upward to telomere on chrosomal short arm and 5'-terminus of this base sequence : 55766
atctccacacttgggtgtcctctattactttcatttattgcccagctttttttaaaaaagtgttgcatatttttttaaatgcaatgtttatagtaatgaaatgattcactatgaatttaccatatatatatatatatatgtatatatatatatatgagtgtttatccaccactattga

SEQ ID NO: 17529 - DNA, 126 bp, Homo sapiens
  DISO7_10016657
  Located on chromosome 11
  Distance between a terminus base of telomere on chromosomal short arm and 5'-terminus of this base sequence : 64351548
  Distance between 3'-terminus of neighbour sequence of sequence listing upward to telomere on chrosomal short arm and 5'-terminus of this base sequence : 104775
ttgacatcatagatgcattatttgttttctgttgtaaaaataagtcgtgtgtgtgtgtgtgtgtgtgctatatacaaatgtattgtttggcatactaaatcttttactcatgccctatcattgttg

SEQ ID NO: 17530 - DNA, 305 bp, Homo sapiens
  AC036111.3_37637
  Located on chromosome 11
  Distance between a terminus base of telomere on chromosomal short arm and 5'-terminus of this base sequence : 64579902
  Distance between 3'-terminus of neighbour sequence of sequence listing upward to telomere on chrosomal short arm and 5'-terminus of this base sequence : 228228
gtatgtaccaggaataggtattgaatgataaatattcccttctatataactgagaatagagccaaacctaccaatgctttgggaaatcagagcacagagagaagatcacacacacacacacacacacacacacacacacacacacactggaagtttttagaaaatgcgatgttttaatataaatatatgctattgtcatcttttaatggagtgaaagatatgtcaccccaaaatatgccagattggtatattgattattttgagtgaaaaacattgaagaacttacagtttcagaaaggatgaac

SEQ ID NO: 17531 - DNA, 350 bp, Homo sapiens
  AC027239.3_184193
  Located on chromosome 11
  Distance between a terminus base of telomere on chromosomal short arm and 5'-terminus of this base sequence : 64698208
  Distance between 3'-terminus of neighbour sequence of sequence listing upward to telomere on chrosomal short arm and 5'-terminus of this base sequence : 118001
caaatttggttacagatgaaagtatgtcatgaatatttattttcttacaaatgtaaagtttaactgtgaaatatgtggtggaaaatatgttatacctcaaatcattttagagtgatgtagaaaaccaaattaaggattaacgtaattacatatatatatatatatatatatatatatatatattcacaaggtgaaaaataaaaaactctcagcaagaagctcatgcaattggttatagtaaacttggattgcttgctttccctttccttattttttattttgacagtaaaatgctgatcctttataacagaaataggtttatttctgtaggcacttcagttagaatcata

SEQ ID NO: 17532 - DNA, 282 bp, Homo sapiens
  HUMUT6880
  Located on chromosome 11
  Distance between a terminus base of telomere on chromosomal short arm and 5'-terminus of this base sequence : 64958909
  Distance between 3'-terminus of neighbour sequence of sequence listing upward to telomere on chrosomal short arm and 5'-terminus of this base sequence : 260351
tgtgagcccttaaaagggacaggaattgctcacttggggagctcggctcttgagacagtagtcttgccgatgcctccggccgaataaacaccttccttctttaactcggtgtctgaggacttttgtctgtggctcgtcctgctacagaaggaaggaaggaaggaaggaaggaaggaaggaaggaaggaacgaaggaaggaatgaaggaagaagggaaggaaggaagagacaataataagactgacaaaccgcttcttaaaagatgcagtgaaaaccaaaaga

SEQ ID NO: 17533 - DNA, 194 bp, Homo sapiens
  DISO7_00031171
  Located on chromosome 11
  Distance between a terminus base of telomere on chromosomal short arm and 5'-terminus of this base sequence : 65118241
  Distance between 3'-terminus of neighbour sequence of sequence listing upward to telomere on chrosomal short arm and 5'-terminus of this base sequence : 159050
aggtctgtccgaaagtcaaaggctgcgccctccctagggctctagaagcctccagccctgcttcaccacacaagtgagtttagggatttttccacctcaggatgcacatatacatccttcccccggaccctctccaacacacacacacacacacacaaacacttcctctgattcacagacagctcagggctgat

SEQ ID NO: 17534 - DNA, 436 bp, Homo sapiens
  AP002826.1_99415
  Located on chromosome 11
  Distance between a terminus base of telomere on chromosomal short arm and 5'-terminus of this base sequence : 65415564
  Distance between 3'-terminus of neighbour sequence of sequence listing upward to telomere on chrosomal short arm and 5'-terminus of this base sequence : 297129
caccatttattgaatagaagttctttctgcattgcttaattttgttgactttgttaaagatcagatctctctctctctctctctctgtgtgtgtgtgtgtgtgtgtgtatgtgtggctttctttctatgttctctattctgttccactagtctatgtcatcgtttttgtaatagtaccagactctttttgccactgttagccccacagtatgttttgacggcaggtaatgtgaaacctccagctttgttcttttgctaaggattgctttcactatttgggctcttttccagtttcatatgaattttagaatagtttttctaattctgtgaaaaatggcattgatggttgataggaacagcattgaatttgtagattgcttgggggcagtttcgccattttaatgatattgattattctaatccatgagtatggact

SEQ ID NO: 17535 - DNA, 134 bp, Homo sapiens
  D11S1357
  Located on chromosome 11
  Distance between a terminus base of telomere on chromosomal short arm and 5'-terminus of this base sequence : 65551451
  Distance between 3'-terminus of neighbour sequence of sequence listing upward to telomere on chrosomal short arm and 5'-terminus of this base sequence : 135451
gggcctctgagagacatgttctcatgcttaatttaaaatgtatattataataatcttaaattatatgtaaatacatgagtatgtgtgtgtgtgtgtgtgtgtgtgtgtgtatttttcaacaaaatgaggtggag

SEQ ID NO: 17536 - DNA, 244 bp, Homo sapiens
  D11S1387
  Located on chromosome 11
  Distance between a terminus base of telomere on chromosomal short arm and 5'-terminus of this base sequence : 65685356
  Distance between 3'-terminus of neighbour sequence of sequence listing upward to telomere on chrosomal short arm and 5'-terminus of this base sequence : 133771
ttcagtgcccataacctctctctcttcttgtatgattaaggatagaggtggtaacagtgctcagaagttattagttctagggtgtattagtaagcgttctccagagagacagaaccaataggagatagagagatagatagatagatagatagatagatagatagatagatagatagacagacatagaggtttacaagagggggtttattaggaaaattggctcacgtgattaaggaggctgaga

SEQ ID NO: 17537 - DNA, 121 bp, Homo sapiens
  DISO7_10795109
  Located on chromosome 11
  Distance between a terminus base of telomere on chromosomal short arm and 5'-terminus of this base sequence : 65792530
  Distance between 3'-terminus of neighbour sequence of sequence listing upward to telomere on chrosomal short arm and 5'-terminus of this base sequence : 106930
tccattaacattaacaggtaggtcattttctacatttgttcactaaaaatacaatttgtgtgtgtgtgtgtgtgtgtgtgtgtgtgtgtgtgtgtgtagagataagtattccatcaatggg

SEQ ID NO: 17538 - DNA, 196 bp, Homo sapiens
  D11S1313
  Located on chromosome 11
  Distance between a terminus base of telomere on chromosomal short arm and 5'-terminus of this base sequence : 65940978
  Distance between 3'-terminus of neighbour sequence of sequence listing upward to telomere on chrosomal short arm and 5'-terminus of this base sequence : 148327
ctaagcatgaagccaagttatctctttctctatttctcttctgtatttttttcttcctgtctctctctgtctctctctctctctctctcacacacacacacacacacacacacacacacacacactctttcttcttttccaatctacattttcttgagatattgcatatgaagtcaaaattccctaatgtcaaact

SEQ ID NO: 17539 - DNA, 246 bp, Homo sapiens
  G08880
  Located on chromosome 11
  Distance between a terminus base of telomere on chromosomal short arm and 5'-terminus of this base sequence : 65969408
  Distance between 3'-terminus of neighbour sequence of sequence listing upward to telomere on chrosomal short arm and 5'-terminus of this base sequence : 28234
ctgtctagtgtcctgagctgctagatagggtctggctacctgccgccctgaactggaataagcaggtaaataattatcttacttgcttttattaatgtttcttaaatctatctatctatctatctatctatctatctatctatctatctatcatctatctatctcacatttattttgtgagataattagaagtgtattggtatttattttagaaattattctaccataaagacatatgcatgtgaa

SEQ ID NO: 17540 - DNA, 184 bp, Homo sapiens
  Z67514
  Located on chromosome 11
  Distance between a terminus base of telomere on chromosomal short arm and 5'-terminus of this base sequence : 66201944
  Distance between 3'-terminus of neighbour sequence of sequence listing upward to telomere on chrosomal short arm and 5'-terminus of this base sequence : 232290
agatgcttctccacttggatgtcccatggacattgtgagtccaacacatctcagactgaactcaacacacacacacacacacacacacacacacacacgcacaaacctgcttcactttttgtggtcactttctcaggagaaaccatcaccttccaactagacctgcaaggcaggactctggtca

SEQ ID NO: 17541 - DNA, 206 bp, Homo sapiens
  DISO7_00000005
  Located on chromosome 11
  Distance between a terminus base of telomere on chromosomal short arm and 5'-terminus of this base sequence : 66285542
  Distance between 3'-terminus of neighbour sequence of sequence listing upward to telomere on chrosomal short arm and 5'-terminus of this base sequence : 83414
  misc_feature (1)...(206): n = A,T,G or C
gactcattccttcatccctcccttccttcctccctccctccctcccgncgtncccncgattccttcatccctcccttccttccttccttccttccttccttccttccttccttccctccatccttccttccttccttccttccttccctccatcttctccacacctggtatcatcatacagaagcagagaggactgcacttggtga

SEQ ID NO: 17542 - DNA, 226 bp, Homo sapiens
  chr11.fa.O7frz.59411702
  Located on chromosome 11
  Distance between a terminus base of telomere on chromosomal short arm and 5'-terminus of this base sequence : 66397315
  Distance between 3'-terminus of neighbour sequence of sequence listing upward to telomere on chrosomal short arm and 5'-terminus of this base sequence : 111567
ttcacaagataactgtcaggatgacaaagttggttcaaagaatgatttgagaaactggtgtgtgtgtgtgtgtgtgtgtgtgtgtgtgtgtgtgtgtgctggaataacacagctaagttacctacaaaactggctattgccctgcaggccaacaagactgaaataggaggtaggactcaactcccgaggtggggctcagataccaaccagattgaggactagctaa

SEQ ID NO: 17543 - DNA, 181 bp, Homo sapiens
  D11S1777
  Located on chromosome 11
  Distance between a terminus base of telomere on chromosomal short arm and 5'-terminus of this base sequence : 66501892
  Distance between 3'-terminus of neighbour sequence of sequence listing upward to telomere on chrosomal short arm and 5'-terminus of this base sequence : 104351
tgagccaagattgcaccatcacgctccagcctgggcttaaaacacacacacacacacacacacacacacacacacacacacacacaaacaaatgccaactgttacgggaaaaaaagaagattaggggaaggaaaaggcagaagaaaggacatttcactaattgttggcattcgtggaactc

SEQ ID NO: 17544 - DNA, 342 bp, Homo sapiens
  chr11.fa.O7frz.59598972
  Located on chromosome 11
  Distance between a terminus base of telomere on chromosomal short arm and 5'-terminus of this base sequence : 66803647
  Distance between 3'-terminus of neighbour sequence of sequence listing upward to telomere on chrosomal short arm and 5'-terminus of this base sequence : 301574
atcacgaggtcaggagttcgagaccagtctaaccaatatggtgaaaacctgtctctactaaaaattagctgggtgtagtggcgcgcgcctgtagtcccagctacttgggagactgaggcaggagaatcacttgaatccaggaagcagaggttgcagtgagccatgattgagccactgcactccagcctcggtgacagaccaagactctgtctccaaaaataataataataataataataatgctttttctgtgtctgttgagataatcatatggtttttgtccttcattctgttcgtgtgatatatcacatttattgatttgtataggttaaaccacatcac

SEQ ID NO: 17545 - DNA, 157 bp, Homo sapiens
  DISO7_10003066
  Located on chromosome 11
  Distance between a terminus base of telomere on chromosomal short arm and 5'-terminus of this base sequence : 66864460
  Distance between 3'-terminus of neighbour sequence of sequence listing upward to telomere on chrosomal short arm and 5'-terminus of this base sequence : 60471
ttgccctgatcatgtctgcctaactacctacctacctactacctacattctaaaaatgaacaatttaaaaatcccttccaggaagctgagggtgaaaatttctcatttttgtcttctttcattcagcaaatctttactaaattcctcctatgctcca

SEQ ID NO: 17546 - DNA, 347 bp, Homo sapiens
  AP002358.1_156295
  Located on chromosome 11
  Distance between a terminus base of telomere on chromosomal short arm and 5'-terminus of this base sequence : 66995502
  Distance between 3'-terminus of neighbour sequence of sequence listing upward to telomere on chrosomal short arm and 5'-terminus of this base sequence : 130885
aaaagattctggtgctaagtactaccccttcatcttccatggatggtcattacctttcctgtcctcctgttatatgaacacacacacacacacacacacacacacacacacacacgcacacacataccacatttcaataagtcttcattgttctgggtccttacctttcctgtcctcctgttatatgaacacacacacacacacacacacacacacacacgcacaccacatttcaatgtctgcatggttctgggggtaacaaaggcaagaagttaaagtaagaccacatttgagtattacttactctgtagaatcaaaacagagtagttaacaccaattatgcaaac

SEQ ID NO: 17547 - DNA, 277 bp, Homo sapiens
  chr11.fa.O7frz.61009379
  Located on chromosome 11
  Distance between a terminus base of telomere on chromosomal short arm and 5'-terminus of this base sequence : 67234389
  Distance between 3'-terminus of neighbour sequence of sequence listing upward to telomere on chrosomal short arm and 5'-terminus of this base sequence : 238540
gtataagccagaaggaactcagttttcctgaaattaaggattcaatttttacctctaaatactggctttactctcaggctctcttgattaacttagccaatgatttttttcctccctaggtgcacacacacacacacacacacacacacacaaaacaaagggggtagaatacaaaaatcccagcgaattgtcaaaagttaaattttataactcctgtaaattgctgcttactaccagtttctttctgactgagtgagacataaatggcatctaactg

SEQ ID NO: 17548 - DNA, 315 bp, Homo sapiens
  chr11.fa.O7frz.60915931
  Located on chromosome 11
  Distance between a terminus base of telomere on chromosomal short arm and 5'-terminus of this base sequence : 67373939
  Distance between 3'-terminus of neighbour sequence of sequence listing upward to telomere on chrosomal short arm and 5'-terminus of this base sequence : 139273
gtagcaatgatcaacttgagttactctgagcatgaacaaagtgttttatttatttgaatataaattaaaaatataaagatatggattctcaaatacaagaatatagattgacccccaggaaaaaggatagaccctggaaatggaaaactaccaggggctctgggaccactttttctccatgcttgttttctctggacagacaggcttaaaaagtacacacacacacacacacacacacacacacacacacacacacacacagtggtaaaatatatataacataatatttattattctaaccacggtaagtacaat

SEQ ID NO: 17549 - DNA, 344 bp, Homo sapiens
  AP001652.3_8772
  Located on chromosome 11
  Distance between a terminus base of telomere on chromosomal short arm and 5'-terminus of this base sequence : 67401924
  Distance between 3'-terminus of neighbour sequence of sequence listing upward to telomere on chrosomal short arm and 5'-terminus of this base sequence : 27670
atgtgctctagtatgaaactgaagggtatatacgtatttctcaatttgtcataaagagtattaaaaatacaaatactaaggatttaagatgtaatgaaattaatcatttttcagctcattaagaaccttcctaagtgaatttgactttttaatattgtgactgggtaacagtaaaatatatatatatatatatatgactatcagcacaatttgttgtggcttcctaaaacaccagagttttacccagatttattttgcaccatcaaaagtagagtttggaaaataactctattttctttagcctcccctccttattacccttctcagcctctggtaacttctat

SEQ ID NO: 17550 - DNA, 237 bp, Homo sapiens
  D11S1983
  Located on chromosome 11
  Distance between a terminus base of telomere on chromosomal short arm and 5'-terminus of this base sequence : 67527660
  Distance between 3'-terminus of neighbour sequence of sequence listing upward to telomere on chrosomal short arm and 5'-terminus of this base sequence : 125392
attctgtgtctaaaaacagaaaagaatagagatagatagatgatagatagatagatagatagatagatagatagatagatagatgatagatagatagatagataataggtaaaagatagatagataatagatgatagatgatagatagatagatgatagatagatagatagatagatagatagatagatagatagatagattcattggttgaatttgattcccctctttcctggtaa

SEQ ID NO: 17551 - DNA, 264 bp, Homo sapiens
  D11S1965
  Located on chromosome 11
  Distance between a terminus base of telomere on chromosomal short arm and 5'-terminus of this base sequence : 67577213
  Distance between 3'-terminus of neighbour sequence of sequence listing upward to telomere on chrosomal short arm and 5'-terminus of this base sequence : 49316
ctgacgcttgcagtggaggtgggatgaggcaggaggccaaagcattccttttaagaaatgtcctgacctaaacagtacattaacagtacattagtcacacacgcgcgcgcgcgcacacacacacacacacacacacacacacacacacacacagaatcaactgaagtgaaatcaaaattctactcccccctacccccttcctctttaccaatcccctttacatcctggtggaggtctctctgcttcccgtgtctctatttcacc

SEQ ID NO: 17552 - DNA, 231 bp, Homo sapiens
  D11S4202
  Located on chromosome 11
  Distance between a terminus base of telomere on chromosomal short arm and 5'-terminus of this base sequence : 67606527
  Distance between 3'-terminus of neighbour sequence of sequence listing upward to telomere on chrosomal short arm and 5'-terminus of this base sequence : 29050
ttaatgggtacaggggtctcctttgttggtggtgatgaaaatgtttggaactagatagaagtgatggttgtacaacactgtaaatgtaccaaatgtcactgaattgtatgctttcaagtattttttactatttttttgttatgtgaatttcacctcaaaacacacacacacacacacacacacacacacacacacacgtgcacaaaagtattgccaggtttctggaataga

SEQ ID NO: 17553 - DNA, 353 bp, Homo sapiens
  chr11.fa.O7frz.60443971
  Located on chromosome 11
  Distance between a terminus base of telomere on chromosomal short arm and 5'-terminus of this base sequence : 67704507
  Distance between 3'-terminus of neighbour sequence of sequence listing upward to telomere on chrosomal short arm and 5'-terminus of this base sequence : 97749
cgatagagctagactccatctcaaaaaaaatgtgtgtgtgtgtgtgtgtgtgtgtgtacagtgtgtgtgtgtgtgtgtgtatatatatatatatatatatatatatatatgtatgtatatagtatgtatatatatgctgcatccttgggccaacattagtgaagtccatatcagttaaaggaatttgttggattttgcctgattaaaaacaattgtgatgacatggtcagaaatatcaaagaagtgctagtttggtgaaaaaggtgagaagtttgccccataatatgttgtattttagatgctaacatgtctcctctctggggatgtgcctcaatacttagaaacctgaactg

SEQ ID NO: 17554 - DNA, 293 bp, Homo sapiens
  chr11.fa.O7frz.60342504
  Located on chromosome 11
  Distance between a terminus base of telomere on chromosomal short arm and 5'-terminus of this base sequence : 67820159
  Distance between 3'-terminus of neighbour sequence of sequence listing upward to telomere on chrosomal short arm and 5'-terminus of this base sequence : 115299
ttcataatgccaattctgtaagattttaaaaccaaccagtgtgcctcccattactgtcttgtatacatggggatgacttttttctgtgtgtgtgtgtgtgtgtgtgtgtgtgtgtgtgtctgtgtatgtgtttgctaattatctttactctggtatgactttatgtattggatgtgaatgtagaaggagctaaattttctttttggttcataaattgctgaaccacaaggagccacatcctgattatgtggagaagaccatttaacctgaggttgagcttgtatggtgactag

SEQ ID NO: 17555 - DNA, 115 bp, Homo sapiens
  DISO7_10003068
  Located on chromosome 11
  Distance between a terminus base of telomere on chromosomal short arm and 5'-terminus of this base sequence : 67932635
  Distance between 3'-terminus of neighbour sequence of sequence listing upward to telomere on chrosomal short arm and 5'-terminus of this base sequence : 112183
attgctgttgggatctggccgtcctctccacagacacacagacacacacacacacacacacacacacacaccccaaagaactaccttagttactctagacctcttcagaattgcc

SEQ ID NO: 17556 - DNA, 202 bp, Homo sapiens
  HUMUT5150
  Located on chromosome 11
  Distance between a terminus base of telomere on chromosomal short arm and 5'-terminus of this base sequence : 67934961
  Distance between 3'-terminus of neighbour sequence of sequence listing upward to telomere on chrosomal short arm and 5'-terminus of this base sequence : 2211
agcctggacaacaagagtgaaactccatctaaaaaaagaaaaagagagaaagagagaaagaaagaaagaaagaaagaaagaaagaaagaaagaaagaaagaaagaaagaaagaaagaaagggagagaaagagagaaagaaagaaaaaaatggccatattgtgtagaacaaaggaacatttagaagttgcacagaggcaggct

SEQ ID NO: 17557 - DNA, 106 bp, Homo sapiens
  DISO7_10003067
  Located on chromosome 11
  Distance between a terminus base of telomere on chromosomal short arm and 5'-terminus of this base sequence : 68076167
  Distance between 3'-terminus of neighbour sequence of sequence listing upward to telomere on chrosomal short arm and 5'-terminus of this base sequence : 141004
ggagaggtagtgctagtgttctacttacacacacacacacacacacacacacacacacacacacgaattgctctgcctggccctttgtggttggtttaatcggacg

SEQ ID NO: 17558 - DNA, 361 bp, Homo sapiens
  chr11.fa.O7frz.61484929
  Located on chromosome 11
  Distance between a terminus base of telomere on chromosomal short arm and 5'-terminus of this base sequence : 68367384
  Distance between 3'-terminus of neighbour sequence of sequence listing upward to telomere on chrosomal short arm and 5'-terminus of this base sequence : 291111
ttgaggatactttgtaacttaggtttaaaataacaacagcaacaacaacaaatacttatagaacagttactatgggccaggcatgatctaagaagattagatgatacatgatgatgatgatagatggtagatagatgatagacagatagataaagatggatagagagatgatagatagatagatagatagatagatagatagatagatagatagatagatgatagatgataattagacagatcctataacaaagtaaatactattattatctctaattttacagagagagagagttcaagtgacctggtcaacatcgcacatctactaagtgaagctgagaattaaatccaggcagtctag

SEQ ID NO: 17559 - DNA, 268 bp, Homo sapiens
  G10111
  Located on chromosome 11
  Distance between a terminus base of telomere on chromosomal short arm and 5'-terminus of this base sequence : 68394279
  Distance between 3'-terminus of neighbour sequence of sequence listing upward to telomere on chrosomal short arm and 5'-terminus of this base sequence : 26534
tataggcacatgccactgtgctggagatgatagatagatagatagatagatagatagatagatagatagatagatagatagataaatttttttaacagatagagtttccctaagttgcccagactggtctcaaactctggggctgaagcgatccaccctccttggcctcccaaaatgctgggattacaggtgtgagccattgtgcctggcctaagaattggattttagttaaaaccttcacacaagaaatctctaagcccagatggct

SEQ ID NO: 17560 - DNA, 205 bp, Homo sapiens
  D11S4075
  Located on chromosome 11
  Distance between a terminus base of telomere on chromosomal short arm and 5'-terminus of this base sequence : 68711053
  Distance between 3'-terminus of neighbour sequence of sequence listing upward to telomere on chrosomal short arm and 5'-terminus of this base sequence : 316506
cactcttaaatgggtggtgactgtttcttaaggaaaggtcttgtattttttttcaagactgctttgaaaaattcctgccaaattttctctctctctctctctctctctctctctcacacacacacacacacacacacacacacacagacacacacacaccctgtaagtccttcttttcaacaatgattccagagttttcagagct

SEQ ID NO: 17561 - DNA, 227 bp, Homo sapiens
  AP000640.3_26645
  Located on chromosome 11
  Distance between a terminus base of telomere on chromosomal short arm and 5'-terminus of this base sequence : 68711068
  Distance between 3'-terminus of neighbour sequence of sequence listing upward to telomere on chrosomal short arm and 5'-terminus of this base sequence : -190
ggtgactgtttcttaaggaaaggtcttgtattttttttcaagactgctttgaaaaattcctgccaaattttctctctctctctctctctctctctctctcacacacacacacacacacacacacacacacagacacacacacaccctgtaagtccttcttttcaacaatgattccagagttttcagagctattggtataggaagtgaaagttttaggttctacatga

SEQ ID NO: 17562 - DNA, 174 bp, Homo sapiens
  D11S1335
  Located on chromosome 11
  Distance between a terminus base of telomere on chromosomal short arm and 5'-terminus of this base sequence : 68738335
  Distance between 3'-terminus of neighbour sequence of sequence listing upward to telomere on chrosomal short arm and 5'-terminus of this base sequence : 27040
cacaatcctatgaagcaggtagtgtttttatcagcatttaacagataaggaaacctaggcacagcaagataggtaacttgccagttcctccctttctcacccctcaccccctgaaagaaacacacacacacacacacacacacacacacacacacacaacccagcaattggtag

SEQ ID NO: 17563 - DNA, 243 bp, Homo sapiens
  chr11.fa.O7frz.61977941
  Located on chromosome 11
  Distance between a terminus base of telomere on chromosomal short arm and 5'-terminus of this base sequence : 68849777
  Distance between 3'-terminus of neighbour sequence of sequence listing upward to telomere on chrosomal short arm and 5'-terminus of this base sequence : 111268
caaattgttcattgctagtgtacagaaatagaactgatttctgtcgattgatcttgtctcctacaacattagtgagcatgcttattagttgtaatagtttttttttttgggtggatctcttatgattttctatatacaagatcatgtctgtttgtctgtctgtctgtctgtctgtctgtctctctctctctctctctctctctctctctctctctctctctctatgcagtcttaatctgttgc

SEQ ID NO: 17564 - DNA, 182 bp, Homo sapiens
  D11S1368
  Located on chromosome 11
  Distance between a terminus base of telomere on chromosomal short arm and 5'-terminus of this base sequence : 68920073
  Distance between 3'-terminus of neighbour sequence of sequence listing upward to telomere on chrosomal short arm and 5'-terminus of this base sequence : 70053
tccattttccaccagagaaaagtgaagggactttatctatctatctatctatctatctatctatctatctatctaatcatctatctacatattcttctacaaaaataatagcatctttcattgagtttactctttccctgggtttatactaagcttctcgagggttggagggagaaaactgt

SEQ ID NO: 17565 - DNA, 127 bp, Homo sapiens
  D11S4191
  Located on chromosome 11
  Distance between a terminus base of telomere on chromosomal short arm and 5'-terminus of this base sequence : 69197707
  Distance between 3'-terminus of neighbour sequence of sequence listing upward to telomere on chrosomal short arm and 5'-terminus of this base sequence : 277452
gcaagatggccaattagaagttactaacctcatcgccatcaacacacacacacacacacacacacacacacacacacacacacacacacacaccaaaaatgaataaacaactacattccaaccaaaa

SEQ ID NO: 17566 - DNA, 457 bp, Homo sapiens
  chr11.fa.O7frz.62476349
  Located on chromosome 11
  Distance between a terminus base of telomere on chromosomal short arm and 5'-terminus of this base sequence : 69294329
  Distance between 3'-terminus of neighbour sequence of sequence listing upward to telomere on chrosomal short arm and 5'-terminus of this base sequence : 96495
gccagatactattcactagaacagtggaggggtgatcccagtgatatttggaagatctttggggctcccattcccattacaggtgccaagtgctaagtttttattgacagatgaatggataaactgtgagatacacacacacacacacacacacacacacacactcatataattcagacttaaaaaaggagatcttgccatttgccacaacatggaagatactggagaaacttatgctaagtaaacttacccagacacagagacatattgcacaatctcatttatatgtggaatctaaaataacaacaaaacaactaacaatatagaattcagagagatagagagtgaaactgtggttaccaggggtagaagaagagagagagagagaaaactggtaggggagagcagcaggtcaaaagatacaaagtgaaagataagtaggatgagcaaatctaga

SEQ ID NO: 17567 - DNA, 253 bp, Homo sapiens
  AC024066.4_26836
  Located on chromosome 11
  Distance between a terminus base of telomere on chromosomal short arm and 5'-terminus of this base sequence : 69617451
  Distance between 3'-terminus of neighbour sequence of sequence listing upward to telomere on chrosomal short arm and 5'-terminus of this base sequence : 322665
agttccatctaaaggtattcaaactcgaaatctcaaaaaaatatggctctaactaaaagcaaagtaaacaaaacacaccaaacacacacacacacacacacacacacacacacacacactcacagaggtcttattcttaattcttctctgaataaagtgaaaagagaacaaacatggattgggtatataagaacatatagatttctactccaactaaatagaatttaaactgacagctattcaatgctatact

SEQ ID NO: 17568 - DNA, 424 bp, Homo sapiens
  AP001259.2_66300
  Located on chromosome 11
  Distance between a terminus base of telomere on chromosomal short arm and 5'-terminus of this base sequence : 69633243
  Distance between 3'-terminus of neighbour sequence of sequence listing upward to telomere on chrosomal short arm and 5'-terminus of this base sequence : 15539
cagcaaatcatagacatatctgtactctcattttcattgcagcattattcactatagcgtatatttggaaacaacctgtgtccatcaatgatgaatggataaagaaactggtacacacacacacacacacacatacacacacacacacatacacaatggaatattgttaagccttaaaaaaaaaaaaaggaaatactgccatttgcaacaacatggatgaacctgaggaacactgtgctaagtgaaataagctatacacaaaaataaaaagaatgtatgatctcacttatatgtggaatctaataaacaacaaatacattgaaacagagagtaggacagtggtaatcagaggcagagaggggaggaaatggggagaagtagatcaaaaggtgcaaacttgcagtgatgtaggatgaataagcct

SEQ ID NO: 17569 - DNA, 237 bp, Homo sapiens
  Z67104
  Located on chromosome 11
  Distance between a terminus base of telomere on chromosomal short arm and 5'-terminus of this base sequence : 69711966
  Distance between 3'-terminus of neighbour sequence of sequence listing upward to telomere on chrosomal short arm and 5'-terminus of this base sequence : 78299
cctttgcagtgtccccctgcccacacacacacacacacacacacatacacacacacacatacaaacaaacacacatacacacacacacacatacacacacacactctctctctctctccttctcctcccctctccaccttcctttctcctttctctcccttctgttacagtcttcctcctgactcacacacctacatgtgacactaatgcaactttcctcataaatggcacaactcc

SEQ ID NO: 17570 - DNA, 248 bp, Homo sapiens
  D11S1765
  Located on chromosome 11
  Distance between a terminus base of telomere on chromosomal short arm and 5'-terminus of this base sequence : 70024120
  Distance between 3'-terminus of neighbour sequence of sequence listing upward to telomere on chrosomal short arm and 5'-terminus of this base sequence : 311917
tcccggagtttgcacaatctgtccactcccgaagtccctgcaagtgttcagacagtcactataggtaagtgttgctgggtactacgcggtttctcagaagcttggacgtgtgtgtgtgtgtgtgtgtgtgtgtgtgtgtgtgtgtgttcctgtgcacacctgtgttggggtggaggatggtttggtcctcatcctccacctccagccaatggacttgcctccccggggctctctgggtggcatttctg

SEQ ID NO: 17571 - DNA, 307 bp, Homo sapiens
  U65744.1_22932
  Located on chromosome 11
  Distance between a terminus base of telomere on chromosomal short arm and 5'-terminus of this base sequence : 70332330
  Distance between 3'-terminus of neighbour sequence of sequence listing upward to telomere on chrosomal short arm and 5'-terminus of this base sequence : 307962
attggcaaagtcatcctgttccgaaagccctaagaccaaggatagcaccaccatccggccttccctgcccggggagggcagcccacaggccagggtgaaacgaggaggccccgtgggcgggggcaggggggaaggagagagagggagagagagagagagagagagagagagagagagagagagagagagagagagagaaagagagagagagagacagagacaaagagagagaagaaaaaagtgtaagaaactggccctgcaggaaagaaaacaaacttcagcagtgtcaacagttgcaggatagagt

SEQ ID NO: 17572 - DNA, 323 bp, Homo sapiens
  chr11.fa.O7frz.63588794
  Located on chromosome 11
  Distance between a terminus base of telomere on chromosomal short arm and 5'-terminus of this base sequence : 70915104
  Distance between 3'-terminus of neighbour sequence of sequence listing upward to telomere on chrosomal short arm and 5'-terminus of this base sequence : 582467
ctatgcaaaggttacaaggttaacagggtctgctctttaattaaaaaaacaattatcctggacaggcatgatgaattaaagatgtaatacgaacactttgggaagtcaagacaagaggatggcttgaagctgggaggttgaggatgcagtgagctatgatggtgccactgctgttgaggatgtgtgacagagcgagccctcgtttcaagatagatagataaataaataaataaataaataataattccaatgattaaattcagaaggaatggtagaatttggaactcattgttttgcaacttctaatgaaacaatggatctag

SEQ ID NO: 17573 - DNA, 457 bp, Homo sapiens
  chr11.fa.O7frz.64320816
  Located on chromosome 11
  Distance between a terminus base of telomere on chromosomal short arm and 5'-terminus of this base sequence : 71201892
  Distance between 3'-terminus of neighbour sequence of sequence listing upward to telomere on chrosomal short arm and 5'-terminus of this base sequence : 286465
gttgtataaagcaggcatacatgaatcttcctcccctcccctcccttcctccctccttcaaaataaattaaaaacttttgtgcatcaaggaacctcctcaacaaagtaaaaaagacgacctacagaatggagtcctccctacctccttcccttccttcccttccttcctttccttcccttccttccctccttccttccttccttccttccttccttccttccttcctttcttccttccttccttccttccttccttccctcctttgttgagacagggtcttgctctgtcacctagtctggactgcagttctgagctggtgtgatcatagctcactgcagcctcaaactcctgggctcaagcaatcatccgacctcagcctcccaaaatgtagggattgtatgtgtgagccactgcaccagggcagattctgcattggtaacaagcttccaaatgatg

SEQ ID NO: 17574 - DNA, 425 bp, Homo sapiens
  AC051664.2_101217
  Located on chromosome 11
  Distance between a terminus base of telomere on chromosomal short arm and 5'-terminus of this base sequence : 71310683
  Distance between 3'-terminus of neighbour sequence of sequence listing upward to telomere on chrosomal short arm and 5'-terminus of this base sequence : 108334
gcatgaacatagctaagcttaccaaaggctgctatatgtgattgtgtgtgtgtgtgtgtgtgtgtgtgtgtatatatatatatatatatatatatataaaaatatataattgttatacgtgactggctacatttacaacataagctgaatcacagacaacgttgataggatctgaagctgtgagctgtaaaacctgaatgactgcaattagttctgagcattgagctgaaaccccagaggtcattattgtttccagacttttttggaataacaaattccggtgaattccaggggctaactgacgtttctatatgtcctgcattcaattgctcttttaccaacaggtgaagttgacctagcttctcctgtgttaggggccattgatccacccacacaggtttgtcactaagccattctaatgataa

SEQ ID NO: 17575 - DNA, 184 bp, Homo sapiens
  DISO7_11015105
  Located on chromosome 11
  Distance between a terminus base of telomere on chromosomal short arm and 5'-terminus of this base sequence : 71355583
  Distance between 3'-terminus of neighbour sequence of sequence listing upward to telomere on chrosomal short arm and 5'-terminus of this base sequence : 44475
cagttcagaagacctagggtgatgtgtgtgtgtgtgtgtgtgtgtgtatatatatatatgtatatgtgtatatgtgtatatatatatgtatatatatataaccaaaaaaaacttttgagtaaactgcaaaagaaaaaaagaaacaaaagaaaatgaccaaattgaccaaattccttcatcattg

SEQ ID NO: 17576 - DNA, 129 bp, Homo sapiens
  DISO7_10003071
  Located on chromosome 11
  Distance between a terminus base of telomere on chromosomal short arm and 5'-terminus of this base sequence : 71576061
  Distance between 3'-terminus of neighbour sequence of sequence listing upward to telomere on chrosomal short arm and 5'-terminus of this base sequence : 220294
ttggaaaccaggttgagcatttttacatgtcacacaccacattttttcactatttccacctgaaatcaaaaaaaagaaagaaagaaagaaaggtgaggtcagtcatgctgctgctggtgatgataggct

SEQ ID NO: 17577 - DNA, 170 bp, Homo sapiens
  chr11.fa.O7frz.65661012
  Located on chromosome 11
  Distance between a terminus base of telomere on chromosomal short arm and 5'-terminus of this base sequence : 71735329
  Distance between 3'-terminus of neighbour sequence of sequence listing upward to telomere on chrosomal short arm and 5'-terminus of this base sequence : 159139
tttacagatctcgttctccaggaatacaatgtctacctgcttgcttgtttgcttgcttccttccttccttccttccttccttccttccttccttccttccttccttccttccttccttcctcctttccttttccttagatattcagaataggattactcagattcttgtg

SEQ ID NO: 17578 - DNA, 137 bp, Homo sapiens
  DISD22_0003184
  Located on chromosome 11
  Distance between a terminus base of telomere on chromosomal short arm and 5'-terminus of this base sequence : 72005072
  Distance between 3'-terminus of neighbour sequence of sequence listing upward to telomere on chrosomal short arm and 5'-terminus of this base sequence : 269573
ttctgaagtttgatggatgggtgggtgtggggggtgtgtgtgtgtgtgtgcgtgtgtgtatagtatggccaatatagatagtaaatacctatagtgtttagattttatttggcaaaaaagtcctcgatagccctctg

SEQ ID NO: 17579 - DNA, 199 bp, Homo sapiens
  chr11.fa.O7frz.65954385
  Located on chromosome 11
  Distance between a terminus base of telomere on chromosomal short arm and 5'-terminus of this base sequence : 72313571
  Distance between 3'-terminus of neighbour sequence of sequence listing upward to telomere on chrosomal short arm and 5'-terminus of this base sequence : 308362
aagcagtaagtggtagcatttatcaatctatctatctatctatctatctatctattatctatctatctatctatctatctatctatctatctatctatctatctatctgttgagatggagtttcgctcttgttgcccaggctggagttcagtggcaagatctcgggccgcctcccaggttcaagcaattcagatagttg

SEQ ID NO: 17580 - DNA, 104 bp, Homo sapiens
  DISO7_10000194
  Located on chromosome 11
  Distance between a terminus base of telomere on chromosomal short arm and 5'-terminus of this base sequence : 72552120
  Distance between 3'-terminus of neighbour sequence of sequence listing upward to telomere on chrosomal short arm and 5'-terminus of this base sequence : 238350
acctggagagttggcttggcagaattcagggatgtgtatacacacacacacacacacacacacacagacacacacacacaccccttactccttacctttcttgc

SEQ ID NO: 17581 - DNA, 143 bp, Homo sapiens
  DISO7_10000003
  Located on chromosome 11
  Distance between a terminus base of telomere on chromosomal short arm and 5'-terminus of this base sequence : 72781568
  Distance between 3'-terminus of neighbour sequence of sequence listing upward to telomere on chrosomal short arm and 5'-terminus of this base sequence : 229344
tgcctacctattcatgtatattctcattctctctctacctgtctctctctctctctcacacacacacacacacacacacacacacacacacacacacacgataatagagaagtttgcatttgctgggcaagcaggactgaagt

SEQ ID NO: 17582 - DNA, 198 bp, Homo sapiens
  D11S4205
  Located on chromosome 11
  Distance between a terminus base of telomere on chromosomal short arm and 5'-terminus of this base sequence : 72835072
  Distance between 3'-terminus of neighbour sequence of sequence listing upward to telomere on chrosomal short arm and 5'-terminus of this base sequence : 53361
gcttagttgctattacatgatgacctaataatttttttcatgttatgagttttctcttctttttaaaaataaatttaattatgtatatttaaggtatacaacataatgctatgagagttatatgtgtgtgtgtgtgtgtgtgtgtgtgtgtgtgtgtataaaatagtcaccatggtgaagcaaattaacgtatctatc

SEQ ID NO: 17583 - DNA, 140 bp, Homo sapiens
  DISO7_11135107
  Located on chromosome 11
  Distance between a terminus base of telomere on chromosomal short arm and 5'-terminus of this base sequence : 72950970
  Distance between 3'-terminus of neighbour sequence of sequence listing upward to telomere on chrosomal short arm and 5'-terminus of this base sequence : 115700
tcaaatgtagcagttacctgtgtattttcttcatcttttatctacaaatcagtcctaaacacacacacacacacacacacacacacacacacacactactgttgcaacctttgaaataagaaagtgattcatgtcaccac

SEQ ID NO: 17584 - DNA, 140 bp, Homo sapiens; identical to SEQ ID NO: 17583
  DISO7_11135103
  Located on chromosome 11
  Distance between a terminus base of telomere on chromosomal short arm and 5'-terminus of this base sequence : 72950970
  Distance between 3'-terminus of neighbour sequence of sequence listing upward to telomere on chrosomal short arm and 5'-terminus of this base sequence : -140

SEQ ID NO: 17585 - DNA, 195 bp, Homo sapiens
  G08895
  Located on chromosome 11
  Distance between a terminus base of telomere on chromosomal short arm and 5'-terminus of this base sequence : 74002658
  Distance between 3'-terminus of neighbour sequence of sequence listing upward to telomere on chrosomal short arm and 5'-terminus of this base sequence : 1051548
ctgaggtgggaggatcagttgagcccgggaggccaaggctgcagcgagctctgtgatcaccctacagcactccagcctgggtaacagagtgagaccctgtatctatctatctatctatctatctatctatctatctatctatctaaactatctgtctctgaataaataaataaaattaaataaatcaaggccggg

SEQ ID NO: 17586 - DNA, 313 bp, Homo sapiens
  chr11.fa.O7frz.79794037
  Located on chromosome 11
  Distance between a terminus base of telomere on chromosomal short arm and 5'-terminus of this base sequence : 74063027
  Distance between 3'-terminus of neighbour sequence of sequence listing upward to telomere on chrosomal short arm and 5'-terminus of this base sequence : 60174
gacattcagtcatgattgaaagaatgacaggttcttaaatatcactatacaatccagttgtgtggtatacagttgctaaattaatgaaagtccttttaatgaattaattcaaaaactattgattgagcctcttcttgctatgtggtgagcactgcattagacattctgggagatattaaggggaacctcctagtttcagggaacgtacacacacacacacacacacacacagtgaatgcacacatacatgcatgtacatacataccgagagacataattataacataatgtgaaagataaactgcaattacag

SEQ ID NO: 17587 - DNA, 106 bp, Homo sapiens
  DISO7_10003091
  Located on chromosome 11
  Distance between a terminus base of telomere on chromosomal short arm and 5'-terminus of this base sequence : 74288745
  Distance between 3'-terminus of neighbour sequence of sequence listing upward to telomere on chrosomal short arm and 5'-terminus of this base sequence : 225405
tccctatcatccagcaggaggcctgaccacaggaggtattacaggaatgagagaatgaatgaatgaatgaatgaatgaatgaatgaagcaagcacaagaggctatg

SEQ ID NO: 17588 - DNA, 101 bp, Homo sapiens
  DISO7_10003090
  Located on chromosome 11
  Distance between a terminus base of telomere on chromosomal short arm and 5'-terminus of this base sequence : 74290396
  Distance between 3'-terminus of neighbour sequence of sequence listing upward to telomere on chrosomal short arm and 5'-terminus of this base sequence : 1545
acggatacacagaggcatgcagagtcacactaaggtgtacatgcagtggacgcaaacggatgcacacacacacacacacacagtctagaccatcagggcct

SEQ ID NO: 17589 - DNA, 126 bp, Homo sapiens
  DISO7_10003089
  Located on chromosome 11
  Distance between a terminus base of telomere on chromosomal short arm and 5'-terminus of this base sequence : 74346796
  Distance between 3'-terminus of neighbour sequence of sequence listing upward to telomere on chrosomal short arm and 5'-terminus of this base sequence : 56299
gagcctgatgagttgctggaaaagttgtgtgtgtgtttgtgtgtgtgtacatatatgctgtgtctttggaacaaagggtacctaaaatggtaggactgagagatgaggttatgtaggctggctgga

SEQ ID NO: 17590 - DNA, 394 bp, Homo sapiens
  chr11.fa.O7frz.79038858
  Located on chromosome 11
  Distance between a terminus base of telomere on chromosomal short arm and 5'-terminus of this base sequence : 74445760
  Distance between 3'-terminus of neighbour sequence of sequence listing upward to telomere on chrosomal short arm and 5'-terminus of this base sequence : 98838
agatttgtacagtttagaaatcgttatgtttggcagtgaagcagaaaaataattcttccttcacagcaccatcatgttcagatcacatatataccaaaggaaatgccatactatctttgcatttattaagtttcaattaaaaacatgtcactaaatttctttgttctgtgaattggtcttccatgtcattaaccagttcctgaattcatcagactatggtgtcattggaaattggttctttattgcagattcactgaatatttccaagcaaacatctttggtggaatttttccctgatgtcagtgtgtgtggggtgtgtgtgtgtgtgtgtgtgtgtgtgtgtgtgtgtgtgtgtgtgtgtttatataccgtgttagcatcctgaaggtctatt

SEQ ID NO: 17591 - DNA, 261 bp, Homo sapiens
  D11S4184
  Located on chromosome 11
  Distance between a terminus base of telomere on chromosomal short arm and 5'-terminus of this base sequence : 74537933
  Distance between 3'-terminus of neighbour sequence of sequence listing upward to telomere on chrosomal short arm and 5'-terminus of this base sequence : 91779
cccagccttacatattcctttacagcagtgcagaacagattaataccctatattaatatgtgtttgaagtgtgtaggtttcttcctatatatctgtgcttttaaaaccatcttcctcaaagttagactgaggtcagtgcattgaaatatctgaggtatattgatatcacacatacacacacacacacacacacacacacacacaccctagaaacttaaaatcagggaaatttgaagtatagttctacctctgctcatcagc

SEQ ID NO: 17592 - DNA, 103 bp, Homo sapiens
  DISO7_10003095
  Located on chromosome 11
  Distance between a terminus base of telomere on chromosomal short arm and 5'-terminus of this base sequence : 74783704
  Distance between 3'-terminus of neighbour sequence of sequence listing upward to telomere on chrosomal short arm and 5'-terminus of this base sequence : 245510
agcatatctggatagggaggctgtgtgtgtgtgtgtgtgtgtgtgtgtgtgtgtgtgtgtgtgtgtgtgcgcgcgcgcgcatgtctgggtctctggatacaat

SEQ ID NO: 17593 - DNA, 418 bp, Homo sapiens
  AC019121.3_110189
  Located on chromosome 11
  Distance between a terminus base of telomere on chromosomal short arm and 5'-terminus of this base sequence : 74852348
  Distance between 3'-terminus of neighbour sequence of sequence listing upward to telomere on chrosomal short arm and 5'-terminus of this base sequence : 68541
gaaatcaccttattaagcagtttatagatcacccctatgattcatttgtttcatttgtccatgctcttttaagaattagatacacttttactttcttagtgtaactgtcctctttctcctagtgtatacagtcaaatttacagattgaggaataatctgggaacattttaatagggaatatctacacaaatgtttctttaaaaaatgttaaagacattttttagacattccctattaaatataatctaggataagtttataaatacacacacacacacacacacacacacacacctgtggttgcttgctctgtgcctttggcaggcattgctaatcaaagacatctctttttcccacagaacttgcacttgctcttcaaatccagcccagctcagcattctaggcagccactatagat

SEQ ID NO: 17594 - DNA, 229 bp, Homo sapiens
  DISO7_10003097
  Located on chromosome 11
  Distance between a terminus base of telomere on chromosomal short arm and 5'-terminus of this base sequence : 74900989
  Distance between 3'-terminus of neighbour sequence of sequence listing upward to telomere on chrosomal short arm and 5'-terminus of this base sequence : 48223
ggagcataggaagcctttatctatcacacacacacacgcacacacacacacacacgcacacacacacaccccttttaaacattttttccttaaattttttttttttttttttggtgctataacagattttactcatgtcaataaaaactgacaaacatgattatctgaaatctgtatgggtaactttttaaagatggagtacattttgattgtagcaacctccatattg

SEQ ID NO: 17595 - DNA, 101 bp, Homo sapiens
  DISO7_10003098
  Located on chromosome 11
  Distance between a terminus base of telomere on chromosomal short arm and 5'-terminus of this base sequence : 74941697
  Distance between 3'-terminus of neighbour sequence of sequence listing upward to telomere on chrosomal short arm and 5'-terminus of this base sequence : 40479
tgctacataatgtaatggatattgccatattcttcatcatcatcatcatcatcaccatcatcatcatcatcatcaccaccatctttcttagagaaggatga

SEQ ID NO: 17596 - DNA, 462 bp, Homo sapiens
  chr11.fa.O7frz.80245867
  Located on chromosome 11
  Distance between a terminus base of telomere on chromosomal short arm and 5'-terminus of this base sequence : 75006437
  Distance between 3'-terminus of neighbour sequence of sequence listing upward to telomere on chrosomal short arm and 5'-terminus of this base sequence : 64639
tgttagtggtatggctacaaacttaaaaggtgaattgagtgaaaatgttaaataatttgtggcattcttctttgtagttgatgagaacacagattaaaaataactttccaagagttgtatccatttaaagtatcaatgagaacttttatgtaagggaaaaatttttggatgtgatgctcatgacaaacatatccaaggaaatacagctctctgaactgaaaaaagttttgaaaactttattaaagactgatgacaaaggatgatgatcctgaaatggtctttgttgacaataaacttgtttcaagatctaaatccaaggtggcaacactttgcaaagacagataaccataaagctatttactgtcttatttactttgtctacaaggctaaaagtcaaaccacacacacacacacacacacacacacacacacacacaattaacatatgaattaaattcctgc

SEQ ID NO: 17597 - DNA, 161 bp, Homo sapiens
  D11S4119
  Located on chromosome 11
  Distance between a terminus base of telomere on chromosomal short arm and 5'-terminus of this base sequence : 75267955
  Distance between 3'-terminus of neighbour sequence of sequence listing upward to telomere on chrosomal short arm and 5'-terminus of this base sequence : 261056
ctgctctgcagtctggtttctttgcgagccgtgtgtgtgtgtgtgtgtgtgtgtgtgtgtgtgtgtgtgtgtgtgatggacattgtatttgaaaaaatatttgtgggaataaatttagacttgcaatgaaagttctgtagagaggatttgcgtttgcttct

SEQ ID NO: 17598 - DNA, 177 bp, Homo sapiens
  DISO7_00000397
  Located on chromosome 11
  Distance between a terminus base of telomere on chromosomal short arm and 5'-terminus of this base sequence : 75639290
  Distance between 3'-terminus of neighbour sequence of sequence listing upward to telomere on chrosomal short arm and 5'-terminus of this base sequence : 371174
aggaaccagacctgcaaccaggcctgcagccatgtattgtactggggcgcgtacacatacacacacacacacacacacacacacacacacacacacacacacacacacacacacacacacacactgacctgggccccccaccactatattcacacaccctggtccctatcagctgac

SEQ ID NO: 17599 - DNA, 358 bp, Homo sapiens
  chr11.fa.O7frz.78144138
  Located on chromosome 11
  Distance between a terminus base of telomere on chromosomal short arm and 5'-terminus of this base sequence : 75878239
  Distance between 3'-terminus of neighbour sequence of sequence listing upward to telomere on chrosomal short arm and 5'-terminus of this base sequence : 238772
caacttcctcaaagtgcagtggtcttcacgccagctgcccacggtgaggctgtgggcagggcccctgcttatgggtgagggcacagagaggggtacataagagtttattggagagcctgcctgggagggagtgtggggccagcagagagagagagagagagtgtgtgtgtgtgtgtgtgtgtgtgtgtgtgtatgggcatgggcatgagtgaggataaaggcgtttgctttattttgggagtgtggaaccttgttgcagtttgttcattcattcaggagatgcttcttgagcttttgctagatgtcaggtcctgtgttagctattgagaaaattaattagttacagtgatgctaggtg

SEQ ID NO: 17600 - DNA, 458 bp, Homo sapiens
  chr11.fa.O7frz.78363662
  Located on chromosome 11
  Distance between a terminus base of telomere on chromosomal short arm and 5'-terminus of this base sequence : 76076807
  Distance between 3'-terminus of neighbour sequence of sequence listing upward to telomere on chrosomal short arm and 5'-terminus of this base sequence : 198210
aaatcctgagactgacagactcaggccgctgaactccaaaaagagtcaaaataacagtactgtaaaaatgttgggaaactatccttcactatataaataaagaaattggtcagacgcggtggctcacgcctgtaatcccagtactttgggaggccaaggcgggtggatcaggaggtcaagagatcgagaccatcctgaccaacaactaaaaatacaaaaattagctgggtgtggtggcccgcacctgtagtcccagctacttgggaggctaaggcaggagaatagcttgaacccgggaggcggaggttgcagtgggccgagattgcgccactgcactccagcttggcgacagagcaagactccatctcagaaataaataaataaataaataaataaataaataaataaataaataaataaattgaggtcaagctggcattagaaccgagtcaggttgt

SEQ ID NO: 17601 - DNA, 375 bp, Homo sapiens
  DISO7_00031756
  Located on chromosome 11
  Distance between a terminus base of telomere on chromosomal short arm and 5'-terminus of this base sequence : 76160600
  Distance between 3'-terminus of neighbour sequence of sequence listing upward to telomere on chrosomal short arm and 5'-terminus of this base sequence : 83335
cctcaaatggctcaggtaatcggttaaaaccaagtgtatggggaaaggatctacagcaatctctgcttttttcaggacctacctctaagccacaagccacacacacacacacacacacacacacacacacacacacacacacatatcaattccatggaaagaaaacataaaagggcgagagcattttgttctcagacactattgtcagagagggacagggaccaaatcaaggatctgcaggagaccagatattgacaagtctgaactcggccctctgaagagcggaagaagggtctctgaaggtgaggaaattaggaatgtcccctgaggagacattggtattaggatggggctgggagacgatctgagggttgg

SEQ ID NO: 17602 - DNA, 217 bp, Homo sapiens
  D11S1314
  Located on chromosome 11
  Distance between a terminus base of telomere on chromosomal short arm and 5'-terminus of this base sequence : 76216356
  Distance between 3'-terminus of neighbour sequence of sequence listing upward to telomere on chrosomal short arm and 5'-terminus of this base sequence : 55381
ttgctacgcactcctctactcatacgtatatgcacaggctctcacacaaacacgcacacagacagatcaaaaggcaatcatatattcaatgcatatacaaggttgcacttagacatgcacatcacatacacacacacacacacacacacacacacacacacacacacagaactcaggctcgggatggggtgaaggaggtcacatttcctgccttcac

SEQ ID NO: 17603 - DNA, 304 bp, Homo sapiens
  DISO7_00031737
  Located on chromosome 11
  Distance between a terminus base of telomere on chromosomal short arm and 5'-terminus of this base sequence : 76334701
  Distance between 3'-terminus of neighbour sequence of sequence listing upward to telomere on chrosomal short arm and 5'-terminus of this base sequence : 118128
gttcacccacttccaaccccagagacagacagacagactttctcttctctatcctcttctctcttctaacctctctctctctctctctctctctttttctctctctctctcccccccacaagctgatggggttgaaatagaaaacgctcctgcatgcagaagaatggtcactagagggcgcaagggcaccaggaaccttcaatctgagcttccctccaggttcctggagagaccctatacctgttacgagttgtgtgaacccaggaagagcatgtaccctttttgtgcttctaccaatcaaccc

SEQ ID NO: 17604 - DNA, 316 bp, Homo sapiens
  chr11.fa.O7frz.88686373
  Located on chromosome 11
  Distance between a terminus base of telomere on chromosomal short arm and 5'-terminus of this base sequence : 76622466
  Distance between 3'-terminus of neighbour sequence of sequence listing upward to telomere on chrosomal short arm and 5'-terminus of this base sequence : 287461
tttcattagacttcatttctgaagggtatagaatctgctgaattgaattttggatagaaagtcttttgtttcagacctgttataatattactccataatttgtgtacacacacacacacacacacacacacacacacacacacacacacagagtaacagccatactagttctatcaggtacatgatataccaaatttttttaaacatcattttttggaaaaaagtaagaaaatgctaggcttcagattatttctagaaacacatttccagtaatttctagtatacagtaaagcataacaaagtctatgaggcagta

SEQ ID NO: 17605 - DNA, 155 bp, Homo sapiens
  G08897
  Located on chromosome 11
  Distance between a terminus base of telomere on chromosomal short arm and 5'-terminus of this base sequence : 76711022
  Distance between 3'-terminus of neighbour sequence of sequence listing upward to telomere on chrosomal short arm and 5'-terminus of this base sequence : 88240
aaggagagaaagagagaaagaggagaagaagggaagaagggaaggaaggaaggaaggaaggaaggaaggaaggaaggaaggaaggaaggaaggaaggaaggaagggaaagaaacccagttgttaaaaaatgcatgaattttatgtgtttgtgtat

SEQ ID NO: 17606 - DNA, 293 bp, Homo sapiens
  AC019134.5_80740
  Located on chromosome 11
  Distance between a terminus base of telomere on chromosomal short arm and 5'-terminus of this base sequence : 76857284
  Distance between 3'-terminus of neighbour sequence of sequence listing upward to telomere on chrosomal short arm and 5'-terminus of this base sequence : 146107
gtttacatattgtctaaggttgctgcttttattctaaaatgagagtggagtagttctgacagagactggtaactgtttggtcctcaaatcctaaaacatttattacctggtcctttacagaaaatatctgtcattctctgcctttgagattcaaaggagtgtgtgtgtgtgtgtgtgtgtgtgtgtgcgtgcacacctgtgcatgtgtgtgatgtgattcctgcttcccagcaacgttactctatagaaaaaatgtacaacattttgttgggtaactagctacctttgcagtg

SEQ ID NO: 17607 - DNA, 261 bp, Homo sapiens
  AP002382.1_68518
  Located on chromosome 11
  Distance between a terminus base of telomere on chromosomal short arm and 5'-terminus of this base sequence : 76944537
  Distance between 3'-terminus of neighbour sequence of sequence listing upward to telomere on chrosomal short arm and 5'-terminus of this base sequence : 86960
tcttcaagtgcattgattagacaataaaacaatatatgagtaccctttctctacacgtttatgatttgatcttcattgataaatcactgtatcttaactgggcccatacatcgtgtattataatttaaaatcaaattgtttgtattgacagaaagagtcccccgctacacacacacacacacacacacacacacacacacacacaatgattcaggaggtttaaatccaccttttctctataggcaaccatacttatactcc

SEQ ID NO: 17608 - DNA, 170 bp, Homo sapiens
  D11S901
  Located on chromosome 11
  Distance between a terminus base of telomere on chromosomal short arm and 5'-terminus of this base sequence : 76981437
  Distance between 3'-terminus of neighbour sequence of sequence listing upward to telomere on chrosomal short arm and 5'-terminus of this base sequence : 36639
tcctacattagcagttggcactatagatctaaatactgatgacgagttgatcaagtgtgtgtgtgtgtgtgtgtgtgtgtgtgtgtgtgtgtacatacaatcttccaatattttttgtgcctctgaagttagaaggtggccagaagaaagaggccagtaatctatgtggg

SEQ ID NO: 17609 - DNA, 216 bp, Homo sapiens
  chr11.fa.O7frz.89191618
  Located on chromosome 11
  Distance between a terminus base of telomere on chromosomal short arm and 5'-terminus of this base sequence : 77096632
  Distance between 3'-terminus of neighbour sequence of sequence listing upward to telomere on chrosomal short arm and 5'-terminus of this base sequence : 115025
attgtcgttcaatgagtatagaagttctgttttgcctgataaagaacttctggagattttctgtacaacattgtgcttatagttaatactaatgcactacatattcaaaaatggttaagatgacaaactttatgtttttagcacacatacacaaccataaacacacacacacacacacacacacacacacaaagagaaatctgtacttgcctagtg

SEQ ID NO: 17610 - DNA, 379 bp, Homo sapiens
  AP001179.3_120818
  Located on chromosome 11
  Distance between a terminus base of telomere on chromosomal short arm and 5'-terminus of this base sequence : 77096632
  Distance between 3'-terminus of neighbour sequence of sequence listing upward to telomere on chrosomal short arm and 5'-terminus of this base sequence : -216
attgtcgttcaatgagtatagaagttctgttttgcctgataaagaacttctggagattttctgtacaacattgtgcttatagttaatactaatgcactacatattcaaaaatggttaagatgacaaactttatgtttttagcacacatacacaaccataaacacacacacacacacacacacacacacacaaagagaaatctgtacttgcctagtgatgcagatggctaggaaagaagagaaaaagggactacaggaggacatgtggaaatatccaatataatacctccaactacacagcagaattttctttaaaagtatcagttttaaaaaatagaactatcaaattactagaagaaaacctggacaaattcttgtat

SEQ ID NO: 17611 - DNA, 180 bp, Homo sapiens
  DISO7_10003110
  Located on chromosome 11
  Distance between a terminus base of telomere on chromosomal short arm and 5'-terminus of this base sequence : 77273763
  Distance between 3'-terminus of neighbour sequence of sequence listing upward to telomere on chrosomal short arm and 5'-terminus of this base sequence : 176752
aataatgtaatacgtccataaggggaataccagaggagaaagagaaaagaaaagaaaaggaaagaaaagaaggaagggagagaagaaagcgaaggaaggaagggagggagggagggagggagggagggaagaagaaaagaagggaaatatttgaagcaataatgactaagaatttctcaa

SEQ ID NO: 17612 - DNA, 252 bp, Homo sapiens
  HUMUT636
  Located on chromosome 11
  Distance between a terminus base of telomere on chromosomal short arm and 5'-terminus of this base sequence : 77306591
  Distance between 3'-terminus of neighbour sequence of sequence listing upward to telomere on chrosomal short arm and 5'-terminus of this base sequence : 32648
ccaggttggtatcctagcaacaccaactgtcagctctgtgtgtgtgcgtgtgtgtgtgtgtgttgagagagagagagagacaatgcgcacgtgtatgtgtgtttatgagaaagtaaggtagggtgggtagattgcagatttccctagaatcttgaacatccagtggccaaactcgcaatgcaagtagctttaaacaacatcagacacttgcatttcatttccctgtgtgcagtgccacagttaacagcccat

SEQ ID NO: 17613 - DNA, 164 bp, Homo sapiens
  DISO7_10003111
  Located on chromosome 11
  Distance between a terminus base of telomere on chromosomal short arm and 5'-terminus of this base sequence : 77330914
  Distance between 3'-terminus of neighbour sequence of sequence listing upward to telomere on chrosomal short arm and 5'-terminus of this base sequence : 24071
aaatcacttccttcctgccctgctcccctatttcttttgctgctttaatttccccttttagtcttctttatcatctaacaaactatgtttgttttcgtgtgtgtgtgtgtgtgtgtgtgtgtgtgtgtgtgtgtgtgttttgttatggtctgtatatcccttgc

SEQ ID NO: 17614 - DNA, 418 bp, Homo sapiens
  chr11.fa.O7frz.89709337
  Located on chromosome 11
  Distance between a terminus base of telomere on chromosomal short arm and 5'-terminus of this base sequence : 77420464
  Distance between 3'-terminus of neighbour sequence of sequence listing upward to telomere on chrosomal short arm and 5'-terminus of this base sequence : 89386
acttccactttgataatgtgatactatcctctccctgattccacttttttctattgagttatctgtgctttctttatagatatgtagattacacacacacacacacacacacacacacacacacacccctcgtatttttgatccaacccgtttcttgtttttctgctagatttagggtaagcaatttatctgtgcctttgtttttcacctataaaatgaggggaaagatgctacctacctcatagagttgtcttgaggaataaattagttaatatagagatagcaattcaaagagtacctgaagtgccactaaagggttaatttttatttattacatggaaattcctatcaactaggcattattatactggatcttattcaatctcacaaaatcctaggtgatatcaagtttgtcatt

SEQ ID NO: 17615 - DNA, 397 bp, Homo sapiens
  AP000793.3_60555
  Located on chromosome 11
  Distance between a terminus base of telomere on chromosomal short arm and 5'-terminus of this base sequence : 77437593
  Distance between 3'-terminus of neighbour sequence of sequence listing upward to telomere on chrosomal short arm and 5'-terminus of this base sequence : 16711
atacctagaaagcaggttttaaactctaccctcagtcttatttataggcaatcaccacatattttcccaaatcctcagaggaaagaaacatttactgaagaactttaataatattgggaactcaccatcccagcctccctgatctgtatataatatatatatatataatatatataataactaatatttttcttagtatacctattcaatattcaatgctaagtcaggcacacacacacacacacacaccacacaccccttactggaaatacttttaaatgtgaagttattcttgatatctagcaaagagaacagggatggagaaaaagcacaaaatgtgagacagcccttacctaggattatccttgctgtaactccagcaaagaatgagtagata

SEQ ID NO: 17616 - DNA, 360 bp, Homo sapiens
  chr11.fa.O7frz.89827866
  Located on chromosome 11
  Distance between a terminus base of telomere on chromosomal short arm and 5'-terminus of this base sequence : 77548070
  Distance between 3'-terminus of neighbour sequence of sequence listing upward to telomere on chrosomal short arm and 5'-terminus of this base sequence : 110080
aatactagttacctccaaggaactgaaggaatgaatgcaaagaaaacgtttaccttctcactatatggctttctgtactacttgactatttttataatgagcatacattacctttacaatatacattgtgtgtgtgtgtgcgtgtgtgtgcgcttaaagcgagtcagtagacttggactgatggaatcatccaccttaggcctaatctcactgatactccctacactcatacactaaaattctactcaggttttattcattcatccattaacatttaagccccactgggtaccaggcatggtcattggatgcactaccctgttgaaaaccttcagtgacttactatcagccatgactgtc

SEQ ID NO: 17617 - DNA, 346 bp, Homo sapiens
  chr11.fa.O7frz.89921257
  Located on chromosome 11
  Distance between a terminus base of telomere on chromosomal short arm and 5'-terminus of this base sequence : 77641062
  Distance between 3'-terminus of neighbour sequence of sequence listing upward to telomere on chrosomal short arm and 5'-terminus of this base sequence : 92632
ttctaagattaacaatgccagaagaggtgggatttctctagttatttctcatgagtcagagccttttcctatgtaccctgagcattccttgtattatggtttatagtaatttttaaaattatactttactaatgtgtcataaaatcaatttagcaggccaagaccagatttttagaaataaaatctaaaacacaataaaaagtgtcaatcagagggcatctgaaatttttattacaattttacatgaatgtgtgtatgtgtgtgtgtgtgtgtgtgtgtgtgtgtgtgtgtgtgtgtgtgttgagtgataacaaaaaatatatttgttaccatagattgtaatcaa

SEQ ID NO: 17618 - DNA, 98 bp, Homo sapiens
  D11S1365
  Located on chromosome 11
  Distance between a terminus base of telomere on chromosomal short arm and 5'-terminus of this base sequence : 77730478
  Distance between 3'-terminus of neighbour sequence of sequence listing upward to telomere on chrosomal short arm and 5'-terminus of this base sequence : 89070
ggccgagccagttcttaaaatactgaaatatttccatatgagttggagaaaaactacctgtgcaacacacacacacacacacacagccctactgccac

SEQ ID NO: 17619 - DNA, 101 bp, Homo sapiens
  DISO7_10003115
  Located on chromosome 11
  Distance between a terminus base of telomere on chromosomal short arm and 5'-terminus of this base sequence : 77950308
  Distance between 3'-terminus of neighbour sequence of sequence listing upward to telomere on chrosomal short arm and 5'-terminus of this base sequence : 219732
aagcttgaccttaatttgctgtaaaacctgctcttgtacacataataataataataataataatataacaataataaatggagaagtgggtagaatacacc

SEQ ID NO: 17620 - DNA, 282 bp, Homo sapiens
  DISO7_10003116
  Located on chromosome 11
  Distance between a terminus base of telomere on chromosomal short arm and 5'-terminus of this base sequence : 77960080
  Distance between 3'-terminus of neighbour sequence of sequence listing upward to telomere on chrosomal short arm and 5'-terminus of this base sequence : 9671
ctggtgcaagtgttgtgggcattttgcatcctgcatgatgtaagataatttttctccctgaatgttttctttaaatctaggtaatttgaactagtataaacagcattggtggccaggtgtggtggctcatacctattatctcagcactttaggaggctgaggtgagaggatcacttgagcccaggaattcaagaccagcctgggcaacatagtgagaccctgcctctaaaataaaataaaataaaataaaataaaaatcattggttatcctatcagagatgt

SEQ ID NO: 17621 - DNA, 470 bp, Homo sapiens
  AP000594.3_101364
  Located on chromosome 11
  Distance between a terminus base of telomere on chromosomal short arm and 5'-terminus of this base sequence : 78043967
  Distance between 3'-terminus of neighbour sequence of sequence listing upward to telomere on chrosomal short arm and 5'-terminus of this base sequence : 83605
ctgtctgctcaagtccaagtttttaaaaataagtttcaccattgtctgtttcttgtctagttctagcctatttatccccttaatactttagtagtaggatttgtgtgtgagtgtgtgagagtgtgtgtgtgtgtgtgtgtgtgtgtgtgtgtggtttcttgaccatgtcctactgttcatgctgtttaggcctactcactgctcctacttgccttggcaaactcctgttaatccttgaagattctatcttagatgtaactttccccaggaatccttctgtgttccccttccctcctaccctggctgagtttgaagtcatctgtgcttccacaggttcctatgaatatttccatcgttgcttttaccacattattttgtattttgtgtttgtatcttctctactaatctgtgagttccttgagggtgtcttcatctttttatccttatggtagacaccagacttacgttga

SEQ ID NO: 17622 - DNA, 476 bp, Homo sapiens
  AP000594.3_80067
  Located on chromosome 11
  Distance between a terminus base of telomere on chromosomal short arm and 5'-terminus of this base sequence : 78095657
  Distance between 3'-terminus of neighbour sequence of sequence listing upward to telomere on chrosomal short arm and 5'-terminus of this base sequence : 51220
tggagtatgaacgactacgtagagaaaaattagaatgtcagcttgatgaatatcgagcagaagttgatcaactcagggaaacactggaaaaaattcaagtcccaaactttgtggctatggttggtgtcctttttaatacatttatttttctcaagaagtatatacaagagtggccaagagtacaagctttgggctggggctctttggacttgaatcctggctatagtcttttttgatttgggctactcatttaacctttttgtgcctcaactataaactggagatgataacttatactttctagagctgatgacaggattaaaggaatacacacacacacacacacacacacacacacacacacacactctatatgtaactataactttctagatacatacacacatctgtctatctatcttcaaacagcagcctagttcataagtattattgttaacattgtaccatagaaggag

SEQ ID NO: 17623 - DNA, 466 bp, Homo sapiens
  chr11.fa.O7frz.90844788
  Located on chromosome 11
  Distance between a terminus base of telomere on chromosomal short arm and 5'-terminus of this base sequence : 78340908
  Distance between 3'-terminus of neighbour sequence of sequence listing upward to telomere on chrosomal short arm and 5'-terminus of this base sequence : 244775
catcgttcagagttctactcacatattcccccttatcagtgaggctttttctgacaggcctgtctaaaattgtgctggccctattactatttgccttcctttgtcttttctttctttccttccttccttccttccttccttccttccttccttccttccttccttccttcctttctctctctttcaacatttatcaccatctgcctgcatacacatttgtttattttctgttttccccatggaaatgtaaactccctgaaaataagaaatgtgttttcatccactgccatctctctggtgccttagaacatgtacatatagtatatactcaataaatatttgttgaatgaatacatgctccaactccttttgtgtttccccacattctggcctttattgctctctattttttatcttttacttgactgtcttctactaaactgtagactggctccttaagtaaagt

SEQ ID NO: 17624 - DNA, 109 bp, Homo sapiens
  DISO7_10003120
  Located on chromosome 11
  Distance between a terminus base of telomere on chromosomal short arm and 5'-terminus of this base sequence : 78358738
  Distance between 3'-terminus of neighbour sequence of sequence listing upward to telomere on chrosomal short arm and 5'-terminus of this base sequence : 17364
tgtcttcctctcacttgctcaaacacacacacacagacacacacacacacacacacacacacattcttttctatctatgctgaattcatagcccagcaggttcattctt

SEQ ID NO: 17625 - DNA, 224 bp, Homo sapiens
  DISO7_10003119
  Located on chromosome 11
  Distance between a terminus base of telomere on chromosomal short arm and 5'-terminus of this base sequence : 78368220
  Distance between 3'-terminus of neighbour sequence of sequence listing upward to telomere on chrosomal short arm and 5'-terminus of this base sequence : 9373
tgcgttgtcatagatagaaagatagctaactagctaggtaggtaagtaggtaggcaggtagatagatagaaagacagacagacaggtaggtagataggtaggtaggtagatagatagatagatagatagatagaaagaaagacagacaggtaagtaggtaggtagatagatagatagatagatagatagatagatagatagatagagtgggctacacatggatg

SEQ ID NO: 17626 - DNA, 172 bp, Homo sapiens
  DISO7_10003121
  Located on chromosome 11
  Distance between a terminus base of telomere on chromosomal short arm and 5'-terminus of this base sequence : 78447799
  Distance between 3'-terminus of neighbour sequence of sequence listing upward to telomere on chrosomal short arm and 5'-terminus of this base sequence : 79355
aggctcatgtatacgtctatgccagttaaaataagctcatgatagagagattattcacacacacatcctatttttttcaaagatgaggaaaagatgagttcacacagctagctatagggtgtgtgtgtgtgtgtgtgtgtgtgtgtgtgtatgacattcaattccaggtctg

SEQ ID NO: 17627 - DNA, 383 bp, Homo sapiens
  AC018708.5_35080
  Located on chromosome 11
  Distance between a terminus base of telomere on chromosomal short arm and 5'-terminus of this base sequence : 78652148
  Distance between 3'-terminus of neighbour sequence of sequence listing upward to telomere on chrosomal short arm and 5'-terminus of this base sequence : 204177
tcataaagattcaacagttcttaacattttggtacatttgttctccctctcttcctccttctcactctctccacttacctacctatctgcctagcagaagacacacacacacacacacacacacacacagacacacactttttctgaaccatttgaattatgttgcagacgtcattccactttcaatctaacatatcagcaaggcatcttcccagtgtaaagacattttctgtataaccacaatgccattattactccagagaaagcaaacaaaactaatatttctataacatttaatatattgcacctattcaaatttcctccgttatcctccaaatgtcttttacagatttttttcttaaatccaggatttaagttttatg

SEQ ID NO: 17628 - DNA, 276 bp, Homo sapiens
  D11S4187
  Located on chromosome 11
  Distance between a terminus base of telomere on chromosomal short arm and 5'-terminus of this base sequence : 78697649
  Distance between 3'-terminus of neighbour sequence of sequence listing upward to telomere on chrosomal short arm and 5'-terminus of this base sequence : 45118
ctggtgctgtgcttggcgctggaaatataactataaatacaatttaggtcctgacttaatgggctctcatcctagggggacagggaggtaagtaaaaataactaattataataacattcattcatccgtaacatttggggtaagtgtgtgtgtgtgtgtgtgtgtgtgtgtgtgtgtgtgtttttttacttgagacggagtctcactctgtctcccaggctggagtgcagtggcgtgatcccggctcactgcaacctccgcttcccgggttcaaga

SEQ ID NO: 17629 - DNA, 423 bp, Homo sapiens
  chr11.fa.O7frz.91339593
  Located on chromosome 11
  Distance between a terminus base of telomere on chromosomal short arm and 5'-terminus of this base sequence : 78906000
  Distance between 3'-terminus of neighbour sequence of sequence listing upward to telomere on chrosomal short arm and 5'-terminus of this base sequence : 208075
aagaacagagttcaaagcattattcttaaaaattagtatgggccaggtacagtggctctcacctgtaatcccaacactttgggaggccaaagcaggaggattacttatgaccaggagttcaagaccagcctgggcaacaaagcaagggtctgtctctaccaaaaaacaaatacaataataataataataataataataataataataaccacatgcactagtgcatgcctgtagtcccagctatttgagaggctgagatgggaggatcacttgagcccaggagcttgaggcttcaatgagtcatgatcctgccactgcactctagcctgggcaacagagtgagaccctgccttaaaacaaaacaaaacaaaacaaaaaacaaacaaacaaaaattagggtggtaattcatctgtttctgcaac

SEQ ID NO: 17630 - DNA, 356 bp, Homo sapiens
  chr11.fa.O7frz.91492499
  Located on chromosome 11
  Distance between a terminus base of telomere on chromosomal short arm and 5'-terminus of this base sequence : 79065777
  Distance between 3'-terminus of neighbour sequence of sequence listing upward to telomere on chrosomal short arm and 5'-terminus of this base sequence : 159354
tgagctgagattgtgccactgcactccagcctgggtgacagtgcaggctctgctgaagaaagagagaaagaaaaagaaacaaagaaggaaaggaaggaaggaaggaaagaaaggaaggaaggaaggaaaggaaggaaggaaggaaggagggagggagggaaaaagggagagagagaaagagagaaagagaaagaaagagagagagagaaagaaagagaaggaaagaagggaaggaaggaaagagagagcgagagaaagggagaaagggagggagggagggagggagggaggaaggaaggaaggattgacagaaggatggacctgggaagcaagcttccaaataagagcgtatttcc

SEQ ID NO: 17631 - DNA, 426 bp, Homo sapiens
  AC019139.5_118694
  Located on chromosome 11
  Distance between a terminus base of telomere on chromosomal short arm and 5'-terminus of this base sequence : 79090409
  Distance between 3'-terminus of neighbour sequence of sequence listing upward to telomere on chrosomal short arm and 5'-terminus of this base sequence : 24276
tgaatcactgaacttttaagaaagctttcagtaattgctgacatttgcctccatgtgtatcatgtttaagagtcttcaaagttaagcttttaagagccatgagaacagggatcatgtctccatgtgagcatatcccacaattcctggagagtgctgactatttagaagatttgaaaatagtcaacttaaaaaaggaggaaattaaaccaacacacaaaaattggaaggatagttttgatgattaattaggttctctctctctctctctctctctctatatatatatatatatatatacactctcacatataaagaacctagagtataatcatttcttgataacaaattagctcccttatctcttctatttctttcttattatgtattgcctacaacagctctgtctgatagaactttctggaataa

SEQ ID NO: 17632 - DNA, 342 bp, Homo sapiens
  chr11.fa.O7frz.91745036
  Located on chromosome 11
  Distance between a terminus base of telomere on chromosomal short arm and 5'-terminus of this base sequence : 79290310
  Distance between 3'-terminus of neighbour sequence of sequence listing upward to telomere on chrosomal short arm and 5'-terminus of this base sequence : 199475
cacctatctaacaaacttgcacattctgcacatgtatcccagaacttaagtataattaaaaaaaaagaaagaaagaaagaaagaaagaaagaaatttcagtgaagaatggccttgttacaaatgtatgatgctcagggataaaattactgattttcggtatttatatgatataaactcactaataaatattagctggaaaaagtgcaataattagtgctaatgtatattaaaaagcaaagcaaaggaatagctacatgtctttgcatgttttatcactatggacaataggaaaaaattgtcactatgaatttatatgtatatcacagtcaatgctacaaact

SEQ ID NO: 17633 - DNA, 354 bp, Homo sapiens
  AP001791.3_69388
  Located on chromosome 11
  Distance between a terminus base of telomere on chromosomal short arm and 5'-terminus of this base sequence : 79362849
  Distance between 3'-terminus of neighbour sequence of sequence listing upward to telomere on chrosomal short arm and 5'-terminus of this base sequence : 72197
gcagtgaggagtccttatctaccagttattacttaaatataaatagattaaattatccaaccaaattacgtagattggctgaatgaacttaaatacacacacacacacacacacacacacacacacacacacaccccaaatatatgcagcctacgaaaccccactttaagtaattgtaagaacacacatagactaaaagtgaaggaatggaaaaagatattttatgcatatgaaaatcaaaagaaaggaagaattacacatatatcagataaaatagactttaagtaaaaaaatcataaaaagagataaaggttattatataatgataaggggttcaattcagcaagaacatac

SEQ ID NO: 17634 - DNA, 113 bp, Homo sapiens
  D11S4135
  Located on chromosome 11
  Distance between a terminus base of telomere on chromosomal short arm and 5'-terminus of this base sequence : 79397755
  Distance between 3'-terminus of neighbour sequence of sequence listing upward to telomere on chrosomal short arm and 5'-terminus of this base sequence : 34552
tttccaagtattgtaaaacgagcctatacacacacacacacacacacacacacacacacacatacacacacatgcatgtatatgctcaattcagccttatcaccattacaggg

SEQ ID NO: 17635 - DNA, 343 bp, Homo sapiens
  chr11.fa.O7frz.92198243
  Located on chromosome 11
  Distance between a terminus base of telomere on chromosomal short arm and 5'-terminus of this base sequence : 79478582
  Distance between 3'-terminus of neighbour sequence of sequence listing upward to telomere on chrosomal short arm and 5'-terminus of this base sequence : 80714
tgtctgtttcaggaaatatgacgccaattctatgaacttggtctgggtgattcttaaatgcatttctctctctctctctctctctctctctctctctctctctcacacacacacacacacacacacacacacacacacacacagaaaccacgttttgtttctactgtgagccatccccacagagtatcagtgtagaaaaatgctgttgaatggtaaacaaggctaccaaaagtaatggcagggagtacattgcaaataattcactagattatgtgtgctccttatggagcagagactctatcttttccatttttatttctctcaggcttagaccagtaattag

SEQ ID NO: 17636 - DNA, 227 bp, Homo sapiens
  D11S4147
  Located on chromosome 11
  Distance between a terminus base of telomere on chromosomal short arm and 5'-terminus of this base sequence : 79666689
  Distance between 3'-terminus of neighbour sequence of sequence listing upward to telomere on chrosomal short arm and 5'-terminus of this base sequence : 187764
accagggcctttttacacatacatacactggcccacactccctcactcacaaatacacacacacacacacacacacacacacacaatttcgtttgatgcttacaacaatctagtaaaggtacacagagaacagaagaaagcctctaaaagatcaacttgctgtaagtctcacaatagaaagtatgtggtatttaaacctatatctacctgactctgaagtctatgat

SEQ ID NO: 17637 - DNA, 177 bp, Homo sapiens
  D11S1354
  Located on chromosome 11
  Distance between a terminus base of telomere on chromosomal short arm and 5'-terminus of this base sequence : 79809155
  Distance between 3'-terminus of neighbour sequence of sequence listing upward to telomere on chrosomal short arm and 5'-terminus of this base sequence : 142239
tccctacctccaagttatatcctaagaattgtatctttgtgtgtgtgtgtgtgtgtgtgtgtgtgtgtgtgtgtgtgtatgtgtatgcatgcactaagatgctttgtaagcacttgtttgttcattagttcattcatccattcaccatcatttatgaaactcctgtcatgtgccaaa

SEQ ID NO: 17638 - DNA, 283 bp, Homo sapiens
  chr11.fa.O7frz.92565903
  Located on chromosome 11
  Distance between a terminus base of telomere on chromosomal short arm and 5'-terminus of this base sequence : 79973410
  Distance between 3'-terminus of neighbour sequence of sequence listing upward to telomere on chrosomal short arm and 5'-terminus of this base sequence : 164078
ttggtctaaagactaaacgtgtttttattaaattcaagtaccttcaatgtcccagacattatacacacacacacacacacacacacacacacacacacacaagaaaaaggaacacagttcctttccttatggagtttctgtctagtcaaaagaaagacaaaataatcacacaaatcagtatgcactatgagttgctatgtgtggaaatgtggcataaaaatcagagtgtactccaagaatacataaaattttaggaaaggtagtgacatgtaaggtgacatct

SEQ ID NO: 17639 - DNA, 369 bp, Homo sapiens
  AC025330.3_15793
  Located on chromosome 11
  Distance between a terminus base of telomere on chromosomal short arm and 5'-terminus of this base sequence : 79998224
  Distance between 3'-terminus of neighbour sequence of sequence listing upward to telomere on chrosomal short arm and 5'-terminus of this base sequence : 24531
gcctactttagatacttcataggagtggaatcatacagtgtttgtccttttgtgactggcttattttgcttagcataatgccctcaaggtccattcatgttagcatatgataggatttccttttgttcctaaggctacatagtgtgtgtgtgtgtgtgtgtgtgtgtgtgtgtgtgtgtgtgtgtgtgtgtgtaacattttctttatccattcttctgttaacggacatttgggttgcttccaccacttgagtattgcaaataaggctgtgatgaccatggctgtgtaaatatttcttcaagatcctgctttgaattcttttggatatttacccagaggtggaattgctggatcgtacggtatttctat

SEQ ID NO: 17640 - DNA, 113 bp, Homo sapiens
  DISO7_10003128
  Located on chromosome 11
  Distance between a terminus base of telomere on chromosomal short arm and 5'-terminus of this base sequence : 80064942
  Distance between 3'-terminus of neighbour sequence of sequence listing upward to telomere on chrosomal short arm and 5'-terminus of this base sequence : 66349
tataccgcagatcccaccatcacctagattctctctctctctcacacacacacacacacacacacacacagagtttcaatcatgcacacagagtcaattatacacaattgcta

SEQ ID NO: 17641 - DNA, 126 bp, Homo sapiens
  DISO7_10003127
  Located on chromosome 11
  Distance between a terminus base of telomere on chromosomal short arm and 5'-terminus of this base sequence : 80073890
  Distance between 3'-terminus of neighbour sequence of sequence listing upward to telomere on chrosomal short arm and 5'-terminus of this base sequence : 8835
gagcacatttattagacatgtgggtggatggatggatggatggatggatggatgcatagatggatgcatggatggatagataaatgtaaaaaatagggagaaagctataagacaaaccaggatgtt

SEQ ID NO: 17642 - DNA, 102 bp, Homo sapiens
  DISO7_10003126
  Located on chromosome 11
  Distance between a terminus base of telomere on chromosomal short arm and 5'-terminus of this base sequence : 80115515
  Distance between 3'-terminus of neighbour sequence of sequence listing upward to telomere on chrosomal short arm and 5'-terminus of this base sequence : 41499
cacaacgatctcagacaactgtgatgacttttgtatgtgtgtgtgtgtgtgtgtgtgtacgtatgtgtgtgttcctgctttcctttgctatcaggctgtcag

SEQ ID NO: 17643 - DNA, 441 bp, Homo sapiens
  chr11.fa.O7frz.93078611
  Located on chromosome 11
  Distance between a terminus base of telomere on chromosomal short arm and 5'-terminus of this base sequence : 80204733
  Distance between 3'-terminus of neighbour sequence of sequence listing upward to telomere on chrosomal short arm and 5'-terminus of this base sequence : 89116
agtaggtgctcaataaattgtaactattagtactttttaaaatgatttttagaaggtgaggacaggaggagaagcaagtcacagagcagcctgcatttccttttcactatgcatacctccaaaaagataaggtttgagagcaacctatcagattcctttcaatatcctctttgtgtgtgtgtgtgtgtgtgtgtgtgtgtgtgtgtgtgtgtgtgtgtgtgttcatgccattctcctgcctcagcctcccgggtagctgggactacaggtgcccgccaccatgcccagctaattttttgtatttttagtagagaagggttttcaccgtgttagccaggatggtctcaatctcctgacctcgtgatccacccacctcagcctcccaaagtgctgggattacaggcgtgagaatatcctctctcctttaagtagttggaggtg

SEQ ID NO: 17644 - DNA, 423 bp, Homo sapiens
  AC009547.4_8600
  Located on chromosome 11
  Distance between a terminus base of telomere on chromosomal short arm and 5'-terminus of this base sequence : 80430663
  Distance between 3'-terminus of neighbour sequence of sequence listing upward to telomere on chrosomal short arm and 5'-terminus of this base sequence : 225489
tagaaacaatatcagctagaacctggggaatcaagaactagaaaccaggggaaaaaaaaaatatatatatatatatatataatatatgtgatgtgtgtgtgtgtgtgtgtgtgtgtgtgtgtgtgtgtgtgtgtatatatatatatatatatatatatatatatatatatatgttttgtttgtttttaaacagggtctcactctgttgcccaggctggagtgcagtggtgtgatcagagctcactgcagcctcaacctcccaagctcaaggaatcctcccacctcagcctcccaagaagttagaacaacacacatgcatcaccatgaccagctttttgttgttgttgttgctcctgttgttgttgttgttgttgagacagggtctcacaatgttacccaggttggtcttaaactcctggcctc

SEQ ID NO: 17645 - DNA, 330 bp, Homo sapiens
  AP000642.4_164331
  Located on chromosome 11
  Distance between a terminus base of telomere on chromosomal short arm and 5'-terminus of this base sequence : 80517013
  Distance between 3'-terminus of neighbour sequence of sequence listing upward to telomere on chrosomal short arm and 5'-terminus of this base sequence : 85927
catctgtctagaattgcaagaccaaagcaagaaaataatttattcagtcattctacacacacacacacacacacacacacacacacacacactcacacacaatctactttgagctagatcttgttataagcattgtggatataatgatgggcaaggttgataaagttcttgtggagccgactttgtaatgagagaagatagcaaataggaaagttttataaaaatgctatacagagatttgttaaagggtcacccaattgaaaataaatctataattattttagattggatagtcaatggacaattctctgaggaaataagatttcagct

SEQ ID NO: 17646 - DNA, 256 bp, Homo sapiens
  D11S1979
  Located on chromosome 11
  Distance between a terminus base of telomere on chromosomal short arm and 5'-terminus of this base sequence : 80756101
  Distance between 3'-terminus of neighbour sequence of sequence listing upward to telomere on chrosomal short arm and 5'-terminus of this base sequence : 238758
gcacccgtggaggctgaggcaggagaatcgcttgaacctgggaggtggaggctgtggtcagccaagatcacgccactgcattccaacctgggcaacacagcatagactagatgattagatagatagatagatagatagatagatagatagatagatagatagatagatagatagacagatagaattcatggccgggtggctcatgcctgtaatcccagcacttcgggaggccgaagcaagcagcttgcttgaagcc

SEQ ID NO: 17647 - DNA, 129 bp, Homo sapiens
  DISO7_10003129
  Located on chromosome 11
  Distance between a terminus base of telomere on chromosomal short arm and 5'-terminus of this base sequence : 80809456
  Distance between 3'-terminus of neighbour sequence of sequence listing upward to telomere on chrosomal short arm and 5'-terminus of this base sequence : 53099
ttcaacattcaaatcctatagaggatttctttgctggtgccaagtgatttcatttctttctacctatttatttatttatttatttatttatttattttcggaaaagcactacagagaatgaacagccaa

SEQ ID NO: 17648 - DNA, 150 bp, Homo sapiens
  DISO7_10003130
  Located on chromosome 11
  Distance between a terminus base of telomere on chromosomal short arm and 5'-terminus of this base sequence : 80816557
  Distance between 3'-terminus of neighbour sequence of sequence listing upward to telomere on chrosomal short arm and 5'-terminus of this base sequence : 6972
atctgttgttaaacaattccatgaaaatatctaaaaaatacagaaaaatgactcaacacacacacacacacacacacacacacacacacacacacacacacacacggagaaaagggtatgtgtataggaattcataagttcaaagctaca

SEQ ID NO: 17649 - DNA, 257 bp, Homo sapiens
  D11S4197
  Located on chromosome 11
  Distance between a terminus base of telomere on chromosomal short arm and 5'-terminus of this base sequence : 81057140
  Distance between 3'-terminus of neighbour sequence of sequence listing upward to telomere on chrosomal short arm and 5'-terminus of this base sequence : 240433
tagtagaatctcataggttctgtggggtgtgtgtgtgtgtgtgtgtgtgtgtgtgtgttcatgagaagtttggtttggtaggtgcagaagtttggctttagtggatgtagaagtaagtctagggttttttccctgaaatattccaggtctaggtttagtccttgctttgttctttctcctcgatattccatattccttacttccttcaagtaaacttcaagtaaactcactgtttttggaaaccaacattgacctca

SEQ ID NO: 17650 - DNA, 267 bp, Homo sapiens
  AP000486.4_115712
  Located on chromosome 11
  Distance between a terminus base of telomere on chromosomal short arm and 5'-terminus of this base sequence : 81231230
  Distance between 3'-terminus of neighbour sequence of sequence listing upward to telomere on chrosomal short arm and 5'-terminus of this base sequence : 173833
tacgttcttgttctcagtagctctttatactatctctgtcccaacagaagttgcagcaattctcagcaaagaatattagtatatatgtttctctctctttctctttctctctctctctctgtctctctctctctctgtgtgtgtgtgtgtgtgtgtgtgtgtatacatatatacaatatgactaatcaagggaattgtaagtatggcagaagaatcagatatgctcatgtgagttgagtagttatgtttagaggtcaaatctggttc

SEQ ID NO: 17651 - DNA, 246 bp, Homo sapiens
  D11S1789
  Located on chromosome 11
  Distance between a terminus base of telomere on chromosomal short arm and 5'-terminus of this base sequence : 81231264
  Distance between 3'-terminus of neighbour sequence of sequence listing upward to telomere on chrosomal short arm and 5'-terminus of this base sequence : -233
tctgtcccaacagaagttgcagcaattctcagcaaagaatattagtatatatgtttctctctctttctctttctctctctctctctgtctctctctctctctgtgtgtgtgtgtgtgtgtgtgtgtgtatacatatatacaatatgactaatcaagggaattgtaagtatggcagaagaatcagatatgctcatgtgagttgagtagttatgtttagaggtcaaatctggttctcaatttcctggt

SEQ ID NO: 17652 - DNA, 410 bp, Homo sapiens
  AP002827.2_91149
  Located on chromosome 11
  Distance between a terminus base of telomere on chromosomal short arm and 5'-terminus of this base sequence : 81250902
  Distance between 3'-terminus of neighbour sequence of sequence listing upward to telomere on chrosomal short arm and 5'-terminus of this base sequence : 19392
actatccattcttcaatccaaggagtgataaaattgctcttgtaataatgagaaagctacaaagggttggatgactattgcctaggcttcaggcagcagagaaagttggaaattggctgtgtttttataacattactagctgagaaacctttcctatacacgaaggcctaggtgaacatgtgccattttagatgtttaaagagcgaatggtgtgtgtgtgtgtgtgtgtgtgtgtgtgtgtgtgtgtgtgtgaatacacgtttgcaaaatatttgaaatagggccttatggactacagcgaattgttatttttagcagaattctccaaaagatgataatgcaacaatgattactaaaaaaaaaaactttatctgaagttggtttgctcctcatggaaactattagactaa

SEQ ID NO: 17653 - DNA, 168 bp, Homo sapiens
  D11S4186
  Located on chromosome 11
  Distance between a terminus base of telomere on chromosomal short arm and 5'-terminus of this base sequence : 81298501
  Distance between 3'-terminus of neighbour sequence of sequence listing upward to telomere on chrosomal short arm and 5'-terminus of this base sequence : 47189
gggcagtaatgatgatgtgtttcagagattatcctggagcaacagggtgtgtgtgtgtgtgtgtgtgtgtgtgtgtgtgtgtgtgtgtaggagagggagggagggatagaggaaagaagagaggaaggaagaggggtaggaagtagatgagcgatagattgggagaat

SEQ ID NO: 17654 - DNA, 435 bp, Homo sapiens
  chr11.fa.O7frz.83753696
  Located on chromosome 11
  Distance between a terminus base of telomere on chromosomal short arm and 5'-terminus of this base sequence : 81476292
  Distance between 3'-terminus of neighbour sequence of sequence listing upward to telomere on chrosomal short arm and 5'-terminus of this base sequence : 177623
ccactagaatgactaaagtgaaacacacacacagacacacacacacacacacacacacacacacaatctcaagtagagctcttatgcattagtggtaggaggacaaattggtataatcactttgcgaaaccatttgactatatctagaaaacctgaggaaataatataatcatgtgttcatataatctagtaattctaagaatatgtccaatagaaatgcatggacatattcaccaaaaaccatgtacaagaatgtctattgcaatagtatttgttagagctgaaaatgagaaacaagctaaatgttcatcaatgaaagaacagatcaataagttcttgtatattcatataatagaatagtaaacaataacgaaaatgaacaaattgttgttgcacacaaccctatggatggatcttacaagcatattaagcaaa

SEQ ID NO: 17655 - DNA, 407 bp, Homo sapiens
  AP000752.3_53805
  Located on chromosome 11
  Distance between a terminus base of telomere on chromosomal short arm and 5'-terminus of this base sequence : 81488314
  Distance between 3'-terminus of neighbour sequence of sequence listing upward to telomere on chrosomal short arm and 5'-terminus of this base sequence : 11587
aacgtcgcacctgttaatgatcttttgtcctatttcgcctctggtcccctaggccagtcttccgagaccccaacgcaaaggaacagaggtgggaactctgaggtctgagaaacaaagatccattccctcccagaccactcccccacactcccgcaacacacacacacacacacacacacacacacacacacacgtgcgcccgccctgcagtcaaggagaaaagccccctttcaacctggggagtagtgccaagaagcggataggctggggcagtaggagcctcggccctgccccttccccaggcctgggtggtggagcacccagaaggggttggtggattgcagggatgaaaggggggttaagcagggaagagaaggggggaactgtaaggaagatgagaggaagtg

SEQ ID NO: 17656 - DNA, 441 bp, Homo sapiens
  AC068081.2_150609
  Located on chromosome 11
  Distance between a terminus base of telomere on chromosomal short arm and 5'-terminus of this base sequence : 81607626
  Distance between 3'-terminus of neighbour sequence of sequence listing upward to telomere on chrosomal short arm and 5'-terminus of this base sequence : 118905
gaagatagcattcacaatagaaacaaaatgcactatcatattagaggggtagtagagtgcagtaattgagagcatgaaccttggaaagttgtcctaagaagtttggactttatccttatactgataagaagccatttaggttatttaaaaagagcgttttaaattgttccccatctaccctcaagggaacagatcattctctaatttatctgttaactagtatgtaaccttattatagtaacctacacacctacacacacacacacacacacacacacacacacacacacacacacacacacacagagtgagccagaatggagctacagcaataacagaatggtaataccaaaaatgagactagatgttataatcttttataccttttttcttagaaaataatttgttattcaattattgtctaattctagctccagccta

SEQ ID NO: 17657 - DNA, 385 bp, Homo sapiens
  chr11.fa.O7frz.83487533
  Located on chromosome 11
  Distance between a terminus base of telomere on chromosomal short arm and 5'-terminus of this base sequence : 81748884
  Distance between 3'-terminus of neighbour sequence of sequence listing upward to telomere on chrosomal short arm and 5'-terminus of this base sequence : 140817
cctttgagtcactcagcatgctgttggctttgtctcagagttttattattcttgtcatctctcaccccatcccctagagaaagggcttcccaccaaatgacttagcctcctgccagggctaagcaggctcctccggcaggtctaccaatcaagttattatacgcaacctttttttcttctttcttttcttccttctctctctctctgtccttccttccttccttccttccttccttccttccttcattccttccctccttccctcccttccttccctccttccctcccttccctctcctttccttccttccttcccactccttccttaatttctttctttctttctttttctttcttttttttctcctttcaactcaaatcactc

SEQ ID NO: 17658 - DNA, 163 bp, Homo sapiens
  D11S2011
  Located on chromosome 11
  Distance between a terminus base of telomere on chromosomal short arm and 5'-terminus of this base sequence : 81851367
  Distance between 3'-terminus of neighbour sequence of sequence listing upward to telomere on chrosomal short arm and 5'-terminus of this base sequence : 102098
catctgtctgtccatctgtccaaccatccatctgtttgtctattatctatctatctatctatctatcatctatctatctatctatctgtctgtctgtctgtctatctttgagaagaacaaagaatctcacagcgttgttgtgagacccagtgcaataggattg

SEQ ID NO: 17659 - DNA, 236 bp, Homo sapiens
  D11S4179
  Located on chromosome 11
  Distance between a terminus base of telomere on chromosomal short arm and 5'-terminus of this base sequence : 81870689
  Distance between 3'-terminus of neighbour sequence of sequence listing upward to telomere on chrosomal short arm and 5'-terminus of this base sequence : 19159
gaaaatgttctgcctgagggctgctgtgcccacagacgccagggtgcccctgtgtgtgtgtgtgtgtgtgtgtgcgtgtgtgtgtaagagacaagaggtatgtaaggatgtgatggtgattgtagaattggctttgggagatgccactgcctgtccctacttgtgcaactttgggcctaacctttctatgcctcagtttcctgaaatgcaaaacggagccagttactcttacatcc

SEQ ID NO: 17660 - DNA, 230 bp, Homo sapiens
  Z18754.1_413
  Located on chromosome 11
  Distance between a terminus base of telomere on chromosomal short arm and 5'-terminus of this base sequence : 81886601
  Distance between 3'-terminus of neighbour sequence of sequence listing upward to telomere on chrosomal short arm and 5'-terminus of this base sequence : 15676
ttcctcaataggtgattgtgagaattaaatgagatgatataggtcaagtgcttagaagactaacatccttaaatgtaggggtgggcttattgtggtagtagtcattgccccccgtacccctgctctttctctctcactctctctctctctctcacacacacacacacacacacacacacacacacacacacacattctttggcacttttctgagttggactcctgagagt

SEQ ID NO: 17661 - DNA, 270 bp, Homo sapiens
  Z67569
  Located on chromosome 11
  Distance between a terminus base of telomere on chromosomal short arm and 5'-terminus of this base sequence : 82037088
  Distance between 3'-terminus of neighbour sequence of sequence listing upward to telomere on chrosomal short arm and 5'-terminus of this base sequence : 150257
acaaagatagtcatggcttccatttaattacttgttctaataaaaagaactttctagaaagtactttggaagcattaacttgcattctaggatatttatacagaggaagtaagaattccacaaaataatttatgtataataatgttcgtcatagaattatttataatgacacacacacacacacacacacacaagacagcctataagtaacctaaaacttgctacaataagaaaatggttaaatatgaggggggcatgtcaaactacatt

SEQ ID NO: 17662 - DNA, 445 bp, Homo sapiens
  chr11.fa.O7frz.83118413
  Located on chromosome 11
  Distance between a terminus base of telomere on chromosomal short arm and 5'-terminus of this base sequence : 82122307
  Distance between 3'-terminus of neighbour sequence of sequence listing upward to telomere on chrosomal short arm and 5'-terminus of this base sequence : 84949
gactgatgctatgtcagtgtaagtttattgattgtagcaagcacaccgctttggtgcaggatgttgatagtgagggaggttgtgcatgtatggggatgggatatacacaatatccccaattttgctatgaacttaaaatttctctaaaaaatcaagttgattaattttttaaaaagtgaaaattaaaacagggcaggcatggtggctcatgtctgtaatcccagcagtttgggaggctgaggcaggaggatcacctgagcccaggaatccgagaccagcttgggcaacatgacaaaaccctgtctctactatatatatatatatatatatatataaaattatccaagtttgatggcatgcacccatggtcccagatacttaggaagctgaagcagaaggatcacttgagcccaggaggtggaggctgaaatgagacatccttgtt

SEQ ID NO: 17663 - DNA, 252 bp, Homo sapiens
  AP002000.3_74767
  Located on chromosome 11
  Distance between a terminus base of telomere on chromosomal short arm and 5'-terminus of this base sequence : 82219667
  Distance between 3'-terminus of neighbour sequence of sequence listing upward to telomere on chrosomal short arm and 5'-terminus of this base sequence : 96915
gtcatttactttgacagagcagtgtttcccaggaatgtttgaccatggagaatctcagatcagtggcctgaggaatgcacttcaggaaaagctgggaggtgtgtgtgtgtgtgtgtgtgtgtgtgtgtgtgtgtgtgtacaggaaggtgagggcatttgtacttgcttctggaggtggtgatccccaacatctaatacacagaatactagtcctcagggatgctgtattagtctattcttgcattgctgtag

SEQ ID NO: 17664 - DNA, 252 bp, Homo sapiens
  D11S2013
  Located on chromosome 11
  Distance between a terminus base of telomere on chromosomal short arm and 5'-terminus of this base sequence : 82291874
  Distance between 3'-terminus of neighbour sequence of sequence listing upward to telomere on chrosomal short arm and 5'-terminus of this base sequence : 71955
tagatatataaccattagggccagatagatagataggtagatacagatcgatctatctatctatctatctgtctatctatctatctatctatctatctacctatctatctatcaccattagggctgcttctccaggtcagactttatccccagtaagtcccctagaagaatggccattagggctagattatctatcatccccagaaactagtgcctttacagcatcattatatggttggatcaagtcatatc

SEQ ID NO: 17665 - DNA, 356 bp, Homo sapiens
  chr11.fa.O7frz.82683803
  Located on chromosome 11
  Distance between a terminus base of telomere on chromosomal short arm and 5'-terminus of this base sequence : 82502530
  Distance between 3'-terminus of neighbour sequence of sequence listing upward to telomere on chrosomal short arm and 5'-terminus of this base sequence : 210404
aacaggacctggataggaggttattgcaaaatccaggccagaaataacagttttggttagggttccagaagtagagaggaagatatgtgaatagatatgtgggaagaactgaaagaattttgtgatggattgattgttacaaaatggtaaagaggggaggagtcaaagatgaccctttcgtttctcaattgagaaacgaggcagatggcggtatctgtgaattgtgatgggaaacacgggagaaggagcaggtgcatatttatttttgtgtgtgtgtgtgtgtgtgtgtgtgtgtgtgtgttttgagacagagtctcactctgttgcccaggctggagtgcagtggtatgatctgg

SEQ ID NO: 17666 - DNA, 213 bp, Homo sapiens
  D11S1321
  Located on chromosome 11
  Distance between a terminus base of telomere on chromosomal short arm and 5'-terminus of this base sequence : 82604684
  Distance between 3'-terminus of neighbour sequence of sequence listing upward to telomere on chrosomal short arm and 5'-terminus of this base sequence : 101798
agctgagatcgcaccattgtactccagcctaggcaacaagagcgaaactccatctcaaaaaaacaaacaaacaaacaaacaaacaaaaaatatatacacacacacacacacacacacacacacacacacatttcagattatagaaagaatcattcatacatactcaattttttaataaggaaaagaaaaactttgtcaacaaatggcagtgaa

SEQ ID NO: 17667 - DNA, 102 bp, Homo sapiens
  DISO7_11575117
  Located on chromosome 11
  Distance between a terminus base of telomere on chromosomal short arm and 5'-terminus of this base sequence : 82837098
  Distance between 3'-terminus of neighbour sequence of sequence listing upward to telomere on chrosomal short arm and 5'-terminus of this base sequence : 232201
tcactacagaattgtgggggagtttctgaggaagtacgtgtgtgtgtgtgtgtgtgtgagagagagagagagaaagagagatggctactgagcaatgtgttc

SEQ ID NO: 17668 - DNA, 167 bp, Homo sapiens
  DISO7_00000403
  Located on chromosome 11
  Distance between a terminus base of telomere on chromosomal short arm and 5'-terminus of this base sequence : 82915873
  Distance between 3'-terminus of neighbour sequence of sequence listing upward to telomere on chrosomal short arm and 5'-terminus of this base sequence : 78673
cagaattaagcatgatctagggaaagacgtgtgagagagtgtgtgtgtatgtgtgtgagtgtgtgtgtgggggggtgggggttggttggggaggggtgtatgcaagggactggataactcagattgtcccttcagcctgttccccacccccagtgctgacaaccatc

SEQ ID NO: 17669 - DNA, 338 bp, Homo sapiens
  AP000584.3_56432
  Located on chromosome 11
  Distance between a terminus base of telomere on chromosomal short arm and 5'-terminus of this base sequence : 83021017
  Distance between 3'-terminus of neighbour sequence of sequence listing upward to telomere on chrosomal short arm and 5'-terminus of this base sequence : 104977
tatcaacttaactggtagctgttcccaacagtggaggggctcaaaaaaaaagagcgccagtagggaggggacccacctgcatgggtccttcagtggcctcaccttcaggggataaaaccacagtgtgaaagtgtaaaaatgtttagtacttacacaccctggagggcacaacagaggtgtctctgtctctctctcacacacggacacacacacacacacacacacacacacacgtcagggagtgcaggcaggaagagacaagacccatgggccactgcctatattgggtcgagggtgtccagctttccctcagggagctttaattggtaggtttaaag

SEQ ID NO: 17670 - DNA, 204 bp, Homo sapiens
  HUMUT694
  Located on chromosome 11
  Distance between a terminus base of telomere on chromosomal short arm and 5'-terminus of this base sequence : 83043790
  Distance between 3'-terminus of neighbour sequence of sequence listing upward to telomere on chrosomal short arm and 5'-terminus of this base sequence : 22435
tctctttcctctcccctcgtgtgtgtgtgtgtgtgtgtgtgtgtgtgtgtgtgtgtgtgtgtccttcccaatttcatgcttctaccagttagggactaagaaatggaacaattgaccttactagaattggttcgtgtattcattcatacctattcaaccagtcagccattggtgagcctgtgtcacactggggattctgtctgt

SEQ ID NO: 17671 - DNA, 173 bp, Homo sapiens
  Z67336
  Located on chromosome 11
  Distance between a terminus base of telomere on chromosomal short arm and 5'-terminus of this base sequence : 83062791
  Distance between 3'-terminus of neighbour sequence of sequence listing upward to telomere on chrosomal short arm and 5'-terminus of this base sequence : 18797
ttaggagcgaatgtttaggattacaggtcacatgagtataatgtgacagaggctcctgtgtactcttaatgaatttatttgtgtgtgtgtgtgtgtgtgtgtgtgtgtgtgtgagatgtgtgggggccccttttccctgtctaagggtgttcggggggtgggtcttcttgcca

SEQ ID NO: 17672 - DNA, 310 bp, Homo sapiens
  chr11.fa.O7frz.81651579
  Located on chromosome 11
  Distance between a terminus base of telomere on chromosomal short arm and 5'-terminus of this base sequence : 83378803
  Distance between 3'-terminus of neighbour sequence of sequence listing upward to telomere on chrosomal short arm and 5'-terminus of this base sequence : 315839
caaatggcagtattggactagctcagctggtttttaggaacagaacccttttcccaactgaaatcttattctttagatttagtctttagacaggtataaaaacacaaaatagtagaactacttggactgaagtgtgtgtgtgtgtgtgtgtgtgtagaggggtggaaggcccttagccctgctcggtgatgcccctcctcctcctccctatggtggtacccttggggttctgggggttcaattcgaaaaaccactcaagcagattgccccaacagggcctcaagcctcgtcgatgttaaaggaagctcta

SEQ ID NO: 17673 - DNA, 392 bp, Homo sapiens
  AC013405.2_159929
  Located on chromosome 11
  Distance between a terminus base of telomere on chromosomal short arm and 5'-terminus of this base sequence : 83600116
  Distance between 3'-terminus of neighbour sequence of sequence listing upward to telomere on chrosomal short arm and 5'-terminus of this base sequence : 221003
agtgatcaataagtcaaatgctactgaaaggctaagtaatataaaaaactactattgaaatttgataagatggagatcagagcagagaaatggtgctagcaacagctgaaaaaggtacctaggcaggcagatatatatatatatatatatatatatatatatatattttaattagtaattaaagtaatagtattaaagtaatcagtgtctgtgataccactgtgttacatgacatatagtttaaagaaataataatttgaaactttaagggttactccaggaaagacaaaaataagtttctaaaattgcgatatagttcacacactataaaattcactatttaaaaataatgccaattcagtggtttttagtatactcacaaggttatgcaa

SEQ ID NO: 17674 - DNA, 296 bp, Homo sapiens
  chr11.fa.O7frz.80711291
  Located on chromosome 11
  Distance between a terminus base of telomere on chromosomal short arm and 5'-terminus of this base sequence : 83977176
  Distance between 3'-terminus of neighbour sequence of sequence listing upward to telomere on chrosomal short arm and 5'-terminus of this base sequence : 376668
tcttgacctcatgatccacctgcctcggcctcccaaagtgctgggattacaggtgtgagccactgcacctggccaggatgatgtttctgaaacacagatctgatgatgttactccctgcttaaaaccctttggtggttctctgttgattttagaataaagtctctctctctctctctccttccttccttccttccttccttcattcattccttccttcattccttccctccctccctccctccctccctgcctccctccctccttccctccttccttccttaatggagtctcactc

SEQ ID NO: 17675 - DNA, 424 bp, Homo sapiens
  AP001372.3_4955
  Located on chromosome 11
  Distance between a terminus base of telomere on chromosomal short arm and 5'-terminus of this base sequence : 84058977
  Distance between 3'-terminus of neighbour sequence of sequence listing upward to telomere on chrosomal short arm and 5'-terminus of this base sequence : 81505
actaaactacctccaaagcaagcagtcttttcagttttgactgagtgatgtgagaaacttcttttcttttcttttctttttttttttttgagacagtctccctatgtcacccaggctgtggtgcagcaacccaatcttggctcactgcaacccccacctcccgggttcaagcaattatcctgcctcagccacctgagtagctgggattacaggttcctgtcaccacacccagttaatttatatatatatatatatatatatatatatatatatatatatatttaagtagagacagggtttcacatgttgcccaggctggtctcgaactcctgtcctcaagttataaagtgctgggattacaaggtgtaagccaccacgactatctgagagaagttttctgatgtcatgttgaatctgcttctaa

SEQ ID NO: 17676 - DNA, 441 bp, Homo sapiens
  chr11.fa.O7frz.79484272
  Located on chromosome 11
  Distance between a terminus base of telomere on chromosomal short arm and 5'-terminus of this base sequence : 84202440
  Distance between 3'-terminus of neighbour sequence of sequence listing upward to telomere on chrosomal short arm and 5'-terminus of this base sequence : 143039
gtgactgagcaagacactatctcaaataaataaataaataaataaataaataaataaataaataaaacagtcctggagatgcatggtggtgatgtgatggctgcacaacaatgtgcgtatacttagtaccagtgaattgtacaatcaaaaaggattaaaatcatacattttgttatgtatattttatcataataaaagacaaacaaaataacaacaaacaaacaaacaaacaaacaaaactcagccttgaccagcacatctactgtattgggagacaattctccaagggccactcagatttctgcaagtcttgtgagcagagacagactgcctttgttccagatgatcttttcgaggatatctgtagagcagacagccttggaagataaagatagagatagtgtccccttctggagccaaaaccaggtttattgactgtct

SEQ ID NO: 17677 - DNA, 286 bp, Homo sapiens
  DISO7_00002808
  Located on chromosome 11
  Distance between a terminus base of telomere on chromosomal short arm and 5'-terminus of this base sequence : 84342377
  Distance between 3'-terminus of neighbour sequence of sequence listing upward to telomere on chrosomal short arm and 5'-terminus of this base sequence : 139496
ctggttccttctgaaggcacctctgtgcatcacaaatggctagctctggcaggaaggtgagagtaacctacactgtcctttctgaccttgagccagcttctccatggtaggaagtcccccagtcaggaaatctgcactgtgaatccagaggccagcattccaaaatatgctgtgtgtgtgtgtatgtgtgtgtgtgtgtaggattccaaaatatgctgtgtgtgtgtgtgtgtgtgtgtgtgtgtgtaagtaactcaaagggaaagggatcttcccaaggttgcac

SEQ ID NO: 17678 - DNA, 141 bp, Homo sapiens
  D11S916
  Located on chromosome 11
  Distance between a terminus base of telomere on chromosomal short arm and 5'-terminus of this base sequence : 84534734
  Distance between 3'-terminus of neighbour sequence of sequence listing upward to telomere on chrosomal short arm and 5'-terminus of this base sequence : 192071
ggacttctaagcctccataagagcatgagccagttcccgtgtgtgtgtgtgtgtgtgtgtgtgtgtgtgtgtgtgtgtgtgtgtggtgggagtggttatcaaaatggacagcagagtcaaagcagcaatgagaatagtctg

SEQ ID NO: 17679 - DNA, 145 bp, Homo sapiens
  Z16809.1_87
  Located on chromosome 11
  Distance between a terminus base of telomere on chromosomal short arm and 5'-terminus of this base sequence : 84534748
  Distance between 3'-terminus of neighbour sequence of sequence listing upward to telomere on chrosomal short arm and 5'-terminus of this base sequence : -127
ccataagagcatgagccagttcccgtgtgtgtgtgtgtgtgtgtgtgtgtgtgtgtgtgtgtgtgtgtgtggtgggagtggttatcaaaatggacagcagagtcaaagcagcaatgagaatagtctgatgtgcacagatctatgg

SEQ ID NO: 17680 - DNA, 232 bp, Homo sapiens
  DISO7_10003094
  Located on chromosome 11
  Distance between a terminus base of telomere on chromosomal short arm and 5'-terminus of this base sequence : 84587868
  Distance between 3'-terminus of neighbour sequence of sequence listing upward to telomere on chrosomal short arm and 5'-terminus of this base sequence : 52975
ctcatatctgtaatcccagcactttccacctgtatcgtctgctactctggaggctaaggtcagaggattatttcaacccaggaggttgaggccatggtgagccacgatcatgccactgcactctgtttccaaaaaaaaaaaagtaggtgaattgtatggtatgtgatttatctctctctgtctctctctctcttttttttttttttttttaaggcaaggttgggattccaga

SEQ ID NO: 17681 - DNA, 229 bp, Homo sapiens
  DISD22_0005462
  Located on chromosome 11
  Distance between a terminus base of telomere on chromosomal short arm and 5'-terminus of this base sequence : 84840801
  Distance between 3'-terminus of neighbour sequence of sequence listing upward to telomere on chrosomal short arm and 5'-terminus of this base sequence : 252701
gttggaagagaatctgaaagatcacccagcccgcccatccatccatccatccatccatccatccatccatccatccatccatccatccgtttatccatctacccactcagtattcctacttgagcctggctctgtgtagggaagtgaggaccaaaaatggatcagactcattccttaccttcctggagctctcaatctagggaacctgggggtgagggaggaaggtaac

SEQ ID NO: 17682 - DNA, 326 bp, Homo sapiens
  chr11.fa.O7frz.84319603
  Located on chromosome 11
  Distance between a terminus base of telomere on chromosomal short arm and 5'-terminus of this base sequence : 85023112
  Distance between 3'-terminus of neighbour sequence of sequence listing upward to telomere on chrosomal short arm and 5'-terminus of this base sequence : 182082
tccactgtaagctaccacttagtgaatattttctacgtattgggaactgtactaagtggctttcatgttttgttttttgtttgtttgactggtttgttgttgttgttgttgttgttgttgttgtttttgagacggagtttcgctcttgttgcccaggctggagtacaatggcgcgatctaggctcaccacaacctctgcctcccgggttcaagcgattctcctgcatcatcctcccgagtagctgggatgacaggcatgcgccaccatgcccggctaattttgtatttttagtagagacgggggtttctcatgttggtcaggctag

SEQ ID NO: 17683 - DNA, 219 bp, Homo sapiens
  Z16580.1_148
  Located on chromosome 11
  Distance between a terminus base of telomere on chromosomal short arm and 5'-terminus of this base sequence : 85055999
  Distance between 3'-terminus of neighbour sequence of sequence listing upward to telomere on chrosomal short arm and 5'-terminus of this base sequence : 32561
taagccgaggtcacgttattgtactccggcctggacgacagagcaagactctgtctcaaacacacacacacacacacacacacacacacacaatcagtgtatatacacacacaaaaggacacaagactgaaaggatatgcaacagaaaattaatagtaaatgcatctcagaattatatttatttttttctacctcttctttgcctgtgcatactttaag

SEQ ID NO: 17684 - DNA, 187 bp, Homo sapiens
  D11S911
  Located on chromosome 11
  Distance between a terminus base of telomere on chromosomal short arm and 5'-terminus of this base sequence : 85172297
  Distance between 3'-terminus of neighbour sequence of sequence listing upward to telomere on chrosomal short arm and 5'-terminus of this base sequence : 116079
cttctgaacaattgccacatacaccattttgtttatcaaaaacaaattttaacaaatggaaagaagttttatgtgttttggggggtgtgtgtgtgtgtgtgtgtgtgtgtgtgtgtgtgtgtgtgtgtgtttaaaaagagcagaagcccaaggaacaaaacatggagaaatggtcaagcatgagaag

SEQ ID NO: 17685 - DNA, 211 bp, Homo sapiens
  chr11.fa.O7frz.84629546
  Located on chromosome 11
  Distance between a terminus base of telomere on chromosomal short arm and 5'-terminus of this base sequence : 85391411
  Distance between 3'-terminus of neighbour sequence of sequence listing upward to telomere on chrosomal short arm and 5'-terminus of this base sequence : 218927
gatccaagatagtgccactacactccagcctgggcaacagagcgagactccatctcaaaaaataataataataataataataataataataataataataataataataaacaaataaatacataagtaagtaaggctgcaggctcaataaactgagaacagtcaatgaagactgacacacacaaaaatgataattgaatagttcaaatcc

SEQ ID NO: 17686 - DNA, 350 bp, Homo sapiens
  chr11.fa.O7frz.84828416
  Located on chromosome 11
  Distance between a terminus base of telomere on chromosomal short arm and 5'-terminus of this base sequence : 85442353
  Distance between 3'-terminus of neighbour sequence of sequence listing upward to telomere on chrosomal short arm and 5'-terminus of this base sequence : 50731
aaacataacttttgtacgcaataggaaaccaaaaaattcatgtgccttactttattgtgatattcgctttatcgtgatggtctaaaactgaactcacagtatctgtgagatatgcctggactaatatccaatgttgattgagctttttctaagtcccaggtgctgccacaagtactttttattccattttatttatttatttatttatttatttatttatttttgagactgagtctcgctttgttgcccagggtggagtgcagtggcacaatctcgtctcacagcatcctctgcctcccaagtgattctcctgccttagcttcctgagtagctggtattacaggtgcctg

SEQ ID NO: 17687 - DNA, 244 bp, Homo sapiens
  D11S937
  Located on chromosome 11
  Distance between a terminus base of telomere on chromosomal short arm and 5'-terminus of this base sequence : 85578034
  Distance between 3'-terminus of neighbour sequence of sequence listing upward to telomere on chrosomal short arm and 5'-terminus of this base sequence : 135331
ctaataaacaaatccctctacctccagacttattatgtgaggaaacacacacacacacacacacacacacacacacacacacacacgtgttactgaaacaccaggggttccgatctagttcctgttccttgcttcacaaaaagccaatcactgagatgattattgccaaagaataaggctttaatcaggtgctgcagagaaacagatgggagatcaatctcaaacttgggtccctgactgacta

SEQ ID NO: 17688 - DNA, 423 bp, Homo sapiens
  chr11.fa.O7frz.85299890
  Located on chromosome 11
  Distance between a terminus base of telomere on chromosomal short arm and 5'-terminus of this base sequence : 85865152
  Distance between 3'-terminus of neighbour sequence of sequence listing upward to telomere on chrosomal short arm and 5'-terminus of this base sequence : 286874
atgtacacatcactgcacttaagcctgagcgacaaagcaagaccgtttccaaaaaataaggctaggcacagtggctcatgcctgtaatccctgccctttcagaggccaaagtgggaggactgcttgagcccaggagttcaagaccagcctgggcaacatggcaaaaccctgtctctacaaaaaatacaaaaattagctgggtgtggtggcttgtgcctgtggtcccagctacgtgggaggctgaggcagaaggatcacttgagcctgggaggctgaggctgcagtgagctgtgatcacgtcactgcactctagcctgagtgagagagtaagaccctgtctctaaataaataaataaataaataaataaataaaagatctctattaagatagtgagttcctattcagtgaagctacaataggta

SEQ ID NO: 17689 - DNA, 120 bp, Homo sapiens
  D11S4166
  Located on chromosome 11
  Distance between a terminus base of telomere on chromosomal short arm and 5'-terminus of this base sequence : 86171178
  Distance between 3'-terminus of neighbour sequence of sequence listing upward to telomere on chrosomal short arm and 5'-terminus of this base sequence : 305603
gtgaagtctgggatttcagcaagtgtgtgtgtgtgtgtgtgtgtgtgtgtgtgtgtgcgcgcgcgtgcatgtgagtaggggtgggggagctggatgagggcaagtatcatggtgccttcc

SEQ ID NO: 17690 - DNA, 464 bp, Homo sapiens
  chr11.fa.O7frz.85599336
  Located on chromosome 11
  Distance between a terminus base of telomere on chromosomal short arm and 5'-terminus of this base sequence : 86246209
  Distance between 3'-terminus of neighbour sequence of sequence listing upward to telomere on chrosomal short arm and 5'-terminus of this base sequence : 74911
aacagatgtcagtgttaaatcaacagttcacttttccagcctcaatctatacagccatatatttattttataaaggagaggcatgctcatgggcactgcagagccatacacatgaacacacacacacacacacacacacacacacacacgagtgtgataaaagagggcagagtttggaggcctataatagaatcacacttcagaaatggagattaaaaatgagcagatgagcctagaggggagtgaaaagaacttgggctatggagccagaacgactgggctcaaactcagctctgctgtctactagccatgtgtccttgggcaagttattcaaccctctgagtctcagattccccaactataaagtagagatgattactcctccctaataaggtttgaattacatgactcgaggcttctagcacagccccgtatatggtaagtgctcaatacatgacatttct

SEQ ID NO: 17691 - DNA, 130 bp, Homo sapiens
  Z67340
  Located on chromosome 11
  Distance between a terminus base of telomere on chromosomal short arm and 5'-terminus of this base sequence : 86348277
  Distance between 3'-terminus of neighbour sequence of sequence listing upward to telomere on chrosomal short arm and 5'-terminus of this base sequence : 101604
ccataaacagttaggtcaagtcccaaatcaacaaggaaccatagttgatgggtaagaggtatgtgtgtgtgtgtgtgtgtgtgtgtgtgtgtgtgtgtgtgtgtgtgagtgtcgggggtggaattcagct

SEQ ID NO: 17692 - DNA, 183 bp, Homo sapiens
  D11S918
  Located on chromosome 11
  Distance between a terminus base of telomere on chromosomal short arm and 5'-terminus of this base sequence : 86450126
  Distance between 3'-terminus of neighbour sequence of sequence listing upward to telomere on chrosomal short arm and 5'-terminus of this base sequence : 101719
taggtacgaggaatgctagaggccacctctttccatttcatactgtggatcactaacctatagagaaaaactacactgctgatttcatgagaaaaaaagtcatttagtgtgtgtgtgtgtgtgtgtgtgtgtgtgtgtatgtattctaagaaacatttttattgttcaactctcccacagtgc

SEQ ID NO: 17693 - DNA, 231 bp, Homo sapiens
  D11S1352
  Located on chromosome 11
  Distance between a terminus base of telomere on chromosomal short arm and 5'-terminus of this base sequence : 86548076
  Distance between 3'-terminus of neighbour sequence of sequence listing upward to telomere on chrosomal short arm and 5'-terminus of this base sequence : 97767
atatccttcatatcctgaatctctgaacttcatgggattctgtctgagttactcccccgcctattggattggtgtgtgtgtgtgtgtgtgtgtgtgtgttgtgtgtgtgacagagagagagaaagagagggggtgcttcagatttcacaaaatccattttaatcaccctctgcaatccacaacactctgtaattacaagtctcttactctcaaggacaaaaaaactcaccg

SEQ ID NO: 17694 - DNA, 143 bp, Homo sapiens
  D11S4172
  Located on chromosome 11
  Distance between a terminus base of telomere on chromosomal short arm and 5'-terminus of this base sequence : 86599673
  Distance between 3'-terminus of neighbour sequence of sequence listing upward to telomere on chrosomal short arm and 5'-terminus of this base sequence : 51366
ttatcagcaacatgaaaatggactaatactatatatatatgtgtgtgtgtgtgtgtgtgtgtgtgtgtgtgtgtgtgtatacatatatatacatgcaccacattttccttatccactcattgactgatgagcatttgagctgg

SEQ ID NO: 17695 - DNA, 259 bp, Homo sapiens
  chr11.fa.O7frz.86258658
  Located on chromosome 11
  Distance between a terminus base of telomere on chromosomal short arm and 5'-terminus of this base sequence : 86673237
  Distance between 3'-terminus of neighbour sequence of sequence listing upward to telomere on chrosomal short arm and 5'-terminus of this base sequence : 73421
agaactcctggttctcgagccttttgactcaaactgggacatattacactggctcccctggttctcaggccttagggtttgggccagaactacaccactggctttcctgggcctcctggaaggtggcagatcatgggtcttccaagccctcataattgccaaaccttcataataaatctctttctctctctctctctctctcctgttggttctgtttttctgaagaacccagactaatacaggactcaagaattaggtg

SEQ ID NO: 17696 - DNA, 203 bp, Homo sapiens
  D11S1761
  Located on chromosome 11
  Distance between a terminus base of telomere on chromosomal short arm and 5'-terminus of this base sequence : 86915631
  Distance between 3'-terminus of neighbour sequence of sequence listing upward to telomere on chrosomal short arm and 5'-terminus of this base sequence : 242135
tggattgttggtagacgattaactaaagatacacacacacacacacacacacacaccccaggtaaagccttttataaactatatattttttatctattaaatagcaacacatataattcaactttatgggcagtaagaagtcactcgtttaacatagtcattggcctggcaataactatgtgccaggcagtaggtgtggtgta

SEQ ID NO: 17697 - DNA, 215 bp, Homo sapiens
  D11S4143
  Located on chromosome 11
  Distance between a terminus base of telomere on chromosomal short arm and 5'-terminus of this base sequence : 87085118
  Distance between 3'-terminus of neighbour sequence of sequence listing upward to telomere on chrosomal short arm and 5'-terminus of this base sequence : 169284
agctatgctcccaccactatactccagcctggaagacagaagaagaccctgcctctatttaaaataaaaaaaaaaaaagatacactgcaacataccacagcacaaacacacaccacaacacacacacacacaacacacacacacacacacacacacacacacacacacacacacacacaatccctggttccgcttcagcagattctggttcagtg

SEQ ID NO: 17698 - DNA, 185 bp, Homo sapiens
  DISO7_10003105
  Located on chromosome 11
  Distance between a terminus base of telomere on chromosomal short arm and 5'-terminus of this base sequence : 87450256
  Distance between 3'-terminus of neighbour sequence of sequence listing upward to telomere on chrosomal short arm and 5'-terminus of this base sequence : 364923
agaaagtcctgaagctaagaggaaaaatgtgtgtgtgtgtgtttgtgtgtgtataaagttttatatatgcatgtgtatatacacgtacatagatatgtttatatataatattttatacattacacaaatacatttatatacatgttaagttgtaaaaaccagtattgccataaatgaaggccgtc

SEQ ID NO: 17699 - DNA, 205 bp, Homo sapiens
  DISO7_10003106
  Located on chromosome 11
  Distance between a terminus base of telomere on chromosomal short arm and 5'-terminus of this base sequence : 87470526
  Distance between 3'-terminus of neighbour sequence of sequence listing upward to telomere on chrosomal short arm and 5'-terminus of this base sequence : 20085
gctgtaaagcttctattatggagagattccactagtacatagagttttacatttttttatttgattaagttctgcaatcattgtgtgtgtgtgtgtgtgtgtgtgtgtgtgtagtttacaggctcattttaccttagaaattgtatagtagtttggaaatgagagtcagatatatgaatataccccacataaaccttctaaccga

SEQ ID NO: 17700 - DNA, 197 bp, Homo sapiens
  D11S1362
  Located on chromosome 11
  Distance between a terminus base of telomere on chromosomal short arm and 5'-terminus of this base sequence : 87523931
  Distance between 3'-terminus of neighbour sequence of sequence listing upward to telomere on chrosomal short arm and 5'-terminus of this base sequence : 53200
acccctcaggattgaccagagttgatttgtatatatattatacacacacacacacacacacacacacacacacacatagacatacatacatatatagagactatatatataattatgtgcagactatattttctgcgtgtctgtgcacgtgcacatgtgtaaaattatgtctttaaaaattcctggcacatagtagg

SEQ ID NO: 17701 - DNA, 238 bp, Homo sapiens
  D11S2002
  Located on chromosome 11
  Distance between a terminus base of telomere on chromosomal short arm and 5'-terminus of this base sequence : 87689076
  Distance between 3'-terminus of neighbour sequence of sequence listing upward to telomere on chrosomal short arm and 5'-terminus of this base sequence : 164948
aatgaggtcttactttgttgcccaggctggtctcgaactcctgggctcaagcaatcctccccccttagcctccccctaatgctgatattacaggtgtgagccaccacaccagccagttattatttttaagtgttattaatacatgtattattttatttaaaagctatctatctatctatctatctatctatctatctatctatctatcatctatctatctatgaaaagaagggccatg

SEQ ID NO: 17702 - DNA, 349 bp, Homo sapiens
  chr11.fa.O7frz.87189055
  Located on chromosome 11
  Distance between a terminus base of telomere on chromosomal short arm and 5'-terminus of this base sequence : 87777762
  Distance between 3'-terminus of neighbour sequence of sequence listing upward to telomere on chrosomal short arm and 5'-terminus of this base sequence : 88448
aaattgtgctaatgtaactaccacaaacaattcatgagacagttctttccccatagtttcaccaatacaatattttaaaacttcactaatttttgtggatctgatagaaatatgtgtgtgtgtgtgtgtgtgtgcgtataaaacatctaacaagttaccactttttaatcactggatgtgtaaaaattttttaaaaatatatatgtgaatgtgagaaaaaaaagcctcttatattctgccagaaaaatgtgtaatcttctagaaaaagttacaagcattttggagagcaaagctgcataactttttgaaatcaagtgtgtatataccctaagacaactatttgctgtgc

SEQ ID NO: 17703 - DNA, 445 bp, Homo sapiens
  chr11.fa.O7frz.87370826
  Located on chromosome 11
  Distance between a terminus base of telomere on chromosomal short arm and 5'-terminus of this base sequence : 87909509
  Distance between 3'-terminus of neighbour sequence of sequence listing upward to telomere on chrosomal short arm and 5'-terminus of this base sequence : 131398
caattcacttaacatccttgtaagacaggcaggctggccaatttcctattttgatgtggtcttgtgaaaaaggaaaagaaaaaacttctcactcgatctgtagcttatctgtcttccagccaatcagcaataaataaataaataaataaataaataaataaagacccaagaagctcttacccacaagttcctgctttatggagacagggacttcttgggacaccacatgcacagttataaatgtcaacttatagttaccccttcctcattttaatgctaaaaatcatgcacggggtagagatttaaaatgttactgttatatgcagtatataaggaagcatgtaaagccactgcaggagcactagaaaaatccctcctgtacatgtgctgatgaaacccatctctgtagaaaggccctataaaactaatgcacgtactatcctaa

SEQ ID NO: 17704 - DNA, 465 bp, Homo sapiens
  chr11.fa.O7frz.87501142
  Located on chromosome 11
  Distance between a terminus base of telomere on chromosomal short arm and 5'-terminus of this base sequence : 88033034
  Distance between 3'-terminus of neighbour sequence of sequence listing upward to telomere on chrosomal short arm and 5'-terminus of this base sequence : 123080
acattgacatctagcaattcatttaatttaatccttaaaatggaggcactattactactcccatttgaaggatgagaaaaatgagataaaaagaggttaagattggctgggcacagtggctcacgcctgtaatcccggcactttgggaggctgaggtgggcggatcatgacgtcaggagtttgagaccaacctgaccaacatggtgaaaccccatctctactaaaaatacaaaaattaaccaggtgtggtggtgtgtgcctgtaatcccagctactcaggaggctgaggcaggagaatcgcttaaacctgggaggcagaggttgcagtgagccaagatcgcgccactgcactccaacctgggcaacagagcgagattccatctcaaaaataaataataataataataataataataataataataataataataataaaagaggttaaggttaaccaagatcacc

SEQ ID NO: 17705 - DNA, 403 bp, Homo sapiens
  AP002759.2_92466
  Located on chromosome 11
  Distance between a terminus base of telomere on chromosomal short arm and 5'-terminus of this base sequence : 88158894
  Distance between 3'-terminus of neighbour sequence of sequence listing upward to telomere on chrosomal short arm and 5'-terminus of this base sequence : 125395
acttgtagatcagctaatgttacagaaggaatatattaggggtcaaatagggttttgtaagttatccctacagcattccacgtgtgtgtatgtgtgtgcgtgtgtgtgtgtgtgtgtgtgtgtgtatttcttgttatagcacttttcatctttttcttcctgtcctttcttctctggtagagtttattggaagagacaggttttggagtgagaggaactgggattgcagtccagccagctcttctacatttcagctacatagcctcatcaagttttagtttcctcatcagtcaaattagggcaataatgtgtaggcactagaaggccagtctggcatgagatatgatgtcagagagattctgtgttttggccacatctgctcatattagaacaatctggtcac

SEQ ID NO: 17706 - DNA, 396 bp, Homo sapiens
  AC026059.4_132601
  Located on chromosome 11
  Distance between a terminus base of telomere on chromosomal short arm and 5'-terminus of this base sequence : 88420336
  Distance between 3'-terminus of neighbour sequence of sequence listing upward to telomere on chrosomal short arm and 5'-terminus of this base sequence : 261039
agtcactgttctgtcacttagaagcttgtatgccaatgaggaccaattcattttaatggctataaaataagttgctaacaccaacagttttccaaatgtatgttaattggttttaccagaaatcctgcaaaaattacttgaaacatttgttgcaatttcattaccatgttaaaatgtgtgtgtgtgtgtgtgtgtgtgtgtgtgtgtgtgtgtgcatgtgtgagagagagagagaggcagggagagagagttgccagtggttccccttcatggctgtcatttatgttcctaaaatgcaaatcatgtcactagcctgccacagtagtccccttttatatgtgatttttctttctggggtttcaatcatctgaggtcaactgaggttcaaaactatta

SEQ ID NO: 17707 - DNA, 314 bp, Homo sapiens
  AC026059.4_21288
  Located on chromosome 11
  Distance between a terminus base of telomere on chromosomal short arm and 5'-terminus of this base sequence : 88456029
  Distance between 3'-terminus of neighbour sequence of sequence listing upward to telomere on chrosomal short arm and 5'-terminus of this base sequence : 35297
cgtaagacttgtaaagctactgagatgagaaattattccggattatccaggtaggccccccatgtgattacatgaattcttataaaaaggaagcagagggagattggacacatacacacacacacacacacacacacacacacagagagagatgtgaaaatggaacagagaaagatttgaagctgttggtgttgaaaattggagtggtgaggccacaagttaaggaatgccagcaggcaccagaagttgaaagacacacagaacatatttgcccataaaacttcaaaagagtataaggttgacaataccttgaa

SEQ ID NO: 17708 - DNA, 292 bp, Homo sapiens
  HUMUT7838B
  Located on chromosome 11
  Distance between a terminus base of telomere on chromosomal short arm and 5'-terminus of this base sequence : 88514971
  Distance between 3'-terminus of neighbour sequence of sequence listing upward to telomere on chrosomal short arm and 5'-terminus of this base sequence : 58628
ttagggcaggtagaggaaaaggagatagatagaatagatagatgatagatatagatagataggtagatagatagatgatagagatagagatagatagatagatagatagatagatagatagatagatggaaacatggtatttaacatatttaacaatgtctttcactggtcatgatctctcctagtgtcaaacttgaagccagttttagacattgcttcaacaaaacaaagcaaaataacaataaataaaagcctatacataagtccaattccaatacaaggaaaaacaggg

SEQ ID NO: 17709 - DNA, 438 bp, Homo sapiens
  chr11.fa.O7frz.87999035
  Located on chromosome 11
  Distance between a terminus base of telomere on chromosomal short arm and 5'-terminus of this base sequence : 88598520
  Distance between 3'-terminus of neighbour sequence of sequence listing upward to telomere on chrosomal short arm and 5'-terminus of this base sequence : 83257
tagaatagtgattcgctgacagagaggaaaagagagttgatttttacaataatcctggcttatgagaatgaaaatgccttttccagaaacgataactgaaaatgtgaatcgggaaacaacaggagttggtaaagataccattcgaaatatgattttgaaaaaaacaaaaaacacattctgtaaggaggctcttctaacagaacatctcccattccatacctttctgagctctccaaagattatttgatttgttgtaaatttctccttgctcagaaattcccacacttggcagatcatcagaatctcttgggtaccttaaaaatacattttacacacacacacacacacacactctctctctctctgacacacacacgtgcaaacatacaaaaaaaagaggttattcctggcctaaaaattctactcctgaggtattgc

SEQ ID NO: 17710 - DNA, 441 bp, Homo sapiens
  AC069332.2_133057
  Located on chromosome 11
  Distance between a terminus base of telomere on chromosomal short arm and 5'-terminus of this base sequence : 88669188
  Distance between 3'-terminus of neighbour sequence of sequence listing upward to telomere on chrosomal short arm and 5'-terminus of this base sequence : 70230
caattacagaccaaagactgaggtactgggatataagaatgtgcaagacacaagcaatgcattagtgagaataggttagattttgctgcttttaagaccccacattcttgtggcttaaaattttacctctctataaaacagcatgacccattttggtgaacgggggtgtgttgtgttcattatagtaacttagaaatctctgtgtgtgtgcgcgcgcgcgtgtgtgtgtgtgtgtgtgtgtatttcaacgtacattttagatacaggggtagatgtgcaagtttgttacatgagaatattgtgtgatgctggggtttggagttcagatcctgtctccctggtagtgagcacaattaacatttttacttgttttttcaacaatctgtgtggcagaggaaaggaatataacatattaacctctggttcttaaagtctcaggat

SEQ ID NO: 17711 - DNA, 333 bp, Homo sapiens
  chr11.fa.O7frz.88158174
  Located on chromosome 11
  Distance between a terminus base of telomere on chromosomal short arm and 5'-terminus of this base sequence : 88792192
  Distance between 3'-terminus of neighbour sequence of sequence listing upward to telomere on chrosomal short arm and 5'-terminus of this base sequence : 122563
aatttacctaggaaatgaattgacagataaatagttagatagatagctagatagctagctagctagctagatagatagataaatagatagatagatagatagatagatagatagatagatagatagatagatagaaaaatagatagaaagacaagtaaatgggagtttttaaagtttcaaagtataagatttcactcctattttataacactacatgtggaaactgcattgaataaacccctttcaacctctaaatgagtagagtgatacaaagttttctcataagcatatttaggtattttctcatcatcaaacaagactcagataggtatc

SEQ ID NO: 17712 - DNA, 360 bp, Homo sapiens
  AC021130.4_19313
  Located on chromosome 11
  Distance between a terminus base of telomere on chromosomal short arm and 5'-terminus of this base sequence : 88931716
  Distance between 3'-terminus of neighbour sequence of sequence listing upward to telomere on chrosomal short arm and 5'-terminus of this base sequence : 139191
atttcctctgtcttaacctcagctgagattaatctcaatttcctcatatggcaaaatgagacaaaataatgctgggtatgtcaactacacaaaaatattgatagggctgtattaagaaaacagaagaaacataattttaattttaagcacagtataaataaatgcactattttttcaaaagtatttgaacatgattgccgtgtgtgtgtgtgtgtgtgtgtgtgtgtgtgtatttaaatacacattatctggctttaaggtacagtaaaattttgtcagtcttggacttcacctaagaaggcctcaattaagaatactttattggtaaatataccctgtcaaagtcattgattaacttgg

SEQ ID NO: 17713 - DNA, 279 bp, Homo sapiens
  chr11.fa.O7frz.88308256
  Located on chromosome 11
  Distance between a terminus base of telomere on chromosomal short arm and 5'-terminus of this base sequence : 88942235
  Distance between 3'-terminus of neighbour sequence of sequence listing upward to telomere on chrosomal short arm and 5'-terminus of this base sequence : 10159
ctgagcataatgtcttgtaagttcattcacattatcataaatgacaggacttcctttttaatgctgaataatatccctctgtgtgtgtgtgtgtgtgtgtgtgtgtgtgtatgtgtgttatagctcacattttctttatccattcatctatgaacacttaggttgtttccatatcttggctattatgattaatggtgcaataaaacacaagagtgcagctatctcttcaacatactgattttattcactcaagatgtgtatctagaagtaggattgcag

SEQ ID NO: 17714 - DNA, 373 bp, Homo sapiens
  AP002801.2_141987
  Located on chromosome 11
  Distance between a terminus base of telomere on chromosomal short arm and 5'-terminus of this base sequence : 88988548
  Distance between 3'-terminus of neighbour sequence of sequence listing upward to telomere on chrosomal short arm and 5'-terminus of this base sequence : 46034
ctcctaaataagccatgctattttatctctcagtacctttggaaagactgtttcttctttttaaaatgcacgtttttatgactcagaaatagtctctgtctctctctctctctctctctctctctcccctctccccccaaacccacctgaatcattttctctctctccccaaaaaatttgaccatcacattcatttttgttttcactgtaccttgtgcttatctctgttgaaatagttattaccatattttgcagttatttactttaaagtctgtttctaactgaaagttctctgaagttcattttccctatacagttgttttctgtctatatttctttggagtttttcctaatgtctatctgatagcaggtc

SEQ ID NO: 17715 - DNA, 217 bp, Homo sapiens
  Z67056
  Located on chromosome 11
  Distance between a terminus base of telomere on chromosomal short arm and 5'-terminus of this base sequence : 89044428
  Distance between 3'-terminus of neighbour sequence of sequence listing upward to telomere on chrosomal short arm and 5'-terminus of this base sequence : 55507
ggcacacagtgacataggtaacattatatctatgtgtgtgtgtgtgtgtgtgcgcgtatgtatgtgtgtgtgtgaggtaacattattgcatcaggaaagcaggaggaggaaaacataagcacacacattgttttccatgattgttttatgggtggccatttcatgtactgggaaaaataagaactagatttcagaaaatctcatgtctaatctagct

SEQ ID NO: 17716 - DNA, 295 bp, Homo sapiens
  AP002783.2_159639
  Located on chromosome 11
  Distance between a terminus base of telomere on chromosomal short arm and 5'-terminus of this base sequence : 89176700
  Distance between 3'-terminus of neighbour sequence of sequence listing upward to telomere on chrosomal short arm and 5'-terminus of this base sequence : 132055
ctttatccgaaaggattcatagattgcaaatgttaaaataataatcaacgccaattctacacaatccctttcagaaaacagaagagggtagaacacctcccaatctattttgtagggttagaattaccctgacacaaaaccagataaagaaaacacacacacacacacacacacacacacaaatccctatagactgttgtccctcataaagatagacacaaaaataatatatatataccactagatgttccccagaaataaaaatacattattgatacatgcaacaggttagatg

SEQ ID NO: 17717 - DNA, 125 bp, Homo sapiens
  D11S4082
  Located on chromosome 11
  Distance between a terminus base of telomere on chromosomal short arm and 5'-terminus of this base sequence : 89410072
  Distance between 3'-terminus of neighbour sequence of sequence listing upward to telomere on chrosomal short arm and 5'-terminus of this base sequence : 233077
aaatgccattatttcattcctttttaaggctgagtagtatttcatggtgtgtttgtgtgtgtgtgtgtgtgtgtgtgtgtgtgtgcataatggtttttattcactggttagttgatgggcatcta

SEQ ID NO: 17718 - DNA, 472 bp, Homo sapiens
  chr11.fa.O7frz.95302167
  Located on chromosome 11
  Distance between a terminus base of telomere on chromosomal short arm and 5'-terminus of this base sequence : 89511168
  Distance between 3'-terminus of neighbour sequence of sequence listing upward to telomere on chrosomal short arm and 5'-terminus of this base sequence : 100971
atagaatgcaatgacaagaaatacagataggccacgtaaaaactggaaaacctgtggactgctggcccctttgcctatctagctctgtctcttccctggaaccacatagcttcttttttttttttttctgagtaattgtatgtgattttattttctttttcatatggctactgatatggtttgactgtgtccccacccaaatctcttcttgaattgtagctcccataatccccatatgtcatgggaggaactcagtagaaggtaattaaatcatgggggtgtggaaccacatagcttcttgtctctgctagaaaatttactgcatttcctctctttctctctctaagaaaatttactacatttcctctctctctctctctctctctctctctctctctctctctctctgtctcacacacacacacacacactttctctctaaggcccttcctcatagcatcaatttacatgg

SEQ ID NO: 17719 - DNA, 481 bp, Homo sapiens
  chr11.fa.O7frz.95211092
  Located on chromosome 11
  Distance between a terminus base of telomere on chromosomal short arm and 5'-terminus of this base sequence : 89597451
  Distance between 3'-terminus of neighbour sequence of sequence listing upward to telomere on chrosomal short arm and 5'-terminus of this base sequence : 85811
atcacatcaagatttagtgctaagtactaatttcatagaaatacatggaaatggagagacagaggaacatttcatgataccatggggagcaatcagcaaaactcagagtaagaaaaatttcataggagaaatgactgtttcatcaacaaatatatctcaaggaaataatacaaagaagtagaacctataaattaaaagatattgaatagatatatcatctaaatgcaatatataaaccttctttagatgctgatccaatcaaactgtgtgtgtgtgtgcgtgtgtgtgtgtgtgtgtgtgtgtgtgtgtgtgtgtgtgaaggggttgggggcagagagagaaagagagagaaatttgagccctgagtggatatttcatgttattaaataaatgtttaggtttatcttttaaattcttgataagacaagatatctgggatttgcttcaaaataatcctattgtatgataggagacgtaagaa

SEQ ID NO: 17720 - DNA, 114 bp, Homo sapiens
  DISO7_10003137
  Located on chromosome 11
  Distance between a terminus base of telomere on chromosomal short arm and 5'-terminus of this base sequence : 89664333
  Distance between 3'-terminus of neighbour sequence of sequence listing upward to telomere on chrosomal short arm and 5'-terminus of this base sequence : 66401
tgaactaatgacctacatcttcaacaaataaatgtcaaggaagaaggaggaggaggagaaggaagaggaggaggaggaggaggaggaagaaaagcagtagcagcagtagtaggg

SEQ ID NO: 17721 - DNA, 172 bp, Homo sapiens
  DISO7_10003135
  Located on chromosome 11
  Distance between a terminus base of telomere on chromosomal short arm and 5'-terminus of this base sequence : 89830460
  Distance between 3'-terminus of neighbour sequence of sequence listing upward to telomere on chrosomal short arm and 5'-terminus of this base sequence : 166013
aatgagaaataagaatctctggaacttttctccacaggcatacacacacacacacacacacacacacacacacaaaggtatggggggatttggtgctaagttagaaaatttttaaaacgtttaaagcaaactgttaaattttgtaaattcagcacaatatgaatttaactcc

SEQ ID NO: 17722 - DNA, 207 bp, Homo sapiens
  chr11.fa.O7frz.94644723
  Located on chromosome 11
  Distance between a terminus base of telomere on chromosomal short arm and 5'-terminus of this base sequence : 90054188
  Distance between 3'-terminus of neighbour sequence of sequence listing upward to telomere on chrosomal short arm and 5'-terminus of this base sequence : 223556
ttatcaatcggaccagactagggcatgcatataaatgtaaacgacacacacacacacacacacacacacacacacacactccagttaaacagttaattttcaatgcagttttcacttgggtaattccctgccaagagaaaacataaatcacttttcagtccagcatccaggggctctacaaaccagtccaagagaaatttaatctgg

SEQ ID NO: 17723 - DNA, 375 bp, Homo sapiens
  AP001528.3_16377
  Located on chromosome 11
  Distance between a terminus base of telomere on chromosomal short arm and 5'-terminus of this base sequence : 90067652
  Distance between 3'-terminus of neighbour sequence of sequence listing upward to telomere on chrosomal short arm and 5'-terminus of this base sequence : 13257
agctactgaccactgagctactgaagtgggaggattgcttggacctaggaggttgaggctgcagtgagctgagatcatgccattgcactccagcctgggtaacagagcaagaccctgtcacactcacacacacacacacacacacacactccacttcgtttctaatcatggtgtatagatgcaagcaatattgttggttctatgacaatacttttaaaactacaaaaacaaatttgaaagtgatgtgatgtgaaaaagaatgaaatcatgtcatagccacatggatgcagctggtggctattatcctaagtgaaataactcacaaacaaaatccgatactgcatgttctcaattataagtggaagctaatcaatg

SEQ ID NO: 17724 - DNA, 265 bp, Homo sapiens
  D11S1887
  Located on chromosome 11
  Distance between a terminus base of telomere on chromosomal short arm and 5'-terminus of this base sequence : 90299235
  Distance between 3'-terminus of neighbour sequence of sequence listing upward to telomere on chrosomal short arm and 5'-terminus of this base sequence : 231208
cctgacattgtatctaaacctctgtgtgtgtgtgtgtgtgtgtgtgtgtgtgtgtgtgtgtctaaaccgcatgcactgtgataatttaaatataatgaaactcaatgaatattcagcctctacctctgggcattaacctgccttagagagatttcacattaagcctttgaagcctgggcctttgaaaattcacttaggtgcattttaatcaatgtttattcagcaattattacatgtccagaattgttttgtgggaatacagagg

SEQ ID NO: 17725 - DNA, 381 bp, Homo sapiens
  chr11.fa.O7frz.94234223
  Located on chromosome 11
  Distance between a terminus base of telomere on chromosomal short arm and 5'-terminus of this base sequence : 90469948
  Distance between 3'-terminus of neighbour sequence of sequence listing upward to telomere on chrosomal short arm and 5'-terminus of this base sequence : 170448
tctgatacctcaagctattaagactttggcctcctgttgccccaagttgcctgcagattggactgccttcaggcaaaaagctgcaaacttgcaaatcccaaaaggtataattcctgctttcaaagcttgattcccctccaatatctgtctgctcttgaccaaaccccattgccttcgcacatgcgtgtgtgtgtgtgtgtgtgtgtgtgtgtgtgatgatggagtagctcaagactgtcactaacctctcttcccatccccagctccatcccccactgcaagaacctcatgcacatgtgtctgaacatcccaacccccatgtccaagtttcagtcacggactcaggcctagggatccagctactgcagtgtggtctgtact

SEQ ID NO: 17726 - DNA, 234 bp, Homo sapiens
  Z67247
  Located on chromosome 11
  Distance between a terminus base of telomere on chromosomal short arm and 5'-terminus of this base sequence : 90994811
  Distance between 3'-terminus of neighbour sequence of sequence listing upward to telomere on chrosomal short arm and 5'-terminus of this base sequence : 524482
gttccagggcgaaatcaattgggcatgttcaaggttaagattactttctctcctttcaggaggtagataaccaagacagggaaagtagagaaaaataagcagataaaaagccctagttcatcttctgtgactcagaaaataaaggcatgcacacatatacatcatacacatcacacacacacacacacacacacacacacacacacatctctgtcagatgttttatgctgttgc

SEQ ID NO: 17727 - DNA, 183 bp, Homo sapiens
  D11S1780
  Located on chromosome 11
  Distance between a terminus base of telomere on chromosomal short arm and 5'-terminus of this base sequence : 91120818
  Distance between 3'-terminus of neighbour sequence of sequence listing upward to telomere on chrosomal short arm and 5'-terminus of this base sequence : 125773
gggatctgcagcaattacttcattggggtaacacacacatacatacacacacacacacacacacacacacacacacactccttgacatcaatatagaaataaagaagttgaaacaaactaaggcaacataaagactgtttgatatttttcaacttaaatgactacagttgtttagtggcatac

SEQ ID NO: 17728 - DNA, 417 bp, Homo sapiens
  chr11.fa.O7frz.98344726
  Located on chromosome 11
  Distance between a terminus base of telomere on chromosomal short arm and 5'-terminus of this base sequence : 91300902
  Distance between 3'-terminus of neighbour sequence of sequence listing upward to telomere on chrosomal short arm and 5'-terminus of this base sequence : 179901
agatacgtaacaagttgcttaaactcattatatgtgaaatgaccttagactaacatgtccagctaaatgcatttcgcccagcaaaacctatcctaataaggctgcatttatgatttggccatctttgtctccctgaattcatttccttccattctttttctaagtcaacccaatctgaaacatagacttctttgtggttccccaggcctccaaatatacacaaactcaaaattactgcatatactgttctctccaactggaattttacacacacacacacacacacacacacacacacacacacacacaaacacacaaacacacatatacatatacatgtatacacactcatggtccacatatatatccatacacactttcgtgctccccttccgctttgaaactttgttcaatttg

SEQ ID NO: 17729 - DNA, 421 bp, Homo sapiens
  chr11.fa.O7frz.98517226
  Located on chromosome 11
  Distance between a terminus base of telomere on chromosomal short arm and 5'-terminus of this base sequence : 91540770
  Distance between 3'-terminus of neighbour sequence of sequence listing upward to telomere on chrosomal short arm and 5'-terminus of this base sequence : 239451
accagtcattaagtgaaacctttcatcttcccagtatagtacctgttcccaagccagcttctttgaaaatcacttttctctcttttactatttagtttataaattgcatagtaacaatacagaaaccacaatagcagaaaaaactaataaagaatatttttaaatgaaaactcacatcctaactctaccaaaacatggtaattaaacctgaatgcctccctttcctgatatattttttcacctaaatattcagctctgggattgcattgtccttggattgagtgaaaattattgcctggtctctaaatcttccatagtgtgtgtgtgagtgtgtgtgtgtgttgaatgtatttctttttgttcagagcaaacttttttcaatatgtatatatagatatatatatttaggcagattatgcca

SEQ ID NO: 17730 - DNA, 353 bp, Homo sapiens
  AP000827.3_143701
  Located on chromosome 11
  Distance between a terminus base of telomere on chromosomal short arm and 5'-terminus of this base sequence : 91592714
  Distance between 3'-terminus of neighbour sequence of sequence listing upward to telomere on chrosomal short arm and 5'-terminus of this base sequence : 51523
tttactaggaaatgaaagcattattctatttctagaagaaatacattggtcttgtatcctgcaaacttgttaaacccatcgattctgctaggtttttgtagcttctatcagcatttttacatacatgattatgtcatctgcaaatgaagataattttatttcttggctttcaatctacatgcccttccttcctctctctctctctctctctctctgtctctctctctctttctttctttctctctttcttctttttgctttattgtactggctagaccctccaggacattttttttctttcttttttgtatatacattttatagaggtactccagtacaatgttgaatagaag

SEQ ID NO: 17731 - DNA, 454 bp, Homo sapiens
  AP002364.2_29698
  Located on chromosome 11
  Distance between a terminus base of telomere on chromosomal short arm and 5'-terminus of this base sequence : 91764907
  Distance between 3'-terminus of neighbour sequence of sequence listing upward to telomere on chrosomal short arm and 5'-terminus of this base sequence : 171840
tattagttggaatttagcagtgagccattcaatatgaaggtgactacaaaactaggaaatttattgacataatttatgacatcaagatatgtatatgtatatatatgtgtgtgtgtatatatatatgtgtgtacacacacacacacacacacacacacacacacatatatatatatatatatatatatagagagagagagagagagagagagagagactgagtctcactctgtcacccaggctggagcacagtggcatgatcttagctcactgcaacctttgcctcccaggttcaagtaagcctcctgcctcagcctcccaagtagctgggactactggcgtctgccacaatgcccacataatttttgtatttttagtagagatgggtttttgccatgtgagggagaagaaaagggaaaaatcagttgggtagacaactaaggctagtcctcag

SEQ ID NO: 17732 - DNA, 385 bp, Homo sapiens
  chr11.fa.O7frz.98797050
  Located on chromosome 11
  Distance between a terminus base of telomere on chromosomal short arm and 5'-terminus of this base sequence : 91817588
  Distance between 3'-terminus of neighbour sequence of sequence listing upward to telomere on chrosomal short arm and 5'-terminus of this base sequence : 52227
ttaccaaccttctaaagcctacttctgtcatttcatccatctcagcctcagtcctgttctgagcttttgctggagaggtgttggggtcattttgaagaaaaggggcactccggctttttgagtttttggcatttttgcattgattctttctcatgtttgtgggcttatctaccttcagtcttcaaggctgctgacctttacatgtttttgtgtgtgtgtgggttttgttgttgttgttattgttgttgttgttgttttctgtttctttcgggtttttttaacaggtcattcttccatggggctgctgtggtatgctgggggagccactccagaccctagttggctcatgttttccccatcctgggaggtatcaccagtgaaagct

SEQ ID NO: 17733 - DNA, 356 bp, Homo sapiens
  AP002003.3_13573
  Located on chromosome 11
  Distance between a terminus base of telomere on chromosomal short arm and 5'-terminus of this base sequence : 91877065
  Distance between 3'-terminus of neighbour sequence of sequence listing upward to telomere on chrosomal short arm and 5'-terminus of this base sequence : 59092
tggtttacatatcaaaggtgacacaagaaggcagaaaatcagctagtttaaactgagctgggtatgtgggcttcaggtgacccaattttttttacactttgcatatgttagcaactgactgcaaaagcctcatgactagtgatttgggagttttaaataaattttagagaggaagatggattcacgaatatgaactctgtagataatactgattgactacacacacacacaacacacagagacacacacacacacacacattattttaggtttgatgggaagaattctgacatgcattgccacagttgggatccacaaccttttgcctatgtctttgaattaaggcagtttacata

SEQ ID NO: 17734 - DNA, 267 bp, Homo sapiens
  D11S931
  Located on chromosome 11
  Distance between a terminus base of telomere on chromosomal short arm and 5'-terminus of this base sequence : 91981569
  Distance between 3'-terminus of neighbour sequence of sequence listing upward to telomere on chrosomal short arm and 5'-terminus of this base sequence : 104148
gattgcttgagcccagaagttagaggctaaaatgatctatagtggtggcactacacatttgcttgggtgacagaatgagaccctatttcttaaaaataaaaatgttggtaggtattcttttttccaattccctggattaatcaggattgactagactattctccattaacaaacatcttcagaatctcatagattacacacacacatacacacacacacacacacacacacacacacacacacagaggcaaacacatactatttctc

SEQ ID NO: 17735 - DNA, 176 bp, Homo sapiens
  Z24577.1_148
  Located on chromosome 11
  Distance between a terminus base of telomere on chromosomal short arm and 5'-terminus of this base sequence : 92071666
  Distance between 3'-terminus of neighbour sequence of sequence listing upward to telomere on chrosomal short arm and 5'-terminus of this base sequence : 89830
gaaccaacattctactttctgtctttatgattttgattaattgcatcatatgagtagaataatacagtatttgtgtgtgtttgtgtgtgtgtgtgtgtgtgtgtgtgtgtgtgtctggtgtatttcacttaatgtccttagggttcatccaggttgtagcatatttcagaatttcc

SEQ ID NO: 17736 - DNA, 260 bp, Homo sapiens
  D11S1342
  Located on chromosome 11
  Distance between a terminus base of telomere on chromosomal short arm and 5'-terminus of this base sequence : 92082916
  Distance between 3'-terminus of neighbour sequence of sequence listing upward to telomere on chrosomal short arm and 5'-terminus of this base sequence : 11074
agggacaggaatactactaccaatacaaaaataatactagtggtagcaaatatttatttgcagaaattacagtggcagggccctgtgctaagtgcttaacatgcataattatagtttgtctctgtctctgtctctctctttctctctctctctctctcacacacacacacacacacacacacacacacacacacacacaaatgaaacaagtgccaataaaattaccgttctgtagagattaaatgtcctataccaggggt

SEQ ID NO: 17737 - DNA, 394 bp, Homo sapiens
  chr11.fa.O7frz.99357866
  Located on chromosome 11
  Distance between a terminus base of telomere on chromosomal short arm and 5'-terminus of this base sequence : 92331776
  Distance between 3'-terminus of neighbour sequence of sequence listing upward to telomere on chrosomal short arm and 5'-terminus of this base sequence : 248600
cttgcctgatggtatttagtatacaagtcaggagcacgtggaattagggtgaacaagagtgagaaaatgaaaagaaataaaatggtaatatcctgttcagatattatagtgttcccacagaaatgctacacacacagatacacacacacacacacacacacacacacacacacactctacacagagtcatcattggaaggacttaacaacaaaaggtaaagataaaatcttccagggatactaaaccattcataggttatttatggttggttaatactgttttaatttgtgccaacattttaattcccaatttatgttacatggtgattcctgatgggtagggaaggaaatatctctgaatcacctgagagtgtggaatgttaaccttggatat

SEQ ID NO: 17738 - DNA, 389 bp, Homo sapiens
  AP001002.3_62540
  Located on chromosome 11
  Distance between a terminus base of telomere on chromosomal short arm and 5'-terminus of this base sequence : 92445737
  Distance between 3'-terminus of neighbour sequence of sequence listing upward to telomere on chrosomal short arm and 5'-terminus of this base sequence : 113567
acagactagttacctgatgcttatattaatacgtacaacatatagtggagagatattgtaaagaggaaaatcaagaatcgtatttctaaaagcccttcccccaaactggaagggagccaagggaccaaagaatgactcaaaccagtccagcttggtgagtagatgtgtctatagaacttacataggaggcactccaggttggcagcaggatagctttagagatctgccctgcctcccatttataagctgcttttaaagtaactttctggctctttacccactgtgtgtgtgtgtgtgtgtgtgtgtgtgtgtgtgtgcgcgcgcgcgcgcgcgcgtgtgtgtgtgtttgtgtgatgggactgttttccttggtacattatctgatgctc

SEQ ID NO: 17739 - DNA, 437 bp, Homo sapiens
  chr11.fa.O7frz.99575638
  Located on chromosome 11
  Distance between a terminus base of telomere on chromosomal short arm and 5'-terminus of this base sequence : 92552728
  Distance between 3'-terminus of neighbour sequence of sequence listing upward to telomere on chrosomal short arm and 5'-terminus of this base sequence : 106602
gtaagaccatgacatttcctaacacttgattttaatacattacggtaattttctaaaacaactcagaggaacccatatttacattaggcagagtatttatgaaaaaatctggcaccaggtgtgtgtgtgtgtgtatatatataatatatatatatacacacatatatatatattatatatatacacacatatatatattatatatatatacacacatatatatattatatatatatacacacatatatatattatatatatatatacacacacatatatattatatatatatacacacatatatatatacacatacacacacatatatatacacgcacatatatatgcacatatatatacatatatacacgtgtgtgtatgtggtgtgtatatatatgtgtgtgtgtgtgtgtgtgtgcatgtacgtatctcaagat

SEQ ID NO: 17740 - DNA, 356 bp, Homo sapiens
  chr11.fa.O7frz.99878305
  Located on chromosome 11
  Distance between a terminus base of telomere on chromosomal short arm and 5'-terminus of this base sequence : 92711343
  Distance between 3'-terminus of neighbour sequence of sequence listing upward to telomere on chrosomal short arm and 5'-terminus of this base sequence : 158178
tgaaagtgctttgatctaagagaataaatctttgaatttgaataagtgagtacattagaatcttatttttcaagggtattgtttcacatgccatgtgtgcacctgttttcccagaatcttccatgagaagggaattccccactcttttataacctagctttgctctagaaatgtcacaattaatagactatcaaagtaatttcatcaaattattaccaaagatttatcacacacacacacacacacacacacttaaatggggactttttaaaaagtaacattcaaagtttgcaccctccactcaaaatgaagacaagtacagttatcaaatataatacaccttagttatccagagc

SEQ ID NO: 17741 - DNA, 256 bp, Homo sapiens
  chr11.fa.O7frz.100080173
  Located on chromosome 11
  Distance between a terminus base of telomere on chromosomal short arm and 5'-terminus of this base sequence : 92913033
  Distance between 3'-terminus of neighbour sequence of sequence listing upward to telomere on chrosomal short arm and 5'-terminus of this base sequence : 201334
gtattggcatgtaagacagaaaaaaggatcaacagaacagaataaaatacagaggaatacatacatacacacacacacacacacacacacacacactcaattgattttgacaaatgtacaaagacaattctctgaagaatagtcttttaaatgtggtttcagaattattggatatccataagcaaaacaataaacatcaatctataccttacaaatacaaaaaaaaatcaaaatgtattggagtcctaaatgtaaa

SEQ ID NO: 17742 - DNA, 194 bp, Homo sapiens
  DISO7_10003139
  Located on chromosome 11
  Distance between a terminus base of telomere on chromosomal short arm and 5'-terminus of this base sequence : 92970085
  Distance between 3'-terminus of neighbour sequence of sequence listing upward to telomere on chrosomal short arm and 5'-terminus of this base sequence : 56796
gacattaagggatcaggtataatgtttttagtagatctgagggatctctctctctctctttctctctgtctctctctctgtctctctctctgtgtgtgtgtgtgtgtgtgtctgtctgtccgtctgtctctctctctctctctctctctctgtatttcgtaagacttttagtaggcagtggaatcataaataga

SEQ ID NO: 17743 - DNA, 315 bp, Homo sapiens
  AC011300.5_30337
  Located on chromosome 11
  Distance between a terminus base of telomere on chromosomal short arm and 5'-terminus of this base sequence : 93081603
  Distance between 3'-terminus of neighbour sequence of sequence listing upward to telomere on chrosomal short arm and 5'-terminus of this base sequence : 111324
ttacaggtactgaagatgcaatcaaaatccatgcattgcagttatttgccatgtctcttaagtgtcttttttacctagagattgcctccctgtcagccagcctctctttctctctacacacacacacacacacacacacacacacacacacacacttcccccctccccttactttacttggtggagcaagaaaagaattcttattaggagtgttttaaagtctggattttgctattgagtccctataccgtcattcaatgtttatctttcccatgtttttcacatttatcagtactttcagcaacattcttgatc

SEQ ID NO: 17744 - DNA, 133 bp, Homo sapiens
  Z66867
  Located on chromosome 11
  Distance between a terminus base of telomere on chromosomal short arm and 5'-terminus of this base sequence : 93131360
  Distance between 3'-terminus of neighbour sequence of sequence listing upward to telomere on chrosomal short arm and 5'-terminus of this base sequence : 49442
actcacctgaagcattgaaaatgaacgctcaaaaatgggtacaattataggctttatgttatatacattttaccacagacacacacacacacacacacacacacacaaacttacaaggtgttgttgcaagtta

SEQ ID NO: 17745 - DNA, 379 bp, Homo sapiens
  AC011300.5_90570
  Located on chromosome 11
  Distance between a terminus base of telomere on chromosomal short arm and 5'-terminus of this base sequence : 93189607
  Distance between 3'-terminus of neighbour sequence of sequence listing upward to telomere on chrosomal short arm and 5'-terminus of this base sequence : 58114
tcattcctgagttacttcacttagagtaatagtctccaatcccataaaggttgctgtgaatgccattaattcatccctttttatggctgagtagtattctattgtgtgtgtgtgtgtgtgtgtgtgtgtgtgtgtataatatgccacattttctttatctactcattgattgatggacatttgagttggttcccctttttgcaattgcgatttgtgctgttataaacatgtgtgtgcaagtatctttttcggataatgacttattttcctccactacccagtagtgcgattgctgaatcaaatggtaattctactttaagttctttaaggaatctccacactgttttccacagtggttgtattagtttacatttccacc

SEQ ID NO: 17746 - DNA, 128 bp, Homo sapiens
  DISO7_10003142
  Located on chromosome 11
  Distance between a terminus base of telomere on chromosomal short arm and 5'-terminus of this base sequence : 93258337
  Distance between 3'-terminus of neighbour sequence of sequence listing upward to telomere on chrosomal short arm and 5'-terminus of this base sequence : 68351
cccatgtcattgttgaggagaggttgtgtgtgtgtgtgtgtgtgtgtgtgtgtgtgtgtctgtgtttgtgtgttgtggggaaagtggttgctttgtgttttgttgtttcactttctaatgccatccaa

SEQ ID NO: 17747 - DNA, 244 bp, Homo sapiens
  DISO7_10003141
  Located on chromosome 11
  Distance between a terminus base of telomere on chromosomal short arm and 5'-terminus of this base sequence : 93263476
  Distance between 3'-terminus of neighbour sequence of sequence listing upward to telomere on chrosomal short arm and 5'-terminus of this base sequence : 5011
gaagaggtactgaaatctggcattaaacctgtatacacacacacacacacacacacacacacacacacacacacacacacatacacacacacacacagtgagctaactttaaacttgaaaatgacctgtgatattttattatttcaagtgtcactgaaattttattcttgctcactaaagcctttctattctttcttcaaactggcttttcatagatattcctatttcttagcttaccagtgaa

SEQ ID NO: 17748 - DNA, 422 bp, Homo sapiens
  AC024715.3_148280
  Located on chromosome 11
  Distance between a terminus base of telomere on chromosomal short arm and 5'-terminus of this base sequence : 93323457
  Distance between 3'-terminus of neighbour sequence of sequence listing upward to telomere on chrosomal short arm and 5'-terminus of this base sequence : 59737
ttggttaaccatttatagtcagatgtcatattctttttgcattcccagagcctacaataatttctggcaaataattggtatttctaaaatatttgttaactgagagttattttaaaaagcatttcagtctattaagttttgaaatgcatgctagaaagacccaaaacttttacatcttagattgattacaaatacacacacacacacacacacacacacacaaatatatacatatatgtatgtatatattcaggaattttagcagttgctcaattcatacttctccagttcctaggcttaattatattaaaataataaaaccttcctcaagaaattactcagagaaattctatacccaacctgatgaaaaatctaatttaaaaattcaataacagggttattatggttacaaagaactggtg

SEQ ID NO: 17749 - DNA, 380 bp, Homo sapiens
  AC024715.3_70531
  Located on chromosome 11
  Distance between a terminus base of telomere on chromosomal short arm and 5'-terminus of this base sequence : 93348980
  Distance between 3'-terminus of neighbour sequence of sequence listing upward to telomere on chrosomal short arm and 5'-terminus of this base sequence : 25101
cactattcatctaaccttgcaccttaatattttccagcatgaattcctattccaagctacaccaagcttattcctcaactctctacttttgttcaagtaggttgaaccatccagaattcctgtctccaaaccctcaagcctgttaaataatcttcttgctttagcaatgtaatactcctgtagaatttcatatatatgtgtgtgtgtgtgtgtgtgtgtgtgtgtgtgtgtacattttgtgttctctagccttcctttcattaaaatcctaagttattcatgaagcctaccttgaagaaagtgttttatattgaatttttaaaaaaatctaaatacctactatataggctcttaaccttagtgccatcaataaacttaag

SEQ ID NO: 17750 - DNA, 419 bp, Homo sapiens
  AC025820.4_156044
  Located on chromosome 11
  Distance between a terminus base of telomere on chromosomal short arm and 5'-terminus of this base sequence : 93522432
  Distance between 3'-terminus of neighbour sequence of sequence listing upward to telomere on chrosomal short arm and 5'-terminus of this base sequence : 173072
agttaacagcaatactgagcagatggtactgctatagtttggatacttgaccctccaaatatcatatttaaatttggtccccaatgttggaaagtagggcctagtggaggtattttggtcacagggagcaaattcctcatgaatggcttggtgctgtccttgcaggaatgagtgagttctaattctgttagtttccatgaaggctggagggctggttgttagaaagagcctggcatctctctctctctctcctctctctctctctctctctctctcactctctctctctctctctatcttcctctcaacgtgtgatatctgcacatgctgtctccacctctcattccgctaggaatggaagcagcctgaagtcctcaccagaaacagatgtcagcaccttgcatcttatacagttctgc

SEQ ID NO: 17751 - DNA, 385 bp, Homo sapiens
  chr11.fa.O7frz.100872571
  Located on chromosome 11
  Distance between a terminus base of telomere on chromosomal short arm and 5'-terminus of this base sequence : 93557228
  Distance between 3'-terminus of neighbour sequence of sequence listing upward to telomere on chrosomal short arm and 5'-terminus of this base sequence : 34377
ggtacaatgtgcactattcaagttactgtgcactaaaatctcagactttacaactatataattcttccatgtaaccaaaaaccacttgtatcctaaaagctattgaaataaatgaataaatattacacacatacacacacacacacacacactgcaatttttttgtcttctaattggtgtgtttagaccacctagtgtcattattgataatggtaaggtttaagtcagccattgtattatttgttttctttgtttcctacgttcctcattcctctgttttccttttctatgacttatttaggatttcctatttaggaaacttatttaggatttcttcatgatttgtttgtagtattttttagtatttcactttacaatggtcttg

SEQ ID NO: 17752 - DNA, 480 bp, Homo sapiens
  AC021143.5_44940
  Located on chromosome 11
  Distance between a terminus base of telomere on chromosomal short arm and 5'-terminus of this base sequence : 93605618
  Distance between 3'-terminus of neighbour sequence of sequence listing upward to telomere on chrosomal short arm and 5'-terminus of this base sequence : 48005
gcttcatgtattgctcaataagttataactttataacttgacattttccctaggccttccaacagggctgtaggagttaaaattctttgaggcccaactgttcagttgaaattaccaaggacaggtctattgctatcgtcaaatgctctatgctcctataacacttatcttctcaataccccattctctcttacacttcaggacttttaaacatgttgggttctaccaaaccccatcccctccccaccaccatcgacacacacacacacacacacacacacacacacacaatttcttcactgtggaaaattcttagttatccttcaatgctcagaccaaaaatccattgtcctatgtcagtgtcataggggcaggactcctgtaggatggtgttcataattctgttctgaaatttaacataaattgtaatacatctatttatatacaagttcccaagttaatcaatgaaatcctcaagta

SEQ ID NO: 17753 - DNA, 334 bp, Homo sapiens
  AC021143.5_42887
  Located on chromosome 11
  Distance between a terminus base of telomere on chromosomal short arm and 5'-terminus of this base sequence : 93729635
  Distance between 3'-terminus of neighbour sequence of sequence listing upward to telomere on chrosomal short arm and 5'-terminus of this base sequence : 123537
agcaccaagttacttctctaactaattggagaatttccacataattagactggtgatattttaaatactaatttgaaaggcttgagtttgcaaatacatatgagaagctagaagccccttagctgtcctcttaaggtgtcaaccatagcaaaaatatctaacactcattaagctcttactctgctaaatgctttttattctacacacacacacacacacacacacacacacacacacatgcacgcgcgcagaagtaggtgggtattttctccatttttcaattgaggactctgaggttgaaagagcttatgtaacttgtccagtacaaagatgt

SEQ ID NO: 17754 - DNA, 458 bp, Homo sapiens
  chr11.fa.O7frz.101070662
  Located on chromosome 11
  Distance between a terminus base of telomere on chromosomal short arm and 5'-terminus of this base sequence : 93745124
  Distance between 3'-terminus of neighbour sequence of sequence listing upward to telomere on chrosomal short arm and 5'-terminus of this base sequence : 15155
cctagtgaaagtagaggcctatttactgtaaagtttttgtagcttcagttttagtacccttccccccatgagctttttccaaggctctccactttatatatatataaacttatatatatatttatattatatatgttatatatatttatattatatatgttatatatatttatattatatatgttatatatatttatattatatattatatatatttatattatatatattatatatttatattatatatttatattatatttatattatatatattatatatattatatatatataaagtggagagccttggaagagccttggaagaggctcataaatatatatatttatatattatatatatatttatatataaatatatataaatatatatataaataaattatatatatataaattatatatatataaatttgagatgagtcttgctctattgc

SEQ ID NO: 17755 - DNA, 200 bp, Homo sapiens
  D11S1332
  Located on chromosome 11
  Distance between a terminus base of telomere on chromosomal short arm and 5'-terminus of this base sequence : 93812469
  Distance between 3'-terminus of neighbour sequence of sequence listing upward to telomere on chrosomal short arm and 5'-terminus of this base sequence : 66887
tattaggcagggtttccagagagacagaaccagtggagatatgtatgcacacacacacacacacacacacacacacacacacacacacacacacacagagacatagatagatatggatatagatgtatgagaggagattaattagggggattggctcatgtgataatggaggctaagttctatgagagtccatctgtaag

SEQ ID NO: 17756 - DNA, 452 bp, Homo sapiens
  AP000722.3_117782
  Located on chromosome 11
  Distance between a terminus base of telomere on chromosomal short arm and 5'-terminus of this base sequence : 93825520
  Distance between 3'-terminus of neighbour sequence of sequence listing upward to telomere on chrosomal short arm and 5'-terminus of this base sequence : 12851
ggaatgttcagctgattaaactgctcccattacagcttgagtgacactgggtaacagatctgggaccggatcctacatcatcccaccacgtaagtggactatatcatgccttcattcattcatcttttcccattccttttcaacaatgcttactgagtggcaggagctgtgtgggattctagacagccaaagacgtttgctgttgccaccgtcttgttaggagatctgtggctcagaggggattcataatgtactgtgataaatgctatgagccagcaatgcccaaggattatgggagctagtgtgtgtgtgtgtgtgtgtgtgtgtgtgtgtgtgtgtgtgtgtgtgtgtaacagagggaaggaacgtcagagcgtcctttccacaaggaggtccagttggaaccaggtccaaatagagaaataggtattattctaaaccaggaacacaag

SEQ ID NO: 17757 - DNA, 406 bp, Homo sapiens
  HUMUT1550B
  Located on chromosome 11
  Distance between a terminus base of telomere on chromosomal short arm and 5'-terminus of this base sequence : 93874061
  Distance between 3'-terminus of neighbour sequence of sequence listing upward to telomere on chrosomal short arm and 5'-terminus of this base sequence : 48089
tttaccatacaggcttttccctgatgtcttttctgtgaccactactaactggtgttagaataacaagacacagctagaggtgatatgataatacagctcttaaagactttattcattaggaccctccctctcttcttatttcttcacattttcttttatttatccttccttccttccttccttccttccttccttccttccttccttccttcctttctctttctttctttcccttccttccttcctttctttattctttctctttttttttttttttgaaacagtgtcttgttctattgcacaggctggagtacagtggtgccatcttggctcattgcgacctctgcccctgggttcaagcaattctcatgcctcagccacttgagtagctggaattaaaggtgtg

SEQ ID NO: 17758 - DNA, 61 bp, Homo sapiens
  Z66657
  Located on chromosome 11
  Distance between a terminus base of telomere on chromosomal short arm and 5'-terminus of this base sequence : 94000003
  Distance between 3'-terminus of neighbour sequence of sequence listing upward to telomere on chrosomal short arm and 5'-terminus of this base sequence : 125536
cagtctctcagatccttctacttcgtgtgtgtgtgtgtgtgtgtttacccaaaatgcttcc

SEQ ID NO: 17759 - DNA, 482 bp, Homo sapiens
  AC067807.2_107045
  Located on chromosome 11
  Distance between a terminus base of telomere on chromosomal short arm and 5'-terminus of this base sequence : 94159345
  Distance between 3'-terminus of neighbour sequence of sequence listing upward to telomere on chrosomal short arm and 5'-terminus of this base sequence : 159281
gaggattggttccaagaaccccctcagataccaaaatcaatgtatactcaagtcccttacataaaatgatgtagtatttgcatataaactatgaactatgaaacctgtattctttaagtcatctgtagattactgataatacctaatacagtgtaaataccatgtaaatagtttttatactatattacttaggaaacaaagacaagaaaaaacagtctgtacatacatgttcagtacagatgtttttttcttctccaaatattttttatccaagtttggttgaatccaggacacagaacccatggatacaggagaaccaactctgtgtgtgtgtgtgtgtgtgtgtgtgtgtgtgtgtgtgtgtgtgtgtgtgtataattttctgtaaatctccacaaactttctttgtaagtagatatggtattaataattaataaatggatgcttgcacactggaaaatattcaagtaagactgttccgt

SEQ ID NO: 17760 - DNA, 384 bp, Homo sapiens
  chr11.fa.O7frz.101555015
  Located on chromosome 11
  Distance between a terminus base of telomere on chromosomal short arm and 5'-terminus of this base sequence : 94159443
  Distance between 3'-terminus of neighbour sequence of sequence listing upward to telomere on chrosomal short arm and 5'-terminus of this base sequence : -384
tgaaacctgtattctttaagtcatctgtagattactgataatacctaatacagtgtaaataccatgtaaatagtttttatactatattacttaggaaacaaagacaagaaaaaacagtctgtacatacatgttcagtacagatgtttttttcttctccaaatattttttatccaagtttggttgaatccaggacacagaacccatggatacaggagaaccaactctgtgtgtgtgtgtgtgtgtgtgtgtgtgtgtgtgtgtgtgtgtgtgtgtgtataattttctgtaaatctccacaaactttctttgtaagtagatatggtattaataattaataaatggatgcttgcacactggaaaatattcaagtaagactgttccgt

SEQ ID NO: 17761 - DNA, 386 bp, Homo sapiens
  AC067807.2_57293
  Located on chromosome 11
  Distance between a terminus base of telomere on chromosomal short arm and 5'-terminus of this base sequence : 94175390
  Distance between 3'-terminus of neighbour sequence of sequence listing upward to telomere on chrosomal short arm and 5'-terminus of this base sequence : 15563
tcattccagaggtctactgaatactaaattatttgttcattccagctgtaaatgtgttaagctgatggacacaaactattcacaagtgaatgactagaaggatggatggatgagcatagatagatagatagatagatagatagatagatagatagatagaaattaatgacagcagttagtgctctatttgcatgaacatgttaacaattttaaagaaaaattaatttacaatgatttagtaaaaccataaacctgcgtttaaaacctatattggctaaacgtaaaacactgtgttggactattacatactagattcagcctttagaagacataggtggagggttatttatgtttgtatatccagtgcttaacctctagtgcttaac

SEQ ID NO: 17762 - DNA, 196 bp, Homo sapiens
  chr8.fa.O7frz.9409444
  Located on chromosome 11
  Distance between a terminus base of telomere on chromosomal short arm and 5'-terminus of this base sequence : 94175390
  Distance between 3'-terminus of neighbour sequence of sequence listing upward to telomere on chrosomal short arm and 5'-terminus of this base sequence : -386
tcattccagaggtctactgaatactaaattatttgttcattccagctgtaaatgtgttaagctgatggacacaaactattcacaagtgaatgactagaaggatggatggatgagcatagatagatagatagatagatagatagatagatagatagatagaaattaatgacagcagttagtgctctatttgcatgaa

SEQ ID NO: 17763 - DNA, 449 bp, Homo sapiens
  chr11.fa.O7frz.101662310
  Located on chromosome 11
  Distance between a terminus base of telomere on chromosomal short arm and 5'-terminus of this base sequence : 94335495
  Distance between 3'-terminus of neighbour sequence of sequence listing upward to telomere on chrosomal short arm and 5'-terminus of this base sequence : 159909
gtgtttggaccaattagtatgtactgtagtacccttctggcaaacaaataactgaattgctactatttaacaatcttatgagcccacactactgcattttgggagtggcaaatgtgtttggaaatggaagcagttctttttaagcactgtatcagagagattgtcttgtacgtttgcctgttgcaaacaggctggtttgtaaaagatgtatgttttggtgtttgaaatgtttataaaattgtatataaatggtttcaattttccaggcttttgtagatactatatttgatgcctatcaggatgctttaatttggggggtcgaatataattgtaagtcatccacgctgttggtctgcaaacttttgaggtaactacacacacacacacacacacaaggattttagatttgaaaatgatgttttttactcatttcaaaatgtactgtaacc

SEQ ID NO: 17764 - DNA, 377 bp, Homo sapiens
  AC016891.3_30756
  Located on chromosome 11
  Distance between a terminus base of telomere on chromosomal short arm and 5'-terminus of this base sequence : 94403920
  Distance between 3'-terminus of neighbour sequence of sequence listing upward to telomere on chrosomal short arm and 5'-terminus of this base sequence : 67976
ctgagtttatcctaatgaagtgacttagggtatggcccctagacagcttaggatggggctattcactagaaataacaagtcattagaggattggaactttcagctctgtccacagacctccaggatgtgtttgcattgggtggtacggggatgttggggagcactggagattgagctccataaaaactcttgaaccaggatacctggagagcttccatgttggtgaacagatcaaggtgccaggtaatggtgtgcctctaaagaagctctgcacaccacacacacacacacacacacacacacacacacacaccttgccctgtgtagctattccttttggctgttcctgagttgtagactctagaataaactggcaa

SEQ ID NO: 17765 - DNA, 468 bp, Homo sapiens
  chr11.fa.O7frz.102135341
  Located on chromosome 11
  Distance between a terminus base of telomere on chromosomal short arm and 5'-terminus of this base sequence : 94493601
  Distance between 3'-terminus of neighbour sequence of sequence listing upward to telomere on chrosomal short arm and 5'-terminus of this base sequence : 89304
attgaagttagaaacacggattattatgaatacagcagatgatgttaaggtacagtgtttagggagaatgtatccgacagccccaaggatttggttgagacagagctgctggctatttctttatattttttgttgttgttttgctgccatagaagcctcagtccctaggatagagagggcatctctgttgtcagcctgtgatacaagctttagcagcaccaaactgccacggggctgcccccagctttcctgagatacagtggggagatgctttgtgcagttcccccacacaatgcatcagaaacatgggctctggggctctggggaccacacaggagctatggggaaggaggctgaagtagccaagagtaatgatggggaggttttatttatttatttatttatttatttatttatttatttatttattttcagaaaccgagaattcctatgtgaaattgttattgt

SEQ ID NO: 17766 - DNA, 258 bp, Homo sapiens
  AP002371.2_147824
  Located on chromosome 11
  Distance between a terminus base of telomere on chromosomal short arm and 5'-terminus of this base sequence : 94539432
  Distance between 3'-terminus of neighbour sequence of sequence listing upward to telomere on chrosomal short arm and 5'-terminus of this base sequence : 45363
ctcagaccttaagaccagattcttcagacagacagagaggaggactaaggggtcaggaagatttctggaacatccctagaggtaatctcttaagaagccattttttgatccatctctactggtccaatcatcacacacacacacatacacacacacacacacacacatgcctgtatgtgctccaatcattctttcctctcctttccatcacatttattatcatacctgctccccagctcctctttgaaactcaggtat

SEQ ID NO: 17767 - DNA, 475 bp, Homo sapiens
  chr11.fa.O7frz.101959430
  Located on chromosome 11
  Distance between a terminus base of telomere on chromosomal short arm and 5'-terminus of this base sequence : 94702162
  Distance between 3'-terminus of neighbour sequence of sequence listing upward to telomere on chrosomal short arm and 5'-terminus of this base sequence : 162472
gctgtccaccatacaataaagtacccagggggccagaacctataaaaaaaagcctagacccccactctccaggcaatataaagggtacaaaagagtaaagccaggagactcaaaggtagagaaaaaaattctaagaggagagagaaagactgacagagggaacagagagagtcacagagacagagagtcaaagagagagaaggaaagagagagagagaaagagacagagaggcaaagagggagtcagagagagagagaaagagagagacagagagagagagagaggcagagagagagagagaaagagacagagaggcaaagagagagggagaggcaaagggaaagaaagaggacaaaacaaatgtttcaaattaaaaataggccacttcaaaagagaatgtcccaaatgggaaaaagaacaaaagtcatacataaaagcaaatcagctaatattaaatttctgttaattccggta

SEQ ID NO: 17768 - DNA, 466 bp, Homo sapiens
  chr11.fa.O7frz.102211775
  Located on chromosome 11
  Distance between a terminus base of telomere on chromosomal short arm and 5'-terminus of this base sequence : 94812995
  Distance between 3'-terminus of neighbour sequence of sequence listing upward to telomere on chrosomal short arm and 5'-terminus of this base sequence : 110358
cctttgaagcctaatagcttagctcctacttatgcgtgagaacgtaagtaggagcaataacaaaatgatgtttcgttttccattcctgagttacttcacttagaataatggtctttaattccatccaggttgctgcaaatgccattattttgtttctttctatggctgtgtagtattcatatatatatacatatatatatacgtatatatatttatatatgtatatatatatgtgtgtgtatatatatatatatatacgtatatatatgccacattttctttatccactcattgattgataggcatttgggctggttctatatttttgcaattgcaaattgtgctgctataaacatgcatgtgcaagtatctttttcatataatgacttcttttcctctgggtaaatacctagtagttagattgctggatcaaatggtagatctaccttgagttctttaaggaatc

SEQ ID NO: 17769 - DNA, 173 bp, Homo sapiens
  G08851
  Located on chromosome 11
  Distance between a terminus base of telomere on chromosomal short arm and 5'-terminus of this base sequence : 95042297
  Distance between 3'-terminus of neighbour sequence of sequence listing upward to telomere on chrosomal short arm and 5'-terminus of this base sequence : 228836
tgttctaaggaaaccatgggaaatactaacctaaactcttcgtttgttaaaaaagaaaaatgtattaagcccttgcaatgatgatgatgatgatgatgatgatgatgatgatgatgaaaatagctaacatttagcaagtgattagctgtgccagacatggtacttggtgctcc

SEQ ID NO: 17770 - DNA, 438 bp, Homo sapiens
  chr11.fa.O7frz.103127257
  Located on chromosome 11
  Distance between a terminus base of telomere on chromosomal short arm and 5'-terminus of this base sequence : 95133231
  Distance between 3'-terminus of neighbour sequence of sequence listing upward to telomere on chrosomal short arm and 5'-terminus of this base sequence : 90761
gcatttcaagaattagttgagtagatttaattataagaatctctgtattcagaattcctggcttctaatacaaaatcccctaattcagagtctgaaacatgctatatactagaaaaatatcaattcatgtcccctaagactgtgcccttatccccatcttcggaacttatatgacatcttggcctataacttggatcttcctcttctctttcctttgtttaaaaataaaatggcttcacacacacacacacacacacacacacacacacacacacacacatcctccttaattgaagtcccattaactataaattcatgaaacataaacaggactgaagtttatttctgaaagattactaaggtaaagaaagttgcaagaacattgaatgctgaaaactaaaatgtgcttaaaagacatcactttagaaggatcaacct

SEQ ID NO: 17771 - DNA, 325 bp, Homo sapiens
  chr11.fa.O7frz.103028587
  Located on chromosome 11
  Distance between a terminus base of telomere on chromosomal short arm and 5'-terminus of this base sequence : 95249255
  Distance between 3'-terminus of neighbour sequence of sequence listing upward to telomere on chrosomal short arm and 5'-terminus of this base sequence : 115586
gagtttagtccatttacattgaacattattattgataagtaatgatttactcttgtcattttgttatttgttttctggttattttttggtcttctcttcctacttttctttcttctgttttgttgttgttgttgttgttgttgttgttgttgttgttttagtgaaggtgattttctctggtggtatgttttgatttcttgctttttatttttttttttgtatctgttgtatgtttttaaatttgaggttaccctgaagcttgcagataatatcttataacccattatttaaaactgatgacaacttaggaatgattgcataaaca

SEQ ID NO: 17772 - DNA, 409 bp, Homo sapiens
  AP000792.2_18003
  Located on chromosome 11
  Distance between a terminus base of telomere on chromosomal short arm and 5'-terminus of this base sequence : 95258094
  Distance between 3'-terminus of neighbour sequence of sequence listing upward to telomere on chrosomal short arm and 5'-terminus of this base sequence : 8514
aagtctttccagtctacctgatgcatgatctctacagttctgagaagcaaaactataaaacaatgtaaaacaataagggcatatgtctggtgtgtgtgtgtgtgtgtgtgtgtgtgtgtgtgtgtacgcacatgtgtttataaagataacagctgtaggaatgaatgagattgagggtgggggggtgcgtatgtatgtctatgaaagcctaatcatttctgggcaatgatgaaaaggttttactactgatctttgtaactatgatggtttctacacttgacctgagctcagaagtgacaactgctggggttggtgatttggggttttcttacatactacttgctacattgtggtatgatattccccttaatttctaggctaaaacactgtcttatgaaccattatcttc

SEQ ID NO: 17773 - DNA, 312 bp, Homo sapiens
  AP001894.3_21316
  Located on chromosome 11
  Distance between a terminus base of telomere on chromosomal short arm and 5'-terminus of this base sequence : 95414152
  Distance between 3'-terminus of neighbour sequence of sequence listing upward to telomere on chrosomal short arm and 5'-terminus of this base sequence : 155649
aaagacaaggtcctaggagagagaaaacaaaaacaaaaacatgatcttttaaatacaaacacacacacacacacacacacacacacacacacacacacacacatcttggatgttagctttttgttaaactgactttaaccactgagctccttaaaaaaatcttctaaaatcttattaccatatttcagctaggacaaataggcactatttcagaagtaccaagtatcaaaccagaaaggtcttgatttaggaaccaaacccaacctgtcatggtggaaaaaataatgcagaaccttagctattgaactgacc

SEQ ID NO: 17774 - DNA, 385 bp, Homo sapiens
  AP002795.2_68767
  Located on chromosome 11
  Distance between a terminus base of telomere on chromosomal short arm and 5'-terminus of this base sequence : 95567765
  Distance between 3'-terminus of neighbour sequence of sequence listing upward to telomere on chrosomal short arm and 5'-terminus of this base sequence : 153301
agtctcatagtctggaggctacactttgtttccctggtcactttccagatgtattctttgcatatgggtaaatgtgcattgttacacacacacacacacacacacacacacacacacacacaaatgggataatactttacatacggctctgcaatttgctttttttttattagtatcttggtgatcacgccatatcagcacctgtagaccaccttattcttttcttatgggtatgtggcatgaatgccatcatttatttacccagctgccagttgaagaacattttggtctttccaggcttttgctatcaaaatcattctctaattttttaaacaggattcctctcttgatcacattgtttggattggaagctgaacctagtaat

SEQ ID NO: 17775 - DNA, 377 bp, Homo sapiens
  AP002795.2_99270
  Located on chromosome 11
  Distance between a terminus base of telomere on chromosomal short arm and 5'-terminus of this base sequence : 95614843
  Distance between 3'-terminus of neighbour sequence of sequence listing upward to telomere on chrosomal short arm and 5'-terminus of this base sequence : 46693
ggttatggtttagacctctcacctttcttccctgctgctgtgggagcctactatgtactaacatatactgttcacaaaatagctgtgtgctgcagacaccagccactactcagatgttccatatatatatatatatatatatatatatatggagaaagagacacacagagagatatttattatgaggaattggctcatatgattatggagactgatagatctcagcacctgcaggctgagtcaacaggcagaagacccaggagagccaatggggtggctccagttagaaagctgacaggctcgagaaccaggaagagccaacattttagtttaagcatgaaggcaaaaagaagccaatgtcctagttcaaggacagt

SEQ ID NO: 17776 - DNA, 479 bp, Homo sapiens
  chr11.fa.O7frz.103250658
  Located on chromosome 11
  Distance between a terminus base of telomere on chromosomal short arm and 5'-terminus of this base sequence : 95727977
  Distance between 3'-terminus of neighbour sequence of sequence listing upward to telomere on chrosomal short arm and 5'-terminus of this base sequence : 112757
tcagacgtaatttcatccataggtatttcagtatgtctttctgaaagaaatacaaaaaagctataatgaatttattttacctaaatgttaatcataatttttaaatttaaaatattctgtccatgaattttttctttatatagatagatgatagataaatgatagatagatagaagatagatagatagctagctagctagctagctagatagatagatagatagatagatagatagatagatagatagagcttgtttgaatcaggttcaattaagagccattcattgtttttcatttctatgaataatatgtcttttttatctagtaatacacccttcatctgttttcctctccttgcaattatttgttgaagaaaacaagttgttattcctataggatttcccacagccttgatgttgctgactcatcttcatgatgccatttttcatttgtcatggtgaacatgtttcactgttctc

SEQ ID NO: 17777 - DNA, 405 bp, Homo sapiens
  AP002784.2_49167
  Located on chromosome 11
  Distance between a terminus base of telomere on chromosomal short arm and 5'-terminus of this base sequence : 95728239
  Distance between 3'-terminus of neighbour sequence of sequence listing upward to telomere on chrosomal short arm and 5'-terminus of this base sequence : -217
aggttcaattaagagccattcattgtttttcatttctatgaataatatgtcttttttatctagtaatacacccttcatctgttttcctctccttgcaattatttgttgaagaaaacaagttgttattcctataggatttcccacagccttgatgttgctgactcatcttcatgatgccatttttcatttgtcatggtgaacatgtttcactgttctctatgttttttgcaaataggtaggtaaatctagagacttaatcagattcacatttgtgtgtgtgtgtgtgtgtgtgtgtgtgcagaccatttcataagtggtggtgagtatttccttcaggaagcacataagttccgaccgtttctctttctgtgatgccagcagctgttgctgatcatgacttagatc

SEQ ID NO: 17778 - DNA, 434 bp, Homo sapiens
  chr11.fa.O7frz.103484852
  Located on chromosome 11
  Distance between a terminus base of telomere on chromosomal short arm and 5'-terminus of this base sequence : 95923527
  Distance between 3'-terminus of neighbour sequence of sequence listing upward to telomere on chrosomal short arm and 5'-terminus of this base sequence : 194883
aaggttcaactgaccactctacctaaaacaaattcttcaatattttcaagatgtagtttaaaacaatttttaacccgtttcctcctagaactaggcacgcatatatgtatgaaagagaagaaaaagcaaaggagaaaggaagagtggggaacgggggggagagggagagagagagagagagagagagagagagaacaccattaaggatacagaataataaaggaaattactaccacttaatgggaacacaatcttttgaaatctttgctacaactggaataaaaaactcagtaattctgaaaggttattctactcttttaaataaaaacatatctgttcaaactattaggtacttctaatcatttagtcttataagaagcattggaaaaaaacatacatagtaacaaacagtgaatttagacataggttcgcat

SEQ ID NO: 17779 - DNA, 274 bp, Homo sapiens
  AP001361.2_184561
  Located on chromosome 11
  Distance between a terminus base of telomere on chromosomal short arm and 5'-terminus of this base sequence : 96017059
  Distance between 3'-terminus of neighbour sequence of sequence listing upward to telomere on chrosomal short arm and 5'-terminus of this base sequence : 93098
agaaagcataggtccatctttccaagccctccttcccgatagcctgcctgaattcagggtctgggcatcagctccaatttaatcatagtggcgttattctgaaaggaattaacacacacacacacacacacacatttatatgtataccattttatatacacatttgtatatgtatatgtgtatgtatgtatgtatgcgtatacacccttagaaacacgcagctcattttgccagttatttcattttacagatgaggaaattgagatctagacca

SEQ ID NO: 17780 - DNA, 449 bp, Homo sapiens
  AP002376.2_134182
  Located on chromosome 11
  Distance between a terminus base of telomere on chromosomal short arm and 5'-terminus of this base sequence : 96255791
  Distance between 3'-terminus of neighbour sequence of sequence listing upward to telomere on chrosomal short arm and 5'-terminus of this base sequence : 238458
ggtttgcaaagtgatattacacattgctcaggaagtgagttttatttcagggtattctagttgggagagagaatggagtaggaagggggaaaatgacaataaattctgaagataaatggttatctgctttggctaaaaaaaaaaaaaagatcaaggaaagagatctggagtaatgggataaaacatatatatgctcacatgcattcacacagcacacacacacacacacacacacgtgcacacacgcacacacacacataggaaaatgggaagggcattttccctgccaaaaagatgtttctactagaaataaatggaagagtggccattcattcctgaaaattaaacacaagcgtgactccccagaaacgatatttcatcagttgttaagcactaagggagtctaaagagtgtataaattactagtgtgatttgttcaaggatactat

SEQ ID NO: 17781 - DNA, 487 bp, Homo sapiens
  AP001152.3_88554
  Located on chromosome 11
  Distance between a terminus base of telomere on chromosomal short arm and 5'-terminus of this base sequence : 96434704
  Distance between 3'-terminus of neighbour sequence of sequence listing upward to telomere on chrosomal short arm and 5'-terminus of this base sequence : 178464
gagctgtgatattcctttcatagaagagttccaggtatggcaagttctaggtgtggccatggagtaaaggggctaaagtgggctaaggaggtgaacagtgatgagattgttagtgttgtgagctgggcattggatgtttgtctacagtgacatcaagcttccctggtgatggtgggaagggagcaatgagtaagacctgggattagatgcaaagttgtgtgtgtgtgtgtgtgtgtgtgtgtgtgtgtgcgtgtgtgtgtagaccatataaaggttgaagatgtttcttgacctttccatggaaaaagtattagtcacacaggtgggagagctggaagtcaaatccaggtatgtgtgatccctaaaattgagctgttatttcagaaaactgcaaagtagaaaatacttgtttttggagtactctgctgttcttttaaaacatgattagttttgagtatagtcctataactatgacctttatccaagg

SEQ ID NO: 17782 - DNA, 187 bp, Homo sapiens
  Z67719
  Located on chromosome 11
  Distance between a terminus base of telomere on chromosomal short arm and 5'-terminus of this base sequence : 96456025
  Distance between 3'-terminus of neighbour sequence of sequence listing upward to telomere on chrosomal short arm and 5'-terminus of this base sequence : 20834
atgcactgtggcaatttggggtaggttgaggaaaacagattgtgtatgtatgtgcatgtatgtgcaggggtgtgtgtgtgtgtgtgtgtgtgtgtagagagacaaaaaacaagtgtatatgtgcacatgggtgtgtgtgcctgtgagagtattttatgatgtctactttgaacccagactagcctgt

SEQ ID NO: 17783 - DNA, 164 bp, Homo sapiens
  D11S1757
  Located on chromosome 11
  Distance between a terminus base of telomere on chromosomal short arm and 5'-terminus of this base sequence : 96470393
  Distance between 3'-terminus of neighbour sequence of sequence listing upward to telomere on chrosomal short arm and 5'-terminus of this base sequence : 14181
tgcaccttgctatccaacttataatctgcatgcctgtgtgtatacacatacacatatacacacacacacacacacacacacacacacacacacacacactccattactccgttactgtatagtaccttcttttaactttgaagttggcctgaggctgggatggg

SEQ ID NO: 17784 - DNA, 433 bp, Homo sapiens
  AP000787.3_88270
  Located on chromosome 11
  Distance between a terminus base of telomere on chromosomal short arm and 5'-terminus of this base sequence : 96746941
  Distance between 3'-terminus of neighbour sequence of sequence listing upward to telomere on chrosomal short arm and 5'-terminus of this base sequence : 276384
ctcaggatacaaattaaagatcactgtggtggcctctgtggggtggttataaaggggaccaggtgtatactaggaagtcatttagttttagaaatgtaaatatgtgtaaatgttttaattttactcaacttgccagaggtagaatgtccctggacaactaactgatacatttctttagggccaatcgctggctttagaagagcctcagctaatcacagtagagctggactgttgtggttttccattcctttgcatcgtattcctcagtctctgcggaaggcactgctccttcctttcctttctaaatctctctctgtctctctctctctctctctctctctcgctctctcctcccctagtttatcctggactcatgctgagctcagcaacccttgaactcattttctatctgacatgtgaaatagttcttagg

SEQ ID NO: 17785 - DNA, 148 bp, Homo sapiens
  Z67441
  Located on chromosome 11
  Distance between a terminus base of telomere on chromosomal short arm and 5'-terminus of this base sequence : 96788964
  Distance between 3'-terminus of neighbour sequence of sequence listing upward to telomere on chrosomal short arm and 5'-terminus of this base sequence : 41590
aatgaagttggctactcacaagccagaagccagattctagccatctacaaataaaaaggggattgtgggtatgtgtacgtgtgtgtgtgtgtgtgtgtgtgtgtgtgtatgcatatgtcagagacagacacagtcatatcagatagct

SEQ ID NO: 17786 - DNA, 240 bp, Homo sapiens
  DISO7_10003143
  Located on chromosome 11
  Distance between a terminus base of telomere on chromosomal short arm and 5'-terminus of this base sequence : 96967064
  Distance between 3'-terminus of neighbour sequence of sequence listing upward to telomere on chrosomal short arm and 5'-terminus of this base sequence : 177952
atcacaaggaccttcatgggccatgctgtgccaatcttttagttctggaaattaaaacaacctcctatgtctagttaaagtttaatttttctatgccaaaatgatgtatgaacagatagatactttgtgtgtgtgtgtgtgtgtgtgtgtgtgtgtgtgtgagagagagagagagaacaggtggagggggtgtgtagaaggaagaggtggagggagggagataatgagaatgattacata

SEQ ID NO: 17787 - DNA, 434 bp, Homo sapiens
  chr11.fa.O7frz.105382084
  Located on chromosome 11
  Distance between a terminus base of telomere on chromosomal short arm and 5'-terminus of this base sequence : 97007279
  Distance between 3'-terminus of neighbour sequence of sequence listing upward to telomere on chrosomal short arm and 5'-terminus of this base sequence : 39975
ctattcctaacattgcagtcagagttattatgttaaaatattaagttagatcatcttacttctcttctcaaaaccatctggtaacttctggtctccctcagagtaaaagccaaagtacacacacacacacacacacacacacacacatacacacacacacactggcctcaagactccacatgctatagccctcctcagagttggcagctgccttccctctctgaggtcatcttcctcccttggtgactctgttccaaccttaggcccctgcctattcctatccagcacagttctaactcagggcatttgcaccagctgtttcttctgtctggtttgttcttcctatagatatccacacaattaaccctctccttcaagtttttctcaattctaaagatgacaagctcattctcacactaagtccgtagaaatta

SEQ ID NO: 17788 - DNA, 151 bp, Homo sapiens
  Z66971
  Located on chromosome 11
  Distance between a terminus base of telomere on chromosomal short arm and 5'-terminus of this base sequence : 97105858
  Distance between 3'-terminus of neighbour sequence of sequence listing upward to telomere on chrosomal short arm and 5'-terminus of this base sequence : 98145
ttcaattaacttggaagagtgtatgtatatgtgtgtgtggtgtgtgcttgtgtgtgtgtgtgtgtgtgtgtgtgtgtgtgtgtggtatgttcctctagcatatctgtttatatattaaactttataatagactttccaggcttattgtgag

SEQ ID NO: 17789 - DNA, 217 bp, Homo sapiens
  AC073844.3_185669
  Located on chromosome 11
  Distance between a terminus base of telomere on chromosomal short arm and 5'-terminus of this base sequence : 97200906
  Distance between 3'-terminus of neighbour sequence of sequence listing upward to telomere on chrosomal short arm and 5'-terminus of this base sequence : 94897
ctgttcctaaggcctaaagtaccccaacattgtgacaaaagaatataacaaagattatgaggtttctgagctaggaactgtatatgaaaacctgtgtgtgtgtgtgtgtgtgtgtgtgtgtgtgtgtgtgtgtgtgtgtgtgtgtgtgtaatcatatcacaagagccatcatcatgcctcacccatcctggaagaatacaacctgagtggagttaca

SEQ ID NO: 17790 - DNA, 469 bp, Homo sapiens
  AP001877.2_65451
  Located on chromosome 11
  Distance between a terminus base of telomere on chromosomal short arm and 5'-terminus of this base sequence : 97252968
  Distance between 3'-terminus of neighbour sequence of sequence listing upward to telomere on chrosomal short arm and 5'-terminus of this base sequence : 51845
taacttatcgtgtaatggcaatgagttataaaaccaaaagcctcaaatttgagacctgcatcctccatgttctagttgtgtgaccttgaacatgtccttttattcctctatgcttacacttatcatctgcctaccttgtggaattattgtgaaggtcaaagggtttcatgaaataaaaagtgctacacagttgttatctaccaagacaacaattgacttaaataaatgcaaatacaatttattggaagttccttattactcttttaaatatggtaaatccattctagaggttaatacctatccgtgtgtgtgtgtgtgtgtgtgtgtgtgtgtgtgtgtaaacttccaaaaaatttcagtgtgaaagttttcaagcttacacaaaaggagataaaattgtataaagaactcccatgtacttctcattggtttcataatatcaacatatatccaatctggttcacctata

SEQ ID NO: 17791 - DNA, 475 bp, Homo sapiens
  chr11.fa.O7frz.105629883
  Located on chromosome 11
  Distance between a terminus base of telomere on chromosomal short arm and 5'-terminus of this base sequence : 97365378
  Distance between 3'-terminus of neighbour sequence of sequence listing upward to telomere on chrosomal short arm and 5'-terminus of this base sequence : 111941
tcaatgtggaactatgtggtatcctatcagtactatgtgcattaaagatggttattattattattattattattattattattattatttcagacagagtcttactctgttgcccaagctggagtgcagtggcactatcttggctcactgcaacatccgcctcccaggttcaagcaattctcctgcctcagcctccccaatagctgagattacaggtgcccgccaccacgcctggttaatttttgtatttttagtagagatgcgttttcatcatgttggccagactgatctcgaactcttgacctgatgtgatccacctgcctcagtctctgaaagtgttgggattataggcgtgagccaccatgtccggccaagatgatcattattaaaaaataagttatgaatttgtgaatatatcaaaatatgtagactgaactgggcccaaaagaattaagtctaattcatgaatcacctt

SEQ ID NO: 17792 - DNA, 343 bp, Homo sapiens
  chr11.fa.O7frz.105844145
  Located on chromosome 11
  Distance between a terminus base of telomere on chromosomal short arm and 5'-terminus of this base sequence : 97471453
  Distance between 3'-terminus of neighbour sequence of sequence listing upward to telomere on chrosomal short arm and 5'-terminus of this base sequence : 105600
tattgtttaagtacaggtttgcttgccttccttccttccttcctttctttccttctttcttcttttgtgtgtgtgtgtgtgtgtgtgtgtgtgtgtgtgtgtgtgtgtgttttgggtctggctctgtcacccaggctggagtgcagtggtgcgatctctgcaatctctgcttcctgggctcaagtgatcctcccacctcagcctcctgagtagcttggattacaggtgcacaccatcacatccagctaaatatatatatatatatttatttatttatttattttttgtagaaacaggttttcaccatgttgcccaggtggtcttgaactcctaagcttaatgg

SEQ ID NO: 17793 - DNA, 456 bp, Homo sapiens
  AP000865.2_71015
  Located on chromosome 11
  Distance between a terminus base of telomere on chromosomal short arm and 5'-terminus of this base sequence : 97538366
  Distance between 3'-terminus of neighbour sequence of sequence listing upward to telomere on chrosomal short arm and 5'-terminus of this base sequence : 66570
gtcctttcattgcttctaaaacagcacagtcagccagctagggcagttggtcaaatactttgaagtgtgtgtgtgtgtgtgtgtgtgtgagagagagagagagagagagagagtgtgtgtgtgtgtgtgtgtcagagagagatttcttctgtttaaaaacatttgttatttatgaaaccacataattaaaaataattccatcaacttactataaagctccatttctaatgcaaaaaaattttgtggaagtagcaaagtaataagaaaagacttgaagcttttcaaattctgcccagaataccaaaattatttttgatactttaatcttttttgatactttattgagcattcaaaatcatttagcatcacgagaaatcttaaaagcatattctaaagggaaaatacatggcatctctgagcactggactcagactatccactataaatttgaggtca

SEQ ID NO: 17794 - DNA, 281 bp, Homo sapiens
  Z66659
  Located on chromosome 11
  Distance between a terminus base of telomere on chromosomal short arm and 5'-terminus of this base sequence : 97569218
  Distance between 3'-terminus of neighbour sequence of sequence listing upward to telomere on chrosomal short arm and 5'-terminus of this base sequence : 30396
agttgctatgaaaattgccctcgttttatcaaatatttattccaaagcaaatataaaaaaatagagagaagttcttgtaatatacccaggatagcaattgttagtttccatggcatatcagggcaaagtatgtgattttaaaaaaatatctcctgtgtcagtcctggtatacagcactctctccctttctctctctagtgcacatgcgtgcgtgcatgcacacacacacacacacacacacacacaggaaagaaaatagagcaaagaaccctggtttagct

SEQ ID NO: 17795 - DNA, 149 bp, Homo sapiens
  HUMUT2499
  Located on chromosome 11
  Distance between a terminus base of telomere on chromosomal short arm and 5'-terminus of this base sequence : 97596601
  Distance between 3'-terminus of neighbour sequence of sequence listing upward to telomere on chrosomal short arm and 5'-terminus of this base sequence : 27102
aagggctggggattttctcctgcccaaatggacctggtgatggtccagcagaagagggcaaggctgaccagttggtaggctggtgctgctgctggtgctgctgcatccgggcatgctgctgacgattagcagctatctgtttgagctgc

SEQ ID NO: 17796 - DNA, 243 bp, Homo sapiens
  D11S4134
  Located on chromosome 11
  Distance between a terminus base of telomere on chromosomal short arm and 5'-terminus of this base sequence : 97799512
  Distance between 3'-terminus of neighbour sequence of sequence listing upward to telomere on chrosomal short arm and 5'-terminus of this base sequence : 202762
tcatcccaagaccctcagaaggctatgttattacttaccctggaggcacaatagtaatttaaatatgtagccatgttatttgataaaatcccaactgagtattaaactacattgtggttcaatcaaattactactgctctgctgctgtaacacacacacacacacacacacacacacacttgcatgaacataaatgtatatgaacatacatgtaccatagtagtacctgatggtagtgttaaa

SEQ ID NO: 17797 - DNA, 411 bp, Homo sapiens
  AP000848.3_14154
  Located on chromosome 11
  Distance between a terminus base of telomere on chromosomal short arm and 5'-terminus of this base sequence : 97830160
  Distance between 3'-terminus of neighbour sequence of sequence listing upward to telomere on chrosomal short arm and 5'-terminus of this base sequence : 30405
gtaggcactcaacatctgtaaccctattccatcatctttttccttgcaccaacattttcctcttatggcagactgggctttagaatttaaacctgggaagaattttaagagattatctagtccatgtacttttcaaatggttgtagcactggaactctatttttaatcacactaaagcgtgtgtgtgtgtgtgtgtgtgtgtgtgtgcatgtatgtgtgtgtgtgtgttttaaatgcataaacaagaggttaagaccttggagtccaattgcatgcccttccttctttcttttatatccctttgctgaaagtcttaaaaactatctcgagtttaggctgggtgcggtggctcatgcctgtaatcccagcactttggggggccgaggcgggtggatcacgaggtcaggagtt

SEQ ID NO: 17798 - DNA, 355 bp, Homo sapiens
  AC018702.3_53841
  Located on chromosome 11
  Distance between a terminus base of telomere on chromosomal short arm and 5'-terminus of this base sequence : 97940310
  Distance between 3'-terminus of neighbour sequence of sequence listing upward to telomere on chrosomal short arm and 5'-terminus of this base sequence : 109739
ctctattctgtttcattggtctacatgtctgtttttatgccagtaccacactgttttgattgtagctttgcagtatgttttgaaatcagatagtccttcagtattgtatttaaattgcaacatgcttccactgtgtgtgtgtgtgtgtgtgtgtgtgtgtgtgtgtgtgtgtatatgtgggtggaaatgtgcttatttttatttgtttatattagagtcgttggttagcgaagtcaggagttcagacgaaaacaaaaacaaaaacaaaactgcaacagatgaaatgcaagcagaggaaagaccataaaagagaactaagctggtttgtagatgctcaacatccattggagtataa

SEQ ID NO: 17799 - DNA, 165 bp, Homo sapiens
  DISO7_10003147
  Located on chromosome 11
  Distance between a terminus base of telomere on chromosomal short arm and 5'-terminus of this base sequence : 98026869
  Distance between 3'-terminus of neighbour sequence of sequence listing upward to telomere on chrosomal short arm and 5'-terminus of this base sequence : 86204
gcaggcttaagtgcacacacacacacacacagacactctctctctctctctctctctctctctctctctctctctctctctatatatatatatatatatatatatatatatatatatatatgtatatgtatatacatatatatttcagatgcagcaactaaatgg

SEQ ID NO: 17800 - DNA, 461 bp, Homo sapiens
  chr11.fa.O7frz.98219163
  Located on chromosome 11
  Distance between a terminus base of telomere on chromosomal short arm and 5'-terminus of this base sequence : 98175684
  Distance between 3'-terminus of neighbour sequence of sequence listing upward to telomere on chrosomal short arm and 5'-terminus of this base sequence : 148650
tgataggattgtagagccaatttctcattataaaatcacattctctctcacacatacacatgctcacacacacacatgctcattcacacacacacacacacacacacagtcccctattgctgctgtttctctggagaattttgacaaataccttaaggaaaatttacattgatacataataaaagagatttgacaaaaatgaatacacattacggaataaaactgattaatccaaatcggcattttattaatatgttatgatttcaaatattagcataattgttacagttgtaagtggtgtaacaattagcttaaaaattagaagcaatacaaaaacatataactgctattatttaatattgctctgtattttctaaaagaacacataaataaaaagggatttgaagtattaaaaatataaatattgccattattttctggtacagtttacctagaacatc

SEQ ID NO: 17801 - DNA, 241 bp, Homo sapiens
  DID22N_0006140
  Located on chromosome 11
  Distance between a terminus base of telomere on chromosomal short arm and 5'-terminus of this base sequence : 98235974
  Distance between 3'-terminus of neighbour sequence of sequence listing upward to telomere on chrosomal short arm and 5'-terminus of this base sequence : 59829
tcaagatgacgaaggtattcagtaaaaggtggaattagttgggcacggtggcatgtgcctgtagtactacctactggagaggctggagctccaagctgcagtgagctatgattgtgccactgcactccagcctggcagcagagtgaaaccctgtctaaaaataataataataataataataataataataataataataataataataattattgagataaagtgacaagacaatacttgg

SEQ ID NO: 17802 - DNA, 390 bp, Homo sapiens
  chr11.fa.O7frz.98029370
  Located on chromosome 11
  Distance between a terminus base of telomere on chromosomal short arm and 5'-terminus of this base sequence : 98275322
  Distance between 3'-terminus of neighbour sequence of sequence listing upward to telomere on chrosomal short arm and 5'-terminus of this base sequence : 39107
gaggctaggaattcaagactagcctggccaacatggcggaaacctgtcttgactaaaaacacaaaaattagctgggcatggtggcacacacctgtaatcccagttacttgggaggctgaggcaggaggatcacctgagccagggaagcagaagttgcagtgagctgagaccacaccactgcactccagcctgggtgacagagtgagactctttaaaagagagagagagagagagagagagagagagagagagagagagaaaattcccaagagtgaatttccaactccaagagctttaaagtgtcatgtgaagtcactgaaggaagaagactttggagagtggtgttccagtaataatatccggcccttagaatagtctcctaaaccacag

SEQ ID NO: 17803 - DNA, 240 bp, Homo sapiens
  AP000720.3_30549
  Located on chromosome 11
  Distance between a terminus base of telomere on chromosomal short arm and 5'-terminus of this base sequence : 98585218
  Distance between 3'-terminus of neighbour sequence of sequence listing upward to telomere on chrosomal short arm and 5'-terminus of this base sequence : 309506
cattagagaacagcatttctaaatgtcggggaaaatttccatagtcattactcaatcagaacttgcgtttatcctaaggaccattctgggttgtgtgtgtgtgtgtgtgtgtgtgtgtgtgtgtgtatgcataaaatgtgtacataaatggctttttgtgttgtttttaaacattcaccaaacaaaaatcatgggtaagcccatgtttttgagatgccatcatactgagcaacctaagaa

SEQ ID NO: 17804 - DNA, 467 bp, Homo sapiens
  AP000720.3_93467
  Located on chromosome 11
  Distance between a terminus base of telomere on chromosomal short arm and 5'-terminus of this base sequence : 98642163
  Distance between 3'-terminus of neighbour sequence of sequence listing upward to telomere on chrosomal short arm and 5'-terminus of this base sequence : 56705
aattaccttgatctttgcttaatatttttgagttattttaataattatgcaaatgtctaatagtaaaatagaattaatagagaattctaagggagcagaaaattctaattttcaaaggttgcagagtggcttttcacagctatatatctacagaatgacattctctctactaaacaaacatgcctacagacattgaatttaatgatagtactttctttaaatataggtgggctacagaaaaaacctctttctcttgtctggtgtgtgtgtgtgtgtgtgtgtatgtgtgtgtgagtgtgtatggaattttgtggtttggcagggatccccaaactttttctgcaaacggctagctattaaatattttccgcattgcaaacaacgtggtcttggtcacagctactcgactctgacattgtagcccgaaagcatccattgacaatatgtaaatgaatatcatggctgtg

SEQ ID NO: 17805 - DNA, 398 bp, Homo sapiens
  chr11.fa.O7frz.97776697
  Located on chromosome 11
  Distance between a terminus base of telomere on chromosomal short arm and 5'-terminus of this base sequence : 98675825
  Distance between 3'-terminus of neighbour sequence of sequence listing upward to telomere on chrosomal short arm and 5'-terminus of this base sequence : 33195
tataagccatgaaataacgagtttttataaccatatttctacagttgattataaaatctgctccccctccattaattattacatcttaagaaaagaaatgtgaatatagtaaccagctatagagcagagctgccctgtatgcctgatcataaaaatcatctgaggcatttactaaaattaaagtttcctaggatccagctatacagtgtgtgtgtgtgtgtgtgtgtgtgtgtattatgaaaatatattctagttttggccatgaaacattatcaacatcaacacgttaggactgccaaattggcgtatatgtaaaaccctaaaaccaagtgaacactaatcacatctggaatcaatatatgtgccagataatttgtaatagccaattagatcacgtt

SEQ ID NO: 17806 - DNA, 331 bp, Homo sapiens
  AP000626.4_126988
  Located on chromosome 11
  Distance between a terminus base of telomere on chromosomal short arm and 5'-terminus of this base sequence : 98813637
  Distance between 3'-terminus of neighbour sequence of sequence listing upward to telomere on chrosomal short arm and 5'-terminus of this base sequence : 137414
gctctggacctataaactcaagttcatatactcccagtggagcttggaagacatgtttactcttggttcctttatggaactttggcaaaaataatatctctctctctctctctctctctctctcacacacacacacacacacacacacacacacacacacagagagagagagagagagagagagaatatgaaaaatgaatacagggaagagaagggagctgaatatgcctgaataggctgagtggggtagtagaaggaacaagaacagggtgatcgggtttggcatcactgcgttcattcagttctaccctaggtagttcctggacagatc

SEQ ID NO: 17807 - DNA, 225 bp, Homo sapiens
  D11S1367
  Located on chromosome 11
  Distance between a terminus base of telomere on chromosomal short arm and 5'-terminus of this base sequence : 98904099
  Distance between 3'-terminus of neighbour sequence of sequence listing upward to telomere on chrosomal short arm and 5'-terminus of this base sequence : 90131
gctgacatttattcacatggctaatataaacttggaatataagattctttaattcatccatttatgattcattcatacatacaccaattaatattataagcatttattgaacatatatttaaagcattgtgctaggctctctaaatacagattatctatctatctatctatctatctatctatctatctatctatctatctctattgccagggagataacactgt

SEQ ID NO: 17808 - DNA, 397 bp, Homo sapiens
  chr11.fa.O7frz.97046403
  Located on chromosome 11
  Distance between a terminus base of telomere on chromosomal short arm and 5'-terminus of this base sequence : 99292605
  Distance between 3'-terminus of neighbour sequence of sequence listing upward to telomere on chrosomal short arm and 5'-terminus of this base sequence : 388281
atgaaggctacctaacgttaaggtgtttacaggtggtaggattacaggttcctttttttacacataaatacatgtgaatatgtgtgtgtgtgtgtgtgtgtaaacatgtatgcagaggattgaatgatattatgagaatgtatcttcatcaataaaaatcattaaaatgatgtttaagccagccatattctcaatagcagtcataaattcttaggaacaccagaattaggtagacaaataaagaatctggtatgaaaaccaagaagacatgaaagaaatgagaaataaatggaggatgaggtcagaacatagcccatgtcctcaattcaacttattttcattgaggacagcaagcagttattcctttgtcttataattaacaggtacctatgctagc

SEQ ID NO: 17809 - DNA, 433 bp, Homo sapiens
  AC024733.6_67703
  Located on chromosome 11
  Distance between a terminus base of telomere on chromosomal short arm and 5'-terminus of this base sequence : 99392396
  Distance between 3'-terminus of neighbour sequence of sequence listing upward to telomere on chrosomal short arm and 5'-terminus of this base sequence : 99394
atacaagattcagaacaagtgaacatcacacttgttattttcttctgattccttttcaaataacactgtaagtgttattattagaaccttaagacccattagaaacaggataaaagaaaatagaagtaactagctctcctactgggataagagatgaaacaagagagagaaagttttgttctccaaagcagcaattccacattatgagattacataaagaagaaacacacacactcacatatacaccactcaccacacacacacacacacacacacacagagagagagagagtgaaaggggggtggtggaggaacacagaaaaacagagcaaggaaaaaaattagaacattttggagggaagggttccagatggcagccaggatgagcctctgccacaaagatgaaccaaaatatcaggtaaacattcacacg

SEQ ID NO: 17810 - DNA, 391 bp, Homo sapiens
  AC024733.6_136875
  Located on chromosome 11
  Distance between a terminus base of telomere on chromosomal short arm and 5'-terminus of this base sequence : 99429967
  Distance between 3'-terminus of neighbour sequence of sequence listing upward to telomere on chrosomal short arm and 5'-terminus of this base sequence : 37138
actgaacaaatttccttaggatttaaagtgtgggaattatcctctgtggtttgtgttaggttttcaagggaaagcaagggttaaagaaagacacacacacacacacacacacacacacacacacacacacacacagaaagagggcagctcaacagtaaatgcaggctttatgcccagcataaaacctatagaagtggggaaccagcccaatgtcagatcccaccgcggcttacaggctggggcaatttataggtatgggtgggaggggtctggtcagtatagcttgctgcccggcaagatattgataagatgttcccataatgaggcagttctggctcttgttccagcggaatgtcatcgtggtgttccttggacctttgtccagcaagat

SEQ ID NO: 17811 - DNA, 302 bp, Homo sapiens
  chr11.fa.O7frz.96750798
  Located on chromosome 11
  Distance between a terminus base of telomere on chromosomal short arm and 5'-terminus of this base sequence : 99489221
  Distance between 3'-terminus of neighbour sequence of sequence listing upward to telomere on chrosomal short arm and 5'-terminus of this base sequence : 58863
ggtgttattcaacctctgataacctgttaatgatgcattctggtgcaaatgttttcagtctcccctatgcaggaccctgcagttgcctggaactttaagagactcgtgtgtgtgtgcgtgtgtgtgtgtgtttgtaagtgggaaaagtgtgggaaggaatacatctaataaaatctctccacttccactgcaatcaggacaaaatagaactccgaatatattttctgtacttatcattcatgcagtattttactagaaggtttttctgttttaaaacagtgtgaaagcattgcactagagta

SEQ ID NO: 17812 - DNA, 154 bp, Homo sapiens
  AC011088.8_103458
  Located on chromosome 11
  Distance between a terminus base of telomere on chromosomal short arm and 5'-terminus of this base sequence : 99587854
  Distance between 3'-terminus of neighbour sequence of sequence listing upward to telomere on chrosomal short arm and 5'-terminus of this base sequence : 98331
caggaactgaatagatttggatagtaaggaatatgtatacatatttcatagagttctctgagggttaaatgccatatatatatatatatatatatatatatatatatatatatatgaagtatatagaacagtgcttagcatatggtaaggagta

SEQ ID NO: 17813 - DNA, 390 bp, Homo sapiens
  AC011088.8_52647
  Located on chromosome 11
  Distance between a terminus base of telomere on chromosomal short arm and 5'-terminus of this base sequence : 99638652
  Distance between 3'-terminus of neighbour sequence of sequence listing upward to telomere on chrosomal short arm and 5'-terminus of this base sequence : 50644
actgtatagcaacttggagcagcagaagttggaggaccatggctccttcaaggaaacacacagctgcaaggaacaggaacattacacacacacacacacacacacacacacacacacacacacacacatcttgcttcttctctgctaaagattttgatgactgatatacaccatttcagagctatataccttctacaaccctcctttcctgttcttgtatcatacaagggaagagagagaggaacccacaccaatagtccttcaaataattaatagtgaattttccacacattttggtgggtagaggagtcttatgtgaatctttaataaaattgagaagtttaaagaaatgtgatattacttgcactttgagtattgagaagtttggac

SEQ ID NO: 17814 - DNA, 206 bp, Homo sapiens
  AC011088.8_46489
  Located on chromosome 11
  Distance between a terminus base of telomere on chromosomal short arm and 5'-terminus of this base sequence : 99644814
  Distance between 3'-terminus of neighbour sequence of sequence listing upward to telomere on chrosomal short arm and 5'-terminus of this base sequence : 5772
accaggagaaccaattctagaggtgcaaagctcagtttgaatgggtattatcaaagagaaagtaggaaatgtggcaatattgtgtgtgtgtgtgtgtgtgtgtgtgtgtgtgtgtgtgtgtgtgatgtcagggctctagatactgagaatggatagggaggaggaaaacggtgtcaaagggtgtcatctcagacttatcacaaggt

SEQ ID NO: 17815 - DNA, 234 bp, Homo sapiens
  AP002510.1_61047
  Located on chromosome 11
  Distance between a terminus base of telomere on chromosomal short arm and 5'-terminus of this base sequence : 99800182
  Distance between 3'-terminus of neighbour sequence of sequence listing upward to telomere on chrosomal short arm and 5'-terminus of this base sequence : 155162
tctgtacttggctttatttcacttaacataatgacctccagttccacccaggttgctgcaaatgataagattttcttctgttttatggcctaataatattccactgtacaccacacacacacacatatatacacacatatatacatatacatgatattttctttatccttttatcccttgatgggcaattaggttgatttcatattttggctattctgaatggtgattcatatt

SEQ ID NO: 17816 - DNA, 120 bp, Homo sapiens
  DISO7_10003148
  Located on chromosome 11
  Distance between a terminus base of telomere on chromosomal short arm and 5'-terminus of this base sequence : 100033670
  Distance between 3'-terminus of neighbour sequence of sequence listing upward to telomere on chrosomal short arm and 5'-terminus of this base sequence : 233254
ccaacctagatttctatgaagactctacctataaaatgtgtgtgtgtttgtgtgtgtgtgtgtgtgtgtgtgtgacataatctgaaaatgactaatttcatgaccctgaatccatactat

SEQ ID NO: 17817 - DNA, 384 bp, Homo sapiens
  chr11.fa.O7frz.107038893
  Located on chromosome 11
  Distance between a terminus base of telomere on chromosomal short arm and 5'-terminus of this base sequence : 100289363
  Distance between 3'-terminus of neighbour sequence of sequence listing upward to telomere on chrosomal short arm and 5'-terminus of this base sequence : 255573
cactctacattgatggcataacatttttgatgatattgagaccctttcctttaaatctggttccagcgtgcgtcctacagccattctttctgatttctgggctgttatcatatatcgtcaaaaattttactctcacaacaccacccactgatctctcttctctttcccatcaggagtaatctatcatttttctttgtctccaaaggcctttctttgcccaaccacagacacacagacacacacagacacaatacacacacacacagacacgatacatacacacacacacagactctctctctctctctctcttaattttatcttgtcaaaagactatggattttttagaaaacacagcaagtacctttgacttcagattcttta

SEQ ID NO: 17818 - DNA, 242 bp, Homo sapiens
  D11S1366
  Located on chromosome 11
  Distance between a terminus base of telomere on chromosomal short arm and 5'-terminus of this base sequence : 100424004
  Distance between 3'-terminus of neighbour sequence of sequence listing upward to telomere on chrosomal short arm and 5'-terminus of this base sequence : 134257
gctacaatgatagggaaataatagaagaaatctatctatctgtatctatctatctatatctatctgtctgtctatctatctatctatctatctatctatctatctatctatctatctatctccttagtcatatttttgtgaaggttcttaggaagccagacagtcgagttatgttgaaatgaaaataattgatattttaagccgtgctacaaaaaagcccataaatagcaaaggatcccacc

SEQ ID NO: 17819 - DNA, 319 bp, Homo sapiens
  chr11.fa.O7frz.107117524
  Located on chromosome 11
  Distance between a terminus base of telomere on chromosomal short arm and 5'-terminus of this base sequence : 100450076
  Distance between 3'-terminus of neighbour sequence of sequence listing upward to telomere on chrosomal short arm and 5'-terminus of this base sequence : 25830
gatctctgtccaaccttaagatagcaccctgagtttttgtgatgttcacctcccattctccagcatacacacacacgcacacacacacacacacacacacacccgtacatgtatgtacacacacacacacacacacatctatatgtatgtataggcatttacaacatttctgctcaccaaattcagtcaacacaatgttatcaatgcagtggacccgtctaataccctgtagaatagtgagataatcaagatttttggggccagtttatgcagagaaccagaggtgaactagcaaaggtgtacttctgacctgaagcta

SEQ ID NO: 17820 - DNA, 149 bp, Homo sapiens
  D11S917
  Located on chromosome 11
  Distance between a terminus base of telomere on chromosomal short arm and 5'-terminus of this base sequence : 100703027
  Distance between 3'-terminus of neighbour sequence of sequence listing upward to telomere on chrosomal short arm and 5'-terminus of this base sequence : 252632
aagacagatgccaagccgtgtgtgtgtgtgtgtgtgtgtgtgtgtgtgtgtgtgtgtaaaacaaaacaaaaagcactctgaggaaatatggaaaatttaaagggaagaaaacttcaaaaacaacaaatacaacatgaacagcaactata

SEQ ID NO: 17821 - DNA, 380 bp, Homo sapiens
  AC009820.5_185132
  Located on chromosome 11
  Distance between a terminus base of telomere on chromosomal short arm and 5'-terminus of this base sequence : 100864451
  Distance between 3'-terminus of neighbour sequence of sequence listing upward to telomere on chrosomal short arm and 5'-terminus of this base sequence : 161275
ttaagacagaaggaaagataacatttaaaaactattctattgaattctcagcttaaaataaaagttagaaaaataaataaaaaatatcaattttgaattttggattatatagcagtattgtattaaaataaaatttcttcaggttgaaaaccatactgtggttttataacaaaatgttctcattaagaagtatacaccaagatatttaggtgtaagaaagcaggatgtctccacaaatccatagacagatgtgtacacacacacacacacacacacacacacacacacacacacacagatggatcagtaatagatggatagaatatttttttaaaatagtacaaactagtacaaactgtaatgaataagtggttagtctg

SEQ ID NO: 17822 - DNA, 436 bp, Homo sapiens
  AP002778.2_18772
  Located on chromosome 11
  Distance between a terminus base of telomere on chromosomal short arm and 5'-terminus of this base sequence : 101032275
  Distance between 3'-terminus of neighbour sequence of sequence listing upward to telomere on chrosomal short arm and 5'-terminus of this base sequence : 167444
gaattaagcatggtgtctcacacctataatcccaacattttgggaggccaaacataggaggattgcttgagcctaggaattccagaccatctttggtgacatagtgaaaccctgcctttacaaaaattcaaaaatgagtcagatgtggtggtgtgtacctgtagtcgcagctactcaggaggctgaggtgggagaattgcctgagcactccagcctgggggaaagagtgagactcttccctgcaacctttctttttacacacacacacacacacacacacacacacacacacacgtacatacatacatatatacatatatatacacactcccttgacatcatacatatatatcaacaaatataccccatctagaactccctaccttcatcaaatctttagaaacaattgtctgtgttatctgcttccacttcagta

SEQ ID NO: 17823 - DNA, 257 bp, Homo sapiens
  D11S920
  Located on chromosome 11
  Distance between a terminus base of telomere on chromosomal short arm and 5'-terminus of this base sequence : 101032451
  Distance between 3'-terminus of neighbour sequence of sequence listing upward to telomere on chrosomal short arm and 5'-terminus of this base sequence : -260
aggaggctgaggtgggagaattgcctgagcactccagcctgggggaaagagtgagactcttccctgcaacctttctttttacacacacacacacacacacacacacacacacacacacgtacatacatacatatatacatatatatacacactcccttgacatcatacatatatatcaacaaatataccccatctagaactccctaccttcatcaaatctttagaaacaattgtctgtgttatctgcttccacttca

SEQ ID NO: 17824 - DNA, 407 bp, Homo sapiens
  AC021962.3_135439
  Located on chromosome 11
  Distance between a terminus base of telomere on chromosomal short arm and 5'-terminus of this base sequence : 101072039
  Distance between 3'-terminus of neighbour sequence of sequence listing upward to telomere on chrosomal short arm and 5'-terminus of this base sequence : 39331
tcattctgtaacttacgattcatcatttgtaactccccacttctaagtagcactgtttatgatggacagaattgagtgccagttagaagatattaatcaaactaacttaaacaaaagacaatgcattttgatgcaattaaagtcaaacctaagtgtagaatacctttaggcaaagcgtttcaaattgttatcacattgtttctctctctctctctctctcacacacacacacaaacacacacacacacacaccacaacctatataacaaggaaggggggatcaagtaatcgatagttctagtaaaaccccatagattagaagaggggtagatattcacagtggtatgttatcagacaaaagcaatatgtgttaactagagctactctgcaagatactgccttagata

SEQ ID NO: 17825 - DNA, 436 bp, Homo sapiens
  chr11.fa.O7frz.107836353
  Located on chromosome 11
  Distance between a terminus base of telomere on chromosomal short arm and 5'-terminus of this base sequence : 101150106
  Distance between 3'-terminus of neighbour sequence of sequence listing upward to telomere on chrosomal short arm and 5'-terminus of this base sequence : 77660
ttcctgtaatgcacttgagtacatgtgcaagtaccatctgttccgtaccacgttctgtttttgagattagagcttggggtactgaagcaagctgttgctttggcttctgattttgcaatgagtaataaactgtctttgtctctgaaccagaggcagacattttatgtgcacacacacatgtgtatatatacatattaatatatgtattatatgtatctatataaacatttgtatactatatgtgtatatatactacagacacacacacacacacacacagtgggaagcaaatttgttagcacctaagtagattaaaaactcaaattcttctgacttaactttctgaattaacaggtctctgttaccttgtccataatactgatacaggtttaaaattgctttcagcaaatttgtaatatggactgtacattcgatc

SEQ ID NO: 17826 - DNA, 479 bp, Homo sapiens
  chr11.fa.O7frz.107936946
  Located on chromosome 11
  Distance between a terminus base of telomere on chromosomal short arm and 5'-terminus of this base sequence : 101248618
  Distance between 3'-terminus of neighbour sequence of sequence listing upward to telomere on chrosomal short arm and 5'-terminus of this base sequence : 98076
gtagcttaggaccacttcaaaccagctgagagcacttacagagctgtatttttaaataaatatacccataggatttgaaaaatattgacaataaaaaatcctactaagatgaattacaactcccttatatgttcttcattacattttaaaaaatcctttgtagtatactttattgtgtgtgtgtgtgtgtgtgtgtgtgtgtgtgtgtgtgtgtgtgtgcgcctaagctcaggagggaggaagaatgggagaaagaagagggaaggtgaggaagtgaggaaggagaagaaagtggccaaggcggattcatgaaaattttagttaacacatgacaatctggctgtctctaaccacactacagcaaagctagctcttctcaattattcgtctttttccccaactttggttgcttatttgttttgttgtattccatttaatgaacacatgtatgtataaggtttagccaaagtcatttcata

SEQ ID NO: 17827 - DNA, 395 bp, Homo sapiens
  AP002379.2_37347
  Located on chromosome 11
  Distance between a terminus base of telomere on chromosomal short arm and 5'-terminus of this base sequence : 101328788
  Distance between 3'-terminus of neighbour sequence of sequence listing upward to telomere on chrosomal short arm and 5'-terminus of this base sequence : 79691
gttaacagtaaggcttctggtcaacagtaggctttgaaaagttaaatgttatacagaaatttcgactgcacaggaggtctggcacacctacccactgtgttgttcaagggtcaattgtaacagggaaagaagatgagaagggaattggttggtacattcaataataaccaagcaaggaagaaaactgcctaccttccacagtagtcatgtctgcatttggatatatggccatagttgatatttaactgtgtgtgtgtgtgtgtgtgtgtgtgtgtgtgtgtgtgtatttttccttttactatccaaacccaatattccctttgctttcaattagctatcaggctggttgaagtcttttcttaggggagatagtctaactttcattctggaaaggt

SEQ ID NO: 17828 - DNA, 473 bp, Homo sapiens
  AP002379.2_105687
  Located on chromosome 11
  Distance between a terminus base of telomere on chromosomal short arm and 5'-terminus of this base sequence : 101424800
  Distance between 3'-terminus of neighbour sequence of sequence listing upward to telomere on chrosomal short arm and 5'-terminus of this base sequence : 95617
tatggcttacatatcctacagaagtccttttgagcaaagtgaaggcatggtaactgtacagcgtaataaagaaaatgtgtctctccagagtaaaggggaggcatgtttactgtttattataaaggtttcagattccctaagctcaggatccctctctgtttctaattcactgcatgggcaggtatcatctcaccctctttacattgctctgtggaaactaagatttgatgaactcttggaaaaagttcatatctaactactgactaagcatctctgtgtgtgtgtgtgtgtgtgtgtgtgtgtgtgtgtgtgtgtgtgtgtgtccacagtggatattatctctctttactcaaaatccaagagaaagagaatgagttagatcatttgcaaaatttattttagctttaatagtttatgtgtatatgtgcatatttatacctatgtctgtacttatgtctatgcctacatctcat

SEQ ID NO: 17829 - DNA, 160 bp, Homo sapiens
  G12410
  Located on chromosome 11
  Distance between a terminus base of telomere on chromosomal short arm and 5'-terminus of this base sequence : 101521727
  Distance between 3'-terminus of neighbour sequence of sequence listing upward to telomere on chrosomal short arm and 5'-terminus of this base sequence : 96454
aaatattaccgggcttggacaaacaggcagaagaaaagaactgaaacaattgcttttgtttatctatctatctatctatctatctatctatctatctatctatctatctatctggtttgaaattctgaagagatttctgaaattctgaaggattccaccc

SEQ ID NO: 17830 - DNA, 139 bp, Homo sapiens
  DISD22_0005488
  Located on chromosome 11
  Distance between a terminus base of telomere on chromosomal short arm and 5'-terminus of this base sequence : 101645075
  Distance between 3'-terminus of neighbour sequence of sequence listing upward to telomere on chrosomal short arm and 5'-terminus of this base sequence : 123188
aagctctttgcatgattgctttgccctgtcccggttgctaaaattgtgtgtgtgtgtggtgtgtgtttagacagagagagacacacacacacacacagagagagagagagagagagagatccatgctacagtttgcaag

SEQ ID NO: 17831 - DNA, 195 bp, Homo sapiens
  G12417
  Located on chromosome 11
  Distance between a terminus base of telomere on chromosomal short arm and 5'-terminus of this base sequence : 101656324
  Distance between 3'-terminus of neighbour sequence of sequence listing upward to telomere on chrosomal short arm and 5'-terminus of this base sequence : 11110
ctgaattcacagacatgaaacctgtacatatggaaagtcaccaactctctctctctctcgctctctctctcactatagatagatagacagatagatagatagatagatagatagatagatagatagatatgcacacacacatgcacatacatcatgttagtacatttccctaacccggttgaacatccatacatg

SEQ ID NO: 17832 - DNA, 272 bp, Homo sapiens
  chr11.fa.O7frz.132751987
  Located on chromosome 11
  Distance between a terminus base of telomere on chromosomal short arm and 5'-terminus of this base sequence : 101829042
  Distance between 3'-terminus of neighbour sequence of sequence listing upward to telomere on chrosomal short arm and 5'-terminus of this base sequence : 172523
ctagctcttattgctcagcacatagcagcctcctgcaagtgcccacacacacacacacacacacacacacacacccgggatccccaaagcccctgtttctgacctatcacctgacacccagtcaggtgacctgcagatgcaatggccaccccagtattgtagctggtgtttgtgccatttctcacaaggggcaatggaggcactgaggttatattctaggagggacaccacccagaaagaggccccagggagttaggttgagccagagtctg

SEQ ID NO: 17833 - DNA, 240 bp, Homo sapiens
  Z17001.1_117
  Located on chromosome 11
  Distance between a terminus base of telomere on chromosomal short arm and 5'-terminus of this base sequence : 101976351
  Distance between 3'-terminus of neighbour sequence of sequence listing upward to telomere on chrosomal short arm and 5'-terminus of this base sequence : 147037
gattgtgcattgaactccagcccgggcgatagagtgagactctgtctcaaacacacacacacacacacacacacacacacacacacacacaaaatctcaaaaatcaagagtctggttcacttcttttctggacatttaggctagtccatccctctggaaaggccccaccacaatgctcatggcttttactttaagagcactttctatgtgttaagtgcctcacatggagtttcattgagt

SEQ ID NO: 17834 - DNA, 253 bp, Homo sapiens
  D11S924
  Located on chromosome 11
  Distance between a terminus base of telomere on chromosomal short arm and 5'-terminus of this base sequence : 101976359
  Distance between 3'-terminus of neighbour sequence of sequence listing upward to telomere on chrosomal short arm and 5'-terminus of this base sequence : -232
attgaactccagcccgggcgatagagtgagactctgtctcaaacacacacacacacacacacacacacacacacacacacacaaaatctcaaaaatcaagagtctggttcacttcttttctggacatttaggctagtccatccctctggaaaggccccaccacaatgctcatggcttttactttaagagcactttctatgtgttaagtgcctcacatggagtttcattgagtcctttgagtggcccaatgagg

SEQ ID NO: 17835 - DNA, 116 bp, Homo sapiens
  D11S4129
  Located on chromosome 11
  Distance between a terminus base of telomere on chromosomal short arm and 5'-terminus of this base sequence : 101995270
  Distance between 3'-terminus of neighbour sequence of sequence listing upward to telomere on chrosomal short arm and 5'-terminus of this base sequence : 18658
acagcgaccacatctcctgctccccgcccccttacacacacacacacacacacacacacacacacacacacacgctcacgcatgctgctccttaagtgatggtaagggcagtggcc

SEQ ID NO: 17836 - DNA, 130 bp, Homo sapiens
  D11S4171
  Located on chromosome 11
  Distance between a terminus base of telomere on chromosomal short arm and 5'-terminus of this base sequence : 102010173
  Distance between 3'-terminus of neighbour sequence of sequence listing upward to telomere on chrosomal short arm and 5'-terminus of this base sequence : 14787
tcatggcagtgtgaacagaggcataaacctctgtgtgagtctccaccatccctccacactccacacacacacacacacacacacacacacacacacacacacctctgagctctctgagacctgggaccat

SEQ ID NO: 17837 - DNA, 384 bp, Homo sapiens
  AC010762.3_86103
  Located on chromosome 11
  Distance between a terminus base of telomere on chromosomal short arm and 5'-terminus of this base sequence : 102066276
  Distance between 3'-terminus of neighbour sequence of sequence listing upward to telomere on chrosomal short arm and 5'-terminus of this base sequence : 55973
ccactgagttcagtacttcaaaattgccgtgctctacctctccccagtgcacaaaaacactctccacaccaagctgctgctgctgggggatggagggatggcgtcagcgattcaagactgtttttcctacctgttcagcacttctttcagcgatatgaagttaaatccaggtactatgagtgctcacttgatttttgtttcttatgaaggagctttttgtgtgtgtgtgtgtgtgtgtagatagttgttaaattggtgtccttgccagggaggaggggacaattagtggagtctcttattctgccatcttgctcttcctcaatatgctctttcttgcagatcttttacaactctctatatttgttcagtttgcatcttacttgt

SEQ ID NO: 17838 - DNA, 465 bp, Homo sapiens
  chr11.fa.O7frz.114834538
  Located on chromosome 11
  Distance between a terminus base of telomere on chromosomal short arm and 5'-terminus of this base sequence : 102737376
  Distance between 3'-terminus of neighbour sequence of sequence listing upward to telomere on chrosomal short arm and 5'-terminus of this base sequence : 670716
gaaatgctatgtttcatgaaagctttaaaaactaccctggatttctcatttcttcatatttcagttaaaactgttttgcagttactttaacagtacacacacacacacacacacacacacacactctctttgattagttctgattgctcaatactttcctcaatgtcaatgtcatcttacaagcaagactaggaaggagaaaaacgtagttacacattaaaatttgttttatatagagtaaaaaatgttaatattcataatggattgttagtttagaaaattttcaaatggcagctttttcctaaatgagcatgcattcttcaagtggggcaatattgtccccaatggggtgcaattagatcttagagggtgaacacaatcttagatattgcaacggtctgtgttccttcaaagggctagcagatataaatagatatacatttctgtggtattaccattcacaag

SEQ ID NO: 17839 - DNA, 283 bp, Homo sapiens
  AC024052.3_102177
  Located on chromosome 11
  Distance between a terminus base of telomere on chromosomal short arm and 5'-terminus of this base sequence : 103024093
  Distance between 3'-terminus of neighbour sequence of sequence listing upward to telomere on chrosomal short arm and 5'-terminus of this base sequence : 286252
cctgagttaccagtctgctagtccgccctacaagtttcagatttactagccccaaaaccaggggctgattccttaaaatccctctttctctctctctctctctctctctctctctgtgtgtgtgtgtgtgtgtgtgtgtgtacatatatatcctactggttctgtgccctctctttcacctggaaggagagttcaactgtgccagaggcttcagagtattggttttcagtgttccacagaaaagcatctcttgaacaaggtgaacttcatttcagagtattgt

SEQ ID NO: 17840 - DNA, 392 bp, Homo sapiens
  chr11.fa.O7frz.114461561
  Located on chromosome 11
  Distance between a terminus base of telomere on chromosomal short arm and 5'-terminus of this base sequence : 103109012
  Distance between 3'-terminus of neighbour sequence of sequence listing upward to telomere on chrosomal short arm and 5'-terminus of this base sequence : 84636
ggatgctaatgtctgagtgacgtgcagccttgagttttttttcctgctccaaatttgcactggtgtgtgtgtgtgtgtgtgtgtagaagtgagggtttttaaaaaaaaaaaaatcctaggttcctctaatttgcatgagatgtgatattgtcaaatagtttcttgggcctttaattattctcttatttgcctgggttgggctctttctacccagtgtcagcagtatcccttctcactttcctgtagggaaaaaattattcttggagccttttcatctgcaattacccaagcctgccaagaaatggcttttagcagactgcaacagaatctctgaatacaaataaattcaaggacttatcaaaaagcattcaagtcatagaccagtttccatt

SEQ ID NO: 17841 - DNA, 328 bp, Homo sapiens
  chr11.fa.O7frz.114305245
  Located on chromosome 11
  Distance between a terminus base of telomere on chromosomal short arm and 5'-terminus of this base sequence : 103325169
  Distance between 3'-terminus of neighbour sequence of sequence listing upward to telomere on chrosomal short arm and 5'-terminus of this base sequence : 215765
ttgtaagcaacctaggctattattctaaatccaattgcattgtgtcatacactggtcttgtaatatttgaaatggttcaattgtactaatttcctctttccctggaaaacattggagaaaactttagctaaatgtggtgctttattttttctaattcaaatttttacttgtttgagtagaggagtatgactctctgtgtgggcgtgtctctctgtgtgtgtgtgtgtgtgtgtgtgtgtgtgtgtgtgtgtgtgatatggaaaaggctttatgtaaaagatgataggatagaactggatgatttttctatttgaccttggaatattcc

SEQ ID NO: 17842 - DNA, 357 bp, Homo sapiens
  chr11.fa.O7frz.114217273
  Located on chromosome 11
  Distance between a terminus base of telomere on chromosomal short arm and 5'-terminus of this base sequence : 103413209
  Distance between 3'-terminus of neighbour sequence of sequence listing upward to telomere on chrosomal short arm and 5'-terminus of this base sequence : 87712
gtgataatgaggaagatgtttagtgaaaatggtagagtctgagagaacactcttagattagaaacttcagaattgttattgacttttttcttcccttcaatctaagtgtccaactctctctctcacacacacatgcgtgcacacgagcacacacacacacacacacacacacacacacacacacactttatcaactgccttcaggcccttcttgaccatccggccgttgtcaccactgattttctagttttgctgattctatccttacctcctcttatttatcaccacactgtttccagaatattattttgtaaatcactacaggatcctgtcaactccatggtttaatcctttagt

SEQ ID NO: 17843 - DNA, 438 bp, Homo sapiens
  chr11.fa.O7frz.114111875
  Located on chromosome 11
  Distance between a terminus base of telomere on chromosomal short arm and 5'-terminus of this base sequence : 103518574
  Distance between 3'-terminus of neighbour sequence of sequence listing upward to telomere on chrosomal short arm and 5'-terminus of this base sequence : 105008
ttgataattctgacctttaagaacactttattctcttggcttcttgatcactacagcctcccaggctttcttctatatacctaactactatttcttggttttaatgatggacaacttttccttttctaaacatctcaatattgaagtgcaccagtgccagatacttggccattcctatggttttaaacactatgttgatatgctgataattgctaattttctatttccaattccagtagctttctcatcaattacttctctgacatttccaccaagatgtctaaaagacatctaaacttatcatgttcaaattagaacttttaatttgcaagaccactcccctcctccctaaacaacaacaacaacaacaacaacaacaacaaaactctgctctattaccatattgtcagtatccttcaactcactaaaccacttaac

SEQ ID NO: 17844 - DNA, 416 bp, Homo sapiens
  AC024177.4_129163
  Located on chromosome 11
  Distance between a terminus base of telomere on chromosomal short arm and 5'-terminus of this base sequence : 103725031
  Distance between 3'-terminus of neighbour sequence of sequence listing upward to telomere on chrosomal short arm and 5'-terminus of this base sequence : 206019
caggtagttagaactgtaggtcaagagttcaaaaaacaggttaaaaactaaagatacataatctctatttaaattcttctctccttgggggaaaaaaagattggtcaaaggatatttttgaaagagataatttttaaaacacctagtacaccctataatgttatgtctattttcaatacttataaatgggacaaatgcaaaaacattttataaataaaactaaagcctaactcttgattcactaaggagagttacattaacaagaatataaaataaataaggttacacacacacacacacacacacacacacacacacactcctatgagaagtgtatagacaggagctaggtggcctgggtttgaatcctggctctaccacttgatagccatgtgaccttagacaagtgaattaac

SEQ ID NO: 17845 - DNA, 470 bp, Homo sapiens
  AC024177.4_2829
  Located on chromosome 11
  Distance between a terminus base of telomere on chromosomal short arm and 5'-terminus of this base sequence : 103730945
  Distance between 3'-terminus of neighbour sequence of sequence listing upward to telomere on chrosomal short arm and 5'-terminus of this base sequence : 5498
gtcctgctctgaaatctatgtaaacattaaaatttaattaaaagcaaaaaggatttgggagagatttaatgaaattatccataggtaataaagtaaacttttatgccataatttaatgataatactattaatgtttgcatacaaagtatcattaatagaagagacaaacccacacacacacacacacacacacacacacacacacacacacacacacataaagtgtagcattctctacctcaaaaaacttgacagggcctccgtgctgtactgcattatataaaaatttgccaatacggcattcaaggcactgtcctaaacatcccatctgtctttctagttttatttcattatattactgatcagcaaaaccattaatatatgtcaatatcggaagaattttacattatcagtaaatatcctatccttcatctccagtgttcttcagaatgttccatttgcctagagta

SEQ ID NO: 17846 - DNA, 184 bp, Homo sapiens
  chr11.fa.O7frz.113470045
  Located on chromosome 11
  Distance between a terminus base of telomere on chromosomal short arm and 5'-terminus of this base sequence : 104003962
  Distance between 3'-terminus of neighbour sequence of sequence listing upward to telomere on chrosomal short arm and 5'-terminus of this base sequence : 272547
cttgccttacacatgttaagatagactataggctaaatatatcaataaatcaactttaaggagagaggtgagtgtatgtatgtgtgtgtgtgtgtgtgtgtgtgtgacagagagagagacggtccctgacatattatacatgagtaccctatttttaagagaaaacaatgaatttcttggattt

SEQ ID NO: 17847 - DNA, 436 bp, Homo sapiens
  chr11.fa.O7frz.113585397
  Located on chromosome 11
  Distance between a terminus base of telomere on chromosomal short arm and 5'-terminus of this base sequence : 104047378
  Distance between 3'-terminus of neighbour sequence of sequence listing upward to telomere on chrosomal short arm and 5'-terminus of this base sequence : 43232
cctcaaggttaggatttctaacaggatttccttatttcttaaggctgaataatatatctttatgtatatatatatatatacacacatatatatatgtgtgtatatatatatatacacacatatatatatgtatatatatatacacacacgcacacacacacacccctatatactacattttcactttttttgagacagggtctcactctgttgcccaggctagagtacaggggcaccatctctgctcactctcactacaatctctgcctcccggggtcaagcgattctcctgcctcagcctcccaagtagctaggattacaggcgcctgctgccacgcccagctaattttcatatttttagcagagatggggtttcatcatgttggccaggctggtctcgaacccctgacctcaggtaatctgcctgtcttgtcct

SEQ ID NO: 17848 - DNA, 233 bp, Homo sapiens
  Z66956
  Located on chromosome 11
  Distance between a terminus base of telomere on chromosomal short arm and 5'-terminus of this base sequence : 104082279
  Distance between 3'-terminus of neighbour sequence of sequence listing upward to telomere on chrosomal short arm and 5'-terminus of this base sequence : 34465
tatgctcaagtgacttcattctgttcctctctctctctctctctctgtgtgtgtgtgtgtgtgtgtgtgtgtgtttcttttacttttctctttcccttccctgaatcaccctccttttcttcctctgtatggactcatctgattcgtcagcagaacatgcatggtttatttttggtcaagacactagcaaaagtaggcaacctgggataataacagggcttccagtgcgagag

SEQ ID NO: 17849 - DNA, 317 bp, Homo sapiens
  AP000647.3_36531
  Located on chromosome 11
  Distance between a terminus base of telomere on chromosomal short arm and 5'-terminus of this base sequence : 104192890
  Distance between 3'-terminus of neighbour sequence of sequence listing upward to telomere on chrosomal short arm and 5'-terminus of this base sequence : 110378
tgtattacaggcatttggtaagaagacccttatttcattgtcatgcaggaatctccaggcatttttatgatttcaaaataaagtgcagaatcaaaacagtttttaaatcattcagtctgatatcttttttactccaaattcctgaaaatcttaactttccaatttatgcaaagtgggtttaaatttgtgtgtgtgtgtgtgtgtgtgtgtgtgtgttttcctgaataacttcctagtctctgtttcatatccgcacataaaatcaaaggatacttcctcacacagaagccattatctttcaggtcactatgttggta

SEQ ID NO: 17850 - DNA, 376 bp, Homo sapiens
  AP000647.3_56299
  Located on chromosome 11
  Distance between a terminus base of telomere on chromosomal short arm and 5'-terminus of this base sequence : 104243354
  Distance between 3'-terminus of neighbour sequence of sequence listing upward to telomere on chrosomal short arm and 5'-terminus of this base sequence : 50147
aaacttggcaaggatctaatacaaatgttcttatttcagatcacggtgacaattctccatttgatggacccaatggaatccttgctcatgcctttcagccaggccaaggtattggaggagatgctcattttgatgccgaagaaacatggaccaacacctccgcaagtaagttaatcaagattatgtccacacacagcttctgaattaaccttttacagattagaatacacacacacacacacacacaataaaggtaacataatatttcaaactcacaaaaagtgatcatttgaaatttttgctacctcatgatactaagtcaatttgggatttttttaaaaaaagaaagaaaaagacatgctgaatctgattactg

SEQ ID NO: 17851 - DNA, 113 bp, Homo sapiens
  D11S4108
  Located on chromosome 11
  Distance between a terminus base of telomere on chromosomal short arm and 5'-terminus of this base sequence : 104319258
  Distance between 3'-terminus of neighbour sequence of sequence listing upward to telomere on chrosomal short arm and 5'-terminus of this base sequence : 75528
gcccatagatggatgagtagataaagaaaatgtggtggtggggtatgtgtgtgtgtgtgtgtgtacagtagaatattgtttaggctttaaaacagagatcctgccacttgcca

SEQ ID NO: 17852 - DNA, 245 bp, Homo sapiens
  HUMUT1283
  Located on chromosome 11
  Distance between a terminus base of telomere on chromosomal short arm and 5'-terminus of this base sequence : 104452593
  Distance between 3'-terminus of neighbour sequence of sequence listing upward to telomere on chrosomal short arm and 5'-terminus of this base sequence : 133222
tccagcctgaggtatagagcaagaacctgtctcaaaaaacaaactgaccagatagatagatagatagatagatatatagatagatgatagatagatacatataggtagatgatagatgatagatagataggtaggtagatagatagatgatagatagatagatagatagatagatagatagatagatagataattagcctggcatggtggcacgcactgtagtcccagctacttgggcggcttta

SEQ ID NO: 17853 - DNA, 122 bp, Homo sapiens
  D11S1339
  Located on chromosome 11
  Distance between a terminus base of telomere on chromosomal short arm and 5'-terminus of this base sequence : 104777997
  Distance between 3'-terminus of neighbour sequence of sequence listing upward to telomere on chrosomal short arm and 5'-terminus of this base sequence : 325159
atggccttggaaaaatatctcagaaacccaaatgaaaaactgaaaacagtttaaaacacacacacacacacacacacacacacacacattttttaaaaagcactgaagaactggttacaccc

SEQ ID NO: 17854 - DNA, 402 bp, Homo sapiens
  AP001527.3_4555
  Located on chromosome 11
  Distance between a terminus base of telomere on chromosomal short arm and 5'-terminus of this base sequence : 104905451
  Distance between 3'-terminus of neighbour sequence of sequence listing upward to telomere on chrosomal short arm and 5'-terminus of this base sequence : 127332
tgaactcctgtactcaagtgatccgcccgcctcagcctcccaaagtgctgggattacagacgtgagccaccatgcctggcccttggctacacttctatggtagcacctttgacatattagtacatacacacacacacacacacacacacacacacacacacacacattttaacatatcaagttcatttagtacaggttttcttatttaccttaatgttccctatatctagcagagtacatggaaaatacacaataaatacttttatatgaataaaaagagagaaaaattgctcttatgtgttaagccagcatagtagcagtagactcccaggaaagagatgcagggcaggtctggcacagctggtcatatttgatcttgatgtatcaaacagatgagtcatt

SEQ ID NO: 17855 - DNA, 404 bp, Homo sapiens
  chr11.fa.O7frz.112274190
  Located on chromosome 11
  Distance between a terminus base of telomere on chromosomal short arm and 5'-terminus of this base sequence : 105099424
  Distance between 3'-terminus of neighbour sequence of sequence listing upward to telomere on chrosomal short arm and 5'-terminus of this base sequence : 193571
ctacttatcttgacgtttgcagattctttcttctgctggctcaaatccgctattgagctctagtgaatttttcacttcagttagttttcaacttctgaattaatatttggtttttcaaaaaataatttctatctttttattttttattggatgaaacataattttcatacttccctgtaggtctttagctatggcttcctttagtactttgaacatgtttaagtagttgatgtaaagtctttgtctagtaagttcaatattttttcttcctcagggaaagtttctattgactttgtgtgtgtgtgtgtgtgtgtgtgtgtgtgtgtgtgtgtgttgtgtatgggccttactttcttgtttctttgcatgactttaattttttgttgaatattggacattcaaga

SEQ ID NO: 17856 - DNA, 295 bp, Homo sapiens
  chr11.fa.O7frz.112200213
  Located on chromosome 11
  Distance between a terminus base of telomere on chromosomal short arm and 5'-terminus of this base sequence : 105169327
  Distance between 3'-terminus of neighbour sequence of sequence listing upward to telomere on chrosomal short arm and 5'-terminus of this base sequence : 69499
caatgcgcttagacaactataccaagcgttttgttgtgaaactaaatagagccatagaaatagacagatttggaaatcaagttaagggagatgtgtgtgtatgtgtgtgtgtgtgtgtgtgtgtgatgtaggtgttttaaaatatcaaactcttgagcattctatatgttcagagaaaatatccatcgaaaagggagaagttgacaatccaggaaaagatgtggaaccagtgtcactgaacacctgtgtgattctcataaaagtcacacctgtgtgattctgaataaagaccaca

SEQ ID NO: 17857 - DNA, 344 bp, Homo sapiens
  HUMUT8147
  Located on chromosome 11
  Distance between a terminus base of telomere on chromosomal short arm and 5'-terminus of this base sequence : 105342407
  Distance between 3'-terminus of neighbour sequence of sequence listing upward to telomere on chrosomal short arm and 5'-terminus of this base sequence : 172785
cccagatccatactttcatcattttaattatttatttgtaactttcttttcttttcttttctttctctttctttctctttctttcttttctttctttctctttctttctttcctttctttctttttctctttctttctttctttctttctttcttttattctttctcactcttctatctatctatctatctatcatctatcatctatcagtctatctgtttagagacagagccttgctttgtcacccaggctggagcacagttggacaattatagttcactgtagtctcgaaacctcctgctttggcttcctgagtagctaggactgactacaggcatggcatg

SEQ ID NO: 17858 - DNA, 182 bp, Homo sapiens
  Z17194.1_68
  Located on chromosome 11
  Distance between a terminus base of telomere on chromosomal short arm and 5'-terminus of this base sequence : 105362176
  Distance between 3'-terminus of neighbour sequence of sequence listing upward to telomere on chrosomal short arm and 5'-terminus of this base sequence : 19425
agtgaatggaatcaaacttcacataggagggtgtgaggaagaaagttagaaagggagattttgagtctcaacaatattaaaaaaagggacaataatttatgtgtgtgtgtgtgtgtgtgtgtgtgtgtgtgtgtgtgtgtgcgaccagagatttttgctcaaatcagtctacctgagcattt

SEQ ID NO: 17859 - DNA, 183 bp, Homo sapiens
  D11S940
  Located on chromosome 11
  Distance between a terminus base of telomere on chromosomal short arm and 5'-terminus of this base sequence : 105362183
  Distance between 3'-terminus of neighbour sequence of sequence listing upward to telomere on chrosomal short arm and 5'-terminus of this base sequence : -175
ggaatcaaacttcacataggagggtgtgaggaagaaagttagaaagggagattttgagtctcaacaatattaaaaaaagggacaataatttatgtgtgtgtgtgtgtgtgtgtgtgtgtgtgtgtgtgtgtgtgcgaccagagatttttgctcaaatcagtctacctgagcatttggggatga

SEQ ID NO: 17860 - DNA, 375 bp, Homo sapiens
  chr11.fa.O7frz.111858167
  Located on chromosome 11
  Distance between a terminus base of telomere on chromosomal short arm and 5'-terminus of this base sequence : 105629187
  Distance between 3'-terminus of neighbour sequence of sequence listing upward to telomere on chrosomal short arm and 5'-terminus of this base sequence : 266821
tctgctcttgttagattcacacaatctatctagtcccccaccaaactctatcaacacaattatttggctagtgaattttagactccttaaatatagcacatgtaatatcagacatggaagagagaaagacgggaggtgggcagagagagagagacagagagagagataaacaaggcagaaatgaaaaaagaggtggatttgaaaggatgtacactcccttttcccttgggagtctggcccaccacatgctccatttctttttggaaggctcaggttccctcttcacttttttttttttttcttcttgagatggagtgtagctctgtcgcccaggctggagtgcagtggcccctcttcacttctaagcaagtgcta

SEQ ID NO: 17861 - DNA, 461 bp, Homo sapiens
  chr11.fa.O7frz.111751207
  Located on chromosome 11
  Distance between a terminus base of telomere on chromosomal short arm and 5'-terminus of this base sequence : 105736861
  Distance between 3'-terminus of neighbour sequence of sequence listing upward to telomere on chrosomal short arm and 5'-terminus of this base sequence : 107299
ccagcaaatcttattgtatgagtaataaacttcttcataccctgttgggtgtgtgtgtgtgtgtgtgtgtgttcatcaatcttgacatttgaaccaaattttgtatgggggtccatcctacattttcaaagtggctagacaactcattaaatgagaataatcttgtttaaaaccatcaacaagttgataaagtattaagcagtgttctagaacactttactatcactctctcctcccaattaacatgtttttctttagttctgtttcctttttaacctataaataagatagcactatttttagtatcttataaagacaatgtttacctatatgtttaccaacatatttgagcaccatttcttttttctgtctcctacctgctgtctgtagtcattttctttatttatttcagcaattcttttatcttacacatttcactgttgtcacctcttcatagatga

SEQ ID NO: 17862 - DNA, 480 bp, Homo sapiens
  chr11.fa.O7frz.111377567
  Located on chromosome 11
  Distance between a terminus base of telomere on chromosomal short arm and 5'-terminus of this base sequence : 105778880
  Distance between 3'-terminus of neighbour sequence of sequence listing upward to telomere on chrosomal short arm and 5'-terminus of this base sequence : 41558
atgtatttgtatcgattaaccaacttcacacacacacacacacacacacacacacacacaccacacacccttcccagcctgtagtgcaaactgcgttcatgactttcctccccacgaccacttctgtccccagtctcagcaaatggtgctagcagtaatccaattgtccaaactagaaaccttgggattacagttaacatcctgcacggtcactagtagcccatatggcatctttgtgcaacttagaaaagatcttcttttctcctgatggacataggccatgccagagcacacaatcaggtaagctgggctcacagaaaaatcagcacctactcatttcctgagcagccatcctttgttcaaggcaacatctgcaggactaagtgcagcattcctgttcttccttggcctcagtaccacatcccaaaacattccctaataactattactactgttttctaaacatgctttgaacgtcta

SEQ ID NO: 17863 - DNA, 403 bp, Homo sapiens
  chr11.fa.O7frz.111290390
  Located on chromosome 11
  Distance between a terminus base of telomere on chromosomal short arm and 5'-terminus of this base sequence : 105992150
  Distance between 3'-terminus of neighbour sequence of sequence listing upward to telomere on chrosomal short arm and 5'-terminus of this base sequence : 212790
cagtaagtcagatattcctatcgtacaaattttaaaaacctcagaggctcctaaagaaacgtgtattttgaggtcacaacaaattcaggacagaggtggctgtttcaattcaggtctcctgactgcaagtcagtgggttccttgagctcctgggatagatcattggccaacatgtttcttttctttctctttcctctttccatccatccatccatccatccatccatccaaaacttccctgagtacctccctagtattgggtgctgtgctaggcaaacagtgagacaaggagatgtggtagcatcattgctggcttgacaatcaaatcaaaaacctctgatatcactgacctgagtgaagtaatcctagcaactctcaagaacgactttgactagttcactaa

SEQ ID NO: 17864 - DNA, 478 bp, Homo sapiens
  AP001919.2_83842
  Located on chromosome 11
  Distance between a terminus base of telomere on chromosomal short arm and 5'-terminus of this base sequence : 106029134
  Distance between 3'-terminus of neighbour sequence of sequence listing upward to telomere on chrosomal short arm and 5'-terminus of this base sequence : 36581
aaggtctgagttgaactgatttagtgaaaacttgtctgaatgaccttctgcatgtttctctttgaatctctctctctctctctctgtgtgtgtgtgtgtgtgtgtgaccttcttcctattttcacactctaacattattacttagggggtaaactatggcaattaaaaaaatataggatgcactacataaaatttgaattccctaaatacctaaggtaaaaaacagatacatagggacttagtttcttttgagggaaaaaaacaaaataaattcatatacttttgatacatgtggcatagaacaagtcaagaaaagaagtttgttaccacagttccaaaggctatttttgaagaaacatcacgtagcttggtttactagcaaaggtattattaagaggtgagtgtataaattaactcataaaaatcaataggtttccaagttctaacttcttctgttgcaagaaatagattactcact

SEQ ID NO: 17865 - DNA, 458 bp, Homo sapiens
  AP001133.2_148565
  Located on chromosome 11
  Distance between a terminus base of telomere on chromosomal short arm and 5'-terminus of this base sequence : 106089729
  Distance between 3'-terminus of neighbour sequence of sequence listing upward to telomere on chrosomal short arm and 5'-terminus of this base sequence : 60117
acaaccattcatagttcatgagccacacacacacacacacacacacacacacacacacacacacacacagagagagagagagagagagagagagagagagagacagtggattagatttagtcagcagtttgccaacccttgccttaaaacatagaaattaacatttgcaaatcaggatggaaacaaaaatcacccttaactgcagggtagaaaactcatcctgaggtaaaagagaacagagtcatctgagtcctgagatacgtgctttgagctggtaagtaagaactgttaaagacagcacagaagacactggattcactttctcctgtgccacacttcttttggggactggataataacagtggaattcacagatggggcaataagcctatcctacccaaagggaaggaaaggaatacattttaaaaaggaaagatacggtagactggagaactaat

SEQ ID NO: 17866 - DNA, 95 bp, Homo sapiens
  D11S900
  Located on chromosome 11
  Distance between a terminus base of telomere on chromosomal short arm and 5'-terminus of this base sequence : 106106750
  Distance between 3'-terminus of neighbour sequence of sequence listing upward to telomere on chrosomal short arm and 5'-terminus of this base sequence : 16563
ctatgccctcattaaaaccctaattacataaacacacacacacacacacacacacacacacacacacacccctatccagattgtacagatgcgac

SEQ ID NO: 17867 - DNA, 132 bp, Homo sapiens
  D11S4100
  Located on chromosome 11
  Distance between a terminus base of telomere on chromosomal short arm and 5'-terminus of this base sequence : 106250441
  Distance between 3'-terminus of neighbour sequence of sequence listing upward to telomere on chrosomal short arm and 5'-terminus of this base sequence : 143596
ggaatggctgcttccaacagcactgaagtatctcaaatacacacacacacacacacacacacacacacacaaatttttatgttttacatgtaagtgaacctaaaattcaattccctgttagccctttgaaat

SEQ ID NO: 17868 - DNA, 222 bp, Homo sapiens
  D11S923
  Located on chromosome 11
  Distance between a terminus base of telomere on chromosomal short arm and 5'-terminus of this base sequence : 106283003
  Distance between 3'-terminus of neighbour sequence of sequence listing upward to telomere on chrosomal short arm and 5'-terminus of this base sequence : 32430
atgtataatatctggaaggtactggagttgggatttcaatccaggtctaccttggtaaaaaggccatgctaaacacacacacacacacacacacacacacacacacacacacacacacacattcaacaaatattcataagtatctgttatatttctgtgctgctgtagatgctggaaatacaacagtaattttgagtaaatttacctcaatccagccctaat

SEQ ID NO: 17869 - DNA, 223 bp, Homo sapiens
  D11S1317
  Located on chromosome 11
  Distance between a terminus base of telomere on chromosomal short arm and 5'-terminus of this base sequence : 106384276
  Distance between 3'-terminus of neighbour sequence of sequence listing upward to telomere on chrosomal short arm and 5'-terminus of this base sequence : 101051
catatctggtgttttgtggtatgcgtttcctatacaccacgaaagacattgcccaccccacaaaaatgttcatcacacacgcacacacacacacacacacacacacacacacacacatacacacatattcaggagattcatgccttgtgtcatcatcctgtctgctcaaatcccatccttaggcttccacattaagtgcccctattctataagcaggcattca

SEQ ID NO: 17870 - DNA, 345 bp, Homo sapiens
  AP001376.3_23210
  Located on chromosome 11
  Distance between a terminus base of telomere on chromosomal short arm and 5'-terminus of this base sequence : 106450043
  Distance between 3'-terminus of neighbour sequence of sequence listing upward to telomere on chrosomal short arm and 5'-terminus of this base sequence : 65544
gaactattttgtttcaaacatcagtcagttttattcactagaattgtgcaggggttaaaagtgagtacaattgaaatagacaaattgtttttttctattttcagaagacatattgtgattcttacccttcacacacacacacacacacacacacacacacacccataaatagaaatgcttcatataccttcctactacatgtacatgtcattgcttttccaaaccacatgtagtctagataaaacaaagtgaaaggatttaaaagagttgcaagaccttttccaggttgtagacagctatgattacatgtaatagtacggatttagttactgtcatccagctctt

SEQ ID NO: 17871 - DNA, 335 bp, Homo sapiens
  chr11.fa.O7frz.110666045
  Located on chromosome 11
  Distance between a terminus base of telomere on chromosomal short arm and 5'-terminus of this base sequence : 106517590
  Distance between 3'-terminus of neighbour sequence of sequence listing upward to telomere on chrosomal short arm and 5'-terminus of this base sequence : 67202
ttctatcttagtcagcatggactgctataataaaataccgaagattgggtggcttaaataacacttattttttcacagttctggaggctggaactccaagatcaatgtgctagcatggttaggttctagtgaggccctcttgatggcttgcagacagccactttctcactatatgttcacatggcctttccttggtgtgtgcatgtgggggagagagatagagagaaagacagagagagagagagagagacagagagagagagagaaagatcttcctcttcttataagggcagtaatctcatcccggggggctctactgtcaagagctcatctac

SEQ ID NO: 17872 - DNA, 434 bp, Homo sapiens
  AP001892.3_72595
  Located on chromosome 11
  Distance between a terminus base of telomere on chromosomal short arm and 5'-terminus of this base sequence : 106697489
  Distance between 3'-terminus of neighbour sequence of sequence listing upward to telomere on chrosomal short arm and 5'-terminus of this base sequence : 179564
ggtgatagagcttctaaggaagtaattaaagttaaatgatgtcataagagtggggctgtgatcttagtgtccttataggatgggacacttgagcttgctcactctctctttctctctctctctgtgtgtgtgtgtgtgtgtgtgtgtgtggttgattcatgtgaaaacaaagaaggccacttgatgttggaactcccaacctctagaactgtaataaagtaaatttctgttgtttaatccactcagtccatggaattttgttatagcagcctgagttgactgatacactgaccctgccatagtacttctgattcctcttactccatttaatttattttcccccatagtactcatcaacttctaagatactatataatttactttcttattatgttctctgtttattgtttgtcttcacctgtaagaatacagtc

SEQ ID NO: 17873 - DNA, 121 bp, Homo sapiens
  chr11.fa.O7frz.110401492
  Located on chromosome 11
  Distance between a terminus base of telomere on chromosomal short arm and 5'-terminus of this base sequence : 106761041
  Distance between 3'-terminus of neighbour sequence of sequence listing upward to telomere on chrosomal short arm and 5'-terminus of this base sequence : 63118
gctggagttagatccaagataggggcagtgtgtgtgtgtgtgtgtgtgtgtgtgtgtgtacgtgcacatttatgtaattggatgggatggggaggggcagtatgataaactcggcttgtta

SEQ ID NO: 17874 - DNA, 449 bp, Homo sapiens
  AC019098.3_94283
  Located on chromosome 11
  Distance between a terminus base of telomere on chromosomal short arm and 5'-terminus of this base sequence : 106974224
  Distance between 3'-terminus of neighbour sequence of sequence listing upward to telomere on chrosomal short arm and 5'-terminus of this base sequence : 213062
tgaatcatagtttcttaaggtgagtgattgctatgtaaataaaggactgaagaatgttctgacataaatggcttatgttaccaacaaataaatgcaccattatgagtattatttatgtaggatgattgaaaaaacctagagagttttatcattaggagaaaatgtttttcatcactagtatgtatgtgtgtgtgtgtgtgtgtgtgtgtgtgtatatatatatattctaaaaataagggaagccaataaatttattctaaaaatatttttttttggaaaatagccaataaatacattctaaaaataagggaagccaataaatttattttccctttccaagcatcaggaataaattgatcaaggggctggcttacactataatcactttcttctgattactaaattttaagacttattttcttatcctgttcttgccactatgatttaga

SEQ ID NO: 17875 - DNA, 413 bp, Homo sapiens
  AC048373.2_23188
  Located on chromosome 11
  Distance between a terminus base of telomere on chromosomal short arm and 5'-terminus of this base sequence : 107226613
  Distance between 3'-terminus of neighbour sequence of sequence listing upward to telomere on chrosomal short arm and 5'-terminus of this base sequence : 251940
cgtaagctagaggtgattctaatattttgcttcatgacaatagaaaaaaacttttgacatacattttttaaaaagccaccttattatttacattccttctacatgcctaaaaccccctctactgcctatgggatagagtacgagttcctttgcctgaatttcaagccccaggtcctgtggcatttgaatacctcttcagcttcatttctcactcaacatttcttcctttagtaagctcactttctacactccaggttctacacacacatacacacacacacacacacacacacacgttactgtcttatgaatgtatcatttttatagcctgccttttctgggttattttttctgctttcagcactttccttctattatttcttcagctggtaaattccaacttatcctgaaat

SEQ ID NO: 17876 - DNA, 394 bp, Homo sapiens
  AC027247.2_170988
  Located on chromosome 11
  Distance between a terminus base of telomere on chromosomal short arm and 5'-terminus of this base sequence : 107515065
  Distance between 3'-terminus of neighbour sequence of sequence listing upward to telomere on chrosomal short arm and 5'-terminus of this base sequence : 288039
cctaaggacaatggcttagtatttgctaattcagtgtttgtggggacatcacagtctttatagaacattactgggcataatgaggacagacagtctatacaatatacatacatatacacacatatgtacatacacaatatatgtgtatacatatacatacatacacaaacatatatatatatatatatatatatatatttctaccagcaatactttttgccaaatagtgagaaatatttattctctgagtttcttcaaatattactgaaaaatcttcattttcttaactaaagtaatatgatgagctcttttcagtaactctttttccccaaacactggggaataacactaaaagtgttttagcctttgtaactggcctaatattaaatctagc

SEQ ID NO: 17877 - DNA, 441 bp, Homo sapiens
  AC084833.1_9195
  Located on chromosome 11
  Distance between a terminus base of telomere on chromosomal short arm and 5'-terminus of this base sequence : 107542714
  Distance between 3'-terminus of neighbour sequence of sequence listing upward to telomere on chrosomal short arm and 5'-terminus of this base sequence : 27255
gcttcctttaagttctttgaacattccaaacattttacactactgttttgtcttcctgcaaactcatccccaggatgtctcacttaagaagactgtcaatttatcaaatatttattcttccctgtttcattaataaaaaaccctctctattccctttgcttctacactctctttgttttacatacgtaacaaacctgcacgttgtgcacatgtaccctagaacttaaagtataattaaaatacagatatatatatatatatatatatatatatatatatatatatataaaaatataaagtaacatgaatcgcttttgtttttcaataatcaggatgtaaaccctgttaggacatacattttctttattttgttcccacctctacctgtcccagtacctaaacgattcccctgatataatgtgtatgcaaagactatttgga

SEQ ID NO: 17878 - DNA, 181 bp, Homo sapiens
  chr11.fa.O7frz.109501824
  Located on chromosome 11
  Distance between a terminus base of telomere on chromosomal short arm and 5'-terminus of this base sequence : 107680815
  Distance between 3'-terminus of neighbour sequence of sequence listing upward to telomere on chrosomal short arm and 5'-terminus of this base sequence : 137660
aacttactaggccaatatccttagtcataatatcatacacacaccacacacacacacacacacacacacacacacacacacacacacacacacacacacacacaccactcatctctggggtaaacagttcttccaagaaataattatcaaaggaaagctgagttcctaaggtcctaaatag

SEQ ID NO: 17879 - DNA, 197 bp, Homo sapiens
  AC021732.3_111646
  Located on chromosome 11
  Distance between a terminus base of telomere on chromosomal short arm and 5'-terminus of this base sequence : 107680815
  Distance between 3'-terminus of neighbour sequence of sequence listing upward to telomere on chrosomal short arm and 5'-terminus of this base sequence : -181
aacttactaggccaatatccttagtcataatatcatacacacaccacacacacacacacacacacacacacacacacacacacacacacacacacacacacacaccactcatctctggggtaaacagttcttccaagaaataattatcaaaggaaagctgagttcctaaggtcctaaatagaccactggtaaacaag

SEQ ID NO: 17880 - DNA, 378 bp, Homo sapiens
  AP001988.3_26638
  Located on chromosome 11
  Distance between a terminus base of telomere on chromosomal short arm and 5'-terminus of this base sequence : 107697313
  Distance between 3'-terminus of neighbour sequence of sequence listing upward to telomere on chrosomal short arm and 5'-terminus of this base sequence : 16301
ggtttattgaactgtcttaaacacattatatgttttatattttttaatctcaaaatagctcttggttgagataatggagctcagaaagattaagtaacttgcctaaaaccaaatagctagcaaacagcagagtgatgatttaaaatgaggactgccacataccttaactaaataagaaatacctctgtcatgtggacaccatgctcttggttcaacttgcacccaaacaagacttgatcctttgtataatgtgtgtgtgtgtgtgtgtgtgtgtgtgtgtgtgtgtgcgtgtgtgtgtgtgtttacttgatagagaaagagagagagagcacaaggagggaataagagagatctctaagtttggcataagtgatagaa

SEQ ID NO: 17881 - DNA, 443 bp, Homo sapiens
  chr11.fa.O7frz.109386490
  Located on chromosome 11
  Distance between a terminus base of telomere on chromosomal short arm and 5'-terminus of this base sequence : 107795938
  Distance between 3'-terminus of neighbour sequence of sequence listing upward to telomere on chrosomal short arm and 5'-terminus of this base sequence : 98247
ctcagtggatcaaatacttgtaaggatcattattcttcttattaatggctcataggtttcatcaacctactttctttcttttcctctttcatttcttcttcatatttcttaaagtgttatctcacaaaatcatatatacacacatatgtacgtattatgggcatatgtggaaaattatctatactaaatacacacacacacacacacacatatagcttattgcatatctacatgcttatttatatcatctctccaagtcatgactataaaatagcacaggaattccaggacctctagattatttacaactactagtatatgaatattcagggatcactctggaagcctgccataactattaagtcatgagtaatttttctcaaacagaaaaagttttctaaaataagggcaaagtacatgtatctgtgttctagtatcaacgg

SEQ ID NO: 17882 - DNA, 266 bp, Homo sapiens
  D11S1891
  Located on chromosome 11
  Distance between a terminus base of telomere on chromosomal short arm and 5'-terminus of this base sequence : 107907527
  Distance between 3'-terminus of neighbour sequence of sequence listing upward to telomere on chrosomal short arm and 5'-terminus of this base sequence : 111146
tttaaccctgtttcctctacctagaatattattttccttatatccacatggatttttccctcactgtctgtttaaatacaaccttctatggcaactctagataaaatttcaacaatgtcttttctacctatttcaatactaccaacatccttccctacttcagcatttatgaccatacacacacacacacacacacacacacacacacttatgtttcatgtttcacttacttattacatatatgactgacagccctactaggatat

SEQ ID NO: 17883 - DNA, 424 bp, Homo sapiens
  AP000923.4_46645
  Located on chromosome 11
  Distance between a terminus base of telomere on chromosomal short arm and 5'-terminus of this base sequence : 107907602
  Distance between 3'-terminus of neighbour sequence of sequence listing upward to telomere on chrosomal short arm and 5'-terminus of this base sequence : -191
atacaaccttctatggcaactctagataaaatttcaacaatgtcttttctacctatttcaatactaccaacatccttccctacttcagcatttatgaccatacacacacacacacacacacacacacacacacttatgtttcatgtttcacttacttattacatatatgactgacagccctactaggatataagctctattacagtgggcactttttttccacttctttttttcagtattttattcttagccctgagaacagtgcctagcacaaagtaggcactctaatttttattgaatctaaaaaaaagatcataattaaaagttttactttaaaatcatgttcaataaaagacataattgatttatgtataattgaaacaaacgatccatcctctggataggtttcagtcacctagacata

SEQ ID NO: 17884 - DNA, 405 bp, Homo sapiens
  chr11.fa.O7frz.109191606
  Located on chromosome 11
  Distance between a terminus base of telomere on chromosomal short arm and 5'-terminus of this base sequence : 107986237
  Distance between 3'-terminus of neighbour sequence of sequence listing upward to telomere on chrosomal short arm and 5'-terminus of this base sequence : 78211
tagataggaagtgagctgacagagcttttgtaagatgacaagaacacctgaggactgcaggacataacttgaagggattagggaagaaaatattacacaggattgagactatttaaataaaaggtggaatagagcttcagaatgattattacatttgtaatttttataataacctcaacccattcccacttggtaggtcttgaaatatctggagaaatagccaaataagtgaaacctacagttacagatgtgtatgtgtgtgtatgtgtgtgtgtgtgtgtgcatgccaaagtaaaattttcctctctgtgatatttacacataaggaaaatacttttgaacaaaatttaaaagtacttaactgagttgggcttagtaagactgataaattctagtcaatggaaa

SEQ ID NO: 17885 - DNA, 306 bp, Homo sapiens
  AP002428.1_163555
  Located on chromosome 11
  Distance between a terminus base of telomere on chromosomal short arm and 5'-terminus of this base sequence : 108003241
  Distance between 3'-terminus of neighbour sequence of sequence listing upward to telomere on chrosomal short arm and 5'-terminus of this base sequence : 16599
agactaattacatgtcacatttgagactagattacaaaatgactactatttttatcattctgtgtgtgtgtgtgtgtgtgtgtgtgtgtgtgtgtgtttatgtgtctatctccttctttcctgtattactcattgtaggggaagctgttttgaagagcctatagaactgaatccttaggctgagagaaaagtgaatgtgtttgaaagtatattccagttttgtttttaatttctcttgggtaaacaccttggataagaattattggattgtatggtaaatgcatgtttaacattacgagaaactgt

SEQ ID NO: 17886 - DNA, 422 bp, Homo sapiens
  AC021731.3_73412
  Located on chromosome 11
  Distance between a terminus base of telomere on chromosomal short arm and 5'-terminus of this base sequence : 108089238
  Distance between 3'-terminus of neighbour sequence of sequence listing upward to telomere on chrosomal short arm and 5'-terminus of this base sequence : 85691
tgattgcaggtcataggacttctcagcctccataaccacgcaagccaattccttcctgtatatacatgcaagcaaacacacgcacaaacacacatatctatatatgtgcgaactctagagaactgaaactaatacacacacacacacacacacacacacacaaatacagacattcacacacacatttcaaaagatgttgaaaacccactagacaaaattaaatgcatctcttgataataaaaaaactttgggcaaactttgagcaaaggaactttctttaatgcaattaagtatgtctattaaaaaccttcagttaacattacattttgtgtgaaatactaaacataacatcatttgactagaaataagtatatcttttctcacaactttattcaaggcggtacatcgaattcagtggaata

SEQ ID NO: 17887 - DNA, 447 bp, Homo sapiens
  AC021731.3_172126
  Located on chromosome 11
  Distance between a terminus base of telomere on chromosomal short arm and 5'-terminus of this base sequence : 108117700
  Distance between 3'-terminus of neighbour sequence of sequence listing upward to telomere on chrosomal short arm and 5'-terminus of this base sequence : 28040
taattaaagcaatctaccactgactgattcatcttctctaaaattagaagaaatgtgagcccattacaagacagggatgttgaagggtataaaatattaaaatttctgaaagacagcatctggtaaatagttattaaaatattttttgtaatatgtcattactgttatgtgtgtgtgtgtgtgtgtgtgtgtgtatactcttactttatttgtaaataaactccttacagaatgataaatatttatacgactttgtttttggttttatcttgttttgattgtttttctttcccttatatgttcttcatagggtacatggatttaacactgctgacacaattaccatgggtgttcatgttggagccagtttggagataggtatagagcttaatacagcacagctggcagcagaaaatcaatatcaccaggcaaattaagctaccataa

SEQ ID NO: 17888 - DNA, 476 bp, Homo sapiens
  chr11.fa.O7frz.108913199
  Located on chromosome 11
  Distance between a terminus base of telomere on chromosomal short arm and 5'-terminus of this base sequence : 108235819
  Distance between 3'-terminus of neighbour sequence of sequence listing upward to telomere on chrosomal short arm and 5'-terminus of this base sequence : 117672
tcttgtgaatttagttggacatatcactgataaataattaattttatctggtctaaaaacatgtttcagctgggcgcagtggctcacacctgtaaccccagcactttgggaggctgaggcaggtggatcacccgaggtcaggagtttgagaccaacctgaccaacatggtgaaacgtggtccctactaaaaaaaaaaaaaaattagctgggcatggtggtacacgcctgtaatcccaactactctggaggccgaggcagaagaatcccttgaacccggtaggcgaagcttgcagtgagctgagattgcaccattgcactccagcctgggcaaaaatagcacaactctgtctcaaaataaataaataaataaataaataaataaataaataaataaataagcaagcaaataaaaatatgtttctaagtctctgttaatcccgtatatgtttatttgaataggtatggatacatttgt

SEQ ID NO: 17889 - DNA, 400 bp, Homo sapiens
  chr11.fa.O7frz.109110086
  Located on chromosome 11
  Distance between a terminus base of telomere on chromosomal short arm and 5'-terminus of this base sequence : 108286336
  Distance between 3'-terminus of neighbour sequence of sequence listing upward to telomere on chrosomal short arm and 5'-terminus of this base sequence : 50041
aatgcaggaaatttgataactctagaccagcctggagccgggcgtggtagctcatgcctgtaattccactttgggaggccgaggtgggcagatcacgaggtcagcagatcgagaccatcctggctaacacggtgaaaccccgtctctaattaaaaaaaacacaaaaaattagccaggcgtggtggcgggcgcctgtagtcccagctactcgggaggctgaggcaggagaatggcgtgaatccaggaggtggagcttgcagtgagccaagatcatgccactgcactccagcctgggcaagagagagagactctgtcacagaaaataaataaataaataaataaataaataaataaataaatagaccagacttatgagaggttcataaggaagtgctaaaca

SEQ ID NO: 17890 - DNA, 358 bp, Homo sapiens
  chr11.fa.O7frz.108820736
  Located on chromosome 11
  Distance between a terminus base of telomere on chromosomal short arm and 5'-terminus of this base sequence : 108314774
  Distance between 3'-terminus of neighbour sequence of sequence listing upward to telomere on chrosomal short arm and 5'-terminus of this base sequence : 28038
ctcctaggttcaagcgattctcctgcctcagcctcccaagtagctgggattacaggtgcccgccaccacacctgactaatttttgtagttttggtagagacagggtttcaccatgttggccgggttggtctcaaacccctgacttcaggttacccacccacttcagcctcccaaagtgctgggattacaggcatgagccaccgtgcctggccttaaatttttatttatttatttatttattttttattattatactttaagtttagggtacatgtgcacaatgtgcaggttagttacatatgtatacatgtgacatgctggtgcgctgcgcccactaactcgtcatctagcattagtt

SEQ ID NO: 17891 - DNA, 272 bp, Homo sapiens
  D11S4120
  Located on chromosome 11
  Distance between a terminus base of telomere on chromosomal short arm and 5'-terminus of this base sequence : 108610820
  Distance between 3'-terminus of neighbour sequence of sequence listing upward to telomere on chrosomal short arm and 5'-terminus of this base sequence : 295688
agatgcgctacttcaactgttctgtcttccccctggagggaaggcagcactgaaaatcataaagggtaatacacaaatacaaacacacacacacacacacacacacacacacacacactctctctctctctctctcaagaacgaaaaaaaacaaatattaacaaaatgttcatgggtggaaattagatgggtaatagcaaattgagtattggcaaaaagatgaaacatgcaagtaatgaagggatcctagaagttggttcatccatgccaca

SEQ ID NO: 17892 - DNA, 474 bp, Homo sapiens
  chr11.fa.O7frz.108514228
  Located on chromosome 11
  Distance between a terminus base of telomere on chromosomal short arm and 5'-terminus of this base sequence : 108641301
  Distance between 3'-terminus of neighbour sequence of sequence listing upward to telomere on chrosomal short arm and 5'-terminus of this base sequence : 30209
taattctaaggtcaaggtggacttcaggactacttcaaatcgacagcttaatgataacttcaaggggctcagatttagtattactttctttcttttctttctttttttttagatggattctcactctgtcgcccaggctggagtgcaatggcgtgatcttggctcactgcaacctctgcctcccaggttcaagctattctcctgcctcagcctaccgagtagctgggattacaggcatctgccagtatgccaggctaatttttgtatttttagtagagagggggtttcaccacgttactcaggttggtctcgaactcctgacctcaggtgatccgcctgccttggcctcccaaagtgctgggattgcaggtgtgagctactgctcccggcctactttcattttaaagtagattttctgttactgtgggtctatcaaacacttcccgcactgtatgtttccttgatcttgactaa

SEQ ID NO: 17893 - DNA, 272 bp, Homo sapiens
  HUMUT1011
  Located on chromosome 11
  Distance between a terminus base of telomere on chromosomal short arm and 5'-terminus of this base sequence : 108914970
  Distance between 3'-terminus of neighbour sequence of sequence listing upward to telomere on chrosomal short arm and 5'-terminus of this base sequence : 273195
tttcatgtgctttttggcctttgatatcttttttatttgaataatatttactcaagttctttgcccatttttaattaggtggttggggtttttctttgttatcaagttgtgggacttccttccttccttccttccttccttccttccttccttccttccttcctccctcctcccctctctccctccttctttccttccgctctctctctcgatttctttctttttttctttcttgacagagtctcactctgttgcccaggctagagtgcact

SEQ ID NO: 17894 - DNA, 313 bp, Homo sapiens
  chr11.fa.O7frz.115029392
  Located on chromosome 11
  Distance between a terminus base of telomere on chromosomal short arm and 5'-terminus of this base sequence : 109031467
  Distance between 3'-terminus of neighbour sequence of sequence listing upward to telomere on chrosomal short arm and 5'-terminus of this base sequence : 116225
taatcatgcagtttatttccacagcaatatgtagcttatgatgatcttgttcagatttgttttccctcagttttaggtttccatctggccacctaggttttgcccctgggcatgccacatattggtcaaaagttaggagtgtgtgtgtgtgtgtgtgtgtgtgtgtgtgtgtctgttttaaagcttcctagcacacttcagggagtttatgtatttttgcctcactttctgttactgatgattactagttgggagattctctatttattcatgagaggacactactttggaaatgtacatagccttccagact

SEQ ID NO: 17895 - DNA, 137 bp, Homo sapiens
  D11S4161
  Located on chromosome 11
  Distance between a terminus base of telomere on chromosomal short arm and 5'-terminus of this base sequence : 109031536
  Distance between 3'-terminus of neighbour sequence of sequence listing upward to telomere on chrosomal short arm and 5'-terminus of this base sequence : -244
gttttaggtttccatctggccacctaggttttgcccctgggcatgccacatattggtcaaaagttaggagtgtgtgtgtgtgtgtgtgtgtgtgtgtgtgtgtctgttttaaagcttcctagcacacttcagggagt

SEQ ID NO: 17896 - DNA, 477 bp, Homo sapiens
  AC024245.2_827
  Located on chromosome 11
  Distance between a terminus base of telomere on chromosomal short arm and 5'-terminus of this base sequence : 109076304
  Distance between 3'-terminus of neighbour sequence of sequence listing upward to telomere on chrosomal short arm and 5'-terminus of this base sequence : 44631
gtagtcaagcttggtcatttatacagtgaaatgcatattgttttattctaaaaggtttttattttatgtctcctttaggttacagtaaatgcataatattgattctgaaaacactaagtgggtaattagattatgttatctactgatttcaggatagtgaaaagaggttatatgaaatattttgtataataaagtatatatatatatatatataaatacctagtatacctaaaatgtatatatatagctatataatattactatatattacatatgtagagtattctataagttctttttctcttttttctctctgttctgtagagagagaatatcattagcattttctgttcttgctcaaatcactatcaacacagttttaccctaaaagttctcattagatctttataaataaatacattgcattacattttacagttatttatttttatactcaggtgattactaacatttagg

SEQ ID NO: 17897 - DNA, 245 bp, Homo sapiens
  G08884
  Located on chromosome 11
  Distance between a terminus base of telomere on chromosomal short arm and 5'-terminus of this base sequence : 109138548
  Distance between 3'-terminus of neighbour sequence of sequence listing upward to telomere on chrosomal short arm and 5'-terminus of this base sequence : 61767
cgccaacagagaaacaagagaagtttttctactcatttcatcttcattcacctctatgctctatctatctatctgtctatcaatctatctatctatctatctatctatctatctatctatctatctatctatctatcaatcatctatctatctattatctatctgtctttctgtgtgtaatctatcactcatggactgtgtagtcagaagatagcacattttgtttggggcctgaaaagtgattt

SEQ ID NO: 17898 - DNA, 266 bp, Homo sapiens
  AC024030.2_141778
  Located on chromosome 11
  Distance between a terminus base of telomere on chromosomal short arm and 5'-terminus of this base sequence : 109210812
  Distance between 3'-terminus of neighbour sequence of sequence listing upward to telomere on chrosomal short arm and 5'-terminus of this base sequence : 72019
caatgctaattactaaccaaagactacatagctatgaaaaggccttttctctatagtaaaatattagtaaatttatatatatatatatatatagtatacacacatatacatatatatttaaatatatttaaagataagtcccttttagctacatgtataatattttataatactctttaacaactgctttaacaggctagttagattaattgaccccaattgtattaaataagaaggatttgctatagtgaggatttggttatcct

SEQ ID NO: 17899 - DNA, 130 bp, Homo sapiens
  G12393
  Located on chromosome 11
  Distance between a terminus base of telomere on chromosomal short arm and 5'-terminus of this base sequence : 109429809
  Distance between 3'-terminus of neighbour sequence of sequence listing upward to telomere on chrosomal short arm and 5'-terminus of this base sequence : 218731
ctgggtatacacccagcaaaaacaactgatgatacatagatgatagatagatagatagatagatagatagatagatagatagatagatagatagatagggaagttggcattatcttttaaaatcacagtt

SEQ ID NO: 17900 - DNA, 429 bp, Homo sapiens
  AC009795.4_31867
  Located on chromosome 11
  Distance between a terminus base of telomere on chromosomal short arm and 5'-terminus of this base sequence : 109437776
  Distance between 3'-terminus of neighbour sequence of sequence listing upward to telomere on chrosomal short arm and 5'-terminus of this base sequence : 7837
ccacttaattctacagaacctttaaagaagatttaatatcaattcttctcaaactttctgaaatactgatttatctttgtattcccagaataagccacatttgatcatgaaaaaaagaaaatggcttaccatttccaaagctagaatcctcttacatctttggactttgcatatgtgtgtgtgtgtgtgtgtgtgtgtgtgtgtgtgtgttttccatacgcatccacacccccagggtattcacacaaaaagcatagcttctttcctcaacaaggaccttgagttttttttttctactaaggcccatctgtgggacaaattaatataaaatgtgttaaggtgttttcttaggatactaaagttaaaaaaaaaaaaaactcctggtaaagtactcataattataacaacttaaagctttgacaaatgtca

SEQ ID NO: 17901 - DNA, 457 bp, Homo sapiens
  AP002004.3_150407
  Located on chromosome 11
  Distance between a terminus base of telomere on chromosomal short arm and 5'-terminus of this base sequence : 109503431
  Distance between 3'-terminus of neighbour sequence of sequence listing upward to telomere on chrosomal short arm and 5'-terminus of this base sequence : 65226
cagaatgtcaaatttctgagacagaaaattctagctttggacagctttgaccattataaattcttcttgaaaaaaatagttatgtatcttgaaaagaatagtttatcttcttgaaaaaaatagttatgtatcttctaccagttgattatttttatttctcttgtttctgaataggattgaaatccttgggggcacaaaccacacacacaggcacacatacacacacacacacacacacacacggttctgatatctttctctcagtcctttgtggttaaaatacaatgttacattaaaacatgacatacaacatatgcatacagagatcagatggctttttaaaagattgtataattactacttaacaaagacttttattcaaacttttttcatgaccttctcttgctagtatataaactgcatacttactctgccgaatggttatccagcaactatt

SEQ ID NO: 17902 - DNA, 411 bp, Homo sapiens
  chr11.fa.O7frz.115541881
  Located on chromosome 11
  Distance between a terminus base of telomere on chromosomal short arm and 5'-terminus of this base sequence : 109549240
  Distance between 3'-terminus of neighbour sequence of sequence listing upward to telomere on chrosomal short arm and 5'-terminus of this base sequence : 45352
ataacttcctgtccaatcctaccaaagtctggaactggaacatccaagggttgcccttagacgccttctctactgagaatggcatcatcatcaagcgaggccataggtaagggtgcagctgggagcgggtgtggcctgggagcaggggctgtcctctgacctgtgctcgccctttaggtgggcacgggtaatacaaacaaaaagagctggagaatggtccaggtccaaacatagctactttcaaaccgttgataactgggatgaaaaacaagaatttcgtgatggtattgtttaaaaaagaatgaaagactaacttgcttttcttagtatttactaaatcagaaaccttgctgtacacacacacacacacacacacacacacttactttcttaaacataaggaagctgctt

SEQ ID NO: 17903 - DNA, 429 bp, Homo sapiens
  AP002004.3_41251
  Located on chromosome 11
  Distance between a terminus base of telomere on chromosomal short arm and 5'-terminus of this base sequence : 109549463
  Distance between 3'-terminus of neighbour sequence of sequence listing upward to telomere on chrosomal short arm and 5'-terminus of this base sequence : -188
tccaaacatagctactttcaaaccgttgataactgggatgaaaaacaagaatttcgtgatggtattgtttaaaaaagaatgaaagactaacttgcttttcttagtatttactaaatcagaaaccttgctgtacacacacacacacacacacacacacacttactttcttaaacataaggaagctgcttgtattggttttttgcttctttatgttttcctttaatataaaattggataaaatgtttgaatgccgttattttacttttcttaactctgtgtgtagagtgttatgcaatttttttcctcttcatataatttacaatcctttagattttaaaagttacgtttttctcattttctttctttgtaaatggtagtgggtagcaatttgtggatttaggtgaagtgacatagactttcctatgtcac

SEQ ID NO: 17904 - DNA, 312 bp, Homo sapiens
  D11S1886
  Located on chromosome 11
  Distance between a terminus base of telomere on chromosomal short arm and 5'-terminus of this base sequence : 109620250
  Distance between 3'-terminus of neighbour sequence of sequence listing upward to telomere on chrosomal short arm and 5'-terminus of this base sequence : 70358
tgatgcaatgtttggctacttagtgtctctctctctctctctctctctctgtgtgtgtgtgtgtgtgtgtgtgtgtaagaaaggggaataaaagagaaagactatgagagataaatgaatataaatagtaatggaagcatgagcatgtttctattttaataattactatccttggtttttcatcatcacattctgctgcggttttccttacctccttgattgattgattgattgcctgattaattgtagagttggaggaatccaaatacatgtaagtcggaaagaagtagcagataatcaccagactatatc

SEQ ID NO: 17905 - DNA, 124 bp, Homo sapiens
  DISO7_10003149
  Located on chromosome 11
  Distance between a terminus base of telomere on chromosomal short arm and 5'-terminus of this base sequence : 109681243
  Distance between 3'-terminus of neighbour sequence of sequence listing upward to telomere on chrosomal short arm and 5'-terminus of this base sequence : 60681
tcctgactaaatcagatcatcggtatatagtgtgtatatatatatgtgtgtgtgtgtgtgtgtgtgtgtgtgtgtgtgtgtgtgtaaacagttaaataacaaatgaatagctaggattcttctt

SEQ ID NO: 17906 - DNA, 101 bp, Homo sapiens
  DISO7_10003154
  Located on chromosome 11
  Distance between a terminus base of telomere on chromosomal short arm and 5'-terminus of this base sequence : 109908175
  Distance between 3'-terminus of neighbour sequence of sequence listing upward to telomere on chrosomal short arm and 5'-terminus of this base sequence : 226808
tagagaaacggagcacaatgagctttatggaaatcagtggtttgtcacacacacacacacacacacacacacacaacaagctcttaggacatatctccctg

SEQ ID NO: 17907 - DNA, 269 bp, Homo sapiens
  DISO7_10003156
  Located on chromosome 11
  Distance between a terminus base of telomere on chromosomal short arm and 5'-terminus of this base sequence : 110054618
  Distance between 3'-terminus of neighbour sequence of sequence listing upward to telomere on chrosomal short arm and 5'-terminus of this base sequence : 146342
agctgctacatgtgttcttactaagaatttatttgaaatttagtaaaagtatgacactatctcacatttttgagtaataattgagattcacacacacatttttggttaataattgagattcacacacacacacacacacacacacacacacacacacacaccaccatactgaataaagagaaagataatagagtataagtctgagagaatgtcattcatgaattttttttggtaggtggatattagcaaaagggttccaatgccatatt

SEQ ID NO: 17908 - DNA, 456 bp, Homo sapiens
  chr11.fa.O7frz.116060134
  Located on chromosome 11
  Distance between a terminus base of telomere on chromosomal short arm and 5'-terminus of this base sequence : 110110563
  Distance between 3'-terminus of neighbour sequence of sequence listing upward to telomere on chrosomal short arm and 5'-terminus of this base sequence : 55676
tacatgctttcataatgagcttggctggataaacaaaacaaattttatttatttatttatttatttatttatttatttgtttgtttgtttatttgtttattgagatggagtcttgcttcatcgttcatcgcgcaggctggagtgcaatggtgcgatctccgctcattgcaacctccgcctcccggattcaaagattctcctgcttcagcctcccaaatagctgggattacagacacgcaccaccatgaccagctactttttgtatttttagtagagatggggtttcaccatgttggccaggctgatcttgaactcctgacatcgtgatctgcccaccttggcctcccaaagttctgggattacaggtgtgagtcaccacgcccagccgaaactaaacaaatcttaaaactcaaatagtttacgtgagtttggttttggcatagtgatagacagtaa

SEQ ID NO: 17909 - DNA, 278 bp, Homo sapiens
  chr11.fa.O7frz.116148825
  Located on chromosome 11
  Distance between a terminus base of telomere on chromosomal short arm and 5'-terminus of this base sequence : 110201496
  Distance between 3'-terminus of neighbour sequence of sequence listing upward to telomere on chrosomal short arm and 5'-terminus of this base sequence : 90477
ctggctaacatggtgaaaccccgtctctactgaaaatacaaaaattagccgggtgtggtggcagtcgcctgtagtcccagctacttgggaggctgaggcaggagaatggtgtgaacctggcaggcggagcttgcagtaagcccagattgggccactgcacttcagcctgggcgacagagcgagattccatcaaaacaacaacaatgacaacaacaacaacaacaacaacaaacaattgaattcttggacacagagtgtagaaggatggttaacagagg

SEQ ID NO: 17910 - DNA, 215 bp, Homo sapiens
  D11S2000
  Located on chromosome 11
  Distance between a terminus base of telomere on chromosomal short arm and 5'-terminus of this base sequence : 110402754
  Distance between 3'-terminus of neighbour sequence of sequence listing upward to telomere on chrosomal short arm and 5'-terminus of this base sequence : 200980
agtagagaacaaaacactgtggctatatgaagaaactaggtagtcctcctaggtttacatctatctcaaatattctctctctctgtctcatatctatatctatatctatatctatatctatatctatatctatatctatatctctatctatctatctatctatctatctatctatttatctatatgctaactggcacatttcacagatcttcaaa

SEQ ID NO: 17911 - DNA, 465 bp, Homo sapiens
  chr11.fa.O7frz.116469307
  Located on chromosome 11
  Distance between a terminus base of telomere on chromosomal short arm and 5'-terminus of this base sequence : 110518802
  Distance between 3'-terminus of neighbour sequence of sequence listing upward to telomere on chrosomal short arm and 5'-terminus of this base sequence : 115833
ttacctacttatgcttgatgctgcatttatttaacatgcagattggtaatctagtggctctcatttatattacaaacagaaaatgttaacatcctaattgatagatttacatgatatgacatttcatcatagtttttcttagcctttgaggcatataaacctgattattaaagacatgttatgatgtaaagctgtctttttgttttccgtaataaataagtgtaacttcatgaacatcaaatgttcttgcttccaatttattaaaacacacaaacacacatgcacacacacacacacacacacacgcactagaccactggaccatcctcaggaaatgacacatatgacacatctccatgttaaaggaaaaaagcagaatcccccacttaacaagtttataaaactatgcattgtattgaaaaagagataaaatgaattctagttaagttgtatactcctgcacag

SEQ ID NO: 17912 - DNA, 190 bp, Homo sapiens
  AP000675.2_82593
  Located on chromosome 11
  Distance between a terminus base of telomere on chromosomal short arm and 5'-terminus of this base sequence : 110610293
  Distance between 3'-terminus of neighbour sequence of sequence listing upward to telomere on chrosomal short arm and 5'-terminus of this base sequence : 91026
agcaaattgaagcatattcacatttgcaaaagaacctttactaaatactaagagaaaacaaaaagaaagcaattacaaaagctacgagctcatgcgtgtgtgtgtgtgtgtgtgtgtgtgtgtgtgtatgtgatttacttttctctgagctaatacctatggctttattaattcacttccttaataggct

SEQ ID NO: 17913 - DNA, 366 bp, Homo sapiens
  AP000813.2_25176
  Located on chromosome 11
  Distance between a terminus base of telomere on chromosomal short arm and 5'-terminus of this base sequence : 110696601
  Distance between 3'-terminus of neighbour sequence of sequence listing upward to telomere on chrosomal short arm and 5'-terminus of this base sequence : 86118
gataaagttggaaaagctgaaggattgattttcttccatcaactctcaagatcccattcgccattcaatctctgtgctgcagtaagagcaatcttaaacagtataaatcacacacacacacacacacacacacacacacacacacaagtccctcaggaaaaattccaagctcttgagaagatcacatgagccccttcatgacctggcgcttgcttatttcttccaggacttctctcacttctatccagctattcccgtcagcaaatgaacctccaaagcagcacatggagcactgcatagactatttcctcagtgcgtaactcctccctgtctcctctttacctgagtaacttgtactcatccttc

SEQ ID NO: 17914 - DNA, 271 bp, Homo sapiens
  chr11.fa.O7frz.116674648
  Located on chromosome 11
  Distance between a terminus base of telomere on chromosomal short arm and 5'-terminus of this base sequence : 110715405
  Distance between 3'-terminus of neighbour sequence of sequence listing upward to telomere on chrosomal short arm and 5'-terminus of this base sequence : 18438
cctcagatctgatgtatttatcacagttctccagagaaacagaatggacagaatatatatatatatatatatatatatatatatatatatatatatatatatatatgtatatgtgtgtgtatgtatatgtatatatgtgtatatgtgtgtgtgtatgtatatatgtgtatatataataccatatatatatatatgggctcatgcaattgtggaagtttgcaaatctgaaatctgtagggcaagggcagactggaaacttaggcaacagttg

SEQ ID NO: 17915 - DNA, 103 bp, Homo sapiens
  DID22N_0006352
  Located on chromosome 11
  Distance between a terminus base of telomere on chromosomal short arm and 5'-terminus of this base sequence : 110750447
  Distance between 3'-terminus of neighbour sequence of sequence listing upward to telomere on chrosomal short arm and 5'-terminus of this base sequence : 34771
aggacagtggagactgcctgacaaacaaacaaacaaacaaacaaacaaacaaaacttcaaagacagcacaggaggaggggtttatgtgggaactggtgaagga

SEQ ID NO: 17916 - DNA, 101 bp, Homo sapiens
  DID22N_0006355
  Located on chromosome 11
  Distance between a terminus base of telomere on chromosomal short arm and 5'-terminus of this base sequence : 110952535
  Distance between 3'-terminus of neighbour sequence of sequence listing upward to telomere on chrosomal short arm and 5'-terminus of this base sequence : 201985
tctccagaatttatcagtggccattgttgtgtgtgtgtgtgtgtgtgtgtgtgtgtgtgtgtgtgtttaaatgcctcttgccaacaatcaagctgatcata

SEQ ID NO: 17917 - DNA, 132 bp, Homo sapiens
  DISO7_10003158
  Located on chromosome 11
  Distance between a terminus base of telomere on chromosomal short arm and 5'-terminus of this base sequence : 110970439
  Distance between 3'-terminus of neighbour sequence of sequence listing upward to telomere on chrosomal short arm and 5'-terminus of this base sequence : 17803
ggtcaccataccttatgtcttgactatagtaatagctttcataaatatatatatatatatatatatatatatatatatatatatatatatatatatatatatatatattcctgccttctgtggtgtccaatt

SEQ ID NO: 17918 - DNA, 192 bp, Homo sapiens
  DID22N_0006359
  Located on chromosome 11
  Distance between a terminus base of telomere on chromosomal short arm and 5'-terminus of this base sequence : 111047282
  Distance between 3'-terminus of neighbour sequence of sequence listing upward to telomere on chrosomal short arm and 5'-terminus of this base sequence : 76711
ctgcttcactagtggaccctaatttacttattttctttctttctttctttctttctttctttctttctttctttctttctttctttctttctttctttcttttctttcagcacatttactttcaaaaacttgcaattgttaattctttttctggtactttgagatataaatcttctcttaacctcttgccag

SEQ ID NO: 17919 - DNA, 420 bp, Homo sapiens
  chr11.fa.O7frz.117124023
  Located on chromosome 11
  Distance between a terminus base of telomere on chromosomal short arm and 5'-terminus of this base sequence : 111155650
  Distance between 3'-terminus of neighbour sequence of sequence listing upward to telomere on chrosomal short arm and 5'-terminus of this base sequence : 108176
acttggatgtttaattgatatcagaaaatagcaattatctgtagccaaaatgttttttctcctgtgaaatacattgtgctgtattacatttacatttttagaaattttcttctagtgtctttgtactcatttgtttaatttggaaaatatatgagtataagggaaacttggaaaaatagtacgaggtatatataccatatacccttacctagattcatcattaacattttgccatagttgcttgtgttttctctctctctgaattatgtttattattattttaagctgaaaataaaatttggccagtgggatcctaattacatactaggatctgtgtacatgtacatgcacacacacacacacacacatacacacacttttttttccaaccatttgaaagtaagaatctgacttcatggc

SEQ ID NO: 17920 - DNA, 289 bp, Homo sapiens
  chr11.fa.O7frz.117422824
  Located on chromosome 11
  Distance between a terminus base of telomere on chromosomal short arm and 5'-terminus of this base sequence : 111252056
  Distance between 3'-terminus of neighbour sequence of sequence listing upward to telomere on chrosomal short arm and 5'-terminus of this base sequence : 95986
caacgtgaatgtattaatggagtatgtctatctcaaaaaattcagagcacagccaagcaactaagactttgggaaaaacaaaaatcagaacttctccgggaatataatgagtgctactttttaaaacttccctctaaatactataagtaatgtgactcagttacacataactcctacccctgtgtttctgaatttaaaattctggattcctaagacagaataattgacaaatatatatatatatatatatatatgtcagctgttcacctttcaatagtctgctacagga

SEQ ID NO: 17921 - DNA, 307 bp, Homo sapiens
  chr11.fa.O7frz.117496967
  Located on chromosome 11
  Distance between a terminus base of telomere on chromosomal short arm and 5'-terminus of this base sequence : 111326353
  Distance between 3'-terminus of neighbour sequence of sequence listing upward to telomere on chrosomal short arm and 5'-terminus of this base sequence : 74008
catatttctgccttacagtcaggctcagattcagtggtaaaagtagaggaaaacctcaaggcaattcatataaagcaaaggtcaagaagaacacagtgaggaaagaagacctaggggtcagtccagtgtttagaccaaaaacgaagggctgagagagcgtttggagtgagggaaagggggaagcattgctcaagcttagaaagcaaatatgccatcagagagagagagagagagagagagagagagagagagagcaagccagccccctcagaagaccaggagacagtatcagcaaatgagtagtcca

SEQ ID NO: 17922 - DNA, 447 bp, Homo sapiens
  chr11.fa.O7frz.117613901
  Located on chromosome 11
  Distance between a terminus base of telomere on chromosomal short arm and 5'-terminus of this base sequence : 111429487
  Distance between 3'-terminus of neighbour sequence of sequence listing upward to telomere on chrosomal short arm and 5'-terminus of this base sequence : 102827
ctctacatgtctttcaaggtctagctaagggatcacattgtattttaattattttttataaacctgtttcctctcttgattgtaatcttcttgtgtctatgtacatttctaaccctcaggaattatctttgtggaatgcataggttgaatgaaaaattagagtctattttctacattggcataaacaggcacattattctcaagtgataagcaaaaatgtcattctttaatgacaaaactgctttctttaatcagcatggaatatatatatatatatatatatatatatatatatattatagtatataatatatactgtttttaaaacttttaggttcagcggtacctaaaagtgtgcaggtttgttatataggtaaattgcatgtcacgggtgtttgttgtacagataatttcatcacccaggtaacaagcatagtacctgatagg

SEQ ID NO: 17923 - DNA, 416 bp, Homo sapiens
  AP000906.3_110752
  Located on chromosome 11
  Distance between a terminus base of telomere on chromosomal short arm and 5'-terminus of this base sequence : 111493906
  Distance between 3'-terminus of neighbour sequence of sequence listing upward to telomere on chrosomal short arm and 5'-terminus of this base sequence : 63972
agctaagtgaaataagccagacacagaaagataaatactatatgatctcacttatgtggaatccaaataactctctgagtttctcatatgaacagagagtagaatggtgtttgccaaggggtgagggtggaagaaatgggaagatgttagtcaaatggcagaaattttcagttataaagactacattctggggatctaccatatagcatgctgaccatagtaactaatactgtattttatacttgaaatctgctgagagtagatattaaatgtcctcactacacacacacacacacacacagaaacacaaaggtaattatgtctgataatagatcaactatgtattaatttgattgtaataatcattatacaatctatgcatatatcaaattgtcacattgtcaaccttaaattta

SEQ ID NO: 17924 - DNA, 446 bp, Homo sapiens
  AP001881.3_70624
  Located on chromosome 11
  Distance between a terminus base of telomere on chromosomal short arm and 5'-terminus of this base sequence : 111670606
  Distance between 3'-terminus of neighbour sequence of sequence listing upward to telomere on chrosomal short arm and 5'-terminus of this base sequence : 176284
gacatggattaatcttaaattcacatttctaaacaaaaggagccagtgaaaaggctatatactatatgattacatttatatgacactctggtgaaggcaaaactatagcatggcaaacagatcggtacttgccagggatttggaggtgacatgcggttgaacaagtgaaacacgggattttttttagaagagtgcaagtatttggtatgatgttataatggcagttatatgacattatgcatttttcaatacccatagaactttacagcagaagagctaaacttactgtatacaaatttaaatgtgtgtgtgtgtgtgtgtgtgtgtttaggaggtcaaagtatcacaggatggaagactataataaaagaatctagctgtattacaaatatatgaaaaaaatcttactggaagtggtggggtagaaaggtgcttacctaagtaac

SEQ ID NO: 17925 - DNA, 448 bp, Homo sapiens
  chr11.fa.O7frz.117952346
  Located on chromosome 11
  Distance between a terminus base of telomere on chromosomal short arm and 5'-terminus of this base sequence : 111758846
  Distance between 3'-terminus of neighbour sequence of sequence listing upward to telomere on chrosomal short arm and 5'-terminus of this base sequence : 87794
cttacttgtggtacaaatcctaagaatttaacctctctactatactaatgtaataccaatggttaaaaaaattatgtacctatgtctgtctatataaatagttgtgtgtgtgtgtgtgtgtgtgtgtgtgtgtgtgtgttgagacagatatatagagagaaacaataataacaacagaaacattaattagaagcatctctgttttcaaggatgcaggaaaaagaaaacacttacacactgcttgtgggaatataaattagtacaaccataagaaggcagtatggagatttctcaaagaactaaaacagaagtgccactgaattcagcaatcccactaccaggtatgtacccacaggaaaataaagcattatatcaaaaagatacccgcaatcattatgtttttaacaatagcaatgatatggaatcaacctaatcgtccatcaatgga

SEQ ID NO: 17926 - DNA, 319 bp, Homo sapiens
  AC024615.2_140282
  Located on chromosome 11
  Distance between a terminus base of telomere on chromosomal short arm and 5'-terminus of this base sequence : 111895669
  Distance between 3'-terminus of neighbour sequence of sequence listing upward to telomere on chrosomal short arm and 5'-terminus of this base sequence : 136375
tatacctaatgcaaatgacgagttaatgggtgcagcacaccaacatggcacatgtatacatatgtaacaaacctgcacattgtgcacatgtaccctagaacttaaagtataataaaatatatatatatatatatatatatatatatatatatatatatataaaagaaaagagagcacagaaccctcacattatatatcagagctgcaggacccagattctcagagaagccattttcatggttataagtaacctgaagacccattctgcagactacattgaaaaaaaagtaaagcaacacttagtgaagatgccactaaa

SEQ ID NO: 17927 - DNA, 249 bp, Homo sapiens
  D11S1781
  Located on chromosome 11
  Distance between a terminus base of telomere on chromosomal short arm and 5'-terminus of this base sequence : 111914217
  Distance between 3'-terminus of neighbour sequence of sequence listing upward to telomere on chrosomal short arm and 5'-terminus of this base sequence : 18229
agctgttcttgtcacaggagaggataagaggatggggggatgagtaatgatataagataatgagtatgtcaatttgtttcactatagtaactatatagagagagttactatacatacacacacacacacacacacacacacacactcatacacatctatatacaaaataacactatgttatatgccgtaaatatacacagtagaagttatctaaaaaaatacatcctagaaggggcactgacaatttgt

SEQ ID NO: 17928 - DNA, 226 bp, Homo sapiens
  D11S1343
  Located on chromosome 11
  Distance between a terminus base of telomere on chromosomal short arm and 5'-terminus of this base sequence : 111914742
  Distance between 3'-terminus of neighbour sequence of sequence listing upward to telomere on chrosomal short arm and 5'-terminus of this base sequence : 276
tccttatggcaagcctgcgttaagtgtccttcctttatactcccacagtctctgtccctccttcccaaacaatccactaatcactcccttcatacacacacacattcacacacacacacacacacacacacacgaagtgatttgcctgggtcataaaacagtagggggaggaactgctacatgaaccaggtggtcttatctagagtctagaccacccattgaacca

SEQ ID NO: 17929 - DNA, 210 bp, Homo sapiens
  D11S1787
  Located on chromosome 11
  Distance between a terminus base of telomere on chromosomal short arm and 5'-terminus of this base sequence : 111925164
  Distance between 3'-terminus of neighbour sequence of sequence listing upward to telomere on chrosomal short arm and 5'-terminus of this base sequence : 10196
ctcagatatattgtgtccagaccttgcccttatttatataccatttcctccttccatacacacacacacacacacacacaaacacgagtctctgtcattccaccttcaatcttgtatttcaaactttctttaaaatttcttaaaattctcaacctcctacatgaggtaagaccatgtaaaccttgctacttgactttagaacagagcgtt

SEQ ID NO: 17930 - DNA, 341 bp, Homo sapiens
  chr11.fa.O7frz.118245091
  Located on chromosome 11
  Distance between a terminus base of telomere on chromosomal short arm and 5'-terminus of this base sequence : 111945888
  Distance between 3'-terminus of neighbour sequence of sequence listing upward to telomere on chrosomal short arm and 5'-terminus of this base sequence : 20514
acctaaatctaaaggctttctaagcatttcacacacaaaaaaactgaaaagtttgaaagttttaactaatttttaaatattttaatatagttttttgaaagcctcccataaataaaactgcaatatttgtaagacatataacatgaaagcatgtaatgtatatgtatctgtgtgtgtgtgtgtgtgtgtgtgtgtatatatatatatagctggataactatgttttaaaaagcaaaaataaaatgaaataaaatagacactatcagaacgtaaatttcttagaaataaattagaaaaaaattaacacattaatataaatgtggtaagtatggaagtcacaa

SEQ ID NO: 17931 - DNA, 279 bp, Homo sapiens
  chr11.fa.O7frz.118786231
  Located on chromosome 11
  Distance between a terminus base of telomere on chromosomal short arm and 5'-terminus of this base sequence : 112148156
  Distance between 3'-terminus of neighbour sequence of sequence listing upward to telomere on chrosomal short arm and 5'-terminus of this base sequence : 201927
caaagcttgactacaagaagtaacacaaaaatctcaggcttaggtctatgcttttataagagtgtggtgtgtgtgtgcgcgcgtgcgtgcacacacacacacacacacacacactatcataaaacagcaaggtatattcttattggttagggtcccatacagtagtctcaaatttctgacccattattctgttaattctataaagatctctcctgctatggaaggaccttaacctgcctaaaacagttaatttcccttagatggttaagtaactttgca

SEQ ID NO: 17932 - DNA, 124 bp, Homo sapiens
  D11S2017
  Located on chromosome 11
  Distance between a terminus base of telomere on chromosomal short arm and 5'-terminus of this base sequence : 112384051
  Distance between 3'-terminus of neighbour sequence of sequence listing upward to telomere on chrosomal short arm and 5'-terminus of this base sequence : 235616
tttttgagcgcaccaaagagcttttttgtgggagattatctatctaatctatctatctatctatctatctatctatctatctatctatctacctatctacctaccatctaatttcctattcaaa

SEQ ID NO: 17933 - DNA, 187 bp, Homo sapiens
  G09990
  Located on chromosome 11
  Distance between a terminus base of telomere on chromosomal short arm and 5'-terminus of this base sequence : 112384051
  Distance between 3'-terminus of neighbour sequence of sequence listing upward to telomere on chrosomal short arm and 5'-terminus of this base sequence : -124
tttttgagcgcaccaaagagcttttttgtgggagattatctatctaatctatctatctatctatctatctatctatctatctatctatctacctatctacctaccatctaatttcctattcaaaattaaaatagactttaaacattaaaatatataagtactcaatccattgccttcagagcaaaga

SEQ ID NO: 17934 - DNA, 225 bp, Homo sapiens
  chr11.fa.O7frz.118352971
  Located on chromosome 11
  Distance between a terminus base of telomere on chromosomal short arm and 5'-terminus of this base sequence : 112582339
  Distance between 3'-terminus of neighbour sequence of sequence listing upward to telomere on chrosomal short arm and 5'-terminus of this base sequence : 198101
gcatgcaaataagttataccttacacacacacacacacacacacacacacacacacacactgctaaacacaaagggaaatgctaattattccaggtggttcttcatttcatgaaataaaaattaaaatgttagttactgaaggactacatttttattctctatttttctgatcccctccattcccacaaaagcatattcccccatttcactgaacatccatttag

SEQ ID NO: 17935 - DNA, 409 bp, Homo sapiens
  AP001024.2_9001
  Located on chromosome 11
  Distance between a terminus base of telomere on chromosomal short arm and 5'-terminus of this base sequence : 112643528
  Distance between 3'-terminus of neighbour sequence of sequence listing upward to telomere on chrosomal short arm and 5'-terminus of this base sequence : 60964
aaataacagctaccacttattgagtgcctactgtgtgccagataatttagattttctattatatgaatcaaatcaccccaaatcatagaggcttcaaacagcaatcattttattatcctttgcggtttctgtgggtcaggaatttaggaaggtgtgggccaggcggttctggctcgagatctctcttgtggttgcagtcagaaggtagctgaactgagaaggcgaggggtagagtgggaggtttgggctggagcatggagcgcctgaccagcatctctctctctctctctctctctctctctctctctctctctctctccatttagtttcaggggctttccatgtggtctctctttgtggcctaatttgctaatttgggcttcctcatagatagctaggtgacttcagg

SEQ ID NO: 17936 - DNA, 242 bp, Homo sapiens
  AP001024.2_156506
  Located on chromosome 11
  Distance between a terminus base of telomere on chromosomal short arm and 5'-terminus of this base sequence : 112715222
  Distance between 3'-terminus of neighbour sequence of sequence listing upward to telomere on chrosomal short arm and 5'-terminus of this base sequence : 71285
acctcacagcactgaatgtggtcatcagaaatactgggtcatgacccgtgggaatgggtcttgtaggttaactagatgcaacatcagggacactggcacagctgagggtgtgtgtgtgtgtgtgtgtgtgtatgtgaagggttgagttgtctttagaagtttgtcatgtttggtgggaaaaagacatatattgagattcgccaggaactttaattttgcttatgatcagtacttaacgttcc

SEQ ID NO: 17937 - DNA, 420 bp, Homo sapiens
  chr11.fa.O7frz.118476050
  Located on chromosome 11
  Distance between a terminus base of telomere on chromosomal short arm and 5'-terminus of this base sequence : 112741947
  Distance between 3'-terminus of neighbour sequence of sequence listing upward to telomere on chrosomal short arm and 5'-terminus of this base sequence : 26483
caagatattacactggtccattacattgatgacattatgctgattggatccagtgaacaagaagtagcaagcccactggacttatttatttatttatttatttatttattttttgcagttgcaagatttaatagagtgaaaacagagctcccatacaaagggaggggacccaaagagggtagccgttgctggctcaaatgcctgggtttatatctcgatcattgtccctcgtgctgtgctctcaggcgatagatgattggctatttctttacctactgtttttgcctaattagcattttagtgagctctctttactacctgattggtcaggtgtgaaataagttgcaagccctgtgtttaaaggtggatgtggtcaccttcccagccaggcttagggattcttagtcagcctaggaaatc

SEQ ID NO: 17938 - DNA, 429 bp, Homo sapiens
  chr11.fa.O7frz.119194592
  Located on chromosome 11
  Distance between a terminus base of telomere on chromosomal short arm and 5'-terminus of this base sequence : 112955637
  Distance between 3'-terminus of neighbour sequence of sequence listing upward to telomere on chrosomal short arm and 5'-terminus of this base sequence : 213270
cggtacctatcatgtttacaagcctatgtcactcagagcacatgctctggagttctaatagccatattttaatttccacgagcttcagcatttatgtgggagagcagcaagatatcaaaactagaaagaagagcaaagatgagattatgaagaaacttacatattatgcaaaaggtttcagaggcaatcctttaagagatttatttatttatttatttatttatttatttatttttgagacggagtctcgctctattgcccaggctggagtgcaatggcatgatcttggctcactgcaacctccacctcctgggttcaagcaattctagtgcctcagcctcccgagtagctgggattacaggtgcacgctgccacgcctggctaatttttgtatttttagtagagaaggggtttcactacgtcagccag

SEQ ID NO: 17939 - DNA, 286 bp, Homo sapiens
  DISD22_0006529
  Located on chromosome 11
  Distance between a terminus base of telomere on chromosomal short arm and 5'-terminus of this base sequence : 113161373
  Distance between 3'-terminus of neighbour sequence of sequence listing upward to telomere on chrosomal short arm and 5'-terminus of this base sequence : 205307
tcttcagaaggtaagtgatatgaagtaaaggagggaaataatttttgatgtcaaaattacatgggctgggcatggttctttgcacctgtaatcccagctactcaagaggctgaagtgggaggattgtttgagcccaggagtttgagtccagcctaggcaatacagcaagaccctgtatctaaaaaaatacacacacacaaacacacacacacacacacacacacacacacacacacgggttagagatttgtatagattatagaatttagtgctagaatcgtattcc

SEQ ID NO: 17940 - DNA, 460 bp, Homo sapiens
  chr11.fa.O7frz.119892749
  Located on chromosome 11
  Distance between a terminus base of telomere on chromosomal short arm and 5'-terminus of this base sequence : 113396429
  Distance between 3'-terminus of neighbour sequence of sequence listing upward to telomere on chrosomal short arm and 5'-terminus of this base sequence : 234770
cctggtttatttcagttaacataaggtcctccaggttcatccatgttgttgtaaataacaggatttcctttttaaaggctgagtcatattccatttgtgtgtgtgtgtgtgtgtgtgtgtgtgtgtgtgtgtatgtgtatgtatataacatatattttctttactcattcatggacacttaggttgatttcatatcttggcttctgtgaataatgctgcaatgaacatgtgagcacaaatacttttcaaagtagtggttttattaataaaccctttggattatacccaggagtggagtaggtggatcacagaataacttgtctctcttcacatggttttccctctgtgcatgtggacccttggtgtctctttgttcaagtttcttctcataaagacaccgtttgtgttggatcagagtccacccctatggggctctaacttaatcaacctctttaaaggc

SEQ ID NO: 17941 - DNA, 255 bp, Homo sapiens
  chr11.fa.O7frz.120183205
  Located on chromosome 11
  Distance between a terminus base of telomere on chromosomal short arm and 5'-terminus of this base sequence : 113693715
  Distance between 3'-terminus of neighbour sequence of sequence listing upward to telomere on chrosomal short arm and 5'-terminus of this base sequence : 296826
tcatatggtaactccatgtttaacaccatggctcaggaatttgctggctggagaatagaaaagtgaggctcttctggatggcaaggagaatttgagtctgtgtgtgtgtgtgtgtgtgttgtacacagatgtgtgcaggagcagcgctgctggggtaggagcagcaacttttgactatcatattcaaagtaattcttggccaaattcctggtaactctgaaatttctgcccacctactcctttgtctgaatgttg

SEQ ID NO: 17942 - DNA, 385 bp, Homo sapiens
  chr11.fa.O7frz.120270391
  Located on chromosome 11
  Distance between a terminus base of telomere on chromosomal short arm and 5'-terminus of this base sequence : 113734008
  Distance between 3'-terminus of neighbour sequence of sequence listing upward to telomere on chrosomal short arm and 5'-terminus of this base sequence : 40038
acattgctactttatttcacagaccaaaatatcttttatagatttccagcatggaaaacagtgtactgtgaaaatggatgcagtttctagtttatcttctcttcactgtggccatagaggagaaaatgtacacacacagatatacacagacacacacacacacacacacacacacacagagcgagagagagagagagagagagagagaattaattgatatccatgtaaatatctattttaaaccacacagatttccaaacccacccctcatccttggttctgattctggagcagaattgttagtttgggggtgtttatgccatgtgattagctcatgctgaagggtgacacatcctggcggcaatcagataagtatccaaagcct

SEQ ID NO: 17943 - DNA, 144 bp, Homo sapiens
  D11S1778
  Located on chromosome 11
  Distance between a terminus base of telomere on chromosomal short arm and 5'-terminus of this base sequence : 113869811
  Distance between 3'-terminus of neighbour sequence of sequence listing upward to telomere on chrosomal short arm and 5'-terminus of this base sequence : 135418
taaccttctacacagtgtcgtttcaatggggttctggagagatagaaggtgaaaatgtgtcctccgtctacacacacacacacacacacacacacacacacacacacacacacctctttatttacatggcttctctgctgaagc

SEQ ID NO: 17944 - DNA, 291 bp, Homo sapiens
  chr11.fa.O7frz.120377060
  Located on chromosome 11
  Distance between a terminus base of telomere on chromosomal short arm and 5'-terminus of this base sequence : 113981427
  Distance between 3'-terminus of neighbour sequence of sequence listing upward to telomere on chrosomal short arm and 5'-terminus of this base sequence : 111472
gcaatcagactttgtaatgaagcacctaggtgttccccacatgtggtagataggcagggcaggagcatcagagaaggaaggtgaaaagcagcagccagctttgagatgtggcttccaactcacctgcaacacacacacacacacacacacacacacacacacacacacacacacacttatgcctgccccttatgcctgggcagggatccatgaccctgattcacatgttatatgttcctcctccccatcagccaacctaaaccctgtctaaagtagcagtgtctcgtttag

SEQ ID NO: 17945 - DNA, 384 bp, Homo sapiens
  chr11.fa.O7frz.120505687
  Located on chromosome 11
  Distance between a terminus base of telomere on chromosomal short arm and 5'-terminus of this base sequence : 114087265
  Distance between 3'-terminus of neighbour sequence of sequence listing upward to telomere on chrosomal short arm and 5'-terminus of this base sequence : 105547
tactttctgtttctaggagttcagcttttttagatcccacaggtaagagggatcatgtagaatttgtctctgtcaggcctatttcatttagtataatgccctccagatgcatccatgttgtcaaaaatgacaggattttcttctttttaaagactgagtaatattttcctccccctcccccgtccccccgtgtgtgtgtgtgtgtgtgtgtgtgtgtgtatgcaacatctttattaactcatctgtcaatggacacttagattgttcatcctggctgtctgggttaatgctacaatgaatatgaaatgcacgtatctctttgaaatagtgattttctctcctttggatatatatccaggagtggtattgctggatcatatagta

SEQ ID NO: 17946 - DNA, 234 bp, Homo sapiens
  AC022897.3_1011
  Located on chromosome 11
  Distance between a terminus base of telomere on chromosomal short arm and 5'-terminus of this base sequence : 114146645
  Distance between 3'-terminus of neighbour sequence of sequence listing upward to telomere on chrosomal short arm and 5'-terminus of this base sequence : 58996
ctgaaggagtaaatgatatgaactttatattatactgtcctttattataagaaacattattaagtcaatttaaaaattgaaatatgaattataaattaaaatactgtattgatgcagatatatatatatatatatatatgtacatatatatgtggaaacatacacagataaaggaggaaacacagagcagacagggtcttctgtaatctggtaatgctctatttcttgactttg

SEQ ID NO: 17947 - DNA, 214 bp, Homo sapiens
  D11S2003
  Located on chromosome 11
  Distance between a terminus base of telomere on chromosomal short arm and 5'-terminus of this base sequence : 114366779
  Distance between 3'-terminus of neighbour sequence of sequence listing upward to telomere on chrosomal short arm and 5'-terminus of this base sequence : 219900
ttcagtgctacccccataaaaatcccaatgacatttttaaatcaaaaactgttacaagaggtgaagatatataataatgaaaggataaattcatcagaaagtaatgtagttataaataggtgtatatctatctatctatctatctatctatctatctatctatctatctatctatctaacatcagagcacctaaagatacactgacaaacatca

SEQ ID NO: 17948 - DNA, 160 bp, Homo sapiens
  D11S4206
  Located on chromosome 11
  Distance between a terminus base of telomere on chromosomal short arm and 5'-terminus of this base sequence : 114678224
  Distance between 3'-terminus of neighbour sequence of sequence listing upward to telomere on chrosomal short arm and 5'-terminus of this base sequence : 311231
atgtgaattgctctctgtgtcactctgctctcatgctcactcttccatctgtcagtgtccttgttacacacacacacacacacgcacgcacacacacacacacacacacacacaacctgaaacacttgaaaccactcaaaaggctagtattaggtttcca

SEQ ID NO: 17949 - DNA, 180 bp, Homo sapiens
  D11S1969
  Located on chromosome 11
  Distance between a terminus base of telomere on chromosomal short arm and 5'-terminus of this base sequence : 114691244
  Distance between 3'-terminus of neighbour sequence of sequence listing upward to telomere on chrosomal short arm and 5'-terminus of this base sequence : 12860
caccataggtagagttttacatgaatgtggcatgtaacttctattctgccacatattttccctttattttcttcatttcaaatggtatatcagcatacacacacacacacacacacacacacacacacatacagtaaattgtcccttaatgtcattgatagattcttgggaactgcaact

SEQ ID NO: 17950 - DNA, 294 bp, Homo sapiens
  chr11.fa.O7frz.121087674
  Located on chromosome 11
  Distance between a terminus base of telomere on chromosomal short arm and 5'-terminus of this base sequence : 114755317
  Distance between 3'-terminus of neighbour sequence of sequence listing upward to telomere on chrosomal short arm and 5'-terminus of this base sequence : 63893
ttggaattacgttacaattatcacagagattttgctcattttaagcaacaggccccagtatttagcctttgttcatgaagaggactgattgctgctcagaccatgtgctcaacaggaaataagcattgatgtgatgatggctacttctgggccatatttatatccaagcttgagcatccatttggtgtgggcctcccaatacccagagtaacataaaccacacacacacacacacacacacacacacacaaaccaacaaatgctaagtgagggtactgcttcagaggacctatc

SEQ ID NO: 17951 - DNA, 462 bp, Homo sapiens
  AP001889.3_150540
  Located on chromosome 11
  Distance between a terminus base of telomere on chromosomal short arm and 5'-terminus of this base sequence : 114985407
  Distance between 3'-terminus of neighbour sequence of sequence listing upward to telomere on chrosomal short arm and 5'-terminus of this base sequence : 229796
tatcattaagctagacactgcagaaaaaaagatttgtgaacttgatgacatagcaaaaaccaatctaaaatgaaactaaaaaaagaaaaacaacaggcattcagtgacctaaaggaaaatatcaaacaatctggcatatatgtatttgaagaaataatggccaaaaaatgtcttaatttgttgaaaactacaaatacacatattcaggaatttcaacaaacaccagccaagataaacacacacacacacacacacacacacacacacacacacacacgtgaagccaccaaggtacaacataatcaaattactgaaaatcaataataaggaaaaaaatcccaaaggcattacaaagtttaaaaggcacattacatacaatgcaacaaagttaagaattacttcatcttttttgtcaaaaactatacaaaccagaaaaaaattaccttagctatctactgtggc

SEQ ID NO: 17952 - DNA, 442 bp, Homo sapiens
  chr11.fa.O7frz.121533322
  Located on chromosome 11
  Distance between a terminus base of telomere on chromosomal short arm and 5'-terminus of this base sequence : 115168494
  Distance between 3'-terminus of neighbour sequence of sequence listing upward to telomere on chrosomal short arm and 5'-terminus of this base sequence : 182625
cttgaaggctgtaagagtgacttttttggttgttttttgttttgttttgttttgttttgttttgtttgagacaggatctcgctttgtcgtccaggctggagcgcagtggtgcgatctcagctcactgcaacctccacctcccgggttcaagcgattctcctgcctcagcctcccgagtagctgggattacaggcacacaccaccatgcccaggggggtttcaccaagttggccaggatggtctcgctctcttgacctcgtgacccatccacctcagcctcccaaagtgctgggattacagacgtgagccaccgtgcccagccagagtgactgttaatgcagctgactcatgtcacaaactgtcacccaatcctctaagcttcggtccttggacattcaaaacacctcaaagtgccaggactagtgccatcttatgaattaat

SEQ ID NO: 17953 - DNA, 290 bp, Homo sapiens
  AP000901.4_53795
  Located on chromosome 11
  Distance between a terminus base of telomere on chromosomal short arm and 5'-terminus of this base sequence : 115175280
  Distance between 3'-terminus of neighbour sequence of sequence listing upward to telomere on chrosomal short arm and 5'-terminus of this base sequence : 6344
cgcaaacctagttgaacttattttttaagatgttgtctccctctgtcacccaggctggagtgcaatggcgccgtcttggctcactgcaacctctgcctccaggattccagcgattcctgtctcagcttcccaggtagctgggattacagacacatgccaccacatccggctaattttgtgtgtgtgtgtgtgtgtgtgtgtgtgtgtgtgtgtgtgtgtgtgtgtgtgttttcagtagagttaaggtttccccatgttggctaggctgctctcaaactcctgacttaggt

SEQ ID NO: 17954 - DNA, 143 bp, Homo sapiens
  D11S927
  Located on chromosome 11
  Distance between a terminus base of telomere on chromosomal short arm and 5'-terminus of this base sequence : 115241006
  Distance between 3'-terminus of neighbour sequence of sequence listing upward to telomere on chrosomal short arm and 5'-terminus of this base sequence : 65436
agtgagccgagttcgcgccactgcactccagcctgggtgccagagcgagactccgtctcaaaacacacacacacacacacacacacacacacacacacacacacacacacacaaataatcttaaaacattccaggcttttggt

SEQ ID NO: 17955 - DNA, 350 bp, Homo sapiens
  HUMUT1004
  Located on chromosome 11
  Distance between a terminus base of telomere on chromosomal short arm and 5'-terminus of this base sequence : 115404515
  Distance between 3'-terminus of neighbour sequence of sequence listing upward to telomere on chrosomal short arm and 5'-terminus of this base sequence : 163366
ccagtttctccatttgcaagttggatataataacagtgtagacctcctatggttaattgaagaatcaatgagttaatacagcgatacaggtagtcttgtgcctagcacgtaatgagggctcagtagatgccacttggtagcagcagcagcagcagcagcagcagcagcagcagcttcttaggttcacaatgttaagagagttttgtattaaatattgaaagaaatgtgacaatttatcccaaatgtgttgaagttttaggttcttgggcatatttgtttttcaaagacactccttagatatactagagatacaatttacacataatttttaccaacatggtggcgattta

SEQ ID NO: 17956 - DNA, 298 bp, Homo sapiens
  AC009294.8_210169
  Located on chromosome 11
  Distance between a terminus base of telomere on chromosomal short arm and 5'-terminus of this base sequence : 115718749
  Distance between 3'-terminus of neighbour sequence of sequence listing upward to telomere on chrosomal short arm and 5'-terminus of this base sequence : 313884
ccagattcaagtcacctacaagttggtggtggtggcagtggtggtggggtatgtgtgtgtgtgtgtgtgtgtgtgtgtgtgtttgatcatgtggtcatctatacattggtaaatagagttgaagaaatgccccagggaacagctcattccctatgctgaggtcctttgccaagagaatcacacaagcctcaggttctcaaaaaagccaatgctcaagccagctttcagaggaatgtctcaaggatgctggcctccctgcaggcttcccaggctctaataaagcgagcttcattatcag

SEQ ID NO: 17957 - DNA, 161 bp, Homo sapiens
  D11S1391
  Located on chromosome 11
  Distance between a terminus base of telomere on chromosomal short arm and 5'-terminus of this base sequence : 115797695
  Distance between 3'-terminus of neighbour sequence of sequence listing upward to telomere on chrosomal short arm and 5'-terminus of this base sequence : 78648
catccatccctctgtctctgtctctatctctgcatccatactatctatctatctatctatctatctatctatctatctatctatctacctaatctatcatccaaccatctatatctatctatgtttctatgtatgtgtgtatgtatgtatgtatgcatgca

SEQ ID NO: 17958 - DNA, 226 bp, Homo sapiens
  AC009294.8_57509
  Located on chromosome 11
  Distance between a terminus base of telomere on chromosomal short arm and 5'-terminus of this base sequence : 115871346
  Distance between 3'-terminus of neighbour sequence of sequence listing upward to telomere on chrosomal short arm and 5'-terminus of this base sequence : 73490
taatccaagatggcactttaaccaattccttccagctcatgtgtgtcagatctgaatcaactccccaaaggtctgtggaatcaactactccctgacttatttcttttatatgtgtgtgtgtgtgtgtgtgtgtgtgtgcgtgcgcgtgcgtgtgtgtgtgtgtgtacattcttttttaaaaagacttaatttttttagagcagtttaaggttcatagcaaaattga

SEQ ID NO: 17959 - DNA, 362 bp, Homo sapiens
  AC009294.8_45735
  Located on chromosome 11
  Distance between a terminus base of telomere on chromosomal short arm and 5'-terminus of this base sequence : 115883104
  Distance between 3'-terminus of neighbour sequence of sequence listing upward to telomere on chrosomal short arm and 5'-terminus of this base sequence : 11532
gaatgtcctttacagaaggtaagtaggggtaagaagcttactgagaggccatctgtgctcctagaatatagtctgatttgaaattagtatgtttttgaaacaagtaatttgtgtgtgtgtgtgtgtgtgtgtgtgtgtgtgtgtgtgtgtgtgttacaaaagaaatgcttcttagcaaaaatattataacaccaagcagctactacatacctcaggcactgggctggctaggtactgttaatctcaacttatttaattcttgcacatttaccccccaggtaaagtttgtcatggtctttttgaaaatgagcacacccaggtttacaatcattaagcaactagactagtggcttatttcttgc

SEQ ID NO: 17960 - DNA, 287 bp, Homo sapiens
  AC009294.8_17384
  Located on chromosome 11
  Distance between a terminus base of telomere on chromosomal short arm and 5'-terminus of this base sequence : 115911472
  Distance between 3'-terminus of neighbour sequence of sequence listing upward to telomere on chrosomal short arm and 5'-terminus of this base sequence : 28006
ttcaggtattaagtttctgcagactttcagtgagcagatgtgctacagcttataaaaagaaaaggcttagaggcagtgtgtgtatgtgtatgtgtgtgcatgcatgcatgcatgtgtgtgtgtgtgtgtgtgtgtgttggggggagagagagagagaaagagaaagaatgtgtgttcttattcttttgccacaaatattatccttaaatagtgaaaggaaaggtgggggctttctaaacacataaagatgatcttgcctgtttctatctagcggtcctaaagagaat

SEQ ID NO: 17961 - DNA, 124 bp, Homo sapiens
  D11S1793
  Located on chromosome 11
  Distance between a terminus base of telomere on chromosomal short arm and 5'-terminus of this base sequence : 115978295
  Distance between 3'-terminus of neighbour sequence of sequence listing upward to telomere on chrosomal short arm and 5'-terminus of this base sequence : 66536
atcctgaacacattcctcaaggctttatgatgtgtgtgtgtgtgtgtgtgtgtgtgtgtgtgtgtgtgtgtgtgtgtgtgaaagagaacagagagagagaatgttacagggaggatgcatgact

SEQ ID NO: 17962 - DNA, 478 bp, Homo sapiens
  chr11.fa.O7frz.122592611
  Located on chromosome 11
  Distance between a terminus base of telomere on chromosomal short arm and 5'-terminus of this base sequence : 116241579
  Distance between 3'-terminus of neighbour sequence of sequence listing upward to telomere on chrosomal short arm and 5'-terminus of this base sequence : 263160
caattacaggaaatacggtcttctctgatttcttaaaatttaccataaaaattatttttcacctcttcaactcataacctgaaccgaccctacaacatgttttgattttagtaagattgttgtgtctccctgggcacagcaaatgggcatcaggtggcccaatgtgtgttttattggttattgctacatttttctttttttattttattttattttattttattttattttattttattttattttattttattttattttattttattttgagatggagtctcgctctgttgcccaggctgaagtgcaatggcatgatctcggcccactgcaacctccacctcctgggttcaagtaattctcctgtctcaggatcccaagtagctgggactacaggcacacgccaccatgcctggctatgtttgtttgtttgtttgttgtatttttagtagagacggggtttcacggtattggtcag

SEQ ID NO: 17963 - DNA, 370 bp, Homo sapiens
  AP002448.2_166737
  Located on chromosome 11
  Distance between a terminus base of telomere on chromosomal short arm and 5'-terminus of this base sequence : 116251657
  Distance between 3'-terminus of neighbour sequence of sequence listing upward to telomere on chrosomal short arm and 5'-terminus of this base sequence : 9600
cgaactcgaggttgatattacagattgcaattgcacgtttgcattcccctaaaattcaaatgttgaggtgctaatcccctgtgtgatggcatttggagaaggggcctttgggaggtaattagatcttgcaggtgaatccctctaatgggattagtgtccttataagaagagacaccagagagatgatctctctctctgtctctctctctctctctctctctctctctctcagccatgtgaacacacagtgagaagccagctttctgcaaaccagaaagagggcccgcactaaaaaccacacctagatctcagacttccagtctcctgaactgtgagaaataaatttttgttatttaagccatgcagtcta

SEQ ID NO: 17964 - DNA, 457 bp, Homo sapiens
  AP002448.2_148284
  Located on chromosome 11
  Distance between a terminus base of telomere on chromosomal short arm and 5'-terminus of this base sequence : 116284402
  Distance between 3'-terminus of neighbour sequence of sequence listing upward to telomere on chrosomal short arm and 5'-terminus of this base sequence : 32375
ctgcatgttctaaatgtacctaagttgatactttctgttttttgtttatcgtgtgtaaatgtatgtgtgtgtgcgtgtgtgtgtgtgtgtgtgtgtatgatggagtctcactcagtcacccaggctggagtgcagtggcccagtctcagctcattgcaacctccacctcctgggttgaagcaattctcctgcctcagcctccccagtaactgggattacaggtgcatgccaccacgcctggctaatgtttgtatttttagtagaggcggggtttcaccatgttggccaggctggtctcgaactcccgacctcagatgatccacctgcctcggcctcccaaagtgctgggattacaggcatgagccaccacgcccggcctaaatatacctaagttgattctgatagagatgatcttctgtttacacttgaaaaacactgacatagtcaatgtccagat

SEQ ID NO: 17965 - DNA, 236 bp, Homo sapiens
  D11S1986
  Located on chromosome 11
  Distance between a terminus base of telomere on chromosomal short arm and 5'-terminus of this base sequence : 116326178
  Distance between 3'-terminus of neighbour sequence of sequence listing upward to telomere on chrosomal short arm and 5'-terminus of this base sequence : 41319
ccaagatcgcaccattgtactccagcctgggcaatggagtgagactccgtcccaaaaaaaaccaaaaaaaagaaagaaagagagaggaaggaaggaaggaaggaaggaaggaaagaaggaaggaaggaaggaaggaaggaaggaaggaaggaaggaaggaaggaaggaaggaaggaaagaaacaaaacccacatggtagcactaagcctaggcgaggacccatcacctttaggctt

SEQ ID NO: 17966 - DNA, 338 bp, Homo sapiens
  AP002008.3_96377
  Located on chromosome 11
  Distance between a terminus base of telomere on chromosomal short arm and 5'-terminus of this base sequence : 116417353
  Distance between 3'-terminus of neighbour sequence of sequence listing upward to telomere on chrosomal short arm and 5'-terminus of this base sequence : 90939
agatggaaataagaataaatggagaaaaataaatgaacaaaataggagaagtttcctgcccaaaccacaccagcaatgacaatgttccatgaactgagtgtaattaattcaaaccactaccctgaggggtgtgtgtgtgtgtgtgtgtgtgtgtgtagagacagtgtgtgtatgtatgtgtgactgagagacagagagagaggagaggagagggagggaagaggagagaaggggaggggaaggcaggggaggggaggggagagaagacataggagagaaaggaaaagaaacaggagagtcctaagaggcaatgtctcacttatttgtggaatctaaag

SEQ ID NO: 17967 - DNA, 462 bp, Homo sapiens
  chr11.fa.O7frz.122812102
  Located on chromosome 11
  Distance between a terminus base of telomere on chromosomal short arm and 5'-terminus of this base sequence : 116536645
  Distance between 3'-terminus of neighbour sequence of sequence listing upward to telomere on chrosomal short arm and 5'-terminus of this base sequence : 118954
ttaggtattctgttacaagcaataggaaatggacgaagacaaccatttaaaaccgtatttcccaacctttttttccactgtgacacacatgacagataaaatgtatgtatcagacaaccactttggtctctttactcgacaagcattcctgtttgtttgtttgtttgtttgttttttgagacggagtctcgctctgttccctaggctggagtgcagggtcatgcgatcttggctcactgcagcctccacctcctgtatttgcaacttttcttagtttgaaattctttaaggaacagcatctgcaaacacaggtactggaatggttggtaacatattacttgcagcacaccttccatctaagctcagcacacaggggtttgccatgatgttggagttgagagcatctaaaagcctctgatccaagataaaaataaatcattagtaaagctgtcaatcagtacc

SEQ ID NO: 17968 - DNA, 446 bp, Homo sapiens
  AP000925.4_108209
  Located on chromosome 11
  Distance between a terminus base of telomere on chromosomal short arm and 5'-terminus of this base sequence : 116641351
  Distance between 3'-terminus of neighbour sequence of sequence listing upward to telomere on chrosomal short arm and 5'-terminus of this base sequence : 104244
tactctgaaattagtcttgaaggatgagcaggaattcttacagtgaggagggtggagatattcagagggaatggtaagggctctatgtaggaagctcttctcagtatggaataactaaagtaaggagtgtgtgtgtgtgtgtgtgtgtgtgtttgtgcacacgcatgcatgtccatccacatgcacaagggaaagagagacacttccgtgtaaatgcttaaggattcatcacatttttgcagcttcatagtattccatatagtatgattatatgccataatttatttaaccattcctcttttgatagatatttgttttctggtttgggctatttcaaataatgttgcactgaacaaacttgcacatgtgttcttgcaaacttgtgactgtaattctgtgtcaagggttaaggtttggttttggtagtcaccattgataaatttgag

SEQ ID NO: 17969 - DNA, 336 bp, Homo sapiens
  AP001781.3_77403
  Located on chromosome 11
  Distance between a terminus base of telomere on chromosomal short arm and 5'-terminus of this base sequence : 116711975
  Distance between 3'-terminus of neighbour sequence of sequence listing upward to telomere on chrosomal short arm and 5'-terminus of this base sequence : 70178
tcgttagaaaccacatattcacctgccttccttcttatgaaacaagatgcatcctcaggttcacatcttcttggtagcacagagagagaaacaagacctggtctcttaaacctgtgaggggtaaaccccacacaaattacagagagaaacaccaaggtgaattccactgttgctgagacatttttattggcataggttatatgtttgtgtgtgtgtgtgtgtgtgtgtgtgtgtgtgtgtgtgtgtgtctgcttcatttttctaatcaaacaaacaactgatgtaagctgccaaggatgaaaaacaacattacatgtctgaagcaatcagacaaat

SEQ ID NO: 17970 - DNA, 464 bp, Homo sapiens
  chr11.fa.O7frz.123265918
  Located on chromosome 11
  Distance between a terminus base of telomere on chromosomal short arm and 5'-terminus of this base sequence : 116740989
  Distance between 3'-terminus of neighbour sequence of sequence listing upward to telomere on chrosomal short arm and 5'-terminus of this base sequence : 28678
aaatagcgttcttggaagtaagcacaatagagcctttgaatgaatgaatgaaataatgaataaataaataaataaataaataaataaataaataaataaatggggttcttggaagtaagcacaatagctagagcctttgatagtaatgaaagtttgggaaccagcagacctgaacagtttttctcaaattatgtctgcgaatgtattctctagggttttaattttattttcattttcatattttttagatttgtataagcatattctgaattatttgggtgaccaccttacaaccaagtattgccacacaatttcagcacccacatttacatgtgtgttttagtgctgcttttattgttctgggataatgagaaaagaacagaggtggttttaaaatgacaatgatactttcatgcacaaaatgaaagccaaatgcatcatgagattgcactatttggtagttg

SEQ ID NO: 17971 - DNA, 322 bp, Homo sapiens
  AC009766.4_14156
  Located on chromosome 11
  Distance between a terminus base of telomere on chromosomal short arm and 5'-terminus of this base sequence : 116869033
  Distance between 3'-terminus of neighbour sequence of sequence listing upward to telomere on chrosomal short arm and 5'-terminus of this base sequence : 127580
caaaggataaatgtttgaggagatggataccccattgtccattatgtgattattatgcattgtatgcctgaatcaaaacaattcatgtaccccataaatatatatatatatatatatatatatatatatgcctactatgtacccacaaaaattaaaaaaaaaaaattagaagtgtttttggtttctattgagaagtttgatgatattttcatgaccagaagtatgtttttgtttagctatgttttcatgaccagaaatatagttttgtttacatcagcctatggtaaaattgttattaaagtcacagtttccaagaacctat

SEQ ID NO: 17972 - DNA, 270 bp, Homo sapiens
  D11S4192
  Located on chromosome 11
  Distance between a terminus base of telomere on chromosomal short arm and 5'-terminus of this base sequence : 116915034
  Distance between 3'-terminus of neighbour sequence of sequence listing upward to telomere on chrosomal short arm and 5'-terminus of this base sequence : 45679
gagcccaggaggttgaggctgcaatgagccatgttcctgctactgttctccagcctgggcaacagggtgagattctgtctcaaaacaaaacgaaacaaaatacacacacacacacacacacacacacacacacacacccacgaagagttttagtctggtctcatctccataagggggacatagagtgagtgaggaagaagattggaaagtgaaacattgctcctaaaggccttgtgccctccatagagtagcggtggcgtcaacactggg

SEQ ID NO: 17973 - DNA, 308 bp, Homo sapiens
  AB042297.1_2234
  Located on chromosome 11
  Distance between a terminus base of telomere on chromosomal short arm and 5'-terminus of this base sequence : 117183761
  Distance between 3'-terminus of neighbour sequence of sequence listing upward to telomere on chrosomal short arm and 5'-terminus of this base sequence : 268457
agaggtttactaggccttcctcttcttggaaaatcgtaaattcaaacttttgtcactctagccctcaaaactattgaaaagcccttctctttaaggttaaggggtaagtgagttgctatggctatacccttatcaaaaagtagcgtgaaggatccttgtggtgatggatctgttctgtatcttgagtggcgtggtgggtacatgaatttacacatgataaaatagcatagaactaaatacacgcacacacacacacacacacacacacacgaatgcatgttaaactagaataaggttggtggattgta

SEQ ID NO: 17974 - DNA, 245 bp, Homo sapiens
  AB042297.1_2793
  Located on chromosome 11
  Distance between a terminus base of telomere on chromosomal short arm and 5'-terminus of this base sequence : 117184514
  Distance between 3'-terminus of neighbour sequence of sequence listing upward to telomere on chrosomal short arm and 5'-terminus of this base sequence : 445
agcatgtatcagaattgcattcccttttaaggttaaataatattcgattgtatacacacacacacacacacacacacacacacacaatatttgtttattcatctgttgatggatacttgggttgtttccatctttggagtattatgaataatgctgctatgaacattggcatacaaatatccaaattcctttttttagttcttttaggtatatatctagaagtggaattgctagatcatgtaatt

SEQ ID NO: 17975 - DNA, 448 bp, Homo sapiens
  AB042297.1_37281
  Located on chromosome 11
  Distance between a terminus base of telomere on chromosomal short arm and 5'-terminus of this base sequence : 117218868
  Distance between 3'-terminus of neighbour sequence of sequence listing upward to telomere on chrosomal short arm and 5'-terminus of this base sequence : 34109
gcaatcctgagcataaagaacaaagctgggttgggcatagtggcttatacctgtaatctcagcactttgggaggccaaaatgggagaactgcatgaggccaggagttcgagcctgcagtgagctatgagtgcaccactgcactccagcctgggcaacagagtgagacccttcacacacacacacacacacacacacacacacacacacaaaacagagtgagacccttcacacacacacacacaccacacacacaaacataccctgaaacacaaaaacccccaaaccaaaaaacaaagctggagggatcacaataccggacttcaaaacttattacaaaagcatagtaaccaaaacagcgtggtactggcataaaagcagacacatagaccagtggaacagaatagagaacccagttataaattcatgcatttataaccaactcatctt

SEQ ID NO: 17976 - DNA, 443 bp, Homo sapiens
  AB042297.1_52676
  Located on chromosome 11
  Distance between a terminus base of telomere on chromosomal short arm and 5'-terminus of this base sequence : 117234501
  Distance between 3'-terminus of neighbour sequence of sequence listing upward to telomere on chrosomal short arm and 5'-terminus of this base sequence : 15185
ttattagctggtcaataagcaaacagaacagagactttggtggttacacatgataaagaatacagacttcacataattaatttaggaaagtcataaaacaaacagcagcaacaacaacaataaaaaagaataacaaacagcaacaaaaacaaactcagggaggagaagggagtctggtgtccaaagttgtcacatttgtgtgtgtgtgtgtgtgtgtgtgtgtgtgtgtatgtatgtatttatttatttttttgagacacagtctcactattgcccaggctggagtgaagtggtgcaatcatagctcactgcagcctcaaattcttgggcttaagtgatcctcctgctgcagcttcccaagtagctggggctataggcacgtgtcatcacacctggttaatttttatagtttttgtagagtcttgctatgttgtccagactgt

SEQ ID NO: 17977 - DNA, 178 bp, Homo sapiens
  D11S1347
  Located on chromosome 11
  Distance between a terminus base of telomere on chromosomal short arm and 5'-terminus of this base sequence : 117234605
  Distance between 3'-terminus of neighbour sequence of sequence listing upward to telomere on chrosomal short arm and 5'-terminus of this base sequence : -339
gcagcaacaacaacaataaaaaagaataacaaacagcaacaaaaacaaactcagggaggagaagggagtctggtgtccaaagttgtcacatttgtgtgtgtgtgtgtgtgtgtgtgtgtgtgtgtatgtatgtatttatttatttttttgagacacagtctcactattgcccaggctg

SEQ ID NO: 17978 - DNA, 157 bp, Homo sapiens
  D11S4078
  Located on chromosome 11
  Distance between a terminus base of telomere on chromosomal short arm and 5'-terminus of this base sequence : 117352643
  Distance between 3'-terminus of neighbour sequence of sequence listing upward to telomere on chrosomal short arm and 5'-terminus of this base sequence : 117860
aggctaaccagccaacatttttgctatattgctatatttcttcttagttcttttttctaaatacatgcataacacacacacacacacacacacacacacacacactcactcatactttcttttaagaacagaattgagacttgagttttatagcccg

SEQ ID NO: 17979 - DNA, 466 bp, Homo sapiens
  AP002499.2_132777
  Located on chromosome 11
  Distance between a terminus base of telomere on chromosomal short arm and 5'-terminus of this base sequence : 117551977
  Distance between 3'-terminus of neighbour sequence of sequence listing upward to telomere on chrosomal short arm and 5'-terminus of this base sequence : 199177
cttaaagagcgattctaaggatgtttgccttttaataacgttgaagtctttgaaaactaagttaataaatctccagtaataggccttgaggccacaagtgaagaaacagttatttaatgagaactaactatagccagtccccatctgatggactggggctgcggcaatgaacaactgacaaagtcattgccctcacagagcgaatattctatagtagagaagataacaaacaaataagtgacagcaaaaatggttaaatgccatggagaaaaataaagcaagataagggaatgaggaggtgctggtgcacgtgtgtgtgtgtgtgtgtgtgtgtgagaatgggtgtgggtgggtgtgggtgtgtgtaggtgtgggtcatcttccaatgatactgccattgccaacaacatgaaattccttttagagaatgcctttcaaagctcagtctttcatggatgaagatgta

SEQ ID NO: 17980 - DNA, 204 bp, Homo sapiens
  Z67709
  Located on chromosome 11
  Distance between a terminus base of telomere on chromosomal short arm and 5'-terminus of this base sequence : 117593120
  Distance between 3'-terminus of neighbour sequence of sequence listing upward to telomere on chrosomal short arm and 5'-terminus of this base sequence : 40677
actgactcccttggaggtaggggtgtgtgtgtgtgtgtgtgtgtgtgtgtgtgtgtgttgcatatgccagtgtggtgtgttgctttcagagctcctgtcaaatgcaatttagtcatgttttcatacatccacatttaacccttacaacaactcattcagggtaagtgacgtcatttgcatttgagaggcattgaagctgcattt

SEQ ID NO: 17981 - DNA, 199 bp, Homo sapiens
  Z66962
  Located on chromosome 11
  Distance between a terminus base of telomere on chromosomal short arm and 5'-terminus of this base sequence : 117729812
  Distance between 3'-terminus of neighbour sequence of sequence listing upward to telomere on chrosomal short arm and 5'-terminus of this base sequence : 136488
gcatgacagattcctggaacactattcttattctcactctcatctcttctcttccccaccatccatctctctctctctctgtctctcacatgtgcatgcgtacacacacacacacacacacacacacacacaccacaaattttatgtctcttgccctaacaattggaacattatggactagaaaatgggtgtttgaagc

SEQ ID NO: 17982 - DNA, 469 bp, Homo sapiens
  AC046200.2_148267
  Located on chromosome 11
  Distance between a terminus base of telomere on chromosomal short arm and 5'-terminus of this base sequence : 117844300
  Distance between 3'-terminus of neighbour sequence of sequence listing upward to telomere on chrosomal short arm and 5'-terminus of this base sequence : 114289
atgacttatgagcttgaattctataccttgcattatcatccaatactttcttatttattttctttcttaaattcttccagctatggctgggacacacagacacacagacagacagacagacagacacacacacacacacacacacacacacacacacacacacacactatgatggaggtaagtcaaagggacacaggagccaaccgaaagagcttaggggctctaacatacaagatgctttgggatccttgtatactccttaccccaatcctagaatcagccatttctccaaggaaacttccttttattggagaatattaaaaaccaagatctgaggaatagatgtgctcattgtggtcagtagcctttaattacagacttaagacttccttccccatctgtcaggtaagtaattattttgctcctctgcccacctctgggttctttctctttgactacatggaattga

SEQ ID NO: 17983 - DNA, 469 bp, Homo sapiens; identical to SEQ ID NO: 17982
  AP000802.3_164005
  Located on chromosome 11
  Distance between a terminus base of telomere on chromosomal short arm and 5'-terminus of this base sequence : 117844300
  Distance between 3'-terminus of neighbour sequence of sequence listing upward to telomere on chrosomal short arm and 5'-terminus of this base sequence : -469

SEQ ID NO: 17984 - DNA, 276 bp, Homo sapiens
  AC046200.2_154626
  Located on chromosome 11
  Distance between a terminus base of telomere on chromosomal short arm and 5'-terminus of this base sequence : 117850615
  Distance between 3'-terminus of neighbour sequence of sequence listing upward to telomere on chrosomal short arm and 5'-terminus of this base sequence : 5846
caggctatacataaagaactgaacctaataacagcctatcttatttttgtcacatctacaagtgagttatcatcactgatgcactaatagtatttgtggtggttatggtttattataatcccttatttttccacagaacaaatataaattatgagagagagagagagagtgtgtgtgtgtgtgtgtgtgtgcgtgtgtgtgtgtgtctttcctccctcattgtggctacactcagagcgtgtgtctcaggcacaagcctcatctgccaaggatgta

SEQ ID NO: 17985 - DNA, 248 bp, Homo sapiens
  D11S3178
  Located on chromosome 11
  Distance between a terminus base of telomere on chromosomal short arm and 5'-terminus of this base sequence : 117925765
  Distance between 3'-terminus of neighbour sequence of sequence listing upward to telomere on chrosomal short arm and 5'-terminus of this base sequence : 74874
ccacgcctggctcatttttgtatttttagtagagacaaagtttcaccatgttggccaggctggtctcgaactcctgacctcaggtgatccacccaccttggcctcccaaaatgctgggattacaggcgtgagccaccgcacccggccacgatttttacttattaaatgaaaagcctttacacacacacacacacacacacacacacacacacacacacacagatgtcactctgctgctgaaaatcctc

SEQ ID NO: 17986 - DNA, 190 bp, Homo sapiens
  Z67379
  Located on chromosome 11
  Distance between a terminus base of telomere on chromosomal short arm and 5'-terminus of this base sequence : 117990756
  Distance between 3'-terminus of neighbour sequence of sequence listing upward to telomere on chrosomal short arm and 5'-terminus of this base sequence : 64743
aattcccagggctgtggtgacttcatcaatgcatctgatgcacaaacgaaaacatccttcacttctgtccaaaaaataaaacgattattatacttttatgttgataataaagtcagccatcagtactgttttgtgtgtgtgtgtgtgtgtgtgtgtatgtatgtccccaggccttgaggattacttgatt

SEQ ID NO: 17987 - DNA, 309 bp, Homo sapiens
  chr11.fa.O7frz.124772422
  Located on chromosome 11
  Distance between a terminus base of telomere on chromosomal short arm and 5'-terminus of this base sequence : 118102084
  Distance between 3'-terminus of neighbour sequence of sequence listing upward to telomere on chrosomal short arm and 5'-terminus of this base sequence : 111138
tggaattattgacattcatgacctgcaattggagagtaactaaaatacttcaagttgtgagggtgtgtgtgtgtgtgtgtgtgtgtgtgtgtgtgtgtgtgtgtgcatgcgtgcaggcacacatgatatattaaaaattaatccttgggggagattatatagagcaaaaaaagagagcagaaacattaaacccatctttattttttctgggagctgtacagtttaagggaggctttttgccttctcattggacaaaacctgatagatgaagtctgggaagagccaccagaataacagctttctcctttc

SEQ ID NO: 17988 - DNA, 388 bp, Homo sapiens
  AP000999.3_143986
  Located on chromosome 11
  Distance between a terminus base of telomere on chromosomal short arm and 5'-terminus of this base sequence : 118130157
  Distance between 3'-terminus of neighbour sequence of sequence listing upward to telomere on chrosomal short arm and 5'-terminus of this base sequence : 27764
gaatggaaaaggtactcgttagacctgtaggtgatggcctgggaagaaattgggtgattggatgtcctgggttgcccaggacagtcatggtttacacatgttgttccagcataattattttaattgtacctcttgtcactcagtttggaatatatattgcaaggtcaccctagagagaagcaatgaagacttaaagacaaaaggtgtttccctgagacacacacacacacacacacacacacacacacacacacagagtaagaaccctggcatgttctgcttaaaaagctgaggcacacagcatgtcgtttgcactgttgggtccaacagagaaatgaatggctcaaaagtctagagagagcacctaggacatttgaaatttagttca

SEQ ID NO: 17989 - DNA, 193 bp, Homo sapiens
  D11S3179
  Located on chromosome 11
  Distance between a terminus base of telomere on chromosomal short arm and 5'-terminus of this base sequence : 118217842
  Distance between 3'-terminus of neighbour sequence of sequence listing upward to telomere on chrosomal short arm and 5'-terminus of this base sequence : 87297
atcaatccatcagtggggttgaaaatacatatctcccagttttgcttctgtgtgtgtgcgtgtgtgtgtgtgtgtgtgtgtgtgtgtgtgtggacccatttataattatgagggaataaaggtattctaaataaaaccaaaggagcaattgcttagttgtatataatccctgcaaggcccctttggtaggaag

SEQ ID NO: 17990 - DNA, 367 bp, Homo sapiens
  AF050737.1_653
  Located on chromosome 11
  Distance between a terminus base of telomere on chromosomal short arm and 5'-terminus of this base sequence : 118405387
  Distance between 3'-terminus of neighbour sequence of sequence listing upward to telomere on chrosomal short arm and 5'-terminus of this base sequence : 187352
aggagaaacttggaaggtgtagcaacacttagtccccaggctgatggagtggggtgaaaagggtcaatctgttaggacagcctgggatccaggaagaaagctggcaggtcctgggagaacagagaggattttctctgatcctctctttctctctctctctctctctctctctctctctctctctccctccctctatccccaccacctcatttctatttcatctggggcacagagctagaaaggtgggggacagaagccctggatgcagcataaaccccagcaacgtgtttcctatgcttccgtctcagcttaagtcttggtgctgccttccctgaaagttcggcacttgaaggaatcaaattgtcta

SEQ ID NO: 17991 - DNA, 450 bp, Homo sapiens
  AF148806.1_5607
  Located on chromosome 11
  Distance between a terminus base of telomere on chromosomal short arm and 5'-terminus of this base sequence : 118449022
  Distance between 3'-terminus of neighbour sequence of sequence listing upward to telomere on chrosomal short arm and 5'-terminus of this base sequence : 43268
gacttcaggtcttggaatctatgtagtcagttctattgctggactcatccaaaggaaaaagcctgtttggagttgacctgacatggaaatgcaaaaggaggcctcaggggttccagctcacccttgactccaaactgaggtgtgtgaggcagggagtggggagagggagaaagagatagagtggtgaagggtgttccgctgctaccctgcccactgtcatttgggctgcagaggaacctcgttcttctccccttttcttcctctctccttttctttcttttcttttcttttctttctttctttctttctttctttctttctttctttctttctttctttctttctctttctttctttcctttctttctttctttcttccttcctttctttttctttctttctctttcttttctttcttctgcagcaattagttaccaactgtcctcagtt

SEQ ID NO: 17992 - DNA, 263 bp, Homo sapiens
  D11S4122
  Located on chromosome 11
  Distance between a terminus base of telomere on chromosomal short arm and 5'-terminus of this base sequence : 118547212
  Distance between 3'-terminus of neighbour sequence of sequence listing upward to telomere on chrosomal short arm and 5'-terminus of this base sequence : 97740
atgcccacataggacatagacatggaatgatctaataggtcagagtcctccccaaactctctctctctcaaacatatatgctcacacacacacacacacacacacacacacacacacactttgtgacattttccatcccttcccaccaccatttattcccagactaataggtatcagtgcctccccacacccagacacaacatatacacacaggaggcacagcagccctgccaggtccccatagagggctggatgtcaaagtc

SEQ ID NO: 17993 - DNA, 128 bp, Homo sapiens
  DISO7_10003160
  Located on chromosome 11
  Distance between a terminus base of telomere on chromosomal short arm and 5'-terminus of this base sequence : 118575194
  Distance between 3'-terminus of neighbour sequence of sequence listing upward to telomere on chrosomal short arm and 5'-terminus of this base sequence : 27719
tccaactaaattgatgctgcttaacacacacacacacacacacacacacacacacacacaccttttttgggcagggggttgggggagatcaaaaaaacaagcaaaaaaatcctgtgcaaggctgacta

SEQ ID NO: 17994 - DNA, 401 bp, Homo sapiens
  chr11.fa.O7frz.125298981
  Located on chromosome 11
  Distance between a terminus base of telomere on chromosomal short arm and 5'-terminus of this base sequence : 118682807
  Distance between 3'-terminus of neighbour sequence of sequence listing upward to telomere on chrosomal short arm and 5'-terminus of this base sequence : 107485
caaatataaattctggagttgagtagtatgatagctgaaatgaaaaatttactagaagggctcaacagcagatctgagcaggcagaagaaagaatctgtgaattaaagatatgtaaattgatattatacagtctaagggatagaaaggaaaaaagaatggagaaaaatgaacaaaggttcagagacatttgagataacatcaaaaatatgtagtgtgtgtgtgtgtgtgtgtgtgtgtgtgtgtgtacgtgtgtgtaatgagaatccaagaaagagaagagagaggaagcagaaataatatttgaaaaaataatgaccaaaaactttacaaatttgatgaaaaatattaatctgcacatgcaaaaaaactcaataaacttcaaataggatacatcaaagag

SEQ ID NO: 17995 - DNA, 302 bp, Homo sapiens
  AP002436.2_25289
  Located on chromosome 11
  Distance between a terminus base of telomere on chromosomal short arm and 5'-terminus of this base sequence : 118692660
  Distance between 3'-terminus of neighbour sequence of sequence listing upward to telomere on chrosomal short arm and 5'-terminus of this base sequence : 9452
cttcctatctgtaagtggacaacaacttcagcccttgtctgtggattcaaggttgcccatgaccttccccatcctgattccctgcactttctgacttgcttagacagcccccataatcacatgaacctcttgtaatatctctctctctctctctctctctggaaatgttggaggttggtgctccaggtggtggtgatgagacagcatggatctggggagatgaaaaactgagaatctgaaagctttgtacattgcccttggtcccatgctatttccccatttgtcttcgtctctatcaataa

SEQ ID NO: 17996 - DNA, 111 bp, Homo sapiens
  DISO7_10004906
  Located on chromosome 11
  Distance between a terminus base of telomere on chromosomal short arm and 5'-terminus of this base sequence : 118703885
  Distance between 3'-terminus of neighbour sequence of sequence listing upward to telomere on chrosomal short arm and 5'-terminus of this base sequence : 10923
tgagctggtttcatgatcacaaaaatatcgtgtgtgtgtgtgtgtgtgtgtgtatgtgtgtacgcacacatcctcacatatttgtgtgtaccattctactttcagaagacg

SEQ ID NO: 17997 - DNA, 215 bp, Homo sapiens
  D11S938
  Located on chromosome 11
  Distance between a terminus base of telomere on chromosomal short arm and 5'-terminus of this base sequence : 119127417
  Distance between 3'-terminus of neighbour sequence of sequence listing upward to telomere on chrosomal short arm and 5'-terminus of this base sequence : 423421
cctggggttatgcagtgataatatgcaaagatgtgtgtgtgtgtgtgtgtgtgtgtgtgtgtggtgtgtgtgtgttcctacatgcacagatacaagcaaatactatacctaagtatgtgcatagttcagtgatatattctttttttctttcagtacatgtaatcagattcccagaggtcacgttcctgatctatcacccaagaactgtgtgtctt

SEQ ID NO: 17998 - DNA, 449 bp, Homo sapiens
  AF060568.1_59340
  Located on chromosome 11
  Distance between a terminus base of telomere on chromosomal short arm and 5'-terminus of this base sequence : 119204294
  Distance between 3'-terminus of neighbour sequence of sequence listing upward to telomere on chrosomal short arm and 5'-terminus of this base sequence : 76662
aatattaacaccaattgagcaaattgccttttaactgcctttatttgctttcattaacagtataatttaaaagctcaagaatttgcatggaacctgttgtgcatgttggggggaaaactattcataaattaattaatcgtgagaacattatctttaaggaaggtcacaaaacatgagcatgatttccaaaaagcagtgacatgtttttgccgtttcttggggacgtgatgtacttttggcttagagatctgtgctgcgtgtgtgtgtgtgtgtgtgtgtgtgtgtgtgtgtgcacgcgcgagataacttggctggatcaagaaaaattttaatgactgggcatgttttaagttaagttgagtgaacctaattacactgtagtttccagagagctaaaggcaataataccattggtatttaagcactagtttgaaaattaaagccaacct

SEQ ID NO: 17999 - DNA, 402 bp, Homo sapiens
  AF060568.1_97085
  Located on chromosome 11
  Distance between a terminus base of telomere on chromosomal short arm and 5'-terminus of this base sequence : 119242187
  Distance between 3'-terminus of neighbour sequence of sequence listing upward to telomere on chrosomal short arm and 5'-terminus of this base sequence : 37444
agtgttaggattataggcgtgagccaccgcgcccgcctgcctggctttctttctaagaaccccatagagagcttctcttttggacagtaggggcaactgttttttactggtgtgtgtgtgtgtgtgtgtgtgtgtgtgtgtgtgtatccgcatatgtgtgtagacaaggtgagtttttttccacctctacatttttctcttccgattctctttcttgtttgtttgctcattcagtcaacaaaaatgagcccctgccatgttctgaggtcagtgatgaagactgagaggatgaatctggtatggacccttatgcaggagatataatccagccagcacagacccatgtcagccccacagcctttcagttttgtaaacctggttggaaagaacctaagaaatcat

SEQ ID NO: 18000 - DNA, 375 bp, Homo sapiens
  AF060568.1_114422
  Located on chromosome 11
  Distance between a terminus base of telomere on chromosomal short arm and 5'-terminus of this base sequence : 119259397
  Distance between 3'-terminus of neighbour sequence of sequence listing upward to telomere on chrosomal short arm and 5'-terminus of this base sequence : 16808
tcagtgaggttgcttggtagggatggaccctgagttccagctcacccagagcaaccaggtaggcagccactcttggtagcatcctggcctccacactaaccctcggtgactgtcagtgaaatggcatggcattcactcctctcccaggtgttcaactgcctaggtctgtggctgtggctctcctgcgttcttggggcatagaactgcaagtatcgtggggcagaggactggtctacgtgtgtgtgtgtgtgtgtgtgtgtgtgtgtgtgtgtgtgtgtgtgtaaccatgagggagagggggcctggaggtgatggaaggtgtttgcagacatctgggcatctgttctgtggagcttgcagactcatccattaaat

SEQ ID NO: 18001 - DNA, 214 bp, Homo sapiens
  AF060568.1_127496
  Located on chromosome 11
  Distance between a terminus base of telomere on chromosomal short arm and 5'-terminus of this base sequence : 119272631
  Distance between 3'-terminus of neighbour sequence of sequence listing upward to telomere on chrosomal short arm and 5'-terminus of this base sequence : 12859
tgtatcttccagaaactctggttctggatcagctttttgttttgttgacaaaggagaaagagcaagagagagagctagagagagagagagagagagagagagccttcaagctcctctctgggagtacacatctccttgagggaaagaacacacagtgccggcctttggaattggcagccagtgtgctgttctccgtctgataagaggtactgta

SEQ ID NO: 18002 - DNA, 269 bp, Homo sapiens
  D11S1792
  Located on chromosome 11
  Distance between a terminus base of telomere on chromosomal short arm and 5'-terminus of this base sequence : 119300844
  Distance between 3'-terminus of neighbour sequence of sequence listing upward to telomere on chrosomal short arm and 5'-terminus of this base sequence : 27999
cagaaggttcctcacaatcagagtcacaggcctcatcttttgtcaccccctatgatgcgtgtacactgagccacttagaatttcccagactctcctggctgtttttctcctccatgcatcttccactaacccccacactctcatgtgtcttgtttgcctgatacacacacacaagacacacacacacacacacacacacacacacacacatattgaggcagagtttcactttgtcacccaggctgtagtgcagtggcaagatctcagct

SEQ ID NO: 18003 - DNA, 377 bp, Homo sapiens
  AF060568.1_158378
  Located on chromosome 11
  Distance between a terminus base of telomere on chromosomal short arm and 5'-terminus of this base sequence : 119303322
  Distance between 3'-terminus of neighbour sequence of sequence listing upward to telomere on chrosomal short arm and 5'-terminus of this base sequence : 2209
tctgtatgtctgctacagtctcaggaatgcagccacaggaacaaagaaatttctagccctggtgctgctacttattaggagcaagacttcagacaagttgcttttcctttcagaagcttggtttcctcattggtagaagagggtcaaaaagtcacttgcccggtgagcctgctgagaagagcagatgaaggaggtgtactctgcactctgtgaaacattgcaaatgtgcgggttgatcattaatgttttctcttacagccaaagctagtgtgtgtgtgtgtgtgtgtgtgtgtgtgtgcgcgcgcgcgcgtgcacagtttgtgagtgtcgggttcccaagcatttactctcctctctcctttctaggacatttcagg

SEQ ID NO: 18004 - DNA, 250 bp, Homo sapiens
  D11S1327
  Located on chromosome 11
  Distance between a terminus base of telomere on chromosomal short arm and 5'-terminus of this base sequence : 119371886
  Distance between 3'-terminus of neighbour sequence of sequence listing upward to telomere on chrosomal short arm and 5'-terminus of this base sequence : 68187
taatgttctgggcacctggtgtgatagaacaggccagtgctccaagcaggcagagagtaccagaggtgactgttggtaggggtgggaggtggacctaatactcatgtgtgtgtgtgtgtgtgtgtgtgtgtattatgtgtgcatatgtgagtgtgtgcacatgtatgtgtggtgattcaggtagtggagagtggctagatctgtcagtggtgtcaccacatgggtgatgaatgaggttgtatcccaggtg

SEQ ID NO: 18005 - DNA, 256 bp, Homo sapiens
  AP001149.3_99165
  Located on chromosome 11
  Distance between a terminus base of telomere on chromosomal short arm and 5'-terminus of this base sequence : 119455754
  Distance between 3'-terminus of neighbour sequence of sequence listing upward to telomere on chrosomal short arm and 5'-terminus of this base sequence : 83618
acaagtgaccaacattaatgttaaaatagaagtcataagactgacaaaacaggctttttgtggtaatagaataccaaattacaaaaaaacctaagtctatgcaaggccagggttaagtcacacaccataaaatcccgttaatgtgtctctgtgtgtgtgtgtgtgtgtgtgtgtgtgtgtgtctgttttaagtaacctggtataatgtggcttaccttccaaccagactctagtgtagcatcacatgacagatagc

SEQ ID NO: 18006 - DNA, 216 bp, Homo sapiens
  DISO7_10003163
  Located on chromosome 11
  Distance between a terminus base of telomere on chromosomal short arm and 5'-terminus of this base sequence : 119756901
  Distance between 3'-terminus of neighbour sequence of sequence listing upward to telomere on chrosomal short arm and 5'-terminus of this base sequence : 300891
ctgtaaggtcaccaggccccttcaccatctcctgtctatctctatctatcatctctatctatcatctatctatctatctatctatctatctatctatctatctatctatctatcatctatccatctatcatctatttatctatcatctatctatttatctatctatctatctatctatctatctatctatctgatctacctacctatctattggcg

SEQ ID NO: 18007 - DNA, 179 bp, Homo sapiens
  DISO7_10003165
  Located on chromosome 11
  Distance between a terminus base of telomere on chromosomal short arm and 5'-terminus of this base sequence : 119796965
  Distance between 3'-terminus of neighbour sequence of sequence listing upward to telomere on chrosomal short arm and 5'-terminus of this base sequence : 39848
caggtggaaatgtggagagggtagtttgtggtagagagccatttagaaggtaaaattaaaataagcatagatagatagatagatagatagatagatagatagatagatagatgatagatagatagatagacagacagacagatagatagatagatgttagatagatttgatggattgcg

SEQ ID NO: 18008 - DNA, 218 bp, Homo sapiens
  DISO7_10003167
  Located on chromosome 11
  Distance between a terminus base of telomere on chromosomal short arm and 5'-terminus of this base sequence : 119821006
  Distance between 3'-terminus of neighbour sequence of sequence listing upward to telomere on chrosomal short arm and 5'-terminus of this base sequence : 23862
atccttcctctccttactcaagttttgcttttagatatacttattagctgttttgatatttctatttcagaaattatttactggcttactatttaggaagataaataattatttctcttaccctgtcccccacccatgtgtacacaacacacacacacacacacacacacacacacacacacacacacatatctttccccttctcttccatttggaag

SEQ ID NO: 18009 - DNA, 119 bp, Homo sapiens
  DISO7_11845126
  Located on chromosome 11
  Distance between a terminus base of telomere on chromosomal short arm and 5'-terminus of this base sequence : 119930972
  Distance between 3'-terminus of neighbour sequence of sequence listing upward to telomere on chrosomal short arm and 5'-terminus of this base sequence : 109748
ttgggatacaggaatatgacagagatttttcagcacatatgtattttcatatatatcatatatatatatatatgcttgaattaaacaaatattaggtctcatcctatcttcttaatctc

SEQ ID NO: 18010 - DNA, 375 bp, Homo sapiens
  AC001235.1_95773
  Located on chromosome 11
  Distance between a terminus base of telomere on chromosomal short arm and 5'-terminus of this base sequence : 120211567
  Distance between 3'-terminus of neighbour sequence of sequence listing upward to telomere on chrosomal short arm and 5'-terminus of this base sequence : 280476
acctcagaaacactttcaaatagatggccaattattattcactcatttactgtttattgtagcaatgccagtcacaatgaactccaggggtgcattaatggagatgtgatctgggcctggggcccttggggaatgacatagtaatgcttcattcattagcatagtgcgttcaaggtgggtgggcacactgtttctccctttggtgccttgccacccagtacagccacagagaaaagtgtacacacacacacacacacacacacacacacacacacacacacatatatacacggtgcccccagtatacacccaggtccccagacaggcagaaggacggaaatctttgctcagccctggcaggagttttaatatttc

SEQ ID NO: 18011 - DNA, 269 bp, Homo sapiens
  D11S1885
  Located on chromosome 11
  Distance between a terminus base of telomere on chromosomal short arm and 5'-terminus of this base sequence : 120211647
  Distance between 3'-terminus of neighbour sequence of sequence listing upward to telomere on chrosomal short arm and 5'-terminus of this base sequence : -295
actccaggggtgcattaatggagatgtgatctgggcctggggcccttggggaatgacatagtaatgcttcattcattagcatagtgcgttcaaggtgggtgggcacactgtttctccctttggtgccttgccacccagtacagccacagagaaaagtgtacacacacacacacacacacacacacacacacacacacacacatatatacacggtgcccccagtatacacccaggtccccagacaggcagaaggacggaaatctttgctc

SEQ ID NO: 18012 - DNA, 390 bp, Homo sapiens
  AP002435.1_99080
  Located on chromosome 11
  Distance between a terminus base of telomere on chromosomal short arm and 5'-terminus of this base sequence : 120387607
  Distance between 3'-terminus of neighbour sequence of sequence listing upward to telomere on chrosomal short arm and 5'-terminus of this base sequence : 175691
agagaaagcatctatgatagcacggggctagagcaaacttttaataaatataacttcttctgtctcttctaactcaaatacctcgtgcagcaatttatagtcctgtgggacttgcaggctgaaatatatgtgtctgtcagtcagccacatgtactgagtgccaattttttttttgcagaatcatgcaccagccatgtggtagaggaagaaaaagaaataggagacagaatgttgcccttggagcttacaatgcagttggagtgagaatatacacatacacacacacatacacacacacacacacacacacacacacacacacacacacactttcagaaccattacaaagcactatccaatcaagtataatatgccacaaactgtattagg

SEQ ID NO: 18013 - DNA, 376 bp, Homo sapiens
  chr11.fa.O7frz.129487982
  Located on chromosome 11
  Distance between a terminus base of telomere on chromosomal short arm and 5'-terminus of this base sequence : 120584749
  Distance between 3'-terminus of neighbour sequence of sequence listing upward to telomere on chrosomal short arm and 5'-terminus of this base sequence : 196752
tacgtctggctttaacagatagtgtttatccaaatggaaacaaaacattaaaaaatgcaaaactataaaactgtagcagggaagagttacagtacagaactttagaatgtgagaggaaaaaccactgagcaattgctactgcagacagagatagccttacaattcctgtgcagatagaataagtgccagactagctggcctaggaatgaaaaaacctaaacaaacaaacaaacaaactgcaaaacaattaaagctctagaacggaaaggtacttacttgaggtaagtaaggtgcaattctgcctctttttctgcttcttctagtttcagtaccagtaactctttccggctctctagtgataagatctaaggaagcc

SEQ ID NO: 18014 - DNA, 108 bp, Homo sapiens
  DISD22_0006552
  Located on chromosome 11
  Distance between a terminus base of telomere on chromosomal short arm and 5'-terminus of this base sequence : 120730706
  Distance between 3'-terminus of neighbour sequence of sequence listing upward to telomere on chrosomal short arm and 5'-terminus of this base sequence : 145581
ttgatgttattccaaaggagacacttaaaaaatagtttgtgtgtgtgtgtgtgtgtgtgtgtgtgtgtgtgtgtgtgtgttctctctgctcttctctgtccttctgag

SEQ ID NO: 18015 - DNA, 101 bp, Homo sapiens
  DISD22_0006557
  Located on chromosome 11
  Distance between a terminus base of telomere on chromosomal short arm and 5'-terminus of this base sequence : 120867308
  Distance between 3'-terminus of neighbour sequence of sequence listing upward to telomere on chrosomal short arm and 5'-terminus of this base sequence : 136494
agttcctaatgcgcaagggagacaaacacacacacacacacacacacacacacacacacacacacacacacacagagacaacaaacgcatacttgtaagtc

SEQ ID NO: 18016 - DNA, 461 bp, Homo sapiens
  chr11.fa.O7frz.131255781
  Located on chromosome 11
  Distance between a terminus base of telomere on chromosomal short arm and 5'-terminus of this base sequence : 120990828
  Distance between 3'-terminus of neighbour sequence of sequence listing upward to telomere on chrosomal short arm and 5'-terminus of this base sequence : 123419
ctagtacaattctgtcttggagatgtaaaccaaaagtcagagtgaggtcatccactgatggtggggactggagctgaaaggtcctgtggggtgtgggccagcacaccctgaagttccacatgcaggaggggcagcaggggaagcagacgggaaggtgcagcgcaggctcatgaagcggatctgaggccctggagagaggccaaggggagccactctgattcttgactaccagctcccatctctgggatgcctgtccagaccctcttctctgaccccggatgtctgcaaggtggcctgccacatccttacaacccactaccccagcacacaaacacacacacacacacacacacacacacacacacacacacacacacacacacacaacttgaatagtcctggtgggtctgttttggggtcaatgagtcccaggtagaattctgctagtattaagccaacag

SEQ ID NO: 18017 - DNA, 152 bp, Homo sapiens
  DISO7_10003175
  Located on chromosome 11
  Distance between a terminus base of telomere on chromosomal short arm and 5'-terminus of this base sequence : 121063940
  Distance between 3'-terminus of neighbour sequence of sequence listing upward to telomere on chrosomal short arm and 5'-terminus of this base sequence : 72651
aatgtagaccacatacgaaacctaaaacttgaaaagtaatttactcagtgagggttttaagtccatcacatttctattctaaaacaaaagcttgcagagaattaaaacacacacacacacacacacacacacccgttatcagtttctgcagt

SEQ ID NO: 18018 - DNA, 400 bp, Homo sapiens
  AP001582.3_115137
  Located on chromosome 11
  Distance between a terminus base of telomere on chromosomal short arm and 5'-terminus of this base sequence : 121304944
  Distance between 3'-terminus of neighbour sequence of sequence listing upward to telomere on chrosomal short arm and 5'-terminus of this base sequence : 240852
taagtcatgagaggatttgtctatagttttcttttcttgtaatgtctttgtttttggtatcagtatattagggttctccagagagagagaaccaatgtgatatatatatgtgtgtgtgtgtgtgtgtgtgtgtgtgtgtgtatgtgtgtgtgtgtgtttgtgtgcgtgtatcccactttgctattgtgaatagtaatctttattatttctttgtctactttaattttatatatatatatatatatatacacacacacacacacatatatatatatatatatctcccattggttcagtttgtctgtttctctgaatccatgggttctgcatttgtggatttaaccaactgaagatcaaaaatatttggaaaaaaaaaaggatgactgcacttgtactgaac

SEQ ID NO: 18019 - DNA, 334 bp, Homo sapiens
  AC068591.2_86017
  Located on chromosome 11
  Distance between a terminus base of telomere on chromosomal short arm and 5'-terminus of this base sequence : 121314686
  Distance between 3'-terminus of neighbour sequence of sequence listing upward to telomere on chrosomal short arm and 5'-terminus of this base sequence : 9342
gtgaatgccattaattcataattcattcctttttaaggctgagtagtattccatcatatgtatacacacacacacacacacacacacacacacacacccccgtatatatatacatatatacacacccctcccacattttctttatccacttgttagttgatgggcatttgggttgcctccacatttttgcaattgcaaattgtgtggctataaacatgtgtgtgcaagtatctttttcatataatgacttcttttcttctgggtagatacccagtagagggattgctggatcaaatggcagttctacttttagttctataaggaatctccatgc

SEQ ID NO: 18020 - DNA, 319 bp, Homo sapiens
  chr11.fa.O7frz.130781752
  Located on chromosome 11
  Distance between a terminus base of telomere on chromosomal short arm and 5'-terminus of this base sequence : 121388164
  Distance between 3'-terminus of neighbour sequence of sequence listing upward to telomere on chrosomal short arm and 5'-terminus of this base sequence : 73144
agatgtcctaaatcttagcagttaaggctggaaagtttttaactggtgactaatattcatgttgccagcacacccccgatccctcccagctgcctgtgtcatcataagtctccagtttttaagctaaattactttgcagtatgatatttaggctggcctactgtcactcctaataaacccagtcctctctctctctctttcacacacacacacacacacacacacacacacacacacacacgagaaatattcaaatattgtcttattgagaaaaaaaatctggaaatggtgttttcttaaatctaatgtcattttgctt

SEQ ID NO: 18021 - DNA, 175 bp, Homo sapiens
  D11S1341
  Located on chromosome 11
  Distance between a terminus base of telomere on chromosomal short arm and 5'-terminus of this base sequence : 121388317
  Distance between 3'-terminus of neighbour sequence of sequence listing upward to telomere on chrosomal short arm and 5'-terminus of this base sequence : -166
tggcctactgtcactcctaataaacccagtcctctctctctctctttcacacacacacacacacacacacacacacacacacacacacgagaaatattcaaatattgtcttattgagaaaaaaaatctggaaatggtgttttcttaaatctaatgtcattttgctttgaagagca

SEQ ID NO: 18022 - DNA, 287 bp, Homo sapiens
  D11S4195
  Located on chromosome 11
  Distance between a terminus base of telomere on chromosomal short arm and 5'-terminus of this base sequence : 121513335
  Distance between 3'-terminus of neighbour sequence of sequence listing upward to telomere on chrosomal short arm and 5'-terminus of this base sequence : 124843
gctgctaaatgtcacactgagacattccatgaatgtacatatgtgtgtgtgtgtgtgtgtgtgtgtgtgtgtgtgtgtgtgtgtgtgtctgcatatgtatataatatatatttttttcattatcattctagttaggtacatttttgtttatgatttctcctttgacctatgaataatttagaagtttttttttaaagcatgtatgtattttatattttaaaaattattgtttgcgggctgggtgtggtggctcactcgaactggagttggagaacagcctgggccac

SEQ ID NO: 18023 - DNA, 195 bp, Homo sapiens
  D11S1356
  Located on chromosome 11
  Distance between a terminus base of telomere on chromosomal short arm and 5'-terminus of this base sequence : 121594056
  Distance between 3'-terminus of neighbour sequence of sequence listing upward to telomere on chrosomal short arm and 5'-terminus of this base sequence : 80434
acctgccctgacttgccttaatcatagggagaaccgcaacttggtgacagcctttctctctctctagtgtgtgtgtgtgtgtgtgtgtgtgtgtgtgcatgtgtgtataccataactagaattatgtgatatctattcttctgcaacttgaactgatctttaaaacgtggaattgatgagcaacagatgagcaac

SEQ ID NO: 18024 - DNA, 378 bp, Homo sapiens
  U73649.1_16072
  Located on chromosome 11
  Distance between a terminus base of telomere on chromosomal short arm and 5'-terminus of this base sequence : 121693048
  Distance between 3'-terminus of neighbour sequence of sequence listing upward to telomere on chrosomal short arm and 5'-terminus of this base sequence : 98797
cattaggatgttcagtgaagatctgatcatgatgatgatgatgatgatgatgatgatgatgatgatgatgaatccgtgggccatctgcaaggaggtagtaggaatgtgacagaggccctgcctggcaagggctgaatatcacagatattactaaagatgtcaaaggtcactgaggcagggaggtgcatgacactgaacatgagagtagccagcagctttttggaagcagccatgtctcaggcagctggcacagagaggcctcccagcaaagccatcaccaccctcatttttattcttgtgcctctatattgcagatgaacatggattacatttattgtaacactatgggtcccactagacaaagacttcacactcatc

SEQ ID NO: 18025 - DNA, 457 bp, Homo sapiens
  U73649.1_9346
  Located on chromosome 11
  Distance between a terminus base of telomere on chromosomal short arm and 5'-terminus of this base sequence : 121699536
  Distance between 3'-terminus of neighbour sequence of sequence listing upward to telomere on chrosomal short arm and 5'-terminus of this base sequence : 6110
agaaaattggaagcttgtctacacaaagcatcgtccagtaaccctctccaagaatctctgtgtggatagaccttattgaaagcttcatgaattctctggaggacagaataacaaaaacatttccacatctgaaggtgatgttgagttgggagattggatagagagcacagagcaacattaaaagcagtttcagaagtcagacggatttgggatgctaaccccatttccagcacttgtcagctatgtggtcttgggcaaattacttaccccatgttttttcttttttctttctttctttctttctttcttttttttttttttttttgaggtgaagtctcactttgtcacccaggctggagtgcagtgggcaccatcttggctcactacaaccttcacctcctgggttcaagtgattctcatgcctcaacctcccgagtagtggaattacaggcgtatg

SEQ ID NO: 18026 - DNA, 157 bp, Homo sapiens
  D11S1998
  Located on chromosome 11
  Distance between a terminus base of telomere on chromosomal short arm and 5'-terminus of this base sequence : 121812282
  Distance between 3'-terminus of neighbour sequence of sequence listing upward to telomere on chrosomal short arm and 5'-terminus of this base sequence : 112289
agccatcaactagctttccctattgcttcctattcatctatctattgatcgatctatcatccatatctatctatctatctatctatctatctatctatctatctatctatctatctctctatttatctatctatccatccatctgttggtgcctccc

SEQ ID NO: 18027 - DNA, 95 bp, Homo sapiens
  D11S4127
  Located on chromosome 11
  Distance between a terminus base of telomere on chromosomal short arm and 5'-terminus of this base sequence : 121865894
  Distance between 3'-terminus of neighbour sequence of sequence listing upward to telomere on chrosomal short arm and 5'-terminus of this base sequence : 53455
actatgcccagtgtgtgtgctgtgctgtgtgtgtgtgtgtgtgtgtgtgtgtgtgtgtgcattttgaggtgaggaggctggatggcacttctcat

SEQ ID NO: 18028 - DNA, 390 bp, Homo sapiens
  AP001147.2_91816
  Located on chromosome 11
  Distance between a terminus base of telomere on chromosomal short arm and 5'-terminus of this base sequence : 121990172
  Distance between 3'-terminus of neighbour sequence of sequence listing upward to telomere on chrosomal short arm and 5'-terminus of this base sequence : 124183
gaggtcaggagttcgagaccagcctggccaatgtggtgaaacctcgtctctactaaaaatacaaaaattagcctggtgtgggggtgcacgcctgtaatcctagctgctggggtggctgaggcaggaggcttgctttaaccctgggaggcggaggttgcagtgagccgagatcatgccattgcactcaagcctgggtgacaagagcgaaattctgtctaaaaatacacacacacacacacacacacacacacacacacacacacacacacatatatatggagagagagagagcgagagggagagagagataagtaaagcattcagaacaatcctggccagagtagatgcttaagatttagttgttatttgctgttctacattaggcctgag

SEQ ID NO: 18029 - DNA, 203 bp, Homo sapiens
  D11S4092
  Located on chromosome 11
  Distance between a terminus base of telomere on chromosomal short arm and 5'-terminus of this base sequence : 121990298
  Distance between 3'-terminus of neighbour sequence of sequence listing upward to telomere on chrosomal short arm and 5'-terminus of this base sequence : -264
ggcttgctttaaccctgggaggcggaggttgcagtgagccgagatcatgccattgcactcaagcctgggtgacaagagcgaaattctgtctaaaaatacacacacacacacacacacacacacacacacacacacacacacacatatatatggagagagagagagcgagagggagagagagataagtaaagcattcagaacaa

SEQ ID NO: 18030 - DNA, 317 bp, Homo sapiens
  chr11.fa.O7frz.127289946
  Located on chromosome 11
  Distance between a terminus base of telomere on chromosomal short arm and 5'-terminus of this base sequence : 122008505
  Distance between 3'-terminus of neighbour sequence of sequence listing upward to telomere on chrosomal short arm and 5'-terminus of this base sequence : 18004
tgctcaaatgtctcttgaataggactgaatgcaatggacaagtgaagaaaagctttaagggatcgggtcctagacttgctcctgaaaaatggtaaaattattgaggctgaaagtggcgttccaggcaggggggcctgtgagaaccagggtgaagatctacaagcccagacactctctctctctctctctctctctctctgtgtgtgtgtgtgtgtgtgtgtgtgtgtgtgtgtgtgtgtatggtgaggaggcagagaaagcagacgtgggcagacaagagaagcacttgtagtttgaagactttctgctcctagaaa

SEQ ID NO: 18031 - DNA, 469 bp, Homo sapiens
  chr11.fa.O7frz.127394073
  Located on chromosome 11
  Distance between a terminus base of telomere on chromosomal short arm and 5'-terminus of this base sequence : 122112757
  Distance between 3'-terminus of neighbour sequence of sequence listing upward to telomere on chrosomal short arm and 5'-terminus of this base sequence : 103935
gtctataagtcaatacgactgacagacaggcagacagacagatagatggatagacagactgacagacaatgagagtgggtgggtggatgggtggatgggtggatgaatggatagaaaaattctttataggagaatgctaactactgactggtaaaggttgatgaagtgttatagttggaaaatcaccatagaaaagactggttcaagcaaggatcatcaatagatgttaaatctaaggggtgagttttgaagaggaacaagatatttgcatgctcttaaagtgccttcccacggattgcttattagttgtaagggttaatatagtaactatacagtagaaaaatcaggcaatgccctgatcagataaccaaaattactatcaccaacaaagggtagaaggacattgggtacctctggatgtaatagtgtaatctccagaataatagtgaaggacatgttacttcagtat

SEQ ID NO: 18032 - DNA, 377 bp, Homo sapiens
  chr11.fa.O7frz.127464323
  Located on chromosome 11
  Distance between a terminus base of telomere on chromosomal short arm and 5'-terminus of this base sequence : 122182828
  Distance between 3'-terminus of neighbour sequence of sequence listing upward to telomere on chrosomal short arm and 5'-terminus of this base sequence : 69602
atgctttaccaatatgttctacagcaagcagcaaaagtgaaaagcaactgagatcatcacatcccagctttgttaggtgtgtgatcttcaaacaagaaaatgtaatctatccaatgctcagtttcctcatcagtaaaatgaggataatagtagacactagaataggggtgagaattagataagacaataaatgtaaaatgtttacttagcagggtgcttggcaggcagtaggtattcctaaatgttagctgtaattattattattattattattattattattattattattacattataccctgcccctagtccatgcaagcattttatcttgcaagctagacaaaagtccctggaatccactggaaagtcctata

SEQ ID NO: 18033 - DNA, 158 bp, Homo sapiens
  Z67490
  Located on chromosome 11
  Distance between a terminus base of telomere on chromosomal short arm and 5'-terminus of this base sequence : 122217471
  Distance between 3'-terminus of neighbour sequence of sequence listing upward to telomere on chrosomal short arm and 5'-terminus of this base sequence : 34266
agctgaaaattcacatataacttttttttgagacaaaggatattttatacacacacacacacacacacacacacacacccttgtttgctcacggaaaagtttagaaacaatgacaagtcagtagcaatgagcacaattcttagatgtgtccgctgtct

SEQ ID NO: 18034 - DNA, 236 bp, Homo sapiens
  chr11.fa.O7frz.127625430
  Located on chromosome 11
  Distance between a terminus base of telomere on chromosomal short arm and 5'-terminus of this base sequence : 122331723
  Distance between 3'-terminus of neighbour sequence of sequence listing upward to telomere on chrosomal short arm and 5'-terminus of this base sequence : 114094
ccactagcctgaaggtttcaaacaaattacaaatgatgagaggtgggagtcaaagaacgcggatgttgcttggtcctatttctttccccagaccccctcatgaccatcccccaattttgtgtgtgtgtgtgtgtgtgtgtgtgtgtgtgtgtgttcagagggcagagtgcaaattcaggaactcgagaaactttgcaacctagaaaatattccttaaacagtttcatcagaagttg

SEQ ID NO: 18035 - DNA, 235 bp, Homo sapiens
  chr11.fa.O7frz.127721639
  Located on chromosome 11
  Distance between a terminus base of telomere on chromosomal short arm and 5'-terminus of this base sequence : 122427983
  Distance between 3'-terminus of neighbour sequence of sequence listing upward to telomere on chrosomal short arm and 5'-terminus of this base sequence : 96024
tataaagttccaaagaatgacaactgaggaccttgcccactttccccagaaatgtcagaatgtgttgtgtgtgtgtgtgtgtctgtgtgtgtgtgtgtgtgtctgtgtgtgtgtgtgtatctgagatggcagaggtgggaaatgacagctggggtaaggggccatggagaaaatctcatatagacaggccacacttggctcctaggaagttttctaggttgcatacttattcagt

SEQ ID NO: 18036 - DNA, 324 bp, Homo sapiens
  chr11.fa.O7frz.127808120
  Located on chromosome 11
  Distance between a terminus base of telomere on chromosomal short arm and 5'-terminus of this base sequence : 122514373
  Distance between 3'-terminus of neighbour sequence of sequence listing upward to telomere on chrosomal short arm and 5'-terminus of this base sequence : 86155
gtcttgtatttggagtcagtaaagtgattggaacttgctttgagtttcctcaggtatgaaacaggggaaattataatacatacctcacagggttgatagaaggatcaaatgtgataatgtacatggaaacatgtataatagaaagcactttacaaattgtgtgtgtgtgtgtgtgtgtgtgtgtgtgtgttcctgtgagtttggtcaagttggggttagactcatggagtggatccaagagaataaaacaaatgatctgatgaacccacttgactagaaattggaaagggcatttcagaggtactttcagaggcaattaacata

SEQ ID NO: 18037 - DNA, 305 bp, Homo sapiens
  chr11.fa.O7frz.127974742
  Located on chromosome 11
  Distance between a terminus base of telomere on chromosomal short arm and 5'-terminus of this base sequence : 122615354
  Distance between 3'-terminus of neighbour sequence of sequence listing upward to telomere on chrosomal short arm and 5'-terminus of this base sequence : 100657
tgttcttaacacctgagaacacttaccttctaaagttctgtggcacccagattagcatttcgcacatggtagaacttcaacgagtgctttttagatggatgggtggatggatggatggatggataaatggatagatggataaatggatggatggatacatggatggatgggtgaatggatggatggatggataggtggataagtgggtggatgaatagatggacggatggacagatgaacaaagagatggatgaatgggaagaaggaaagaaagatgaaatgataaatagacaagcagtgacttg

SEQ ID NO: 18038 - DNA, 427 bp, Homo sapiens
  AP000797.4_53619
  Located on chromosome 11
  Distance between a terminus base of telomere on chromosomal short arm and 5'-terminus of this base sequence : 122641393
  Distance between 3'-terminus of neighbour sequence of sequence listing upward to telomere on chrosomal short arm and 5'-terminus of this base sequence : 25734
tactagatgaggcaatgaagagttccgggcatgaatgcccagacccagtaccaggaactctggactcctagccagcaatctctagactagcccagcagcatttctgctcatctgacctgtgactaatggccagcagtgagtggctatgtgcagttctggaccagagggtaatctgtggcaaaagcttcaaagacaaaaaatacatggcagcatgtggggaagatgcccatcaatttctagccccatagtactctggttctattgatgaactgatctttgctgcacaagagtctcacggatgctctgactctctcatttctctctctctctctctctctctctctctgtcactctctctgtctctcccatcctcccttcctttctgttttcgttttatcctcagatatttactgaatacatgccatgt

SEQ ID NO: 18039 - DNA, 207 bp, Homo sapiens
  D11S4111
  Located on chromosome 11
  Distance between a terminus base of telomere on chromosomal short arm and 5'-terminus of this base sequence : 122700327
  Distance between 3'-terminus of neighbour sequence of sequence listing upward to telomere on chrosomal short arm and 5'-terminus of this base sequence : 58507
tgtgcaggcagaacaaagcgacatagggagagaggacgggggaatttcctcctgctgctgtttcgccacacggcggccataccgtgtgtgtgtgtgtgtgtgtgtgtgtgtgtgtgtgtgtgcgcgcgcgcgcgcgcgcatgaactggatatgtctgtgtgcagtgcacgtatgtgtcggggggggcatgacctggagatgcccgtg

SEQ ID NO: 18040 - DNA, 188 bp, Homo sapiens
  AB017651.1_100584
  Located on chromosome 11
  Distance between a terminus base of telomere on chromosomal short arm and 5'-terminus of this base sequence : 122743736
  Distance between 3'-terminus of neighbour sequence of sequence listing upward to telomere on chrosomal short arm and 5'-terminus of this base sequence : 43202
acttagacatctccataaggcttctcacaatatgacagctagcttccccaaaaatgaatggggtgtgtgtgtgtgtgtgtgtgtgtgtgtgtgtgtgtgtgtgtgtgtgttagagagagagagttagagagagagagagagaaggagaaaatgtaaaagggtgtcttctgaccaatagaacatggtag

SEQ ID NO: 18041 - DNA, 333 bp, Homo sapiens
  AB017651.1_116272
  Located on chromosome 11
  Distance between a terminus base of telomere on chromosomal short arm and 5'-terminus of this base sequence : 122759298
  Distance between 3'-terminus of neighbour sequence of sequence listing upward to telomere on chrosomal short arm and 5'-terminus of this base sequence : 15374
tggaaatagttgagccaatacttaaagggcagtaagggaccggccatatcaagaactaaggaaagggtattccagggagagagaactgcaagctcaaagctgctgaggcagggacaagactggaaactctaagatgtgtgcacgtgctggcacacataggcgcgcgcgcatgcgcgcgcgcgcgcgcgcacacacacacacacacacacacacacacacacacacacacacactggcctaacgcagggagtgagagggcattaaggaggagaattaagacagaagattgcaaggccagatcacacaggcttagtaactatggtaatgcactgg

SEQ ID NO: 18042 - DNA, 479 bp, Homo sapiens
  AC009764.3_84405
  Located on chromosome 11
  Distance between a terminus base of telomere on chromosomal short arm and 5'-terminus of this base sequence : 122851783
  Distance between 3'-terminus of neighbour sequence of sequence listing upward to telomere on chrosomal short arm and 5'-terminus of this base sequence : 92152
gaagttatgtctgcgtctgtatatattaacacatgggtatatgtctttgtacacacaaaccagcatcaatgtctgtttgtgaatttgtacgtgtgcatgcgtatgtgcatgcatgtaaatgtgtggcatgcactgtgtgtgtgtgtgtgtgtgtgagagagagagagagagagagagagagagagagagcatggcttccagtacagtgctgtctgggctctgccttgcagctctatgccttatttttgcggttcagccagagcccaatcattaccatcagctggagacatcatttggtgtcatttggctctgcagagctcctgtgccagtgaggaaacccaggagggtagagttgtcttaaaaaagaacaaaagtgagagagaaacaaaaaacagagggagcagagggaggagagggatggcaggtttcccaagcagagacaaagaaatgtgtgtgggtgatactgcaggtaaactgag

SEQ ID NO: 18043 - DNA, 130 bp, Homo sapiens
  D11S4145
  Located on chromosome 11
  Distance between a terminus base of telomere on chromosomal short arm and 5'-terminus of this base sequence : 122940926
  Distance between 3'-terminus of neighbour sequence of sequence listing upward to telomere on chrosomal short arm and 5'-terminus of this base sequence : 88664
ccgaagtgcgtgtgtaagtgtgattgtgtgtgtgtgtgtgtgtgtgtggcatgcacacatgcattgagcagtctctgcctagggcctaaagatccttctccacaatgcctttggcactgacatcttgagc

SEQ ID NO: 18044 - DNA, 450 bp, Homo sapiens
  chr11.fa.O7frz.128386557
  Located on chromosome 11
  Distance between a terminus base of telomere on chromosomal short arm and 5'-terminus of this base sequence : 123035292
  Distance between 3'-terminus of neighbour sequence of sequence listing upward to telomere on chrosomal short arm and 5'-terminus of this base sequence : 94236
gtggcaatttgtgtaaagaacataaccccctactggactgcaaatgccttaagggtgaggaggatccacacaggtgttctgtacctgtttgttgaattaatcaaaagcagaattcatcctctgttattatctctggaggcggtggggagcaaaattaaataggaaaagagcagtgaacatgcacaaagctcctgaagctttctcctcgattaaacacagacacatgcatgcatgcatatgcacatgtgtatgtgagtgcatgcgcatgcacacacacgtgcacgcacacacacacacacacacacgtttaaaagggactcttggcttcctgctgcttgcttgaaaatgcaagcttcaagagacaattaaatattgatatctttacatctcagtattttttcaaatccaaacagccccaacaggggccattgctggtacttatttaactcc

SEQ ID NO: 18045 - DNA, 214 bp, Homo sapiens
  AP002346.1_42788
  Located on chromosome 11
  Distance between a terminus base of telomere on chromosomal short arm and 5'-terminus of this base sequence : 123142968
  Distance between 3'-terminus of neighbour sequence of sequence listing upward to telomere on chrosomal short arm and 5'-terminus of this base sequence : 107226
tgtacatctaggatgaggtgagattagaaagctcgatattctagactaagactgaactacactattagaagagagaatgatgtccatggctgtgtgtgtgtgtgtgtgtgtgtgtgtgtgtgtgtttgcataagggcatgcgtgcatgtgtgtgtgtatgtgcctgtgtgcatgggaggagggctggggggtagtatcgcactatctactctgc

SEQ ID NO: 18046 - DNA, 186 bp, Homo sapiens
  D11S4142
  Located on chromosome 11
  Distance between a terminus base of telomere on chromosomal short arm and 5'-terminus of this base sequence : 123143045
  Distance between 3'-terminus of neighbour sequence of sequence listing upward to telomere on chrosomal short arm and 5'-terminus of this base sequence : -137
tgatgtccatggctgtgtgtgtgtgtgtgtgtgtgtgtgtgtgtgtgtttgcataagggcatgcgtgcatgtgtgtgtgtatgtgcctgtgtgcatgggaggagggctggggggtagtatcgcactatctactctgcttctggcagtggtggtggtttgggggaaggggtattaagcagccatctc

SEQ ID NO: 18047 - DNA, 457 bp, Homo sapiens
  chr11.fa.O7frz.128544845
  Located on chromosome 11
  Distance between a terminus base of telomere on chromosomal short arm and 5'-terminus of this base sequence : 123179074
  Distance between 3'-terminus of neighbour sequence of sequence listing upward to telomere on chrosomal short arm and 5'-terminus of this base sequence : 35843
tatccactgtgctagccaggctttggcagagaaagtgacctgggtctgatagaggcaaactgagcagctgcacgtgttttgacttatattctggacccagactacatcctggtgtggaggaaagaatggagagacaaatgaatatcttcctcgctgctgtgtcctcagaacccaacagaaagggtgcacgatatatattattgagggaacggatagatggatggatggatggatggatggatggatggatggatggatggatggttggatggatggatggatggatgaatgaattaattattcaacagacacccacctatgagtatgtgctctcctgtcattggatatattcttcttctctggtcttcagagagagagagagagagaaacagtaaaaagcaacacccagggacttctacctctgcaggaaggcaagaactgcctaaatgaattcact

SEQ ID NO: 18048 - DNA, 404 bp, Homo sapiens
  chr11.fa.O7frz.128665492
  Located on chromosome 11
  Distance between a terminus base of telomere on chromosomal short arm and 5'-terminus of this base sequence : 123291221
  Distance between 3'-terminus of neighbour sequence of sequence listing upward to telomere on chrosomal short arm and 5'-terminus of this base sequence : 111690
ttcctgttgataggataccaggtttgtggggagatgggggattcatgggcctgtatgccagcattccttggattctagagctgaagggggctaagaaaaggcaggacagaggttacaccagcacccatgtggctgctcagggccatatgttctgaacgagaatcttctaagcctgggcagctggcacatgatcaagcatatggcaggatccatgaggcccttcctaaccgtccacctcctcctgccaagtcagttattcctccctgccatccatccccacaacccctgtctttccccaccctaaaaacactgcgcgcacgcgcgcacacacacacacacacacacacacacacacacacacacacacacacacaccaatggcctcatctggacagtctactcaa

SEQ ID NO: 18049 - DNA, 190 bp, Homo sapiens
  D11S1340
  Located on chromosome 11
  Distance between a terminus base of telomere on chromosomal short arm and 5'-terminus of this base sequence : 123440912
  Distance between 3'-terminus of neighbour sequence of sequence listing upward to telomere on chrosomal short arm and 5'-terminus of this base sequence : 149287
ggcctagacgttcttttgtgtacttagagagcattgtgatagtatatagatgttcttaattctgaaattgtccttcctattttgtttgtggttttatatccatacatatacttgtgtgtgtgtgtgtgtgtgtgtgtgtgtgtgtaaggtatatatataaccttaccttattactcaggactcattcagc

SEQ ID NO: 18050 - DNA, 339 bp, Homo sapiens
  AC007707.13_53649
  Located on chromosome 11
  Distance between a terminus base of telomere on chromosomal short arm and 5'-terminus of this base sequence : 123492479
  Distance between 3'-terminus of neighbour sequence of sequence listing upward to telomere on chrosomal short arm and 5'-terminus of this base sequence : 51377
ctacgtgcaggactaaggtaggaggattgcttgcacctggaaggtagaggctacaatggggcatgatcacaccactgtatttcagcctgggcaacagagcaagaccctgtctcaaaaataataataataataataataataataataatagtgctctaatattgacgacgtaggcaaactggcattctcatcacctctagtgggagtgtaaattggtagcaccttttggaaagcaacatgggaatataactaaagcgaaccataccctttgatccactcatttcattttatgggaataaagaaataaactgatttctacaaatgatttatgtacaacga

SEQ ID NO: 18051 - DNA, 223 bp, Homo sapiens
  X78901.1_406
  Located on chromosome 11
  Distance between a terminus base of telomere on chromosomal short arm and 5'-terminus of this base sequence : 123552630
  Distance between 3'-terminus of neighbour sequence of sequence listing upward to telomere on chrosomal short arm and 5'-terminus of this base sequence : 59812
gtgaagacctggattaaggttcccagccttactactaatgggctgtgcacttggagcccttagagccttaggtttctaacctataaaatggacttaacgtctacttcacagggttctatttgcattttaacagaaaacaaagtcttaagtcaaaggaatgaatctctctctctctctctctctctctcttttttagaccaagtctagctctgtcactggagtg

SEQ ID NO: 18052 - DNA, 473 bp, Homo sapiens
  chr11.fa.O7frz.129050575
  Located on chromosome 11
  Distance between a terminus base of telomere on chromosomal short arm and 5'-terminus of this base sequence : 123675965
  Distance between 3'-terminus of neighbour sequence of sequence listing upward to telomere on chrosomal short arm and 5'-terminus of this base sequence : 123112
cttgaggtacattcacatgaagtccaggaccaagaaacggatctctctaatactgcttcctgctgggtgcagtagctcatgcctataatcccaacactttgggaggccaaggcaggaggattgctacagcccaggagttcacaaccagcctgggcaacataatgagacctaatcgctataaaaatttaaaaattagcctggcatggtggtgtatacctacagtcccagctactcaggaagctaaggcaggaggattacttgagcccaggaagctgggggtgcactgagctgtgatcccgttactgcacttcacctggtcaacagagccaagaccctagctcaaaaaagaataaataaataaataaataaataaataaataaataaataaaatctgctttcttaaagagtaaggtagattgatgtgccctgtgtttgggtctttttttattacaaacattaagatgacatgatc

SEQ ID NO: 18053 - DNA, 395 bp, Homo sapiens
  chr11.fa.O7frz.129820187
  Located on chromosome 11
  Distance between a terminus base of telomere on chromosomal short arm and 5'-terminus of this base sequence : 124023527
  Distance between 3'-terminus of neighbour sequence of sequence listing upward to telomere on chrosomal short arm and 5'-terminus of this base sequence : 347089
ttatgacttcactacatcaccacctcctcctttgcatgccatcaagggtgatgtcctcttttccctcatttcttctcctttctcataaactctgccctttttttgccttctccctcttcaactttgatcgatctcctttgccctttctcttttccttcccatctcttctgttttgatccctctgatctccctttttcctttctctttcttcatttcctttttcttctctcccctcctcaacgaatattattctgagcctcgtcccctccttcccctgacccctgctgcaccctgggaaatggagaattcaccagtgagtcacagaattaaacacacacgcacacacacacacacacacacacacaccacacacactaggacgttctgcacttaaa

SEQ ID NO: 18054 - DNA, 183 bp, Homo sapiens
  D11S4104
  Located on chromosome 11
  Distance between a terminus base of telomere on chromosomal short arm and 5'-terminus of this base sequence : 124057415
  Distance between 3'-terminus of neighbour sequence of sequence listing upward to telomere on chrosomal short arm and 5'-terminus of this base sequence : 33493
ggagaatggcctgaacctgggaggcggagattgcagtgagtcaagattgcgcctctgcactccagcctgggcaacagagcaagactccatctccaaaaaaaaaaaaaatatacacacacacacacacattatatatacatttataattttaaaatatactcccaaattgcccatgatagagat

SEQ ID NO: 18055 - DNA, 463 bp, Homo sapiens
  AP000713.2_28149
  Located on chromosome 11
  Distance between a terminus base of telomere on chromosomal short arm and 5'-terminus of this base sequence : 124234848
  Distance between 3'-terminus of neighbour sequence of sequence listing upward to telomere on chrosomal short arm and 5'-terminus of this base sequence : 177250
aaagcacttgagaatttctgtatttaaaaatctccaattctggctgggcacggtggctcacacctgtaatcccagcactttgggaggccaagacaggaagattacttgtgtccaggaattcaagaccagtctggacaacagtggcaaagccctggtctctacgaaaatataaaaatattagccgagcatactggtgcatacactgtggtcccagctactcaggaggctgaggtaggaggatcgcttgagcccaggaggttgatgctacagtgagctgtgactgtgccacagcactcagtctgggcagcagtgagaccttgtcacacacacacacacacacacacacacacacacacacacacacaaacacaaaaaaacccctctgagttcaagttccccatgtcttacatataatcttgaatatcagctcctcaggatgatgataaagatctaagcggtcttg

SEQ ID NO: 18056 - DNA, 458 bp, Homo sapiens
  chr11.fa.O7frz.132160355
  Located on chromosome 11
  Distance between a terminus base of telomere on chromosomal short arm and 5'-terminus of this base sequence : 124334273
  Distance between 3'-terminus of neighbour sequence of sequence listing upward to telomere on chrosomal short arm and 5'-terminus of this base sequence : 98962
catacaaagtcggtctaatgaccctacatatctgtcatccagcttcatctccccacaggcaagttattaacacattcattcccctttcctggattatgtgtgtgtgtgtgtgtgtgtgtgtgtgtgtgtgtgtgtgtgtgtgtgtgtgtttgagacggagtctcactctgtcacccagactggaatgcagtggcactatctcggctcactgcaacctccgcctcccgggttcaagcaattctcctgcctcagcctaccatgtagttggaattacaggtgagcgccaccacgcccagctaatttctgtatttttaatagagggtttcaccatgttgcccaagctggtcttgaactcctgacctcaagtgatccacctgccttggcctccctggattattttgaatcaatttctagacatcatttcttttctctaaaaagactgaacatgatacaatcat

SEQ ID NO: 18057 - DNA, 308 bp, Homo sapiens
  AP000854.2_82126
  Located on chromosome 11
  Distance between a terminus base of telomere on chromosomal short arm and 5'-terminus of this base sequence : 124455055
  Distance between 3'-terminus of neighbour sequence of sequence listing upward to telomere on chrosomal short arm and 5'-terminus of this base sequence : 120324
ctgagaaataggaagctcagtagggagaagggtttggaggccagagaggagcaagagcttgaaatagttgttgttaggagggggatgcagctacaaatagccttgaggaaggctgtatttgatggtgatggcccagctgagcttggggactactggggcaccaactgtattagggttcccccagagaaacagagcaaacaggatgtgtgtgtgtgtgtgtgtgtgtgtttgtgtgtgtgtatacatatatatggagagagagagagaaacagagagagagagattttaaggaattagctcacatgatt

SEQ ID NO: 18058 - DNA, 101 bp, Homo sapiens
  DID22N_0006505
  Located on chromosome 11
  Distance between a terminus base of telomere on chromosomal short arm and 5'-terminus of this base sequence : 124884346
  Distance between 3'-terminus of neighbour sequence of sequence listing upward to telomere on chrosomal short arm and 5'-terminus of this base sequence : 428983
tgttatgccaagttcaggagggcttcctggaggaggaggaggaggaggaggaggaggaggaggaggagggtagatttcaggggctggatgaatggcagaca

SEQ ID NO: 18059 - DNA, 219 bp, Homo sapiens
  AP001924.3_159709
  Located on chromosome 11
  Distance between a terminus base of telomere on chromosomal short arm and 5'-terminus of this base sequence : 124980015
  Distance between 3'-terminus of neighbour sequence of sequence listing upward to telomere on chrosomal short arm and 5'-terminus of this base sequence : 95568
gatcataatcactcaactttgaagtcttcaaagtctgttcttcctggtgagtgtgtgtgtgtgtgtgtgtgtgtgtgtgtgtgtgtgtgtgtgagagagagagagagagagaaagagagagcgtaattatttatttgaacatggaaatagaatcttcagagaagcaattacgatgcagaactgacagctcttgcttcctaagttcaaatggtgtattgc

SEQ ID NO: 18060 - DNA, 308 bp, Homo sapiens
  AP002763.1_79858
  Located on chromosome 11
  Distance between a terminus base of telomere on chromosomal short arm and 5'-terminus of this base sequence : 125034661
  Distance between 3'-terminus of neighbour sequence of sequence listing upward to telomere on chrosomal short arm and 5'-terminus of this base sequence : 54427
ctcaacttaactatggactgaaagaagagcatgcctggcacatggatgtgctgctgtctttcagatgagcagcttcttttattgatagaagttgtcctgagttctggttctaagtgatggaataaaacattatgtttacttctgttccctcttgaagttacacacacacacacacacacacacacacacaccagcagaaggatagaaaggaaacagatctttaaaagactagaaatagagacacaacctcaaaaatgtagaagctggaaagccaatggggagcagctattgacttcgttgaagtgatt

SEQ ID NO: 18061 - DNA, 308 bp, Homo sapiens; identical to SEQ ID NO: 18060
  AC016996.3_129612
  Located on chromosome 11
  Distance between a terminus base of telomere on chromosomal short arm and 5'-terminus of this base sequence : 125034661
  Distance between 3'-terminus of neighbour sequence of sequence listing upward to telomere on chrosomal short arm and 5'-terminus of this base sequence : -308

SEQ ID NO: 18062 - DNA, 300 bp, Homo sapiens
  AP001977.3_132762
  Located on chromosome 11
  Distance between a terminus base of telomere on chromosomal short arm and 5'-terminus of this base sequence : 125083827
  Distance between 3'-terminus of neighbour sequence of sequence listing upward to telomere on chrosomal short arm and 5'-terminus of this base sequence : 48858
aatcttcatggctaaaggttaggcagggggttcttcaacatgacaccaaagaatgatccataaagaaaaaagttaatacattgagctttatcaaaattacaaatatgtgttctatgaaagatcctaagaaagtatttgcaatatttgcaatgtatatatgttttatatatatatatatatatataaataacaaaagtattcagaatacataaagaaccctctaaactcaacagtaaaaaagcaaacaatctaactcaaaaatgagtggcaaacttgaacagacactaccaaataggatac

SEQ ID NO: 18063 - DNA, 326 bp, Homo sapiens
  chr11.fa.O7frz.135122913
  Located on chromosome 11
  Distance between a terminus base of telomere on chromosomal short arm and 5'-terminus of this base sequence : 125089774
  Distance between 3'-terminus of neighbour sequence of sequence listing upward to telomere on chrosomal short arm and 5'-terminus of this base sequence : 5647
gtagcaggtgtaatctcagctactcaggaggctgaggcaggagaatcgctcgaactcaggaggcagaggttgcagtggagctgagatgctgccattgcactccagcctggaggacaagagccagactctgtctcaaaataaataaataaataaataaataaataaataaataaataaataaaaataaaaaataaaccgtgaattttggagcccccagtgaggtgattcagtggagatgtttcatatttaaggaaaagagatgagtttagcaagatgtggagcccagagctggagctcatgatgttcctactgaagattctactgtg

SEQ ID NO: 18064 - DNA, 102 bp, Homo sapiens
  DISO7_10003183
  Located on chromosome 11
  Distance between a terminus base of telomere on chromosomal short arm and 5'-terminus of this base sequence : 125235411
  Distance between 3'-terminus of neighbour sequence of sequence listing upward to telomere on chrosomal short arm and 5'-terminus of this base sequence : 145311
agagggagagttggagcccccccatacacacacacacacacacacacacacacacactcaagaaaaactgctcaattctctaggcaggccaatctcatctga

SEQ ID NO: 18065 - DNA, 109 bp, Homo sapiens
  DISO7_10003182
  Located on chromosome 11
  Distance between a terminus base of telomere on chromosomal short arm and 5'-terminus of this base sequence : 125267647
  Distance between 3'-terminus of neighbour sequence of sequence listing upward to telomere on chrosomal short arm and 5'-terminus of this base sequence : 32134
ttattctcctgcttggcctttgagattccttccttccttccttccttccttccttccttctttctttctttctttctttttctttccttctttcaattcattagacaat

SEQ ID NO: 18066 - DNA, 119 bp, Homo sapiens
  DISO7_10003181
  Located on chromosome 11
  Distance between a terminus base of telomere on chromosomal short arm and 5'-terminus of this base sequence : 125267647
  Distance between 3'-terminus of neighbour sequence of sequence listing upward to telomere on chrosomal short arm and 5'-terminus of this base sequence : -109
ttattctcctgcttggcctttgagattccttccttccttccttccttccttccttccttctttctttctttctttctttttctttccttctttcaattcattagacaatgagcaagcac

SEQ ID NO: 18067 - DNA, 140 bp, Homo sapiens
  DISO7_10003178
  Located on chromosome 11
  Distance between a terminus base of telomere on chromosomal short arm and 5'-terminus of this base sequence : 125538786
  Distance between 3'-terminus of neighbour sequence of sequence listing upward to telomere on chrosomal short arm and 5'-terminus of this base sequence : 271020
tgagaattggacatggaaagaaaaagaaaccagacataaggggagaagaaaccataaagggaaacttgaacataaaggaaaacttgttcaagttttttgtgtgtgtgtgtgtggagatctcatgcttatctaaattgcgg

SEQ ID NO: 18068 - DNA, 160 bp, Homo sapiens
  Z67121
  Located on chromosome 11
  Distance between a terminus base of telomere on chromosomal short arm and 5'-terminus of this base sequence : 125721041
  Distance between 3'-terminus of neighbour sequence of sequence listing upward to telomere on chrosomal short arm and 5'-terminus of this base sequence : 182115
gctgtgatgccactcccttctctcccaaaatgctagtcagcgaaggtaacattatagggattccttggaaccattctagtgtgtgtgtgtgtgtgtgtgtgtgtgtgtgtgtgtgtgtaaccttttgaaataatatatatccttttggaaacttcagcac

SEQ ID NO: 18069 - DNA, 198 bp, Homo sapiens
  D11S4107
  Located on chromosome 11
  Distance between a terminus base of telomere on chromosomal short arm and 5'-terminus of this base sequence : 125754864
  Distance between 3'-terminus of neighbour sequence of sequence listing upward to telomere on chrosomal short arm and 5'-terminus of this base sequence : 33663
tcattctacaagactagcattaccctgatatcaaaactagaccaggacaccacacacacacacacacacacacacacacacacacacacacacactaactacaagccaatatctaaacatagatgcaaaaatcctcaagaaaatactagcaaactgaatctaacaacacatcaaaaagataatacgccatgatcaagc

SEQ ID NO: 18070 - DNA, 203 bp, Homo sapiens
  D11S4089
  Located on chromosome 11
  Distance between a terminus base of telomere on chromosomal short arm and 5'-terminus of this base sequence : 125814310
  Distance between 3'-terminus of neighbour sequence of sequence listing upward to telomere on chrosomal short arm and 5'-terminus of this base sequence : 59248
taatcaaaggctgtagtgaattgggggtttgtattgtgtttgtaccatctccagggcatggctatgtggctacaattattgcaagccaggaccatgagaaacttatctctttccagtttttctgaactgtgtgtgtgtgtgtgtgtgtgtgtgtgtgtgtgtgtgtgtgtgtgcctatcagtgtttatgagggaactaggaat

SEQ ID NO: 18071 - DNA, 175 bp, Homo sapiens
  D11S925
  Located on chromosome 11
  Distance between a terminus base of telomere on chromosomal short arm and 5'-terminus of this base sequence : 125975748
  Distance between 3'-terminus of neighbour sequence of sequence listing upward to telomere on chrosomal short arm and 5'-terminus of this base sequence : 161235
agaaccaaggtcgtaagtcctgtatgctatgacagccaaacccacagcagatttttaagagaggatcaaaaagttgtgttctgcaaacttgcctctctaggctacacacacacacacacacacacacacacacacacatttgttttgtctttcctttgcccccataatggtctaa

SEQ ID NO: 18072 - DNA, 198 bp, Homo sapiens
  Z17002.1_214
  Located on chromosome 11
  Distance between a terminus base of telomere on chromosomal short arm and 5'-terminus of this base sequence : 125975757
  Distance between 3'-terminus of neighbour sequence of sequence listing upward to telomere on chrosomal short arm and 5'-terminus of this base sequence : -166
gtcgtaagtcctgtatgctatgacagccaaacccacagcagatttttaagagaggatcaaaaagttgtgttctgcaaacttgcctctctaggctacacacacacacacacacacacacacacacacacatttgttttgtctttcctttgcccccataatggtctaataacaatgatcagtccatatgtttatgtagca

SEQ ID NO: 18073 - DNA, 206 bp, Homo sapiens
  D11S1774
  Located on chromosome 11
  Distance between a terminus base of telomere on chromosomal short arm and 5'-terminus of this base sequence : 126113213
  Distance between 3'-terminus of neighbour sequence of sequence listing upward to telomere on chrosomal short arm and 5'-terminus of this base sequence : 137258
caaaaaggcttggcggttggccagtctccttgtaacctagttcccctctgttccactcatgcccagggagtcctggcaagtagtactcctggatggactccctccccatctctctctctctttctctctttttctctttctctcttaaacacacacacacacacacacacacacacacacacggacacatgagcatgggaatgccc

SEQ ID NO: 18074 - DNA, 206 bp, Homo sapiens
  G08850
  Located on chromosome 11
  Distance between a terminus base of telomere on chromosomal short arm and 5'-terminus of this base sequence : 126212323
  Distance between 3'-terminus of neighbour sequence of sequence listing upward to telomere on chrosomal short arm and 5'-terminus of this base sequence : 98904
actgctcccacagatgttgtaattgcccatttttgtatccataaacccttcattagacagttacctccagaaaagcatgtctttccctccagtgtgtagcaccctgactggtgctgctcagttactcttaggtgaatgaatgatgaatgaatgaatgaatgaatgaatgaatgaatacgtgaatgaacaaactcatccagctttgg

SEQ ID NO: 18075 - DNA, 437 bp, Homo sapiens
  AP002348.2_151955
  Located on chromosome 11
  Distance between a terminus base of telomere on chromosomal short arm and 5'-terminus of this base sequence : 126289096
  Distance between 3'-terminus of neighbour sequence of sequence listing upward to telomere on chrosomal short arm and 5'-terminus of this base sequence : 76567
cagtagctggcacatagttaagttatcaataaatataattcacaacggtaccacattcccgttgcctggaagcaaacagctctgctgcttctgatccacacatttaatctagcaaagagcattttcctcactgctctttcattcattcaacaaggatttactgagcacttaatgtgtgcgaggcataagatcttgtaaaaaatacagtatccttgtccttgaaacatttattaaataataaaaaaaaccctgtgtcacagaactgtacacacatacacagaatcacacatacacacactttctctctctctctctctctctcctctctctctctctcacacacacacacacacacacacacacacacacagaccctctcccctggaaacttgtcatctatatataaagtactattatctgcattgttagactggata

SEQ ID NO: 18076 - DNA, 165 bp, Homo sapiens
  DISO7_10003177
  Located on chromosome 11
  Distance between a terminus base of telomere on chromosomal short arm and 5'-terminus of this base sequence : 126456238
  Distance between 3'-terminus of neighbour sequence of sequence listing upward to telomere on chrosomal short arm and 5'-terminus of this base sequence : 166705
cctgccagcttcagaaagttggaaagaaatccaaaatacaaaaaagaaaaaagaaatatcctttaaatatactcagaaagcaaaactaaacaaaaaccaaatcaaccaacaacaacaacaacaacaacaacaacaacaacaacaaaacccactctgccagagaat

SEQ ID NO: 18077 - DNA, 145 bp, Homo sapiens
  DISO7_10003176
  Located on chromosome 11
  Distance between a terminus base of telomere on chromosomal short arm and 5'-terminus of this base sequence : 126490941
  Distance between 3'-terminus of neighbour sequence of sequence listing upward to telomere on chrosomal short arm and 5'-terminus of this base sequence : 34538
tcctcactctaattatgcacatgcaaaaaacacaaatatgtgtgtgtgtgtgtgtgtatatatatgtgtgtgtgtgtgtgtgtgtgtgtgtgtatatatatatatataatcccctaaaacctactgtgagaattcatatgcctaa

SEQ ID NO: 18078 - DNA, 319 bp, Homo sapiens
  chr11.fa.O7frz.133435606
  Located on chromosome 11
  Distance between a terminus base of telomere on chromosomal short arm and 5'-terminus of this base sequence : 126586132
  Distance between 3'-terminus of neighbour sequence of sequence listing upward to telomere on chrosomal short arm and 5'-terminus of this base sequence : 95046
taattacctgcttctgctacacacacacacacacacacacacacacacacacacagacagagagagagagagagagagaaacagagagagacagagagaaagaaagaaagaaaaagaaagagaaagaaagaaagaaagaaaggaaggaaggaaggaaggaaggaaggaaggaaggaaggaaggaaggaaggaaagaaagaaagaaagggagaggctggaaaagtagatggcattctgttgtaagcctcctccagaaatactcaaaatgaaatcaaaacaagttcaggctgtcaaattctagatacgctctatgaacgtg

SEQ ID NO: 18079 - DNA, 133 bp, Homo sapiens
  Z67522
  Located on chromosome 11
  Distance between a terminus base of telomere on chromosomal short arm and 5'-terminus of this base sequence : 126672204
  Distance between 3'-terminus of neighbour sequence of sequence listing upward to telomere on chrosomal short arm and 5'-terminus of this base sequence : 85753
catgcaggtatgtggggaatgatcctcagggggaggcaaacaaacaaacaaacaaaacacacacacacacacacacacacacacacacacacaaaacaacaaaaaaaaaaaccatgtctccaaccccaaagca

SEQ ID NO: 18080 - DNA, 444 bp, Homo sapiens
  chr11.fa.O7frz.132876765
  Located on chromosome 11
  Distance between a terminus base of telomere on chromosomal short arm and 5'-terminus of this base sequence : 126723834
  Distance between 3'-terminus of neighbour sequence of sequence listing upward to telomere on chrosomal short arm and 5'-terminus of this base sequence : 51497
gatgctcgacataagtggttgacagcaggtatttggcagatgtttaagcatagagcgtctgggccagacgcggtggctcatgcctgtaatcctagcactttgggaggccgaggcgggcggattgcctgagctcaggagttcgagaccaacctgggcaacaaggtgaaatcccgtctctactaaaatacaaaagaaattagctgggtgtggcggcgtgcgcctgtaatcccagctactcgggaggctggggtaggagaattgcttgaacccaggaggcagaagttgcagcgagccaaaattgcgccactgcactccagcctgggtgacagaggaagactccgtctctacaaaacaaaacaaaacaaaacaaaacaaaaacatagagcatctgaaacaagcagcatccttcctggagaacctggctcctaaggagttcatcttcac

SEQ ID NO: 18081 - DNA, 410 bp, Homo sapiens
  AP000679.4_106351
  Located on chromosome 11
  Distance between a terminus base of telomere on chromosomal short arm and 5'-terminus of this base sequence : 126769921
  Distance between 3'-terminus of neighbour sequence of sequence listing upward to telomere on chrosomal short arm and 5'-terminus of this base sequence : 45643
tctgagtagacttcatccagtaagttgaaaggccttaagagcaaaattgaggtttcccagggaaagaaattctgactgtggactgactatagcctcagctcctgctagagagtttccagcctgccagcctaccctactctacagatttcagatttgctagccccttcagtcacatcagccaattccttgaaattctgtctctctgaacacacacacacacacacacacacacacacacacacacccctgtatatctatagaaatatagatatccagtaggttctgtttctctggtagaacactgactgatgatacacgattcaaatagaactcatcaaaaagctagagttactaaattaatatcagacagactgaacttcaagacaaagtgtattaccggaaattaaagg

SEQ ID NO: 18082 - DNA, 200 bp, Homo sapiens
  D11S4132
  Located on chromosome 11
  Distance between a terminus base of telomere on chromosomal short arm and 5'-terminus of this base sequence : 126855546
  Distance between 3'-terminus of neighbour sequence of sequence listing upward to telomere on chrosomal short arm and 5'-terminus of this base sequence : 85215
actccagcctgggtgaaagaatgagattccgtttctctctctttctgtgtgtgtgtgtgtgtgtgtgtgtgtgtgtgtgtgtgtgtatagtaaaattacggagttcatgacctcctggagagatgactagcaggaattgcaatggattctgaaaagatttggagaatgtggatatcatgggacgaagccaagacttgcac

SEQ ID NO: 18083 - DNA, 455 bp, Homo sapiens
  AP001928.2_28501
  Located on chromosome 11
  Distance between a terminus base of telomere on chromosomal short arm and 5'-terminus of this base sequence : 126960032
  Distance between 3'-terminus of neighbour sequence of sequence listing upward to telomere on chrosomal short arm and 5'-terminus of this base sequence : 104286
aaaatatggagatgcattcacaatagcaaagtcagagaaccaacctctgttaccattcactgataactggataaaggaaatgtagtgtgtgtatgtgtgtgtgtgtgtgtgtgtgtgtgtgtgtgtgtgtgtgtaaaatggaatactatgcagccatgtaaaagaatttaaaagaatgaaatcatgtcttttgcagtaacatggatggagctggagaccattatcctaagtgaaataactcagaaacagagagttacatactgcatgttcttacttataagtgggagctaaacaatgggtacacatggacataaaaagatggaaacaatagacatttgtgactccaaaaggggagtggggtggaaggaagtgagggttgaaaaattacctgggtgcatgggtgcaccagaagcccaaacgtcaccattatgcagtagatccatgtaacaaacctg

SEQ ID NO: 18084 - DNA, 400 bp, Homo sapiens
  chr11.fa.O7frz.133116197
  Located on chromosome 11
  Distance between a terminus base of telomere on chromosomal short arm and 5'-terminus of this base sequence : 126964147
  Distance between 3'-terminus of neighbour sequence of sequence listing upward to telomere on chrosomal short arm and 5'-terminus of this base sequence : 3660
tactaggacagtgctttccacactttttcatagaggaagataatacttgatgacacactggggtaaacttgagggcattaaaatggataaatagatggatggatggatggatggatggatggatggatggatagatagatagatgatagatagatagatagatagatgatagatagatgataggtagatgatagatgatagatagattgatgatagatagatgataggtagatgatagatagatagatagacagacagataatagatagaaaaatatatatggctgggggtaaagccccctataactttatattatattattatgataaaaataaaataaaatccctctatactgcaggcttttatatccaactgcctagttgacatttcctcttagatg

SEQ ID NO: 18085 - DNA, 260 bp, Homo sapiens
  chr11.fa.O7frz.135565699
  Located on chromosome 11
  Distance between a terminus base of telomere on chromosomal short arm and 5'-terminus of this base sequence : 127302703
  Distance between 3'-terminus of neighbour sequence of sequence listing upward to telomere on chrosomal short arm and 5'-terminus of this base sequence : 338156
gtgatactcattgaaacagaaaagaagggttgggacagcttttaagtatttaatcttttcccctgtgaaagaaaccagatagcaaaagaggacagtatacaagtaactcggagaaaaagcatagaaaccatctagaaagggctcttttctttctttctttctttctttctttctttctttctttctttctttctttctttctttctttctttctttcttccttttcttcaaggagagtacagaatccatatgacttccta

SEQ ID NO: 18086 - DNA, 361 bp, Homo sapiens
  AP000666.2_102232
  Located on chromosome 11
  Distance between a terminus base of telomere on chromosomal short arm and 5'-terminus of this base sequence : 127380732
  Distance between 3'-terminus of neighbour sequence of sequence listing upward to telomere on chrosomal short arm and 5'-terminus of this base sequence : 77769
tgtctattgatttccacatgtctctctttgtttggaacaacaaccaaccaactagaagacgattttatatactcttcaccaaattgaagttgggaaagaaaaaaagtattagactattttccttacttctcgctctcaacttgtcccaaatattgatctggttattttgctttctagccctccatcaacctcctaactctttctctctctctctctgtctctctctctctctctctctctcacacacacacacacacacacacacacacatacatacatacacacacacacacaactgctgcttgatccaatctggtgcctgcttaacaacaagagaatgacaagcaacatctgtttgtaa

SEQ ID NO: 18087 - DNA, 339 bp, Homo sapiens
  AP001835.3_115854
  Located on chromosome 11
  Distance between a terminus base of telomere on chromosomal short arm and 5'-terminus of this base sequence : 127479477
  Distance between 3'-terminus of neighbour sequence of sequence listing upward to telomere on chrosomal short arm and 5'-terminus of this base sequence : 98384
attcatatgtagtttgaggacctatatttttgatattccaaaaacctatcaacaatgccaatatgtggatgactatttggtgctcaatccatctctgacatcagatgcatgaaatcagtttctcctatatctgttttgccttctaattaatatgaattgattggttaagtttttccaatatggaaactaacagacttttgagtcaaataatatgtgcatgtgtgtgtgtgtgtgtgtgtgtgtgtgtgtgtgcttgcatacatgttaacatgtgtttaaatgctttacttttgttttactttattcaattcattcattagcttgcaaccagtcaagtgt

SEQ ID NO: 18088 - DNA, 106 bp, Homo sapiens
  D11S4167
  Located on chromosome 11
  Distance between a terminus base of telomere on chromosomal short arm and 5'-terminus of this base sequence : 127501983
  Distance between 3'-terminus of neighbour sequence of sequence listing upward to telomere on chrosomal short arm and 5'-terminus of this base sequence : 22167
tccccacctgcctgaggggaaaaaatacacacacacacacacacacacacacacacacacacacacacacacagatatctactgcataacaacattttggtcaaca

SEQ ID NO: 18089 - DNA, 171 bp, Homo sapiens
  DISO7_10003186
  Located on chromosome 11
  Distance between a terminus base of telomere on chromosomal short arm and 5'-terminus of this base sequence : 127558215
  Distance between 3'-terminus of neighbour sequence of sequence listing upward to telomere on chrosomal short arm and 5'-terminus of this base sequence : 56126
aacagggcaagcaggtacccaaacagaatggctttaaaagataaataaaataaaataaaataaaataaaataaaataaaataaaataaaataaaaatgaaaagatgtttgctataaatgaatccccaattctgtaagaaaatactaagagaatgttctttagaaggtcatg

SEQ ID NO: 18090 - DNA, 113 bp, Homo sapiens
  DISO7_10003185
  Located on chromosome 11
  Distance between a terminus base of telomere on chromosomal short arm and 5'-terminus of this base sequence : 127630883
  Distance between 3'-terminus of neighbour sequence of sequence listing upward to telomere on chrosomal short arm and 5'-terminus of this base sequence : 72497
ttactcaataatttgcatggctttccaggatctaccaaaccaagtttcatttttcacacacacacacacacatacacacacacacgccctccttcacatctttattcatacag

SEQ ID NO: 18091 - DNA, 474 bp, Homo sapiens
  chr11.fa.O7frz.136252455
  Located on chromosome 11
  Distance between a terminus base of telomere on chromosomal short arm and 5'-terminus of this base sequence : 127728613
  Distance between 3'-terminus of neighbour sequence of sequence listing upward to telomere on chrosomal short arm and 5'-terminus of this base sequence : 97617
gtatgactacctgtcatttcctacaatgtcctctttcattaatacacaccagactttcccctagtctctaaatggcctgctctattttaagttgagcagtagagggtcctctatttaaatgaccttcttcacttttctactggtacaattttcttttcttttttcttttcttttctttcgtgtgtgtgtgtgtgtgtgtgtgtgtgtgtgtgtgtgtctgtgtgtgtttgtcagggtcttgctctgtcaccaaggctggagtgtagtggcacaatcaaaactcactgcagccttgacctcctgggctcaagtgatcctcccacctcagcctcctcaatagctgggacgataggtgtgcaccacaatacctgcctaactttttaaaatcctttttctttggaagggtttcatgtcaaaaattgccatcttagtgacactttcagtattatctctccttaccactgtagaattaat

SEQ ID NO: 18092 - DNA, 435 bp, Homo sapiens
  AC067823.3_145811
  Located on chromosome 11
  Distance between a terminus base of telomere on chromosomal short arm and 5'-terminus of this base sequence : 127803099
  Distance between 3'-terminus of neighbour sequence of sequence listing upward to telomere on chrosomal short arm and 5'-terminus of this base sequence : 74012
gttcatctttcaaagaatacgtcccttcttgtctttagggtttttcccccaaagaatattttcagcagaagtattttacatctcagtctagagatgaacttccccaagagtgttgtgtgtaggcttgccggtttttttttaaattattattattcactataaatctttattaataaagatttaacaaggacctaacccagcagttcagaggtacagaaagtcaatgtgtggaaagaagacggaactgatcggaaatgtttattcctctcctaaatcaccactgacaacgacaaccacacacacacacacacacacacacacacacacacacacacacagctgacgctcagaatgcgtagggacagagacacagggagcaggacaggaagcaaagggtagttatatatggccgagaggaacatggttccttagtaa

SEQ ID NO: 18093 - DNA, 236 bp, Homo sapiens
  D11S1336
  Located on chromosome 11
  Distance between a terminus base of telomere on chromosomal short arm and 5'-terminus of this base sequence : 127990698
  Distance between 3'-terminus of neighbour sequence of sequence listing upward to telomere on chrosomal short arm and 5'-terminus of this base sequence : 187164
ctggatggcatgaggtttcaaataccatattgcagtcaggagttttgggtactgaatcatgtatttactcatatatatatatgagtatattaaaaaagaaaaagatagagatatatatgtatgtgtgtgtgtgtgtgtgtgtgtgtgtgtgtgtgtgtgtatatatatatatttgagactgagcctcactctatcgcccacgctggagtgcagtggcacaatctcggcttgctgca

SEQ ID NO: 18094 - DNA, 184 bp, Homo sapiens
  Z24048.1_135
  Located on chromosome 11
  Distance between a terminus base of telomere on chromosomal short arm and 5'-terminus of this base sequence : 127990711
  Distance between 3'-terminus of neighbour sequence of sequence listing upward to telomere on chrosomal short arm and 5'-terminus of this base sequence : -223
ggtttcaaataccatattgcagtcaggagttttgggtactgaatcatgtatttactcatatatatatatgagtatattaaaaaagaaaaagatagagatatatatgtatgtgtgtgtgtgtgtgtgtgtgtgtgtgtgtgtgtgtgtatatatatatatttgagactgagcctcactctatcgc

SEQ ID NO: 18095 - DNA, 441 bp, Homo sapiens
  AC069316.2_41833
  Located on chromosome 11
  Distance between a terminus base of telomere on chromosomal short arm and 5'-terminus of this base sequence : 128056888
  Distance between 3'-terminus of neighbour sequence of sequence listing upward to telomere on chrosomal short arm and 5'-terminus of this base sequence : 65993
cctgaggtctgcagatttatggagaatgttttttgtgccaagatgctgggtgctctgggtattataatattttcaatttaaccatccatgagtgccccataaagaaggtgtggccccgggtgagctggttctcttccaccgagggcaagtataaaaatttgaagtccttcaaaggaatctcatagacaaagaaaaatgtgtgtgtgtgtgtgtgtgtgtgtgtgtgtgtgtgtatcactgactcactgtgtcacttcaggcaaacttcttaattctttgggttttttaaattttatttattttttttgagacagagtctcgttctgtcgccgaggctggagggcagtggcgcaatctcggctcactgcaacctccgcctcccaagttcaagcaattctcctgcctcagcctcccaagtagctggaactacagctaccgtag

SEQ ID NO: 18096 - DNA, 119 bp, Homo sapiens
  DISD22_0006590
  Located on chromosome 11
  Distance between a terminus base of telomere on chromosomal short arm and 5'-terminus of this base sequence : 128566243
  Distance between 3'-terminus of neighbour sequence of sequence listing upward to telomere on chrosomal short arm and 5'-terminus of this base sequence : 508914
accactgtccacctgctcccaatttctgtaggggtgtgtgtgtgtgtgtgtgtgtgtgtgtgtgtgtgtatgcaaagcgaggtgcagcttcggtgccaggcatacttcatgtgctgcga

SEQ ID NO: 18097 - DNA, 196 bp, Homo sapiens
  D11S4094
  Located on chromosome 11
  Distance between a terminus base of telomere on chromosomal short arm and 5'-terminus of this base sequence : 128682369
  Distance between 3'-terminus of neighbour sequence of sequence listing upward to telomere on chrosomal short arm and 5'-terminus of this base sequence : 116007
ggagtcggggaatttctaagtgtgtgtgtgtgtgtgtgtgtgtgtgtgtgtgtgtgtgtgtgtgaatgagaaagagaaagagagagagggagcaagaaaaaggaaggaaagcagtagactagattttcagtaccctagtgggcctctgcctgaaggacatatggggccaatgagtgctgactggctgttctttgag

SEQ ID NO: 18098 - DNA, 254 bp, Homo sapiens
  D11S936
  Located on chromosome 11
  Distance between a terminus base of telomere on chromosomal short arm and 5'-terminus of this base sequence : 128685840
  Distance between 3'-terminus of neighbour sequence of sequence listing upward to telomere on chrosomal short arm and 5'-terminus of this base sequence : 3275
gcagatataggcagaactccattgtaaatggcataatcatacagtcacattttgttcctctaaaacataacatctaccaacaataagacacacacacacacacacacacacagattaaaagaaaaaaaaaccttatccccaaccccaaatgttccctctcctctcctttcttctcccctccactcccctcctctctcctcttctcttctctctctccttttgctcccactccaaccacaagtaacttttcacag

SEQ ID NO: 18099 - DNA, 259 bp, Homo sapiens
  Z17157.1_104
  Located on chromosome 11
  Distance between a terminus base of telomere on chromosomal short arm and 5'-terminus of this base sequence : 128685864
  Distance between 3'-terminus of neighbour sequence of sequence listing upward to telomere on chrosomal short arm and 5'-terminus of this base sequence : -230
taaatggcataatcatacagtcacattttgttcctctaaaacataacatctaccaacaataagacacacacacacacacacacacacagattaaaagaaaaaaaaaccttatccccaaccccaaatgttccctctcctctcctttcttctcccctccactcccctcctctctcctcttctcttctctctctccttttgctcccactccaaccacaagtaacttttcacagtctaactctaggcattagaaggatgttta

SEQ ID NO: 18100 - DNA, 205 bp, Homo sapiens
  D11S1353
  Located on chromosome 11
  Distance between a terminus base of telomere on chromosomal short arm and 5'-terminus of this base sequence : 128696342
  Distance between 3'-terminus of neighbour sequence of sequence listing upward to telomere on chrosomal short arm and 5'-terminus of this base sequence : 10219
ccaacgcttaaaatgttacgtgcgtgtgtgtgtgtgtgtgtgtgtgtgtgtgtgtgtctttgtgtgtatgaagaaaaaaatcttgcattgctggctaggatggggatgacagtagatttggttagatttaggaaggtattcctggtttcgagagttgtctatgtgtgtagtggaaccttcattttgttggatttggggacatatc

SEQ ID NO: 18101 - DNA, 461 bp, Homo sapiens
  chr11.fa.O7frz.141352429
  Located on chromosome 11
  Distance between a terminus base of telomere on chromosomal short arm and 5'-terminus of this base sequence : 128755293
  Distance between 3'-terminus of neighbour sequence of sequence listing upward to telomere on chrosomal short arm and 5'-terminus of this base sequence : 58746
agaattaaatttgaaggctgacaggcattcaagagagaggatcatgtaaacttatgggcaggtttgtgtgtttttgcttttgttttggcgtaaagagaaacatcactgagaaagatggaatgaatgaagtgaggagagaaaaggaaggagaaaggcagaaagaggggccaaatggatttcagaggtagggagaggctagaggcagtaggtggcttaacctcaatcctctctctctctctgtctctctctttcacacatacacacacacacacacacacacacacacacgcataggcatagatgcctgtgattgtttagctgtctattgacaagggtttctcatggctaaagttttggggctggtgagcaaagactgtgtccctctctgattagatgacttctctggtaccgatattcagcgctgtgccttgcacacagtaggttctcaacagataatggta

SEQ ID NO: 18102 - DNA, 179 bp, Homo sapiens
  D11S4144
  Located on chromosome 11
  Distance between a terminus base of telomere on chromosomal short arm and 5'-terminus of this base sequence : 128823328
  Distance between 3'-terminus of neighbour sequence of sequence listing upward to telomere on chrosomal short arm and 5'-terminus of this base sequence : 67574
atggcttccaggttagtgctaactcgtgctgacgcctggtgcgtgtgtgtgtgtgtgtgtgtgtgtgtgtgtgtgtgtgtgtgtgtgtgtatctttgtttcctcgtgggattttttggaagcggtggctctgtcctggggtcagaatggggccctgggggctgtggtgaagacctgtct

SEQ ID NO: 18103 - DNA, 175 bp, Homo sapiens
  U73644.1_14241
  Located on chromosome 11
  Distance between a terminus base of telomere on chromosomal short arm and 5'-terminus of this base sequence : 128823339
  Distance between 3'-terminus of neighbour sequence of sequence listing upward to telomere on chrosomal short arm and 5'-terminus of this base sequence : -168
gttagtgctaactcgtgctgacgcctggtgcgtgtgtgtgtgtgtgtgtgtgtgtgtgtgtgtgtgtgtgtgtgtgtgtatctttgtttcctcgtgggattttttggaagcggtggctctgtcctggggtcagaatggggccctgggggctgtggtgaagacctgtctttctggt

SEQ ID NO: 18104 - DNA, 206 bp, Homo sapiens
  D11S1316
  Located on chromosome 11
  Distance between a terminus base of telomere on chromosomal short arm and 5'-terminus of this base sequence : 128864078
  Distance between 3'-terminus of neighbour sequence of sequence listing upward to telomere on chrosomal short arm and 5'-terminus of this base sequence : 40564
aaaaaagttcccactcagatgcagttggatgttgagaaactgtctccaagccagagaaagagatgtaggagaaaacgcaccgacacacacacataatgtttcccccaggattaatttttatgtgtgtgtgtgtgtgtgtgtgtgtgtgtgtatgattgacatgggtgtatttaaatatatacatatattggccttgactctagccc

SEQ ID NO: 18105 - DNA, 297 bp, Homo sapiens
  HUMUT544
  Located on chromosome 11
  Distance between a terminus base of telomere on chromosomal short arm and 5'-terminus of this base sequence : 128974446
  Distance between 3'-terminus of neighbour sequence of sequence listing upward to telomere on chrosomal short arm and 5'-terminus of this base sequence : 110162
tgttctgcctctgttgttacttgaatcatctctttaggcaaagttgaccaatctttttctttctttctttctttccttccttctttctttctttctttctttctttctttctttctttctttctttctttccttctttctttctttctttttccttccttccttccttctctttctttctctttctttccttctttctttctttttctttcttctttctctttctttctttcttccttcctttttttgtttcttttttttttttttcaagttctcactctgtcaccgaggctgaagt

SEQ ID NO: 18106 - DNA, 241 bp, Homo sapiens
  AP000825.2_67617
  Located on chromosome 11
  Distance between a terminus base of telomere on chromosomal short arm and 5'-terminus of this base sequence : 129019105
  Distance between 3'-terminus of neighbour sequence of sequence listing upward to telomere on chrosomal short arm and 5'-terminus of this base sequence : 44362
aacagttagaacagtttacacgagagattcatgaagcttttggaggacagaatcttgagtcacggagtttgcaagtgtgtgtgtgtgtgtgtgtgtgtgtgtgtgtgtgtgaagtatggtgtcagccattctctgtaacacatgtacatgtggatctaagcttcatggaggaaggggctgcaggtggtatgtgaatgacctcttttgagattctggtcacagacagtactgccgtggtatc

SEQ ID NO: 18107 - DNA, 283 bp, Homo sapiens
  chr11.fa.O7frz.141909464
  Located on chromosome 11
  Distance between a terminus base of telomere on chromosomal short arm and 5'-terminus of this base sequence : 129294708
  Distance between 3'-terminus of neighbour sequence of sequence listing upward to telomere on chrosomal short arm and 5'-terminus of this base sequence : 275362
gtaaagtccataaacatgtaggaccccacctaaaataaattgatccttttagctttttatgagtagacatttaaaaaatgtcctttatatctctgataatacttcttacttgaaagttcactttatttgctaataatatagtcatattagtttttttcctagtattttcttggcataaattttctaccctttaactttccgtgtgtgtgtgtgtgtgtgtgtgtgtgtgtgtgtgtttgtatttagtgtagttgtttttaaaccagatataattagatgttgc

SEQ ID NO: 18108 - DNA, 358 bp, Homo sapiens
  AP001884.3_52935
  Located on chromosome 11
  Distance between a terminus base of telomere on chromosomal short arm and 5'-terminus of this base sequence : 129333547
  Distance between 3'-terminus of neighbour sequence of sequence listing upward to telomere on chrosomal short arm and 5'-terminus of this base sequence : 38556
tagaatgctcttgtcagaataaagtttaaaaaaaggctgtaattatttttaataattttatttttgtaggttttcacattttgaatgttaattcttgtttcaagaggatttctgattataagtagaatatccttttgtgactatgagagtgtgtgtgtgtgtgtgtgtgcgtgtgtgtgtgtgactgttctcatggtggaggcgtaggaaagtaatagtaatagtagtgttctttcatagtggcctcagatgaggaagtgggaaagactataaatatctttcctgcttatagcatgttaaaaagcacttatgtgtgaatcagcaaaataccggggttctaacagtggttccactaata

SEQ ID NO: 18109 - DNA, 356 bp, Homo sapiens
  chr11.fa.O7frz.141991728
  Located on chromosome 11
  Distance between a terminus base of telomere on chromosomal short arm and 5'-terminus of this base sequence : 129376876
  Distance between 3'-terminus of neighbour sequence of sequence listing upward to telomere on chrosomal short arm and 5'-terminus of this base sequence : 42971
aggaacaataccagacatgatttctctccagagaaaaggataatttcctctcataattagttcagtacatgtaaaaaacatggttgtagggcctagtactgataaaatagaatttgtgcttatattatgctttactatatatgcatatattacatgcatgtaactgtatatacatgcatgggtgtacatatatacacatatatacatctatgcatgcacatccatgtatataaatgtgtatgtgggtgtatatatataaagtatataaatgtgtgtgtgtgtgtgtgtgtgtgtgtatatatatatatatatatatatatataaaacttttatagccactaagattcattagatct

SEQ ID NO: 18110 - DNA, 161 bp, Homo sapiens
  D11S1328
  Located on chromosome 11
  Distance between a terminus base of telomere on chromosomal short arm and 5'-terminus of this base sequence : 129419699
  Distance between 3'-terminus of neighbour sequence of sequence listing upward to telomere on chrosomal short arm and 5'-terminus of this base sequence : 42467
gagcctgtccttggaacacagtaagtattcattaaatggtgtgagtgtgtgcgtgtgtgtgtgtgtgtgtgtgtgtgtgtgtgtgtgttaccattattattactaagtgagtaatgagagatccctgaatctttcaggcattataccctgctcctgactta

SEQ ID NO: 18111 - DNA, 336 bp, Homo sapiens
  chr11.fa.O7frz.142314073
  Located on chromosome 11
  Distance between a terminus base of telomere on chromosomal short arm and 5'-terminus of this base sequence : 129579025
  Distance between 3'-terminus of neighbour sequence of sequence listing upward to telomere on chrosomal short arm and 5'-terminus of this base sequence : 159165
gcactgaattggtagattgagtgcaatgggtagtatgaacattttaacaatattgatttttccagtccgtgaacttggaataactttttatttgtgtgtgtgtgtgtgtgtgtgtgtgtgtgtgtgtgtgttctctttctttcatcgatgttttataattttcattgtagagatatttcacttctttggttaatttctaggtattttatttgagttgtaggtattgtaaataggattacttcttaaatttctttttcagattgctcactgttggcatgtagaaatgctactgattttgtatgtcaactttatatcttgcaactttactgagtttgt

SEQ ID NO: 18112 - DNA, 289 bp, Homo sapiens
  D11S1752
  Located on chromosome 11
  Distance between a terminus base of telomere on chromosomal short arm and 5'-terminus of this base sequence : 129680534
  Distance between 3'-terminus of neighbour sequence of sequence listing upward to telomere on chrosomal short arm and 5'-terminus of this base sequence : 101173
tgctttagttttattgcatgatgatcaaagaacattgatgggactatttttaatatatcaaatttattgaagtttgcttttgtgacctaatattcactcttcatgtgactgttttttgaccctttgattaaaaggtatgtttttaatatctaggacacagaactacacatacacacacacacacacacacacacatacacataaaaaattggatgtttatatagaaaaaactaatttatgtaagtaattagatttatctctctattatcttcttgacattttctacatc

SEQ ID NO: 18113 - DNA, 379 bp, Homo sapiens
  AP000916.4_180897
  Located on chromosome 11
  Distance between a terminus base of telomere on chromosomal short arm and 5'-terminus of this base sequence : 129854627
  Distance between 3'-terminus of neighbour sequence of sequence listing upward to telomere on chrosomal short arm and 5'-terminus of this base sequence : 173804
tattacatttgcctttgcatacttataacaagccccacctccgtactcccatccggcacctacaaagccaccttagccgtgggagagtcccaggttaggcaagatacaggcaaatcctttgagctgatctttcagagagccaccagggaagccaaaacaaacatcaatttttttttaatcatccatggatggatgagtggataaagaaactgcaatacgcacgcacacacaatacatacacacacacacacacacaatacacacacacacacacacacaagtattatttagctttaaaaaaggagattctgccctttgaggaaacatggatgaacacgaatctgagggcgttatgctaagtgaaataagctagatgcag

SEQ ID NO: 18114 - DNA, 126 bp, Homo sapiens
  Z66581
  Located on chromosome 11
  Distance between a terminus base of telomere on chromosomal short arm and 5'-terminus of this base sequence : 129940319
  Distance between 3'-terminus of neighbour sequence of sequence listing upward to telomere on chrosomal short arm and 5'-terminus of this base sequence : 85313
tgtgagaaacaacacctggccagtatgctatcatttaacaaaagaggttgatatgaatacataactgtgtgtgtgtgtgtgtgtgtgtgtgtgtgtgtttgtgtgtgtatttgccacagggtttgg

SEQ ID NO: 18115 - DNA, 255 bp, Homo sapiens
  D11S933
  Located on chromosome 11
  Distance between a terminus base of telomere on chromosomal short arm and 5'-terminus of this base sequence : 130064041
  Distance between 3'-terminus of neighbour sequence of sequence listing upward to telomere on chrosomal short arm and 5'-terminus of this base sequence : 123596
ggtgcctggttcacagtaaacattgtgtgaggactgtaaaagaatctgaaacatctatcaaaacaaaattaactctcattcagcccagtgataaatgttttaatgtcataaggtatttggtgtgtatgaaagggagagttgtgcctaaatcatatactaaatcagagattccaaagaggggtgtgtgtgtgtgtgtgtgtgtgtgtgtgtgtgtgtgggagacagggtctcactctgtcactgaggctggagtgc

SEQ ID NO: 18116 - DNA, 357 bp, Homo sapiens
  chr11.fa.O7frz.140639403
  Located on chromosome 11
  Distance between a terminus base of telomere on chromosomal short arm and 5'-terminus of this base sequence : 130404660
  Distance between 3'-terminus of neighbour sequence of sequence listing upward to telomere on chrosomal short arm and 5'-terminus of this base sequence : 340364
gactcatgcctgtaatcctagcactttgggggtccaaggtgggagaatcgcttgagctcaggagttcaagaacagcctgggtaagatagtgagacctcgtctctacaaaacattaaacaaattagccaggtgtggtagcagacgcctgtagtgccggctactcaagaggctaaggtgggaggattgcttcagcccaggaggttgagactgtagtgagccaagatcgcactcactgcactccagccttggagacagggtgagaccctgtctcataaataaataaataaataaataaataaataaatatgcattcttaagtaattaaagtgaaagttcttgaaatcagaatttactgta

SEQ ID NO: 18117 - DNA, 171 bp, Homo sapiens
  DISD22_0006602
  Located on chromosome 11
  Distance between a terminus base of telomere on chromosomal short arm and 5'-terminus of this base sequence : 130560617
  Distance between 3'-terminus of neighbour sequence of sequence listing upward to telomere on chrosomal short arm and 5'-terminus of this base sequence : 155600
gcttgcatagcatgttcgctctctctctctctctctctctcttactttctctctttctttctttctctctcagtctctctttccttctttctctctctggtgtgtgcgcacatgcacaaacacacatacacttacacacactcatcatcatcatcctcatcctcatctctg

SEQ ID NO: 18118 - DNA, 128 bp, Homo sapiens
  D11S4158
  Located on chromosome 11
  Distance between a terminus base of telomere on chromosomal short arm and 5'-terminus of this base sequence : 130725614
  Distance between 3'-terminus of neighbour sequence of sequence listing upward to telomere on chrosomal short arm and 5'-terminus of this base sequence : 164826
ctgttttcaacgtgattggattgttaaattttgaggtgtgtgtgtgtgtgtgtgtgtgtgtgtgtgtgtgtgtgcgtgccttaaatttcattctgtgcagtagacgaggacttgataagacaataaca

SEQ ID NO: 18119 - DNA, 271 bp, Homo sapiens
  Z66789
  Located on chromosome 11
  Distance between a terminus base of telomere on chromosomal short arm and 5'-terminus of this base sequence : 130888171
  Distance between 3'-terminus of neighbour sequence of sequence listing upward to telomere on chrosomal short arm and 5'-terminus of this base sequence : 162429
tggagttcacatggggcatgttcaggctcggtgtggccaggatgtgcatgtgcgtgaaattaggcaggaggccaggctgtgaaagtttccccatcccctcaaaacacacacacacacacacacacacacacagtctctctcacacacacacaaagtcacacccagtcatacacacagagtcacactcacacacatgcatgaacacccacccatggagtcacacacacaggcatgtgcacacacgaccctccagacaacagcacgctggtga

SEQ ID NO: 18120 - DNA, 375 bp, Homo sapiens
  AP000708.3_84317
  Located on chromosome 11
  Distance between a terminus base of telomere on chromosomal short arm and 5'-terminus of this base sequence : 131146237
  Distance between 3'-terminus of neighbour sequence of sequence listing upward to telomere on chrosomal short arm and 5'-terminus of this base sequence : 257795
ctaggcaacatggcgaaatctcatctcttctaaaaatacaaaaattagctgggtgtggaggtgtgcacctatggtcccagctacttggggagctgaggtgtgaagattgcttgagcccgggaggtggaggttgctgtgagctgagattgagccactgccctccagactgggcaacacagcaagaccctgtctcaaaaatacacacacacacacacacacacacacacacacacacattgtaaataatcacttgaaaagatgctcaatattctatgtcactagagaaaagcaaattagaactgaaataaggtatcaattttgttactacccatgaagatgtctaaattttaaagattgtccataacaagtgttagt

SEQ ID NO: 18121 - DNA, 413 bp, Homo sapiens
  AP000801.2_44954
  Located on chromosome 11
  Distance between a terminus base of telomere on chromosomal short arm and 5'-terminus of this base sequence : 131328140
  Distance between 3'-terminus of neighbour sequence of sequence listing upward to telomere on chrosomal short arm and 5'-terminus of this base sequence : 181528
tttaatgctttaatgtgtaggaagagtatagtgtcctgttttgcacagaaaggcattctgtaaataataagttgccttaattttcctgtaatgttcattatattgttgtgggaaggtatttactcctattattaaaaataaaaatgtgtaaaatttactacctgaagataacagttcaaattttgatggaaaaatcaacctatgcttgtgtgtgtgtgtgtgtgtgtgtgtgtgtgtaatgtgtacagtgtgtgtggttgttgagataagcataattatataaaaatatgtgtgtgtgtgtttaatgtgtacagtgtgtgtggttgttgagataagcataattatataaaaatacataaaatatgtacacttcaatgtgcagttgtaaagttaacattcacttaaccacaact

SEQ ID NO: 18122 - DNA, 116 bp, Homo sapiens
  chr11.fa.O7frz.143485773
  Located on chromosome 11
  Distance between a terminus base of telomere on chromosomal short arm and 5'-terminus of this base sequence : 131350087
  Distance between 3'-terminus of neighbour sequence of sequence listing upward to telomere on chrosomal short arm and 5'-terminus of this base sequence : 21534
gcaaagttgctataagctattaaggtaaaaaaaaaaaagtctaggcatattatatatatatatatatatagacacacacacatatatgaattgtatccttgtgacataccatttac

SEQ ID NO: 18123 - DNA, 340 bp, Homo sapiens
  chr11.fa.O7frz.143881883
  Located on chromosome 11
  Distance between a terminus base of telomere on chromosomal short arm and 5'-terminus of this base sequence : 131513018
  Distance between 3'-terminus of neighbour sequence of sequence listing upward to telomere on chrosomal short arm and 5'-terminus of this base sequence : 162815
cgacagagcaagactctatctcaaaaacaaacaaacaaacaaacaaacaaacaaaaaaccactttccattctattccattgtctattcatgctatggtctgaatgtttgtgtcccaccaaaattcatatgcagaaacctaatccccagtgcaatagcattaagaggtagggcccttcagagatgattatgtcataaggatggggccctaatgaataggattgctgtccttatgaaagaggccagagagagcttgtttgcccctgccaccatgtgaggacacaacaagaaggcatcatctggaaagcagagggtgagccctcaccaaacatgtaatctgtt

SEQ ID NO: 18124 - DNA, 191 bp, Homo sapiens
  DISO7_00032480
  Located on chromosome 11
  Distance between a terminus base of telomere on chromosomal short arm and 5'-terminus of this base sequence : 131786109
  Distance between 3'-terminus of neighbour sequence of sequence listing upward to telomere on chrosomal short arm and 5'-terminus of this base sequence : 272751
tcagccagtccctacctctggcctgtggctgagggtggacagggagtcaggagggtctctgttttgccttcctcctctctctctctctctctctctctgtctctcactctctcctgaagatagggaatatataaccaatctataacctggaagactgaggacaggagactaggaggcagtggacttcagtc

SEQ ID NO: 18125 - DNA, 337 bp, Homo sapiens
  AP001893.3_70423
  Located on chromosome 11
  Distance between a terminus base of telomere on chromosomal short arm and 5'-terminus of this base sequence : 131829651
  Distance between 3'-terminus of neighbour sequence of sequence listing upward to telomere on chrosomal short arm and 5'-terminus of this base sequence : 43351
attcagacacttgagtcacttaagtggcaggtttccatgaaaattaggtttctatttttttaataaaagaaaggaatatgtgtgtgagagcctgtgtgtatggtgtcttgcacaagtgagtgtttgtgtgagtctgtgtgtggacagcaacccgcaagagtgtgtgggtttgagaccgtctgtgtatggcatcttgcatgagtgtgtgtgtgtgtgtgtgtgtgtgtgtgtgtgtgcgcgcgcgcgcacctgtgtatggtgtcttgtataagtgtttttgtatggtatcttgcatgagtgtgcgagagaccgtctgtgtatagtgtcttgcgtgagt

SEQ ID NO: 18126 - DNA, 180 bp, Homo sapiens
  D11S934
  Located on chromosome 11
  Distance between a terminus base of telomere on chromosomal short arm and 5'-terminus of this base sequence : 131881142
  Distance between 3'-terminus of neighbour sequence of sequence listing upward to telomere on chrosomal short arm and 5'-terminus of this base sequence : 51154
gctgtccctgacaactacatgcaacatctgttgaaagacatttgaaggtccactaaattccagtcactctggggttgtatgttacatatactccaacatacatacacacacacacacacacacacacacacacccccttttttcttatgtatcattttctcattcccagttctgatggaa

SEQ ID NO: 18127 - DNA, 159 bp, Homo sapiens
  Z17119.1_105
  Located on chromosome 11
  Distance between a terminus base of telomere on chromosomal short arm and 5'-terminus of this base sequence : 131881175
  Distance between 3'-terminus of neighbour sequence of sequence listing upward to telomere on chrosomal short arm and 5'-terminus of this base sequence : -147
aaagacatttgaaggtccactaaattccagtcactctggggttgtatgttacatatactccaacatacatacacacacacacacacacacacacacacacccccttttttcttatgtatcattttctcattcccagttctgatggaagataacctttag

SEQ ID NO: 18128 - DNA, 150 bp, Homo sapiens
  D11S4151
  Located on chromosome 11
  Distance between a terminus base of telomere on chromosomal short arm and 5'-terminus of this base sequence : 132193106
  Distance between 3'-terminus of neighbour sequence of sequence listing upward to telomere on chrosomal short arm and 5'-terminus of this base sequence : 311772
aatgggcacctccaccctattagtgcacactctgtgtgtgtgtgtgtgtgtgtgtgtgtgtgtgtgtgtgtgtagcaggagcaaggggcagggtcagctgtgctgaggactaggaggtaaatggtctacgcatatccaaggtgggaagac

SEQ ID NO: 18129 - DNA, 101 bp, Homo sapiens
  DISO7_10003195
  Located on chromosome 11
  Distance between a terminus base of telomere on chromosomal short arm and 5'-terminus of this base sequence : 132329734
  Distance between 3'-terminus of neighbour sequence of sequence listing upward to telomere on chrosomal short arm and 5'-terminus of this base sequence : 136478
tacatatgcatgcaggtgtgtgcattgtgtgtgtatgtgtgtgtgcatgctcatgtgtgtgttggagatgtggctgaggaaccagtgagagtaaactggat

SEQ ID NO: 18130 - DNA, 105 bp, Homo sapiens
  DISO7_10003198
  Located on chromosome 11
  Distance between a terminus base of telomere on chromosomal short arm and 5'-terminus of this base sequence : 132401933
  Distance between 3'-terminus of neighbour sequence of sequence listing upward to telomere on chrosomal short arm and 5'-terminus of this base sequence : 72098
tcagttgtctgtgcaatcagtctgtatgtatgtattcattcattcattcattcattcattcattcattcattctgctatgtattcagcaacctctaggtgccaca

SEQ ID NO: 18131 - DNA, 239 bp, Homo sapiens
  AP001783.3_163494
  Located on chromosome 11
  Distance between a terminus base of telomere on chromosomal short arm and 5'-terminus of this base sequence : 132464312
  Distance between 3'-terminus of neighbour sequence of sequence listing upward to telomere on chrosomal short arm and 5'-terminus of this base sequence : 62274
agaatgcatctgaaagtcaacaaggagagaaagagactctgccggcatgccgtaaaagcgtgcaagtcatggcaggggaacacataagtgtgttacatctgtatgcacatgcatgtgagtgcctgtgaccacacacacacacacacacacacacccatagtcagaggaagcctcaaatcaggctgagtttccgaagggaaaatctcatttgtccaccagtgatagcgtatgtagccttc

SEQ ID NO: 18132 - DNA, 375 bp, Homo sapiens
  AC068865.2_80589
  Located on chromosome 11
  Distance between a terminus base of telomere on chromosomal short arm and 5'-terminus of this base sequence : 132624755
  Distance between 3'-terminus of neighbour sequence of sequence listing upward to telomere on chrosomal short arm and 5'-terminus of this base sequence : 160204
atacatggtgactgatcttcaaggttaattattcaaccctttgcatcaacaagtagtgcacatgaatcatctcatgggagtctcctcttacagcattcagggaaaagggttctccagtcttgattgtggatcttttttttttctttttagtaaaaacaaagctcctgttaacatatggcctaaactcttccagtaataagtttcttgtgtgtgtgtgtgtgtgtgtgtgtgtgtgtgtatgtggtgtgtggttttttgtttttctatttttctcttaatagttgatacttctttttaaaaattgtgttaaaatgcactaaaataaaatttatgatttaaactattttaatggtagagttcagtggcattaagtac

SEQ ID NO: 18133 - DNA, 420 bp, Homo sapiens
  chr11.fa.O7frz.145501470
  Located on chromosome 11
  Distance between a terminus base of telomere on chromosomal short arm and 5'-terminus of this base sequence : 132795741
  Distance between 3'-terminus of neighbour sequence of sequence listing upward to telomere on chrosomal short arm and 5'-terminus of this base sequence : 170611
agatgtctatttactccagtggtaactctggttttagttagactaaaagggttgaacttgagctgggtctcaaaagagaggtacaatttggagattgtctcagaaggcggggtgtgtgtgtgtgtgtgtgtgtgtgtgtgtgtgtgtgtgtaagaggggtagcaaatcaaaacccaggtggatcttgacaaaggcctgatagttgcagaaatgagactctcatgaatgaaggaaaataaaatagaatagaggacacagagggtctcatatgaggaatgatgttaaatttattgaaaggcagcgtagtaaagattctggccttacgctacttggatgaaattctggctctgtcatgtatccacttttggcaaatcatttaacctccaaactttagtttccttatctatggtagctacttca

SEQ ID NO: 18134 - DNA, 109 bp, Homo sapiens
  D11S4110
  Located on chromosome 11
  Distance between a terminus base of telomere on chromosomal short arm and 5'-terminus of this base sequence : 132872610
  Distance between 3'-terminus of neighbour sequence of sequence listing upward to telomere on chrosomal short arm and 5'-terminus of this base sequence : 76449
gtttgtggcagagccctaaggtgagggttgtgtgtgtgtgtgtgtgtgtgtgtgtgtgtgtgtgtgtgtgtgtgtgtacagaggagaaaggtaggtactgggaggctca

SEQ ID NO: 18135 - DNA, 347 bp, Homo sapiens
  AC074180.2_45799
  Located on chromosome 11
  Distance between a terminus base of telomere on chromosomal short arm and 5'-terminus of this base sequence : 133177172
  Distance between 3'-terminus of neighbour sequence of sequence listing upward to telomere on chrosomal short arm and 5'-terminus of this base sequence : 304453
aactctattagaaccttggctaacttttcatctgattctatattacttctgaattttatgtagttttctatggaataccccaccacgatgtggtccctctctccttctctctcactttctcttttatgcacacacacacacacactctctctctctctctctctctctctcacatacaggaatgatggctttaaattcaataattgttgccagaagaaagtcttcactgaatccccagatgtccaggctgagtaggaaacctttttcctatgctcttagaaaatgagatcccttacatttttatataaatgttaaaatcagtttgtcaattttggtaaagaaatcag

SEQ ID NO: 18136 - DNA, 362 bp, Homo sapiens
  AC074180.2_147682
  Located on chromosome 11
  Distance between a terminus base of telomere on chromosomal short arm and 5'-terminus of this base sequence : 133205259
  Distance between 3'-terminus of neighbour sequence of sequence listing upward to telomere on chrosomal short arm and 5'-terminus of this base sequence : 27740
atttctccattcatcctaaactgctgaaattaggctaaacaaatcactagattaaaaaaaatgacaccgtgcttctcttatccttattcgccactcatctctccctctctctctctctctctctctctctctgtctcacattttaaaaaactatataccatttttatcaggccacctgaatttcttccctctttgtcttctaaaatgcactcatctctctatatgctctctttaaatttatactttgacttctaggtctacactcttgattccctcccaccctattttcaacaactggggccttccagcaaggtaattgaaagtattaatgggttttataacactaagatccagattaccat

SEQ ID NO: 18137 - DNA, 278 bp, Homo sapiens
  chr11.fa.O7frz.145967585
  Located on chromosome 11
  Distance between a terminus base of telomere on chromosomal short arm and 5'-terminus of this base sequence : 133321551
  Distance between 3'-terminus of neighbour sequence of sequence listing upward to telomere on chrosomal short arm and 5'-terminus of this base sequence : 115930
ttcaacttggtagaaagtttgttgttaataaactctagaagttaaatagactgtgaaataattctatttttaaaatcttgctctatgtgaaatctgaagggatttgtcatggggagataatgattgacactttggtggctaaggaagctaaaataaattttctctgattgggaaagagagattcgtaaaccctatttcattcattcattcattcattcatccaagttatggacagaaatccatatatgggcaatatctctgaattctgaacatccata

SEQ ID NO: 18138 - DNA, 393 bp, Homo sapiens
  chr11.fa.O7frz.146089363
  Located on chromosome 11
  Distance between a terminus base of telomere on chromosomal short arm and 5'-terminus of this base sequence : 133443236
  Distance between 3'-terminus of neighbour sequence of sequence listing upward to telomere on chrosomal short arm and 5'-terminus of this base sequence : 121407
gagtctaaagagatctggtgactaaacacaatgtgttgtcctggaatagaaaacagacatttccttggtaatttccaaggaaatcagagtaaaatatgcactttaaccaataataatgtattcatattggtttattaaatgtgacaaatataccatactaatgtaaaatgttatcaggaaacaaatgatggagtacaaggaaagtctcattttctcctattaaaaacaacattccttcttttctccatcgctttgaaatatcacctttatagttctctaaatcctctagatgtgtgtgtgtgtgtgtgtgtgtgtgtgtgtgtgtgtgtgtggggatatcctttaatccattgatctatttatgtatcagtgacaaatgattgactacaattt

SEQ ID NO: 18139 - DNA, 466 bp, Homo sapiens
  chr11.fa.O7frz.144437066
  Located on chromosome 11
  Distance between a terminus base of telomere on chromosomal short arm and 5'-terminus of this base sequence : 133584809
  Distance between 3'-terminus of neighbour sequence of sequence listing upward to telomere on chrosomal short arm and 5'-terminus of this base sequence : 141180
gaggattgaaggattaagttacttggccaaggtcatacagctcgtaagcagctgagctaggactcaaatccaggcttgcttccaaaaccttcacttttcagcccagttctcaactgccccctggagtttgctcattttgccccatgaagaaacagatcccagctcaaaggcgtgaaggggtttgctcaaggccacagtgtattagtgtcaaaggtggaacacaaaccctgacctctgagtgctctcccgaaccccacatcccggccgggccgtaccctgagcacacgcttgtccgctttctcagctgggcggggcggggcaggacaaggttcttctccctccctccttccctccttccctccttccctccttccccgtgggccctcccagcctccccagcccccacctctgctgctttcccttggcaattgcttccatctggcctgcctgcagctcctattccttt

SEQ ID NO: 18140 - DNA, 229 bp, Homo sapiens
  D11S4123
  Located on chromosome 11
  Distance between a terminus base of telomere on chromosomal short arm and 5'-terminus of this base sequence : 133747695
  Distance between 3'-terminus of neighbour sequence of sequence listing upward to telomere on chrosomal short arm and 5'-terminus of this base sequence : 162420
cataatcataaatcttgcctttggaccacagaaacagcacgcgtgcacacacacacacacacacacacacacgcatgcatgcacacacacacacacatccagcaatcatccctgcttttgctaagaatggcttaggcacatttcatcataaaggaagaacatataatgacaatgttcttcacaggctctcctgtgaggccgcgataccctccaatttgaagtgtgtgtg

SEQ ID NO: 18141 - DNA, 448 bp, Homo sapiens
  Y17293.1_25939
  Located on chromosome 11
  Distance between a terminus base of telomere on chromosomal short arm and 5'-terminus of this base sequence : 133753300
  Distance between 3'-terminus of neighbour sequence of sequence listing upward to telomere on chrosomal short arm and 5'-terminus of this base sequence : 5376
acaggcttaatcgtctctagaggccaggcccgatgttgggagataaatgccggcaccacctgaatgaggtcctggcagcgtgtgtttgcctggatactacagttaattcatttcagaagaggggttgctacccagcaagagggagctgctcctgcaataagcctgaatgagccagcagtgttacaaatgtcctccctaaacacaaaagggccaagggaaggaaatgtgtatggcaggtagaggacacggctgaacaataagacagcaggaggaggaggaggaggaggaggaggaggaggaggaggaggaggaggagatggttagcaacacatttcaacttggctaaaccagtttctaaactaaaccctatatctgaagcccaatatcagaaaatatttcattagctctgcttcagagcctcactggctaattctgatgttggtagcag

SEQ ID NO: 18142 - DNA, 115 bp, Homo sapiens
  DISO7_10002707
  Located on chromosome 11
  Distance between a terminus base of telomere on chromosomal short arm and 5'-terminus of this base sequence : 133765720
  Distance between 3'-terminus of neighbour sequence of sequence listing upward to telomere on chrosomal short arm and 5'-terminus of this base sequence : 11972
aggacactcatacctcctcctccttctcagtgtgtgtatgtgtgtgtgtgtgtgtgtgtgtgtgtgtgtgtgtgtgtgtgtgtgtgtggtggggatgttgcactttcagcacaag

SEQ ID NO: 18143 - DNA, 309 bp, Homo sapiens
  AP001122.3_188376
  Located on chromosome 11
  Distance between a terminus base of telomere on chromosomal short arm and 5'-terminus of this base sequence : 133838977
  Distance between 3'-terminus of neighbour sequence of sequence listing upward to telomere on chrosomal short arm and 5'-terminus of this base sequence : 73142
aattcaagatggtagtgatacaattttatttatttttcattaaataccagaggtgtctttagtgtaaagtgccaaattctttatgatttttcttttaaagacttctctctctctctctctctctcacacacacacacacacacacacgcaaacacatacacacactgcctccacgattctataattcataaaaatgtaacaaaagcaaatgatattttcatggtatagtggaaagaacactggcctaagggtgcagagccctgaactttcactatgactctgttggtagttagctgtatgatcttggac

SEQ ID NO: 18144 - DNA, 335 bp, Homo sapiens
  chr11.fa.O7frz.146917806
  Located on chromosome 11
  Distance between a terminus base of telomere on chromosomal short arm and 5'-terminus of this base sequence : 133962359
  Distance between 3'-terminus of neighbour sequence of sequence listing upward to telomere on chrosomal short arm and 5'-terminus of this base sequence : 123073
actaacaaaggacgcctattacatgattgttggataaatacaatcgtactcccttaactgtggttttgccttccgaggtttcagttactctccgtcaaccaaggtctgaaaataggtgagtacagtacagtaagatattttgagagagagagagagagagaaaccacattcaataacttttatcacagtatattgttataattgttctagtcatgtattagttattgttgttaatctcttactgcgtctaatgtataagttaaactttatcataggtgtgtatgtataggaaaacacatagtatgtatggggttctgtactatctgaggtttcag

SEQ ID NO: 18145 - DNA, 156 bp, Homo sapiens
  D11S4091
  Located on chromosome 11
  Distance between a terminus base of telomere on chromosomal short arm and 5'-terminus of this base sequence : 134140867
  Distance between 3'-terminus of neighbour sequence of sequence listing upward to telomere on chrosomal short arm and 5'-terminus of this base sequence : 178173
ttagagagcatgtgttcccctaagcccagtttgtttgagtagtgtgtgtgtgtgtgtgtgtgtgtgttagtgtgtgtgtgtgcatactgaaattacttgtgaagatttttttcaaaacatgcatgcctggacctcagggtctgacgacctaattca

SEQ ID NO: 18146 - DNA, 266 bp, Homo sapiens
  D11S1351
  Located on chromosome 11
  Distance between a terminus base of telomere on chromosomal short arm and 5'-terminus of this base sequence : 134265373
  Distance between 3'-terminus of neighbour sequence of sequence listing upward to telomere on chrosomal short arm and 5'-terminus of this base sequence : 124350
caaaacccagaaagatagaaaataagagcctgtcagtgactgtattgggtattttttgttttagttataaaagcaatacaagttcattatagaggaaaagcacacgcgcgcgcgcacacacacacacacacacacacacacacacacacacacactcttaacaggacacagagtatgaaataaaagacaggtctgtacaggtcccttcaccacccaacttacatatataagtgagatcatactatacattttgtatttccacttgc

SEQ ID NO: 18147 - DNA, 315 bp, Homo sapiens
  HUMUT6027
  Located on chromosome 11
  Distance between a terminus base of telomere on chromosomal short arm and 5'-terminus of this base sequence : 134455634
  Distance between 3'-terminus of neighbour sequence of sequence listing upward to telomere on chrosomal short arm and 5'-terminus of this base sequence : 189995
aggctacaattctatgcacaaaaatcaatagcatttcttcctttctttcctttctttttctttctttcctttctttttctttcttttttctttctttcatctttctctttttctttcatctttctttctctctcttctttccttccttccttccttccttcattccttccttccttccttccttccttccttccttccttctttcttcttgatggagtcccactctgtcacccagattggagtgcagtagtgcgatcttggctcactgcaacctccacctcccgggtttaagcgattctcctgtctcagcctttc

SEQ ID NO: 18148 - DNA, 266 bp, Homo sapiens
  AP001000.3_8326
  Located on chromosome 11
  Distance between a terminus base of telomere on chromosomal short arm and 5'-terminus of this base sequence : 134589082
  Distance between 3'-terminus of neighbour sequence of sequence listing upward to telomere on chrosomal short arm and 5'-terminus of this base sequence : 133133
cttggagacatttactgtttctacttcagatgggacacagctaagccattcccacaaaagcactgcgcccatggcaaaagccactgcagatcttcttgttccacttttaaatctctctgtctctctctctgtctctgtctctgtctctctctctctctctctctctctctcacacacacacacacacagctaaccaacctcttacccctctttcattcagtcaggaaaaattatttagcattaactagattagctgccaggtctat

SEQ ID NO: 18149 - DNA, 409 bp, Homo sapiens
  AC009546.3_8074
  Located on chromosome 11
  Distance between a terminus base of telomere on chromosomal short arm and 5'-terminus of this base sequence : 134600405
  Distance between 3'-terminus of neighbour sequence of sequence listing upward to telomere on chrosomal short arm and 5'-terminus of this base sequence : 11057
acagattgatatgctgtatcagacttttaaagtggttcatggcacaaagaagcttaataacccttgtatattgtaacttcaaacaaaagaaaacaaagcaaaaatcagttttgtttagtttatccgccaacttgttctgtgtaggttttgtggtgttattttcatttgcttcaactaaactagaaaaataacatgctcctgtttattatgtacttctgtatattcttattgtgtattctatattattttcctcctcagctaacacacacacacacacacacacacacacacacacacgtctttctttttgaaaagaattctcagtgttttaaagtatcacagttaggccacaagggaagagatgtgaatattttaggacttctcaacatgaacttaagccacatgtaga

SEQ ID NO: 18150 - DNA, 472 bp, Homo sapiens
  chr11.fa.O7frz.146293439
  Located on chromosome 11
  Distance between a terminus base of telomere on chromosomal short arm and 5'-terminus of this base sequence : 134643458
  Distance between 3'-terminus of neighbour sequence of sequence listing upward to telomere on chrosomal short arm and 5'-terminus of this base sequence : 42644
gaatcaatgttaaatctatgttgataccatacccattcatttgctattttgtttgtttgtttgtttgtttgtttgagacaatggcttgctctgtcgccaggctggagtgcagtggcactatctcggctcacagcaagctccacctcccgggttcacgccattctcctgtctcagcctcctgagtagctgggactattctcgcatgccaccacgcccagctaatttttgtatttttagtagagacagagtttcaccatgtgagccaagatggtctagatctcttgaccttgtgatcctcccaccttggcctcccacagtgctgggattacaggagtcagccaccgttcccgaccggccccatttgcatttttttttttactaggagaagaaagggttgaagcttaagatctgactagtgccctggacattgtatagatgtataccattccagtttatatgcgtgacatcactt

SEQ ID NO: 18151 - DNA, 405 bp, Homo sapiens
  AP001535.2_94421
  Located on chromosome 11
  Distance between a terminus base of telomere on chromosomal short arm and 5'-terminus of this base sequence : 134759985
  Distance between 3'-terminus of neighbour sequence of sequence listing upward to telomere on chrosomal short arm and 5'-terminus of this base sequence : 116055
atactgtgaggtaatctcctgttatttttagggagtaaataacatctctcatgcagcaggttgtgtgaccccacaggccccatctacgtcagctcacacacacttcaaattggagggtatcgcggcctcacaggagagcctgtgaagaacattgtcattatatgttcttcctttatgatgaaatgtgcctaagccattcttagcaaaagcagggatgattgctggatgtgtgtgtgtgtgcatgcattcgtgtgtgtgtgtgtgtgtgtgtgtgtgtgtgtgcacgcgcgctgtttctgtggtccaaaggaaagatttatgattatgggatagacagtagcttgctctctctattttattttttaaaaactgttttcctttgaaattcctgagttaaagttctgt

SEQ ID NO: 18152 - DNA, 241 bp, Homo sapiens
  D11S4150
  Located on chromosome 11
  Distance between a terminus base of telomere on chromosomal short arm and 5'-terminus of this base sequence : 134847195
  Distance between 3'-terminus of neighbour sequence of sequence listing upward to telomere on chrosomal short arm and 5'-terminus of this base sequence : 86805
tctccctgttgtggggtcctgtgggcagaggtacctaagccatcctgtcccttcactcgcggccccttgggtcactccctttctctagcgagagcagctggaacaatctctctctctctctctctctctctctctctctctgtgtgtgtgtgtgtgtgtgtgtgtgtgtgtgtgtgtgtgtgtcccctcctccctctcctctctccctccgtcctggtacaaatgaatctctgggtagtaa

SEQ ID NO: 18153 - DNA, 377 bp, Homo sapiens
  AP000751.3_184511
  Located on chromosome 11
  Distance between a terminus base of telomere on chromosomal short arm and 5'-terminus of this base sequence : 134917393
  Distance between 3'-terminus of neighbour sequence of sequence listing upward to telomere on chrosomal short arm and 5'-terminus of this base sequence : 69957
actaacaggaaaggatttcaacacttctatgaaagaaaacagtaatgtctcaaaagccttaaaacagttacaagaaaaattccaataggcatcaaggggagaatatttgagcaaaggatatgcttttgaaataaagagcctaattcaaatcctcatattctggtttatcttgactacttaaaatttgctttacttaaacaattccacatatattgtgattaaacaatagggaagagtacttttgaaaacaagacatgatcaccttaaatgtaagttaaaccaggtaagtgccgtgtgtgtgtgtgtgtgtgtgtgtgtgtgtgtgtctgtgcgcatgcacacacagaggtattatctatcacctagcatgtctcaaa

SEQ ID NO: 18154 - DNA, 256 bp, Homo sapiens
  DISO7_10003199
  Located on chromosome 11
  Distance between a terminus base of telomere on chromosomal short arm and 5'-terminus of this base sequence : 134920869
  Distance between 3'-terminus of neighbour sequence of sequence listing upward to telomere on chrosomal short arm and 5'-terminus of this base sequence : 3099
ccaagtttagtcagccatccctttgtccatccattcattcattcaacctttaagtacctatggaatgctaaacagtgtgccaggccctggggatctaaggacaaatgaatatctatacataaacatatacatatacatataggtacacatacatatagtgtgtgtgtgtgtgcgtgtgtgtgtgtgtgtgtgtgtgtgtgtatatatatatatatatatatatatatgaaatggaagtttaattagaactccaagg

SEQ ID NO: 18155 - DNA, 196 bp, Homo sapiens
  DISO7_10003203
  Located on chromosome 11
  Distance between a terminus base of telomere on chromosomal short arm and 5'-terminus of this base sequence : 135127458
  Distance between 3'-terminus of neighbour sequence of sequence listing upward to telomere on chrosomal short arm and 5'-terminus of this base sequence : 206333
tcatacccatgcataaggcaaacaaagcaggcaggcaggcaggcacgcacacacacacacacacacacacaccacattccaagaaaaagaggaagaaaaatctattagatacaaattcagatcaaatctatttgatacaaatcagatacaggaaggggtagtagttcattatgagtgtctacttgaaattcctgaa

SEQ ID NO: 18156 - DNA, 101 bp, Homo sapiens
  DISD22_0006605
  Located on chromosome 11
  Distance between a terminus base of telomere on chromosomal short arm and 5'-terminus of this base sequence : 135220056
  Distance between 3'-terminus of neighbour sequence of sequence listing upward to telomere on chrosomal short arm and 5'-terminus of this base sequence : 92402
tgtgacagtggtgagaagttgctattactcataagcgcgcacacacacacacacacacacacacacacacacactttactgtaaacacattgaatgctcca

SEQ ID NO: 18157 - DNA, 101 bp, Homo sapiens
  DISO7_10003208
  Located on chromosome 11
  Distance between a terminus base of telomere on chromosomal short arm and 5'-terminus of this base sequence : 135615998
  Distance between 3'-terminus of neighbour sequence of sequence listing upward to telomere on chrosomal short arm and 5'-terminus of this base sequence : 395841
gatggacaggaggctgaggactctgtgtgtgtgtgtgtgtgtgtgtgtgtgtgcgcgtgtgtgtgtgtctgtgtgtgtcagcctcctgaagcaagcttagc

SEQ ID NO: 18158 - DNA, 327 bp, Homo sapiens
  chr11.fa.O7frz.148091061
  Located on chromosome 11
  Distance between a terminus base of telomere on chromosomal short arm and 5'-terminus of this base sequence : 135713720
  Distance between 3'-terminus of neighbour sequence of sequence listing upward to telomere on chrosomal short arm and 5'-terminus of this base sequence : 97621
aactgtcaaacttgaaattaagacaactgaaattatccagtttgaagaggtgaaagaaaaagaataaagaaaataaacagaacctgagggatctgtgggacaccatcaaacacacacacacacacacacacacacacacacacacatagatatataaagatataggttagatataaatatagatatatcatgagcactccagaagaagagggaaaggggcagagacattatttgtaaactaatggcccggaattccccaaatatgataaaaagacatgaaaatatacatgttcaaaaagttcaatgaacttcaagcaggataaactc

SEQ ID NO: 18159 - DNA, 263 bp, Homo sapiens
  DISD22_0007567
  Located on chromosome 11
  Distance between a terminus base of telomere on chromosomal short arm and 5'-terminus of this base sequence : 135873074
  Distance between 3'-terminus of neighbour sequence of sequence listing upward to telomere on chrosomal short arm and 5'-terminus of this base sequence : 159027
agagtggcttatttagtccattcatatatattaatggcttattttgtgtgtgtgtatgtgtgtgtgtgtgtgtgtgtgtgtgtatgcatgaaggaaggggtaggaaatagagctattatagatgtgtgtgtgtgtgtgtgtgtgtgtgtgtgtatgcatgaaggaaggggtaggaaatagagctattatatattggaacaaagtcactatattttatcagaattaagttactattaaaatagaccatggtaacttcaagatgc

SEQ ID NO: 18160 - DNA, 122 bp, Homo sapiens
  DISD22_0007572
  Located on chromosome 11
  Distance between a terminus base of telomere on chromosomal short arm and 5'-terminus of this base sequence : 135951481
  Distance between 3'-terminus of neighbour sequence of sequence listing upward to telomere on chrosomal short arm and 5'-terminus of this base sequence : 78144
agccttagaaatccgaacctccccgatgacttgaaacgtgagagagagagagagagagagagagagagagagagagagagagagagagtgcttgcttggtcaaagccctgatcacttgaagc

SEQ ID NO: 18161 - DNA, 342 bp, Homo sapiens
  chr11.fa.O7frz.148594398
  Located on chromosome 11
  Distance between a terminus base of telomere on chromosomal short arm and 5'-terminus of this base sequence : 136233489
  Distance between 3'-terminus of neighbour sequence of sequence listing upward to telomere on chrosomal short arm and 5'-terminus of this base sequence : 281886
cgtggctataatctcagctactcaggaggctgcggcacaagaatcacttgaacccgggaggcagaggttgtagtgagcccagatcacaccactgcactctagcctgggcaacagagcaagactctgtcaaaaagaaagaaagagaggaaggaaggaaggaaggaaggaaagaaggaaggaaggaaggaaggaaggaaggaaggaaggaaggaagaaggggaaggggaaggaaagggaaagggaaggggaaggggaaggaaggaaagaaaggaaagaaagaaaagactttgcgggtgatagtgggggtgtgcagaatggggtatgacagccacctttaattat

SEQ ID NO: 18162 - DNA, 277 bp, Homo sapiens
  DISO7_00032592
  Located on chromosome 11
  Distance between a terminus base of telomere on chromosomal short arm and 5'-terminus of this base sequence : 136343288
  Distance between 3'-terminus of neighbour sequence of sequence listing upward to telomere on chrosomal short arm and 5'-terminus of this base sequence : 109457
gaggccgcttacgtaaagcccaggggacattcaacagcccctactacccaggccactacccacccaacattgactgcacatggaacattgaggtaggagctatggggcgtgtgaacgtgtgtgtgtgtgagcatgtatgtgcacgtgtgtgtgtctccctgtgcagatgtgtgtggatgtgtgtgcatgtgtttgcatatgtgtgcatgtgtgtgtgtgtgtgtgtgtgtgcgtatgtgtgtgtgtgagacagaggtggatggcaaatgaggaagac

SEQ ID NO: 18163 - DNA, 192 bp, Homo sapiens
  DISD22_0007582
  Located on chromosome 11
  Distance between a terminus base of telomere on chromosomal short arm and 5'-terminus of this base sequence : 136462524
  Distance between 3'-terminus of neighbour sequence of sequence listing upward to telomere on chrosomal short arm and 5'-terminus of this base sequence : 118959
gatcctcaggaaggaaaggaaaagaggtgtgtgtgtgtgtgtatgtgtgtgtgtgtttgtgtgtgtgtatatatatatatatatatttttttaaagaagtgccatctttttctttctgtaccagagaaaaagcagaaggggaaaggaggaaaaaaaacaggtctgagcctcccgggttcgaccaggtgagag

SEQ ID NO: 18164 - DNA, 447 bp, Homo sapiens
  AC079081.2_46871
  Located on chromosome 11
  Distance between a terminus base of telomere on chromosomal short arm and 5'-terminus of this base sequence : 136769519
  Distance between 3'-terminus of neighbour sequence of sequence listing upward to telomere on chrosomal short arm and 5'-terminus of this base sequence : 306803
caaactggcaaactctgagagtgcaaggaggcattgttagtaattatgctgtgatgacagatgtaaattgaaactggggcaaactagggcatttgatcctcctggttatagggctcagggcaaagcctttgaagggcaagtcatgaggagtttgccttttaaggaaaaatcattcattttggtttaaagtagagaggttctacttccagattttatatatatatatatacacacacacacacacacacacacacacacacacatatatataggaatccctagagtttcctctgtcctctctactgtaagtctttgaacccagtgaaagtaagtaggagagaattaaagacactgtctactgacctcgaaaatcaaaaacatactgtggcaattattctatcgacagcttggctccaagctatttctacatttgtagacctaacatcc

SEQ ID NO: 18165 - DNA, 123 bp, Homo sapiens
  chr11.fa.O7frz.149147922
  Located on chromosome 11
  Distance between a terminus base of telomere on chromosomal short arm and 5'-terminus of this base sequence : 136837534
  Distance between 3'-terminus of neighbour sequence of sequence listing upward to telomere on chrosomal short arm and 5'-terminus of this base sequence : 67568
tacagcaataactggtatggagggtaacaccctcccttgggcataggaactgcagaggtgcatgtgtgcgcacacacacacacacacacacaccatcccatgttgatttagctacttggttga

SEQ ID NO: 18166 - DNA, 119 bp, Homo sapiens
  D11S4126
  Located on chromosome 11
  Distance between a terminus base of telomere on chromosomal short arm and 5'-terminus of this base sequence : 136928742
  Distance between 3'-terminus of neighbour sequence of sequence listing upward to telomere on chrosomal short arm and 5'-terminus of this base sequence : 91085
ttgcagtgagacaaagcaagactccatatatttttttatacacacacacacacacacacacacacacacacacacacaccttatgaatggaaatctaaggaacggcacaggcttctgac

SEQ ID NO: 18167 - DNA, 158 bp, Homo sapiens
  chr11.fa.O7frz.149974699
  Located on chromosome 11
  Distance between a terminus base of telomere on chromosomal short arm and 5'-terminus of this base sequence : 137255381
  Distance between 3'-terminus of neighbour sequence of sequence listing upward to telomere on chrosomal short arm and 5'-terminus of this base sequence : 326520
actgcagtcatctcaatgttacttggcttccccagctctcaagtacacacacacacacacacacacacacacacacacacacacacacacacggccccccctaaatacttcaggaggccttttctctccatccccttagtcttgtctggtgaaataaa

SEQ ID NO: 18168 - DNA, 419 bp, Homo sapiens
  AP002856.2_100952
  Located on chromosome 11
  Distance between a terminus base of telomere on chromosomal short arm and 5'-terminus of this base sequence : 137359560
  Distance between 3'-terminus of neighbour sequence of sequence listing upward to telomere on chrosomal short arm and 5'-terminus of this base sequence : 104021
aaatagtcaatcctgtggtatctaatttcagctggaaaatgtaagccaataaaacattcggttgtggtttgtgggtatgaccaatcaatccatgtccaggaatttgtcttatagtcaagactttggtgatcaagttaaggctgatatcagaagctcactgatacctggggtcaaggctggtgtgtgtgtgtgtgtgtgtgcgtgtgtgtgtgtgtgtgtgtgtgtgtgtttcccccacgggaagagaggaaatcttatgggaattttttaatataatgtacttaattttggttttgaattcttcaaaatgtttttgagattcccaagacttccttcatcagaatctgtactttaacaagatctccacctgattccatgtgtcttctgtgagagaagtatgactgtaaagcactccatat

SEQ ID NO: 18169 - DNA, 465 bp, Homo sapiens
  AP002856.2_14034
  Located on chromosome 11
  Distance between a terminus base of telomere on chromosomal short arm and 5'-terminus of this base sequence : 137529540
  Distance between 3'-terminus of neighbour sequence of sequence listing upward to telomere on chrosomal short arm and 5'-terminus of this base sequence : 169561
tatgcaacaaatgctacatttaaattaaatagtaaaattaagttagaaagataatttttaaaaatcatattcttcatagtattaaagtattcaatcaatcactctgggaaaattatcataataaaaacatattttttcagggagaataatgagtcagtgtagaactatgtactttttctcttcatgagttgtgtgtgtgtgtgtatgtgtgtgtgtgtgtgtgtgtgtgtgtgtgactacatagcaaggaaatttaaactttcttccaaacaaggtgtcacgtttactgaggcctaagcaaaagcatactttctctctgtagagtttttcttataaatgctattctgtcccatctattagagtcctaggaccctagaaccctatcagttttggtgcaggcaaccgaaggtgagggtgctgtgacagaatgagaagtcattggcgtagagtcaaaggaactggttt

SEQ ID NO: 18170 - DNA, 324 bp, Homo sapiens
  chr11.fa.O7frz.149601362
  Located on chromosome 11
  Distance between a terminus base of telomere on chromosomal short arm and 5'-terminus of this base sequence : 137597043
  Distance between 3'-terminus of neighbour sequence of sequence listing upward to telomere on chrosomal short arm and 5'-terminus of this base sequence : 67038
tgcttattgtaggacaattcacaattgcaatgatatggaatcaacctaagtgcccatcaactgatgagagaataaagaacatggtgtgtgtgtgtgtgtgtgtacacacgtgtgtgcacacacgtgtgtgcatcatggaatactactcagccataaaaaaagaaataactcttttgcagcaacttggatggaactggcggccattattctaagtgaagtaacttaggaatgggaagctaaataccacatgttcttacttataagtgggagctaagctatgagtatgcaaaggcatacagagtggtatgatagacattggatact

SEQ ID NO: 18171 - DNA, 327 bp, Homo sapiens
  chr11.fa.O7frz.149529096
  Located on chromosome 11
  Distance between a terminus base of telomere on chromosomal short arm and 5'-terminus of this base sequence : 137664419
  Distance between 3'-terminus of neighbour sequence of sequence listing upward to telomere on chrosomal short arm and 5'-terminus of this base sequence : 67052
gataattaaataccatctgagcactgaagatacatagatagatagatagatagatagatagatagatagatagatagatagatagacggacagacagatcaatccagaattgcgtatttaacaaaacaatttttcacgtgggagacacagagatttcataagaacaagtgccaatagcagcattgcgatcacaacactcagccttgggacagcaatcgggtggatgattaaacctgacatgctcatacacggcaccactatttctgaagcatggcacacactgagtaaacatggagccacctggataggatctgttctttcaaagat

SEQ ID NO: 18172 - DNA, 468 bp, Homo sapiens
  AC009551.4_15172
  Located on chromosome 11
  Distance between a terminus base of telomere on chromosomal short arm and 5'-terminus of this base sequence : 137731193
  Distance between 3'-terminus of neighbour sequence of sequence listing upward to telomere on chrosomal short arm and 5'-terminus of this base sequence : 66447
aatacatggaacactgcataacattctaacactaatcaagaaaaaaagctggaacacaatttgaaaggagcaccattaggcaattttggagcagggcacccaagagaataatggcacaaaattgaaaatgagggacttcttctcaactcattctataaggatagcattactctgatttccaaacaaaagacattacaagaaaaaaaaataaaacacacacacacacacacacacacacacacacatatatacaattggtcttcaacttacaatgattcaacttaccatttttttactttaaaatggtgccaatttatgatggggttatgtccagataaaccaaccataacctgaaaacatcacattgaaaatatacttttgaggccgggtgcagtggctcacgcctgtaatcccagcactttgggaggccgaggtgggtggatcacaaggtcaggagatcgagaccat

SEQ ID NO: 18173 - DNA, 325 bp, Homo sapiens
  AP001890.2_107918
  Located on chromosome 11
  Distance between a terminus base of telomere on chromosomal short arm and 5'-terminus of this base sequence : 137731336
  Distance between 3'-terminus of neighbour sequence of sequence listing upward to telomere on chrosomal short arm and 5'-terminus of this base sequence : -325
caactcattctataaggatagcattactctgatttccaaacaaaagacattacaagaaaaaaaaataaaacacacacacacacacacacacacacacacacatatatacaattggtcttcaacttacaatgattcaacttaccatttttttactttaaaatggtgccaatttatgatggggttatgtccagataaaccaaccataacctgaaaacatcacattgaaaatatacttttgaggccgggtgcagtggctcacgcctgtaatcccagcactttgggaggccgaggtgggtggatcacaaggtcaggagatcgagaccat

SEQ ID NO: 18174 - DNA, 474 bp, Homo sapiens
  AP001890.2_48998
  Located on chromosome 11
  Distance between a terminus base of telomere on chromosomal short arm and 5'-terminus of this base sequence : 137854498
  Distance between 3'-terminus of neighbour sequence of sequence listing upward to telomere on chrosomal short arm and 5'-terminus of this base sequence : 122837
aatattcaatgactgatacgatctctcacggacctaccttatacaattttcacttaagtatttcttaacgttggcacacacacacacacacacacacacacacacacagacaaacacacacacaaaggatttcttagtagatgctacaaggagctctaaggctttgatgacctaaatcttaaggaagtgtagagaggcatccagagaaaatgatctctttggtctcatcttctccacaactgattggagataaggctctgcccaattgtttttcacttgccttcttttggagtttttggcaccctgttcatgtggatggaaggccccagaagcagacatggtgaaatcaaacttcagcctcacctcacataaccagacgcctttatgtatgatgctttggtttttaggtgaacctctaagcgtatgaaatgctacctcttgctttcaataatgtaatagcttgattcctttgct

SEQ ID NO: 18175 - DNA, 411 bp, Homo sapiens
  AC073904.3_125520
  Located on chromosome 11
  Distance between a terminus base of telomere on chromosomal short arm and 5'-terminus of this base sequence : 138082724
  Distance between 3'-terminus of neighbour sequence of sequence listing upward to telomere on chrosomal short arm and 5'-terminus of this base sequence : 227752
tcctggatcaagtatttacagtagatgatgctggtatgaaattcagttgtatggaggttgttagcaaaccaagacattccacggcttttatctccacccagcctaacaaccacccagtgcgtgtagagtaaccatatgaaagaccagagaactgactttaaaactccatttggtctcttccaaactcatgccctcttgtgttttttctctaccctttgtcagaaagataattagtcagcctctctctctctctctctctctctctctctctctctcttccccttcctccctctcattctcccccttattttctcctctaatgaggctgccattatcatatgtgggctaatgtctgtaatatatgagggtacggggaattgaggtatcctttcagtaaatagtgatgtttgg

SEQ ID NO: 18176 - DNA, 464 bp, Homo sapiens
  chr11.fa.O7frz.150515025
  Located on chromosome 11
  Distance between a terminus base of telomere on chromosomal short arm and 5'-terminus of this base sequence : 138098977
  Distance between 3'-terminus of neighbour sequence of sequence listing upward to telomere on chrosomal short arm and 5'-terminus of this base sequence : 15842
attcagtgcaattgatcataagaaaattaaagctagtaaaaatgttccttttagccttatgactacttaccctgtcattaccatcttttatttctctctctctcttcctctccctccatcactctccctctctctctctctgtctctctctgcctccctctctctcacatacacacaagcactcacacatacttatattgaaagttcaagatcatataacctccttaatcacccctttgcctaagcttagacccagtaatgagaacttccagagcatcaattctccctatcatttcagagaaaacattttttctgtttaagagtcacttaaaaaaaaaatgattacaaattttgctttagaattcatgggatacatgtccaggtttgttacttgggtatatcatgtgatggtgaggtttggggaacaattgatcccattactcaggtattgagaatagtatcca

SEQ ID NO: 18177 - DNA, 258 bp, Homo sapiens
  D11S910
  Located on chromosome 11
  Distance between a terminus base of telomere on chromosomal short arm and 5'-terminus of this base sequence : 138121488
  Distance between 3'-terminus of neighbour sequence of sequence listing upward to telomere on chrosomal short arm and 5'-terminus of this base sequence : 22047
tccctgctcataagtcagccctcccgctaatagaaaaaaatattttaatatttttgttgtatggctaacattttcattcaccatggatttttatcccttaataaatctaaggcatgacatttcacattctggctggtctataacatcacatgccctggtgagaatggcgtgtgtgtgtgtgtgtgtgtgtgtgtgtgtgtgtgtgtgtggccaagtggaggtggactcaggggaagccttgcctttgtctgcaaagct

SEQ ID NO: 18178 - DNA, 444 bp, Homo sapiens
  AP002831.1_89546
  Located on chromosome 11
  Distance between a terminus base of telomere on chromosomal short arm and 5'-terminus of this base sequence : 138287244
  Distance between 3'-terminus of neighbour sequence of sequence listing upward to telomere on chrosomal short arm and 5'-terminus of this base sequence : 165498
atgtttgacttactcattgcagaattaaattacgatgtgatattgcggtaatagttatacatggcataaaagaaacgaactcataggaattattcacttaactcgcgggatcagaaaaatgccaatgtactaaatgttagcctaataactatgggcttttggtatgttgtttagaggaaatgacatcagttaatctggcaggatatcgaagtgaaaagtagttaaggggttctaatgtgtatcagtcagattggctaaattatactgcaataacaaatgctcccaatatttcagtagcttacaacaaaggtgagttatatacacatgcatatttagatacatgcacacacacacacacacacacacacatgaacacatacacatacacttacttactggaccaaagcatataggaataggttctatttaggtcatgcagtcttg

SEQ ID NO: 18179 - DNA, 247 bp, Homo sapiens
  Z23726.1_63
  Located on chromosome 11
  Distance between a terminus base of telomere on chromosomal short arm and 5'-terminus of this base sequence : 138350634
  Distance between 3'-terminus of neighbour sequence of sequence listing upward to telomere on chrosomal short arm and 5'-terminus of this base sequence : 62946
aaacagcaggaaatctaacagacaggaattaaggcaccaaatgggaaagtcaattgcttattcgctccaagttttgtatttgaagggaatgttatttgatttggggattccctcattctccctttcttttttctagggggcaagtggaatagtagaatcaattatctcttcacaaacatattttccaggctcactgtgtgtgtgtgtgtgtgtgtgtgtgtgtgtgtgtaaatgctcatttaacctt

SEQ ID NO: 18180 - DNA, 349 bp, Homo sapiens
  chr11.fa.O7frz.137867154
  Located on chromosome 11
  Distance between a terminus base of telomere on chromosomal short arm and 5'-terminus of this base sequence : 138449311
  Distance between 3'-terminus of neighbour sequence of sequence listing upward to telomere on chrosomal short arm and 5'-terminus of this base sequence : 98430
tagcaaatcgttcagaatctacctcctgtggcttcaatgatattgtgcaattgtcaaatcctccaattataacaagcaggcagagaaaggacaagtgaaacagcaactatttagggagatattagtatctcaactagggttcaaatgccaggccctatggttgtaatttcagtgacttgtgaattattcaacatggatgagaatatcttcattagaaaagggagatgtgtgtgtgtgcgtgtgtgtgagaaagagagagaagaaacagagagagagacagagagatagagataaaggagaaacattcatcttttcagaaaacttagagcacctactaagcattaggtat

SEQ ID NO: 18181 - DNA, 278 bp, Homo sapiens
  D11S1895
  Located on chromosome 11
  Distance between a terminus base of telomere on chromosomal short arm and 5'-terminus of this base sequence : 138458786
  Distance between 3'-terminus of neighbour sequence of sequence listing upward to telomere on chrosomal short arm and 5'-terminus of this base sequence : 9126
tccactgaatacatcagagaagcagggccagactggctacccatgccctttctaatctcactgttcaattccttggggaaatatgctactttgaggatgtcttcagtgccttgcttctcttttcttcattttcactggaaaggaggttgctcagatggcgtgtgtgtgtgtgtgtgtgtgtgtgtgtgtgtgcgtgtgcgtgttttaaggattgaatgccctgaaaaaacaagatgagacctagaagtatgttcagcaacaccatatctggcttctct

SEQ ID NO: 18182 - DNA, 401 bp, Homo sapiens
  chr11.fa.O7frz.136879981
  Located on chromosome 11
  Distance between a terminus base of telomere on chromosomal short arm and 5'-terminus of this base sequence : 138537237
  Distance between 3'-terminus of neighbour sequence of sequence listing upward to telomere on chrosomal short arm and 5'-terminus of this base sequence : 78173
ggcagaaactacattgcagccccacccagacacaagagacacaggtggaatgcaagggtgcagggtcatattctccacctctcagtgggaggactgtcaaagtcagtgtggtatggagacaccatccagagatctttggaaaacacattctgtcttagcttcgtaatgctgctttacagttctcctcctttggaatgtctttcttaaccttcatttgggcttctctctctctctctctctctctttactgcttaaatgtcagtaatctccagggtggctctgatacagatcctttctttgttcactctacgctcctctccttgtatttcattcaaccccgcagctataacttacaccaatatgtagctgcaataaacatgtaacaagcagatctgtacagc

SEQ ID NO: 18183 - DNA, 224 bp, Homo sapiens
  chr11.fa.O7frz.137029118
  Located on chromosome 11
  Distance between a terminus base of telomere on chromosomal short arm and 5'-terminus of this base sequence : 138714383
  Distance between 3'-terminus of neighbour sequence of sequence listing upward to telomere on chrosomal short arm and 5'-terminus of this base sequence : 176745
tcctaagccattacatattgatagagactaccgttgtctgtcaaaaaccttctttgtcaaattcattcattcattcattcattcattcattcattcatatgtaaggcataacttactctatagactataatctctgccctcacacagcttacattttagagagaaagcacagacatcagatgacataacagatgatatgcgttagtggttattgactgtcaaac

SEQ ID NO: 18184 - DNA, 319 bp, Homo sapiens
  AP000912.2_20220
  Located on chromosome 11
  Distance between a terminus base of telomere on chromosomal short arm and 5'-terminus of this base sequence : 138779182
  Distance between 3'-terminus of neighbour sequence of sequence listing upward to telomere on chrosomal short arm and 5'-terminus of this base sequence : 64575
aggaataggttgttaatggaatactagagactcattttccttgtatttctatttttttaattgtttcattggaaataattgtcgatccacaggaagttgcaaaaatggtagagataggtacccagtactatcacccatctcccccaatggtgtcatcttatgtaactaaatatatatgtgtgtgtgtgtgtgtgtgtgtgtgtgtatgcatatagtattatatataaagttgtatttataaagttgtatgtgacacattttctttatccagtctatcattgatgggcatttgggttggttccaagtctttgctattgta

SEQ ID NO: 18185 - DNA, 191 bp, Homo sapiens
  D11S4085
  Located on chromosome 11
  Distance between a terminus base of telomere on chromosomal short arm and 5'-terminus of this base sequence : 138965074
  Distance between 3'-terminus of neighbour sequence of sequence listing upward to telomere on chrosomal short arm and 5'-terminus of this base sequence : 185573
gctacaatgcaatatcaatagaaggaagaatgacaaacacacacacacacacacacacacacacacacacacagagagagaaatcctgaaaatgttccattgatctagagcagagaactaactttggatgttgttggcattggagggactgcagaatgctgaaaagacactactctgaaagtcctgtggcc

SEQ ID NO: 18186 - DNA, 428 bp, Homo sapiens
  AP000784.3_20179
  Located on chromosome 11
  Distance between a terminus base of telomere on chromosomal short arm and 5'-terminus of this base sequence : 139014255
  Distance between 3'-terminus of neighbour sequence of sequence listing upward to telomere on chrosomal short arm and 5'-terminus of this base sequence : 48990
atatctttgcctatcctttcactttcagcctatgtttgtctttaatctaaagtgaggtccttgttgacagcaaatagttggaccagttttttgtgtttatgctctcagccactctatgtcttttgattggagaatttaatccatttaaatttaatgtacttatttataatgcataattttctggtgtcattttgttgttttccaactactttgtggtttcttttttcctttcttcctcccttgctgcctttctttgcaatttgatgattgtgtgtgtgtgtgtgtgtgtgtgtgtgtgtgtggtggtggtgggcgtgtgctttccttttttttttatcttttgtgtatctactataggtgtttttgtgattagcatagggcttacatcaaaacatcttgtagttataaccgtctactttaagctgata

SEQ ID NO: 18187 - DNA, 158 bp, Homo sapiens
  DISO7_10003189
  Located on chromosome 11
  Distance between a terminus base of telomere on chromosomal short arm and 5'-terminus of this base sequence : 139187182
  Distance between 3'-terminus of neighbour sequence of sequence listing upward to telomere on chrosomal short arm and 5'-terminus of this base sequence : 172499
aatgatccaaaggagtaactagggaacaatcttttatctttccctccctccctccctccctccctccctcccttccttcttccttccttctttccttcccttccttccttctttccttcctattttaaaaattttcctgaaggataaactgtcttctt

SEQ ID NO: 18188 - DNA, 147 bp, Homo sapiens
  D11S969
  Located on chromosome 11
  Distance between a terminus base of telomere on chromosomal short arm and 5'-terminus of this base sequence : 139443376
  Distance between 3'-terminus of neighbour sequence of sequence listing upward to telomere on chrosomal short arm and 5'-terminus of this base sequence : 256036
ttgatttggaagattttcacatgatctgactttttccttttcatcaacatgactctccccactgctgcctctctctctatctctctctctttcacacacacacacacacacacacacacacacacacttatatacccattctgcccc

SEQ ID NO: 18189 - DNA, 247 bp, Homo sapiens
  D11S1309
  Located on chromosome 11
  Distance between a terminus base of telomere on chromosomal short arm and 5'-terminus of this base sequence : 139537873
  Distance between 3'-terminus of neighbour sequence of sequence listing upward to telomere on chrosomal short arm and 5'-terminus of this base sequence : 94350
actctagcccacaaattaagactctctctgtgtgtgtgtgtgtgtgtgtgtgtgtgtgtgtgtgtgtgtaagagcttttacatttccctctacctcttctttttattaatagccattctcggtataactactttagcccgtgaattaagaatgtgtatgtgtgtgtgtgtgtgctaggtagagagaggcttaagtgtatgtataagaaaatgtataattcctaagcacctgtttctgtgacgaaggg

SEQ ID NO: 18190 - DNA, 473 bp, Homo sapiens
  chr11.fa.O7frz.140190041
  Located on chromosome 11
  Distance between a terminus base of telomere on chromosomal short arm and 5'-terminus of this base sequence : 139609212
  Distance between 3'-terminus of neighbour sequence of sequence listing upward to telomere on chrosomal short arm and 5'-terminus of this base sequence : 71092
catttggatcagtcatgattagacttttatattttcccctcacaaatggaaataaaagagaacaaatgtaattttcctgaggtgactagggagtcttaacgagaagaggaaaagcaggaaaaaatagagttgaggccaggcgcggtggctcactcctgtaatcctagcactttgggaggccaagatgggcgaatcacctgaggtcaggagttcgagaccagcctggtctatatggtgaaaccccatctcaactaaaaatacaaaaatttgctaggcgtagtggcgcacacctgtagtcccagctactggggaggctgaagcaggagaatcacttgaacccgggaggcagaggttgcagtgagccgagatcgcaccactgcactacagcctgggcgacagagtgagactccgtctcaataataataataataataataataataataataataataatactgataggctggacg

SEQ ID NO: 18191 - DNA, 281 bp, Homo sapiens
  chr11.fa.O7frz.140303681
  Located on chromosome 11
  Distance between a terminus base of telomere on chromosomal short arm and 5'-terminus of this base sequence : 139723116
  Distance between 3'-terminus of neighbour sequence of sequence listing upward to telomere on chrosomal short arm and 5'-terminus of this base sequence : 113431
agcattgttaaaggttagcataaagtttcttttttcctttttccctccttcccttcccttccattcccttcccttcccttcccttcccttcccttcccttcccttcccttcccttctcctgctccctccctcactccctcccttccttctttccttcctttcttccttccttcttgtttctgcaaacatatattagggaacattactctcaatctcctatggacaaaagtcacaaagatgagtgtgatgctggtcctatcttcaaagacatgcaattagtc

SEQ ID NO: 18192 - DNA, 151 bp, Homo sapiens
  D11S968
  Located on chromosome 11
  Distance between a terminus base of telomere on chromosomal short arm and 5'-terminus of this base sequence : 139940683
  Distance between 3'-terminus of neighbour sequence of sequence listing upward to telomere on chrosomal short arm and 5'-terminus of this base sequence : 217286
aaggcggatgctggaccaagaggaatgggtgaataatgggtgccatgagtttgcagagaagctgtgtgtgtgtgtgtgtgtgtgtgtgtgtgtgtgtgtgtgtgtgtgtctacagcacacacctgtgaggagataagaaactacaagagcc

SEQ ID NO: 18193 - DNA, 239 bp, Homo sapiens
  Z67178
  Located on chromosome 11
  Distance between a terminus base of telomere on chromosomal short arm and 5'-terminus of this base sequence : 139982301
  Distance between 3'-terminus of neighbour sequence of sequence listing upward to telomere on chrosomal short arm and 5'-terminus of this base sequence : 41467
gagacttgtcagcctccgtaattgcatgagccaataacacacagacacagacacagacacagacacacacacacacacacacacacactcacccgtgctgttgcttctgtttctctggaaaacccaatacagcgatcttccagtagtcttcatcaggctgtgtgtcaaatggaaatgtgttgggggatttgggggttgtcagatgatttaggagagtagacactgctaacatttggggt

SEQ ID NO: 18194 - DNA, 110 bp, Homo sapiens
  DISO7_10003190
  Located on chromosome 11
  Distance between a terminus base of telomere on chromosomal short arm and 5'-terminus of this base sequence : 140141052
  Distance between 3'-terminus of neighbour sequence of sequence listing upward to telomere on chrosomal short arm and 5'-terminus of this base sequence : 158512
agctcctgagctcctcagccccttcacagtaacacacacacacacacacacacacacacacacacacacactaatgggatttgtgctttgcaagcgctagtgatggtact

SEQ ID NO: 18195 - DNA, 245 bp, Homo sapiens
  D11S4125
  Located on chromosome 11
  Distance between a terminus base of telomere on chromosomal short arm and 5'-terminus of this base sequence : 140176888
  Distance between 3'-terminus of neighbour sequence of sequence listing upward to telomere on chrosomal short arm and 5'-terminus of this base sequence : 35726
gaagtcaaaacccctgaagttcaactgcttaaatatattcaggtatatatacacacacacacacacacacacacacacacacacacacacctgaaatgaacagcaatgcattttcacataagattctccagcagacactcaccagtcactttgtcccgggtgctcttaggaagatgctttgcaatatgcccaatcacacagagaatatgtcctaaggtgtttgaattgggattctgctgactaga

SEQ ID NO: 18196 - DNA, 237 bp, Homo sapiens
  chr11.fa.O7frz.138180532
  Located on chromosome 11
  Distance between a terminus base of telomere on chromosomal short arm and 5'-terminus of this base sequence : 140395376
  Distance between 3'-terminus of neighbour sequence of sequence listing upward to telomere on chrosomal short arm and 5'-terminus of this base sequence : 218243
aggattcaatttctatgaggtatccagagtagtaaaattcatagagacagaaactaggatggtggcttgtgggggctgggatgttgtggagaatgggagtcatttaacgggtacagagtttctttctttatatatatatatatatatatatatatatatatatatatatatatatttattatacgttaagttctagggtacatgtgcacaatgtgcaggtttgttacatatgtatac

SEQ ID NO: 18197 - DNA, 365 bp, Homo sapiens
  chr11.fa.O7frz.139163428
  Located on chromosome 11
  Distance between a terminus base of telomere on chromosomal short arm and 5'-terminus of this base sequence : 140694218
  Distance between 3'-terminus of neighbour sequence of sequence listing upward to telomere on chrosomal short arm and 5'-terminus of this base sequence : 298605
gaggaacatgcctaggaatggatggaggccaaagggaggagagcccagtgagccagggagcctgtaggaggttctgaggagggcactggaagcaactgcaacctttggagagtggtttgcactggaggagtgctaagagcagggaggatgggggatggattagaaagctggagtcagggtgttgaaggcagagtagctaggtctgtggtggatcgagtgtgggggctgtggggaagaggaatctcatgtttctagcattgattgaggaatactgggcaataaatgaggtgtgtgtgtgtgtgtgtgtgtgtgtgtgtgtgtgtgtatgtaattcaagagctctagtctggatgtattgataccag

SEQ ID NO: 18198 - DNA, 444 bp, Homo sapiens
  AC025739.2_63416
  Located on chromosome 11
  Distance between a terminus base of telomere on chromosomal short arm and 5'-terminus of this base sequence : 140694406
  Distance between 3'-terminus of neighbour sequence of sequence listing upward to telomere on chrosomal short arm and 5'-terminus of this base sequence : -177
cagagtagctaggtctgtggtggatcgagtgtgggggctgtggggaagaggaatctcatgtttctagcattgattgaggaatactgggcaataaatgaggtgtgtgtgtgtgtgtgtgtgtgtgtgtgtgtgtgtgtatgtaattcaagagctctagtctggatgtattgataccagacatataataatggctataaattacttattcagccacaaattattgtgtacctagtatgtgccaggctctgccctaggcacaggcaatacagcaggagacaaaacagacctcctctttttcatggagcacacattctagaagagacaggcaacagacgagatgaatgtagggagtgctaggaggagagcagtgccttggagaaagatgagacagagaagggaaatatgaagagagttgaagttttgtctaggatgtccagagaagtc

SEQ ID NO: 18199 - DNA, 222 bp, Homo sapiens
  chr11.fa.O7frz.139236780
  Located on chromosome 11
  Distance between a terminus base of telomere on chromosomal short arm and 5'-terminus of this base sequence : 140729756
  Distance between 3'-terminus of neighbour sequence of sequence listing upward to telomere on chrosomal short arm and 5'-terminus of this base sequence : 34906
taaagcaccttgtattcaagagtctgaatcttattcccaagaaacgtgttgctggtaaaatgctttaaagtgtgtgtgtgtgtgtgtgtgtgtgtgtgtgtgtgtgtgtgtgtatgtgtgagagagagagagagagagagagacagagacagagagacaggcagagagatgatcagacctgcaactcagctagattctttctggaagatgtttagaggtagg

SEQ ID NO: 18200 - DNA, 438 bp, Homo sapiens
  AP001999.3_160080
  Located on chromosome 11
  Distance between a terminus base of telomere on chromosomal short arm and 5'-terminus of this base sequence : 140932547
  Distance between 3'-terminus of neighbour sequence of sequence listing upward to telomere on chrosomal short arm and 5'-terminus of this base sequence : 202569
tttctgtcttgagtaggcatatgtccagcccagtgagatggcatctaccacagagggatgctgtgcacctttgtgttacacccaggctcacactttgaggtgcaatgtgtgtgtgtgtgtgtgaatgggggatctgtggagggagaactcttggattgggtcccacgcatgactgtgaggctgcctcctccttccaggggtgactgggttgtgttttctgaggaagccagcctcaagacctcctcttcctcacggcccttcctctcgctttggtgcagtggaggatttcattctcttcctgccactgctccaggggtcccaggctcagctcttctctcagagcttgtctctccctctgctcgttggtggggttggccctgagtggagtggagatggtgtcttctcaggcttcatgctctcatgtttgaaactttggag

SEQ ID NO: 18201 - DNA, 364 bp, Homo sapiens
  chr11.fa.O7frz.139699570
  Located on chromosome 11
  Distance between a terminus base of telomere on chromosomal short arm and 5'-terminus of this base sequence : 141174359
  Distance between 3'-terminus of neighbour sequence of sequence listing upward to telomere on chrosomal short arm and 5'-terminus of this base sequence : 241374
ggttctacatgtaagtgagatcaggtggcatttgtctttctgtgcctgccttatttcacttggcacaatgttctccagattcatccgtgttgtcttaaatggcaagatctctcttatcactgagtaatattccagtgtgtgtgtgtgtgtgtgtgtgtgtgtgtgtgtaccacagtgagatatttcctcacacctgttagaatggctagcacaaaaaagacaagaggcagaaagtgccagtaacgatgtggagaaaagggaaccctgctggggagaatgtgaattggtatggccattatggaaaatagtacaaaggtacctcaaaaacctaagaatagaactagaactaccatatgatccagaa

SEQ ID NO: 18202 - DNA, 436 bp, Homo sapiens
  chr11.fa.O7frz.139896578
  Located on chromosome 11
  Distance between a terminus base of telomere on chromosomal short arm and 5'-terminus of this base sequence : 141373038
  Distance between 3'-terminus of neighbour sequence of sequence listing upward to telomere on chrosomal short arm and 5'-terminus of this base sequence : 198315
caactagataatgctccatcacaggctcattaactggtcagagcagagggtctttgtgtgatggcaccgcgaaaaccttacccgatgagggaagacacccctgccccctgaagcacacacatgaacacacacacacacacacacacacacgcacacatacacacacacacacacacacacacacacacacacacacacaagagaggcattaacagaagacagggctttccattccaggtaggtacaaagaagatatgttgataacacattataagggtgtcccagagccctcctcattagatgctgcaacactgagaacagagtttctgcttcctgtctctcgagattgttttgcttatttcctggggatttcgctagttatgattatagtcaaaggatcagagagttgaaatggtgctcaaagattgtcatttta

SEQ ID NO: 18203 - DNA, 101 bp, Homo sapiens
  DISO7_11895117
  Located on chromosome 12
  Distance between a terminus base of telomere on chromosomal short arm and 5'-terminus of this base sequence : 39483
  Distance between 3'-terminus of neighbour sequence of sequence listing upward to telomere on chrosomal short arm and 5'-terminus of this base sequence : 0
taagaacaaatctctgcagtgagagtttcatcacacacacacacacacacacacacacacacacacacacacacacaaggcctcagcaggtggagtgagaa

SEQ ID NO: 18204 - DNA, 372 bp, Homo sapiens
  chr12.fa.O7frz.62851
  Located on chromosome 12
  Distance between a terminus base of telomere on chromosomal short arm and 5'-terminus of this base sequence : 71236
  Distance between 3'-terminus of neighbour sequence of sequence listing upward to telomere on chrosomal short arm and 5'-terminus of this base sequence : 31652
attcttgagtattgcatcacacatggcctggggaccccagtgacctcccttacagagtatggatatcagttctctccttgtgagtttgcttatcatttcggtcccatcagggagcacccacctcccatcctcagtttgagtggccctatcttgcccagctcttcctcctcctcttcagaaagttggggttttaataccaccttagggatatctgggattaggccaaatagtttaacttctacctccagggaggctgcttagcagctttatccacaagcctgttccctaaccctaaccctaaccctaaccctaaccctagcttctatagagtttcctttctgatggccgtttacatgaactatggctacctct

SEQ ID NO: 18205 - DNA, 395 bp, Homo sapiens
  chr12.fa.O7frz.247631
  Located on chromosome 12
  Distance between a terminus base of telomere on chromosomal short arm and 5'-terminus of this base sequence : 180578
  Distance between 3'-terminus of neighbour sequence of sequence listing upward to telomere on chrosomal short arm and 5'-terminus of this base sequence : 108970
tgcctctagcatttaatacaattctgcctcagaataggcactcagtgttcattggatggaggatggatggatggatggatggatggacagatggatggatggatggatggatggatggatggatggacagacggatggatggacagatggatggacggatggatggatggatggatggatggatggatggatggatggacagacggatggatggatggacagacggatggatggatggatggatggaggatggacggatggatggatgaacgagtggatgaatggaacttgaagggggaaaaatgattacagttttcccttttctgggaggacattgtttccccagaatcagagggctcagatgactcaggtcctgcttatcttggacagtactg

SEQ ID NO: 18206 - DNA, 155 bp, Homo sapiens
  DISO7_10003213
  Located on chromosome 12
  Distance between a terminus base of telomere on chromosomal short arm and 5'-terminus of this base sequence : 419326
  Distance between 3'-terminus of neighbour sequence of sequence listing upward to telomere on chrosomal short arm and 5'-terminus of this base sequence : 238353
atggaacacagtctgcccaacaaacacacaggtatatatagacagggataagatagatacagatatagatatagatatagatatagatatagatatagatatagatatagatatagatagatacagatatggatatagatatggaaggtcagact

SEQ ID NO: 18207 - DNA, 162 bp, Homo sapiens
  D12S352
  Located on chromosome 12
  Distance between a terminus base of telomere on chromosomal short arm and 5'-terminus of this base sequence : 514560
  Distance between 3'-terminus of neighbour sequence of sequence listing upward to telomere on chrosomal short arm and 5'-terminus of this base sequence : 95079
tggaccagggtgatggtggcaccccagcccaaagtctttgctcttgctcttcctgagtactacacacacacacacacacacacacacacacacacacacacacacccgctcaccagcctccttcctccactctagtctggggcaaaacgtcagactcctgct

SEQ ID NO: 18208 - DNA, 449 bp, Homo sapiens
  AC021054.20_47564
  Located on chromosome 12
  Distance between a terminus base of telomere on chromosomal short arm and 5'-terminus of this base sequence : 652172
  Distance between 3'-terminus of neighbour sequence of sequence listing upward to telomere on chrosomal short arm and 5'-terminus of this base sequence : 137450
acagtcaagaccttccgtccggtaacaaagcaacagacctcagtcatgtcatctgcttacaaaggagccacggtatgttgaatcacttcttttttctttttattatttatttatttatttatttatttatttatttatttatttatttatttgagacggagtttcactcttgttgcccaggctggagtgcaatggtgcgatctcagttcaccgcaacctccacctctcggattcaatcaattctcctgcctcagcctcccgagtagctgggattacagacaagtgccaccacacccggtgagctttttgtatttttagtagagacggggtttcaccgacctcaggtgatccgcccgcctcggcctcccaaaatgctgggattacaggtgtgagccaccgtgcccacccctgctgaatcatttctaagcatctagctatcatgattagtt

SEQ ID NO: 18209 - DNA, 124 bp, Homo sapiens
  D12S341
  Located on chromosome 12
  Distance between a terminus base of telomere on chromosomal short arm and 5'-terminus of this base sequence : 702297
  Distance between 3'-terminus of neighbour sequence of sequence listing upward to telomere on chrosomal short arm and 5'-terminus of this base sequence : 49676
atcttttactgttatgatgaacacatttcattaaaaaacctagtttgttctgtgtgtgtgtgtgtgtgtgtgtgtgtgtgtgtgtgtaagtgtgcatgaatgtgtgtgagggtgggcttggata

SEQ ID NO: 18210 - DNA, 201 bp, Homo sapiens
  D12S94
  Located on chromosome 12
  Distance between a terminus base of telomere on chromosomal short arm and 5'-terminus of this base sequence : 763530
  Distance between 3'-terminus of neighbour sequence of sequence listing upward to telomere on chrosomal short arm and 5'-terminus of this base sequence : 61109
ttgcttagcagcgttgaaaattgaggaggcagaggtgtatgtatgtatttggttcaggatagtatctcactagcaactcccaatataacctttttttctttgtgtgtgtgtgtgtgtgtgtgtgtgtgtgtgtgtgtgtgtagtggcacgatcacactcattgcagcctcaacctcctgggcttaagggatcctcccacct

SEQ ID NO: 18211 - DNA, 177 bp, Homo sapiens
  D12S91
  Located on chromosome 12
  Distance between a terminus base of telomere on chromosomal short arm and 5'-terminus of this base sequence : 800215
  Distance between 3'-terminus of neighbour sequence of sequence listing upward to telomere on chrosomal short arm and 5'-terminus of this base sequence : 36484
ttctcaaggttcgtccatgttgtagcaaatgttcatgcttcattcctctttaagtctgagtaatattccagtgtgtgtgtgtgtgtgtgtgtgtgtgtgtgtatgtataaacacaattgtttagccatttatcgattggtagacatttggactgttcctaccattggctgttgtgaa

SEQ ID NO: 18212 - DNA, 219 bp, Homo sapiens
  X69855.1_132
  Located on chromosome 12
  Distance between a terminus base of telomere on chromosomal short arm and 5'-terminus of this base sequence : 965280
  Distance between 3'-terminus of neighbour sequence of sequence listing upward to telomere on chrosomal short arm and 5'-terminus of this base sequence : 164888
agttcagcaacctgaattctatacctgaattctatatgaacaatgagaaaaaaaaaatttatacacacacacacacacacacacacacacacacacacacacacagaaaaaggcaggcagccagagaaaagaaagtcatcaacagcaattttttttcaagtaagtaaaatctttcaaaggaaaaaaatgcttagaaatgtgttaaccagctgagcatgg

SEQ ID NO: 18213 - DNA, 419 bp, Homo sapiens
  AC004802.1_36841
  Located on chromosome 12
  Distance between a terminus base of telomere on chromosomal short arm and 5'-terminus of this base sequence : 1189010
  Distance between 3'-terminus of neighbour sequence of sequence listing upward to telomere on chrosomal short arm and 5'-terminus of this base sequence : 223511
ccattcctgagttacttcacttaggatgatggcctccagttccatccaggttgctgcaaaagacatgatttcattctttttttcatggccgagtagtattccatggtgtgtgtgtgtatgtatatgtatatgtatatgtatatgtatatgtatatgtatatgtgtatatatacacatatacatgtatatatacacacacacgtgcatatatatgtgtgtgtgtatatatatatacacacatacccatgtgtgtttatacacacacacacacacacacacacacactttctgtctcttgccatatacaaaaattaacctaggtggattaaagacttaatctaagacccgaaaccataaaaattctggaagataacacagggaaaactcctctgaacattggctcaggcgaaggatttatg

SEQ ID NO: 18214 - DNA, 222 bp, Homo sapiens
  AC004802.1_10940
  Located on chromosome 12
  Distance between a terminus base of telomere on chromosomal short arm and 5'-terminus of this base sequence : 1215077
  Distance between 3'-terminus of neighbour sequence of sequence listing upward to telomere on chrosomal short arm and 5'-terminus of this base sequence : 25648
gtaatcctagtcctcatggctttcctctctacatggccatctctatactggatcttttctgctagctacttttcttattttgttagggatgtgtgtgtgtgtgtgtgtgtgtgtgtgtgcgcgcacgcgtgtgcgcgcgcgcatacacatgtgtacttttttttgttttgcctacaagttcctacaaatttaatttgcctacaaatttaaggttttgcatgt

SEQ ID NO: 18215 - DNA, 239 bp, Homo sapiens
  AC004804.1_106299
  Located on chromosome 12
  Distance between a terminus base of telomere on chromosomal short arm and 5'-terminus of this base sequence : 1228302
  Distance between 3'-terminus of neighbour sequence of sequence listing upward to telomere on chrosomal short arm and 5'-terminus of this base sequence : 13003
gcatattagttggaattcagtgagaagcagaattagtaggatacacacacacacacacacacacacatagagatagataaatacatatatacacacatatataaacacacacaagcatacatatattatgagatttatacgtatatttatatatattaatatatgcctacatatattaagagatttattacagagaatagtcttgtaaaatcgtggggctggctaagcaagactgaaat

SEQ ID NO: 18216 - DNA, 241 bp, Homo sapiens
  D12S1587
  Located on chromosome 12
  Distance between a terminus base of telomere on chromosomal short arm and 5'-terminus of this base sequence : 1260330
  Distance between 3'-terminus of neighbour sequence of sequence listing upward to telomere on chrosomal short arm and 5'-terminus of this base sequence : 31789
acagccaggacaacaaaatgaggctgtctcttacacacacacacacacacacacacacacacacacacacacacacggagtggttgattggataggatgagggtaatgaatttcttgaattgttttttctgaaacacgactaaaaacaccataacctagttttatgatttgtaggtaaagtaggatttttaaaatcacttactcttcgatataattgtgatggaaagtgctgaggaatgaa

SEQ ID NO: 18217 - DNA, 242 bp, Homo sapiens
  AC004804.1_15446
  Located on chromosome 12
  Distance between a terminus base of telomere on chromosomal short arm and 5'-terminus of this base sequence : 1319013
  Distance between 3'-terminus of neighbour sequence of sequence listing upward to telomere on chrosomal short arm and 5'-terminus of this base sequence : 58442
ctatctccatgaaatcaaatttcttctagctcccacgtgtgagtgagaacaagcaacatctgtctttccgtgcctggcttgtttcacttaacataatgttctccagttccattcatgttgctgcaaatgacaggatttcattctttttatggctgaatagtattcgtgtgtgtgtgtgtgtgtgtgtgtgtgtgtgtgtgtgtgtgtgtatacataccacattttatccattcatccactga

SEQ ID NO: 18218 - DNA, 345 bp, Homo sapiens
  AC004672.1_43129
  Located on chromosome 12
  Distance between a terminus base of telomere on chromosomal short arm and 5'-terminus of this base sequence : 1437478
  Distance between 3'-terminus of neighbour sequence of sequence listing upward to telomere on chrosomal short arm and 5'-terminus of this base sequence : 118223
ctaagcatccaaatcaagaaatagaaaaagaatatctgtgtaacccccaacacacacacacacacacacacacacacacaaaagaacaaagaaaataaaaacaaattaaatgaaatagaaaacaagctgtaagagaagatcagtgaaactaaaagctagctcttagagaggatttaatgacttaattagatgtgaaatacatagtgagacagattgttcatgaagaaaagaccagatattataataattttaacagtgacttaatctgatgtcccttcagacttctattactaaagaattaattagtctgcttttattctggttaatagaacctgcaactgaact

SEQ ID NO: 18219 - DNA, 312 bp, Homo sapiens
  G10157
  Located on chromosome 12
  Distance between a terminus base of telomere on chromosomal short arm and 5'-terminus of this base sequence : 1459547
  Distance between 3'-terminus of neighbour sequence of sequence listing upward to telomere on chrosomal short arm and 5'-terminus of this base sequence : 21724
actgtcatcctcccttttcctcttgtttcttcatccctagaagtaaacaaactaaaaatggttttgacctttgaaaaagaaataaacactgaagtaattgcctgtgattctctctacccagccgtctgctgaaagtgtgtcttgagaagagcttgagatgatagatagatagatagatagatagatagatagatagatagatagatagatgatagatagatagatagatcgatagatagatagatagatagatagatagatagatagatagatagataatctgtctctactccacaggtcgataatagctca

SEQ ID NO: 18220 - DNA, 268 bp, Homo sapiens
  AC004672.1_9593
  Located on chromosome 12
  Distance between a terminus base of telomere on chromosomal short arm and 5'-terminus of this base sequence : 1470865
  Distance between 3'-terminus of neighbour sequence of sequence listing upward to telomere on chrosomal short arm and 5'-terminus of this base sequence : 11006
ctaatgagaagctacgtctaccacaggctctagacacatgatgagaccctcagtggctatagcctagctgtgagcactcagcagtagacttatatctgcatagtctgttgtgtttggtttgacgctagagttcaaataataaggtgactaactgcaaactgcctctgcctgctcccccagcccttccatgtacagacagacggacacacacacacacacacacacacacgtgcacgcacgccctcttatcctgaccttgaaatagcta

SEQ ID NO: 18221 - DNA, 261 bp, Homo sapiens
  AC004671.1_122108
  Located on chromosome 12
  Distance between a terminus base of telomere on chromosomal short arm and 5'-terminus of this base sequence : 1597568
  Distance between 3'-terminus of neighbour sequence of sequence listing upward to telomere on chrosomal short arm and 5'-terminus of this base sequence : 126435
tagaacattcagtactcctaccacttgcatgcttatatgtgtatgactcgatactatcaaaagctttacaagtatttcatcctctttcccttgtgtgtgtgtgtgtgtgtgtgtgtgtgtgtgtgtgtgtgtgtgtgtgtgtgtttaatgctattaaaattctcctccctttgtagggcagcagtgccaggactagggcaaacagagttcaaagagtgtcccggcatgaactattctaataccaggtttcagatatgagct

SEQ ID NO: 18222 - DNA, 246 bp, Homo sapiens
  D12S1608
  Located on chromosome 12
  Distance between a terminus base of telomere on chromosomal short arm and 5'-terminus of this base sequence : 1684980
  Distance between 3'-terminus of neighbour sequence of sequence listing upward to telomere on chrosomal short arm and 5'-terminus of this base sequence : 87151
actgacactgggcaggtggattttgggagaacctctgtgtgtgtgtgtgtgtgtgtgtgtgtgtgtgtgtgtgtgtctctctatgtgtgtgtctggaaatgagtatttttcattaatttgggggtggaggtggagaggcaccagaggcatggagtatgtaaaaaattaaaaacaactcaacacttctggctgagacgttgcagagcctgggttgtctatctttattggaaatgtttgtcctctgcc

SEQ ID NO: 18223 - DNA, 359 bp, Homo sapiens
  AC005182.2_69949
  Located on chromosome 12
  Distance between a terminus base of telomere on chromosomal short arm and 5'-terminus of this base sequence : 1686373
  Distance between 3'-terminus of neighbour sequence of sequence listing upward to telomere on chrosomal short arm and 5'-terminus of this base sequence : 1147
gcaagtaatagaaaccaatttgagtcagattatgaagaaggagtatgacatgagggtcccaagagtctcaaagacgccagggtcttcaggagctgacctggacacctctggatccctctcccttcctcctctctcctctgaggtctctctctctctctctctctctctctctctctctctcacagttccagccccaggaagggactctgaatctctcctggtccttgtcccagattcccaggaggggcttctggtcagggctctgtccaccattgcatgactttgcagcagttcaagtcaatgagtggaggggctgaagaactcatcaaggtgagaggaactgctcacgttctcataaa

SEQ ID NO: 18224 - DNA, 271 bp, Homo sapiens
  D12S1656
  Located on chromosome 12
  Distance between a terminus base of telomere on chromosomal short arm and 5'-terminus of this base sequence : 1735523
  Distance between 3'-terminus of neighbour sequence of sequence listing upward to telomere on chrosomal short arm and 5'-terminus of this base sequence : 48791
ccgtactgctgacatttgcaaacccatttcagctgtggtgtggagctgtggcgttgtacttctggatgtgaccagaaacagtgtttgggagctcagcaggtggtgctgtcttggctgattgtgtgtgtgtgtgtgtgtgtgtgtgtgtgtgtattttatttaatttctgagacagggtcttgctctgtcacccaggctggagtgccatggcacaatcacggctcactgccctctcgaactcaaacagtcctcccaactgagactcccacgt

SEQ ID NO: 18225 - DNA, 391 bp, Homo sapiens
  AC005183.2_27128
  Located on chromosome 12
  Distance between a terminus base of telomere on chromosomal short arm and 5'-terminus of this base sequence : 1748913
  Distance between 3'-terminus of neighbour sequence of sequence listing upward to telomere on chrosomal short arm and 5'-terminus of this base sequence : 13119
cagatacaggttgaagttccacttaagaagaatatgccttggctgggtagacagaaatttaccctggcttttaaaggaatagggtacactgttttttctttactacttctatctctgtgtctctctttgtctcttcctctctctctctctctctctctctctctttctctctttctgacttcttttctgtctcttcctctctctgtttctctctttctgactccctctttgtctgtctcttcctctctctctctttcctctctgctggtctttccctgcctctgccagctgcttatgctgctgttctcccctctcctttcagcagtgtaagactgccacctccttgggtttttgcactgtgtgcaataactccgtgatttccttatggtat

SEQ ID NO: 18226 - DNA, 455 bp, Homo sapiens
  AC005343.1_111173
  Located on chromosome 12
  Distance between a terminus base of telomere on chromosomal short arm and 5'-terminus of this base sequence : 1801730
  Distance between 3'-terminus of neighbour sequence of sequence listing upward to telomere on chrosomal short arm and 5'-terminus of this base sequence : 52426
tccagttaggtatctttgcttaagcagccctgtttaatgccttctttgatcacttttatcgtgcctggttttatttagtgaagccatttctgtggactagtaaataattttgaaggaaatagtttggtaaaaggaaaaaagcagggttttgtactcagagtgacctaaatttgtatccctgatctcttctgtatcattatttttcaaacttctgtgtaagaggacccttcaaagaaaaacaacaaaaaccttattaaagtattaaacacacacacacacacacacacacacacacacgtagatatattgtaagtggatagtctgataaacttttataaactagacactcctgtataaccagcactcctggaggtctctttattacctcctcatagtaactgcctattcccactcccccaaaggtaaccattaccctgacttctaatggcatggat

SEQ ID NO: 18227 - DNA, 364 bp, Homo sapiens
  AC005343.1_73703
  Located on chromosome 12
  Distance between a terminus base of telomere on chromosomal short arm and 5'-terminus of this base sequence : 1839319
  Distance between 3'-terminus of neighbour sequence of sequence listing upward to telomere on chrosomal short arm and 5'-terminus of this base sequence : 37134
gctgactatgagaccaacgtagaggctgcaatgtgatttttttaatggtacagaattccttggaacaattctgtgtgaatcacttgcagcaaggttaaagaatgttttatgaaactggatttgttttatatgctgtgtgtgtgtgtgtgtgtgtgtgtgtgtgtgtgtgtgtgtgtgttgggtcagatataaaacacgtttctgcaggtcaaggtcagaagcagcgcctgtctcatgcacgctggtgtcctcatcttcccagtgtgagagggctgctgtggcttttgctgtccctccatcacctcccacaatcagtgtgccctgtggatcggtcatttgtcccctccatgacaatgacctaacc

SEQ ID NO: 18228 - DNA, 361 bp, Homo sapiens
  AC005343.1_71599
  Located on chromosome 12
  Distance between a terminus base of telomere on chromosomal short arm and 5'-terminus of this base sequence : 1841437
  Distance between 3'-terminus of neighbour sequence of sequence listing upward to telomere on chrosomal short arm and 5'-terminus of this base sequence : 1754
ggaatgtgaaagacattgaaatcctgcctgttcttcacggcgcagccctgaagctctccctggtgcctccagctggagtaaactctctcagctggggctcgctttttgctattctagttactgtgtgtgtgtgtgtgtgtgtgtgtgtgtgtgtgtgtgtgtgtcccctccgtcaccccctcacctgacagcaggattctaggggacagaaatccacttctgtcccacagcaccacaccatgtcctgttcacagttattattccatgcatatttgctgaaggaatgtgtgagggaatgaatgacccgagtcttctgctccctgggaaagtgcagcggggtgcagacaaggcttctgacgag

SEQ ID NO: 18229 - DNA, 289 bp, Homo sapiens
  AC005342.1_20923
  Located on chromosome 12
  Distance between a terminus base of telomere on chromosomal short arm and 5'-terminus of this base sequence : 1933955
  Distance between 3'-terminus of neighbour sequence of sequence listing upward to telomere on chrosomal short arm and 5'-terminus of this base sequence : 92157
aatgctcaatatcacgaatcacgagggaaatgcaaatcaatactacaaagatatatcatctcatcccagttagaatagctattaataaacacacacacacacacacacacacacacacacacacacacacacacacaaaacagatgctagcaaggatgcagagaaaaagaaactcatatgccattggtgggaatgtaaattagtatagccactatggaaaacaatatggtgatttctcaaaaaactaaaaatagaactaccatatgatgccactacctagaatttatcc

SEQ ID NO: 18230 - DNA, 181 bp, Homo sapiens
  D12S1642
  Located on chromosome 12
  Distance between a terminus base of telomere on chromosomal short arm and 5'-terminus of this base sequence : 1962193
  Distance between 3'-terminus of neighbour sequence of sequence listing upward to telomere on chrosomal short arm and 5'-terminus of this base sequence : 27949
gccatgtctataaataccctgaaggtaacttgttagagggtgtgtgtgtgtgtgtgtgtgtgtgtgtgtgtgtgagagagagagagagagagagagagagagcgagagagagagagagagtatggggaggcaaagactgaagcagaagaaactcagagggcccagcggggatttaggagct

SEQ ID NO: 18231 - DNA, 275 bp, Homo sapiens
  AC005342.1_191766
  Located on chromosome 12
  Distance between a terminus base of telomere on chromosomal short arm and 5'-terminus of this base sequence : 2104712
  Distance between 3'-terminus of neighbour sequence of sequence listing upward to telomere on chrosomal short arm and 5'-terminus of this base sequence : 142338
caggtggattagtcatcagaatagccaatgggccccttgagctctgagtggatgcacaaagggccaggtggactttctttggggagcataacaggaagaagatgacaaaagcctgggtggtggagatggtggcagtttaaggatgtgggcttaggactgtggactaggatgcacgtgtgtgtgtgtgtgtgtgtgtgtgtgtgtgtgcgcgcgtgtgcgtgcctgtatgtaagggcaggcacatgaagacagactttattggtttcacagtttgg

SEQ ID NO: 18232 - DNA, 142 bp, Homo sapiens
  D12S100
  Located on chromosome 12
  Distance between a terminus base of telomere on chromosomal short arm and 5'-terminus of this base sequence : 2104853
  Distance between 3'-terminus of neighbour sequence of sequence listing upward to telomere on chrosomal short arm and 5'-terminus of this base sequence : -134
gatgtgggcttaggactgtggactaggatgcacgtgtgtgtgtgtgtgtgtgtgtgtgtgtgtgtgcgcgcgtgtgcgtgcctgtatgtaagggcaggcacatgaagacagactttattggtttcacagtttggcctccaga

SEQ ID NO: 18233 - DNA, 206 bp, Homo sapiens
  AC006051.1_13946
  Located on chromosome 12
  Distance between a terminus base of telomere on chromosomal short arm and 5'-terminus of this base sequence : 2158019
  Distance between 3'-terminus of neighbour sequence of sequence listing upward to telomere on chrosomal short arm and 5'-terminus of this base sequence : 53024
tttattcaaatcagcacctgtctcattccggcctgttttccaaaagaatattccagttaggtggtggtgagctctgtgtgtgtgtgtgtgtgtgtgtgtgtgtgtgtgtgtgtgtttagtagcaaatcccgtgactgctacaaaatgtgctgcaaaagttgtgagtgcaggtgttcgctgcagcgaacatctgttcttggattgtg

SEQ ID NO: 18234 - DNA, 239 bp, Homo sapiens
  AC006051.1_10493
  Located on chromosome 12
  Distance between a terminus base of telomere on chromosomal short arm and 5'-terminus of this base sequence : 2161392
  Distance between 3'-terminus of neighbour sequence of sequence listing upward to telomere on chrosomal short arm and 5'-terminus of this base sequence : 3167
ggtcttgttaatagtgctggatactattgttattattgtcatcatcatcatccttgtcaacctaacccaggccctgttgcctttttcatggactcttacagtcacctccttcctgctgtcctccctctggtctctccttccactggtctagctcgtgtgtgtgtgtgtgtgtgtgtgtgtgtgtgtgtgtgtgtgcagtcatttgccaaacatctataccaacagataggcactatgat

SEQ ID NO: 18235 - DNA, 111 bp, Homo sapiens
  D12S1689
  Located on chromosome 12
  Distance between a terminus base of telomere on chromosomal short arm and 5'-terminus of this base sequence : 2263527
  Distance between 3'-terminus of neighbour sequence of sequence listing upward to telomere on chrosomal short arm and 5'-terminus of this base sequence : 101896
actcccaaggtatgccgcttggatatggggacgcgcacacacacacacacacacacacacacacacacacacacacacacacagttttcttcatacaggggtagtaaaacc

SEQ ID NO: 18236 - DNA, 271 bp, Homo sapiens
  D12S1694
  Located on chromosome 12
  Distance between a terminus base of telomere on chromosomal short arm and 5'-terminus of this base sequence : 2314641
  Distance between 3'-terminus of neighbour sequence of sequence listing upward to telomere on chrosomal short arm and 5'-terminus of this base sequence : 51003
acacagggtcaggggccccgtgagccattacttggaaacactgtcattaacaattacttcttatagttgtttctagcaactcatgtcctggaaatgtctggtttaattcatctctctctccttctagtagacagacagacagacagacagacagacagacacacacacacacacacacacacacacacacacacacacacacacacacacacacacacacacactgagggctgatagggaagaggacttctcttcttgattctccatagct

SEQ ID NO: 18237 - DNA, 335 bp, Homo sapiens
  chr12.fa.O7frz.2437756
  Located on chromosome 12
  Distance between a terminus base of telomere on chromosomal short arm and 5'-terminus of this base sequence : 2416046
  Distance between 3'-terminus of neighbour sequence of sequence listing upward to telomere on chrosomal short arm and 5'-terminus of this base sequence : 101134
agatggtctactttgtattgtcatcatggcctggccattctaaataaggtcggggataaaatactccccgtgggggaagagtgttccctcaccacttcacaggctactaaatcttcattgctctcggccattgcttggttgtccttgttctttttgtttgtttatttgggtccttccttccttccttccttccttccttccttccttcctctctctctttccttctttttttctttccttttcttttctttcctttctttgccaataggccaccgtagtcagtttcatgtgtcttcctggtcaatcccatgtttactgcacaaatttaggtttct

SEQ ID NO: 18238 - DNA, 237 bp, Homo sapiens
  AC005414.2_60870
  Located on chromosome 12
  Distance between a terminus base of telomere on chromosomal short arm and 5'-terminus of this base sequence : 2529292
  Distance between 3'-terminus of neighbour sequence of sequence listing upward to telomere on chrosomal short arm and 5'-terminus of this base sequence : 112911
gcctaacgtaggcaaagtaatcacacttacgattgttttgatatatatgaaaccagaaaataatcctgggttatctgttgtctctaaatgaagaactataagcaaattctctctctctctctctctctctctctctctctctttggaagtgtattttcattgttataggcaatcatttatttgttggaactggggtctcttctgtctgttattgtcattactttgtctaaggacagg

SEQ ID NO: 18239 - DNA, 330 bp, Homo sapiens
  AC005414.2_66877
  Located on chromosome 12
  Distance between a terminus base of telomere on chromosomal short arm and 5'-terminus of this base sequence : 2535324
  Distance between 3'-terminus of neighbour sequence of sequence listing upward to telomere on chrosomal short arm and 5'-terminus of this base sequence : 5795
ataagtcacttgtcagctccacccttcatcttgccatcccactatgtgtctggatgtgcggagaaggtatttctattaaattcacacacacacacacacacacacacacacacacaacagctattaatctcttggtattggtgctgctgaaatatccctcgtttatgacaaagaccttttgcatccaagcaggttgaattgggtgttttaccctatttttgtctactccatcttcacaaagccacctcctttcactgcagaatatagagttgctgaaggcttcataaaagttagagctgaattctgctgatgacctaggagtcattctaa

SEQ ID NO: 18240 - DNA, 445 bp, Homo sapiens
  AC005866.3_62424
  Located on chromosome 12
  Distance between a terminus base of telomere on chromosomal short arm and 5'-terminus of this base sequence : 2639852
  Distance between 3'-terminus of neighbour sequence of sequence listing upward to telomere on chrosomal short arm and 5'-terminus of this base sequence : 104198
caaagcacctcatgtatgagtgtatgtgtgaatgtgtgtatatatatgtctgtgtaagtgtggggtgtatgtgtgcacgtgtgtggatgtgtggggtgtgtgtatatgtggatgtgtgtttgtggctgtgtgtatgtgtgtgtatgtatgtgtttgtgtttgtgtctgcatatgtgtctatggacgtgaatgtatatgtgtatgtatgtgcatatgtatgtgtgagtgcatgtatgtgtgtgactgtgtatatttgtgtcttgtgtgtgtgtgtgtgtgtgtgtgtgtgtgtgtgtgtgtgagtttttcatttcactggtctggggtacagtctgggtgtgagttctaagagctttccaggtgactcccctgtacagccaagcttgcagtcctcgttcaggtgtggaggatctgattaccagtttctaccaagttctaacagctg

SEQ ID NO: 18241 - DNA, 342 bp, Homo sapiens
  AC005866.3_106562
  Located on chromosome 12
  Distance between a terminus base of telomere on chromosomal short arm and 5'-terminus of this base sequence : 2684068
  Distance between 3'-terminus of neighbour sequence of sequence listing upward to telomere on chrosomal short arm and 5'-terminus of this base sequence : 43771
acagaactccttgtccatgagcaagggagctcaagcactgggccaggagcggggcagaaaggtgccagtggatagctagacctgaccatcctgggcaactatcacacaccagagcaaaaggggtttaggtgctttgccaagaaatttcttctgtgcatgcctgtatgagagagagagagagaaagagagagagagagagagagagtgtgtgtgtgcgcgtgtgtgtgtctgcctatgtttgtctctgtgttcaatctcagtctgctagccaaatcctagggaccccacaccctgcaatcacaaggactgacctggcaggtggaatcttcatgaagcagaagc

SEQ ID NO: 18242 - DNA, 213 bp, Homo sapiens
  D12S1615
  Located on chromosome 12
  Distance between a terminus base of telomere on chromosomal short arm and 5'-terminus of this base sequence : 2698685
  Distance between 3'-terminus of neighbour sequence of sequence listing upward to telomere on chrosomal short arm and 5'-terminus of this base sequence : 14275
gatggctccactgcactccagcctgggtgatgaagtgacatcccatctctaaacacatacacacacatacacacacacacacacacacacacacacacacacaagatttttctaagagtagcagacaaataatatcagacttttaaaaagaagacagagaacatcatgaacaaatatgcaaatatatttgaaaacctaaatgaagcagacgct

SEQ ID NO: 18243 - DNA, 212 bp, Homo sapiens
  AC005911.6_81924
  Located on chromosome 12
  Distance between a terminus base of telomere on chromosomal short arm and 5'-terminus of this base sequence : 2854184
  Distance between 3'-terminus of neighbour sequence of sequence listing upward to telomere on chrosomal short arm and 5'-terminus of this base sequence : 155286
ccactgcacctagcctattattgagctttttatcttgacagatctcttttttgtgtgcgtgcgtgtgtgtgtgtgtgtgtgtgtgtgtgtttttgagacggagtcttgctctgtcacccaggctagagtgcagtggcacagtcttggctcactgcaacctccacctccctggttcaagcgattctcctgcctcagctcctgagtagctaaga

SEQ ID NO: 18244 - DNA, 347 bp, Homo sapiens
  AC005841.3_25314
  Located on chromosome 12
  Distance between a terminus base of telomere on chromosomal short arm and 5'-terminus of this base sequence : 2897899
  Distance between 3'-terminus of neighbour sequence of sequence listing upward to telomere on chrosomal short arm and 5'-terminus of this base sequence : 43503
aatcacttgaggtcaagagttcgagaccagcctggccaacatggggaaaccccatctctactaaaaatataaaaaattagccaggagtggtggtgcacctgtaatcccagctacttgggaggctgaggcaggagaatcacttgagcctgggagatggaggttgcagtgagccaagatcgtgccactgcactccggcctgggcaacagagtgagactctgtctcaacaaaacaaaacaaaacaaaacaaaacaaaacaaaaacaaagactctggatcagtcagtgagcacactgaagcactgaagctgtagggacccagaggacttcagacatagaatgagatgtaag

SEQ ID NO: 18245 - DNA, 318 bp, Homo sapiens
  AC005841.3_27092
  Located on chromosome 12
  Distance between a terminus base of telomere on chromosomal short arm and 5'-terminus of this base sequence : 2899749
  Distance between 3'-terminus of neighbour sequence of sequence listing upward to telomere on chrosomal short arm and 5'-terminus of this base sequence : 1503
ttggagattcaactgaaattctaaattgttatatttcttccttggaggactctcatcgaaggtgggaggactgcggccaggaggctgggtagagcagggagaacagggaggggctccagttcctaaggagaggagaagtgggaaggaaggagtgtgtgtgtgtgtgtgtgtgtgtgtgtgtgtgtgcgtgtgtgtgtctgttggggtgggggaagaggcactgtaagaaacatggataagaagaagctatctccactctcataacccattgggaatgaggctgggattggtcagggtatagaaagcctcttaggcaaa

SEQ ID NO: 18246 - DNA, 186 bp, Homo sapiens
  D12S1626
  Located on chromosome 12
  Distance between a terminus base of telomere on chromosomal short arm and 5'-terminus of this base sequence : 3136829
  Distance between 3'-terminus of neighbour sequence of sequence listing upward to telomere on chrosomal short arm and 5'-terminus of this base sequence : 236762
gccaatgtaaagtctccaatgtaagaaacagcacagaggacaatgtcgctggagtggagtgagtgggccaggagtttgtttgtgtgtgtgtgtgtgtgtgtgtgtgtgtgtatacacacaagttcttctaagaactttgtctttttctttgagagacatgagaaggcattagggggttttgcacag

SEQ ID NO: 18247 - DNA, 322 bp, Homo sapiens
  AC005912.1_99125
  Located on chromosome 12
  Distance between a terminus base of telomere on chromosomal short arm and 5'-terminus of this base sequence : 3136830
  Distance between 3'-terminus of neighbour sequence of sequence listing upward to telomere on chrosomal short arm and 5'-terminus of this base sequence : -185
ccaatgtaaagtctccaatgtaagaaacagcacagaggacaatgtcgctggagtggagtgagtgggccaggagtttgtttgtgtgtgtgtgtgtgtgtgtgtgtgtgtgtatacacacaagttcttctaagaactttgtctttttctttgagagacatgagaaggcattagggggttttgcacagatcagtggcatggtctcacttaagagacacgatcactgtagtataagagctaatttcagttgtgtttttcttggggaggccccaggagaccagacagggggctgccccatcctttccctatgactcgtccagcctct

SEQ ID NO: 18248 - DNA, 202 bp, Homo sapiens
  AC005865.1_96887
  Located on chromosome 12
  Distance between a terminus base of telomere on chromosomal short arm and 5'-terminus of this base sequence : 3287809
  Distance between 3'-terminus of neighbour sequence of sequence listing upward to telomere on chrosomal short arm and 5'-terminus of this base sequence : 150657
ttgttctcttgacaaaggtctaacccacaaatcttccacagatttccctggccttgttgtgttcttattctctttccctgtctcatcagggttgcaggacacaagtttatctgtcatagacacacactctttctctctctctctctctctctctcacacacacacacacgttcagcatggctgctttgcagtggaaacctgt

SEQ ID NO: 18249 - DNA, 224 bp, Homo sapiens
  D12S1664
  Located on chromosome 12
  Distance between a terminus base of telomere on chromosomal short arm and 5'-terminus of this base sequence : 3320262
  Distance between 3'-terminus of neighbour sequence of sequence listing upward to telomere on chrosomal short arm and 5'-terminus of this base sequence : 32251
gatcttgtgagacctcctgcatgccagcacagggcctgatagccttaccatgcagcagcagtatctataaccatccctagaagtggagtcacagaaaataccatggtaattgtggctttgttttgaggatggttaccacacacacacacacacacacacacacacacacacgtgcatggcatggaggagcctgacctgttattgttggcatccccaggatacat

SEQ ID NO: 18250 - DNA, 450 bp, Homo sapiens
  AC005908.1_112252
  Located on chromosome 12
  Distance between a terminus base of telomere on chromosomal short arm and 5'-terminus of this base sequence : 3387839
  Distance between 3'-terminus of neighbour sequence of sequence listing upward to telomere on chrosomal short arm and 5'-terminus of this base sequence : 67353
catagtgctcgataagcagtttttgaatcctcatcgtcctcccaccctctaccctcaagtaggcctcagtgtctgttcccttctttgtgtccatgtgggtatcttaaaatttatgtaatcattccctttctggtgtgcattcaggctatatatatatatatatatatatatatattgcattcagctactctttctgggagtgtagtatacctaacacgggggcttttggtgtaggcagacctgggcctgaatcccagcttgaccactgactgtgtgaccttagggatgttctctaaggtcgtctagcctcaaggccttcaactgcaaaatgagagcagcagacagctcacggtgtcacatgcggtgatggaatgaggtgatgtacagtgtgtgcttctaacgcagggcctgacacacggcgagggcccagttagctcgagcagtaacttg

SEQ ID NO: 18251 - DNA, 176 bp, Homo sapiens
  D12S372
  Located on chromosome 12
  Distance between a terminus base of telomere on chromosomal short arm and 5'-terminus of this base sequence : 3428558
  Distance between 3'-terminus of neighbour sequence of sequence listing upward to telomere on chrosomal short arm and 5'-terminus of this base sequence : 40269
tccaatggaaagaaatggagtcttcatcctatccatcatatatttatatctattgatccacctatcatctatctatctatctatctatctatctatctatctatctatctatctacctacctatctatctgtctgtctatctaatcatgaggttatagatgataccctgtggtcca

SEQ ID NO: 18252 - DNA, 170 bp, Homo sapiens
  D12S1062
  Located on chromosome 12
  Distance between a terminus base of telomere on chromosomal short arm and 5'-terminus of this base sequence : 3428610
  Distance between 3'-terminus of neighbour sequence of sequence listing upward to telomere on chrosomal short arm and 5'-terminus of this base sequence : -124
ttgatccacctatcatctatctatctatctatctatctatctatctatctatctatctatctacctacctatctatctgtctgtctatctaatcatgaggttatagatgataccctgtggtccaccctgccaggccatgcagggatttattctacagaaccttggcttgg

SEQ ID NO: 18253 - DNA, 248 bp, Homo sapiens
  D12S1050
  Located on chromosome 12
  Distance between a terminus base of telomere on chromosomal short arm and 5'-terminus of this base sequence : 3509214
  Distance between 3'-terminus of neighbour sequence of sequence listing upward to telomere on chrosomal short arm and 5'-terminus of this base sequence : 80434
agctgctcttttccctttgtaattagtaagattttctgggggaggtactttgagagcatgtaaatatttcattattcaccaaactaacatttatctgtctatctatctacctatctatctatctatctatctatctatctgtctatctatcctgtctatctaatctatctaatctagctgtctatctgtccatccatccagccagccagccagccagacagccagcgttcatccatctactgatctgt

SEQ ID NO: 18254 - DNA, 205 bp, Homo sapiens
  AC005925.1_9784
  Located on chromosome 12
  Distance between a terminus base of telomere on chromosomal short arm and 5'-terminus of this base sequence : 3530587
  Distance between 3'-terminus of neighbour sequence of sequence listing upward to telomere on chrosomal short arm and 5'-terminus of this base sequence : 21125
gatctattgaaagctgtcagctacaagagttgatagctgacattttgttgatggacatctgacagcaagatcctttagaggtggaattcctgccagatggggggtgcgtgtgcgtgtgtgtgtgtgtgtgtgtgtgtgtgtgtacgcgtgcgcatgcgggatagaaggagaaagtaaccacgtctagattgtaagccataaggaa

SEQ ID NO: 18255 - DNA, 308 bp, Homo sapiens
  AC005831.1_130789
  Located on chromosome 12
  Distance between a terminus base of telomere on chromosomal short arm and 5'-terminus of this base sequence : 3553892
  Distance between 3'-terminus of neighbour sequence of sequence listing upward to telomere on chrosomal short arm and 5'-terminus of this base sequence : 23100
gtacctcagcacgtattgaaacttgggtgggaagtatttcaggccattaacaaaaggactaaagaggagagagttagggatgaaatcagaatgggtagtgtgcgtggtttcatctgtgtgtgtgtgtgtgtgtgtgtgtgtgtgttgtacacccacagacacaggatgagtcagtgtagcccctgagcccacctccttcctgggtgtagacaatcagcactgaccgctgtccgggccactgagagggtctggcagtactcgggaggcctcagcaccctgttgggatctctgctttactaatgacctgc

SEQ ID NO: 18256 - DNA, 245 bp, Homo sapiens
  D12S1652
  Located on chromosome 12
  Distance between a terminus base of telomere on chromosomal short arm and 5'-terminus of this base sequence : 3553982
  Distance between 3'-terminus of neighbour sequence of sequence listing upward to telomere on chrosomal short arm and 5'-terminus of this base sequence : -218
atgggtagtgtgcgtggtttcatctgtgtgtgtgtgtgtgtgtgtgtgtgtgtgttgtacacccacagacacaggatgagtcagtgtagcccctgagcccacctccttcctgggtgtagacaatcagcactgaccgctgtccgggccactgagagggtctggcagtactcgggaggcctcagcaccctgttgggatctctgctttactaatgacctgccgtgtggcactaagcaagtcatcaaca

SEQ ID NO: 18257 - DNA, 369 bp, Homo sapiens
  AC005831.1_68108
  Located on chromosome 12
  Distance between a terminus base of telomere on chromosomal short arm and 5'-terminus of this base sequence : 3616575
  Distance between 3'-terminus of neighbour sequence of sequence listing upward to telomere on chrosomal short arm and 5'-terminus of this base sequence : 62348
tggaaagaatgagtcctactgaaaacccagatgaaaacccaggtccagctcagggcattaaacatcttcacccaagatatctggttctggcaaatgtccctccctaaaggacggctgcgtgtgtgtgtgtgtgtgtgtgtgtgcgtgcgtgtgcgcgtgcgcgcgcacgcgcgcacacgctcatgtgtacatctggtgctgggttactggggagctaaggatgggaggcagatgggatatgaaacaaggatataggggtgaagaattcattattctaatgtaaatacaaagcgtagcttctgagaggcctttagagataatttgcagggaactacaaggtgagatgtagttagcgttaacttatcctgc

SEQ ID NO: 18258 - DNA, 188 bp, Homo sapiens
  AC005831.1_551
  Located on chromosome 12
  Distance between a terminus base of telomere on chromosomal short arm and 5'-terminus of this base sequence : 3684127
  Distance between 3'-terminus of neighbour sequence of sequence listing upward to telomere on chrosomal short arm and 5'-terminus of this base sequence : 67183
agctaagattatctgaggtgatgtgcactgagatgttcctgagaccacaagaccacattctagaatccaatcccactatcctaaccacaacattcccaaattttcaggacacacacacacacacacacacacacacacacacacacacttttctctccaccttttcttggtattcagtccttttccta

SEQ ID NO: 18259 - DNA, 184 bp, Homo sapiens
  AC012599.8_27760
  Located on chromosome 12
  Distance between a terminus base of telomere on chromosomal short arm and 5'-terminus of this base sequence : 3876615
  Distance between 3'-terminus of neighbour sequence of sequence listing upward to telomere on chrosomal short arm and 5'-terminus of this base sequence : 192300
ccggtcctcagtactttacatatgtgtgtgtgtgtgtgtgtatgtgtagtaaatatatatatatatatatatatatatgtttacttcttataaaaactcttagaagtaggccctgttgtcttctctcattttaaagatgaggaaattgaggcatgaaggggttaagtaaccagctcaagatcac

SEQ ID NO: 18260 - DNA, 392 bp, Homo sapiens
  AC007207.22_55441
  Located on chromosome 12
  Distance between a terminus base of telomere on chromosomal short arm and 5'-terminus of this base sequence : 4023513
  Distance between 3'-terminus of neighbour sequence of sequence listing upward to telomere on chrosomal short arm and 5'-terminus of this base sequence : 146714
ttagtcctcagataagaccagaagaatgatctctctctctctctctctctctctctttctctccgttttcctctccaccgtgtgagcacttagcaaggagacagctgctctctctctctctctctctctctctctctctctctttctctccgttttcctctccaccgtgtgagcacttaacaaggagacagctgtctgcaaggtgggaagagagccctcaccaggaacacaaccatgctggcaccctgatctcagacttcccagccttgagaaataaatatctgttgtttaggccacccagtccatgatattttgttataacagtccaaactaagatgccttcacccagttccccctattgttgacatcttagatttgtatggttctttcgt

SEQ ID NO: 18261 - DNA, 164 bp, Homo sapiens
  D12S1725
  Located on chromosome 12
  Distance between a terminus base of telomere on chromosomal short arm and 5'-terminus of this base sequence : 4286180
  Distance between 3'-terminus of neighbour sequence of sequence listing upward to telomere on chrosomal short arm and 5'-terminus of this base sequence : 262275
tttgtcccttggagattttttgtatgttctgtgggcccagcaatgcagcacacacacacacacacacacacacacacacacacacacacacacacactcacacacatacaccatttagatctttagtaggaggtcccttcagagtgtccagccaaccgttatcc

SEQ ID NO: 18262 - DNA, 309 bp, Homo sapiens
  AC005832.1_166167
  Located on chromosome 12
  Distance between a terminus base of telomere on chromosomal short arm and 5'-terminus of this base sequence : 4478576
  Distance between 3'-terminus of neighbour sequence of sequence listing upward to telomere on chrosomal short arm and 5'-terminus of this base sequence : 192232
catcttgctagccttactgtattctaatgggaagctaatgagaaccaggaacaaaccagcacatctttttaaatttactcctttgggactattaaatcagttacacacacacacacacacacacacacacacacacacacacacaaacaaaagtgatttagtcctaatatactctcacaatcaaagcaacactaaaactattatcttaatggcatatacacccaatgtcttaaataagtgtttttaagataataaatattattagattctgctaaattacaatggattatctagaaggacacatcctga

SEQ ID NO: 18263 - DNA, 255 bp, Homo sapiens
  AC005832.1_108374
  Located on chromosome 12
  Distance between a terminus base of telomere on chromosomal short arm and 5'-terminus of this base sequence : 4536390
  Distance between 3'-terminus of neighbour sequence of sequence listing upward to telomere on chrosomal short arm and 5'-terminus of this base sequence : 57505
ggtatttgagaatggagtacaagtgtgcagagatgtagaggccaccagtcctcggggtcacttggtcacctggggctgctaaactcctgggctgcgtacacacacacacacacacacacacacagacacacacacacacccctttgctctgtcagctaagctctgagtccatggttttcctgttcatgggaaatgagcaaagatcgctctctccattttgcaaataaggaaaatgaactctagcagacaactttg

SEQ ID NO: 18264 - DNA, 229 bp, Homo sapiens
  D12S1624
  Located on chromosome 12
  Distance between a terminus base of telomere on chromosomal short arm and 5'-terminus of this base sequence : 4551597
  Distance between 3'-terminus of neighbour sequence of sequence listing upward to telomere on chrosomal short arm and 5'-terminus of this base sequence : 14952
gctaaagatttacataagatttccatatgtctagtcttaagtgagaccagtctgtagggtttgtgtgtgtgtgtgtgtgtgtgtgtgtgtgtgtgtatctttgtcctgtttgaataccaaagttgcatcttgaaaaaatgaattgatcattttctattttctgttccttcaaagtctgaacaaaataggaatcattttattttcacaaggcctcttagaacctaattgg

SEQ ID NO: 18265 - DNA, 130 bp, Homo sapiens
  G09388
  Located on chromosome 12
  Distance between a terminus base of telomere on chromosomal short arm and 5'-terminus of this base sequence : 4556039
  Distance between 3'-terminus of neighbour sequence of sequence listing upward to telomere on chrosomal short arm and 5'-terminus of this base sequence : 4213
ttttgtgtgcaaacaccaagctagctggctggctggctatctatctatctatctatctatctatctatgtatctgtatctatctatctttgccaaatttctattttccagattgtctcaaagttacagag

SEQ ID NO: 18266 - DNA, 423 bp, Homo sapiens
  AC005832.1_69389
  Located on chromosome 12
  Distance between a terminus base of telomere on chromosomal short arm and 5'-terminus of this base sequence : 4575275
  Distance between 3'-terminus of neighbour sequence of sequence listing upward to telomere on chrosomal short arm and 5'-terminus of this base sequence : 19106
gcgttgctaataccatgtaaataccacttaattaagcagagaaagcctgtttttccttatcttctgattcctatgatgatgaaattttctaaataattctagcctcttgtgccaccctttgctacttaatgattaacagcagttggtccacttttctcaatcaagaggagacaatcaaaagcactgaggaagagaaaatgagagagagagagagagagagagagcaagcgagcgagaaggcagagaggagagagaagagaaggttgtagggatggtctttttaattcccgcacttcagtgtgaagcatctggggtaagtgtgcgtgttctccagactcaaaccctccctttggcgcgcagttctgatgcttactgggcaccttgggtggaggacaagaacttatcaggcacgtttacctttat

SEQ ID NO: 18267 - DNA, 299 bp, Homo sapiens
  AC005833.1_108906
  Located on chromosome 12
  Distance between a terminus base of telomere on chromosomal short arm and 5'-terminus of this base sequence : 4753476
  Distance between 3'-terminus of neighbour sequence of sequence listing upward to telomere on chrosomal short arm and 5'-terminus of this base sequence : 177778
aacatcaatgagtttgtggaaccagtgggtgctactgcaggaaattaaccctcgaagttcaagatatctgacttctttttaatgtaactctcagatgaccaaatttttggtgtgtgtgtgtgtgtgtgtgtgtgtgtgtgtagaaggaggggaacaaaaggaaaacagcaaaaattgactgcaaagtatagaattacccggtcatccatttttctccccttcttccccaggattcaatgctgtcttctctctccagcagaaaaagtaggagaaggttaagagaaggagtaaacatgacc

SEQ ID NO: 18268 - DNA, 256 bp, Homo sapiens
  D12S314
  Located on chromosome 12
  Distance between a terminus base of telomere on chromosomal short arm and 5'-terminus of this base sequence : 4808967
  Distance between 3'-terminus of neighbour sequence of sequence listing upward to telomere on chrosomal short arm and 5'-terminus of this base sequence : 55192
agcagaccctgtctctcataattgaaaagcgtgtgtgtgtgtgtgtgtgtgtgtgtgtgtgtgtgtgtgtgtgtgtatgtatgcatccttttcatattccttaaaacatttttagcaggtaaaatcatgtctctatgctattctctcactgccagccacagaaaggatcttacacaaagaagtccatggggctccccttctcctgcactcaagtcctggataggagttctgacttttctgagtgacagttcccaaa

SEQ ID NO: 18269 - DNA, 386 bp, Homo sapiens
  chr12.fa.O7frz.5175101
  Located on chromosome 12
  Distance between a terminus base of telomere on chromosomal short arm and 5'-terminus of this base sequence : 4882106
  Distance between 3'-terminus of neighbour sequence of sequence listing upward to telomere on chrosomal short arm and 5'-terminus of this base sequence : 72883
ggcattctaaattctggtattctaaattcaagctccacaaggagcttggtgcagtgagacagacagacatgaccacggacattgggataagccaagaacactaggagcagaggaagccaagaacaagctaggggagcccagaagaggaagtcctggttctgaaaggaatgtctagagaacttctgagagggggaaatgtttacattgggccttagagcattctttctttctttcttcttcttcttcttcttcttcttcttcttcttcttcttcttcttcttcttcttcttcttcttcttcttcttcttcttcttcttcttcttctcttaaaacaatataaatttatttcctcacaattctggggctttgaagtctgaaatcaaaga

SEQ ID NO: 18270 - DNA, 230 bp, Homo sapiens
  AC005906.1_183689
  Located on chromosome 12
  Distance between a terminus base of telomere on chromosomal short arm and 5'-terminus of this base sequence : 4919369
  Distance between 3'-terminus of neighbour sequence of sequence listing upward to telomere on chrosomal short arm and 5'-terminus of this base sequence : 36877
ttatgttcatcgattagcctattcatttatgcttccattcattcattcattcattcattcattcattcattcaatgttcattgatcacctactacattcctagcactgagtttggttgtggagctcccaagataaaaatggggagtactctgagctccatgaatagagggttaataaaagagagagcaggtcaattatttggaactctaattagtgtgatttccactcac

SEQ ID NO: 18271 - DNA, 472 bp, Homo sapiens
  AC005906.1_117666
  Located on chromosome 12
  Distance between a terminus base of telomere on chromosomal short arm and 5'-terminus of this base sequence : 4985297
  Distance between 3'-terminus of neighbour sequence of sequence listing upward to telomere on chrosomal short arm and 5'-terminus of this base sequence : 65698
tcaaaccttataggtagtggtcagaggtgtagagtgggactcaaccattgttttctgcctgccaatgtcatgctcattacatggcctagagaggatgctagcagccaggccctcctcacctcagcccaaagacagacagacagacacacacacacacacacacacacattgcaattttgccttattcctgggctctaggaaagcagccttcaccacttggtaactggttttcaatgttatccagtttagtagagtaataccagggagctgagagtcaccaggcccttcacaaagtcagccgtgggggcgtttgccagtcatttctttgtcggcaaagacaaaagctttgaagctccatcgaaaaatgcaatgggtggtggccaagcctcagctgagagtgtgagagtccttattgcgatcctcaatatcatattcccacagttggcatcagtccgctacaaataaggaagtt

SEQ ID NO: 18272 - DNA, 178 bp, Homo sapiens
  D12S1594
  Located on chromosome 12
  Distance between a terminus base of telomere on chromosomal short arm and 5'-terminus of this base sequence : 4985330
  Distance between 3'-terminus of neighbour sequence of sequence listing upward to telomere on chrosomal short arm and 5'-terminus of this base sequence : -439
gtgggactcaaccattgttttctgcctgccaatgtcatgctcattacatggcctagagaggatgctagcagccaggccctcctcacctcagcccaaagacagacagacagacacacacacacacacacacacacattgcaattttgccttattcctgggctctaggaaagcagccttc

SEQ ID NO: 18273 - DNA, 219 bp, Homo sapiens
  AC005906.1_97704
  Located on chromosome 12
  Distance between a terminus base of telomere on chromosomal short arm and 5'-terminus of this base sequence : 5005283
  Distance between 3'-terminus of neighbour sequence of sequence listing upward to telomere on chrosomal short arm and 5'-terminus of this base sequence : 19775
agaaataggttccagatgttgacagctggtggccaccagggcagacctaagtctgtgtggagcttgcaatttcccagagccacacagaggcctttgttctgcagctttgtgtgtgtgtgtgtgtgtgtgtgtgtgtgtgtgtgttttgtttttttgtttgagatggagtcttgctctgtcaccctggctggagtgcagtggtatgatcttggttcactg

SEQ ID NO: 18274 - DNA, 268 bp, Homo sapiens
  AC005906.1_16844
  Located on chromosome 12
  Distance between a terminus base of telomere on chromosomal short arm and 5'-terminus of this base sequence : 5086157
  Distance between 3'-terminus of neighbour sequence of sequence listing upward to telomere on chrosomal short arm and 5'-terminus of this base sequence : 80655
gtgaagacatggagaaacagatacagatagagccagaaacagacaaagtcaggcagagacacaaacagaaactctttcatgtagtagaaacacacacacacacacacacacacacacacacacacacacagacacactccaggagaaataaacatatgcacaaagcatacagagacctggctaaactaaattagaagcatacacattttagagacctacacattgagagagatggagagaactaagggttctttggatgctaggaaga

SEQ ID NO: 18275 - DNA, 279 bp, Homo sapiens
  D12S93
  Located on chromosome 12
  Distance between a terminus base of telomere on chromosomal short arm and 5'-terminus of this base sequence : 5171469
  Distance between 3'-terminus of neighbour sequence of sequence listing upward to telomere on chrosomal short arm and 5'-terminus of this base sequence : 85044
gctggtggacactgagtttgtggtcatgcattctaggtggtagagggcaaaaggctggaagggaaggtgcaagaggaagaaagacaagaaagaaacattcagcctcacaggaccagtgggtggaaaggctggtatttgagcagagatcctacagacacacacacacacacacacacacacacacacacacacactatgttctttctctctatctcaaggcctgagaaggcagataaaatgcaagagacactttaaggaaagaagccacaagaggtgatg

SEQ ID NO: 18276 - DNA, 163 bp, Homo sapiens
  AC006206.3_37348
  Located on chromosome 12
  Distance between a terminus base of telomere on chromosomal short arm and 5'-terminus of this base sequence : 5171601
  Distance between 3'-terminus of neighbour sequence of sequence listing upward to telomere on chrosomal short arm and 5'-terminus of this base sequence : -147
tatttgagcagagatcctacagacacacacacacacacacacacacacacacacacacacactatgttctttctctctatctcaaggcctgagaaggcagataaaatgcaagagacactttaaggaaagaagccacaagaggtgatgactagtcttggaagca

SEQ ID NO: 18277 - DNA, 386 bp, Homo sapiens
  AC007848.11_87519
  Located on chromosome 12
  Distance between a terminus base of telomere on chromosomal short arm and 5'-terminus of this base sequence : 5331253
  Distance between 3'-terminus of neighbour sequence of sequence listing upward to telomere on chrosomal short arm and 5'-terminus of this base sequence : 159489
cagtctggtgaaatctatggactcgaaaaagtcttcttaagtgcacaaaataaaatgaaggagattaaaaagaataccggtttttaaaagatacagttgtcaacataagaaagaaacaattttgtgatcaataataattgtgctattttataacacattaaatattaataaaaagctgtattagtcagggttctcttagagggacagaactaacaggatatacacacacacacacacacacacacacacacacacatatatgagtttattaagtattaatttatataatcacaaggtcccacccacaataggctgtctgcaagctgaggagcaaggagagccagtccaagtcccaaaactgaagaacttggagtccaatatttgag

SEQ ID NO: 18278 - DNA, 314 bp, Homo sapiens
  AC007848.11_66215
  Located on chromosome 12
  Distance between a terminus base of telomere on chromosomal short arm and 5'-terminus of this base sequence : 5352737
  Distance between 3'-terminus of neighbour sequence of sequence listing upward to telomere on chrosomal short arm and 5'-terminus of this base sequence : 21098
acaatcaaccaaggatgtgtacagagagctagtcaaggggtgtgtgtgtgtgtgtgtgtgtgtgtgtgtgtgtgtgcatgtatgaacagggtgggggtagggaagaaaagcttaatatccgtctttcattcatatagtacacaaacatttatagaaccctattgggcatcagacactaagctggacagtgatatcttaaaacaaaagctctgtgaatatattttttaaatatccaggagtataagttagaggagcccacaagattatgcacgtgaaaatgggataaggatgtaggtgaaggaacattacaacag

SEQ ID NO: 18279 - DNA, 298 bp, Homo sapiens
  AC007848.11_55940
  Located on chromosome 12
  Distance between a terminus base of telomere on chromosomal short arm and 5'-terminus of this base sequence : 5363000
  Distance between 3'-terminus of neighbour sequence of sequence listing upward to telomere on chrosomal short arm and 5'-terminus of this base sequence : 9949
aagatgtttgctgtaggtttgtaggtgttgtgtgggaggtggtatgtatgtgtgtgtgtgtgtgtgtgtgtgtgtgtgtgtgtgtgtgagtagatacactttatcagacttgggagacttttttctgtttttaatttgctgagtttgctagttttatgatgaatgagaatttaatttcaccaaataatttttctgcatctattaagatgatcatatgcttgctttcttttgtgctcttcatgtgctgaattaaactgattttttcaatgttcaatcaatcatgcatttctggaataaa

SEQ ID NO: 18280 - DNA, 257 bp, Homo sapiens
  AC007848.11_34740
  Located on chromosome 12
  Distance between a terminus base of telomere on chromosomal short arm and 5'-terminus of this base sequence : 5384179
  Distance between 3'-terminus of neighbour sequence of sequence listing upward to telomere on chrosomal short arm and 5'-terminus of this base sequence : 20881
ggatatgcttatctatggagtgagattgtgaccattgagtgagtggtcagggagggatggggatgtttttccaaagtgtgtgtgtgtgtgtgtgtgtgtgtgtgtgtgtaggggaaggtggcaaaagagctggagtcctatccctctttggtgcctgggaggtgtgtgtttctggggagtctgtcggatgggcatctgtgtgcttagcgggagacaagagcttgcaggaacataggtgtagctaatgcgaaatctgt

SEQ ID NO: 18281 - DNA, 436 bp, Homo sapiens
  AC007848.11_13662
  Located on chromosome 12
  Distance between a terminus base of telomere on chromosomal short arm and 5'-terminus of this base sequence : 5405090
  Distance between 3'-terminus of neighbour sequence of sequence listing upward to telomere on chrosomal short arm and 5'-terminus of this base sequence : 20654
cttcgatcgttgtcagctctgggaggcttatgccaagcttcttgagcgtaacccatgactgcctgggttaggtgttgtgagctgtccaggaggcaggaggacgatgcatgcaagtcagggcttagggcagaagtgcctgggcctggcctccccttggactccaggagtcctgtcctaacagagcccacagccccctatccatctggcctctgtaacccctccccaacacacacacacacacacacacacacacacacacacacacacacacacacatagcccctgtgattgagggggccccaattcctgttcatatcctccaggatagcccacctgcaccctcgacagtgagagacaaagttctattccctgtttagatgggtgctggggacaatggaaaggaggtgtggctctgagaagttcatgtcttgctcag

SEQ ID NO: 18282 - DNA, 220 bp, Homo sapiens
  D12S99
  Located on chromosome 12
  Distance between a terminus base of telomere on chromosomal short arm and 5'-terminus of this base sequence : 5405215
  Distance between 3'-terminus of neighbour sequence of sequence listing upward to telomere on chrosomal short arm and 5'-terminus of this base sequence : -311
ggcagaagtgcctgggcctggcctccccttggactccaggagtcctgtcctaacagagcccacagccccctatccatctggcctctgtaacccctccccaacacacacacacacacacacacacacacacacacacacacacacacacacatagcccctgtgattgagggggccccaattcctgttcatatcctccaggatagcccacctgcaccctcga

SEQ ID NO: 18283 - DNA, 110 bp, Homo sapiens
  D12S1673
  Located on chromosome 12
  Distance between a terminus base of telomere on chromosomal short arm and 5'-terminus of this base sequence : 5610885
  Distance between 3'-terminus of neighbour sequence of sequence listing upward to telomere on chrosomal short arm and 5'-terminus of this base sequence : 205450
gaggtgcattttccaggggagaatgtcttaatttttgtcagattccaaatgatttatcacacacacacacacacacacacacacacaataaggatgaacatgctggaccc

SEQ ID NO: 18284 - DNA, 373 bp, Homo sapiens
  AC007539.8_61344
  Located on chromosome 12
  Distance between a terminus base of telomere on chromosomal short arm and 5'-terminus of this base sequence : 5611862
  Distance between 3'-terminus of neighbour sequence of sequence listing upward to telomere on chrosomal short arm and 5'-terminus of this base sequence : 867
cactggctatgaaggactaaatagaaaacgtagggagagaaaacagcaggtggaaggctccctgaaaaaataagctgtgctggactacacacacacacacacacacacacacacacacacacacacacacacgcatgcacagggagggaggcaggaaggagggggtaagaggaggggaggagaggcacaggaggaaaggggaggggaagtgggggcctctggcttgggcagtgctttgcaagcagtgtgaatgacactccagtggcttgctaatgggtggcagatgtgtccaggtatggatgttttcagacctctggggggtacctggggtgtgctggtggcagactcagctctttatcctggtaggcttcaa

SEQ ID NO: 18285 - DNA, 265 bp, Homo sapiens
  AC007539.8_54900
  Located on chromosome 12
  Distance between a terminus base of telomere on chromosomal short arm and 5'-terminus of this base sequence : 5618327
  Distance between 3'-terminus of neighbour sequence of sequence listing upward to telomere on chrosomal short arm and 5'-terminus of this base sequence : 6092
gaacttacctgaccaacctatttaatatatgtattttgtgtctttttaaattttattgtgaacatgcagaaaaatccattttacacacacacacacacacacacacacacaatgaataaaacaaacaccaatatagcccagaccagcactgccagcagctctgaattcccttctcccccgtacacatacatgatctcccatccctgctgctcctttggatccaaccactgtgcagaattttatgataatcattctcttgctcatt

SEQ ID NO: 18286 - DNA, 407 bp, Homo sapiens
  AC007539.8_3410
  Located on chromosome 12
  Distance between a terminus base of telomere on chromosomal short arm and 5'-terminus of this base sequence : 5669753
  Distance between 3'-terminus of neighbour sequence of sequence listing upward to telomere on chrosomal short arm and 5'-terminus of this base sequence : 51161
aactagaaggtggccaatttaccagctctgtttgattccaaaactctccactataaaaaaatgtgcaccaccaacctgcgccagtccccaaagcttcgaggatctctgcttcagttccttagcagaagggtttaccagagacagagagagagagagagagagagagagagagagaataaaacagacacaaatagggacagaaggagaaagctagaggagagagaaggagaaagccacaggagagagaaagagtgtcagatacaggcagccaacatgggtcctctttggggaaggatgagcagttcagacccactagcgagtggtgagccaggcctcctaagacccacgctaggatcaccagctcccgagtgtccccacaaagagtttacagagaagcaagtttcaag

SEQ ID NO: 18287 - DNA, 209 bp, Homo sapiens
  D12S356
  Located on chromosome 12
  Distance between a terminus base of telomere on chromosomal short arm and 5'-terminus of this base sequence : 5715186
  Distance between 3'-terminus of neighbour sequence of sequence listing upward to telomere on chrosomal short arm and 5'-terminus of this base sequence : 45026
ctaggtgaaactgctagaaatactccacatccttgagagccaatagatatgttacacacacacacacacacacacacacacacacacgctcctttctccacttctaagttatgagaggagggtaaacactgatctggagaagtaaagtaaggatggcgggatgaagaaaataaaaagggaggggtctgcaggattttttgacaagcctc

SEQ ID NO: 18288 - DNA, 183 bp, Homo sapiens
  Z67538
  Located on chromosome 12
  Distance between a terminus base of telomere on chromosomal short arm and 5'-terminus of this base sequence : 5823073
  Distance between 3'-terminus of neighbour sequence of sequence listing upward to telomere on chrosomal short arm and 5'-terminus of this base sequence : 107678
ttcccagccaccataattgtattaatcaattcctcataacacctctgtgtgtgtgtgtgtgtgtgtgtgtgtgtgtgtcctgttggttctgtttctctggagaaccctaatacaagcctcaaatctggataactgagaaataagaggtgctgcagtcctggctgagtagagtccctcaggccg

SEQ ID NO: 18289 - DNA, 281 bp, Homo sapiens
  G08963
  Located on chromosome 12
  Distance between a terminus base of telomere on chromosomal short arm and 5'-terminus of this base sequence : 5833284
  Distance between 3'-terminus of neighbour sequence of sequence listing upward to telomere on chrosomal short arm and 5'-terminus of this base sequence : 10028
tcgatgatcagtgatgttaagcattttttcatatacctgttgtccatttctatgtcttcttttatgaagtgtttatttagatcctttgcccagtttttaattagattatttgttgaatcaacctaaatgtccatcaagagaggaatggataaaagaaatgtgatagatagatagatagatagatagatagatagatagatagatagatgcccactggaatagtactcagccataaaaagaatgatatcctgctattcacagcaatatggatgagcctggag

SEQ ID NO: 18290 - DNA, 381 bp, Homo sapiens
  AC006576.15_27811
  Located on chromosome 12
  Distance between a terminus base of telomere on chromosomal short arm and 5'-terminus of this base sequence : 5941942
  Distance between 3'-terminus of neighbour sequence of sequence listing upward to telomere on chrosomal short arm and 5'-terminus of this base sequence : 108377
ccagatctttggagtcacatagagcttcaaattctgagatcaactccattacttataaattgtttccatgggtaacttactgagctctttaggtcttagtttcttcataggatttttgtatttatgagtgacacaggatacaataatgtattctgtggaatcccagtcccaagggattctcacacacacacacacacacacacacacacacacacacacatgcacacacacgctccatgatcaaataagtttgagaaacaaaaactctcttaaatatctgcaaggtacagtagtatattaaaaagactaaagagttctgcaataaagaagcctgtttaactatggttagctggtgttctttaaactcacttgaccacaagt

SEQ ID NO: 18291 - DNA, 271 bp, Homo sapiens
  AC006576.15_36094
  Located on chromosome 12
  Distance between a terminus base of telomere on chromosomal short arm and 5'-terminus of this base sequence : 5950229
  Distance between 3'-terminus of neighbour sequence of sequence listing upward to telomere on chrosomal short arm and 5'-terminus of this base sequence : 7906
tatttggtgacaacctgaaaagcatagtttcaaggggactgggagcaaaaaaaaatggaaaggtgcttggaaagtgactggagacataaaaataaagcaaacgggaaagtcagggtccagaaaaacctgaaaaatcagaggccacacaatccttcaggatccacatgtacacacatacacacacacacacacacacacacacacacacaccactaaggaaatgacttttctatactaatagaaaggagggtcactgaaccagaaatcttgt

SEQ ID NO: 18292 - DNA, 392 bp, Homo sapiens
  AC006576.15_64483
  Located on chromosome 12
  Distance between a terminus base of telomere on chromosomal short arm and 5'-terminus of this base sequence : 5978687
  Distance between 3'-terminus of neighbour sequence of sequence listing upward to telomere on chrosomal short arm and 5'-terminus of this base sequence : 28187
ctttccaacctctagaaccatatgataataaatgtgttgttttaagctatcaagtttttggtgatttgttatagcagcaataaaaaaacaaatacatggaagacacatacacacacacacacacacacacacacacacacacccctaaacaaaaaaacttttttcccctgctgtatccacagcgcctaggaccacgtttgacacatacaggaactcagtatttgttgaataaatgaatgaatgaattgttaatgctttctgggactgagatgggctgccacagagaagtgagggcagtgctgcctcactggcttgtacaagctgaaaatggatggtgttatcagggatgctgtggaggccattcctgcctgactaaaccagtggctagagta

SEQ ID NO: 18293 - DNA, 392 bp, Homo sapiens; identical to SEQ ID NO: 18292
  AC005846.1_92762
  Located on chromosome 12
  Distance between a terminus base of telomere on chromosomal short arm and 5'-terminus of this base sequence : 5978687
  Distance between 3'-terminus of neighbour sequence of sequence listing upward to telomere on chrosomal short arm and 5'-terminus of this base sequence : -392

SEQ ID NO: 18294 - DNA, 335 bp, Homo sapiens
  AC005846.1_64847
  Located on chromosome 12
  Distance between a terminus base of telomere on chromosomal short arm and 5'-terminus of this base sequence : 6006628
  Distance between 3'-terminus of neighbour sequence of sequence listing upward to telomere on chrosomal short arm and 5'-terminus of this base sequence : 27549
atagatgctaattcctttcactgtttctcataactcctcttccaacaggaccatctactttatatatatatatatgtatacacacacacacacacacacacacacacacacacacagggtctttctctgttggccaggtcagagtgcagtggtgcgatcataactcactgcagccttaaattcctagactcaagcaatcctcttgcctcaacctcccaagtagctgggactacacctacattttaatttctaaacacatctactttaccctaaaaaacagaatatccactatgccttattcttaacagaatatactcgtcacttctatgcctact

SEQ ID NO: 18295 - DNA, 279 bp, Homo sapiens
  chr12.fa.O7frz.6615547
  Located on chromosome 12
  Distance between a terminus base of telomere on chromosomal short arm and 5'-terminus of this base sequence : 6209350
  Distance between 3'-terminus of neighbour sequence of sequence listing upward to telomere on chrosomal short arm and 5'-terminus of this base sequence : 202387
gagatcaggagttctagaccagcctggccaacatggtgaaactctgtctctactaaaactacaaaaattagctgggcttggtggcaggcgtctgtaatcccagctattcaggaggctgaggcaggagaatcgcttgaacccgggaggccgaggttgcagtgagccaagatcgtgccactgcactccagcctgggggacaagagcaagacttcatctcaaataataataataataataataataataataataataataacaatccattacttgatttgt

SEQ ID NO: 18296 - DNA, 130 bp, Homo sapiens
  DISO7_10003217
  Located on chromosome 12
  Distance between a terminus base of telomere on chromosomal short arm and 5'-terminus of this base sequence : 6262031
  Distance between 3'-terminus of neighbour sequence of sequence listing upward to telomere on chrosomal short arm and 5'-terminus of this base sequence : 52402
tgtcatccctggacatctctctatctctgtctagctctcaccacacacacacacacacacacacacacacacacacacacacacacacacacacacagtgaatgggaagagggaagggctaggaactagg

SEQ ID NO: 18297 - DNA, 477 bp, Homo sapiens
  chr12.fa.O7frz.6704709
  Located on chromosome 12
  Distance between a terminus base of telomere on chromosomal short arm and 5'-terminus of this base sequence : 6298445
  Distance between 3'-terminus of neighbour sequence of sequence listing upward to telomere on chrosomal short arm and 5'-terminus of this base sequence : 36284
tttacaactttgacacgtcatattacatttttcaataaaattttgtttaaaaaaaaagatgatgagaagtgagtggatctaggaatatgaaaagctaacacgtttcgtggaggaggtgagaatgagaccatcatccctccagggacagaaaaaaatcatggtcagaggagatggagaaacaggagaggggcagactagggatgacagaatcggctgttagggcttgtagagcaaaggatgaagaaaacagctacagagagcagggaccttcctcccgcatcatggcacacacacacacacacacatgcttaacccaaagggtcactggactccaagtccagatgacgtgggttctagccccagacctgccattcagactctatgtgtcacagggtggcagggtgagtcatagaaagggagctgggttcatggcaggttctctaagaattatgaagctcagcaagtcacttcaactac

SEQ ID NO: 18298 - DNA, 127 bp, Homo sapiens
  DISO7_10019944
  Located on chromosome 12
  Distance between a terminus base of telomere on chromosomal short arm and 5'-terminus of this base sequence : 6560926
  Distance between 3'-terminus of neighbour sequence of sequence listing upward to telomere on chrosomal short arm and 5'-terminus of this base sequence : 262004
tggccatcccataatacacacggacacccccccccccaacacacacacacacacacacacacacacacacacacacacacacaacacacacacaccctgcccccccacatttcatacacatatgcca

SEQ ID NO: 18299 - DNA, 221 bp, Homo sapiens
  D12S1623
  Located on chromosome 12
  Distance between a terminus base of telomere on chromosomal short arm and 5'-terminus of this base sequence : 6813055
  Distance between 3'-terminus of neighbour sequence of sequence listing upward to telomere on chrosomal short arm and 5'-terminus of this base sequence : 252002
tccaacctgggcaacaatagcgaaactccatctcaaaaaaaaaaaagcaaagggcatatagtgaaaagctttcttcctacacatgagtattcacttcctcttcctagaggcaaccaaggttatttttgtgtgtgtgtgtgtgtgtgtgtgtgtgtgtgtgtgttttgggacagtctcactctctcaccaaggctggaatgcagtggtgcgatctcactgca

SEQ ID NO: 18300 - DNA, 229 bp, Homo sapiens
  U47924.1_24784
  Located on chromosome 12
  Distance between a terminus base of telomere on chromosomal short arm and 5'-terminus of this base sequence : 6813158
  Distance between 3'-terminus of neighbour sequence of sequence listing upward to telomere on chrosomal short arm and 5'-terminus of this base sequence : -118
ctagaggcaaccaaggttatttttgtgtgtgtgtgtgtgtgtgtgtgtgtgtgtgtgtgttttgggacagtctcactctctcaccaaggctggaatgcagtggtgcgatctcactgcaaactctgcctcccagtctcaagcgatcttgtgcctcagcctcccagtttttttttcttttaaatggggtctcattctgtcgcccagggtggagtgcagtggcatgatcata

SEQ ID NO: 18301 - DNA, 152 bp, Homo sapiens
  DISO7_10019959
  Located on chromosome 12
  Distance between a terminus base of telomere on chromosomal short arm and 5'-terminus of this base sequence : 6925445
  Distance between 3'-terminus of neighbour sequence of sequence listing upward to telomere on chrosomal short arm and 5'-terminus of this base sequence : 112058
gagaccaatgggttgtggggggctgagccagagagggagctggggtgagggatggctggggctgtgtgtgtgcgtgtgcgtgtgtgtgtgtgtgtgtgtgtgtgagagagagagagagagatgtcccctgcagctggactataagcctggcc

SEQ ID NO: 18302 - DNA, 301 bp, Homo sapiens
  chr12.fa.O7frz.7697528
  Located on chromosome 12
  Distance between a terminus base of telomere on chromosomal short arm and 5'-terminus of this base sequence : 7243064
  Distance between 3'-terminus of neighbour sequence of sequence listing upward to telomere on chrosomal short arm and 5'-terminus of this base sequence : 317467
ttacagcatctagatttggactagttatatttcaagtattcaacggccatctgaagttagcagctgctatactgggtaatgcagaaaagctacaaagatttcttggccgattagatgtggtggtggtggtggtggtggtggtgtgtgtgtgtgtgtgtgtgtgtgtgtgtgtgtgctgggagcctagaggtaaggaaacaagagatattgaccatgactcccaggtctctggcctggctggttattgccattagtggagagagtagatataaaagtggggtaggtttggataggaagacag

SEQ ID NO: 18303 - DNA, 365 bp, Homo sapiens
  AC006927.26_9784
  Located on chromosome 12
  Distance between a terminus base of telomere on chromosomal short arm and 5'-terminus of this base sequence : 7491363
  Distance between 3'-terminus of neighbour sequence of sequence listing upward to telomere on chrosomal short arm and 5'-terminus of this base sequence : 247998
aggttaattggaacagctattaacaaacaaatgcccatgacctaccagcaaaataacttactgttgttagacactgaaccagactatgaagaagaaagtaaagtagtcctaaaatgatttgaggacgaaaggacccaaaaattaaagtaaaaataagaccaaaagatgaaaagaaagaaagaaagaaagaaagaaagaaagcaagaaagaaaagagaagagaagaaaaggaaaggaaagaaaaaaaagggaacttgtaagaaaacattttaatggtccattttcaaggcatgatagacctaagtactcgcagccagcctgcggatatgacaaactgcacagcttatgcacgtagaaagtcataat

SEQ ID NO: 18304 - DNA, 326 bp, Homo sapiens
  AC006927.26_65257
  Located on chromosome 12
  Distance between a terminus base of telomere on chromosomal short arm and 5'-terminus of this base sequence : 7546837
  Distance between 3'-terminus of neighbour sequence of sequence listing upward to telomere on chrosomal short arm and 5'-terminus of this base sequence : 55109
tctcggtagcagagtcaatacaagcccaaacctcagcatcacacaatatatacccttgtaacaaatctgcacgtgtaccccatgaatctgaaataaaaattataattaaaaaataagaaagagtatttggtagtgtggagagaagccaggatatctttgatgacagatgatagatagatagatagatagatagatagatagatagatatctctttataattgtaattatacatattttaaaccacaactcgagaggaaggagaaaagataactgaatgagtaataagtgtaaaaagatacttgtaaagaacatatggaaagatcct

SEQ ID NO: 18305 - DNA, 241 bp, Homo sapiens
  U72889.1_1197
  Located on chromosome 12
  Distance between a terminus base of telomere on chromosomal short arm and 5'-terminus of this base sequence : 7551152
  Distance between 3'-terminus of neighbour sequence of sequence listing upward to telomere on chrosomal short arm and 5'-terminus of this base sequence : 3989
ggttaaagtcacttggagatgtaaatatttactaataataaaccatcttatttaagactaatatattaatcaataatagggaagtttgaaaacacccacagatgcaagaatcagcaggacacacacacacacacacacacacacacacacacacacacacacacacacacaccattcttgcattgttcaagaatacttgccaagcccccggatccattttacctttctcagaagtcatggt

SEQ ID NO: 18306 - DNA, 380 bp, Homo sapiens
  M12_7671449
  Located on chromosome 12
  Distance between a terminus base of telomere on chromosomal short arm and 5'-terminus of this base sequence : 7671237
  Distance between 3'-terminus of neighbour sequence of sequence listing upward to telomere on chrosomal short arm and 5'-terminus of this base sequence : 119844
ctgaaggcgtaaatactgacatattggggaggtttctttttcttcttggtttttattttatcttagaggtagggtctttgtcactcaggctggagcaccgtggcttgattatagctcactgcagccctgatctctaaggctcaggtgattctcccacctcagcccctcaagtagttgggactacaggtacatgctaccatacctggctaatttttgtttgtttgtttgtttgtttttttttttttggtagagagaaggtctcactatgttgcccaggcctcaagtaatcctcctgcctttgccccacaaagtgctgggattacaggtgtgaggcattgtggccagccaataagttttaagtggaagagagtggttgtctt

SEQ ID NO: 18307 - DNA, 378 bp, Homo sapiens
  AC006511.5_43458
  Located on chromosome 12
  Distance between a terminus base of telomere on chromosomal short arm and 5'-terminus of this base sequence : 7841268
  Distance between 3'-terminus of neighbour sequence of sequence listing upward to telomere on chrosomal short arm and 5'-terminus of this base sequence : 169651
tcattacactgaaacgcattatagaggttaatattgatttagctaagggaagagggtagtgaagaatttttttttaaaaaaaaatagttttataggttggaaaactgttttctaaccatttatttatttgtgtgtgtgtgtgtgtgtgtgtgtgtgtgtgtaatagagtctcactcttccacccaggctggagtgcaatggcgcgatcttggctaactgcaacctcgggttcaagcaattctcttgcctcagcctcctgagtagctgagattacaggcacaggccaccatgcccagctaatttcttttgtatttttagtaaagacggggttccaccaagttggccaggctggtctcaaactcctgacttcaggaaatc

SEQ ID NO: 18308 - DNA, 397 bp, Homo sapiens
  AC006511.5_47602
  Located on chromosome 12
  Distance between a terminus base of telomere on chromosomal short arm and 5'-terminus of this base sequence : 7845361
  Distance between 3'-terminus of neighbour sequence of sequence listing upward to telomere on chrosomal short arm and 5'-terminus of this base sequence : 3715
caaccgttgtaaagcttatgatcataacctttgctcactggtaaaactgctgaaggaaaaaccgaatggtggatgatgacagttggtgacgaaattgacaacagtacaaaaaataaatcagataatccagagtggcaagcaacacgattacccataaatgtgcatggggaactggaaaggtgtgtgtgtgtgtgtgtgtgtgtgtgtgtgtgtgtgtgtgtgagagagagagagagagaaaggatgaggatgataagctgaaggacgcagggaagagcgaatgaaaggggactggcaatggagcaagcacgactgaaagtgcatgatggggagcagatgggtgccccaggggattacgggagaggcagagtggaataacgcagagtggtaatttaat

SEQ ID NO: 18309 - DNA, 210 bp, Homo sapiens
  D12S397
  Located on chromosome 12
  Distance between a terminus base of telomere on chromosomal short arm and 5'-terminus of this base sequence : 7923139
  Distance between 3'-terminus of neighbour sequence of sequence listing upward to telomere on chrosomal short arm and 5'-terminus of this base sequence : 77381
ttcagatagagggaaaggcatatgtgtattagtcagggttctcttaaagggagagaactaataggatagatagatgattgattgatagatagatagatagatagatagatagatagatagatagatagataaatagatagatagatagatagagtttattaagtattaacttacacgataacagagtcccacaataggctgtctgcaagc

SEQ ID NO: 18310 - DNA, 207 bp, Homo sapiens
  D3S2395
  Located on chromosome 12
  Distance between a terminus base of telomere on chromosomal short arm and 5'-terminus of this base sequence : 7923142
  Distance between 3'-terminus of neighbour sequence of sequence listing upward to telomere on chrosomal short arm and 5'-terminus of this base sequence : -207
agatagagggaaaggcatatgtgtattagtcagggttctcttaaagggagagaactaataggatagatagatgattgattgatagatagatagatagatagatagatagatagatagatagatagataaatagatagatagatagatagagtttattaagtattaacttacacgataacagagtcccacaataggctgtctgcaagc

SEQ ID NO: 18311 - DNA, 470 bp, Homo sapiens
  AC006511.5_135815
  Located on chromosome 12
  Distance between a terminus base of telomere on chromosomal short arm and 5'-terminus of this base sequence : 7933566
  Distance between 3'-terminus of neighbour sequence of sequence listing upward to telomere on chrosomal short arm and 5'-terminus of this base sequence : 10217
cagtattgagtcaggaattgagactgctcaccactgcacttacttgtcaactattttcataaatattagttgtttaaagaaagcagcagccaaaaagaagaaccagagaggggagatgtgcagattggcagtgcaaggtgaggaataggcactagagcaacattgaaagagagtttggagcaatggccttcttcttcttcttttggtttgtttactcaggtaataattaaaaaaaaaaaaaaactatgtatttcctctacactgtttgttttttttggggtggtgggacgaaatctcgctctgtcgcccaagctggagtgcactggcgcgatcgcagctcactgcaacctctgccttccgagttcaagcgattccttccacatgtttttaagtgacatctaagaaaattttttttgtgtttaagtagcttccagggattaatttctgctgtccggtatttggtatacatg

SEQ ID NO: 18312 - DNA, 117 bp, Homo sapiens
  DISD22_0008048
  Located on chromosome 12
  Distance between a terminus base of telomere on chromosomal short arm and 5'-terminus of this base sequence : 8101735
  Distance between 3'-terminus of neighbour sequence of sequence listing upward to telomere on chrosomal short arm and 5'-terminus of this base sequence : 167699
ttacactacacgagcatttgcagaaagttgtacccatctttggaaactaccacacacacacacacacacacacacacacacacacctttacatgcaaccctcccttgaggtgcatct

SEQ ID NO: 18313 - DNA, 102 bp, Homo sapiens
  DISD22_0008052
  Located on chromosome 12
  Distance between a terminus base of telomere on chromosomal short arm and 5'-terminus of this base sequence : 8207847
  Distance between 3'-terminus of neighbour sequence of sequence listing upward to telomere on chrosomal short arm and 5'-terminus of this base sequence : 105995
cctctgccttaggtaatactgggtgtgtgtgtgtgtgtgtgtgcgcacgtgtgtgtgcctttgcatgtgtttgaaatatattctgtatcccacattccacat

SEQ ID NO: 18314 - DNA, 109 bp, Homo sapiens
  DISO7_10003233
  Located on chromosome 12
  Distance between a terminus base of telomere on chromosomal short arm and 5'-terminus of this base sequence : 8556442
  Distance between 3'-terminus of neighbour sequence of sequence listing upward to telomere on chrosomal short arm and 5'-terminus of this base sequence : 348493
tacatgcaccttggttggcggggtgtgtgtttgtgtgtgtgtgtgtgtgtgtgtgtgtgtgtgtgtgtgtgtgtgtggagagagagagagccttatcataaggaagaaa

SEQ ID NO: 18315 - DNA, 375 bp, Homo sapiens
  chr12.fa.O7frz.9013944
  Located on chromosome 12
  Distance between a terminus base of telomere on chromosomal short arm and 5'-terminus of this base sequence : 8718656
  Distance between 3'-terminus of neighbour sequence of sequence listing upward to telomere on chrosomal short arm and 5'-terminus of this base sequence : 162105
gtctgatttggctacctatttcttcctaccagacggtgttgagatacaatattctccctcccacaaatatgaagacctttagtcttagtgtggaaataggaaaagctagatgtgagcaaccgacttcacctcgatccttgactctcactattcacaccaggtgattaaagctggggtgctggtggccggcagagcacctggtcataggagctgagctgggacacttgtgtgtgtgtgtgtctgtgtatgtgtgtgtgtacgtgtgtgtgtgtgtgtgttggggatgcagagtgcactgaagtaataggctcacatgtgttttcttcttcctgctctcagttatgtggggagccgtagctcttccaatatggctat

SEQ ID NO: 18316 - DNA, 146 bp, Homo sapiens
  DISO7_10003234
  Located on chromosome 12
  Distance between a terminus base of telomere on chromosomal short arm and 5'-terminus of this base sequence : 8739900
  Distance between 3'-terminus of neighbour sequence of sequence listing upward to telomere on chrosomal short arm and 5'-terminus of this base sequence : 20869
ttatctttggtggtcaagagggggtatgtgtgtgtgtgtgtgtatgtgtgtgccctagaacagcataccatggaaggaatgagagttgcagtaaccttttgtaaagtgagcagggagaggggaaagaagatgctttgacacgtaga

SEQ ID NO: 18317 - DNA, 151 bp, Homo sapiens
  D12S1695
  Located on chromosome 12
  Distance between a terminus base of telomere on chromosomal short arm and 5'-terminus of this base sequence : 8853304
  Distance between 3'-terminus of neighbour sequence of sequence listing upward to telomere on chrosomal short arm and 5'-terminus of this base sequence : 113258
tgtgagccactgcaccagaccgatttgtactttcatgctgcttctatattctctctctttctaatacacacacacacacacacacacacacacacacacattatccatgagtacatagaatataaggttattgtactatggttttgaaggc

SEQ ID NO: 18318 - DNA, 334 bp, Homo sapiens
  AC007436.1_143969
  Located on chromosome 12
  Distance between a terminus base of telomere on chromosomal short arm and 5'-terminus of this base sequence : 8853315
  Distance between 3'-terminus of neighbour sequence of sequence listing upward to telomere on chrosomal short arm and 5'-terminus of this base sequence : -140
gcaccagaccgatttgtactttcatgctgcttctatattctctctctttctaatacacacacacacacacacacacacacacacacacattatccatgagtacatagaatataaggttattgtactatggttttgaaggcctcttccaagtgggaagattttcgagtgaaagtgccataataaacattttcaatatccagcctcaccaatgagaagttgtaagaggactgactgatcaagtgatttagaattatatgggtcttgagggtagtaaatgagcacaggattggggtttgtacgtgggcattacctaatcctagctctgcagattcta

SEQ ID NO: 18319 - DNA, 334 bp, Homo sapiens; identical to SEQ ID NO: 18318
  AC006581.16_151868
  Located on chromosome 12
  Distance between a terminus base of telomere on chromosomal short arm and 5'-terminus of this base sequence : 8853315
  Distance between 3'-terminus of neighbour sequence of sequence listing upward to telomere on chrosomal short arm and 5'-terminus of this base sequence : -334

SEQ ID NO: 18320 - DNA, 359 bp, Homo sapiens
  AC009533.9_98225
  Located on chromosome 12
  Distance between a terminus base of telomere on chromosomal short arm and 5'-terminus of this base sequence : 9133819
  Distance between 3'-terminus of neighbour sequence of sequence listing upward to telomere on chrosomal short arm and 5'-terminus of this base sequence : 280170
tctttgtacaagcaatcacataacagagtcaattatatagttttatcagcagatcacagggccttctttctcttttgttagtgacatagatgaatacacacacacacacacacacacacacacacacatatattctgtataatcattaaaaatgtcacttaatgtaagaaagaatgcggttctcatttacattcttctagtttattattatttcttgagaaaatattgctgggttaattataaaatagattctggctgttgcgtgttagcgcgcgtcccggagtgcgcatgcgcagcggcgggggttgttccggcagcctttcactgaggccacccgccagtttcaaattcagtggcgt

SEQ ID NO: 18321 - DNA, 203 bp, Homo sapiens
  AC009533.9_49226
  Located on chromosome 12
  Distance between a terminus base of telomere on chromosomal short arm and 5'-terminus of this base sequence : 9182844
  Distance between 3'-terminus of neighbour sequence of sequence listing upward to telomere on chrosomal short arm and 5'-terminus of this base sequence : 48666
tgtacatagagcacctcataacagcagaactcgcttccccagtttaaggaatgcaatggagactgagagagacagagagagagagagagagagagagagagaaacaagagactgagagattgggggaggaaaaacagaagagagtgaacagcagaaaaatggcagctttggggataataaaagcataacagttgcaatagact

SEQ ID NO: 18322 - DNA, 304 bp, Homo sapiens
  chr12.fa.O7frz.8890459
  Located on chromosome 12
  Distance between a terminus base of telomere on chromosomal short arm and 5'-terminus of this base sequence : 9271878
  Distance between 3'-terminus of neighbour sequence of sequence listing upward to telomere on chrosomal short arm and 5'-terminus of this base sequence : 88831
aggatggtcttaaacttctgacattgtgatctgcctgcctcggcctcccaaaatgcttacaggcatgagccaccacggccgccccgagtttcttcttaaaccctattttcattaaaaaaaaaattatatatatataaaaaatatataaattgtgtatgaatataaattttgtgtatatatatatatgcacacacacacacacacacacacacacacacacacacacgaataatcccaccttgtctgtgggggacgtttcaaaaccctcaatggatgcttggaactgtggaaagcctaaactgta

SEQ ID NO: 18323 - DNA, 330 bp, Homo sapiens
  chr12.fa.O7frz.8818322
  Located on chromosome 12
  Distance between a terminus base of telomere on chromosomal short arm and 5'-terminus of this base sequence : 9301803
  Distance between 3'-terminus of neighbour sequence of sequence listing upward to telomere on chrosomal short arm and 5'-terminus of this base sequence : 29621
ccaagagtaagcagtaatgtaaactatggactttgcatgatgatgtgtcatgtcagttcatcaagttcaacaaacatgtccttctggtaagggatgttcaaaatggggcaaagatatccatgtatgtgggcagaggatacataggagatccctgtactttctgcctaattttgctgtaaacctaaaattactctaaaaatgattatacacacacacacacacacacacacacacacacacacacacatatatatatatatatagagagagagagagagacggagtctcgctttgttgtcagactagagtgtaatggtgctatctcagctc

SEQ ID NO: 18324 - DNA, 247 bp, Homo sapiens
  AC006432.15_101149
  Located on chromosome 12
  Distance between a terminus base of telomere on chromosomal short arm and 5'-terminus of this base sequence : 9559344
  Distance between 3'-terminus of neighbour sequence of sequence listing upward to telomere on chrosomal short arm and 5'-terminus of this base sequence : 257211
atcatgctccagattaactcaggggttttatttctgtcttctctagcataagacatggttgagaggggtgtgtgtgtgtgtgtgtgtgtgtgtgtgtgtgtgtgtgtgtgtatgtgtatgtgtatgtgtatgtgtgtacttaagccctagcctagtcattaaggcccagctccttcccattccctctcaaagcttcttgacactttaaggtatagtattatcttatcctataatcaggaactccaag

SEQ ID NO: 18325 - DNA, 259 bp, Homo sapiens
  AC006432.15_33306
  Located on chromosome 12
  Distance between a terminus base of telomere on chromosomal short arm and 5'-terminus of this base sequence : 9627241
  Distance between 3'-terminus of neighbour sequence of sequence listing upward to telomere on chrosomal short arm and 5'-terminus of this base sequence : 67650
agtctaatgattgctgtccttaacacacacatccacacacacacacacacacacacaaacatacacacgcgaatgtgcccgtgaaaacgggaggcagaggttagagtgatgtgtctaccaggcatgggaagtgaacggttgccagaaaccagcagaagccaggagagagccatggagttgatctgcctcacagcctctagttggaactcatcccatcaataccttgattttgcacttgtagccttctcaactgacagaa

SEQ ID NO: 18326 - DNA, 275 bp, Homo sapiens
  AC010186.6_74046
  Located on chromosome 12
  Distance between a terminus base of telomere on chromosomal short arm and 5'-terminus of this base sequence : 9734303
  Distance between 3'-terminus of neighbour sequence of sequence listing upward to telomere on chrosomal short arm and 5'-terminus of this base sequence : 106803
ctgaagttgcttatcagcttaataagttttaaggggatgagacaatggggttttctaaatatacaattctgtcatctgcaaacagagataatttgacttcctctcttcctgttgaatacactttctttctttctttcttttacctgattgccctgactagaacttccaatactatattgaataggagtggtgagagagggcatccttgccttgtgccagtttacaaagggaatgcttccagcttttggccactcagtatgatattcgctatgagt

SEQ ID NO: 18327 - DNA, 182 bp, Homo sapiens
  HUMUT1833
  Located on chromosome 12
  Distance between a terminus base of telomere on chromosomal short arm and 5'-terminus of this base sequence : 9745801
  Distance between 3'-terminus of neighbour sequence of sequence listing upward to telomere on chrosomal short arm and 5'-terminus of this base sequence : 11223
aaggaaggtgcagagtcagaagatgaagaagaggaggatgtgaaactcttaagtatatctggaaagcagtctgcccctggaggtgggcagaaaaaagtaaaacttgctgctgctgctgatgatgatgatgatgaagatgatgatgatgatgatgacgaggaagctgaagaaaaagcgccagt

SEQ ID NO: 18328 - DNA, 351 bp, Homo sapiens
  HUMUT6553
  Located on chromosome 12
  Distance between a terminus base of telomere on chromosomal short arm and 5'-terminus of this base sequence : 9797367
  Distance between 3'-terminus of neighbour sequence of sequence listing upward to telomere on chrosomal short arm and 5'-terminus of this base sequence : 51384
gcagcctgcagaaccatgaaccaattaaacctcttttctttatgaattacccatcctcaggtcttccttccttccctccctttcttcctccttttttccctgcctccctcctttccttccttccttccttccttccttccttccttccttccttccttccttccttctcttccttctttttctttctttcttcttttttacagcatcctcactctgttgccctggctctagtgcagtggcaatcccagtccactgcaacctctacctcccaggctcaggtggtccttccacctcaaactcctatgtatctgggatgataggcacatgccaccatgcccggctaatttttgt

SEQ ID NO: 18329 - DNA, 453 bp, Homo sapiens
  AC007068.17_104006
  Located on chromosome 12
  Distance between a terminus base of telomere on chromosomal short arm and 5'-terminus of this base sequence : 9809385
  Distance between 3'-terminus of neighbour sequence of sequence listing upward to telomere on chrosomal short arm and 5'-terminus of this base sequence : 11667
aactcaatttgctactaattgaatcacccaaggataacgtccaaggatgactagggcagcctaaatcagacattcaaaagaaagttgaaacagtatcaggaaaagttaaaaatttctgtattaggtccttctttcacctatgctctctatttattgagtagttattattattattattattattatttctttttggcggcacacctgtgccgtaagtaatggctcgcctgattacctgaaaatttgcatgctttgcatttgtaatccacactatattttatgttcttaaacacaggatggatttatgagaagtaactgatgtttttcggaagtaaactaatatagtagacacacgcttagaaaataatccctttccacaagattgttttagttctcctgtttcttacatatccctttgttaatagatcgctcttgctgacaagtagactaatt

SEQ ID NO: 18330 - DNA, 128 bp, Homo sapiens
  G09364
  Located on chromosome 12
  Distance between a terminus base of telomere on chromosomal short arm and 5'-terminus of this base sequence : 9821680
  Distance between 3'-terminus of neighbour sequence of sequence listing upward to telomere on chrosomal short arm and 5'-terminus of this base sequence : 11842
gttctccaaagaaacagaaccaataggatagatagatagatagatagatagatagatagatagatagatagaatttatatttatcttttatgacacataaaattaaccatcacactaccattttcttt

SEQ ID NO: 18331 - DNA, 175 bp, Homo sapiens
  G09988
  Located on chromosome 12
  Distance between a terminus base of telomere on chromosomal short arm and 5'-terminus of this base sequence : 9821683
  Distance between 3'-terminus of neighbour sequence of sequence listing upward to telomere on chrosomal short arm and 5'-terminus of this base sequence : -125
ctccaaagaaacagaaccaataggatagatagatagatagatagatagatagatagatagatagatagaatttatatttatcttttatgacacataaaattaaccatcacactaccattttctttattcttttgtgttatcttttatgaaaatgtttttttcaaatcttcacccc

SEQ ID NO: 18332 - DNA, 366 bp, Homo sapiens
  AC007068.17_30828
  Located on chromosome 12
  Distance between a terminus base of telomere on chromosomal short arm and 5'-terminus of this base sequence : 9882677
  Distance between 3'-terminus of neighbour sequence of sequence listing upward to telomere on chrosomal short arm and 5'-terminus of this base sequence : 60819
tggcatacagtctaatacggagaaaggagtgtatgtgtagagtgtgtgtgtgtgtgtgtgtgtgtgtgtgtgtatgtgtgtgtatgtgtggtatttgaaacagtttttctgtgtttcttggatactttaatagataaaattttactgttttgcttaaatattttaatacattttatctaaggttgcatttagtttgcttttccttttgtccagcaaatattcaccgagcagctacaatactccaaatattacaaattccccaaaatttttaagaaaagaatagtcagggtgaggaatgtgatattctagtgggagaagcaggtactaagtaattatggtacaatgttctgactacagtgttggagg

SEQ ID NO: 18333 - DNA, 220 bp, Homo sapiens
  Z67367
  Located on chromosome 12
  Distance between a terminus base of telomere on chromosomal short arm and 5'-terminus of this base sequence : 9882677
  Distance between 3'-terminus of neighbour sequence of sequence listing upward to telomere on chrosomal short arm and 5'-terminus of this base sequence : -366
tggcatacagtctaatacggagaaaggagtgtatgtgtagagtgtgtgtgtgtgtgtgtgtgtgtgtgtgtgtatgtgtgtgtatgtgtggtatttgaaacagtttttctgtgtttcttggatactttaatagataaaattttactgttttgcttaaatattttaatacattttatctaaggttgcatttagtttgcttttccttttgtccagcaaatat

SEQ ID NO: 18334 - DNA, 297 bp, Homo sapiens
  chr12.fa.O7frz.33352176
  Located on chromosome 12
  Distance between a terminus base of telomere on chromosomal short arm and 5'-terminus of this base sequence : 9984075
  Distance between 3'-terminus of neighbour sequence of sequence listing upward to telomere on chrosomal short arm and 5'-terminus of this base sequence : 101178
ttcctttccacatgtaactgacccaatctggtttccagatgacaagtatgcaagccccagatgttgagaagccatatttcaactgcttcctgcatctgttgaaatataattgttcatacttgccatcccttatgtttcttgtaacaatttgcacagttcttgccagaataaatgccattctctgtatgcttcagagaattccgcaatttgatcagtgtgtgtgtgtgtgtgtgtgtgtgtgaccttccgtaaaacacttctaaagggtgaaagctcttgtatggcatagacatgaat

SEQ ID NO: 18335 - DNA, 225 bp, Homo sapiens
  AC016958.15_175968
  Located on chromosome 12
  Distance between a terminus base of telomere on chromosomal short arm and 5'-terminus of this base sequence : 10048667
  Distance between 3'-terminus of neighbour sequence of sequence listing upward to telomere on chrosomal short arm and 5'-terminus of this base sequence : 64295
gctgaaatattacttgctgttaaggcctgatgtgtttgtattttttgttttgttttgttttgttttgttttgttttatgctcacccatgccataaataattgctttaataaacagcaaatgaagaatcacactcatttgctcacatatagaaaatgaaatttccactcttttccgttatccccttgacttctatgccctcgagtattaaacgctcagaatcttaa

SEQ ID NO: 18336 - DNA, 200 bp, Homo sapiens
  D12S1674
  Located on chromosome 12
  Distance between a terminus base of telomere on chromosomal short arm and 5'-terminus of this base sequence : 10093497
  Distance between 3'-terminus of neighbour sequence of sequence listing upward to telomere on chrosomal short arm and 5'-terminus of this base sequence : 44605
ccctacttcaaacaagagagcactggtcataagacaattctaccttcccctctcccattcttaaactctttatctaagccacaacccatttttatacctgatattattcccattcatttctatattaatctttaccatggaacagtgtgtgtgtgtgtgtgtgtgtgtgtgtctttaaattgctctgattctctgcatat

SEQ ID NO: 18337 - DNA, 326 bp, Homo sapiens
  AJ131757.1_12287
  Located on chromosome 12
  Distance between a terminus base of telomere on chromosomal short arm and 5'-terminus of this base sequence : 10165082
  Distance between 3'-terminus of neighbour sequence of sequence listing upward to telomere on chrosomal short arm and 5'-terminus of this base sequence : 71385
agtacttccaacagtttctggcacatagtgagtgatatttgtgtttgttaaattatataaaaaataaacatagtaagtgatatttgtattgttatataatttaacaaacacaaatatcacttactctgtttatttttgtgtacacacacacacacacacacaaagaaatacagtaagtttaaatactacattttgtaatgtgtccttcttactttgtcataactgggaaaacttgcccagactgtctttttagtccacaaaaaacttatatacatctaaatatattttttgagacagagtcttcctctgtcatccaggttagagtg

SEQ ID NO: 18338 - DNA, 179 bp, Homo sapiens
  D12S77
  Located on chromosome 12
  Distance between a terminus base of telomere on chromosomal short arm and 5'-terminus of this base sequence : 10487227
  Distance between 3'-terminus of neighbour sequence of sequence listing upward to telomere on chrosomal short arm and 5'-terminus of this base sequence : 321819
gaagggcaacaacagtgaaacgccatctacacacacacacacacacacacacacacacacacacacacacacacaaagagagagagagagagaccctaaatcgaagaaatcagacctatctttatggtaaattccacctgttttcagattcaaatgcttgagtgggggagaaaaaaaag

SEQ ID NO: 18339 - DNA, 353 bp, Homo sapiens
  chr12.fa.O7frz.11847280
  Located on chromosome 12
  Distance between a terminus base of telomere on chromosomal short arm and 5'-terminus of this base sequence : 10682101
  Distance between 3'-terminus of neighbour sequence of sequence listing upward to telomere on chrosomal short arm and 5'-terminus of this base sequence : 194695
attgtctaaaagcttcggttacactgatgtaattgtcatctttatattatattatattatattatactatatattatatgataacataatatatattatgtgatggtcatctttatatttttatttgatgttgatgctctctaaatatatatttcacaattatttgagcatatttatattctttccatttatcctagcaaaggctgattataatagaaaacacttcttcagcatttactatgatattcagtcttcagaactatcatattagggaggtgtgattattattattatcttaattttgtagatgaggtgatttaggtgcgtgcctaggttcatgtaaaggtagtgag

SEQ ID NO: 18340 - DNA, 455 bp, Homo sapiens
  AC068775.26_83983
  Located on chromosome 12
  Distance between a terminus base of telomere on chromosomal short arm and 5'-terminus of this base sequence : 10862671
  Distance between 3'-terminus of neighbour sequence of sequence listing upward to telomere on chrosomal short arm and 5'-terminus of this base sequence : 180217
gagtgatcctactggtgtcaggttggtgtctcttgaggtcagagatcccacaggaaggagcaggcactcatctttgctgttctccagccaccttgagtgacatctccaggcgagggagtgaaccagttgaacaggcctgaagtgaacccccagcaaaatgcagcaaccctacagaagagggagctgaccattgaaagaaaagcaaacaaacagaaagcaacaacaatagaatcaacaacaacaacaaaaatccccacaaaaaccccatccaagggtcagcagcttcaaagatcaaaactggataaactcgtgaagatgagaaaaaaatcaacaaaacaacgctgaaaaccaaaaatgccagagtgcctcttctcctccaaatgatggcagtgcttctctagcaagggcacataaccggatagaggatgaaatggacgaattgacagaagtaggtt

SEQ ID NO: 18341 - DNA, 211 bp, Homo sapiens
  AC021049.12_170657
  Located on chromosome 12
  Distance between a terminus base of telomere on chromosomal short arm and 5'-terminus of this base sequence : 10947537
  Distance between 3'-terminus of neighbour sequence of sequence listing upward to telomere on chrosomal short arm and 5'-terminus of this base sequence : 84411
tcatgaggacctcaatcttaagaatagattaattccctcatgagagtgagatcgttatctcaggagtggttctgttgtaaaaaaagctctctctctctctctctctctctctctctctcgctgtctctccatgtaatgccttcaccatgggatgacccttgccagatgccagtgccatgctcttggacttccttggtttatagatgcataa

SEQ ID NO: 18342 - DNA, 426 bp, Homo sapiens
  AC021049.12_53095
  Located on chromosome 12
  Distance between a terminus base of telomere on chromosomal short arm and 5'-terminus of this base sequence : 11064979
  Distance between 3'-terminus of neighbour sequence of sequence listing upward to telomere on chrosomal short arm and 5'-terminus of this base sequence : 117231
cagtcatattggattagacctcaccctaaaatggacttattttaaactcatctatcaccccttaaaacaacttatctcccaatatggttacattctgaggtactggaggttaggacttcaacatttgagttttagggggacacaatttggcccttaacagccattctggaaaacatcttaggaactttttaaaataacaacacacacacacacacacacacacacacacacacacacacttcttcccacaatttttattactcgggaaattctgttctcaactgataagagggagttttcaccagtggtgccaagtccatgtgacaggcacaggcgttgcctggaaccccttatgtgcaagccttcatgaatttgacaatgagatcaatgcataaaagaacaatactatggcaataacaaagtggt

SEQ ID NO: 18343 - DNA, 301 bp, Homo sapiens
  chr12.fa.O7frz.11607373
  Located on chromosome 12
  Distance between a terminus base of telomere on chromosomal short arm and 5'-terminus of this base sequence : 11402049
  Distance between 3'-terminus of neighbour sequence of sequence listing upward to telomere on chrosomal short arm and 5'-terminus of this base sequence : 336644
agtgaactgagattatgccactgcactccagcctgggcgacacagcaagactctgtcaaaaaacaaaacaaaacaaaacaaaacaaaacaaaacaaaaaaccaacatcaaacgacatgtgagatataaatatctaatgtagttttgaagggtcttctcctgcagagaaacataactgataaaagaactcttaaaccaagagtgtgggaaatatgtacaaccttgttgtgtcaggaattcaggagccgaaagaaaaaatagatggggaatggcaaaggtttgtcctgtgaggtcgataatta

SEQ ID NO: 18344 - DNA, 463 bp, Homo sapiens
  chr12.fa.O7frz.11734982
  Located on chromosome 12
  Distance between a terminus base of telomere on chromosomal short arm and 5'-terminus of this base sequence : 11468142
  Distance between 3'-terminus of neighbour sequence of sequence listing upward to telomere on chrosomal short arm and 5'-terminus of this base sequence : 65792
caatgttacaggagctaaacagaataaacaaaatataccagaattaaagacgaggaagatacaaatgcttcagtgaagaattgactatagttctctgaggttagggacattcagtttgaactggaatttttgtttgtttgtttgtttgtttgtttgagacagagtgagactccatcacacaggctgtactgcagtggcacaatctcagctcactgcaacctccgcctcccaggttcaagcgatccttctgcctcagcctcccgagtagctgggactataggcgagcaccaccacgcccagctgatttttgtattttcagtagagacggggtttcaccatattggccaggcaggctggtctcaaactcctgacctcgtgatcctcctgcctcagcctccaaaagtgctgggattacaggtgtgagccaccacgcctggccctggaattctttagaatttatgaa

SEQ ID NO: 18345 - DNA, 278 bp, Homo sapiens
  chr12.fa.O7frz.10840831
  Located on chromosome 12
  Distance between a terminus base of telomere on chromosomal short arm and 5'-terminus of this base sequence : 11616080
  Distance between 3'-terminus of neighbour sequence of sequence listing upward to telomere on chrosomal short arm and 5'-terminus of this base sequence : 147475
ctaccatatgactcagcaatctgggtctttctccaatggaaaggaaatcagtatattgaagtaacgtctgcacccccatgtttattgcagcattattcacaatagccaagatatggaattaacctgtgtccattaacagataaatagctaagcacacacagacacacacacacacacacacacacacacagaggaataccattcagtcataaaaaaaagaatgaaaagaatgaaatcctattatttgcaccaacatggatgagtcagaagtacataat

SEQ ID NO: 18346 - DNA, 101 bp, Homo sapiens
  DISO7_10019986
  Located on chromosome 12
  Distance between a terminus base of telomere on chromosomal short arm and 5'-terminus of this base sequence : 11798428
  Distance between 3'-terminus of neighbour sequence of sequence listing upward to telomere on chrosomal short arm and 5'-terminus of this base sequence : 182070
cacatacacttcatagggaacagcataagaaaaagaaatgaaggagacagacagagagagagacagagagagagaaatgagacaatgaccttattcatgag

SEQ ID NO: 18347 - DNA, 302 bp, Homo sapiens
  AC007450.1_151605
  Located on chromosome 12
  Distance between a terminus base of telomere on chromosomal short arm and 5'-terminus of this base sequence : 11941631
  Distance between 3'-terminus of neighbour sequence of sequence listing upward to telomere on chrosomal short arm and 5'-terminus of this base sequence : 143102
ctcaatttatactggtccatgaacagttaacagttttcaacacttaacacttctcttcccgtgctagctggcagccagagttattctgcaaaactgtgtttccaagtcctcaagaggaatacatgtgtaagtgtgctttaaatttgcaaatgttttatctttgagatccttaaacagtaacactattaatcttcatcttcaagctgctaagtttgttatgatatgtttatacgtgtgtgtgtgtgtgtgtgtgtgtgtgtctacgcagaactttttttggctggtcatgtgactcctagaac

SEQ ID NO: 18348 - DNA, 208 bp, Homo sapiens
  AC007450.1_53908
  Located on chromosome 12
  Distance between a terminus base of telomere on chromosomal short arm and 5'-terminus of this base sequence : 12039450
  Distance between 3'-terminus of neighbour sequence of sequence listing upward to telomere on chrosomal short arm and 5'-terminus of this base sequence : 97517
tccagcatactgtctgcttatcttttggataccttctgtttatagcaatgggagaagaattcatgaaagatgtagttttcaggtactacttaacagaaaacaaatggtttcgtagtgtgtgtgtgtgtgtgtgtgtgtttgtgtgaattttgaatatgaacaaggactaaaaatagaaattggaataatgaagtaaggattgtgatgg

SEQ ID NO: 18349 - DNA, 373 bp, Homo sapiens
  AC007450.1_52388
  Located on chromosome 12
  Distance between a terminus base of telomere on chromosomal short arm and 5'-terminus of this base sequence : 12040946
  Distance between 3'-terminus of neighbour sequence of sequence listing upward to telomere on chrosomal short arm and 5'-terminus of this base sequence : 1288
acgagatccacttcatgcttttgagttctagcttataatttgtttcacccactttacatccatcttctcttcccaaatggctgccttaaatatatttcttttatgatgtcagtcagcatgcaatcaaagaagcagaatacacacacacacacacacacacacttctgcttctctgattgtatgatgactgtataataaagtctttattatacagtatgccctaaacatacagcttagggcactaattctcaatatttaaaactccatgtcttatttggataagcatacacacttctcctctcctttcccttttcaccagttatgacagacccttcttaaggaaacatgcccattaggatgaggaatttctggt

SEQ ID NO: 18350 - DNA, 328 bp, Homo sapiens
  U81830.1_26370
  Located on chromosome 12
  Distance between a terminus base of telomere on chromosomal short arm and 5'-terminus of this base sequence : 12072648
  Distance between 3'-terminus of neighbour sequence of sequence listing upward to telomere on chrosomal short arm and 5'-terminus of this base sequence : 31329
gacaatagaaacactttggcaccttctgtggcgctgctaaaatgtgtgctgtagctcaaggcccataggggttaatgtaggggttatttgtgtgtgtgtgtgtgtgtgtgtgtgtgtgtgtgtgtgtgtgtgtgtttggtgttttccccatgaagccctgattgtgcgaccctgggtgagccagctgcttccgctgttttccaggaaagcatgagtgtccaccacctagagagatgatgatgtgagaaggggcagggagagacctctctggctgccactctctcactgccccaggagcggaggcccctggtgctcaggagttctttgg

SEQ ID NO: 18351 - DNA, 208 bp, Homo sapiens
  U81831.1_19108
  Located on chromosome 12
  Distance between a terminus base of telomere on chromosomal short arm and 5'-terminus of this base sequence : 12102858
  Distance between 3'-terminus of neighbour sequence of sequence listing upward to telomere on chrosomal short arm and 5'-terminus of this base sequence : 29882
ttgctatagtgaggtaggcaaccattctcacaggggtttgtgtgtgtgtgtgtgtgtgtgggacaagaacaactaaaatctacatatttaacaaaaattcctaatagaatatagttttattaagccttaaaaaaggagatcttgccatttgccacaacatggatagacctagaggacattatgataagtgacataagccagatacaga

SEQ ID NO: 18352 - DNA, 416 bp, Homo sapiens
  U81834.1_20519
  Located on chromosome 12
  Distance between a terminus base of telomere on chromosomal short arm and 5'-terminus of this base sequence : 12147129
  Distance between 3'-terminus of neighbour sequence of sequence listing upward to telomere on chrosomal short arm and 5'-terminus of this base sequence : 44063
taggtattacaattggcctcagaaattgcagtgcttcccttttgttcagctggttggcttgataggttgtatctgcaaatttgagagcagcgtgttttattttttacagcatctaaacaataatgtaaccacatcacggcattctgagtcacatcattgacctccaccagcagtttatccccctacaacacttgaatacattaatatcactgtctgtagcattttaatttaattagagcagcggttataatcctcttgggaaaatcgttatcccccccatacacacacacacacacacacacacacacacacacacacacacacacacacacacacacacacccctactccccataatgttaaaagaaagaaagcagctctggttttcatctgtctgacaatttgctttagaggtg

SEQ ID NO: 18353 - DNA, 282 bp, Homo sapiens
  D12S89
  Located on chromosome 12
  Distance between a terminus base of telomere on chromosomal short arm and 5'-terminus of this base sequence : 12147207
  Distance between 3'-terminus of neighbour sequence of sequence listing upward to telomere on chrosomal short arm and 5'-terminus of this base sequence : -338
atttgagagcagcgtgttttattttttacagcatctaaacaataatgtaaccacatcacggcattctgagtcacatcattgacctccaccagcagtttatccccctacaacacttgaatacattaatatcactgtctgtagcattttaatttaattagagcagcggttataatcctcttgggaaaatcgttatcccccccatacacacacacacacacacacacacacacacacacacacacacacacacacacacacacacacccctactccccataatgt

SEQ ID NO: 18354 - DNA, 238 bp, Homo sapiens
  D12S98
  Located on chromosome 12
  Distance between a terminus base of telomere on chromosomal short arm and 5'-terminus of this base sequence : 12344670
  Distance between 3'-terminus of neighbour sequence of sequence listing upward to telomere on chrosomal short arm and 5'-terminus of this base sequence : 197181
caaagcctgacgtagaagcattatggttggtgacacctaaatcacacatctgcccctggcagcaagggggcaagggggacctgcgtgtgtgtgtgtgtgtgtgtgtgtgtgtgtttcatctcccttcccccttgcacccctgttgagaggttggtatttacactatgaaaaaccatcaaagtgtggaaagagttcaggaggttttgggcagccagtcactatagcacgggtccccaat

SEQ ID NO: 18355 - DNA, 337 bp, Homo sapiens
  AC007537.3_71871
  Located on chromosome 12
  Distance between a terminus base of telomere on chromosomal short arm and 5'-terminus of this base sequence : 12555523
  Distance between 3'-terminus of neighbour sequence of sequence listing upward to telomere on chrosomal short arm and 5'-terminus of this base sequence : 210615
ttgctcaaaaccagtgataaagaaaaaaaaaagtcttccaagcaagcagagaaaaaggcatattatatgcagagaaagaaaaattaaaatgacagcaaacttcttggggactaacacaaaagaaacagtaacctctctaaagtatcaagacacacacacacacacacacacacacacacacacacacactataaatgcagaattctatacccagccaaaagatgattttaaaatgtagggaaaatagagattttttgagatgtataaaacctaaaagaattccttatcagcagacctgaactataataaatattaaagaaattccttcagtagaagc

SEQ ID NO: 18356 - DNA, 478 bp, Homo sapiens
  AC007621.23_50039
  Located on chromosome 12
  Distance between a terminus base of telomere on chromosomal short arm and 5'-terminus of this base sequence : 12703454
  Distance between 3'-terminus of neighbour sequence of sequence listing upward to telomere on chrosomal short arm and 5'-terminus of this base sequence : 147594
ggaaatttatcttaagatgctgtaaaactaattttttgtccatttgaaatatataagttgtgctataacagaaggaaggaaggaaggaaggaaggaaggaaggaaggaaggaaggaaggaaggaaggaaggaaataaattaattaaagttcacctggtcaacaagcaattctatgcagctaattcccaaaacatcatctctagttctgtccctctaactttttgttggccatctctacctcccgttaaattaaattcatcacctttcccccaaaacaacaaaatccctcaccagtcaatggtacacaattctaaccttactggcatgccttggagccatctttgagcccctccccttttcccctagtctgacaattactgtcttgttgactcttattttacaagcatgtctttaaatctgtctcctcttctccatttttaaaaccactatcctactctagaccttcatgactttaggc

SEQ ID NO: 18357 - DNA, 225 bp, Homo sapiens
  G08921
  Located on chromosome 12
  Distance between a terminus base of telomere on chromosomal short arm and 5'-terminus of this base sequence : 12768528
  Distance between 3'-terminus of neighbour sequence of sequence listing upward to telomere on chrosomal short arm and 5'-terminus of this base sequence : 64596
aacaggatcaatggatgcataggtagatagatagatagatagatagatagatagatagatagatagatagacagacagacagacagacagacagacagatgagaggggatttattagaggaattagctcaagtgatatggaggctgaaaaatctcatgacagtccatctgcaagctggagacccagggacactaggagcatggctcagtccaggtctaaaagcca

SEQ ID NO: 18358 - DNA, 261 bp, Homo sapiens
  D12S358
  Located on chromosome 12
  Distance between a terminus base of telomere on chromosomal short arm and 5'-terminus of this base sequence : 13178275
  Distance between 3'-terminus of neighbour sequence of sequence listing upward to telomere on chrosomal short arm and 5'-terminus of this base sequence : 409522
gcacagatgagatcccgtcaagaccattgccaggaaaataaccaaatgagagtgtgtgtgtgtgtgtgtgtgtgtgtgtgtgtgtgtgaaaattctgttagatcaaacactacctgaaattattggcatgtggaccccggctcagaaacactgacataaagacttaaatgtaatgggatttgttttcaaaagatttgacttttctctgtaaaaaacacagcaacaaggcaacagggaatattaccaaagtttcccaaaggc

SEQ ID NO: 18359 - DNA, 365 bp, Homo sapiens
  AC007619.22_151265
  Located on chromosome 12
  Distance between a terminus base of telomere on chromosomal short arm and 5'-terminus of this base sequence : 13217444
  Distance between 3'-terminus of neighbour sequence of sequence listing upward to telomere on chrosomal short arm and 5'-terminus of this base sequence : 38908
agtagctcatgactgtaatccaagcactttggaaggccaaggcaggaggatcacttgagtccaagagttcaagaccagcctgagcaacacagtgagaccctatctctacaaaaaattaaaaatatatgtatacacacacacacacacacacacacacacacaattttcccccctagaattacatactagagtacctaagaagctgacaagtaactcataatagtgtgctcaaaaggttagcaaattaaatgctgggggtcaccacagctggcctgttttatgacatactagttagagagtaccctctataactactctggcttaaaagaaagttaaaatgtgatggtgaacattcatgaagttat

SEQ ID NO: 18360 - DNA, 212 bp, Homo sapiens
  AC007688.15_127734
  Located on chromosome 12
  Distance between a terminus base of telomere on chromosomal short arm and 5'-terminus of this base sequence : 13457029
  Distance between 3'-terminus of neighbour sequence of sequence listing upward to telomere on chrosomal short arm and 5'-terminus of this base sequence : 239220
gaagtcttgctatgttgtccagacttgtctggatttccggaactcaaataatatatttctgaccacaagggagaaggttcttaacttgaggcccatccttgagtccctctgtgtgtgtgtgtgtgtgtgtgtgtggtccatggacactaggtgtcttagtctgctggggctgcaataacaaaatgccatagcacaggtagtcaaataacaga

SEQ ID NO: 18361 - DNA, 202 bp, Homo sapiens
  AC007688.15_90142
  Located on chromosome 12
  Distance between a terminus base of telomere on chromosomal short arm and 5'-terminus of this base sequence : 13494686
  Distance between 3'-terminus of neighbour sequence of sequence listing upward to telomere on chrosomal short arm and 5'-terminus of this base sequence : 37445
ttcaggatgttccaaggatgctgctggatctgtgtgtgtgtgtgtgtgtgtgtgtgtgtgtgtgtgtgtgcgtgcgtgcgtgtatgtgcgcctgaccctgatttctgcaacctccagatttctttcttgacccttcaaagtggaacagtccagtgccaaaaattttagagtttgagaaggtcacagaaatcctctagttggt

SEQ ID NO: 18362 - DNA, 415 bp, Homo sapiens
  AC007688.15_75868
  Located on chromosome 12
  Distance between a terminus base of telomere on chromosomal short arm and 5'-terminus of this base sequence : 13508810
  Distance between 3'-terminus of neighbour sequence of sequence listing upward to telomere on chrosomal short arm and 5'-terminus of this base sequence : 13922
tttgaatatcatgcagtgacatctctgccagtagtaaagattctcatgcggtatgtgtctgttttatgttatagaggtggctcagattatgctgtaaaaagcagcagagtgatagtggcccaaatgcagtttattaggtgagagtcttagcatcttagtaaaatatatattataaaatatatgtatgtctctgtgtgtgtgtgtgtgtgtgtgtgtgtgtatgtgtgtatttcataattgaaaagcattggctaatccatccaatggatcagatgagatggtggatgtgaaaattatttgtaaattgtaaagagctataaaatagaaagcaaagcactatttaaaaaaattgttgttaccctaaaagatcaggcatctcatcatagggtcatcattggacacttatgatctaaga

SEQ ID NO: 18363 - DNA, 169 bp, Homo sapiens
  D12S1581
  Located on chromosome 12
  Distance between a terminus base of telomere on chromosomal short arm and 5'-terminus of this base sequence : 13508926
  Distance between 3'-terminus of neighbour sequence of sequence listing upward to telomere on chrosomal short arm and 5'-terminus of this base sequence : -299
ggcccaaatgcagtttattaggtgagagtcttagcatcttagtaaaatatatattataaaatatatgtatgtctctgtgtgtgtgtgtgtgtgtgtgtgtgtgtatgtgtgtatttcataattgaaaagcattggctaatccatccaatggatcagatgagatggtgga

SEQ ID NO: 18364 - DNA, 362 bp, Homo sapiens
  AC007688.15_17244
  Located on chromosome 12
  Distance between a terminus base of telomere on chromosomal short arm and 5'-terminus of this base sequence : 13567444
  Distance between 3'-terminus of neighbour sequence of sequence listing upward to telomere on chrosomal short arm and 5'-terminus of this base sequence : 58349
gatccaggacctctatggataccaaaatccatggatgctcaagtccctgatataaaatggtgtagtattttgcatataacccacacacatcctcatacatactttaaatcatctctacattacttataatacttaatacaatgtaaaagccaagcaaatagttgctactctctgtgcacacacacacacacacacacacacacacacacaaacacacacacatgtattttatttatttatttatttttgagacagtgtttcactctgtcacccaggctggtgtgcagtggtatgatcatggctcactagcctcgacctcctgagctcaagcgatcctcctacttaggcttcctgagtaagtg

SEQ ID NO: 18365 - DNA, 188 bp, Homo sapiens
  Z66921
  Located on chromosome 12
  Distance between a terminus base of telomere on chromosomal short arm and 5'-terminus of this base sequence : 13567574
  Distance between 3'-terminus of neighbour sequence of sequence listing upward to telomere on chrosomal short arm and 5'-terminus of this base sequence : -232
acttaatacaatgtaaaagccaagcaaatagttgctactctctgtgcacacacacacacacacacacacacacacacacaaacacacacacatgtattttatttatttatttatttttgagacagtgtttcactctgtcacccaggctggtgtgcagtggtatgatcatggctcactagcctcgacct

SEQ ID NO: 18366 - DNA, 361 bp, Homo sapiens
  chr12.fa.O7frz.13887210
  Located on chromosome 12
  Distance between a terminus base of telomere on chromosomal short arm and 5'-terminus of this base sequence : 13647516
  Distance between 3'-terminus of neighbour sequence of sequence listing upward to telomere on chrosomal short arm and 5'-terminus of this base sequence : 79754
tttaatcctgacaccattacttattggagaccttgggcatattacctaatcttgcctagctgcagtttctgcatttataaaacaggggtaataatattgcctgccttcataggattattgtgacagttaaatgaagttaaactataataattaaaaaaagatatatatatatatatatatatatatatatatatatataaaatgaaatatgtgtttgagtggatagaagtttttagtgcagtgtctctagacttctcttttccccaagattgccaaaggcaatcttgaagtgcttgtctgtttttctttctctgctggttgagaagattttgtctctgccgggttggttccaggaacttgt

SEQ ID NO: 18367 - DNA, 172 bp, Homo sapiens
  D12S1580
  Located on chromosome 12
  Distance between a terminus base of telomere on chromosomal short arm and 5'-terminus of this base sequence : 13865346
  Distance between 3'-terminus of neighbour sequence of sequence listing upward to telomere on chrosomal short arm and 5'-terminus of this base sequence : 217469
tcagttctcagggacttgtgaagatgcagcatcatcaaatcattgtgtgtgtgtgtgtgtgtgtgtgttgtgttttccttatcatccaccttagaaaatattctccacattcccatgttaaaatattttttcctaaaatccatccatccacatgccaacatcctaaagacag

SEQ ID NO: 18368 - DNA, 299 bp, Homo sapiens
  AC007535.3_44000
  Located on chromosome 12
  Distance between a terminus base of telomere on chromosomal short arm and 5'-terminus of this base sequence : 14335379
  Distance between 3'-terminus of neighbour sequence of sequence listing upward to telomere on chrosomal short arm and 5'-terminus of this base sequence : 469861
ggagataggttctgagttcctaactgaaaagagagggtgtgtgtgtgtttgtgtgtgtgtgtgtgtgtttgtgtgtgtgtgtgtgtgtgtgtgataacaggaattataagtatagaaagatacaagaaagctttctcccccctttatctttctttccctctctcctttccttcctttcttccttctatttttgctaatcacagaaaaatgttacactgaaatagccagtcacagtctgggctaaccagcctccacacctccagctccaccccagatgctggaccatttcttaacacgta

SEQ ID NO: 18369 - DNA, 287 bp, Homo sapiens
  D12S364
  Located on chromosome 12
  Distance between a terminus base of telomere on chromosomal short arm and 5'-terminus of this base sequence : 14350696
  Distance between 3'-terminus of neighbour sequence of sequence listing upward to telomere on chrosomal short arm and 5'-terminus of this base sequence : 15018
ccctggaagtcccatcaaggttgtgtgtgtgtgtgtgtgtgtgtgtgtgtgtgtgtgtgtgtgtgtgtgtattttaaattgcttgatttgtctctagaatgtagtttgaaccttaagaaaccagatggtctgcctcatatagttctaatattacacagaatctcacattgctaaaactaggagagaacttagaaattatccatagagaaccttcattttagagaggagaaaataggtcccaagatgcaaaacaactttgccaaggtgacctgcctgttcaggactgg

SEQ ID NO: 18370 - DNA, 280 bp, Homo sapiens
  AC007397.21_66301
  Located on chromosome 12
  Distance between a terminus base of telomere on chromosomal short arm and 5'-terminus of this base sequence : 14387179
  Distance between 3'-terminus of neighbour sequence of sequence listing upward to telomere on chrosomal short arm and 5'-terminus of this base sequence : 36196
tgcaaggacttagttctttgacctaatgcaagaactatagaaaactactaaattttctgcaaacccagaaaataagaacggtcagttctcaacagaaggggaaatgagggaaaggttactagcatttcctatgtaataaatatgtttgcattgtatcatgccatacgcgtgtgtgtgtgtgtgtgtgtgtgtgtgtgtgtgtgtattcactcaatcattacagagacccttaaattttggagtttatatctcctttttacagttggtaaagctgaggtat

SEQ ID NO: 18371 - DNA, 334 bp, Homo sapiens
  AC007784.7_42299
  Located on chromosome 12
  Distance between a terminus base of telomere on chromosomal short arm and 5'-terminus of this base sequence : 14495703
  Distance between 3'-terminus of neighbour sequence of sequence listing upward to telomere on chrosomal short arm and 5'-terminus of this base sequence : 108244
tagaaaggtcaatttggtcaagctggtagattttatatatatataatatatatataataaatatatatatattttgtgtgtgtgtgtgtgtgtgtgtgtgtgtgtgtgtgtatgatggagttttgctcttgtagcccaggctagagtgcaatggcccgatgtcggctcactgcaacctccacttcctgggttcaagtgattctcctgcctctgcctcccgagtagctgggactacaggcatacactaccacgcccagctaatttttgtgtttttagtagagagggggtttcaccacattggccaggttggtctccacctcttgacctcaggtga

SEQ ID NO: 18372 - DNA, 391 bp, Homo sapiens
  AC007784.7_85258
  Located on chromosome 12
  Distance between a terminus base of telomere on chromosomal short arm and 5'-terminus of this base sequence : 14538498
  Distance between 3'-terminus of neighbour sequence of sequence listing upward to telomere on chrosomal short arm and 5'-terminus of this base sequence : 42461
gagcaaagtttactcctgacagttttctgatctcagtgtctctgtgaaaacagagaatgactccatgagccctggaaacctttgctgatgggctgtacacaatttagcaggagaaacagggcctgaattcctcctcccagaacttaaaggaaagaaacactagataggcaattgagtagtactgatattcagaggaagacagaaggagtttgacaccacaaagagctgtggacaaagtacacacacacacacacacacacacagttcaattccaatgactggttctcaaggaaagccaaaagatttaccatttggcaaaactataagctaacttcattccaatggtattctaatcctacagttacaagtcactaaattagtttccttcacg

SEQ ID NO: 18373 - DNA, 292 bp, Homo sapiens
  AC007784.7_149755
  Located on chromosome 12
  Distance between a terminus base of telomere on chromosomal short arm and 5'-terminus of this base sequence : 14603054
  Distance between 3'-terminus of neighbour sequence of sequence listing upward to telomere on chrosomal short arm and 5'-terminus of this base sequence : 64165
ttctcagaaatcaggatgaagtaggaagcagccaacccttaaccacaaaagcctaatttctacactgttctcttcccagataaggtaagtagaaagacttcatctaaaactattggtatttcttcattggtattccaaaataatggtaaactgttgtttgcactgaaaagggctttgtcgtgtgtgtgtgtgtgtgtgtgtgtgtgtgtgtgtgcgtgtgcgtgtgtgtgtgtttgtgtgaatggccacagctactgttgggcagcttctcttccatagctacagcttacag

SEQ ID NO: 18374 - DNA, 412 bp, Homo sapiens
  AC007784.7_157870
  Located on chromosome 12
  Distance between a terminus base of telomere on chromosomal short arm and 5'-terminus of this base sequence : 14611056
  Distance between 3'-terminus of neighbour sequence of sequence listing upward to telomere on chrosomal short arm and 5'-terminus of this base sequence : 7710
ttgctaaataagccattctgtaacggatgagtgttccatctctgtattatctctctccctccctgccccaccctgacatataccccacaatcacccatgctctccacacaccttccaacatgatgattgaaactaggggactctccacacaccttacagggactttggggctccaattcacattaaccctctctccaatttcccttcatttcccacattttctttcactaaccattattatttatgctagtgccccactagcttccccagggaaagcagacacacatatgttcacacacacacacacacacacagtaggtaggaggtagataggagggtgggtagacaggggattcacactctctgtggccgttggatagagctgggccagttaccaagaatgaccaaaaca

SEQ ID NO: 18375 - DNA, 241 bp, Homo sapiens
  AC007784.7_182360
  Located on chromosome 12
  Distance between a terminus base of telomere on chromosomal short arm and 5'-terminus of this base sequence : 14635810
  Distance between 3'-terminus of neighbour sequence of sequence listing upward to telomere on chrosomal short arm and 5'-terminus of this base sequence : 24342
aactcatgctagaatccagattacacaccacacacacacacacacacacacgtgtgtgtgattgtatgttagttaccagttcccaattatatttctaagaaattaaagatatacttcttgttcttatgaagatggcttttactgctttccctttaatttctcatataactaaagtttttcattttttatttcctaatcatcttttctaaatataaaaatgatatgctttattgtggaaatt

SEQ ID NO: 18376 - DNA, 273 bp, Homo sapiens
  AC007784.7_187489
  Located on chromosome 12
  Distance between a terminus base of telomere on chromosomal short arm and 5'-terminus of this base sequence : 14640947
  Distance between 3'-terminus of neighbour sequence of sequence listing upward to telomere on chrosomal short arm and 5'-terminus of this base sequence : 4896
cttctacatgcaggctctaaacacacacacacacacacacacacacacacacacacacatccagtatttctttcttcaaaaatccaaagggtagcattctcctactcaggaaagatctttcaaatctgagcacctgtatttggccagggtagaatttcttctgcagtccttcttcctatgtgaactgaaggaaaaaccaggatacagatgtaaacaaaatcaaataaaaactgaaatattctccattccccctcaagctcagaaacaattctg

SEQ ID NO: 18377 - DNA, 416 bp, Homo sapiens
  chr12.fa.O7frz.14843834
  Located on chromosome 12
  Distance between a terminus base of telomere on chromosomal short arm and 5'-terminus of this base sequence : 14744987
  Distance between 3'-terminus of neighbour sequence of sequence listing upward to telomere on chrosomal short arm and 5'-terminus of this base sequence : 103767
gtgacagagcaagactacatctcaaaaatatatatatatatatgtgcgtgtatatatatatatatatatagagagagagagagagagagagagtgctaaaagtaatagaactctaagtagaaatagacaaatccacaatcacattcggagattatgacaaattttctcattaatctataagttaagcgaagggaaaaaatcattaataatgtaacttgaacaacatgataaaaaaatataatttgctgaacacatgtagaacactgcactcaacagctatagaatacacattcctttcaactgtgtatagtatatttgtgaaaattgattataacttaggccacaaaagaaatcttagcaaatttcaaaagattaaaattatataaaattttatgtccaggatcacaatgtaatta

SEQ ID NO: 18378 - DNA, 397 bp, Homo sapiens
  AC007782.20_36856
  Located on chromosome 12
  Distance between a terminus base of telomere on chromosomal short arm and 5'-terminus of this base sequence : 14943738
  Distance between 3'-terminus of neighbour sequence of sequence listing upward to telomere on chrosomal short arm and 5'-terminus of this base sequence : 198335
tcaaacatcagactccaacttcttcagttttgggactcagatgggctgtccttgttcctcagcttacagacagcctattgtgggaccctgtgattgtgtaagttaatacttaataaactcccctttatatatatatatatatatatatatatatatatatatatatactctctatataaagtatatactatatactatataaagcatatagtataaaaatataacatatatactatatactttatagatataaaatactatacataaaatatatgctatatataaactaatacaatatatatcctattagttctgtccctctagagaaccctgactaatacagattttggtaccaggagtggggtctagaggaacagaatattaagcatggaattct

SEQ ID NO: 18379 - DNA, 477 bp, Homo sapiens
  AC007782.20_113415
  Located on chromosome 12
  Distance between a terminus base of telomere on chromosomal short arm and 5'-terminus of this base sequence : 15020187
  Distance between 3'-terminus of neighbour sequence of sequence listing upward to telomere on chrosomal short arm and 5'-terminus of this base sequence : 76052
tgaagtctgctttggtaagttatttaagctttgtatttttaatacatattaagcagttttttaaccaacaaatctgattgactcataaacttgcagaaaaaaagtgctaggaaaaatgtagtactgtttagaatttgagattttagagaaactttaatgtattaggactgtgattcaagtgttttatgattctcctgtaaatagaaaaacacttaaatatatagatattgatgtgcacacacacacacacacacacacacaaatatatatggacagtggcatgtttcttgaaagtggcccatttatttagcttaacattcatttctttaattggcacctaataagtaaaggtgtcaagttaatattttaggtgatgaaatgcaaggcacatatttttttccaagaaaatagagtgtttttgctggaagttttgcttttatattcgcatctattctaagattcctgctagcatattgt

SEQ ID NO: 18380 - DNA, 273 bp, Homo sapiens
  AC007782.20_127611
  Located on chromosome 12
  Distance between a terminus base of telomere on chromosomal short arm and 5'-terminus of this base sequence : 15034537
  Distance between 3'-terminus of neighbour sequence of sequence listing upward to telomere on chrosomal short arm and 5'-terminus of this base sequence : 13873
tatcagccaagtaaaggttcatactttaataagtgaatagaattgataaaactgtagcacaacttaccaaaaaaagagaatacacacacacacacacacacacacacacacacacacacacacacaacctttgtatttattttgaaatttttttgtagtggcattactgagataaaaccacatatctactattcacccacttaaagtacaattcagttatttttagtatattcacagagctgtataatcatcaccataatcaatgttagaaca

SEQ ID NO: 18381 - DNA, 102 bp, Homo sapiens
  DISO7_10000209
  Located on chromosome 12
  Distance between a terminus base of telomere on chromosomal short arm and 5'-terminus of this base sequence : 15411161
  Distance between 3'-terminus of neighbour sequence of sequence listing upward to telomere on chrosomal short arm and 5'-terminus of this base sequence : 376351
tcgtgcagcagatgttaagcaaatgctctgtgtgtgtgtgtgtatgtgtgtgtgtgtctgtgtgtaaaccttacggaagcctgggaatggaacaggcagtaa

SEQ ID NO: 18382 - DNA, 113 bp, Homo sapiens
  DISO7_10000212
  Located on chromosome 12
  Distance between a terminus base of telomere on chromosomal short arm and 5'-terminus of this base sequence : 15648296
  Distance between 3'-terminus of neighbour sequence of sequence listing upward to telomere on chrosomal short arm and 5'-terminus of this base sequence : 237033
ttgagccactgtccttccagtgagacacacacacacacacacacacacacacacacacacacacacacacacacacacacagtctttacagatctgttgaagaggatcatgga

SEQ ID NO: 18383 - DNA, 104 bp, Homo sapiens
  DISO7_10000211
  Located on chromosome 12
  Distance between a terminus base of telomere on chromosomal short arm and 5'-terminus of this base sequence : 15681990
  Distance between 3'-terminus of neighbour sequence of sequence listing upward to telomere on chrosomal short arm and 5'-terminus of this base sequence : 33581
ttctatcttgttggcaaaggggggagttgaagagttttgttttgttttgttttgttttgtttgaggggaattgaatgtttttaagagggagacttgtaggatgg

SEQ ID NO: 18384 - DNA, 348 bp, Homo sapiens
  chr12.fa.O7frz.21353455
  Located on chromosome 12
  Distance between a terminus base of telomere on chromosomal short arm and 5'-terminus of this base sequence : 15892862
  Distance between 3'-terminus of neighbour sequence of sequence listing upward to telomere on chrosomal short arm and 5'-terminus of this base sequence : 210768
tgttccagacttacataagcactatgtcactttactttgcattactggggtctgggagcttccttagaagctccctgtagacaaggaggcacaagtgtttgcagaaagggttgtaggcatttacagggaaagtgagggctgatgatgggagcactaccgtcatccgctacagtccacctgctggatcatccagatccattcacgccctgctttaagttaatctgctctgttactcattctacaaagggatacccagtccccacccacttcacacacacacacactcacacgcacacacacacacacacacaatttctaagacaaatagaaatatcgcctataggtgat

SEQ ID NO: 18385 - DNA, 312 bp, Homo sapiens
  chr12.fa.O7frz.21126050
  Located on chromosome 12
  Distance between a terminus base of telomere on chromosomal short arm and 5'-terminus of this base sequence : 16056412
  Distance between 3'-terminus of neighbour sequence of sequence listing upward to telomere on chrosomal short arm and 5'-terminus of this base sequence : 163202
cactatggcatatttagatggttttcttccttccacccttccttccattgaccatctgctctgtatattattatgctccataaatgccctgtctcctcttttatgtttattcaagtccccatcattttttagggtcaaactgaagtcatatttctactaagccttaaccaacaactccttagaactcttactgcaaattatattataatataatatagaatatataattatatatataatataatataatataatataatataatataatataatataatataatataatttgcacttacctgataagctaa

SEQ ID NO: 18386 - DNA, 204 bp, Homo sapiens
  DISO7_10000214
  Located on chromosome 12
  Distance between a terminus base of telomere on chromosomal short arm and 5'-terminus of this base sequence : 16113102
  Distance between 3'-terminus of neighbour sequence of sequence listing upward to telomere on chrosomal short arm and 5'-terminus of this base sequence : 56378
tgagataagtaactctacctacccgtatctagagagagagagagagagagatacaaatgtctatgttgccaaaatggccttaagatagttttcaaatataacaccccaaatatctcaaatattacagttattataaaagttgttgagtatacatgaaagattgaaaatagaaaattaaaaattctcatgtccgttaaagctgct

SEQ ID NO: 18387 - DNA, 220 bp, Homo sapiens
  D12S1650
  Located on chromosome 12
  Distance between a terminus base of telomere on chromosomal short arm and 5'-terminus of this base sequence : 16202185
  Distance between 3'-terminus of neighbour sequence of sequence listing upward to telomere on chrosomal short arm and 5'-terminus of this base sequence : 88879
ctgaaatgaggcaacataggctcaaatcaactaacccttaccaatcctcccatcataaatcttccttaacatagacaaactttctaaaaggaaaaactaacttcatgtacacacacacacacacacacacacacacacacacacaattcttgagtgacacctcacaagataaatttcaatttcatttagcatgtgacatattgttccctgtgatccaagc

SEQ ID NO: 18388 - DNA, 242 bp, Homo sapiens
  DISD22_0008097
  Located on chromosome 12
  Distance between a terminus base of telomere on chromosomal short arm and 5'-terminus of this base sequence : 16347149
  Distance between 3'-terminus of neighbour sequence of sequence listing upward to telomere on chrosomal short arm and 5'-terminus of this base sequence : 144744
cgacaaagctgaagtcaccaaaaatctaaatgcagaaaaaaattagagaggaaaataatatacttaacagcttacttctcaacacacacacacacacacacacacacacacacgcacacacacacttgttttaattttttaaaagacagtaagtttttaagtaaaaaatcataacaccatattggtgtatttataacatatatagatggagcatatatatgacaacaatagcacaaaggatg

SEQ ID NO: 18389 - DNA, 320 bp, Homo sapiens
  AC010168.6_68435
  Located on chromosome 12
  Distance between a terminus base of telomere on chromosomal short arm and 5'-terminus of this base sequence : 16544142
  Distance between 3'-terminus of neighbour sequence of sequence listing upward to telomere on chrosomal short arm and 5'-terminus of this base sequence : 196751
agtttgatgtaattgcattcacctatttttgcttttgttgcctgtgtttttgaggtcttatcaaaaaaattcttgctccagacaaatgccatgaaccatttcccagagatagatagatagatagatagatagatagatagatagacagacagacagacagatagatagatagatgttttgagacagagtctgccatgctggagtgcagtgacatgatcttggctcactgcaacctccgcctcctgggttcaagtgattctcatgcctcagcctcccaagtagctgggattacaagcacataccatcacacctgactaatg

SEQ ID NO: 18390 - DNA, 372 bp, Homo sapiens
  AC010168.6_57136
  Located on chromosome 12
  Distance between a terminus base of telomere on chromosomal short arm and 5'-terminus of this base sequence : 16555389
  Distance between 3'-terminus of neighbour sequence of sequence listing upward to telomere on chrosomal short arm and 5'-terminus of this base sequence : 10927
tggcttatgacgtaccttagaaaatattccctagaaatgtgtagaaaagagaatgatgatgtctatagacaaaatttgtcagaagaaatgagtcagttaggtcagccagtcagtagattggctgagaatcagtagatctgttaaatgactgtcgtgtgtgtgtgtgtgtgtgtgtgtgtgtgtgtgtgtgtgtgtgtcagtcagggggtagatagtaaattctaataaagaatatttagcccatttgttattagactagttcacccaataatgaaaattgtaatcctccaagtacaaaaacaatgttaaaaaaactaaatgagcagctcatggaggtcacacagatgcctaagctcaacatgtccataattt

SEQ ID NO: 18391 - DNA, 192 bp, Homo sapiens
  AC010168.6_54341
  Located on chromosome 12
  Distance between a terminus base of telomere on chromosomal short arm and 5'-terminus of this base sequence : 16558300
  Distance between 3'-terminus of neighbour sequence of sequence listing upward to telomere on chrosomal short arm and 5'-terminus of this base sequence : 2539
actgtatttagagctatttggcacatgcgcgtgcgcgcgcgcacgcacgcgcacacacacacacacacacacacacacacatatctgatttttttctgtttattcccagttgaatgttatgtccatgacagcagggatttttacctattgtgtctgctggtgtagtcccagtaactaaattggtgatggcac

SEQ ID NO: 18392 - DNA, 254 bp, Homo sapiens
  AC007655.1_35543
  Located on chromosome 12
  Distance between a terminus base of telomere on chromosomal short arm and 5'-terminus of this base sequence : 16646337
  Distance between 3'-terminus of neighbour sequence of sequence listing upward to telomere on chrosomal short arm and 5'-terminus of this base sequence : 87845
aaattgattcatttgctaccatacacatacacacacacacacacacacacacacagagggtgagagagaggagaagggagacaggactctcactttgctactttttctggacctatatgtgtctagggtttcaatctccttttagttttaggattatgtttcagaatgttggatgcaacagctagggggattcatatggaaatgaatgagacaaggaccaagaaaagtcttggtgcatagtctttctgtgaggt

SEQ ID NO: 18393 - DNA, 315 bp, Homo sapiens
  AC007655.1_41262
  Located on chromosome 12
  Distance between a terminus base of telomere on chromosomal short arm and 5'-terminus of this base sequence : 16651980
  Distance between 3'-terminus of neighbour sequence of sequence listing upward to telomere on chrosomal short arm and 5'-terminus of this base sequence : 5389
ttgctcatattgtttgataggataaccagatgagggagaaatacatttctactattttcacacaatatatacattttttagttttttggaatttctatataggagtgtgtgtgtgtgtgtgtgtgtgtgtgtgtgtgtgtgtgtgtatacaagtagaaattccaagacagaaaagacagaaattactctgtgtgtgtatgtgtgtactgtatgtatgtatatatatatatatatatatatatatatatatatatatatatatatatacagtaatttctgtcttatttttttgagttggagttctcactctgtcac

SEQ ID NO: 18394 - DNA, 387 bp, Homo sapiens
  AC007655.1_86063
  Located on chromosome 12
  Distance between a terminus base of telomere on chromosomal short arm and 5'-terminus of this base sequence : 16696672
  Distance between 3'-terminus of neighbour sequence of sequence listing upward to telomere on chrosomal short arm and 5'-terminus of this base sequence : 44377
gaatgctaggaatgctgtagaaagaaatagtgggaggctgggcttgattaatggttctaaatagtgttctgcaagattttggtcaatgccccttgataaaaacattgtattgtcaaagtatcttgcaaacccctgtgctaaacagactcaaacaaattcctttacttatggaccacacagaagatttgatatattacatttagtatattaaacatatatatatatatatatatatatatatatatatatatatatatatatatctacgaggagatatataaagacaatagaacttgtctgggcatagaacaattttggcagcacactggactggagtattattactggaatacttgtttggggaacattgaactaaatttgcgttat

SEQ ID NO: 18395 - DNA, 262 bp, Homo sapiens
  AC007655.1_113793
  Located on chromosome 12
  Distance between a terminus base of telomere on chromosomal short arm and 5'-terminus of this base sequence : 16724495
  Distance between 3'-terminus of neighbour sequence of sequence listing upward to telomere on chrosomal short arm and 5'-terminus of this base sequence : 27436
gagtaaatgccttggtctaatctaagcttacaatttcccaaaggttctttagttaactagctaaattccaaaaagttaatttgcccatagggggctaatttatatggtcttcctagggaaacacacacacacacacacacacacacacacacactttcttaggggagaaaaccaataggttatgacaaattcattcgtgaaggtaagtaaactaagtttggaaactgaaaagttaaactctgtggagtctcttgaattgctc

SEQ ID NO: 18396 - DNA, 238 bp, Homo sapiens
  AC007655.1_158826
  Located on chromosome 12
  Distance between a terminus base of telomere on chromosomal short arm and 5'-terminus of this base sequence : 16769627
  Distance between 3'-terminus of neighbour sequence of sequence listing upward to telomere on chrosomal short arm and 5'-terminus of this base sequence : 44870
agtatttgagtttagtccttgcacacacacacacacacacacacacacacacacacacttaatgcctgaaatcttacagctctgttatgaaaaacatgagagtttccctgcccccaagtttgatgacaatgctaaaaatacacaagacattacaaataatgagttgtgaagataaatctttttttggtccatttattctctcattgagaattatattactggtcaaatgaagaggtta

SEQ ID NO: 18397 - DNA, 237 bp, Homo sapiens
  chr12.fa.O7frz.15751559
  Located on chromosome 12
  Distance between a terminus base of telomere on chromosomal short arm and 5'-terminus of this base sequence : 16833586
  Distance between 3'-terminus of neighbour sequence of sequence listing upward to telomere on chrosomal short arm and 5'-terminus of this base sequence : 63721
tcttcctctgatagtcataaacacagacacacacagacacacacacacacacacacacacacacacacacacagagagagagagagagagagagcgagagacagagagacagagagacagaaagagagagctttaccacaattgattatggaaaaaatcacaattgattatggaaagaagaaatgctaggagagctcaggcccatttatctcagtagatgaacaagattgtaactgc

SEQ ID NO: 18398 - DNA, 206 bp, Homo sapiens
  AC007543.4_114927
  Located on chromosome 12
  Distance between a terminus base of telomere on chromosomal short arm and 5'-terminus of this base sequence : 16924163
  Distance between 3'-terminus of neighbour sequence of sequence listing upward to telomere on chrosomal short arm and 5'-terminus of this base sequence : 90340
tcttgcaattcctggtataaactctcttggtcatgatatgttatgatatgtgtgtgaatgtgtgtgtgtgtgtgtgtgtgtgtgtgtgcattcatctgctaaaactttgataaagatttttgtgttcatgttcaagagaaatatcagcctgcagttttttaaaaataatatggcttttcttgctttggtgttagagtaatgctgat

SEQ ID NO: 18399 - DNA, 301 bp, Homo sapiens
  HUMUT5075
  Located on chromosome 12
  Distance between a terminus base of telomere on chromosomal short arm and 5'-terminus of this base sequence : 16927610
  Distance between 3'-terminus of neighbour sequence of sequence listing upward to telomere on chrosomal short arm and 5'-terminus of this base sequence : 3241
gattacaggcatgagccaccatgcccaggctttcctttctttcttttctttctttttctttcttgtttttctttcttttctttctttttctctttccttcctttctctctttctcttttctttctttcttctttctcttttctttcttttttctttttttctttctccttccttccttctttccttcctctttctttcttctttttttctctttctttcatttctttctctctctttctttcctttttatttttaactgtattgcttcttggaacctgtcacttggcagtaagctgaagca

SEQ ID NO: 18400 - DNA, 460 bp, Homo sapiens
  AC007543.4_99923
  Located on chromosome 12
  Distance between a terminus base of telomere on chromosomal short arm and 5'-terminus of this base sequence : 16938951
  Distance between 3'-terminus of neighbour sequence of sequence listing upward to telomere on chrosomal short arm and 5'-terminus of this base sequence : 11040
cttctgctttagaatctggttaagataatttgttctgggtgtatctattttcgtatgaacgattccaagcagcaggagttgtaaggcaggcaagaagaaccaatcacagaaccaaagaactagtgggtctaacgtctcctcattcccatcctcatctgcttagaaaactaagcagattcaaacacagtgcctccaaggtaacagtcgcagtagtgatagaggctgaaatacagtctctctcttcctctccaaatgcctccatcacacacgcgcacacacacacacacacacacacacacacacagtcacaggcacacacattctaagcctctatctatattctctgtggtgaccagcattcttagagggtaatatgactcttggagatagggattcaattcttggttgggatccattcagaacatggatcctgttgttctacaatcagataattgctgcc

SEQ ID NO: 18401 - DNA, 346 bp, Homo sapiens
  AC007543.4_47663
  Located on chromosome 12
  Distance between a terminus base of telomere on chromosomal short arm and 5'-terminus of this base sequence : 16991333
  Distance between 3'-terminus of neighbour sequence of sequence listing upward to telomere on chrosomal short arm and 5'-terminus of this base sequence : 51922
ttggccagtactaaactttgactcttaatgattaaaccacactctttagggagaccacaatgtggggacacattaacagaagccaaacaccacacaagcaatgaaacaagaaggacacacgtcatctgctaaaaatgtgtgtgtgtgtgtgtgtgtgtgtgtgtgtgtgtgtgtgtgtgtgtaacatcagggatcaacaatgcatgagtttgggaagaccagatgatgagacccagcttacaaggtattttgtatttctaattgttataaaacccgccagattcaaagtaagtgagaaatacagatatagaaatggcactcataaatgaattcaactccaaagtga

SEQ ID NO: 18402 - DNA, 300 bp, Homo sapiens
  AC007543.4_42242
  Located on chromosome 12
  Distance between a terminus base of telomere on chromosomal short arm and 5'-terminus of this base sequence : 16996732
  Distance between 3'-terminus of neighbour sequence of sequence listing upward to telomere on chrosomal short arm and 5'-terminus of this base sequence : 5053
actttcctaagctaatcctgtaaagtctatattcttcatagtgtgtaaccacggttctgttcagttacgttgttaatcagctaatgcttggtcagagatttcttaaatgcctccaaaaattaaatctttcaacctttactctcaggctctgtgtgtgtgtgtgtgtgtgtgtgtgtgtgtgtgtgtgtgtgtgtgtgtgtgtgttggggcatgctttccatgttcaggcagccagtttacaaactctaccctagacttcatttcctgcttgcacagggcttcaagatcagccaaagacta

SEQ ID NO: 18403 - DNA, 273 bp, Homo sapiens
  AC007543.4_22029
  Located on chromosome 12
  Distance between a terminus base of telomere on chromosomal short arm and 5'-terminus of this base sequence : 17017064
  Distance between 3'-terminus of neighbour sequence of sequence listing upward to telomere on chrosomal short arm and 5'-terminus of this base sequence : 20032
ttccacttaacttcttaaggcacagcaagcttggctgtgtgtgtgtgtgtgtgtgtgtgtgtgtgtgtgtgtgtgtgtgtgtgtgcatgtgtgtgttgtattctgttggtttagttaattacccaaatccattcagcatctattcgtctcaaattgaactgcggtcaaaggatgggaggaaatcagtaactgctgccatatggcaccaaactgagacatgcagatacctagaagttgcatcactaataataattacattgctaatatgccacc

SEQ ID NO: 18404 - DNA, 458 bp, Homo sapiens
  chr12.fa.O7frz.16040922
  Located on chromosome 12
  Distance between a terminus base of telomere on chromosomal short arm and 5'-terminus of this base sequence : 17077403
  Distance between 3'-terminus of neighbour sequence of sequence listing upward to telomere on chrosomal short arm and 5'-terminus of this base sequence : 60066
gcagaattctaatactcatgatcttggctctctatctaattagaaactaaagagagttctttgttttcagctctcatagtgcaattccatctaaaacagttgctaccttaattctctgaggtggagtgcaagcctacgtcagcctgttcaatattttaagacacaagtttctcacgtctcagcaaatggaaacctacagggttgtagcaggtcctcaacatgtatgtctctccaattctccatttcctctatttagtagcaagtagtgcgtgcgtgtgtgtgtgtgtgtgtgtgtgtgtgtgtgtgcaggtgcatgcgcatgtatgtgtctgattggaggattattcctctatttttctatagcattatcatttctcattttaaaacattatttgctgttactgaccctccattccagaaacacatcgctttcttcctctgtactggagtgtagcaac

SEQ ID NO: 18405 - DNA, 202 bp, Homo sapiens
  G08975
  Located on chromosome 12
  Distance between a terminus base of telomere on chromosomal short arm and 5'-terminus of this base sequence : 17302237
  Distance between 3'-terminus of neighbour sequence of sequence listing upward to telomere on chrosomal short arm and 5'-terminus of this base sequence : 224376
catctgccctctggctataagctgatgtagaagatggatggatggatggatggatggatggatggatggatggatgcatggatggacggacggacggacagacacacacacagacagagagacagacagatagatagatagacataaaaataactcattctgtgccaattctgtcaagtgtcaactgccctccaaaatctct

SEQ ID NO: 18406 - DNA, 108 bp, Homo sapiens
  DISO7_10003245
  Located on chromosome 12
  Distance between a terminus base of telomere on chromosomal short arm and 5'-terminus of this base sequence : 17605448
  Distance between 3'-terminus of neighbour sequence of sequence listing upward to telomere on chrosomal short arm and 5'-terminus of this base sequence : 303009
cctttctgctatgtgctgggataaacacacacacacacacacacacacacacacacacacacacacacacacaggcatacacacttttcatttaacatcctccatgga

SEQ ID NO: 18407 - DNA, 350 bp, Homo sapiens
  chr12.fa.O7frz.17180219
  Located on chromosome 12
  Distance between a terminus base of telomere on chromosomal short arm and 5'-terminus of this base sequence : 17858509
  Distance between 3'-terminus of neighbour sequence of sequence listing upward to telomere on chrosomal short arm and 5'-terminus of this base sequence : 252953
ttacttgtttagctgcaaattatctcaaaggatttttttttttacatgattggagagcaaggttgtgtgtgtgtgtgtgtgtgtgtgtgtgtgtgtgtgtgtgtgtttaatgacactttcccttcctgagaggcatcttttaaatccagtctcttgatttgtgccaaatagaaacccaaaaaagacctttaatcctttgtccattggatgtgatgactttatatgtaagtgtagcttcagtttattttggaatagtgaccttttttttaatatactgttttatgagaggaaataaactccttccagaattttctcacttaaaataacttcacatcttaattacgaatagg

SEQ ID NO: 18408 - DNA, 425 bp, Homo sapiens
  AC018654.20_163408
  Located on chromosome 12
  Distance between a terminus base of telomere on chromosomal short arm and 5'-terminus of this base sequence : 17935452
  Distance between 3'-terminus of neighbour sequence of sequence listing upward to telomere on chrosomal short arm and 5'-terminus of this base sequence : 76593
acaaatcaagttagacttgaacaggtgaaagggatagaaattcattacagtagggttatggtcacataaaaataaggaataaaggagaagataaaataaaatcgcattcactgagtatttacatgccagatattatattatattatattatattatattatattatattatatacgattttacctatattattaactcacttaattgttacagcaaccctgcaaaacaggtataaatatccaccaccataaaggaattaaaaaaggaattccagagagattagctaacttgctcacacagtgaataaatgtcagcagtgggactggagcctctaggcacaaggcttggcctagggcagtgaagaggtgggtttccacatcctcccttccagggatatggctgtctttagcttgactgcagtacat

SEQ ID NO: 18409 - DNA, 254 bp, Homo sapiens
  DISO7_10009672
  Located on chromosome 12
  Distance between a terminus base of telomere on chromosomal short arm and 5'-terminus of this base sequence : 18018639
  Distance between 3'-terminus of neighbour sequence of sequence listing upward to telomere on chrosomal short arm and 5'-terminus of this base sequence : 82762
ttagcactttatcaatattcgtccccgtaaaacccacaagaggttttttattttacatgtgtaaaaacagaggcccagagaggttagagaattttctcaaaagtacacagctgtccaagaatatgtcaaggggagagagagagagagagagagagagagagagagagagagagagagagagagagagagagagagaggctggcaatggatgggtggatggatggtagctggtacatattaagccactctcaggt

SEQ ID NO: 18410 - DNA, 317 bp, Homo sapiens
  AC007528.5_18659
  Located on chromosome 12
  Distance between a terminus base of telomere on chromosomal short arm and 5'-terminus of this base sequence : 18137276
  Distance between 3'-terminus of neighbour sequence of sequence listing upward to telomere on chrosomal short arm and 5'-terminus of this base sequence : 118383
tttgatggagttgatagtgagatacttgaagatccaaagcagaaatgcaggagagatactgagttgtgatccactggagggctgattgaagaatctctctttctcctttcctctttttcccatgctctctgttcagagagagagagagacagagagagagagagagagtgtgtgtgtgtgtgtgtgtgtgtgtgtgtgtttgggggggaggtcttcttaatatgtaaatggaggctaggaaatctaaaagtattagtagctgtgagtaggcaaaaccactataaccttatttattgtgtaatgagatggacagcttc

SEQ ID NO: 18411 - DNA, 282 bp, Homo sapiens
  AC007528.5_139226
  Located on chromosome 12
  Distance between a terminus base of telomere on chromosomal short arm and 5'-terminus of this base sequence : 18257974
  Distance between 3'-terminus of neighbour sequence of sequence listing upward to telomere on chrosomal short arm and 5'-terminus of this base sequence : 120381
ctgtcctcactcgcaaatctctcctctctctctctgacacacacacacacacacacacacacacacacacacacacacacacacacacagagagagagaatattgtcagagttctccagaggaaaagaatcaataggctgtgtagataaatagagaaaaagatttattacaaggagttcactcacacaattatggacgctgacaagaccaaagagctgaagggtgacttggcaagtgggaatttcaggacagtcaatggtgtctgtcaatggtgacctagtc

SEQ ID NO: 18412 - DNA, 254 bp, Homo sapiens
  AC007528.5_146793
  Located on chromosome 12
  Distance between a terminus base of telomere on chromosomal short arm and 5'-terminus of this base sequence : 18265479
  Distance between 3'-terminus of neighbour sequence of sequence listing upward to telomere on chrosomal short arm and 5'-terminus of this base sequence : 7223
agaagttcagatacaatggtgaacacattgtaagtgatgaataaatgattgcttgtatgcatgtgtatttttcatgttatattaagaaatgtgtgtgtacacacacacacacacacacacacatacacagtaaagcgtataaaccttgggtatagagtttaataatttttatatttggatactccatgtgacagccactcaataattccaacttcttagaggtttcctcatgctcctttctagccaataccttc

SEQ ID NO: 18413 - DNA, 311 bp, Homo sapiens
  AC007552.4_54379
  Located on chromosome 12
  Distance between a terminus base of telomere on chromosomal short arm and 5'-terminus of this base sequence : 18361295
  Distance between 3'-terminus of neighbour sequence of sequence listing upward to telomere on chrosomal short arm and 5'-terminus of this base sequence : 95562
acaaaggatttaggcttgaaaggagaaatgctgggtgaagagggctgtcaaccattggaagggttatttagtctcctcctaaagcctgagtagaatctcagtaacttggtgtgtgtgagtgtgtgtgtgtgtgtgtgtgtgtgtgtgtgtgtgtcaggtgaggaggagtaggggagtttcttgtctaaaggccaggaatacactagctgtttctcttattaggaagtctatgagatataattgaaagagttaaaaaattattttaaccatttagatttatacgctgactttgaagcaggacaataagtaat

SEQ ID NO: 18414 - DNA, 246 bp, Homo sapiens
  D12S1715
  Located on chromosome 12
  Distance between a terminus base of telomere on chromosomal short arm and 5'-terminus of this base sequence : 18369379
  Distance between 3'-terminus of neighbour sequence of sequence listing upward to telomere on chrosomal short arm and 5'-terminus of this base sequence : 7773
acatttgtttggtcgctgcagttttcaggttgagtattcctttctggaacagttcacagcatcttactgtgctgcactgcgtttttctcatgccttttatttttggatttctggttttctaaggtattgtctttcaaaacaaactttttaaattgacaccttaagtaagaactacacacacacacacacacacacacacacacacacacacacacaaaacataacctactagtcaatctgcctgca

SEQ ID NO: 18415 - DNA, 392 bp, Homo sapiens
  AC007529.5_18831
  Located on chromosome 12
  Distance between a terminus base of telomere on chromosomal short arm and 5'-terminus of this base sequence : 18549013
  Distance between 3'-terminus of neighbour sequence of sequence listing upward to telomere on chrosomal short arm and 5'-terminus of this base sequence : 179388
ctagatgagtaacagaaggaacagtgttttatctaaagagagagaaaaggaataattttgattatgtgtataaataagtttccagaagagggagacacttcaggaggcctctggttaataatttatctatctatctatcatctatctatctatctatctatctatctatctatctatctatctacacacaaacatttttacccttgtgaagtagaaagcaaggcaccttctgatgaagaggtgagatatggggcggaaggcttgagaagagtagtaaaattcacgaatgaaagaaagagagatgatcacaaaagtataaaagtattgacaagccagtgcattgggaggacattgatttatggatttataacagcattagtccaatttaatta

SEQ ID NO: 18416 - DNA, 245 bp, Homo sapiens
  AC007529.5_11278
  Located on chromosome 12
  Distance between a terminus base of telomere on chromosomal short arm and 5'-terminus of this base sequence : 18556582
  Distance between 3'-terminus of neighbour sequence of sequence listing upward to telomere on chrosomal short arm and 5'-terminus of this base sequence : 7177
gatgtgtttagatgcttggaaggtgaccaggatcaaggtaagcctctattatgtctttgtgccatatgaaaaagtttaatttcattacagcatttttctattacacaaacatctgtcaatagggaagactgatcttcagaaacacacacacacacacacacacacacaaatgttaaattgtaataacttataaactatggtgcctggtggactcccacttgcagatttccaagatgcaagtatca

SEQ ID NO: 18417 - DNA, 143 bp, Homo sapiens
  Z67076
  Located on chromosome 12
  Distance between a terminus base of telomere on chromosomal short arm and 5'-terminus of this base sequence : 18679655
  Distance between 3'-terminus of neighbour sequence of sequence listing upward to telomere on chrosomal short arm and 5'-terminus of this base sequence : 122828
acactgtgctaggtgctgtaggggatataaaatatgtatcatgtgattcctgccctcaaagggaaacacacacacacacacacacacacacacacacacagacacacacacactctctctctcaaacctataagggtaaggga

SEQ ID NO: 18418 - DNA, 212 bp, Homo sapiens
  D12S373
  Located on chromosome 12
  Distance between a terminus base of telomere on chromosomal short arm and 5'-terminus of this base sequence : 18687394
  Distance between 3'-terminus of neighbour sequence of sequence listing upward to telomere on chrosomal short arm and 5'-terminus of this base sequence : 7596
tggcactagatgttttcaaggctcacatatctagtttcatgattaaaattgaaggataattaaattcaataaacattgtgttaatatctttttagaaatgcatttattttggcaaaataaaattcaactgtctatctatctatctatctatctatctatctatctatctatctatcacctatctgtctgcctttctctaaaaacatcctaga

SEQ ID NO: 18419 - DNA, 208 bp, Homo sapiens
  DISO7_10003251
  Located on chromosome 12
  Distance between a terminus base of telomere on chromosomal short arm and 5'-terminus of this base sequence : 18774458
  Distance between 3'-terminus of neighbour sequence of sequence listing upward to telomere on chrosomal short arm and 5'-terminus of this base sequence : 86852
catttctgcagactccaattagtttaaaagtggtttctgatgaaaattttcaaaataactgagcagttcatgaaaaacaactttatatttttatgtatttgactatatcaactcatatttcatatatacatgcccctatacatgcacttacatacacacacacacacacacacacacacacacacacaggcttccaaatagctacagc

SEQ ID NO: 18420 - DNA, 271 bp, Homo sapiens
  chr12.fa.O7frz.18220711
  Located on chromosome 12
  Distance between a terminus base of telomere on chromosomal short arm and 5'-terminus of this base sequence : 18807878
  Distance between 3'-terminus of neighbour sequence of sequence listing upward to telomere on chrosomal short arm and 5'-terminus of this base sequence : 33212
gttagaatcactgatagatggaaggcagaatacttattgcccatggaattagtcagaatcagttttatatataattatatgctgtatatatgcaatattacatatacaatatgtagcatatattaaactaatatattatggtgtgtatgtatgtgtgtgtatatatatatatatatatacacacacacacacacatatatagtctatctacctatctacctatctatataattggctcacagttatagagtctgacaagtcctaacatctg

SEQ ID NO: 18421 - DNA, 236 bp, Homo sapiens
  DISO7_10003254
  Located on chromosome 12
  Distance between a terminus base of telomere on chromosomal short arm and 5'-terminus of this base sequence : 19039766
  Distance between 3'-terminus of neighbour sequence of sequence listing upward to telomere on chrosomal short arm and 5'-terminus of this base sequence : 231617
catatccaaattcagccttgaatatttttatttaagaatctgatgcatttattttagcaaattatgtgggcttcaaaacaaaaattagcatgacataattatttgtatgtctacttatatacattgttttcatctgtttctaatctcccactccaaaacacacacacacacacacacacacacacacacacacacacagtaactgaaatgttaggaaacttctatcgaacaatagg

SEQ ID NO: 18422 - DNA, 250 bp, Homo sapiens
  Z66798
  Located on chromosome 12
  Distance between a terminus base of telomere on chromosomal short arm and 5'-terminus of this base sequence : 19239978
  Distance between 3'-terminus of neighbour sequence of sequence listing upward to telomere on chrosomal short arm and 5'-terminus of this base sequence : 199976
agctttgtttggcgtaagttgatttaaaaaaaaatcagcaaaaacacttatcttcttatgttcttctttggcccaaacacacacacatacacacacacacacacacacacacacacacacacacacatataatgcacatttttaagggtatctttaactttcgcattggtaaactcagtaaataatggtatatatgaatgtatttaaatgaattgtatattaaataatatatgatgcaatgtaaaatgca

SEQ ID NO: 18423 - DNA, 126 bp, Homo sapiens
  G09593
  Located on chromosome 12
  Distance between a terminus base of telomere on chromosomal short arm and 5'-terminus of this base sequence : 19287884
  Distance between 3'-terminus of neighbour sequence of sequence listing upward to telomere on chrosomal short arm and 5'-terminus of this base sequence : 47656
tttgtttgtgtgtatctacagctatctatatctatctatctatctatctatctatctatctatctatctatctggttgtatgccctgaaactaaaatcttttcctggatattaagaagtctttcgt

SEQ ID NO: 18424 - DNA, 213 bp, Homo sapiens
  D12S363
  Located on chromosome 12
  Distance between a terminus base of telomere on chromosomal short arm and 5'-terminus of this base sequence : 19328678
  Distance between 3'-terminus of neighbour sequence of sequence listing upward to telomere on chrosomal short arm and 5'-terminus of this base sequence : 40668
gaggggtggcatctctcttttcgcctaaagtaactcttcgttttctttaacattttttcttgatttaccttaaaacaaaaaacaccttccccattgggaacagaattgataagtaatccatatataatatatccaataaatatttttcaaccacagtgacagacacacacacacacacacacacacacacattttatgctgatttcatttgag

SEQ ID NO: 18425 - DNA, 192 bp, Homo sapiens
  D12S1595
  Located on chromosome 12
  Distance between a terminus base of telomere on chromosomal short arm and 5'-terminus of this base sequence : 19774231
  Distance between 3'-terminus of neighbour sequence of sequence listing upward to telomere on chrosomal short arm and 5'-terminus of this base sequence : 445340
actcttggtctcagtctgccaattgaggattgtcaaatgaatgcaatagttgtaggatttcccagtatgctgtaagaattagataacttactgtgtgtgtgtgtgtgtgtgtgtgtgtgtctgtgtgtatacatatatatataatgtatatatataaaacttcaaacatgacctgacacatcataagatccc

SEQ ID NO: 18426 - DNA, 107 bp, Homo sapiens
  DISD22_0008128
  Located on chromosome 12
  Distance between a terminus base of telomere on chromosomal short arm and 5'-terminus of this base sequence : 19960018
  Distance between 3'-terminus of neighbour sequence of sequence listing upward to telomere on chrosomal short arm and 5'-terminus of this base sequence : 185595
ggcacaggatctataattgtactgaatatgatgatagagatgtgtgtgtgtgtgtgtgtgtgtgtgtgtgtgtgtgtgtattggaaaggtgtcaagaaacgcttcct

SEQ ID NO: 18427 - DNA, 102 bp, Homo sapiens
  DISD22_0008133
  Located on chromosome 12
  Distance between a terminus base of telomere on chromosomal short arm and 5'-terminus of this base sequence : 20045138
  Distance between 3'-terminus of neighbour sequence of sequence listing upward to telomere on chrosomal short arm and 5'-terminus of this base sequence : 85013
ttgtattgcttatcatttgcctgtttgttccaagatctaattattgactctgtgtgtgtgtgtgtgtgtgtgtgtgtgcgcgcacgcacatcctcaattcac

SEQ ID NO: 18428 - DNA, 110 bp, Homo sapiens
  DISD22_0008138
  Located on chromosome 12
  Distance between a terminus base of telomere on chromosomal short arm and 5'-terminus of this base sequence : 20141802
  Distance between 3'-terminus of neighbour sequence of sequence listing upward to telomere on chrosomal short arm and 5'-terminus of this base sequence : 96562
ttctagcttcatgcatccacgtgtgtgtgtgtgtgtgtgtgtgtgtgtgtaatttttttccacagcaatatccatgtagctcaaagtctggggcatgatcggtgattaat

SEQ ID NO: 18429 - DNA, 238 bp, Homo sapiens
  DISD22_0008143
  Located on chromosome 12
  Distance between a terminus base of telomere on chromosomal short arm and 5'-terminus of this base sequence : 20231340
  Distance between 3'-terminus of neighbour sequence of sequence listing upward to telomere on chrosomal short arm and 5'-terminus of this base sequence : 89428
tggaactctggagaacagcaacatttgtgttgttgttgttgttgttgttgttgttgttgttgttgttgagatggagtcttgctctgtctcccaggttagagtgcagtggtgcgatctcggttcacagcaacctccgcctccccgggagaacagcaacattttaagaacagtgcaaagcaagaaaaaccaggaaaataaactgaaaaaaaagtgaccaaaaggttgcaggagatccaga

SEQ ID NO: 18430 - DNA, 110 bp, Homo sapiens
  DISD22_0008145
  Located on chromosome 12
  Distance between a terminus base of telomere on chromosomal short arm and 5'-terminus of this base sequence : 20309854
  Distance between 3'-terminus of neighbour sequence of sequence listing upward to telomere on chrosomal short arm and 5'-terminus of this base sequence : 78276
gatataggcatcaaagcattctctaacacacacacacacacacacacagacttactagcattcttcaaatagtacaaagaatgaaatacattgaacccacattcttactt

SEQ ID NO: 18431 - DNA, 455 bp, Homo sapiens
  chr12.fa.O7frz.19543316
  Located on chromosome 12
  Distance between a terminus base of telomere on chromosomal short arm and 5'-terminus of this base sequence : 20507135
  Distance between 3'-terminus of neighbour sequence of sequence listing upward to telomere on chrosomal short arm and 5'-terminus of this base sequence : 197171
agactgacctcagatgtgaactctgcaaacactgtcacctcgtggactcacaccacacttataatcctttctttagtcctacacggtttttcttctagtatatcataaacttctccagggcgggttaaatgtcttatcctttttaatacttttaacacttagttacctctaaaatgatgtgtaataaatattcggggcagttttataagtgacactgtgtgtgtgtgtgtgtgtgtgtgtgtgtgtgtgtgtataaaatgtaaatacatgtatatactgcatatatatatagagagagagagattctctaaactggtaaggaaaaatattttgacactattatttgtcatgatgtcaacagtgagaagcatacacttcccaacaatatatcactgtttcttttcatactttttgagtacaagtctccatgcctcactatcaagaaacttctcaga

SEQ ID NO: 18432 - DNA, 296 bp, Homo sapiens
  DISO7_10003262
  Located on chromosome 12
  Distance between a terminus base of telomere on chromosomal short arm and 5'-terminus of this base sequence : 20560733
  Distance between 3'-terminus of neighbour sequence of sequence listing upward to telomere on chrosomal short arm and 5'-terminus of this base sequence : 53143
ggtaatgaacttcctggtgtgaaaaataaactcatggactgaaaaagaataattaaaacattgtgaaagaattcaaataaatttaaaaagccactatatatatatatatatatatatatatatcatataattctataatagtttcaacaattttgatatgtattgtcttggcaaaaatttgcaattcatgaatatcaaaataaatccatgcctttatgtttatagtataattcactattatttagatgttagtgacaattttatcataaaatgtatgtacactgatcattcaagga

SEQ ID NO: 18433 - DNA, 152 bp, Homo sapiens
  DISO7_10003263
  Located on chromosome 12
  Distance between a terminus base of telomere on chromosomal short arm and 5'-terminus of this base sequence : 20603942
  Distance between 3'-terminus of neighbour sequence of sequence listing upward to telomere on chrosomal short arm and 5'-terminus of this base sequence : 42913
atagtatagaggtggccagggttaaggctgtgtgtgggtgtgtacgtgtgtgtgtgtgtgtgtgtgtgtgtgtgtgagagagagagagagagagagagagagacttttgactgtttcgaactgaaaaggtatacaaatgaatatcactccac

SEQ ID NO: 18434 - DNA, 149 bp, Homo sapiens
  DISO7_10003264
  Located on chromosome 12
  Distance between a terminus base of telomere on chromosomal short arm and 5'-terminus of this base sequence : 20603945
  Distance between 3'-terminus of neighbour sequence of sequence listing upward to telomere on chrosomal short arm and 5'-terminus of this base sequence : -149
gtatagaggtggccagggttaaggctgtgtgtgggtgtgtacgtgtgtgtgtgtgtgtgtgtgtgtgtgtgtgagagagagagagagagagagagagagacttttgactgtttcgaactgaaaaggtatacaaatgaatatcactccac

SEQ ID NO: 18435 - DNA, 252 bp, Homo sapiens
  D12S310
  Located on chromosome 12
  Distance between a terminus base of telomere on chromosomal short arm and 5'-terminus of this base sequence : 20685111
  Distance between 3'-terminus of neighbour sequence of sequence listing upward to telomere on chrosomal short arm and 5'-terminus of this base sequence : 81017
gaaaactaatttccccttactataaagaatctcaattgtctaagaaagtgaacctttcttcccaaaatgagtctaacacacacacacacacacacacacacacacacacacatatatacacacacatatacatatatatatataaagtatcattatttctcctgaaagatctcttatttcagatgacctcaaattgagaaaactaaaaaaaaattgattttaaaaaacgttttggcatttggagaatctaaa

SEQ ID NO: 18436 - DNA, 371 bp, Homo sapiens
  AC024092.19_106752
  Located on chromosome 12
  Distance between a terminus base of telomere on chromosomal short arm and 5'-terminus of this base sequence : 20721526
  Distance between 3'-terminus of neighbour sequence of sequence listing upward to telomere on chrosomal short arm and 5'-terminus of this base sequence : 36163
ggaatctaatgtacagtatggtgactacagttaataataccatataatttactggaaatctaagagactaaatcttgtattcttactacacatacacacacacacacacacacacacacatacacacaaagtaacaatgtgagggatggatgtgttaattacttggttgtgggagtcatttcacaacgtatacatatatcaaatcatcatgttgcacaccttaagtacacatgatgcaaatatacacaatttttatttgctgattataagtcaatgaagctggaaaaaaataatttaaaaagaaatctactccaataaggctttgctctcaccattaagtctttgttgtcaccagtgacctcactattaat

SEQ ID NO: 18437 - DNA, 293 bp, Homo sapiens
  AC024092.19_92870
  Located on chromosome 12
  Distance between a terminus base of telomere on chromosomal short arm and 5'-terminus of this base sequence : 20735325
  Distance between 3'-terminus of neighbour sequence of sequence listing upward to telomere on chrosomal short arm and 5'-terminus of this base sequence : 13428
ggcaaacatgtgtttagcttacagttttaaactcttattgatccaaaatcaatagcttgtgtttaaaagtactatctcaaagacataaattataaaaatgtaagggagtgtgatctgacaatatttggtatatatttttcccttctctggaagctgagatatatatatatatatatatatatatatatatatatatatatatagcattatatatattgcattatatatatacatatatatatttagagcaatgcttattaaattaggatcagtggaagctctgaaattgtatg

SEQ ID NO: 18438 - DNA, 220 bp, Homo sapiens
  AC024092.19_82235
  Located on chromosome 12
  Distance between a terminus base of telomere on chromosomal short arm and 5'-terminus of this base sequence : 20746066
  Distance between 3'-terminus of neighbour sequence of sequence listing upward to telomere on chrosomal short arm and 5'-terminus of this base sequence : 10448
tgctagtccttaacaggtaatgtctctgatactggcacgagtaaacatgaaggtaaatacacacacacacacacacacacacacacacacacacacaggcttacatatgtagtatctcctatatcaaaatagagcctataacacttcagggcacaaactagtagttctttctattaaagtctccacaatacaatcacttaattctgtagcatctacctgc

SEQ ID NO: 18439 - DNA, 240 bp, Homo sapiens
  D12S1027
  Located on chromosome 12
  Distance between a terminus base of telomere on chromosomal short arm and 5'-terminus of this base sequence : 20785021
  Distance between 3'-terminus of neighbour sequence of sequence listing upward to telomere on chrosomal short arm and 5'-terminus of this base sequence : 38735
agctctatttcctatccataccgtgatttatttaaccagtcacctgctggcagacatttggcttatttcaacacttttgctattacccacaagtgaaatcctttaaaatcatttaaatagatagatagatagatagatagatagatagatagatagatagatagaaaacatgttatatatgatgagtcatgtataaaaatcattatgtactttgagcaagaatatgcatagaagaaaata

SEQ ID NO: 18440 - DNA, 158 bp, Homo sapiens
  AC024092.19_23306
  Located on chromosome 12
  Distance between a terminus base of telomere on chromosomal short arm and 5'-terminus of this base sequence : 20805024
  Distance between 3'-terminus of neighbour sequence of sequence listing upward to telomere on chrosomal short arm and 5'-terminus of this base sequence : 19763
gtaaggtatagcatgctcagcttgcttgtaaagtgtgtgtgtgtgtgtgtgtgtgtgtgtgtgtgtgtcatataacagatttctgcttccaacaatatgcctggttaggaggttcaaggggacatccctccacagaacaactaaagtttggaagcaac

SEQ ID NO: 18441 - DNA, 430 bp, Homo sapiens
  chr12.fa.O7frz.19962062
  Located on chromosome 12
  Distance between a terminus base of telomere on chromosomal short arm and 5'-terminus of this base sequence : 20891495
  Distance between 3'-terminus of neighbour sequence of sequence listing upward to telomere on chrosomal short arm and 5'-terminus of this base sequence : 86313
ggataggaacgttattaagacttcttgcagagcactttttataagttcttatttaacaaatcctatccataaaaatacctaggacaatagatccattcagaacctcactcagtaacttatctttacatttgtaattgtatagataaaaatatttttataatcatcacattttgtgaagtaaaaagacaactttcaaaaattaatatgaagttaaagaagccagatacacacacacacacacacacacacacacacacacactggtagtctggtgctattttaatctcaattttattagtaaaataatatgcagagaaaaatttctagaaggattataagaaaatgttaatgttaattatctttagggggaaacataatgaaatttcagaataataataaaagatttctaagatctacagatgacagttcc

SEQ ID NO: 18442 - DNA, 144 bp, Homo sapiens
  DISO7_10000207
  Located on chromosome 12
  Distance between a terminus base of telomere on chromosomal short arm and 5'-terminus of this base sequence : 20928224
  Distance between 3'-terminus of neighbour sequence of sequence listing upward to telomere on chrosomal short arm and 5'-terminus of this base sequence : 36299
ttgtatgattgttaccttacctttgtaataaagttgttaacatgttttgatgctttgtgtttaacttttatgtttatatatatatatatatatatatatatacatatatatatatttagatgaagtagaacaattacctctgca

SEQ ID NO: 18443 - DNA, 147 bp, Homo sapiens
  DISO7_10000208
  Located on chromosome 12
  Distance between a terminus base of telomere on chromosomal short arm and 5'-terminus of this base sequence : 20967884
  Distance between 3'-terminus of neighbour sequence of sequence listing upward to telomere on chrosomal short arm and 5'-terminus of this base sequence : 39516
gagaacaaagctgaggaagggcagtgtgtgtgtgtgtgtgtgtgtgtgtgtgtgtgcatgtgtgtgtgtgtttaattatcttgataattaacagaaaaaccatttctttgtctgagtactttggaaaaggtggctcactatacccag

SEQ ID NO: 18444 - DNA, 95 bp, Homo sapiens
  DISO7_10004913
  Located on chromosome 12
  Distance between a terminus base of telomere on chromosomal short arm and 5'-terminus of this base sequence : 21064741
  Distance between 3'-terminus of neighbour sequence of sequence listing upward to telomere on chrosomal short arm and 5'-terminus of this base sequence : 96710
cacagagtctatccggtgctgtgtgtgtgtgtgtgtgtgtgtgtgtgtgtgtgtgtgtgtgtgtgtgtgtttaagtcgcctcgttcacttccaag

SEQ ID NO: 18445 - DNA, 402 bp, Homo sapiens
  chr12.fa.O7frz.20364041
  Located on chromosome 12
  Distance between a terminus base of telomere on chromosomal short arm and 5'-terminus of this base sequence : 21321209
  Distance between 3'-terminus of neighbour sequence of sequence listing upward to telomere on chrosomal short arm and 5'-terminus of this base sequence : 256373
actagtatcttgatcatagcaacactttgtaattcacctactaaatgtgagaaatgggtttttactgttaaaaagtgacatgttgaccaacatgatgaatgttagaaatcagatttttttgtcaaaatgaaggatactcaatatatctgattacctaaaatttttccagatccagaggtttacagagatgagagattaaatcaatacaatacaatacaatacaatacaatacaatacaatacaatacaatacaatacaatacctccagaggctctctttgccctttcattactagggtgtaggaatccctagaggcctgtaacccacacccatggcaatgatgttttcagctaaatcccttaagcagtctctggccaagaacactagaggattctggatgcc

SEQ ID NO: 18446 - DNA, 101 bp, Homo sapiens
  DISO7_10004914
  Located on chromosome 12
  Distance between a terminus base of telomere on chromosomal short arm and 5'-terminus of this base sequence : 21373850
  Distance between 3'-terminus of neighbour sequence of sequence listing upward to telomere on chrosomal short arm and 5'-terminus of this base sequence : 52239
gaatcatccatccaacccctctgcctgactttgtgtgtgtgtgtgtgtgtgtgtgtgtgtgtatgtgtttttaatgagacagtcttactatgttgtccaag

SEQ ID NO: 18447 - DNA, 226 bp, Homo sapiens
  D12S345
  Located on chromosome 12
  Distance between a terminus base of telomere on chromosomal short arm and 5'-terminus of this base sequence : 21677388
  Distance between 3'-terminus of neighbour sequence of sequence listing upward to telomere on chrosomal short arm and 5'-terminus of this base sequence : 303437
cagcctgggtaacaaagcaagacttggtctcaaaaaatacacacacacacacacacacacacacacacacacacacacacacacacactaaaactgctgacattgagcattatacagtaagacagattttccttccttgtttctttgcatcaattttctctgcctctccctccgttccttttctgtttgcttctactcaggactgggcacgaatgcacacattgct

SEQ ID NO: 18448 - DNA, 460 bp, Homo sapiens
  AC023973.4_78189
  Located on chromosome 12
  Distance between a terminus base of telomere on chromosomal short arm and 5'-terminus of this base sequence : 21735663
  Distance between 3'-terminus of neighbour sequence of sequence listing upward to telomere on chrosomal short arm and 5'-terminus of this base sequence : 58049
ggagagtgaaccgtaggagtcatgggagtgagtgcctgccataggagagaagatccctcaaaaagaggaattcagggctggatgcagtggctcctgcctgtaatcctagcaccttaggaggctgagatggaaggattgcttgagcccaggaggtcaggactgcagtgagccaaggtcacaccactgcactccagtctaggcaacagaatgagaccctgtctcaaataaataaataaataaataaataaataaataaataaataaataagcaagcaaataaataaataggaattcaagaattgagatcatctgtgtgggtattgagaatgccaggaattaagaccagaaattctagagatgatggcaatggcaatgagaaatgaaggggaatgagttggtgtttgctacataacagtaacagtgctggatagcggatgatagaatctgatgacatgaggtt

SEQ ID NO: 18449 - DNA, 464 bp, Homo sapiens
  AC073262.2_110587
  Located on chromosome 12
  Distance between a terminus base of telomere on chromosomal short arm and 5'-terminus of this base sequence : 22166339
  Distance between 3'-terminus of neighbour sequence of sequence listing upward to telomere on chrosomal short arm and 5'-terminus of this base sequence : 430216
gctacagtaatcaaagcagaatagaactgagaatccagaaataaacccatataataaatctttggctggccaggcatggtggctcatgcctgtattcccagcactttgggaggccgaggtggatggatcacctgaggtcaggagttcaagaccagcctggccaacatggcaaaaccccgtatctactaaaaaaaaataccaaaaaaaatagcccggcgtgatggcaggtgactgtagtctcagctacttgggaggatgaggcagaagaatcgcttgaactcaggaggtggaggctgtagtgacccaagactgcatcattgcactccagcctgggtgacagagtgagaccctgtctcaacaacaacaacaaaatctttgctcaactgattttcaacaatgccaagactattcaatggggaaagaacagtctctccaacaaatggtactaggtcaactggagaagc

SEQ ID NO: 18450 - DNA, 249 bp, Homo sapiens
  D12S1692
  Located on chromosome 12
  Distance between a terminus base of telomere on chromosomal short arm and 5'-terminus of this base sequence : 22331875
  Distance between 3'-terminus of neighbour sequence of sequence listing upward to telomere on chrosomal short arm and 5'-terminus of this base sequence : 165072
gcagcaatttcagacttctcccgaataataaacattggttttattgatgctacatccaggggttttccaatcagtgatgtagaaaacagagttaatagtcaggtcacaccaatgccctaggaactgatactatgagccacagtataaattcacactaaattaaaaaaaaaaaagggactcacaataggcgtgtgtgtgtgtgtgtgtgtgtgtgtgtgtgtgtgtgtctaggagggtatggaatcaaag

SEQ ID NO: 18451 - DNA, 213 bp, Homo sapiens
  DISO7_10003337
  Located on chromosome 12
  Distance between a terminus base of telomere on chromosomal short arm and 5'-terminus of this base sequence : 22518633
  Distance between 3'-terminus of neighbour sequence of sequence listing upward to telomere on chrosomal short arm and 5'-terminus of this base sequence : 186509
tgtggctagaaagtgaatcctttctagattttccttctttctttctttctttctttctttctttctttctttctttctttctttctttctttccttccttccttccttccttccttccttccttccttccttctctctctctctctctctctctcccctattcccttcccttcccttcccttcctttctttctcccattactgttgacagaag

SEQ ID NO: 18452 - DNA, 438 bp, Homo sapiens
  chr12.fa.O7frz.33683959
  Located on chromosome 12
  Distance between a terminus base of telomere on chromosomal short arm and 5'-terminus of this base sequence : 22738738
  Distance between 3'-terminus of neighbour sequence of sequence listing upward to telomere on chrosomal short arm and 5'-terminus of this base sequence : 219892
agagatctagctcaggagttagacaggcctgggttcaaatgctgcctctgctaattcacagatttgggtgagtcagtttctctcaggctgtttatttataaaatcaggataatcaaaggtctcatttcagaagttatgaaggattaaatagagtaatgctcataaaatgatatatttacatattcagtactcaataaattctagctacaattaaaaaagtgtgtgtgtgtgtgtgtgtgtgtgtgtgtgtgtgttttaaatgactaagttggaattggccttttttttggggtttccatcattcaaacttattttattgatactcattagcgaatataattttgttgatttttttggtgcattatgacactttttgttagtgattacacaatgttgatcatttatttatttattgtactaagtactgcaacctctgaa

SEQ ID NO: 18453 - DNA, 182 bp, Homo sapiens
  G08949
  Located on chromosome 12
  Distance between a terminus base of telomere on chromosomal short arm and 5'-terminus of this base sequence : 23072163
  Distance between 3'-terminus of neighbour sequence of sequence listing upward to telomere on chrosomal short arm and 5'-terminus of this base sequence : 332987
gggcaaggtatcaatcagtgttctagcagagaaacagaatgagtaggacttattatctatctatctatctatctatctatctatctatctatctatgtcttgtatctaacacaaggaagtctcttatgccattatggggactggctaggtaaatttgaaatccatagggcaggctatcaaga

SEQ ID NO: 18454 - DNA, 356 bp, Homo sapiens
  AC016956.19_89983
  Located on chromosome 12
  Distance between a terminus base of telomere on chromosomal short arm and 5'-terminus of this base sequence : 23282789
  Distance between 3'-terminus of neighbour sequence of sequence listing upward to telomere on chrosomal short arm and 5'-terminus of this base sequence : 210444
gcttgacaagatgcatttatacattacctagttttctactttttatttaatcattaaataaaaatttagcccacacaataaatatattaaaattcatgcatttatttatactattttggagtcccccagaagaacagagattagaattttgcctaatgaaatgagttcagatatataaaaataaggatatctatctatctatctatctatctatctatctatctatctatctatctatctatctaatttacatggaacatcctaacagctgagtcagcagtatacattcctggtcatgcatcagcgttgcctgcagggctttgtaaaatacccatatctgaatcataccaaagacc

SEQ ID NO: 18455 - DNA, 375 bp, Homo sapiens
  AC024153.22_73938
  Located on chromosome 12
  Distance between a terminus base of telomere on chromosomal short arm and 5'-terminus of this base sequence : 23446489
  Distance between 3'-terminus of neighbour sequence of sequence listing upward to telomere on chrosomal short arm and 5'-terminus of this base sequence : 163344
ggattacgaggttaggacatagagaccatcctggctaacacgatgaaaccccgtctctactaaaaatacaaaaacttagccgggtgtggtggtaggcacctgtagtcccagctactcggggggctgaggcaggagaatggcgtgaacccgggagatggagcttgcagtgagcagagatcatgccactgcactcaagcctgggcgacagagcaagactctgtctcaaaaataaatatataaataaataaataaataaataaataaataaatactggttatttcaatttggaaatttttaaagttttcttttctcattgaacattttatattagcattttttttctgtaatcagtatttgttgctaagatcttcaaa

SEQ ID NO: 18456 - DNA, 434 bp, Homo sapiens
  chr12.fa.O7frz.35663467
  Located on chromosome 12
  Distance between a terminus base of telomere on chromosomal short arm and 5'-terminus of this base sequence : 23674493
  Distance between 3'-terminus of neighbour sequence of sequence listing upward to telomere on chrosomal short arm and 5'-terminus of this base sequence : 227629
tcaaaccttcatctttgtacttagtggccccaactaaactagagtgtacctgctgggcatggtggctcacacctgtaatcccagcacttgggaggccgaggtgggtaaatcatgaggtcaggagtttgagaccagcctggccaacatagtgaaacgccatctctactgaaaaatacaaaaattagccaggcatggtggcatgtgcctatagtcccagctacttgggaggccaaggtaggagaatcacttgaacccagaaggtagatggtgtggtgagccgagatcacgccactgcactccagcctgggcaacagagtgtgactccatctcaaaaagcaataaataaataaataaataaataaacaaataaataaataaactagagtgtaccaagttccatctgtgcctaaatataggtgagatagaagccagtt

SEQ ID NO: 18457 - DNA, 369 bp, Homo sapiens
  chr12.fa.O7frz.35857076
  Located on chromosome 12
  Distance between a terminus base of telomere on chromosomal short arm and 5'-terminus of this base sequence : 23825613
  Distance between 3'-terminus of neighbour sequence of sequence listing upward to telomere on chrosomal short arm and 5'-terminus of this base sequence : 150686
gcttgaagtataaattggtacaaccactttagaagacccattgttaatatttaacctagaaaatgcacagatttatgagacactcattacaatcctgggtatatactctacaaaatgtgtgcttaggtaatataatcaagacacacacacacacacacacacacacacacacacacttcaaattctagtggagatctgtttttatcttgtgctaagtgctgaaccctgaatgtcaaaagtcttcctctcagtattcctgctccatcctcaactttcagcactctttgcaagcctgcacctcagagggatttttttccccatgctttgtctcattccccaacacaacagttgacttcttgtcactcagtg

SEQ ID NO: 18458 - DNA, 295 bp, Homo sapiens
  DISO7_10000219
  Located on chromosome 12
  Distance between a terminus base of telomere on chromosomal short arm and 5'-terminus of this base sequence : 23890078
  Distance between 3'-terminus of neighbour sequence of sequence listing upward to telomere on chrosomal short arm and 5'-terminus of this base sequence : 64096
ttacagcctactgagtcctctatcaaattagaaaactttaagaaaaagcataagctaaacacacacacacacacacacacacacaaacagaaaaactctgtacttctctctatttgcacaagaattttggagtctatcatttactaaggaactctgaaataaaaatctgaagatataattttagttttcactttgccaatttctacctatatattttcataaactcaagcaaggtaattcacttttatgagtatatgttttctaatttgtaaagtggagatgacatctaccctaa

SEQ ID NO: 18459 - DNA, 101 bp, Homo sapiens
  DISD22_0008164
  Located on chromosome 12
  Distance between a terminus base of telomere on chromosomal short arm and 5'-terminus of this base sequence : 23961398
  Distance between 3'-terminus of neighbour sequence of sequence listing upward to telomere on chrosomal short arm and 5'-terminus of this base sequence : 71025
atctcacttgcagagccctgcctggctgctctgagaatcattctgcctcctcctcctcctcctcctcctcctcctcttccctccacagctctcctggcttc

SEQ ID NO: 18460 - DNA, 110 bp, Homo sapiens
  DISO7_10003267
  Located on chromosome 12
  Distance between a terminus base of telomere on chromosomal short arm and 5'-terminus of this base sequence : 24137317
  Distance between 3'-terminus of neighbour sequence of sequence listing upward to telomere on chrosomal short arm and 5'-terminus of this base sequence : 175818
aaatacatcagttgagttagtgcactttctataaacatacactttctctctctctcacacacacacacacacacacacacacacacttccaactatacacagcacaagaa

SEQ ID NO: 18461 - DNA, 294 bp, Homo sapiens
  chr12.fa.O7frz.21472071
  Located on chromosome 12
  Distance between a terminus base of telomere on chromosomal short arm and 5'-terminus of this base sequence : 24152111
  Distance between 3'-terminus of neighbour sequence of sequence listing upward to telomere on chrosomal short arm and 5'-terminus of this base sequence : 14684
tacaagatgaattgagtagctttcttttttttctgttatctcgagtgtgtctgtgtgtgtgtgtgtgtgtgtgtgtgtgtgtgcatagacagacagaaaaagagaggagagcaagaatatgttactttaaagtttggtaagacatatttctaaaactttctgtacctgtttttttgtgagaggctaatgatggtagatatggaataatttttatatccaatttcattttttaaagattttgtatcatcatttatatttcaaatgtatctcctgacaactcagaaaggatactaa

SEQ ID NO: 18462 - DNA, 348 bp, Homo sapiens
  AC011604.10_6121
  Located on chromosome 12
  Distance between a terminus base of telomere on chromosomal short arm and 5'-terminus of this base sequence : 24243417
  Distance between 3'-terminus of neighbour sequence of sequence listing upward to telomere on chrosomal short arm and 5'-terminus of this base sequence : 91012
ggctgctattacaagatactgaatactgaatggcttaaacaacagaaatttatttctcatattctgcaggctaagaagtccaaggtgaaggtgccagctgattcaattcctggtaagtgccctcttcttagcttggagacagctaccttctccctgagttgttacatggcctttttgttgtgatcacttggagagagagagagagagagagaggaagagagagagagcacttcctttctctacttataaggccaccagttctttcaggtaagggcacactcttatgagctcatttaatcttaattattttctaaagaccctgtctcaaattacagtcactttaggatg

SEQ ID NO: 18463 - DNA, 224 bp, Homo sapiens
  AC011604.10_71320
  Located on chromosome 12
  Distance between a terminus base of telomere on chromosomal short arm and 5'-terminus of this base sequence : 24308662
  Distance between 3'-terminus of neighbour sequence of sequence listing upward to telomere on chrosomal short arm and 5'-terminus of this base sequence : 64897
ttagaactcacagagcggttagtatttttgagcatcagcgtctgtccctgatccagctccatctccgttgttcttattttttcctcataaagtttaaatgaattagaaatttgtttttattgagttttgaaaagtcaagcactttgtgtgtgtgtgtgtgtgtgtgtgtgtgtgtgtgtgtacatgaaagaaaatcagacagattgaccatctttgatggtaac

SEQ ID NO: 18464 - DNA, 327 bp, Homo sapiens
  chr12.fa.O7frz.21680372
  Located on chromosome 12
  Distance between a terminus base of telomere on chromosomal short arm and 5'-terminus of this base sequence : 24378726
  Distance between 3'-terminus of neighbour sequence of sequence listing upward to telomere on chrosomal short arm and 5'-terminus of this base sequence : 69840
atgatcataccactacactcctacctgggtgctagagagagaccttgtctccaaaagaaaaaaatatatataagcttaaaaatccacagcacatagccctatccctgttggtggagatatttctttttcttttttcttttcttttcttttcttttctttcctttccttttcttttcttttctttctttctttctttctttttctttctttttattatactttaagttctagggtacatgtgcacaacatgcaggtttgttacatatgtatacatgtgccatgttggtgtgctgcacccattaacttgtcgtttacattaggtatgtc

SEQ ID NO: 18465 - DNA, 238 bp, Homo sapiens
  DISO7_10003269
  Located on chromosome 12
  Distance between a terminus base of telomere on chromosomal short arm and 5'-terminus of this base sequence : 24496779
  Distance between 3'-terminus of neighbour sequence of sequence listing upward to telomere on chrosomal short arm and 5'-terminus of this base sequence : 117726
ccagcctcatactgtgtttcatataaaaacacatatccaaaaaaatatatatatatttttatatatatatttatttaaatatatatttaaatatgcatatatatttttatatatttaaatgtgtatatatatttaaatatacatatttaaatgtgtgtgtgtgtgtgtgtgtgtgtgtgtgtgtgtgtgtgtatatatttacagcttttttctcttatttctaggagtcctcgcccta

SEQ ID NO: 18466 - DNA, 164 bp, Homo sapiens
  chr12.fa.O7frz.21550503
  Located on chromosome 12
  Distance between a terminus base of telomere on chromosomal short arm and 5'-terminus of this base sequence : 24559814
  Distance between 3'-terminus of neighbour sequence of sequence listing upward to telomere on chrosomal short arm and 5'-terminus of this base sequence : 62797
cctttagtgaaggttttggtagaactaaaaggaaatgtgtgtgtgtgtgtgtgtgtgtgtgtgtgtgttgtgtacacccacacatatatatgtatgtgtgtatgtaagtgggaagcaacagaagaggtcagagggatgtgatgtgagaacgactatgcatattg

SEQ ID NO: 18467 - DNA, 280 bp, Homo sapiens
  AC022335.8_151249
  Located on chromosome 12
  Distance between a terminus base of telomere on chromosomal short arm and 5'-terminus of this base sequence : 24585105
  Distance between 3'-terminus of neighbour sequence of sequence listing upward to telomere on chrosomal short arm and 5'-terminus of this base sequence : 25127
tcttcacattgagtaggctgtcttgctgtctcaggagtggcagaggtagaagaagtgaaggaggcggaggagggcttaggagaagcaggcacacttggtgttacttttattgaagaaatccacgtataagtggacctgtgaagttgaaacctgtgttgtgcaagggtcagctatacacacacagacacacacacacacacacacacatatacagacagagagagagaaagtagtcctgcaaactagagacccggaaaagaactgatgctgtaattcaagt

SEQ ID NO: 18468 - DNA, 210 bp, Homo sapiens
  AC022224.22_92309
  Located on chromosome 12
  Distance between a terminus base of telomere on chromosomal short arm and 5'-terminus of this base sequence : 24753396
  Distance between 3'-terminus of neighbour sequence of sequence listing upward to telomere on chrosomal short arm and 5'-terminus of this base sequence : 168011
tctaaaccagcaataaccaactagaaaatataagagaacagtaccacacatatacatatatacctatctctacttatgcgtagagatgatagagataaatatggacacacacacacacacacacacacacacacacacacagacctatctgtccaaaatagtgcaataatttataagggaggggtagagcaaggagctaaatagaagtct

SEQ ID NO: 18469 - DNA, 335 bp, Homo sapiens
  AC022224.22_79508
  Located on chromosome 12
  Distance between a terminus base of telomere on chromosomal short arm and 5'-terminus of this base sequence : 24766098
  Distance between 3'-terminus of neighbour sequence of sequence listing upward to telomere on chrosomal short arm and 5'-terminus of this base sequence : 12492
catgtacaatcacattgataatcacaattatttacaagcaatacaaatataaatttaaatatatttaaaatcaatacaaatataaatcagtttaaaatcatatacatattcatatctctatatatttgcaatcacaaatatttacatgtagatggatatatatgtatattgtacatttgtgatggtaatggtaccattctgtgtgtgtgtgtgtgtgtgtgtgtgtgtgtgtgtgtgtgtatggcatcactagaaatatatttggtctttgtccctagcttctgacacgtgtccttggagttcttagaattcccttggaacatcctgagtgatag

SEQ ID NO: 18470 - DNA, 185 bp, Homo sapiens
  D12S1654
  Located on chromosome 12
  Distance between a terminus base of telomere on chromosomal short arm and 5'-terminus of this base sequence : 24893334
  Distance between 3'-terminus of neighbour sequence of sequence listing upward to telomere on chrosomal short arm and 5'-terminus of this base sequence : 126901
agctcattttaccttggaaatattggctaatctgtcaggcaatgctgggaaggaagaccagacttcattttctgtcagtcacaattaaatcaggaaagggaaataatgaatgaagattcactatagaatctcgggcacacacacacacacacacacacacacacaaaagacaataaatcactcgc

SEQ ID NO: 18471 - DNA, 346 bp, Homo sapiens
  AC006559.6_61871
  Located on chromosome 12
  Distance between a terminus base of telomere on chromosomal short arm and 5'-terminus of this base sequence : 24907425
  Distance between 3'-terminus of neighbour sequence of sequence listing upward to telomere on chrosomal short arm and 5'-terminus of this base sequence : 13906
ttggatcagcttataatcctgtcctattctccccagaaagcctcattatgtaagtaataagccttttcattccctcatggggtgagtgtgtgtgtgtgtgtgtgtgtgtgtgtgtatgtgtgtgtgatcattaatcttcacatccaaatcaaattttggatgggggttccttcctgatactgtgagttccttcctgatactgtggggtgactgtaacatttatctacctagaacaacagaacaacctggtctcaaaatatcatatcaaactattgagaaaggaacagcagtatctcataaggcaaattcatgtttcacaattgtagattcagccatactatgaagc

SEQ ID NO: 18472 - DNA, 382 bp, Homo sapiens
  AC022072.13_34335
  Located on chromosome 12
  Distance between a terminus base of telomere on chromosomal short arm and 5'-terminus of this base sequence : 25069068
  Distance between 3'-terminus of neighbour sequence of sequence listing upward to telomere on chrosomal short arm and 5'-terminus of this base sequence : 161297
ctatcactagactggctttacaagaaatatttaagggagtcctacacatgaaagtgacaggacactgccattatgaagacacacaaaggtatacaactaactggtagagcaaaacacaaataaagaagagaaagaactcaaacgttaccactacagaaaatcaccaaaccacaatcataaataataagaaagaaagaaagaaagaaagagagagagagagagaatgaaagaaagaaaaggaaggaaggaagaaaaaaacacaaaacaaacaaactaaaaaaaaaacaaaacaaccaggaatcaattaacaaaatggcaggaataagctctcacatgtcaataatagccttgcatgtaaatggattaaattgttacttgaaag

SEQ ID NO: 18473 - DNA, 155 bp, Homo sapiens
  DISO7_10003272
  Located on chromosome 12
  Distance between a terminus base of telomere on chromosomal short arm and 5'-terminus of this base sequence : 25295547
  Distance between 3'-terminus of neighbour sequence of sequence listing upward to telomere on chrosomal short arm and 5'-terminus of this base sequence : 226097
gagtgagtccatgctctcactatatatatctatatctatatctatatctatctatatatatatctatatataactatatagatatatatatatgtgtgtgtgtgtgtgtgtgtgtgtgtgtgtgtgtgatatgggttcagagaagttacacatct

SEQ ID NO: 18474 - DNA, 137 bp, Homo sapiens
  G08968
  Located on chromosome 12
  Distance between a terminus base of telomere on chromosomal short arm and 5'-terminus of this base sequence : 25308030
  Distance between 3'-terminus of neighbour sequence of sequence listing upward to telomere on chrosomal short arm and 5'-terminus of this base sequence : 12328
ggggatgttcaaagggttataggatttactgaaacaatgaacatgaaccataaagattatctatctatctatctatctatctatctatctatctatcatcaatctatcatctctctatatacacacacgcaaggctc

SEQ ID NO: 18475 - DNA, 177 bp, Homo sapiens
  DISO7_10003274
  Located on chromosome 12
  Distance between a terminus base of telomere on chromosomal short arm and 5'-terminus of this base sequence : 25311797
  Distance between 3'-terminus of neighbour sequence of sequence listing upward to telomere on chrosomal short arm and 5'-terminus of this base sequence : 3630
ccatccatctgttcctttcatatatatatatccagaagaataaaagaggggctgaaaatgatatatatatatgacttatacatatagcatatataacattatacacacacacacacacacacacacacacacacacacacacagtgcgcacatgaggagggagcccagtgaactgat

SEQ ID NO: 18476 - DNA, 120 bp, Homo sapiens
  DISO7_10003276
  Located on chromosome 12
  Distance between a terminus base of telomere on chromosomal short arm and 5'-terminus of this base sequence : 25644802
  Distance between 3'-terminus of neighbour sequence of sequence listing upward to telomere on chrosomal short arm and 5'-terminus of this base sequence : 332828
aagattctggagagtaaccagctattacacacacacacatacacacacacacacacacacacacacacacacacagatttgaggaaaactcagtggaaaggcaaaggaatctctacatga

SEQ ID NO: 18477 - DNA, 108 bp, Homo sapiens
  DISO7_10003277
  Located on chromosome 12
  Distance between a terminus base of telomere on chromosomal short arm and 5'-terminus of this base sequence : 25646695
  Distance between 3'-terminus of neighbour sequence of sequence listing upward to telomere on chrosomal short arm and 5'-terminus of this base sequence : 1773
ttacaacctgggtgtcaggaaacccggaatctttttatatatatatatatatatatttttttttttttttattatactttaagtcaactgcctcttactatgtaagct

SEQ ID NO: 18478 - DNA, 241 bp, Homo sapiens
  D12S1688
  Located on chromosome 12
  Distance between a terminus base of telomere on chromosomal short arm and 5'-terminus of this base sequence : 25786089
  Distance between 3'-terminus of neighbour sequence of sequence listing upward to telomere on chrosomal short arm and 5'-terminus of this base sequence : 139286
gcacagttaaggatagagatgcctaacttcatgctacacacacacacacacacacacacacacacacacacacacacacactcctatctaaccaattatgtccaaaaggcatatgtatggtgtatctagtgagttgtaatctaccataagaaaatattttcattaaattgtagtcatattttgaatgctgtgagcatgtatatctatctttaagtgaagacaaggtggaacaatcaaaatt

SEQ ID NO: 18479 - DNA, 417 bp, Homo sapiens
  chr12.fa.O7frz.23036341
  Located on chromosome 12
  Distance between a terminus base of telomere on chromosomal short arm and 5'-terminus of this base sequence : 25891368
  Distance between 3'-terminus of neighbour sequence of sequence listing upward to telomere on chrosomal short arm and 5'-terminus of this base sequence : 105038
attagaaggaaagttccaaattatgggaaaaggcctctgaagtggctaaatccgccccgccaccaccaccaccaccctgccacacacacacacacacacacacacacacacacacacacacaaaagtggtgtggtacagggagaaaaacgaacagcaaaaaacagaaaagactttcatttttgactacttaaaaggctttatttacataacaaggccacctttttgctagtcaggccaaccaaaagagcaatggctgtcgtctcacgctgctgttccatagctaagggttctgccatctttttttccaccacaatagcctgggtttgtttcctaaatcaagccctttctggtttgatacttggtacttctaaaataacagcaatttgttccagctgaactacggtcataagatttaa

SEQ ID NO: 18480 - DNA, 156 bp, Homo sapiens
  DISO7_10003280
  Located on chromosome 12
  Distance between a terminus base of telomere on chromosomal short arm and 5'-terminus of this base sequence : 26143011
  Distance between 3'-terminus of neighbour sequence of sequence listing upward to telomere on chrosomal short arm and 5'-terminus of this base sequence : 251226
tgcaatctactccataattgtgaaatttcactacatacacgcatgcacacacatacacacacacacacacacacacacacacacacacaatgtaactggattttcattactctaaaattactggtaatatagaaaagctcacatatcacgcatgct

SEQ ID NO: 18481 - DNA, 425 bp, Homo sapiens
  chr12.fa.O7frz.23259881
  Located on chromosome 12
  Distance between a terminus base of telomere on chromosomal short arm and 5'-terminus of this base sequence : 26175074
  Distance between 3'-terminus of neighbour sequence of sequence listing upward to telomere on chrosomal short arm and 5'-terminus of this base sequence : 31907
ggaccttgaatcactttaagagaaaccacaggctatgtatagatgatggagtcccaaatgactgcgtggagcaaccacactacccttacactgcctggcacgacatttctttcacataagagaaaaacatctattttgcttaagacatgtatttgagtgctatatatatatatatatatatatatatatatatatacacacacacacacacacacacacacacagtgtatatatattatacacaactgtatacataacaactatatatacaactgtgtatatatatacagtatatatataactgtatatatacaactatgtgtatatgtatacatacaactgtgtatatatatatacacaactgtgtgtgtatatatatttaaaactgaatatatatatataactgaatgcaattaacaactgat

SEQ ID NO: 18482 - DNA, 101 bp, Homo sapiens
  DISO7_10003281
  Located on chromosome 12
  Distance between a terminus base of telomere on chromosomal short arm and 5'-terminus of this base sequence : 26188841
  Distance between 3'-terminus of neighbour sequence of sequence listing upward to telomere on chrosomal short arm and 5'-terminus of this base sequence : 13342
ctgacatcagagtcattccggcatttgtgtgtgtgtgtgtgtatgtgtgtgagtgtgtcggtggctgcgcggccacgccttgggatctcctgagtggcagg

SEQ ID NO: 18483 - DNA, 302 bp, Homo sapiens
  AC027624.2_31410
  Located on chromosome 12
  Distance between a terminus base of telomere on chromosomal short arm and 5'-terminus of this base sequence : 26254454
  Distance between 3'-terminus of neighbour sequence of sequence listing upward to telomere on chrosomal short arm and 5'-terminus of this base sequence : 65512
cctcattatcactaatggtctaacactatcataaaagtttactaattggtacagtaggctttattcttttaaagccatcaggattttgcctcactgtactttaaactcttgtggatggttattactggatttcttgacaatctgtcgtctagtggttactggcatcctggtttatcttgccagtttacaattaatagggctacattctgcctgtttttataaacaaacaaacaaacaaacaaacaaaaaacacacacaaaaaaaccacgctagtatttcacttaactctttagcaatcgtca

SEQ ID NO: 18484 - DNA, 440 bp, Homo sapiens
  chr12.fa.O7frz.23545655
  Located on chromosome 12
  Distance between a terminus base of telomere on chromosomal short arm and 5'-terminus of this base sequence : 26455647
  Distance between 3'-terminus of neighbour sequence of sequence listing upward to telomere on chrosomal short arm and 5'-terminus of this base sequence : 200891
tcagaaggccttagagttctacattttttctagggaaacatgtttaagggagtcctacattttttctaggtaaacatgttttagggtttattcaatcaaaaaacctaaatgaataaataaacgttctaacaaaattttacattgaaatgaaagctctcaaatcactctataactagtactctagtaaaatttcactgagtttctaaagatatcagaaaaatgtggtgatatcatagaatattataaaaatcaccaaataagttgaataaattgggcaaggtctcacacacacacacacacacacacacacacacaaaatcaaaagcgatataggattaacattataataaatgtttgcagtctctgattctaataaaggccttcacccccaatttcgtgtctgaaaaaaaaagcacctgaatgagtgctcactagtattt

SEQ ID NO: 18485 - DNA, 214 bp, Homo sapiens
  DISO7_10003284
  Located on chromosome 12
  Distance between a terminus base of telomere on chromosomal short arm and 5'-terminus of this base sequence : 26461521
  Distance between 3'-terminus of neighbour sequence of sequence listing upward to telomere on chrosomal short arm and 5'-terminus of this base sequence : 5434
ccaggtataaggcagcttgagtatttatatatataacatatacttagatatcatatagagtatttatatgaatatacttaagctgccttatatataaaatatgtaatatataaacaatttacatatttatgtagaaagataaataatgcataatacaaatatatatatatatatatatatatatatattttcctagattcccagtctaatgtct

SEQ ID NO: 18486 - DNA, 165 bp, Homo sapiens
  DISO7_10003285
  Located on chromosome 12
  Distance between a terminus base of telomere on chromosomal short arm and 5'-terminus of this base sequence : 26483160
  Distance between 3'-terminus of neighbour sequence of sequence listing upward to telomere on chrosomal short arm and 5'-terminus of this base sequence : 21425
cagatatactcatgctttaacgggtctaatgtgtacacacacacacacacacacacacacacacacacacacacacacacactcttaaaaattacctttaaaccagagtggcaaattatctttctgtactgacttatactagaaaagatagccctgcattggtag

SEQ ID NO: 18487 - DNA, 475 bp, Homo sapiens
  chr12.fa.O7frz.23701542
  Located on chromosome 12
  Distance between a terminus base of telomere on chromosomal short arm and 5'-terminus of this base sequence : 26606415
  Distance between 3'-terminus of neighbour sequence of sequence listing upward to telomere on chrosomal short arm and 5'-terminus of this base sequence : 123090
ctagaatagcaagtatgcaattactattttctgattaaatgaaggaatgagtgcaaactgtggcctctgcttctctgtttccctttatcttcactcttagaaaacaaaaatgagaaactcactgatttcaccaaaatctcttttatacaaaacatttgtaaagataatagactttaactaccatatagtacacacacacacacacatacacacacacagggtcatacatacacatattggaatggggagagagagtgggaagctttaaatcaaagaagcaatttaaatgataacaattaacattagaaaatttcattcttaaaatgttcttcagtagctccaccatagtaaaattttcactggccacttcctcttagaattccctcttgctgattcttctctcctcctctgttttcagcattctcatccatgttttctttccttcaagtttcttactaacaggaattgtagcact

SEQ ID NO: 18488 - DNA, 476 bp, Homo sapiens
  chr12.fa.O7frz.16737018
  Located on chromosome 12
  Distance between a terminus base of telomere on chromosomal short arm and 5'-terminus of this base sequence : 26730819
  Distance between 3'-terminus of neighbour sequence of sequence listing upward to telomere on chrosomal short arm and 5'-terminus of this base sequence : 123929
aagaaagcatctcaaaggttagagttttaggggactcaagccaaatcaacaagacttgacttgtaatacagtattagaagcttacttttgccatattgtattggtcaaaaatgagtcacagggccaacctgggttcaaggagagggggactacacaaaggagtaaatactgggattcagattttttctggggtgtagagaatccttgaagaccatctcaactagaatatatagcttttccttgtcttctttgctctcctgcagcttctttcttcttgccttgaatttatggtataggaattactagattcaccagcatgcttgatatacatatatacacatatatatgtgttatagatatcatataggtgtgtgtatatgtgtgtgtgtgtgtgtgtgtgtgtgtgtgtgtgtatatatatatatatatatatatatatatatatatatatataaccttaatcagaattcttggat

SEQ ID NO: 18489 - DNA, 102 bp, Homo sapiens
  DISO7_10003239
  Located on chromosome 12
  Distance between a terminus base of telomere on chromosomal short arm and 5'-terminus of this base sequence : 26744075
  Distance between 3'-terminus of neighbour sequence of sequence listing upward to telomere on chrosomal short arm and 5'-terminus of this base sequence : 12780
acaccagtgaagcacagatcaaactttgtgtgtgtgtgtgtgtgtgtgtgtctgtggtttttttgttttttttttttcttagtacagccctccaactctcag

SEQ ID NO: 18490 - DNA, 271 bp, Homo sapiens
  chr12.fa.O7frz.16593920
  Located on chromosome 12
  Distance between a terminus base of telomere on chromosomal short arm and 5'-terminus of this base sequence : 26755152
  Distance between 3'-terminus of neighbour sequence of sequence listing upward to telomere on chrosomal short arm and 5'-terminus of this base sequence : 10975
gcattgctttatacatttcctaacatagaagtatatgtaaataaactacacatttctaagcatagtgatgctgggtgaggagtaggctgggtcaatctgaaataaataaataaataaataaataaataataaataaataaataaataagccagagcatcctccaaagtcttactctgagtgattttcttctgtcctgtgtttaccttccctcaatatccaatttacaatgtctcacttgttgtggaggcctcatgcgtatatcctgaatta

SEQ ID NO: 18491 - DNA, 136 bp, Homo sapiens
  DISO7_10003241
  Located on chromosome 12
  Distance between a terminus base of telomere on chromosomal short arm and 5'-terminus of this base sequence : 26762250
  Distance between 3'-terminus of neighbour sequence of sequence listing upward to telomere on chrosomal short arm and 5'-terminus of this base sequence : 6827
ttgcagatttaagaagttagaaggggaatgtgtgtgtgtgtgtgtgcatgtgtttgtgtgtgtgtgtgcacatattcctatagaagtataagtttgttacaatgtaagtgggttttccaagaattcaaagaatgca

SEQ ID NO: 18492 - DNA, 271 bp, Homo sapiens
  D12S1606
  Located on chromosome 12
  Distance between a terminus base of telomere on chromosomal short arm and 5'-terminus of this base sequence : 26876592
  Distance between 3'-terminus of neighbour sequence of sequence listing upward to telomere on chrosomal short arm and 5'-terminus of this base sequence : 114206
atgagaggccaaattaaagcaataaaaattaccaaatgggaattctctagtttaaatatacaacattgagaattaaaaattcactgaatggacttaagagtgcattgactactacagaagaaaagaacaatgaactcgaacacatatattagaaactatcctgttgaagcatagagaaacagagaaagggtaggtgcatgcacacacacacacacacacacacacacacacacaaaatgaacagaaatcagtgaccctgacacaacagtag

SEQ ID NO: 18493 - DNA, 148 bp, Homo sapiens
  DISO7_10003289
  Located on chromosome 12
  Distance between a terminus base of telomere on chromosomal short arm and 5'-terminus of this base sequence : 27132235
  Distance between 3'-terminus of neighbour sequence of sequence listing upward to telomere on chrosomal short arm and 5'-terminus of this base sequence : 255372
gccaattattcctgaggaatacgtgtgtgtgtgtgtgtgtgtgtgtgtgtgtgtgtctgtgtgtgtgtgtgtgtgtgtaggttctaaagatgatagaacagaatgacaaataatgtgatatttgatctggttgaatttattgttattg

SEQ ID NO: 18494 - DNA, 102 bp, Homo sapiens
  DISO7_10003290
  Located on chromosome 12
  Distance between a terminus base of telomere on chromosomal short arm and 5'-terminus of this base sequence : 27160929
  Distance between 3'-terminus of neighbour sequence of sequence listing upward to telomere on chrosomal short arm and 5'-terminus of this base sequence : 28546
agcaatcaaccatccaggtttattcaagacttggcttttattatcattattattattattattattattattattattttgagaatgcaaacattcaatgct

SEQ ID NO: 18495 - DNA, 467 bp, Homo sapiens
  chr12.fa.O7frz.24101967
  Located on chromosome 12
  Distance between a terminus base of telomere on chromosomal short arm and 5'-terminus of this base sequence : 27302325
  Distance between 3'-terminus of neighbour sequence of sequence listing upward to telomere on chrosomal short arm and 5'-terminus of this base sequence : 141294
atagtcctggagtaagatccaaaagggaacaaattaaataattgctgaagagacaagcgtatgagtatttagaaaaattttattgtaacagctgagaaatttttaaaatctgtcaatgctcttaattctgtatcatccagtctttggcaagatagaccatggcggggggggtgcatatatatatatatatatatatatatatatacacatacttggcttgggactaaaaaaaccaaggcattgagaaaagaaaaagtaactcatgacaatatgtcaggcattagtgcaaacagttcacaaacagtaagttcaaggacctgtaactcaacaagcaacaatatgcatgttcttgaatgcagattttgaacagaccagatttctttttgtgttttcacatttacagaacacaactccagtgtgccgttttcagaggttcactgtgagtcctctaaaggtttctttatcat

SEQ ID NO: 18496 - DNA, 276 bp, Homo sapiens
  AC022359.3_108185
  Located on chromosome 12
  Distance between a terminus base of telomere on chromosomal short arm and 5'-terminus of this base sequence : 27354812
  Distance between 3'-terminus of neighbour sequence of sequence listing upward to telomere on chrosomal short arm and 5'-terminus of this base sequence : 52020
ctagtttccagtagcattcaatacaggcaatctgtagtattcattccttgtatttgaagtatagtaagtatttattaattatatactatgttttaggggctgaaaatgtaacagggaacaagagaagcatgctttgatgtggatatatggatggatgaatgaatatggatggatggatggatgaatgtacagatagatggatggatggatggatggatggatggatggatggatggatgggtggatggatgccagtatgatctcaatcctaggctt

SEQ ID NO: 18497 - DNA, 200 bp, Homo sapiens
  DISO7_10003291
  Located on chromosome 12
  Distance between a terminus base of telomere on chromosomal short arm and 5'-terminus of this base sequence : 27428037
  Distance between 3'-terminus of neighbour sequence of sequence listing upward to telomere on chrosomal short arm and 5'-terminus of this base sequence : 72949
tattcacctgtttggctctcttttctgaagaataatggtgttaaatacatacatccccgagagagagagagagagagagagagagagagagagagagagagagagagagagagaggtcagtttctcactgtttgtaagttacatgaaaatttactagcaaaagctcaaaagagtagaagttagtactctgtctagggagc

SEQ ID NO: 18498 - DNA, 184 bp, Homo sapiens
  DISD22_0008174
  Located on chromosome 12
  Distance between a terminus base of telomere on chromosomal short arm and 5'-terminus of this base sequence : 27560058
  Distance between 3'-terminus of neighbour sequence of sequence listing upward to telomere on chrosomal short arm and 5'-terminus of this base sequence : 131821
acgatatctgtacctttcttatggaatttattatttcctgatatttaacattttctctatttacctatcattgttttatatatatatatatatatatatatatatatatatatatatatatatatatattcctttaaaaaatcttcaacataaaaatgtaactttctatgtgacaaggttggca

SEQ ID NO: 18499 - DNA, 268 bp, Homo sapiens
  D12S1591
  Located on chromosome 12
  Distance between a terminus base of telomere on chromosomal short arm and 5'-terminus of this base sequence : 27695857
  Distance between 3'-terminus of neighbour sequence of sequence listing upward to telomere on chrosomal short arm and 5'-terminus of this base sequence : 135615
gcgctttgtactatgttacatttccaaaagaatcaatgaagatactggcaaatataaatcttaacctagaagaggaaattattttatttacagaggagataagtattacacacacacacacacacacacacacacacacacacacaaactcattcatttgataggtatgctttagaccctgaacactcaactttcatattatctcaacctaaaacctcaaatatccccaaatgttactcaagcataccttgattcacccaacgtcttc

SEQ ID NO: 18500 - DNA, 409 bp, Homo sapiens
  AC026134.2_108079
  Located on chromosome 12
  Distance between a terminus base of telomere on chromosomal short arm and 5'-terminus of this base sequence : 27775279
  Distance between 3'-terminus of neighbour sequence of sequence listing upward to telomere on chrosomal short arm and 5'-terminus of this base sequence : 79154
cttgagtccaggaatactgagaccagcctaggcaacataaagaaactccctccctatgaaatgtatgtatgtatgtatgtatgtatgtatgtatgtatgtatgtatgtatgcatgtatgcatgtatgtgtgtatgtttgtatgtatacataaataaataaatagctgggtgtggtggcgtgtgtctgtagtcccagctactttggaggctgagatgggagaatcatttgagctcaggaggtcgaggctgcaatgagccatgatcacaccactggcaccactgcactccagcctgggcaacagagcaagaccttgtctccaaaaacaaaataaaacaaaaacaaaaacaagaaaaaggaatgtttctataaaggtgtatcatgagagggaaatctgatgtgaatgagtga

SEQ ID NO: 18501 - DNA, 429 bp, Homo sapiens
  chr12.fa.O7frz.24526728
  Located on chromosome 12
  Distance between a terminus base of telomere on chromosomal short arm and 5'-terminus of this base sequence : 27908539
  Distance between 3'-terminus of neighbour sequence of sequence listing upward to telomere on chrosomal short arm and 5'-terminus of this base sequence : 132851
aatacttccaaatgaagaccagatatagtaaaacaagttgatgccaggcacagtggctcatgcctgtgatcccagcattttgggaggccaaggcagatggatcattgtttgagcacaggagtttgagaccagcctgggcaacatggcaaaaccctgtctctacaaaaaatacaaaaattagccaggcatggtggcgcatgcctgtagtcccagctactgaggaggctcaggtgggaggattgcttgagcccaggaggtgggttcagctgtgagctgagactgccccactgcattccagcctgggtaatagagctagaccctatctcaataataataataatgataataataataataataataataccaattggttatctagtttacctcattatcttattaatgctatcaggtcactactgcaatact

SEQ ID NO: 18502 - DNA, 435 bp, Homo sapiens
  chr12.fa.O7frz.33560146
  Located on chromosome 12
  Distance between a terminus base of telomere on chromosomal short arm and 5'-terminus of this base sequence : 28088939
  Distance between 3'-terminus of neighbour sequence of sequence listing upward to telomere on chrosomal short arm and 5'-terminus of this base sequence : 179971
gagaccatttcagtgttacattagcttcagtgtccttttttcataatgacccatcacctattgaaaatatgttgaggctgggtatggtggttcacgcctgtaatcccagcactctgggaggccaaggcaagcagatcacatgaagccagttcaagaccagcctggccaacatggcgaaaccctgttttgactaaaaatacaaaaattagctgggcagaggttgcagtgagccgatatcacacgactgcactccagcctgggtgacagagcgagactgtctcaaaaaacaaacaaacaaacaaacaaacagaattgctgtatgggtatgcgaaatacactttctactgaatgtgtatcactttcataccatcacagtcaagaaatcctaagtcaaaccactgccaagtcagggactatctgtacatttcattcctg

SEQ ID NO: 18503 - DNA, 152 bp, Homo sapiens
  DISO7_10000216
  Located on chromosome 12
  Distance between a terminus base of telomere on chromosomal short arm and 5'-terminus of this base sequence : 28234541
  Distance between 3'-terminus of neighbour sequence of sequence listing upward to telomere on chrosomal short arm and 5'-terminus of this base sequence : 145167
caaatacctaatgtaacaggtcatctttaaaataaattgtttcctgccagcagaggtgtgctaaatcatcatcatcatcatcatcatcatcatcataatttatgagagatttggggctttcccaccttcttctttaattcaagattgctgtc

SEQ ID NO: 18504 - DNA, 191 bp, Homo sapiens
  D12S1621
  Located on chromosome 12
  Distance between a terminus base of telomere on chromosomal short arm and 5'-terminus of this base sequence : 28289180
  Distance between 3'-terminus of neighbour sequence of sequence listing upward to telomere on chrosomal short arm and 5'-terminus of this base sequence : 54487
agctctctacaccaatgtagcatatattctttcttatttttctctgttcttgtacacacacacacacacacacacacacacacacacatttaaaggcttgtgtgggggaggggtcattgtttcctaaaacggcaccacagtacacttacttttatacactgtctttcattcagtatcttatgaaatccctt

SEQ ID NO: 18505 - DNA, 169 bp, Homo sapiens
  D12S1584
  Located on chromosome 12
  Distance between a terminus base of telomere on chromosomal short arm and 5'-terminus of this base sequence : 28667158
  Distance between 3'-terminus of neighbour sequence of sequence listing upward to telomere on chrosomal short arm and 5'-terminus of this base sequence : 377787
cgtagaatatgcacctaattttaatatatatatatctgttttaccatgttgccttttaatctcttaatttaataacaataataaaagtattgcttgaattacacacacacacacacacacacacacacacacagtttttaagagagaggttctcactatgtttccctgg

SEQ ID NO: 18506 - DNA, 174 bp, Homo sapiens
  DISD22_0008187
  Located on chromosome 12
  Distance between a terminus base of telomere on chromosomal short arm and 5'-terminus of this base sequence : 28979413
  Distance between 3'-terminus of neighbour sequence of sequence listing upward to telomere on chrosomal short arm and 5'-terminus of this base sequence : 312086
acaatccctctgcatatgtgatataataaataaataaatatatatatatatatatatatatatatatatatatatatatatatatacacatatacatacacacacacacacacacacatatatacacacatatatatatttggtatttgtccccagagtctattattcctcaca

SEQ ID NO: 18507 - DNA, 277 bp, Homo sapiens
  AC021737.3_71497
  Located on chromosome 12
  Distance between a terminus base of telomere on chromosomal short arm and 5'-terminus of this base sequence : 29075839
  Distance between 3'-terminus of neighbour sequence of sequence listing upward to telomere on chrosomal short arm and 5'-terminus of this base sequence : 96252
gttatgcatcattggaaatagtatcttcaatttaattacactctgaagcaggtgtggttttttgttgttttgggtttgggttctatcttgttgttttttgttgttgttgttgttgttgttgttgttcttggaccaaatacaatatctaagtggctttagggactcctctctaatctaagttatattgttacaatcccagcagaatgctaaaaggacaggagtttacagcttgtgaggccgtggttcctaattccagatggacaaaggagtatttgtt

SEQ ID NO: 18508 - DNA, 146 bp, Homo sapiens
  D12S1640
  Located on chromosome 12
  Distance between a terminus base of telomere on chromosomal short arm and 5'-terminus of this base sequence : 29178687
  Distance between 3'-terminus of neighbour sequence of sequence listing upward to telomere on chrosomal short arm and 5'-terminus of this base sequence : 102571
gggggctacctctaagtcaaataagagggcatctgctctagagatgggatgtcccacaccatgggcagatgcagatgtgtatacacacacacacacacacacacacacacacatatatcatattctcaaccaggaatgaacattgc

SEQ ID NO: 18509 - DNA, 125 bp, Homo sapiens
  D12S1042
  Located on chromosome 12
  Distance between a terminus base of telomere on chromosomal short arm and 5'-terminus of this base sequence : 29239702
  Distance between 3'-terminus of neighbour sequence of sequence listing upward to telomere on chrosomal short arm and 5'-terminus of this base sequence : 60869
tatgacggtgcaccacatactagtctctttcttttttatttaatttaatttattattattattattattattattattattattatactttaagttctgggttacatatgcagaacatgcaggtt

SEQ ID NO: 18510 - DNA, 331 bp, Homo sapiens
  AC009509.7_25690
  Located on chromosome 12
  Distance between a terminus base of telomere on chromosomal short arm and 5'-terminus of this base sequence : 29356921
  Distance between 3'-terminus of neighbour sequence of sequence listing upward to telomere on chrosomal short arm and 5'-terminus of this base sequence : 117094
taaactgaaccagtttccataaagtagttgaattttatttctttttcccagatccgacccaccagagggccatggtattggttctgcagtcaacactgtgctctctctctctctctctctctctctctctctcatttgtttcatgagtcattaggccaaaaaatgttaggtaaatgaaagcaaatatgacagcagtaccttgaacaaggggaccacgtctttccccctcaagtccatgacgtgtaacatgtctaatattctagttctgaggattttaaatgtaattcgttgatctgtagtgtgctttcactggacaccttgctttagttaa

SEQ ID NO: 18511 - DNA, 353 bp, Homo sapiens
  AC009511.16_38593
  Located on chromosome 12
  Distance between a terminus base of telomere on chromosomal short arm and 5'-terminus of this base sequence : 29545502
  Distance between 3'-terminus of neighbour sequence of sequence listing upward to telomere on chrosomal short arm and 5'-terminus of this base sequence : 188250
ttagattcttggaccaagtgagggtgtactctgatccacaaagctcttttataaaccaggtttgaggttgtgtgtgtgtgtgggggtgtgtgtgtgtgtgtgtgtgtatgtttgcatattatagctctctttaagacagacatctaaaaagattttggttattctgggctgccagcagtacgtgggaaaggtggaatgtgcaataggaacagatctgtgcattttgtgacatcgtccttcctgctgtgcacatcagctgtgatgacattttgagggtagttttaatttagctcggttctcttgttggtgccagtattacattgaagactacctatgatagaggcaatgttgct

SEQ ID NO: 18512 - DNA, 190 bp, Homo sapiens
  AC008011.11_69101
  Located on chromosome 12
  Distance between a terminus base of telomere on chromosomal short arm and 5'-terminus of this base sequence : 29672115
  Distance between 3'-terminus of neighbour sequence of sequence listing upward to telomere on chrosomal short arm and 5'-terminus of this base sequence : 126260
aggcatttaaaggattaaggaggatgtgtgtgtgtgtgtgtgtgtgtgtgtgtgcgcgcgtgcgcgcgcatgtgcgtgtgcatgtctgttgtgtttgtagcagctggtgtattagctaagctttacctccttttccataaatggaacttttgcctttcatctcttttcagtgttgcttaccaggaagata

SEQ ID NO: 18513 - DNA, 344 bp, Homo sapiens
  chr4.fa.O7frz.39050849
  Located on chromosome 12
  Distance between a terminus base of telomere on chromosomal short arm and 5'-terminus of this base sequence : 29707354
  Distance between 3'-terminus of neighbour sequence of sequence listing upward to telomere on chrosomal short arm and 5'-terminus of this base sequence : 35049
atttcaattccaaggactactcaggtcttttagccgtggaatgccttggctttctattttataaaatgggattaatatttgccccactttttgcctcatagaaacatacccccctagatagatagatagatagatagatagatagaaatagattatagataggtagatggtacaatcagaactagttccaaaaacaccaaaataatatgttgcaatttattgagtgtttactatatgacagatatttagtccacatataatctcatttagttgacaccaaactctatgaggttggtacaattatatttcacagaagatgtaagtgagtcttagaaaggcagagt

SEQ ID NO: 18514 - DNA, 249 bp, Homo sapiens
  HUMUT7594
  Located on chromosome 12
  Distance between a terminus base of telomere on chromosomal short arm and 5'-terminus of this base sequence : 29707360
  Distance between 3'-terminus of neighbour sequence of sequence listing upward to telomere on chrosomal short arm and 5'-terminus of this base sequence : -338
attccaaggactactcaggtcttttagccgtggaatgccttggctttctattttataaaatgggattaatatttgccccactttttgcctcatagaaacatacccccctagatagatagatagatagatagatagatagaaatagattatagataggtagatggtacaatcagaactagttccaaaaacaccaaaataatatgttgcaatttattgagtgtttactatatgacagatatttagtccaca

SEQ ID NO: 18515 - DNA, 280 bp, Homo sapiens
  AC008011.11_31766
  Located on chromosome 12
  Distance between a terminus base of telomere on chromosomal short arm and 5'-terminus of this base sequence : 29709363
  Distance between 3'-terminus of neighbour sequence of sequence listing upward to telomere on chrosomal short arm and 5'-terminus of this base sequence : 1754
gacagaaaccacggagtatctcttcacatttttcagagttctgctgagaaaataaatctagaagtcccagcctgggaaataaaaggcagctgcttttacctgagtattctctctctctctctctctctctctctctctctcctctctctctctcacacacacacacacacgccccattaagaaaataataatattgaaacagcaagccgtaagagtaaaaacaaacaaaggctgaaggagaagtgagcagtgtagcctgtctaggaaaccatctgattca

SEQ ID NO: 18516 - DNA, 198 bp, Homo sapiens
  AC008011.11_31538
  Located on chromosome 12
  Distance between a terminus base of telomere on chromosomal short arm and 5'-terminus of this base sequence : 29709622
  Distance between 3'-terminus of neighbour sequence of sequence listing upward to telomere on chrosomal short arm and 5'-terminus of this base sequence : -21
tctaggaaaccatctgattcacagactgaactttaacattttagactactggctaccaagaacatacatttgaaggccaatcgtcagagagagagagagagagagagagaaagagagggagagtatgtgtatttttctgtaaagtagtgggtggtctccttaaaatgggtttctttgtgtgcttaaatgagctcattc

SEQ ID NO: 18517 - DNA, 400 bp, Homo sapiens
  chr12.fa.O7frz.28810017
  Located on chromosome 12
  Distance between a terminus base of telomere on chromosomal short arm and 5'-terminus of this base sequence : 29995972
  Distance between 3'-terminus of neighbour sequence of sequence listing upward to telomere on chrosomal short arm and 5'-terminus of this base sequence : 286152
ttactatgtgctaggaactgctcagttcaattgctggagggtaaaaaaaagatgaataaagaaaggatccccacactacctccagatttcttatataaacttaggtagacagttacattttcttgacccaataagcctgaaattctgttcttacatattttgactcttctaattagctcagtcttaattgctttctatttttaactttaaggtttgagtgtgtgtgtgtgtgtgtgtgtgtgtgtgtgtgtgtatttcctttgttctgttttctctaatttctgtttgcccagaagagtcagaaaaaaaaccacttgtctctgttgcttctaggaaacatggcattaaacaggatcaaatggaaaagtattattgcgactgtgaggatgttagcaagtag

SEQ ID NO: 18518 - DNA, 446 bp, Homo sapiens
  AC022079.16_66370
  Located on chromosome 12
  Distance between a terminus base of telomere on chromosomal short arm and 5'-terminus of this base sequence : 30043643
  Distance between 3'-terminus of neighbour sequence of sequence listing upward to telomere on chrosomal short arm and 5'-terminus of this base sequence : 47271
gtctttactttgaagctggatcttttcctatcctattaactcagagcatgctttgattgggggttaacgtgactcctgggggttgattatttcaattaggtaggatattgaaacaaaagtctttagaagtatatttttaagcaggtatagttatttttttattttttctttgttgtatttaaaaataacacacctgaatctgctatttaagaactagagtgttaaccaatttcataatttttcttctatcctatccctttgcctttgtccctagaggaaccactgtcctccattttatgttagcatttccttgattttgtaaaaaaaaaacaacaacaacaacaacaaaaaattgtgtgtgcttgtgtgcacatatatatatatataagagctttgcttgtttatgtgctttataaaaatgggttcatactgtttgaaatcttcag

SEQ ID NO: 18519 - DNA, 106 bp, Homo sapiens
  DISO7_10003331
  Located on chromosome 12
  Distance between a terminus base of telomere on chromosomal short arm and 5'-terminus of this base sequence : 30219156
  Distance between 3'-terminus of neighbour sequence of sequence listing upward to telomere on chrosomal short arm and 5'-terminus of this base sequence : 175067
ctaacaaatgatccactcggaaatttaattttagttgtagtgtgcatgtgtgtttgtgtgtgtgtgtgtgtgtgtgcacgtgtgtaagaaatctgttgtcttgaag

SEQ ID NO: 18520 - DNA, 177 bp, Homo sapiens
  DISO7_10003332
  Located on chromosome 12
  Distance between a terminus base of telomere on chromosomal short arm and 5'-terminus of this base sequence : 30237068
  Distance between 3'-terminus of neighbour sequence of sequence listing upward to telomere on chrosomal short arm and 5'-terminus of this base sequence : 17806
cttcagccatccttagaagtcaaaaattttgtgtgtgtgtgtgtgtgtgtgtgtgtgtgtgtgtgaaggtgtaggtgtatgtatgtgtgtatatatcaaaatgtgtgtgtgcgtgtatgaaggtgttggggtgtgtgtgtgtgtgtgtgtctgtttgaaggacctctatttgtgagc

SEQ ID NO: 18521 - DNA, 139 bp, Homo sapiens
  DISO7_10003335
  Located on chromosome 12
  Distance between a terminus base of telomere on chromosomal short arm and 5'-terminus of this base sequence : 30344338
  Distance between 3'-terminus of neighbour sequence of sequence listing upward to telomere on chrosomal short arm and 5'-terminus of this base sequence : 107093
tccttacttgtccaggccccttccaaggcctggaaatacacacacacacacacacacacacacacacacacacacacacacacacaaactgtcatttgaattatgttcctttaagactctcatagagtgaatacccttc

SEQ ID NO: 18522 - DNA, 428 bp, Homo sapiens
  AC053493.4_104583
  Located on chromosome 12
  Distance between a terminus base of telomere on chromosomal short arm and 5'-terminus of this base sequence : 30418029
  Distance between 3'-terminus of neighbour sequence of sequence listing upward to telomere on chrosomal short arm and 5'-terminus of this base sequence : 73552
aactcacattcacaattgctacaaagagaataaaatacctaggaatacagctaacaagggatgtgaaggacatcttcaaggagaacaacaaaccacagctcaaggaaataagagaggacacaaacacatgaaaaaacattccatcctcatgtacattacatgtaccctaaaacttaaagtataataataataataataataataatactaaaagaaaaaaagttttagggtacatgtgcacaacgtgcaggtttgttacatatgtatacatgtgccatgttggtatgctgcacccattaactcgtcatttaacgtcaggtatatctcctaatgctatccctccctgctcccctcaccccacaacaggccccagtgtgtgatgttccccttcctgtgtccaagtgttctcattgttcagttctcaccta

SEQ ID NO: 18523 - DNA, 235 bp, Homo sapiens
  chr12.fa.O7frz.29464240
  Located on chromosome 12
  Distance between a terminus base of telomere on chromosomal short arm and 5'-terminus of this base sequence : 30496930
  Distance between 3'-terminus of neighbour sequence of sequence listing upward to telomere on chrosomal short arm and 5'-terminus of this base sequence : 78473
cataaagtcctcatgaacctaacaggctaataaaatgttctttttggattattctctttgtcgtcccctgaccatcaccaccacctccaacatcaccaccaccacaacacacacacacacacacacacacacacttcccttcccttcttttcttctccattcaccttgaactttgtatcatctcttggtgatgctcaacttaactccttttctttcttgaaataagcttgaaata

SEQ ID NO: 18524 - DNA, 191 bp, Homo sapiens
  G08959
  Located on chromosome 12
  Distance between a terminus base of telomere on chromosomal short arm and 5'-terminus of this base sequence : 30592802
  Distance between 3'-terminus of neighbour sequence of sequence listing upward to telomere on chrosomal short arm and 5'-terminus of this base sequence : 95637
acccttgaactactctattgtctgtctgtgtatctatctatctatctatctatctatctatctatctatctatctatctatctacctacctacctatctatctacctacctacctacctacctacctgtctacctatttatttcttcatacattcttttatttagaaagcaaagaattcaactagaatgtt

SEQ ID NO: 18525 - DNA, 432 bp, Homo sapiens
  AC012150.16_204492
  Located on chromosome 12
  Distance between a terminus base of telomere on chromosomal short arm and 5'-terminus of this base sequence : 30767256
  Distance between 3'-terminus of neighbour sequence of sequence listing upward to telomere on chrosomal short arm and 5'-terminus of this base sequence : 174263
agattcatgatatcttcaacgtactctcaaaagattctgagaatatgcaaatatttataaagagaaatagagtgtatgtgaaaaatactaacaattggtgattctagataaagagtatatgggtactcattgccttattcttgcaattgtatgtagtttaaaatttttcaaaataaaacatggaaaaataagttgaaagaataacagaactaaaaagtaaacctaaaaaatatatacaagactcagattaaatatatcagcattattactggtaaaactggattggaaaccatgaaggttaaaagatagataaatagatagatagatagatagatagatagatagatagatagatagatagttagatagatagatatgcattttgcttcctacttcatctggaggtgatttactaaagacagagtcacaggc

SEQ ID NO: 18526 - DNA, 318 bp, Homo sapiens
  AC012150.16_158903
  Located on chromosome 12
  Distance between a terminus base of telomere on chromosomal short arm and 5'-terminus of this base sequence : 30813043
  Distance between 3'-terminus of neighbour sequence of sequence listing upward to telomere on chrosomal short arm and 5'-terminus of this base sequence : 45355
tcctatgctgtcttgctagaagactattttcctgctttatctcattatttcttccattgtttcaccttttgattctttcattctaccaccagcaaggatacctactgtaatgtgttggtatatgtacagggatatgtgggtgtgtgtgtgtgtgtgtgtgtgtatttctttgaaaacctatgtcatcgttttgggtatcatgtgatttttaaatttacataagtggtgctaagctgcatatcattctattttttttcactgaacactctgataataagatctatctgtgtttttgtaggtactgtaattcattgcctc

SEQ ID NO: 18527 - DNA, 116 bp, Homo sapiens
  D12S1704
  Located on chromosome 12
  Distance between a terminus base of telomere on chromosomal short arm and 5'-terminus of this base sequence : 30813129
  Distance between 3'-terminus of neighbour sequence of sequence listing upward to telomere on chrosomal short arm and 5'-terminus of this base sequence : -232
caccagcaaggatacctactgtaatgtgttggtatatgtacagggatatgtgggtgtgtgtgtgtgtgtgtgtgtgtatttctttgaaaacctatgtcatcgttttgggtatcatg

SEQ ID NO: 18528 - DNA, 455 bp, Homo sapiens
  AC012150.16_151430
  Located on chromosome 12
  Distance between a terminus base of telomere on chromosomal short arm and 5'-terminus of this base sequence : 30820438
  Distance between 3'-terminus of neighbour sequence of sequence listing upward to telomere on chrosomal short arm and 5'-terminus of this base sequence : 7193
aagtttatgtcaccagtagcctaaaaattcctttgattagagtgttgagctctttgggtataaagaggctttgagaatggtgagaggggggtgtccttagggagacccaggataatgactcggaatgcaggaaaaatgcagtagaaagtcaaatcatgctgtgagaagtaggggaagagtaggtgaggagtgtgtgtgtgtgtgtgtgtgtgtgtgagagagagagagagagagagagagaaagaagagattcacaatgtggtgttctagctaagggagacctctggaggtgaagtggggtgaaagagggaggggaaacggttatagtcaaactgcaacacagagctgatgatttaaatactttgctgtcatcctcaaccattcctaactacaatatgtatgtatgtatgtatgtatgtacatgtgtatgtatgtattagcatgtttctggcatc

SEQ ID NO: 18529 - DNA, 362 bp, Homo sapiens
  AC012150.16_145172
  Located on chromosome 12
  Distance between a terminus base of telomere on chromosomal short arm and 5'-terminus of this base sequence : 30826836
  Distance between 3'-terminus of neighbour sequence of sequence listing upward to telomere on chrosomal short arm and 5'-terminus of this base sequence : 5943
ggattcaacctaggtacctgtcaacagttgactggataaagaaaatgtgattgataggtgtgtgtgtgtgtgtgtgtgtgtgtgtgtgtgtgtgtgtgtgtactatggaatactatgcagtcataaggaaaaacaaaatcatgtcctttgcagcaacatggatgcagctgaaggccattatcctaaacaaattaatgcaggaacagcaaaccaaatactgcatgttttcatttataagtgggagctaaattttgggtacaaatggacataaagttgggaacaatagacacaggggactgtcagagttggggaaagagcagggcaaggttgaaaactacctattaggtactatgctcactgcc

SEQ ID NO: 18530 - DNA, 327 bp, Homo sapiens
  AC012150.16_135841
  Located on chromosome 12
  Distance between a terminus base of telomere on chromosomal short arm and 5'-terminus of this base sequence : 30836126
  Distance between 3'-terminus of neighbour sequence of sequence listing upward to telomere on chrosomal short arm and 5'-terminus of this base sequence : 8928
aacaggagtgagactcgaaagaaagaaagaaagaaagaaagaaagaaagaaagaaagaaagaaagaaagaaagaaagaaagaaagaaagaaagagagagagagagagagagagagagagagagagagagagagagagagagaaagaaagaaagaaagaaagaaagaaagaaagaaagaaagaaagaaagggaaaggaaaggaaaggaaaggaaagaaagaaagaaaggaaaggaagacctacagcacacacaaaaaggggttcaaaatggattaataacttaaatgtaagagcttaaactataaaactccttgacaaagcatagagg

SEQ ID NO: 18531 - DNA, 174 bp, Homo sapiens
  AC012150.16_69728
  Located on chromosome 12
  Distance between a terminus base of telomere on chromosomal short arm and 5'-terminus of this base sequence : 30902311
  Distance between 3'-terminus of neighbour sequence of sequence listing upward to telomere on chrosomal short arm and 5'-terminus of this base sequence : 65858
atcaacaccagtattaaagcaaagaacattttatatatatatatatatatatatatatatatatatatatgtatcaatgtgattaaacaatgcaattaaacaatgaaaattgattaaacaatgtggttaaacaatgaaaaaaaagccttactgtaattgccagacactaagaat

SEQ ID NO: 18532 - DNA, 142 bp, Homo sapiens
  D12S1643
  Located on chromosome 12
  Distance between a terminus base of telomere on chromosomal short arm and 5'-terminus of this base sequence : 30939703
  Distance between 3'-terminus of neighbour sequence of sequence listing upward to telomere on chrosomal short arm and 5'-terminus of this base sequence : 37218
agttggaacagacctccatccaaaatttgatttaggtttccaggctagtgatgccacacacacacacacacacacacacacacacacacacaccacaggagggtatgaagaggtttattactcccataatgatgctttctgg

SEQ ID NO: 18533 - DNA, 234 bp, Homo sapiens
  AC012150.16_17154
  Located on chromosome 12
  Distance between a terminus base of telomere on chromosomal short arm and 5'-terminus of this base sequence : 30954864
  Distance between 3'-terminus of neighbour sequence of sequence listing upward to telomere on chrosomal short arm and 5'-terminus of this base sequence : 15019
ttccttgccactagtttgtaagaatatgtcaactcttttctgctacaaagaaggatgtctgctctgtgtgtgtgtgtgtgtgtgtgtgtgtctgtgtgtgtaaaagaaagaataaaagaatgcgtaaaagaaagaatagtgaactaaaaagcagatgagctgattttaatttcagccctgcctcacaatactcatttacatacactaattttgtgactttggcaattcatttaa

SEQ ID NO: 18534 - DNA, 360 bp, Homo sapiens
  AC009318.11_10404
  Located on chromosome 12
  Distance between a terminus base of telomere on chromosomal short arm and 5'-terminus of this base sequence : 30977976
  Distance between 3'-terminus of neighbour sequence of sequence listing upward to telomere on chrosomal short arm and 5'-terminus of this base sequence : 22878
tatcttcctcttcattgcaaatcctgccacactgattcaggtgacccaacaaacacacacacacacacatacgcgctcgcgcacacacacacacacacacacacacagagtgcccttcccactcttcatgggaaaattattcccttggccacactatggaccttgtcacccagagttgcttcaactctggaatcttgaatttcaatatctcattctcaagcaatgatctgcttctgaaaagagctttctgtgttgtgatcaccatacttattctctgaccttattcagtgctccagtctcttgcccctgttcattttctctcaatctatcagtcccctcttggcttcaataccatttcta

SEQ ID NO: 18535 - DNA, 263 bp, Homo sapiens
  AC009318.11_63647
  Located on chromosome 12
  Distance between a terminus base of telomere on chromosomal short arm and 5'-terminus of this base sequence : 31031238
  Distance between 3'-terminus of neighbour sequence of sequence listing upward to telomere on chrosomal short arm and 5'-terminus of this base sequence : 52902
ttagaagtatctggatcacaggataaaatcagaaacgttggcatgacccaacacacacacagacacacacacacacacacacacacatacacacacacacaacacagctttctgatcagcagtttttggaaatggagtattgctgtggaagtagaaagggaattttcctattattagggaactacaaagcggtgggcactatgacaaacatctgactttcattacacgaatcctcagaaatctctgcagtatgcctattccta

SEQ ID NO: 18536 - DNA, 337 bp, Homo sapiens
  AC009318.11_86272
  Located on chromosome 12
  Distance between a terminus base of telomere on chromosomal short arm and 5'-terminus of this base sequence : 31053811
  Distance between 3'-terminus of neighbour sequence of sequence listing upward to telomere on chrosomal short arm and 5'-terminus of this base sequence : 22310
gctgaatggcttaggtcttaagaaacaaacttaaaaacacatttccctctagctgctcttaaatataatctctgtaacatctttaagtaagtcaatatacacacagacacacagacacacacacacacacacacacacacacacatatatatatatatgtatatatatctggcatggactctatagctggtaaaaaatgttaagaaatgggccattaacacaaatcatgttttcaatgttctcctaaggaggctgaaatcaggactaaggtggagaagtatggttggtgaattgcttagcagatcatgatataaggacaaggtccaatttagtccat

SEQ ID NO: 18537 - DNA, 410 bp, Homo sapiens
  AC009318.11_164759
  Located on chromosome 12
  Distance between a terminus base of telomere on chromosomal short arm and 5'-terminus of this base sequence : 31132273
  Distance between 3'-terminus of neighbour sequence of sequence listing upward to telomere on chrosomal short arm and 5'-terminus of this base sequence : 78125
acagagtctaactcagttgctcaggctggagtgcagtggcgcgatctcggctcactgcaacctccacctcaagcaattctggtgcctcagcctcctgagtagctgggactactggcatgagccgccatgcctggttaattgtgtgtgtgtgtgtgtgtgtgtgtgtgtgtgtgtgtgtgtgtgtgtattttcagtagagatggggtttcatcatgttgcccaggctggtctggaactcctgccctcaagtgatctgtccccaccatggcctccttaagtcctgggattacaggtgtaagccaccgtgcccagtacccaagtggatttcataatttatctccaaatctatttcttctcctctgtgcctagaaaagtcaatggcaccattaacctcaaacttaaccaggtta

SEQ ID NO: 18538 - DNA, 189 bp, Homo sapiens
  D12S1631
  Located on chromosome 12
  Distance between a terminus base of telomere on chromosomal short arm and 5'-terminus of this base sequence : 31221914
  Distance between 3'-terminus of neighbour sequence of sequence listing upward to telomere on chrosomal short arm and 5'-terminus of this base sequence : 89231
tgggctcatctggaaagatctttgagatatttttcagtgaccaaggcattgccaagcagcataagtacacacgcgcgcacacacacacacacacacacacacacacacacacacacacacacacacacaggttagtaaatgctcaaaatacctcccaaggacactagtaagttatcagtgtttgcctcc

SEQ ID NO: 18539 - DNA, 422 bp, Homo sapiens
  AC009320.7_40349
  Located on chromosome 12
  Distance between a terminus base of telomere on chromosomal short arm and 5'-terminus of this base sequence : 31267641
  Distance between 3'-terminus of neighbour sequence of sequence listing upward to telomere on chrosomal short arm and 5'-terminus of this base sequence : 45538
tgccatctatttgagttcctacatttaagtaacattagggaacaaggtgtggtttgtcaaacttcatccacactccagcaaaaataaggatccatgtctctaaatatatgttttttaattgccaaactcaacaaattatcaaattcaaaaaatttaaagatgaattaaagtctcaaaatatttcctttcaatctattgaagagaagctttctgaagctctcgtccattgaaggactgacaatgtgtgtgtgtgtgtgtgtgtgtgtgtgtgtgtaatgaagacaggcagaacagaaattatataacaacctgagaaaattaacatctagagagtaccatagggtgtatattcatgtatccattcattccacatgcatttactgcaatggctatagaagtatgacatagtggttaagaacgag

SEQ ID NO: 18540 - DNA, 309 bp, Homo sapiens
  AC009510.9_54869
  Located on chromosome 12
  Distance between a terminus base of telomere on chromosomal short arm and 5'-terminus of this base sequence : 31362698
  Distance between 3'-terminus of neighbour sequence of sequence listing upward to telomere on chrosomal short arm and 5'-terminus of this base sequence : 94635
aacagatatgtttcattgccatctaaaaagatagtctctttgggcactgtacttacttagaagcaaacacttaaagaatttagcaatcaatcactcccatctcttttgtattttccaggtactagtctaggctcttgggaaaacatcagtaagcaaaacagacaacagagagagagagagagagagagagagagagagataaaaaccctgcctttccagagaggaaaagagagaaagagaccacgagaaagtgagtcagtgaggctggtaaggggtatctgtaatacacagattaaggtggacaagaaa

SEQ ID NO: 18541 - DNA, 193 bp, Homo sapiens
  AC009510.9_74418
  Located on chromosome 12
  Distance between a terminus base of telomere on chromosomal short arm and 5'-terminus of this base sequence : 31382375
  Distance between 3'-terminus of neighbour sequence of sequence listing upward to telomere on chrosomal short arm and 5'-terminus of this base sequence : 19368
aagatcctgtttcaaaatgaaacgaaacaaaatgagaaacacacacacacacacacacacacacacacacacacacaaaagaacaacagtaacaacaaaaacaaagaagccatttggaatcacttcaaaagctaattacactggagatagggggtggaggggatagttcagctagctgtccaacagctacagt

SEQ ID NO: 18542 - DNA, 426 bp, Homo sapiens
  AC009510.9_112922
  Located on chromosome 12
  Distance between a terminus base of telomere on chromosomal short arm and 5'-terminus of this base sequence : 31420746
  Distance between 3'-terminus of neighbour sequence of sequence listing upward to telomere on chrosomal short arm and 5'-terminus of this base sequence : 38178
ggacacaggaccttcagtactaaaactgggacaatcctggaaaaacctggtcaccctgtgtgccatcctctagtaagctggtacagtacagtagaataaactgctaaggagtagttctgcaaaagtcaaagaaaaaagtggtttctctgtgccctggacacacatgcaaatacacacacacacacacacacacacacacacacacacacacaccctccatgactttctgtttcttgtgaataagagtttaatcaaaaacgagtgtttctctggtggaagatatctactaattggttcaacttgttaattctgaaaacatgagaactagaattttctcacccacgctttccagctgtcagacaaatcttttcatctaacttggatgagccaatataaggtattcttaatagcattgttccatgaaag

SEQ ID NO: 18543 - DNA, 244 bp, Homo sapiens
  D12S333
  Located on chromosome 12
  Distance between a terminus base of telomere on chromosomal short arm and 5'-terminus of this base sequence : 31495313
  Distance between 3'-terminus of neighbour sequence of sequence listing upward to telomere on chrosomal short arm and 5'-terminus of this base sequence : 74141
tgattgcccccaacagcctgcaccacgaagaggccagagggaacgtttttaaaagaaatgttatcataactgtctatacacacacacacacacacacacacacacacacaaactccagtatcttcccattcccctcagaataaaatccaaacctgcttccacagccagcacagcccttcacctgtgccctgccccctccttgccctcaccccttctcctcccaatttgctatgatcctcaagcc

SEQ ID NO: 18544 - DNA, 470 bp, Homo sapiens
  chr12.fa.O7frz.30626416
  Located on chromosome 12
  Distance between a terminus base of telomere on chromosomal short arm and 5'-terminus of this base sequence : 31566126
  Distance between 3'-terminus of neighbour sequence of sequence listing upward to telomere on chrosomal short arm and 5'-terminus of this base sequence : 70569
aaatctggtccttctacatattaactgtatgatcttgggaatatcatttaatctctctgagctccagttttaccctctgaaaatgtgataatgctacttaacaattattgtaagggttaagtcaatcagggttctccagagaaacaggagcaacaggatgtgtgtgtgcgtgtgtgtgtgtgtgtgtgtgtgtgtgacagagagagagagagagagagaatatatatgggggtgcagattttaaggaattggctcacatgattgtggaggctggcaaatcctaaatcttcagggtagactggcagactggagactcagaatttttgcagttggagtctgaaggcagtctgctggcagaatttcttctttcttggggaagatcagtctttattctcttcaggcctccaattgattggatgaggtccacccacatcgtggagggtaaactgatttactcgaagtccactgat

SEQ ID NO: 18545 - DNA, 392 bp, Homo sapiens
  AC023281.13_68404
  Located on chromosome 12
  Distance between a terminus base of telomere on chromosomal short arm and 5'-terminus of this base sequence : 31671393
  Distance between 3'-terminus of neighbour sequence of sequence listing upward to telomere on chrosomal short arm and 5'-terminus of this base sequence : 104797
gtgatcagcacaatttagctattattactagcccaatattctactctttatatatttatcctccatatagtaattattaatatatttgttttcaaagcaacgtattaatgtatttagttatttgtatatacatgtatatttatatttataaagaaaattatgctgttaattatagaacatcaattaggaaggtaggtgttaaaatattttttagatgtggtattattaaaatatgtttcagatgtggtattgttaaaatattgtatacacacacacacacacacacacaccacatatgcaatgaagtactattcagccttaaagaagagggaaatcctatcattgcaacatggatgcacatggaggacattatgctaagtgaaataagctgg

SEQ ID NO: 18546 - DNA, 334 bp, Homo sapiens
  AC023281.13_135367
  Located on chromosome 12
  Distance between a terminus base of telomere on chromosomal short arm and 5'-terminus of this base sequence : 31738383
  Distance between 3'-terminus of neighbour sequence of sequence listing upward to telomere on chrosomal short arm and 5'-terminus of this base sequence : 66598
gtcttggtgactttactctgaaacactttcagggaatcattaccattcacctttaatagctctttagaaaaatcccagtaattacccataaaatatctagttttaaacaacgtaactccctggtgatatgtccaatataaattaccacatttcctcaattctaaatatatattttcccacattataatgtttctaaaatcaggattgatgtggacatttaatatagtcggtgttttctttctctctctctctctctctctctctctaaagctgtttatagctgatgagttcttacaattaagggaatatggtaattgcgaaatgtacttctagc

SEQ ID NO: 18547 - DNA, 133 bp, Homo sapiens
  HUMUT553
  Located on chromosome 12
  Distance between a terminus base of telomere on chromosomal short arm and 5'-terminus of this base sequence : 31739537
  Distance between 3'-terminus of neighbour sequence of sequence listing upward to telomere on chrosomal short arm and 5'-terminus of this base sequence : 820
tccacctgcaattctagggtgggctctatctatccatttatttatttatttatttatttatttagaaacagactctgtcacccaggctggagtacagtggcattatcttggctcactgcaacctctgactttt

SEQ ID NO: 18548 - DNA, 427 bp, Homo sapiens
  chr12.fa.O7frz.30875700
  Located on chromosome 12
  Distance between a terminus base of telomere on chromosomal short arm and 5'-terminus of this base sequence : 31816148
  Distance between 3'-terminus of neighbour sequence of sequence listing upward to telomere on chrosomal short arm and 5'-terminus of this base sequence : 76478
cagatcacgaggtcaagaaatcgagaccatcccggccgacatggtgaaaccccgtctctattaaaaatacaaaaattagctggccatggtggcacacgcctgtagtcccagctactcaggaggctgaggcaggagaattgcttgaacctgggaggcagaggctgcagtgagccaaggtctcaccactgcactctagcctggtggcagagcgaagactctgtctcaaaaaagaaaaaagaaaagaaaagaaaagaaatagaattgatagtatatacatacactcacatatatatatatacatacgtgtgtgtgtgcgtgtgtgtattgagatattgacaggaacaaaaagagattgagatttgttatgataaatttgatcacacagttttggaggctgagaaatccgtaatctgtcatctgcaaactg

SEQ ID NO: 18549 - DNA, 476 bp, Homo sapiens
  AC068811.8_91498
  Located on chromosome 12
  Distance between a terminus base of telomere on chromosomal short arm and 5'-terminus of this base sequence : 31912284
  Distance between 3'-terminus of neighbour sequence of sequence listing upward to telomere on chrosomal short arm and 5'-terminus of this base sequence : 95709
tgacctagatgaaagtccagaaggtggactgttaggattcacaaaaagtagtgactgatgagcccatctcttccttgaacggaagcgtccaaagtgtgggtgtgtactgatatgaatgtgtgagtgtattgatgtggaggtaagtgtgtatgtgtgcctatgcatgaatgggtgaaagggcttaatggagagctaccactactcttcctcctacatacatacacacacacacacacacacacactgccttgctaattttcctcaattccttacttttttcaccctacacattaatgcttcattgagtcccttccattccacctctaaagcatgtacccagtttgtctactacacatcatctctattactactacccgattgaagccatcaccacctctcaccttgaccacaacaaacatcttctagccagttatctattctgattctcactccctacaataaatgttccacagcaa

SEQ ID NO: 18550 - DNA, 358 bp, Homo sapiens
  AC068811.8_107969
  Located on chromosome 12
  Distance between a terminus base of telomere on chromosomal short arm and 5'-terminus of this base sequence : 31928735
  Distance between 3'-terminus of neighbour sequence of sequence listing upward to telomere on chrosomal short arm and 5'-terminus of this base sequence : 15975
actcggaactgtacatttaaagaggtacatatgatagtaaaattatcacatgtaaattatacaccaaaaagctgaaaattatatttaagaaagagattctctatggtgctgaaagaattagaaagatacaaggttttttaggagcatagaggtagtactaacttgtatttgtatcttttaaacattaattaatgtgaaaagttcctttttaaaatgtatgtttgtgtgtgtgtgtgtgtatgtgtgtgtgtgtgtgtgtgtgtgagagagagtgtatttcagtttgctgctattcctgaacttcaaaaaccttgcatcttgttaggaattaaaaatgaattatctcagtaggaagcag

SEQ ID NO: 18551 - DNA, 228 bp, Homo sapiens
  AC068811.8_124202
  Located on chromosome 12
  Distance between a terminus base of telomere on chromosomal short arm and 5'-terminus of this base sequence : 31945076
  Distance between 3'-terminus of neighbour sequence of sequence listing upward to telomere on chrosomal short arm and 5'-terminus of this base sequence : 15983
gtggttaagacattgtctccacaaaacttctgtaaaaatgtaagcatgtttcttggaaagattaacacactgacctgtaacatctactaaaataacaatgtcagtattttagttagcattttacacacacatacacacacacacacacacacacacacacacacaccaactttgagcatgactggtcatccagcccattccattgtgcactgcatggcagattattcc

SEQ ID NO: 18552 - DNA, 158 bp, Homo sapiens
  D12S87
  Located on chromosome 12
  Distance between a terminus base of telomere on chromosomal short arm and 5'-terminus of this base sequence : 31980388
  Distance between 3'-terminus of neighbour sequence of sequence listing upward to telomere on chrosomal short arm and 5'-terminus of this base sequence : 35084
ctgcacaaacacttgaaacatcttccactccttattgccatggggaccatggtcacagattcccgggtccccatgagtcgtgtgtgtgtgtgtgtgtgtgtgtgtgtgtgtgtgtgtccttgtccctgtgtgttttcaatgtccagcatcacctagtg

SEQ ID NO: 18553 - DNA, 320 bp, Homo sapiens
  chr12.fa.O7frz.31491583
  Located on chromosome 12
  Distance between a terminus base of telomere on chromosomal short arm and 5'-terminus of this base sequence : 31992948
  Distance between 3'-terminus of neighbour sequence of sequence listing upward to telomere on chrosomal short arm and 5'-terminus of this base sequence : 12402
ctttatcacaatagtgagctcatcctctcttgctttctcttgctctctctttacccctctatcatgtgatggcttctgccctattatgatatggcaaaaaggtctttgccagatgctgtcaccttcatgttggacttctcagactccatagctgtgagctaataaaatttttttcattataaattacccaatcactgttatagcagcacaaaaaggttgaagacatacacacacacacacacacacacacagataagtgtacacacatatatttgcttgtactatgagctgaaagggcctagaaacagtaacaccctaaa

SEQ ID NO: 18554 - DNA, 229 bp, Homo sapiens
  D12S1681
  Located on chromosome 12
  Distance between a terminus base of telomere on chromosomal short arm and 5'-terminus of this base sequence : 32060109
  Distance between 3'-terminus of neighbour sequence of sequence listing upward to telomere on chrosomal short arm and 5'-terminus of this base sequence : 66841
gtcccttaccttgtagatacaccactccaatctctgcctccacttttacatgacacattcttccgtgtgtgtgtgtgtgtgtgtgtgtgtgtgtttgtgttttcttaagaacagcaaatattggatttgggagggcccactctaatccactatgaacttcccttagtttggttacatctacaaagaccctgtttgcaaacaaggtcacattcgaggttctgagtggaca

SEQ ID NO: 18555 - DNA, 416 bp, Homo sapiens
  chr12.fa.O7frz.31195584
  Located on chromosome 12
  Distance between a terminus base of telomere on chromosomal short arm and 5'-terminus of this base sequence : 32135826
  Distance between 3'-terminus of neighbour sequence of sequence listing upward to telomere on chrosomal short arm and 5'-terminus of this base sequence : 75488
ggtttgcctttacaaataaaactgccatggaaattgctttacccaaaattttggttcacagctttcattggattacctatcaggacaaagtctggccatctgaaaatgttcatagaccagagagtttgtattgctgtctcatggctagaattctgaggtaaaagctattggttctttgtgtgtgtgtgtgtgtgtgtgtgtgtgtgtgtgtgtgtgtgtgtgtgtgtgtgtgtgtctagatgttacatgttgttttacacagtaccaatatggcttataagtaagaatgcttataaataaataagtccaagcaatttaaaagttcatgtgacttaagtaaatctttaataaacaagctggtttaaaattattggtaaaataaaaataggaatatcttcagaattgtcagcatacat

SEQ ID NO: 18556 - DNA, 433 bp, Homo sapiens
  chr12.fa.O7frz.31270065
  Located on chromosome 12
  Distance between a terminus base of telomere on chromosomal short arm and 5'-terminus of this base sequence : 32210286
  Distance between 3'-terminus of neighbour sequence of sequence listing upward to telomere on chrosomal short arm and 5'-terminus of this base sequence : 74044
cagaataaccactatctagagcagctatagccttacaaaatttatttcttaaataagacttgaaaggctaaattgctccttgatccatgggctacagaatggatgctgtgtttgcagggatgaaaataatattaatcttatcgtacatttccgtcagagctgttggatgaccaggtatattgtcaatgagcagtaatatagatagatagatagatagatagatagatagatagatagatagatagatatagatataggtagatacagatatagatagatatagatatagatagatatagatatagatagatatagatatagatagatagatatagatatatctatatatatacttttttttttttgagatggagtctcactctgtccccccaggctggagtgcagtggcacaatttcgactcactacaagctc

SEQ ID NO: 18557 - DNA, 436 bp, Homo sapiens
  chr12.fa.O7frz.31403997
  Located on chromosome 12
  Distance between a terminus base of telomere on chromosomal short arm and 5'-terminus of this base sequence : 32275524
  Distance between 3'-terminus of neighbour sequence of sequence listing upward to telomere on chrosomal short arm and 5'-terminus of this base sequence : 64805
ctgatcaaagctaatgaattctagcaaaggagtctggaatgtcttggtctcattgcttctattaaccactgtttcttgccttcagtgacaaaaaatccatgggtgttataatccttcctagtatttggtctgagactgagagtctgttatttttaaattccattttccaaataccaaaaaaatgctaatgttagccattaaccatgattctttaaggattatgctataacaacatactacctaatatttttgtatgatctgacacctgaacacacaattattataattttggtatattttctgcaagaactttgtaagagctatagttggtttccctcacatgctattatattattatattatattatattatattatattatattacattatatattgcacatatttccatgtagtcacatgaaactaaaccatt

SEQ ID NO: 18558 - DNA, 226 bp, Homo sapiens
  AC010198.8_191515
  Located on chromosome 12
  Distance between a terminus base of telomere on chromosomal short arm and 5'-terminus of this base sequence : 32449080
  Distance between 3'-terminus of neighbour sequence of sequence listing upward to telomere on chrosomal short arm and 5'-terminus of this base sequence : 173120
aaatttcttgtacatcctagcagaaaaaagttcaagcaatcggatatatgcttttacgatttttcacacaaatgagatgttatcgattctgttctactatttgtagggcaaattcctagtagcggaatttctgggtcaaaagtgtgtgtgtgtgtgtgtgtgtgtgtgtgtgtgtgtgtgtgtgtgtgtttttaccttaacagtcattaccaatttactctccaaa

SEQ ID NO: 18559 - DNA, 136 bp, Homo sapiens
  D12S1648
  Located on chromosome 12
  Distance between a terminus base of telomere on chromosomal short arm and 5'-terminus of this base sequence : 32776851
  Distance between 3'-terminus of neighbour sequence of sequence listing upward to telomere on chrosomal short arm and 5'-terminus of this base sequence : 327545
ggagatgaggagccttgcagccctaagggaaggtgctgaataccactctctctctctctctctctctctctctctctctctctctctctgtgtgtgtgtgtgtgtgtgtgtgtgtgtgtgtgtgtgaaagcaccca

SEQ ID NO: 18560 - DNA, 160 bp, Homo sapiens
  AC008013.8_113581
  Located on chromosome 12
  Distance between a terminus base of telomere on chromosomal short arm and 5'-terminus of this base sequence : 32813068
  Distance between 3'-terminus of neighbour sequence of sequence listing upward to telomere on chrosomal short arm and 5'-terminus of this base sequence : 36081
aactgcatgagctaattctttaagcctctttttcgctctgtgtagacacacacacacacacacacacacacacacacaccctgctggttgtttctctggagaaccctaatacaaataatagcctcagggctcatccatgtcgtagcatgtgtcagaactt

SEQ ID NO: 18561 - DNA, 294 bp, Homo sapiens
  chr12.fa.O7frz.32477255
  Located on chromosome 12
  Distance between a terminus base of telomere on chromosomal short arm and 5'-terminus of this base sequence : 32904904
  Distance between 3'-terminus of neighbour sequence of sequence listing upward to telomere on chrosomal short arm and 5'-terminus of this base sequence : 91676
tgaaccgagatcataccactgcactccagcctgggtgacagagtgagactttgtctcaaaaataaaaaaaaaagtgggggggtacaatttgatgtttcaatacacacacacacacacagacacacacacatatctatatatttagtataatgatcatattggggcagtgttaccagtacttcattcatttatcttttttttttatggtgaagacattcaaaaacctctcatctagctattttgtaatttgctaaatcttactgtaaactattgtcatcctactgtgcaatagaa

SEQ ID NO: 18562 - DNA, 468 bp, Homo sapiens
  AC068793.15_36597
  Located on chromosome 12
  Distance between a terminus base of telomere on chromosomal short arm and 5'-terminus of this base sequence : 33005214
  Distance between 3'-terminus of neighbour sequence of sequence listing upward to telomere on chrosomal short arm and 5'-terminus of this base sequence : 100016
gaatagaatgcattgttctgaatctaaatgacaaagcaatctttgtttgtttgtttgtttgtttgttttgagacagagttttgctcttgttgcccaggctggagtgcaatggcacgatctgggctcactgcaacctcagcttcctgggttcaagcgattcgccgacctcagtacctgggattacaggcagctgccaccacgccccgctaatttttgtatttttagtagagacggggtttcaccatgttggccaggctggtcttgaactcctgacgtcaggtaatccgcccaccttggcctcccaaagtgctggatttataggcatgagccactgcgcccagcccaaagcaatcttttagaagttgtataatcaagaaaaagaagaaaatcgggggtttttttttagggattcggggtatgcttatgagcacaggaataaaggaaaaaggcagtaatctaagttgcata

SEQ ID NO: 18563 - DNA, 369 bp, Homo sapiens
  chr12.fa.O7frz.27544703
  Located on chromosome 12
  Distance between a terminus base of telomere on chromosomal short arm and 5'-terminus of this base sequence : 33362399
  Distance between 3'-terminus of neighbour sequence of sequence listing upward to telomere on chrosomal short arm and 5'-terminus of this base sequence : 356717
gtgtggccttgtagactgtagtatgggattttgcttctattctgaatgaaagggaaaggcattggaaggttttgagcaaatggtgccatgatctaagatattttaatgagatcactggctgctttttgagaaaagacggaggcaagagcagaaatgcagattggttaggaggccactgaagtaatccaggggagagataactaggttaggtagaatgggggcagtgaaggtgttgtgaggggtgtgtgtgtgtgtgtgtgtatttagcagtttatcttgaaatggtttctcagaaaatatgcaaaaatagtataaagaatttctgtataatcttcatccagattcctcaaagcttaatgtattaggcta

SEQ ID NO: 18564 - DNA, 238 bp, Homo sapiens
  chr12.fa.O7frz.27419079
  Located on chromosome 12
  Distance between a terminus base of telomere on chromosomal short arm and 5'-terminus of this base sequence : 33454381
  Distance between 3'-terminus of neighbour sequence of sequence listing upward to telomere on chrosomal short arm and 5'-terminus of this base sequence : 91613
cagtaggaacacttctattgatctcctctctgtctccctctctctgtctctctctctctatatatatatacacacacacaaatatatatatatacaaagatatatatatacacacaaagatgtatatatacacacacatatacacaaagatattagtattactaactaatcaaatctggtttaggggacttcagaaaaacaatattttggcaaacagcctaaattcttaaactgattt

SEQ ID NO: 18565 - DNA, 353 bp, Homo sapiens
  chr12.fa.O7frz.27305969
  Located on chromosome 12
  Distance between a terminus base of telomere on chromosomal short arm and 5'-terminus of this base sequence : 33580881
  Distance between 3'-terminus of neighbour sequence of sequence listing upward to telomere on chrosomal short arm and 5'-terminus of this base sequence : 126262
tggtgcttctgtaatgttttactatgtggctgagattggggtgtgtgtgtgtgtgtgtgtgtgtgtgtgtgttctactggatgacttggaggtggtcaaacttacagagactctgaagggccatgaagaactggaggataacatgcttatctagagagtgtcctatcttggaagtaccctaaaaatggtttttactagcatttttgaaagggcagaagcttcagctctgtttagaaatagggctgtggacatttgtccttctggttctatttagacaggctgcatgaaacacaagtgcagttacaaattgttgtaggaagcctcacagttatgcaacttgaactctgattata

SEQ ID NO: 18566 - DNA, 134 bp, Homo sapiens
  DISO7_10003328
  Located on chromosome 12
  Distance between a terminus base of telomere on chromosomal short arm and 5'-terminus of this base sequence : 33688571
  Distance between 3'-terminus of neighbour sequence of sequence listing upward to telomere on chrosomal short arm and 5'-terminus of this base sequence : 107337
ctctcagtcttggccagggatcagtgtgtgcgtacacacacacaaacacacacacgtgtgcgctcgtgcacgtgcccgttccctcccacccccccccccccacacacacacccctacctagtcatatcactcct

SEQ ID NO: 18567 - DNA, 112 bp, Homo sapiens
  DISO7_10003327
  Located on chromosome 12
  Distance between a terminus base of telomere on chromosomal short arm and 5'-terminus of this base sequence : 33700097
  Distance between 3'-terminus of neighbour sequence of sequence listing upward to telomere on chrosomal short arm and 5'-terminus of this base sequence : 11392
gccaggttatctatctgtctgtctgtctatctatctatctatctatctatctatctatctatctatctatctatctagtctatctatcctgtaacatctgataatgctgtga

SEQ ID NO: 18568 - DNA, 110 bp, Homo sapiens
  DISO7_10003326
  Located on chromosome 12
  Distance between a terminus base of telomere on chromosomal short arm and 5'-terminus of this base sequence : 33736321
  Distance between 3'-terminus of neighbour sequence of sequence listing upward to telomere on chrosomal short arm and 5'-terminus of this base sequence : 36112
atcttgcatgggatctggattttgtttcctttttgccgtgtgtgtgtgtgtgtgtgtgtgtgtctgtgtatgatatagcaaaactcagaatccagcttattaggtatgga

SEQ ID NO: 18569 - DNA, 225 bp, Homo sapiens
  DISO7_10003325
  Located on chromosome 12
  Distance between a terminus base of telomere on chromosomal short arm and 5'-terminus of this base sequence : 33784372
  Distance between 3'-terminus of neighbour sequence of sequence listing upward to telomere on chrosomal short arm and 5'-terminus of this base sequence : 47941
tcattatatgaagcaagccagattatctatctatctgtctgtctgtctatctatctatctatctatctatctatctatctatctatctatcatctgtctatctattcatccaatttttttttatcccttccttcctattttcattcatttaaagtaagccttctggggactatcattataattttaaatatgatctttatagttctgctataaccatttaggaca

SEQ ID NO: 18570 - DNA, 101 bp, Homo sapiens
  DISO7_10003324
  Located on chromosome 12
  Distance between a terminus base of telomere on chromosomal short arm and 5'-terminus of this base sequence : 33793313
  Distance between 3'-terminus of neighbour sequence of sequence listing upward to telomere on chrosomal short arm and 5'-terminus of this base sequence : 8716
cttatagctacctgtccgtcccttatcttataaacaaaaacacacacacacacacacacacacacacaaaaaaaaaaatagagacccaggcaatattctta

SEQ ID NO: 18571 - DNA, 151 bp, Homo sapiens
  DISO7_10003323
  Located on chromosome 12
  Distance between a terminus base of telomere on chromosomal short arm and 5'-terminus of this base sequence : 33805299
  Distance between 3'-terminus of neighbour sequence of sequence listing upward to telomere on chrosomal short arm and 5'-terminus of this base sequence : 11885
tcctgacaccagaagtggtgtatgtgtgtgtgtgtgtgtgtgtctgtgtgtctctgtgtgtttgtctgtgtgtgtgtgtgtctatgtgtgaaactggtaaaaatttaaaaatagggcaatgaagcataaatttgcttcatggttgaaccaa

SEQ ID NO: 18572 - DNA, 135 bp, Homo sapiens
  DISO7_10003322
  Located on chromosome 12
  Distance between a terminus base of telomere on chromosomal short arm and 5'-terminus of this base sequence : 33818188
  Distance between 3'-terminus of neighbour sequence of sequence listing upward to telomere on chrosomal short arm and 5'-terminus of this base sequence : 12738
tgaggttctaagtggtggggtacttcactgactgtacaggaaaagagaattgtcttgaatcattcagatacacacttgtgtgtgtgtgtgtgtgtgtgtgtgtgtaaatacagtaaacatgaagcttagaacatg

SEQ ID NO: 18573 - DNA, 136 bp, Homo sapiens
  DISO7_10003321
  Located on chromosome 12
  Distance between a terminus base of telomere on chromosomal short arm and 5'-terminus of this base sequence : 33836128
  Distance between 3'-terminus of neighbour sequence of sequence listing upward to telomere on chrosomal short arm and 5'-terminus of this base sequence : 17805
gttcagggactaccacggcgggggaaaaatgtagggttgcatgtgtgtgtgtgtgtgtgtgtgtgtgtgtgataattggcaataaaggaaatttggagacagtggaaaaattggatagaagacataaggcaaaggt

SEQ ID NO: 18574 - DNA, 237 bp, Homo sapiens
  DISO7_10003320
  Located on chromosome 12
  Distance between a terminus base of telomere on chromosomal short arm and 5'-terminus of this base sequence : 33839855
  Distance between 3'-terminus of neighbour sequence of sequence listing upward to telomere on chrosomal short arm and 5'-terminus of this base sequence : 3591
tctcttcctcccatatgaattacaaaggcacttaaaagctgtccttttaaaaatttgtttcccttctctccccacccccaccccccaccacacacacacacacacacacacacacacacacacacacacacacaaaacccttatctacttgttaacaaaataaattctgggatctttttttaggaagatgagggcttttttaactaacatattttgtgaaccataatttccatgaag

SEQ ID NO: 18575 - DNA, 159 bp, Homo sapiens
  DISO7_10003319
  Located on chromosome 12
  Distance between a terminus base of telomere on chromosomal short arm and 5'-terminus of this base sequence : 33846624
  Distance between 3'-terminus of neighbour sequence of sequence listing upward to telomere on chrosomal short arm and 5'-terminus of this base sequence : 6532
ttgataagtaataccagtgccagttttcttcctctcttttaagaataatctatttctagtattttggggaaaaataatgaggtctttgtctctcacttaatccgtgtgtgtgtgtgtgtgtgtgtgtgtgtgttggtggggggcagtgggtcttctacc

SEQ ID NO: 18576 - DNA, 205 bp, Homo sapiens
  DISO7_10003317
  Located on chromosome 12
  Distance between a terminus base of telomere on chromosomal short arm and 5'-terminus of this base sequence : 33888159
  Distance between 3'-terminus of neighbour sequence of sequence listing upward to telomere on chrosomal short arm and 5'-terminus of this base sequence : 41376
gtgaaatcagctggtctcagaaaacttctagaaatgtatccctatacacatatatgtaactttatatgtatgtgtgtgtgtgtgtgtgtgtgtgtgtatatatatatgtatgtgtgcatatatatatatatatatatatatatatatatatatatatatatttatatgcttttctttttcttattgtcagctttgtgagacctga

SEQ ID NO: 18577 - DNA, 100 bp, Homo sapiens
  DISO7_10003316
  Located on chromosome 12
  Distance between a terminus base of telomere on chromosomal short arm and 5'-terminus of this base sequence : 33898516
  Distance between 3'-terminus of neighbour sequence of sequence listing upward to telomere on chrosomal short arm and 5'-terminus of this base sequence : 10152
aaggcatcagttccttactttccgtgtgtgtgtgtgtgtgtgtgtgtgtgtgtgtgtgtgtgtgtgatatgagagaaagctgtcttgagatctcatgatt

SEQ ID NO: 18578 - DNA, 150 bp, Homo sapiens
  DISO7_10003314
  Located on chromosome 12
  Distance between a terminus base of telomere on chromosomal short arm and 5'-terminus of this base sequence : 33935778
  Distance between 3'-terminus of neighbour sequence of sequence listing upward to telomere on chrosomal short arm and 5'-terminus of this base sequence : 37162
tctgttactgtctttcttgttcttcttccttaaatgttacttttcccagagttttacaggtataaatatggggacttgtgtttgtgtgtgtgtgtgtgtgtgtgtgtgtgtgtgtgtgtacatatatacatgtagactatctgcttccca

SEQ ID NO: 18579 - DNA, 417 bp, Homo sapiens
  chr12.fa.O7frz.26782274
  Located on chromosome 12
  Distance between a terminus base of telomere on chromosomal short arm and 5'-terminus of this base sequence : 34079224
  Distance between 3'-terminus of neighbour sequence of sequence listing upward to telomere on chrosomal short arm and 5'-terminus of this base sequence : 143296
ggacctgatctatccaaactattattacttcagcatgccctcaataaaaaatgtattaatgagattttttacattcttttttttttggtaccaagtctttgaaatcctgcatgtgttttacaaccacagcacaccccggttcagactagccattcaaatgctcagtggctacctgggactagtagcttctacattaggcaggaaagacctagagttgctttctcatctataaaaatgaaaaaaatggcactatcaggggttttctaactgcctctgcttagagtcctaagaattctatagaggtaactcaatgagtgtctgtgagtgtgtgtgtgtgtgtgtgtgtgtgtgtagtgaattttggtgtggcagagatagccagctttggttcatctactaccacttcatgccaaatac

SEQ ID NO: 18580 - DNA, 296 bp, Homo sapiens
  D12S1034
  Located on chromosome 12
  Distance between a terminus base of telomere on chromosomal short arm and 5'-terminus of this base sequence : 34254438
  Distance between 3'-terminus of neighbour sequence of sequence listing upward to telomere on chrosomal short arm and 5'-terminus of this base sequence : 174797
ttttcaaaaagtgtgactgtgcttgctaggaggagtcattttaaattgaaaatttataatttacgaaagattcggtaaaaatgcacttgttctatgagtaccagccttggggaatgtgctgagtgagcatgggaagaggaagtccaaaggtagaaggcaaagttcctgctttccaggacccacctggtttggaagatcaggacagtatctctgaaataataataataataataataataataataataataataataatacagtagaaaatccaatttaaattttttactaggctg

SEQ ID NO: 18581 - DNA, 354 bp, Homo sapiens
  AC022509.20_123069
  Located on chromosome 12
  Distance between a terminus base of telomere on chromosomal short arm and 5'-terminus of this base sequence : 34254520
  Distance between 3'-terminus of neighbour sequence of sequence listing upward to telomere on chrosomal short arm and 5'-terminus of this base sequence : -214
gcacttgttctatgagtaccagccttggggaatgtgctgagtgagcatgggaagaggaagtccaaaggtagaaggcaaagttcctgctttccaggacccacctggtttggaagatcaggacagtatctctgaaataataataataataataataataataataataataataataatacagtagaaaatccaatttaaattttttactaggctgatagtaaaatttcattttactccatttagacaacaatcttttaaacacatatctcagctccctccctgtgccttctcaaatggtatactgaacttcgtttggtctttgcttgatgactgattgacattagcctattagaa

SEQ ID NO: 18582 - DNA, 326 bp, Homo sapiens
  chr12.fa.O7frz.26524072
  Located on chromosome 12
  Distance between a terminus base of telomere on chromosomal short arm and 5'-terminus of this base sequence : 34330250
  Distance between 3'-terminus of neighbour sequence of sequence listing upward to telomere on chrosomal short arm and 5'-terminus of this base sequence : 75376
tctgcaaagtgataaatcttctacaaccaggaatccttttaaatttcaagatttcttttaagtcaatttagttatacacacagacacacacagacacacacacacacacacacacacacacacacacacacacagtgtatgcccgaacttccacacaagcctgtgcctgaagaacatttatgttatttagtctgttctgggagccataagaaagtttagattttgttgcaccacagttattttaatggctgtaatgtaatgagactacatttttatttaatatataatttcatgcgtgcagatgggtgctgtacctattaaggcag

SEQ ID NO: 18583 - DNA, 212 bp, Homo sapiens
  D12S1596
  Located on chromosome 12
  Distance between a terminus base of telomere on chromosomal short arm and 5'-terminus of this base sequence : 34622852
  Distance between 3'-terminus of neighbour sequence of sequence listing upward to telomere on chrosomal short arm and 5'-terminus of this base sequence : 292276
cgtgaagcagatttatcgtgactagaccatttgtgtgtgtgtgtgtgtgtatgtgtgtgtgtgtgtgtgtgtgtgtgtgtgtgtgtgtatttggtagtgctgttttccaggcacatgcagaagacagattgttgacagtcaatcagtcaatgtttagtcaagggtgagaatacttttgttttagtcacagatcttctctaccagccacatga

SEQ ID NO: 18584 - DNA, 474 bp, Homo sapiens
  chr12.fa.O7frz.26009717
  Located on chromosome 12
  Distance between a terminus base of telomere on chromosomal short arm and 5'-terminus of this base sequence : 34849418
  Distance between 3'-terminus of neighbour sequence of sequence listing upward to telomere on chrosomal short arm and 5'-terminus of this base sequence : 226354
acataaaccatgaacaaagactataaatagcctcacctcagttttggaccaggctttgcttcaaatatgttttaaaaaaatttttttgctttttcagagctttttggattttggaactgtggataagaaattgtggagaactatatacagagataggtagacaaataaatagaaacatagacatagatatacatatatatgtatatatatgtgtgtatatgtgtgtgtgtgtgtgtgtgtgtgtgtgtgtgtgtgtgtatatatatatatatatatatatatatatatatatatatatagtgttattaagtgcctggcatataagtggtattgttattattattggtacagatatatcttatttccaagatgggggtcctcacttaccaaagtgatttttgacccactaataagttgtgactcacaatctgaaaaatgctgatacataatgatatgtaaatgattagcctggtc

SEQ ID NO: 18585 - DNA, 406 bp, Homo sapiens
  chr12.fa.O7frz.25893249
  Located on chromosome 12
  Distance between a terminus base of telomere on chromosomal short arm and 5'-terminus of this base sequence : 34955464
  Distance between 3'-terminus of neighbour sequence of sequence listing upward to telomere on chrosomal short arm and 5'-terminus of this base sequence : 105572
accataattatgtgagccaattacgtaaaataaatctcttttacacagatatatatgggtgtactatatatatagtacacacacacaagtacatatacatatatgtgtatatatacacatatttatatgtgtgcgtatatatgtatggttatatacagatatacatacaccatatatatgtacacaccatatatatacacacacacacacacacacatatatatagggtttgtgtatatttacaaacctattggtttggcttctctggagaactatgaataatacattgaactgatgactcacaaagaatagagcaggaaaagagaaaaatagtaacactgaattagaaaaatctggcaaacaccatttaatccaagtgatgaaggttaacctcaccagtgatgtc

SEQ ID NO: 18586 - DNA, 217 bp, Homo sapiens
  DISO7_10003312
  Located on chromosome 12
  Distance between a terminus base of telomere on chromosomal short arm and 5'-terminus of this base sequence : 34992179
  Distance between 3'-terminus of neighbour sequence of sequence listing upward to telomere on chrosomal short arm and 5'-terminus of this base sequence : 36309
tggcttcctctcctaaacctaaacctttccctctccccacccccttttgtgtgtgtgtgtgtgtgtgtgtgtgtgtgtgtgtgtgtgtgtgtgtgtgtttccagggagcagcttcgctgggccgcaggctctggcactgggtgctttgtcagcgaggcatcgcaggattttaggcaaaggccaaaggggcgagcactggcgtgactcgggaactctt

SEQ ID NO: 18587 - DNA, 287 bp, Homo sapiens
  AC023510.16_13557
  Located on chromosome 12
  Distance between a terminus base of telomere on chromosomal short arm and 5'-terminus of this base sequence : 35274317
  Distance between 3'-terminus of neighbour sequence of sequence listing upward to telomere on chrosomal short arm and 5'-terminus of this base sequence : 281921
tgtcattcaatttgcaagtattagcacacacacacacacacacacacacacacaatttttatactagcaacactgcatttatctagtgctttacattacccaaagttcttttatttccattatcttatttgacccttaaaacagttatctccctcagcttcagtttccttatttcttcggattgtttgcaagatgtgttatatgtctgatacacagttaaataccaaatgtgttattgttacatcaggaatttgaggctcataatagttaaatgacttgctcaaggt

SEQ ID NO: 18588 - DNA, 394 bp, Homo sapiens
  AC023510.16_142417
  Located on chromosome 12
  Distance between a terminus base of telomere on chromosomal short arm and 5'-terminus of this base sequence : 35402856
  Distance between 3'-terminus of neighbour sequence of sequence listing upward to telomere on chrosomal short arm and 5'-terminus of this base sequence : 128252
gagtcactttgtctaaccaaatacaaatgaggtgggaggtgtatggttgagaggcactattagaagaaaggggccaggtgcagtggctcatgcctgtaatcccaggactttgagaggcccaggcaggtggattgtttgatcccatgagtttgagaccaacctgggcaacatagagaaaccctatctctaccaaaaatacaaaattagccaggcagggtggcgcatgcctataaactcagctactcaggaggctgaggcaggagaatcacttgaatccagaaggtggaggttgcagtgagccaagccattgcacaccagtctgggcaaagagtgaaactctgtctcaaataaaataaaataaaataaaataaaatagtaaatctgctgaccttcc

SEQ ID NO: 18589 - DNA, 257 bp, Homo sapiens
  D12S1617
  Located on chromosome 12
  Distance between a terminus base of telomere on chromosomal short arm and 5'-terminus of this base sequence : 35451049
  Distance between 3'-terminus of neighbour sequence of sequence listing upward to telomere on chrosomal short arm and 5'-terminus of this base sequence : 47799
tgggcaacttggataagaaacataggatatacactgagtagcatgtgtacaaaaatggtaagtgagtattatgacttaataaatttagatggggatttaaaaatgatacacatgtaaatgggattggaggcaagggaagtccgtgtgtgtgtgtgtgtgtgtgtgtgtgtgtgtgtgtgtgtgtgtggagggaagacgggaggcctagtggggagagaggttttacattccagacacaggatgtggcccctcaggct

SEQ ID NO: 18590 - DNA, 476 bp, Homo sapiens
  chr12.fa.O7frz.25304738
  Located on chromosome 12
  Distance between a terminus base of telomere on chromosomal short arm and 5'-terminus of this base sequence : 35511222
  Distance between 3'-terminus of neighbour sequence of sequence listing upward to telomere on chrosomal short arm and 5'-terminus of this base sequence : 59916
gcctgtcctttggagttaggcctgggtaccctactagtggtgtctgctcttgggatgataaacccgaggggcttatcagctttatatatatatatatatatatatttttttttttttttttttttttttttttagctagcatctctctcgttcttccaggctggagagcagtggtgtgatcttggctcactgtaatctccacctcctgggttcaagcgattctcctgcctcagcctcccaagtagctgagattacaggcacgtgccactatgcctggctaatttttgtatttttagtagagactgggtttcaccatgttggcatgtgagccactatgcccggcctcttttttttttttttttaagagacagggtcttactatgttgcccaggctggtgttgaactcctggcctcaatagatcctctgtccttggtctcccaaagtgctggctcagtcattatgttctttactgcca

SEQ ID NO: 18591 - DNA, 378 bp, Homo sapiens
  AC023796.22_143879
  Located on chromosome 12
  Distance between a terminus base of telomere on chromosomal short arm and 5'-terminus of this base sequence : 35574200
  Distance between 3'-terminus of neighbour sequence of sequence listing upward to telomere on chrosomal short arm and 5'-terminus of this base sequence : 62502
gtacagccactatggagaacagtatggagggtcctccaaaaataaaagtagaactagaacttccgtgtgatccagcaattctaccaccgggtatatatccaaaagaaaaaaattagtatatcaaagagatatctgcactcccatgtttattgcaatagtattcacaatagccaagatatggaattaacctaaatgtctgtcaacagataaatggataaagagaatgtggcataaagatatatatatatatatatatacacacacacacacacacacacacaatgtggtactattcagccataaaaaagaatgaaatcctgtcatttgcagcaacatgtatggaactggaggccattttgttaagtgaaataagcgagg

SEQ ID NO: 18592 - DNA, 275 bp, Homo sapiens
  AC023796.22_73262
  Located on chromosome 12
  Distance between a terminus base of telomere on chromosomal short arm and 5'-terminus of this base sequence : 35645003
  Distance between 3'-terminus of neighbour sequence of sequence listing upward to telomere on chrosomal short arm and 5'-terminus of this base sequence : 70425
ggtgatggaaactgtattagtcagagttccccagagaaacagaaccaataggatacatacacacacacacacacacacacacacacacacacacatacatatatatatatatatatatatatatatatatatatatatatatatatatatatatatagagagagagagagagagagagagagagagagagagagagagagaaacgtattttaagactttggctcacactattgtggaggcttggcaagtccaaaatctgcagtgtagatcgtcaa

SEQ ID NO: 18593 - DNA, 101 bp, Homo sapiens
  DISO7_10003306
  Located on chromosome 12
  Distance between a terminus base of telomere on chromosomal short arm and 5'-terminus of this base sequence : 35753456
  Distance between 3'-terminus of neighbour sequence of sequence listing upward to telomere on chrosomal short arm and 5'-terminus of this base sequence : 108178
tcctttgtctagcgctctctctctctctctttctgtgtgtgtgtgtgtgtgagagagagagagagagagagagacagagttcttagctgaggctatcagat

SEQ ID NO: 18594 - DNA, 223 bp, Homo sapiens
  D12S1057
  Located on chromosome 12
  Distance between a terminus base of telomere on chromosomal short arm and 5'-terminus of this base sequence : 35875208
  Distance between 3'-terminus of neighbour sequence of sequence listing upward to telomere on chrosomal short arm and 5'-terminus of this base sequence : 121651
agagacagaagcagtaggatggatagaaggatggatggatggatggatagatagatagatagatagatagatagatagatagatagatagatgggaggggatttattagggaaattggctcatgggtatggaggatgagaagtcccatgacaggctatctctgagctgaagaccctgaggtgctggtagcatggcttagtccgagtcttaaaacgtcagaacc

SEQ ID NO: 18595 - DNA, 470 bp, Homo sapiens
  chr12.fa.O7frz.24820573
  Located on chromosome 12
  Distance between a terminus base of telomere on chromosomal short arm and 5'-terminus of this base sequence : 35958907
  Distance between 3'-terminus of neighbour sequence of sequence listing upward to telomere on chrosomal short arm and 5'-terminus of this base sequence : 83476
gaggacggagactttagtaagactgatgaagagtatggtcacagaaattccagtagagagaattaagggtgctgaggtgtttcttctgttcttcacacacacacacacacacacacacacacacacacacacacacacaaaggatcatgtgaatgggatgccacacaaccactcagggagcatggtacaggtagcctggctcctaggggttgcagagtctggtacccgacctaagcatgcaaaggtaagaaggcaagaaaccatggcaatgaaacagggacgcatggaatgagccacactttcacaactagtagggaagagatgggatctcctggaggtcatctgcggatcctgtggaagggagtcaattatgaccgctcccaccccacacactgaagaatttactgtcaggaggaagataacctcagcagaaagagactagagtagattatctaaggtagaagttgagg

SEQ ID NO: 18596 - DNA, 287 bp, Homo sapiens
  DISO7_10003303
  Located on chromosome 12
  Distance between a terminus base of telomere on chromosomal short arm and 5'-terminus of this base sequence : 35969784
  Distance between 3'-terminus of neighbour sequence of sequence listing upward to telomere on chrosomal short arm and 5'-terminus of this base sequence : 10407
gtaacctgttgtattggatgttatcttataatcctttaattttttcatttgtttacccaaataagaataatttagagttgtactgacaaaataacatttgtgtatttatgctttagatattgagtagaacatattgaatgatctacaaaacataccatttttataaacactttagttttgagttggagggctttgtgctcatggggtgtgtgtgtgtgtgtgtgtgtgtgtatgtgtgtgtgtgtatgtgtgtttccaggaaaatagcttagaaagcaacaccaagt

SEQ ID NO: 18597 - DNA, 153 bp, Homo sapiens
  DISO7_10003302
  Located on chromosome 12
  Distance between a terminus base of telomere on chromosomal short arm and 5'-terminus of this base sequence : 36035032
  Distance between 3'-terminus of neighbour sequence of sequence listing upward to telomere on chrosomal short arm and 5'-terminus of this base sequence : 64961
tcagtcatcaatagagtttggaggaaaagtgaatttctcacttatgtaaagaataaagaacaaatttattcgtgtatatatatatatatatatatatatatatatatgaaaaaatgttaagttgttcagttttggctgacacaaatcaatgga

SEQ ID NO: 18598 - DNA, 172 bp, Homo sapiens
  DISO7_10003300
  Located on chromosome 12
  Distance between a terminus base of telomere on chromosomal short arm and 5'-terminus of this base sequence : 36092070
  Distance between 3'-terminus of neighbour sequence of sequence listing upward to telomere on chrosomal short arm and 5'-terminus of this base sequence : 56885
aggtcaagtgcatgtttgaccttttgacccagggtgggtgagtgggtgggtgggggggccggccttccttccttccttccttccttccttccttccttccttccttccttccttccttccttccttcctttccagctatacagtactaaatgagaaagacactgtctctgcc

SEQ ID NO: 18599 - DNA, 177 bp, Homo sapiens
  DISD22_0008203
  Located on chromosome 12
  Distance between a terminus base of telomere on chromosomal short arm and 5'-terminus of this base sequence : 36326629
  Distance between 3'-terminus of neighbour sequence of sequence listing upward to telomere on chrosomal short arm and 5'-terminus of this base sequence : 234387
tcatatgtgaagtcccaagtggctgcattggaaagaaaaagaaagagaaagaaaggaagaaagaaagaaagaaagaaagaaagaaagaaagaaagaaagaaagaaagaaagaaagaaagaaggaaggaaggaaggaaggaaggaaggaaggaaggaagtccttccctggaactacag

SEQ ID NO: 18600 - DNA, 310 bp, Homo sapiens
  chr12.fa.O7frz.40363910
  Located on chromosome 12
  Distance between a terminus base of telomere on chromosomal short arm and 5'-terminus of this base sequence : 40139252
  Distance between 3'-terminus of neighbour sequence of sequence listing upward to telomere on chrosomal short arm and 5'-terminus of this base sequence : 3812446
tgaataaaattaagttaggtgcagtggctcatgcctgtaatcccagcacattaggaggccaaggcgggtggatcaacttaaggccaggagttcgagaccagccatggccaacatggcaaaaactcaggaggctgggtgcagtgagtcacttgaaccagtgaagtggaggttgcagtgagccgagattgcgccatggtgctgcagcctaggtgacagaatgagaccctgtctcaaaataataataataataataataataataataataataataataataataataaaaagattatcttggcatagtggt

SEQ ID NO: 18601 - DNA, 245 bp, Homo sapiens
  M12_40594157
  Located on chromosome 12
  Distance between a terminus base of telomere on chromosomal short arm and 5'-terminus of this base sequence : 40594133
  Distance between 3'-terminus of neighbour sequence of sequence listing upward to telomere on chrosomal short arm and 5'-terminus of this base sequence : 454571
cagccataactgaaacctcagagtcacacacacacacacacacacacacacacacacacacacgccacacctccttctccaccctcccttcaccaacaccctgcccctcccccctcatcccaactaagcttctcttgtgtttctggacaaaacgcaccagaccccaaggcctgttaattttcatttctcactctgtccaggcagcccacaccgtcctgcacgctccttcacacagtcacactcgg

SEQ ID NO: 18602 - DNA, 389 bp, Homo sapiens
  chr12.fa.O7frz.40588900
  Located on chromosome 12
  Distance between a terminus base of telomere on chromosomal short arm and 5'-terminus of this base sequence : 40724723
  Distance between 3'-terminus of neighbour sequence of sequence listing upward to telomere on chrosomal short arm and 5'-terminus of this base sequence : 130345
aagcacagtttaatagcacttaaggattcaggaatattaagaagaaaatgattgattattggtgctggttgcctgagtggtaattaggtatgtattagtcagggttctccagagagacagaaccaatagaaatggctcatcatacatatatacatatacacatatgcatttattataaatgataaatatattagtaatatacataagtaatatatacattagttatatatatatacatatatgtgtgtgtgtgtatatatatatatatatatatatatttgagaggggatttattaggaaaatttgctcacatgattatggaggctgaggagtcccatgacaggctgtctgcaagctggagaccctgggaagtcaatagcatggctcag

SEQ ID NO: 18603 - DNA, 101 bp, Homo sapiens
  DISD22_0008221
  Located on chromosome 12
  Distance between a terminus base of telomere on chromosomal short arm and 5'-terminus of this base sequence : 40988873
  Distance between 3'-terminus of neighbour sequence of sequence listing upward to telomere on chrosomal short arm and 5'-terminus of this base sequence : 263761
gggctgaatactgtcttcaactcagtgtgtgtctgtgtgtgtgtgtgtgtgtgtgtgtgtgtgtgtgtgtgttttgggaaagcatgaacagatatgaagag

SEQ ID NO: 18604 - DNA, 189 bp, Homo sapiens
  Z66876
  Located on chromosome 12
  Distance between a terminus base of telomere on chromosomal short arm and 5'-terminus of this base sequence : 41099579
  Distance between 3'-terminus of neighbour sequence of sequence listing upward to telomere on chrosomal short arm and 5'-terminus of this base sequence : 110605
aggctttcaggagacatcagcatgtatgtatatatgtgtgtgtgtgtgtgtgtgtgtgtgtgtgtgtatgtgtatttactgaataaatattaagtaaccaaatacctgtattggtaaatattacactgtatgacagacatttacatttaaagtttttttttaaatagaggaaaattaactgatgaaaag

SEQ ID NO: 18605 - DNA, 331 bp, Homo sapiens
  chr12.fa.O7frz.40793991
  Located on chromosome 12
  Distance between a terminus base of telomere on chromosomal short arm and 5'-terminus of this base sequence : 41140096
  Distance between 3'-terminus of neighbour sequence of sequence listing upward to telomere on chrosomal short arm and 5'-terminus of this base sequence : 40328
agatgaaagcctattatgctattcatatatttggaaattttccctctggtaatttatacaacatagatttgtcacattaaatgaaaatgtcattgaatttatgctttgattgtgtgtgtgtgtgtgtgtgtgtgttggattcccataaaaggagagattttttaaatacattcctgtgcactgtattaaaatatgatgttgaaaaatacttcttcttaatcttcaaaataacatcttttgaggaatggaatatccacatccctctgtaataaagtaagaaataaatctccctgcatgctgttgtgacctttgacaagtgtcatagctaact

SEQ ID NO: 18606 - DNA, 367 bp, Homo sapiens
  chr12.fa.O7frz.40866090
  Located on chromosome 12
  Distance between a terminus base of telomere on chromosomal short arm and 5'-terminus of this base sequence : 41169612
  Distance between 3'-terminus of neighbour sequence of sequence listing upward to telomere on chrosomal short arm and 5'-terminus of this base sequence : 29185
attctgaaacttgaatacagtcatttattttttaatcccataagagctttaaaaagtatcagccagtgtcaggccttgactggactcactggttaaaagaaaaaaaagaggatattacagtacaacataatatagcagggtacttcagaagcactaacaagggactttgggagcacctaatgggatgttgttctctccaacagagagagaagaaaaaatatgtcacactcaagaaattgaaagattgagtggatcataggcattaacagtggggtgtgtgtgtgtgtgtgtgtgtgtttgtgtgtttgtgtgtgtgtttgaaaaggaattagtgaagagaggtaggatggataagtcttaaacctgc

SEQ ID NO: 18607 - DNA, 438 bp, Homo sapiens
  chr12.fa.O7frz.40939954
  Located on chromosome 12
  Distance between a terminus base of telomere on chromosomal short arm and 5'-terminus of this base sequence : 41242920
  Distance between 3'-terminus of neighbour sequence of sequence listing upward to telomere on chrosomal short arm and 5'-terminus of this base sequence : 72941
cctaaggaaagtcagagcttactctagcctattttactgtgttctgaacacttccattagcctatagttgggcaaaataatctggcaacacagtacactgtggagcatcagttgtttacccagtgatcctgtggctgattgggagctgtggccaccgtccagcatcagaagagagtatcatgctgcttttctttctactaaatgtgtattgattttgcactatggtaaagaaaaatcttgctgaattattgtaagctgaggaccatctgtgtgtgtatgtatgtgtatatatatatatatatatatatatatatatatatatttaaatttcggcacatggttgttacccaaacttattttagtgaattagtttagtttttttttttttttttgctgatggaaactaatgaggtagtggtagtcacataagaaattcac

SEQ ID NO: 18608 - DNA, 404 bp, Homo sapiens
  chr12.fa.O7frz.41023563
  Located on chromosome 12
  Distance between a terminus base of telomere on chromosomal short arm and 5'-terminus of this base sequence : 41311250
  Distance between 3'-terminus of neighbour sequence of sequence listing upward to telomere on chrosomal short arm and 5'-terminus of this base sequence : 67892
gtgtccatcaacagatgaatagatacagaaaatgttttatatatatataaaatttatacacacacacacacacatatatatgtaaaacaatggaatattattcagccttaaaaaggaagaacatccatccatttgcaacaagatagatgagcctggaagacactatataagtgaaataagacagccataaaaagataaatactacatattgtaacttacatgaggattctaaaatagtcaaaattatagaagcagggagtagaatgatggtttcccgggattgaggggaagaagaaactggaaggtattatcaaggagcacaaaatttcagttatgtaagatgaataagtcatagagatctactatatacagtatagtacctatggttaacaatactgcactgt

SEQ ID NO: 18609 - DNA, 179 bp, Homo sapiens
  D12S331
  Located on chromosome 12
  Distance between a terminus base of telomere on chromosomal short arm and 5'-terminus of this base sequence : 41405630
  Distance between 3'-terminus of neighbour sequence of sequence listing upward to telomere on chrosomal short arm and 5'-terminus of this base sequence : 93976
acatgtaagagagtaagtttacaaaaaagtccttgatgtttgttgaatagtatagtgtgtgtgtgtgtgtgtgtgtgtgtgtgtgtgtgagagagagagagagagagagagagagagacagagagagagagagagataccaaaacaagtattattcagtatggagatgaataaatgtta

SEQ ID NO: 18610 - DNA, 116 bp, Homo sapiens
  DISO7_10003342
  Located on chromosome 12
  Distance between a terminus base of telomere on chromosomal short arm and 5'-terminus of this base sequence : 41513941
  Distance between 3'-terminus of neighbour sequence of sequence listing upward to telomere on chrosomal short arm and 5'-terminus of this base sequence : 108132
tgtgtatatggtatggtatgtcatgtatataacacatgtattcacacacacacacacacacacacacacattcacacattggactaaattatttacagaccctaagatgataagcc

SEQ ID NO: 18611 - DNA, 220 bp, Homo sapiens
  DISO7_10003341
  Located on chromosome 12
  Distance between a terminus base of telomere on chromosomal short arm and 5'-terminus of this base sequence : 41605934
  Distance between 3'-terminus of neighbour sequence of sequence listing upward to telomere on chrosomal short arm and 5'-terminus of this base sequence : 91877
aggaagtgggtagtcataattatgtagatcaacttagaaatccaaagcaaaaattggcgtgatattcttttgtataataataacaatatgtcctactattgtaattatgtcctatatatatatatatatatatatatatataatatgtcctattataattcaaatagtcattataactttgaactattaagtatatgtttttgattgccacaatggtcaa

SEQ ID NO: 18612 - DNA, 162 bp, Homo sapiens
  DISO7_10003343
  Located on chromosome 12
  Distance between a terminus base of telomere on chromosomal short arm and 5'-terminus of this base sequence : 41677166
  Distance between 3'-terminus of neighbour sequence of sequence listing upward to telomere on chrosomal short arm and 5'-terminus of this base sequence : 71012
cagtagccagagttactacaatgtgttatttaaaatgtctaactttctttttaacaaaaaagttacaagatatgcaaaaaggaagaagtgtgacacacacacacacacacacacacacacacacacacacacaggcaatagaaactgcctttgaagaggacc

SEQ ID NO: 18613 - DNA, 157 bp, Homo sapiens
  DISD22_0008232
  Located on chromosome 12
  Distance between a terminus base of telomere on chromosomal short arm and 5'-terminus of this base sequence : 41894044
  Distance between 3'-terminus of neighbour sequence of sequence listing upward to telomere on chrosomal short arm and 5'-terminus of this base sequence : 216716
tgcctcaaaggtctctaccaaaaacatgaagcatgaacaattatatatatatatatatatatatatatgttatatgcataacatttataatatatatgtacacacacacatacacagaataaaattatacttgaataactatattgccacatcggga

SEQ ID NO: 18614 - DNA, 425 bp, Homo sapiens
  chr12.fa.O7frz.41963382
  Located on chromosome 12
  Distance between a terminus base of telomere on chromosomal short arm and 5'-terminus of this base sequence : 42038681
  Distance between 3'-terminus of neighbour sequence of sequence listing upward to telomere on chrosomal short arm and 5'-terminus of this base sequence : 144480
tcttaaagaacatttaggaatgattaacattattaattttaggcaactggcatatccctgagtgctcagatttaaacaaaacttggacatgagaaatctgctagcataatactacacctatgggatgcggggcttgactgtccataaggaggtcattaaaatctttttttcatatatatatacatatatatatgatacacacacatatataaatataaaatatgtatgcatatgtatgtagagatgtgtgtgtgtatatatatatagagagagagagagagaggtggggtatgtgtgtgtagagagagagagaagtatgtatatgtataaatacataaatacagcgtgagagagagaggttttgtagttacaatgatcatcattacagaatcttcttattacttgtagacctttacttcctgaat

SEQ ID NO: 18615 - DNA, 145 bp, Homo sapiens
  DISO7_10000204
  Located on chromosome 12
  Distance between a terminus base of telomere on chromosomal short arm and 5'-terminus of this base sequence : 42074941
  Distance between 3'-terminus of neighbour sequence of sequence listing upward to telomere on chrosomal short arm and 5'-terminus of this base sequence : 35835
ccctatgctgcttacacttgaaaatttctctccagatagatagatagatagatagatagatagatagatagatagatagattgatttactatatatattttactataaatatatagtaaaaacttaacgaagtaaacatgcagaa

SEQ ID NO: 18616 - DNA, 442 bp, Homo sapiens
  chr12.fa.O7frz.42452999
  Located on chromosome 12
  Distance between a terminus base of telomere on chromosomal short arm and 5'-terminus of this base sequence : 42404492
  Distance between 3'-terminus of neighbour sequence of sequence listing upward to telomere on chrosomal short arm and 5'-terminus of this base sequence : 329406
cacatgcctatggttcaagctactcggtaggttgagatgggaggagcacatgagcctaggcaatagaggctgcagtgcactgtgatcgcaccattgcactccagcctgggcaacaaagtgagaccttgcctcaaaacaagaaagaaagcaagacaggaagcaagaaagcaggcaaggaaggaaggagggagggaggaaagaaggaaggaaggaaagaaggaaggaaggaaggaaagaaggaaggaaggaaagaaggaggaaggaaggaaagaagaaggaaggaaggaaggaaggaaggaaggaaggatggaaggaaggaaggaaggaaggaaggaaataattttttatttctgttttcaaatcatcctccagcatgatgatggttttaaaatatttacttcacagaaggcaacatttacttctacttcatccacttattcaa

SEQ ID NO: 18617 - DNA, 101 bp, Homo sapiens
  DISO7_10004916
  Located on chromosome 12
  Distance between a terminus base of telomere on chromosomal short arm and 5'-terminus of this base sequence : 42434067
  Distance between 3'-terminus of neighbour sequence of sequence listing upward to telomere on chrosomal short arm and 5'-terminus of this base sequence : 29133
ggcctcttcaaggataaattctcattcattcattctttgaaaaaaaaaaaatatatatatatatatatatgaaacccattgtgtgccaggcttaaacatac

SEQ ID NO: 18618 - DNA, 266 bp, Homo sapiens
  DISO7_10000223
  Located on chromosome 12
  Distance between a terminus base of telomere on chromosomal short arm and 5'-terminus of this base sequence : 42516057
  Distance between 3'-terminus of neighbour sequence of sequence listing upward to telomere on chrosomal short arm and 5'-terminus of this base sequence : 81889
tccttctcagtttcgctatagtcgtgtgtgtgtgtgtgtgtgtgtgttgtgtgtgtgtgtggtttaggcacatgtgtttacaaatttttacctggttctttcaaagatgattttttctgttttatttttaatatccttgtgcaatccttatatattttacttcttgatttattgatcttgatttaatatattcacatataaagaaaaagcagaatatatgtgtatttatatataaatatatgtttctgttcaattatcgtgtgctg

SEQ ID NO: 18619 - DNA, 213 bp, Homo sapiens
  D12S1048
  Located on chromosome 12
  Distance between a terminus base of telomere on chromosomal short arm and 5'-terminus of this base sequence : 42642930
  Distance between 3'-terminus of neighbour sequence of sequence listing upward to telomere on chrosomal short arm and 5'-terminus of this base sequence : 126607
aaggaaccaaggagtggaagtgaaagtgatgttttaacctaccataccaatgtcaccttcacaaaatccatgccattgtggactcttctgtcattgttttattattattattattattattattattatttaaacctattctgacaatttaattatgtggacttgtcaaaatgttatttcaagattgttcaaaaaaagggacctaagcagacc

SEQ ID NO: 18620 - DNA, 327 bp, Homo sapiens
  chr12.fa.O7frz.42766580
  Located on chromosome 12
  Distance between a terminus base of telomere on chromosomal short arm and 5'-terminus of this base sequence : 42717085
  Distance between 3'-terminus of neighbour sequence of sequence listing upward to telomere on chrosomal short arm and 5'-terminus of this base sequence : 73942
cagttcataagaattacctgagattgttaaaaaggaggaatcctgactctcatccctacagactccggcttagtagatctgatatgggacccaggaatctgcatttctaacagtgtctctgttgcttctaagagcacattccagaaacaaaaattttgatcaacctagatggagttaatgcttgtgcttcaacaaaacatacatataaagacgtgcgcgcgcgcgcttgcgcacacacacacacacacacacacacacacacacacacacacacccctgctcagattaagactatagaattgcttttaaatacctcaaggatcacca

SEQ ID NO: 18621 - DNA, 356 bp, Homo sapiens
  chr12.fa.O7frz.42887576
  Located on chromosome 12
  Distance between a terminus base of telomere on chromosomal short arm and 5'-terminus of this base sequence : 42921321
  Distance between 3'-terminus of neighbour sequence of sequence listing upward to telomere on chrosomal short arm and 5'-terminus of this base sequence : 203909
cagaagtctgacgtggaacaatcacttgtgcccaggagtttgaggttgcagtgacctatgattgtaccactgcattccagtctgggtgacagagtgagaccttgtctcttaatacacacacacacacacacacacacacacgaaatatttttcttatttaccctatttttacttttctgatcctcttcacttctttctgtagatccaggttgtgttcagtgtcatactctttctgctgtgcagcccagtttctaacaggtcacggactggtaccagtctactgcctttcacatttcttaaaatgtgggtttccctttatggggtttacagaggttactgatttctcctgtagtctg

SEQ ID NO: 18622 - DNA, 175 bp, Homo sapiens
  Z67269
  Located on chromosome 12
  Distance between a terminus base of telomere on chromosomal short arm and 5'-terminus of this base sequence : 43042670
  Distance between 3'-terminus of neighbour sequence of sequence listing upward to telomere on chrosomal short arm and 5'-terminus of this base sequence : 120993
ttaattcctttgatgatattcaccgtgtgtgtgtgtgtgtgtgtgtgtgagtgtatgtgtgtatgtgtgtatatgtataatcctgctctgaagggaagtttatattcactatacatgtgtatattcaaacacatacatacttaatgaatactctagggcttaccagatacatttg

SEQ ID NO: 18623 - DNA, 254 bp, Homo sapiens
  Z23595
  Located on chromosome 12
  Distance between a terminus base of telomere on chromosomal short arm and 5'-terminus of this base sequence : 43178969
  Distance between 3'-terminus of neighbour sequence of sequence listing upward to telomere on chrosomal short arm and 5'-terminus of this base sequence : 136124
aataatgtctctcacggtgctataaaccaagaaataattttttttataaaatcgaattggaatgaatcaccagagaaaagtgcctcctggctggtgattcatgatggtagaggaggcaccttaatgtaagtggaactgtttaatgatatttttccaattatctctctctcttaattatctctcttaaacacacacacacacacacacacacacacacacacacacacaccaggcacattatagacattactaca

SEQ ID NO: 18624 - DNA, 474 bp, Homo sapiens
  chr12.fa.O7frz.43212966
  Located on chromosome 12
  Distance between a terminus base of telomere on chromosomal short arm and 5'-terminus of this base sequence : 43287338
  Distance between 3'-terminus of neighbour sequence of sequence listing upward to telomere on chrosomal short arm and 5'-terminus of this base sequence : 108115
tgatgctaccaggatctctagtgtgaccatgtgcatatgagatatatgctgtttggtgtttaatgaaccacagcctacttctctcctgtgtgaagtgtgataatgaaacaaaatggccaaaagtagaaatagaaaggaaaagcaaaagtcgtgtcttaagaaaacaagcaaaaatctacacacacacacacacacacacacacacacacacacacacacaccagaagggttgaaatggtatattaccatactctaaaaatataattactttcaaagatgtttaccagtactatttagttgactgattatactataaaagaaaaggtctttgatgccatccacagtagaaataaagtgttaccagaaatgacaaaataaaatggtacaggaaaagacagtcatctgaatggaagtgatatggagccataaagactgaatgccacatctacttattacagaacgttatgaacaatc

SEQ ID NO: 18625 - DNA, 238 bp, Homo sapiens
  DISO7_10003345
  Located on chromosome 12
  Distance between a terminus base of telomere on chromosomal short arm and 5'-terminus of this base sequence : 43302189
  Distance between 3'-terminus of neighbour sequence of sequence listing upward to telomere on chrosomal short arm and 5'-terminus of this base sequence : 14377
ctcttgttattccaaattgtaacacaaaattattaagaactattaagattaggaagcattttattcttgttcttgtggacacacacacacacacacacacacaaagttgattgggatttcagacagggttttgccatattgcccaggctggcttcgatttttttcttgcttcacccaaaatgtcagttagataaaactgctgctgcaaaacatgactttcccttaacacgttggagag

SEQ ID NO: 18626 - DNA, 343 bp, Homo sapiens
  chr12.fa.O7frz.43298318
  Located on chromosome 12
  Distance between a terminus base of telomere on chromosomal short arm and 5'-terminus of this base sequence : 43329676
  Distance between 3'-terminus of neighbour sequence of sequence listing upward to telomere on chrosomal short arm and 5'-terminus of this base sequence : 27249
tggtaaagtggactgagttagtagtcatataaacctggatttgactttaatttcacgtttgcccatttaacagctatggctgagtcagttactcatttctaaagcagtgataattattttcccatcaccacatgttataaattaaatgcgctaatagatgtaacaatagattttactcaattaactctgcaattatctgggataatttttggatcgtaactattgtgtgtgtgtgtgtctgtgtgtgtggtgtgtgtgtgtgtctgtgtgtgtggtgtgtgtgtgtgtctgtgtgtgtgtgtgtgtgtgtatttagaattagattgttaatgcatgtaacctg

SEQ ID NO: 18627 - DNA, 177 bp, Homo sapiens
  DISO7_10003346
  Located on chromosome 12
  Distance between a terminus base of telomere on chromosomal short arm and 5'-terminus of this base sequence : 43362465
  Distance between 3'-terminus of neighbour sequence of sequence listing upward to telomere on chrosomal short arm and 5'-terminus of this base sequence : 32446
tgaaccttagaatctaagggtaccctaaagggtaaatcacattataaatttttctgtccaggagaatactattttagtcctgtcctgatttcatatatatatataaaatacacacacacacacacacacacacacactcacacacacacaaacatacactactcagacactcttgtg

SEQ ID NO: 18628 - DNA, 114 bp, Homo sapiens
  DISO7_10003348
  Located on chromosome 12
  Distance between a terminus base of telomere on chromosomal short arm and 5'-terminus of this base sequence : 43376051
  Distance between 3'-terminus of neighbour sequence of sequence listing upward to telomere on chrosomal short arm and 5'-terminus of this base sequence : 13409
gagcagctctgagatcagtatgattactagaggaaaaaggcaaatgtgtgtgtgtgtgtgtgtgtgtgtgtgtgtgtgtgtgtataaaataaaaactgtagcccaggacaatga

SEQ ID NO: 18629 - DNA, 292 bp, Homo sapiens
  DISO7_10003350
  Located on chromosome 12
  Distance between a terminus base of telomere on chromosomal short arm and 5'-terminus of this base sequence : 43468251
  Distance between 3'-terminus of neighbour sequence of sequence listing upward to telomere on chrosomal short arm and 5'-terminus of this base sequence : 92086
ggtctgctgaagactttggaaatcggaattttatatatttttccaaaaaacaatatgatgttcttgtaaaattttcaaagatctggttgaataaatgaagaaactatttttctatttttcttcttcctttctccttcctaaacatttctctctctctctctctctctgtcttctctctctctctctgtctctgtctctcttgcgctctctctctcactctctcgcactctcttgctctctttctccccctttttctttctccttattactcttggggccagaagatgttcat

SEQ ID NO: 18630 - DNA, 205 bp, Homo sapiens
  DISO7_10003352
  Located on chromosome 12
  Distance between a terminus base of telomere on chromosomal short arm and 5'-terminus of this base sequence : 43580117
  Distance between 3'-terminus of neighbour sequence of sequence listing upward to telomere on chrosomal short arm and 5'-terminus of this base sequence : 111574
gagactctttggatatacctctcactttttcagaaagttgttttgttcttcaaattaaatatgagagaaaatatgatcatatttttgtagtttaaatttgaaattattatttacttttccagtaaacatgcctaaatacagacacacacacacacacacacacacacacacacacacacacacacagcctctaactcagccgcat

SEQ ID NO: 18631 - DNA, 242 bp, Homo sapiens
  DID22N_0007239
  Located on chromosome 12
  Distance between a terminus base of telomere on chromosomal short arm and 5'-terminus of this base sequence : 43799412
  Distance between 3'-terminus of neighbour sequence of sequence listing upward to telomere on chrosomal short arm and 5'-terminus of this base sequence : 219090
ggcaaatacattcataatacatcctacaatacagttttacagaacattttttgaattgggcacagaaaatattttcttcccaattcaactaccttaaatcaatctgtctctcttcccctctctctctgtctgcccccctcttcctccccccttacctccctgtcccccccacaccccacacacacacacacacacacacacactcacagtcatacaaacacatccagatttcctggaatgaa

SEQ ID NO: 18632 - DNA, 214 bp, Homo sapiens
  G10067
  Located on chromosome 12
  Distance between a terminus base of telomere on chromosomal short arm and 5'-terminus of this base sequence : 43963607
  Distance between 3'-terminus of neighbour sequence of sequence listing upward to telomere on chrosomal short arm and 5'-terminus of this base sequence : 163953
gagatgcactgggctatgttctttctttttccaattagtttatgaaacctctgtatgaatattctattctttcaatagataaatggatgaacagatagatggatagatagatagatagatgatagatagatagatagatagatagatagatagatagataataaatagaattgctgagaaatttcaatcacaataattgcccatagaaccttcc

SEQ ID NO: 18633 - DNA, 391 bp, Homo sapiens
  chr12.fa.O7frz.43847267
  Located on chromosome 12
  Distance between a terminus base of telomere on chromosomal short arm and 5'-terminus of this base sequence : 43988471
  Distance between 3'-terminus of neighbour sequence of sequence listing upward to telomere on chrosomal short arm and 5'-terminus of this base sequence : 24650
ctagcttacaacgaatgtaacatcaaatagacaaatagacagtggaagaggaattgatattagtgatgacctcatgaatagttatagaaatgtgactcttatgaatgtctacctttgtttaatttgtgtgtgtgtatctacctttgcttaatttgtgtgtatctatctatctatctatatatatatatatatatatatatatataatgttaattcatttcttccccctccttttttcccctattattttacttaagttctactattcatgattaagtttataacgtcatctttagtttacagagtattcagatagatatgtagatatgcatatgattgttacaggaaatctcttttggttagaaggtaatacagtcttcatttgtatgagg

SEQ ID NO: 18634 - DNA, 170 bp, Homo sapiens
  D12S1589
  Located on chromosome 12
  Distance between a terminus base of telomere on chromosomal short arm and 5'-terminus of this base sequence : 44114257
  Distance between 3'-terminus of neighbour sequence of sequence listing upward to telomere on chrosomal short arm and 5'-terminus of this base sequence : 125395
gaaataatatctgccctgcccccagcaatgtggctactgtgatgaggtaatgaccttcacacacacatgcgcgcacacacacacacacacacacacacacacttttgtttgaagacactggttaactgtaaagcactgtccatgtgagttttaacactcagggaagtcac

SEQ ID NO: 18635 - DNA, 282 bp, Homo sapiens
  D12S1592
  Located on chromosome 12
  Distance between a terminus base of telomere on chromosomal short arm and 5'-terminus of this base sequence : 44204858
  Distance between 3'-terminus of neighbour sequence of sequence listing upward to telomere on chrosomal short arm and 5'-terminus of this base sequence : 90431
gctgagtgtggtggcacgtgcctgagtgggactccatctctacatatatatatatttttatatatatatatatatatatatatatatatatatatacacacacacacacacacacatacacacacatatgtatatatatacacatatgaatatatatatgaattatctgaaaaatgcctgaaatttactcaaatatcccaaaagatccgtaattgaatggaatttatatatcacaaattttagaaagattggggactgaaaatacactgttggaatagtctc

SEQ ID NO: 18636 - DNA, 180 bp, Homo sapiens
  AC020629.6_64297
  Located on chromosome 12
  Distance between a terminus base of telomere on chromosomal short arm and 5'-terminus of this base sequence : 44371322
  Distance between 3'-terminus of neighbour sequence of sequence listing upward to telomere on chrosomal short arm and 5'-terminus of this base sequence : 166182
gacgttagaacttgctggtaaggtccaaatttttatgtgacagtctacatcaggctactaggaaacacacacacacacacacacacacacacacacacacacacacagatgattatcgatctcatcaaggcttaggtatttcatggtatttcagattactgcagttataaagctaggtgc

SEQ ID NO: 18637 - DNA, 227 bp, Homo sapiens
  Z67199
  Located on chromosome 12
  Distance between a terminus base of telomere on chromosomal short arm and 5'-terminus of this base sequence : 44415260
  Distance between 3'-terminus of neighbour sequence of sequence listing upward to telomere on chrosomal short arm and 5'-terminus of this base sequence : 43758
tgtatttctatggctaaattgctataaaactcctgaactacttgaaaataatagaatgttacaggtctgaaagtttctaaaatcttctcaaatccaagcataaattttaagtttaaatgaggcatatattacacacacacacacacacacacacacgtaaaagtgctttgtagagttgatacattttacaaatgtaagatgtgatcacgtataaaatcaatctggtc

SEQ ID NO: 18638 - DNA, 219 bp, Homo sapiens
  D12S1653
  Located on chromosome 12
  Distance between a terminus base of telomere on chromosomal short arm and 5'-terminus of this base sequence : 44566692
  Distance between 3'-terminus of neighbour sequence of sequence listing upward to telomere on chrosomal short arm and 5'-terminus of this base sequence : 151205
gtaccatgctgttttgataactatatatatgtatatgtgtgtgtgtgtgtgtgtgtgtgtgtgtgtgtgtgtgtgtgtgtattcttttgagatggagtgtcactctcttgcccgggctggagtgcagtggcgccatctcggctcactgcaacctccacctcctgggtttaagtgattctcctgtctcagcttctggagtagctcggattacaggcacct

SEQ ID NO: 18639 - DNA, 455 bp, Homo sapiens
  chr12.fa.O7frz.44585817
  Located on chromosome 12
  Distance between a terminus base of telomere on chromosomal short arm and 5'-terminus of this base sequence : 44827182
  Distance between 3'-terminus of neighbour sequence of sequence listing upward to telomere on chrosomal short arm and 5'-terminus of this base sequence : 260271
cactattccaagatgaactatgttttatatatattaaattgtacactattagatttcatgttggtccccagagatagttttaggccgatcatgcctttaaacaaacaaacaaacaaacaaacaaacaacaacaacaacaacatacccgggaggctctgcctggtttcacagctgggccctggcctgtgggtttcagcctgtgatggactcttaggtaaaatcgacctgagcttccagccttgtgttgcatgttgtgcatccttcactttcgcagacactttattttctcaacatcctattgatatttaggagacagagtagctgcagtgatgtgtcacagacactcaggaactttacaacacccaggacgctggatttctggtctggaagatggtgagtagtaggagctgcctttactgagagcctggctttaaattgttctttaggctaaagga

SEQ ID NO: 18640 - DNA, 331 bp, Homo sapiens
  chr12.fa.O7frz.44926790
  Located on chromosome 12
  Distance between a terminus base of telomere on chromosomal short arm and 5'-terminus of this base sequence : 44962327
  Distance between 3'-terminus of neighbour sequence of sequence listing upward to telomere on chrosomal short arm and 5'-terminus of this base sequence : 134690
ctgttagccaaaccaatgtactcagctcaatggagaaagtaggggaggttgtctcgtgtgtgtgtgtgtgtgtgtgtgtgtgtgtgtgtgtgtgtgtgtgtacacagtatacatcaacgagagggctgtcattggattttgtattgggtcccattttaacttgttgcattatgtcactgcccctacactgtaacaaggatcattgttttgaagactggcttctcagggcttttgttaagctaaaaataataaagattataagaaattattgaagtagaattgggaaagtccacgactctgagactgcttttaatgcaataaagcattcact

SEQ ID NO: 18641 - DNA, 249 bp, Homo sapiens
  DISO7_10003355
  Located on chromosome 12
  Distance between a terminus base of telomere on chromosomal short arm and 5'-terminus of this base sequence : 45018013
  Distance between 3'-terminus of neighbour sequence of sequence listing upward to telomere on chrosomal short arm and 5'-terminus of this base sequence : 55355
gagataagacacaaatggtcagacaaaacaggagatatatatgtgtgtgtgtgtgtatatgtgtatatgtgtgtatatatgtaaatgtatgtgtgtgtatatatgtatatatgtgtatgtatgtgtgtgtgtatgtgtgtgtatatatatatatatatatgctgcagcagttttgcaatgtattttttattctcagatttgcaacttaaattcaaagtaaattctttaaggctaactattggcccattc

SEQ ID NO: 18642 - DNA, 121 bp, Homo sapiens
  DISO7_10003357
  Located on chromosome 12
  Distance between a terminus base of telomere on chromosomal short arm and 5'-terminus of this base sequence : 45045321
  Distance between 3'-terminus of neighbour sequence of sequence listing upward to telomere on chrosomal short arm and 5'-terminus of this base sequence : 27059
tccaaagttgaattctgttctgtctgtccatccatccatccatccatccatccatccatccatccatccatcctgagtaacattaaagagttatttttcaaataatgacatggacacaatt

SEQ ID NO: 18643 - DNA, 243 bp, Homo sapiens
  D12S1663
  Located on chromosome 12
  Distance between a terminus base of telomere on chromosomal short arm and 5'-terminus of this base sequence : 45324518
  Distance between 3'-terminus of neighbour sequence of sequence listing upward to telomere on chrosomal short arm and 5'-terminus of this base sequence : 279076
gcccatgatactaagtgagaaataccagttgcaaagtaatatggatagtatggttctttttttgtaaaaacaaaacacacacacacacacacacacacacacacacacacacagacagaataatactttatatatgtttatgatttgtttgaatgtacaggaagctgtgaaaggatacactcaagttcttaaaactgtatcttagtgtgtgcatgtatatcttaggattgtttcacgttttac

SEQ ID NO: 18644 - DNA, 455 bp, Homo sapiens
  chr12.fa.O7frz.46281946
  Located on chromosome 12
  Distance between a terminus base of telomere on chromosomal short arm and 5'-terminus of this base sequence : 45489238
  Distance between 3'-terminus of neighbour sequence of sequence listing upward to telomere on chrosomal short arm and 5'-terminus of this base sequence : 164477
ctaatcagcatccagtgaatataaaagaggcagaaaaatgtgaaaaggagagactggcctagcctcccagcttacctctttctcccatgctggatgcttcctgccctccaacatcagactccaggttcttcagttttgggactcggactggctctccttgctcttcaacttgtagacagcctattgtgggaccttgtgattgtgtaagttaatccttaataaactacacacacacacacacacacacacacacacacacacacacacacacacttattagttctgcccctctagggaatcctgagtaatattgattttggtaccaggagtagttgtagaggaacagaatattaaggatggagttctttcattggttttgggtttctggagttggcttcttaatatgattagaccccaaaatgctaaggactctacttctaatggtatggagaaca

SEQ ID NO: 18645 - DNA, 131 bp, Homo sapiens
  DISO7_10004917
  Located on chromosome 12
  Distance between a terminus base of telomere on chromosomal short arm and 5'-terminus of this base sequence : 45632509
  Distance between 3'-terminus of neighbour sequence of sequence listing upward to telomere on chrosomal short arm and 5'-terminus of this base sequence : 142816
tggttaatgctgaagatgaaacagtttatatagttctgctcattttcagacctaaaagacatacacacacacacacacacacacacacacacacacacacacacacacgtgctcctactttcttatagtgt

SEQ ID NO: 18646 - DNA, 157 bp, Homo sapiens
  DISO7_10000014
  Located on chromosome 12
  Distance between a terminus base of telomere on chromosomal short arm and 5'-terminus of this base sequence : 45779343
  Distance between 3'-terminus of neighbour sequence of sequence listing upward to telomere on chrosomal short arm and 5'-terminus of this base sequence : 146703
cagcttccagctaggagcttataaaaacaaattaaacaaactactgttactacacacacacacacacacacacacacacacacacacagacacacacacccctacacttagagaaattcttgactagaaataaactgtcctaaattgaatatcagca

SEQ ID NO: 18647 - DNA, 184 bp, Homo sapiens
  DISO7_10000231
  Located on chromosome 12
  Distance between a terminus base of telomere on chromosomal short arm and 5'-terminus of this base sequence : 45917282
  Distance between 3'-terminus of neighbour sequence of sequence listing upward to telomere on chrosomal short arm and 5'-terminus of this base sequence : 137782
tagtcttacctttcagcaggtcaaaaacacacacatacacatatatatgtggcatatatatatatatatatatatatatatatatatatgattttaggtagttttgcctttcagcaggtcaaaaacaaattaatggatgaaaaagattgtaatctttctcccaatgtgtgcaatgatctcctca

SEQ ID NO: 18648 - DNA, 155 bp, Homo sapiens
  DISO7_10000232
  Located on chromosome 12
  Distance between a terminus base of telomere on chromosomal short arm and 5'-terminus of this base sequence : 45953492
  Distance between 3'-terminus of neighbour sequence of sequence listing upward to telomere on chrosomal short arm and 5'-terminus of this base sequence : 36026
tccagaaggacatatctaaatgacaaatatgtatctatatgggtgtatacacacacacacacacacacacacacactttcctacacacatttcttactctcttataaaaatgagtaaagtatactttttcaggaggattcaatatgaaatcacaa

SEQ ID NO: 18649 - DNA, 338 bp, Homo sapiens
  chr12.fa.O7frz.46794890
  Located on chromosome 12
  Distance between a terminus base of telomere on chromosomal short arm and 5'-terminus of this base sequence : 45963951
  Distance between 3'-terminus of neighbour sequence of sequence listing upward to telomere on chrosomal short arm and 5'-terminus of this base sequence : 10304
ctaatgttagaacagaggtccactggcacaacttcaagtttgtagtttttgatagataaaggcaacatttacaaatgtctggtacctacccaccaactactttctctctctctctctctctctctctctctctctctctctctctctctctcgttcccactcttgccatgtgaaatgccttccccgaagcagaccatggtactgtttcctatagaccctgcagaactgtaagccaattaaaccccttttctttgtaaattacccaagctcaagtatttctttatagcaatgcaagaatggccttacacagtgtgctatctaatatgacagccagtagc

SEQ ID NO: 18650 - DNA, 134 bp, Homo sapiens
  DISO7_10004918
  Located on chromosome 12
  Distance between a terminus base of telomere on chromosomal short arm and 5'-terminus of this base sequence : 46071603
  Distance between 3'-terminus of neighbour sequence of sequence listing upward to telomere on chrosomal short arm and 5'-terminus of this base sequence : 107314
ggaatcataatgtgaaactcttgagaaacataattttctaaaagagaagatgacaaatatatatatatgtgtgtgtatatatatatatatatatatatatatatatatatatttctgaacaagtgaatgttggg

SEQ ID NO: 18651 - DNA, 200 bp, Homo sapiens
  DISO7_10000070
  Located on chromosome 12
  Distance between a terminus base of telomere on chromosomal short arm and 5'-terminus of this base sequence : 46259588
  Distance between 3'-terminus of neighbour sequence of sequence listing upward to telomere on chrosomal short arm and 5'-terminus of this base sequence : 187851
agtcagtagcacagcaggggcagcatatataagctttataaatacacacacacacacacacacacacgtatatatattctataatgctgcacatatgatactatacaaattttatcctgcaaaattttataataatatatttttcccttttgaactcatgttccattttgttctcacaaagccctggagacttgatagca

SEQ ID NO: 18652 - DNA, 110 bp, Homo sapiens
  DISO7_00032840
  Located on chromosome 12
  Distance between a terminus base of telomere on chromosomal short arm and 5'-terminus of this base sequence : 46337863
  Distance between 3'-terminus of neighbour sequence of sequence listing upward to telomere on chrosomal short arm and 5'-terminus of this base sequence : 78075
atcctcaatgccaacctcgtcaccccccccccccacacacacacacacacacacacatacaagcccaccatcgcgcaagaaactcgaccccgtctacctcggttcagtgg

SEQ ID NO: 18653 - DNA, 249 bp, Homo sapiens
  DISO7_10003368
  Located on chromosome 12
  Distance between a terminus base of telomere on chromosomal short arm and 5'-terminus of this base sequence : 46507389
  Distance between 3'-terminus of neighbour sequence of sequence listing upward to telomere on chrosomal short arm and 5'-terminus of this base sequence : 169416
gacagcaaggacaatcttaggggtgtgtgtgtgtgtgtgtatgtgtgtgagagagagagagagagcacgagagggaaaagggagggaggaagagagagagaaagaaagaaaataaaagttttattaggaaagtagtaacttgaatatttttctgtttgcattctctttattaacatttcatgctgtttaaacaaaaatttttttgaataaaaagaaaacacaaacatataaagcacatatcggtaagac

SEQ ID NO: 18654 - DNA, 354 bp, Homo sapiens
  chr12.fa.O7frz.45783305
  Located on chromosome 12
  Distance between a terminus base of telomere on chromosomal short arm and 5'-terminus of this base sequence : 46513079
  Distance between 3'-terminus of neighbour sequence of sequence listing upward to telomere on chrosomal short arm and 5'-terminus of this base sequence : 5441
atcattctcagcaaactaacataggaacagaaaactaaacaccacatgtcctcacccataagtgggagtcgaacaatgagaacatatggacacagggaggggcctgttgggggatggggagttaggggagggatagcattaggagaaatacctaatgtaaatgacggcttgatgggtgcagcaaaccaccatggcatgcgtatacctatgtaacaaacctgcacgttctgcacatgtatcccagaacttaaactataataatcaaaataaaataaaataaaataaaataaagagggaaagtctattcagtcgttcaattattcattcatccaacatttattgagtgaccatgat

SEQ ID NO: 18655 - DNA, 103 bp, Homo sapiens
  G08970
  Located on chromosome 12
  Distance between a terminus base of telomere on chromosomal short arm and 5'-terminus of this base sequence : 46598989
  Distance between 3'-terminus of neighbour sequence of sequence listing upward to telomere on chrosomal short arm and 5'-terminus of this base sequence : 85556
tattggacagtaaagaaacctgctgtatataaagatagatgatagatagaagatagatagatagatagatagatagatagacgagatagatgcacatctgtgt

SEQ ID NO: 18656 - DNA, 280 bp, Homo sapiens
  chr12.fa.O7frz.45658880
  Located on chromosome 12
  Distance between a terminus base of telomere on chromosomal short arm and 5'-terminus of this base sequence : 46625676
  Distance between 3'-terminus of neighbour sequence of sequence listing upward to telomere on chrosomal short arm and 5'-terminus of this base sequence : 26584
ctactcaggagactgattcagtataatcgcttgaacctgggaggcggaggttgcagtgagccgagatcacgcctttgcactactaggggacaagagtgagacttcgtctcaaaaaaaaaaaaaaaaaaaaaaatatatatatatatatatatatataatttagttgtgcctcttatctaggcaactctccttccttccagagaaaactcctattctgatttttatttccagagattcgtttttttcttgttcttgtaagtagaactatacagcgtcatct

SEQ ID NO: 18657 - DNA, 124 bp, Homo sapiens
  DISO7_10003366
  Located on chromosome 12
  Distance between a terminus base of telomere on chromosomal short arm and 5'-terminus of this base sequence : 46653002
  Distance between 3'-terminus of neighbour sequence of sequence listing upward to telomere on chrosomal short arm and 5'-terminus of this base sequence : 27046
gatcatgacagcaagtttatacttctaatttaaatttcttgttatttggtttgtgtgtgtgtgtgtgtgtgtgtgtgtgtgtgtgtgtttgtgtgtgcatgtgtgtgtgtgcgtgattggtctt

SEQ ID NO: 18658 - DNA, 471 bp, Homo sapiens
  chr12.fa.O7frz.45439033
  Located on chromosome 12
  Distance between a terminus base of telomere on chromosomal short arm and 5'-terminus of this base sequence : 46774815
  Distance between 3'-terminus of neighbour sequence of sequence listing upward to telomere on chrosomal short arm and 5'-terminus of this base sequence : 121689
gtaagaatgaagacatgatcgtttctcacagcgaatggtatttgatagtggatgttcaggagaaagatgaaacacacacacacacacacacacacacacacacacacaccctcttaaaacagctcaacaatgaatgaatgctctctatatagtaatcatttttagcgttactcatttaataaattataactcgtattacaaaaacaaaaagcaaaattctgttggtcccataagaatatgacccctaaataaacaggagtctgtatgtggcactgttggaaaaattttgctttatttcaacaaataaactaatgagaaaaattttcataccaccaacttgcttttcatatattttatactctcttttttcttgcgtttaatcaggttcctgatcagttgttttgactccatcagtatctcaagcagttatataaaggattaaacagtatcttgacaaatatgttagaggac

SEQ ID NO: 18659 - DNA, 106 bp, Homo sapiens
  DISO7_10003361
  Located on chromosome 12
  Distance between a terminus base of telomere on chromosomal short arm and 5'-terminus of this base sequence : 46911406
  Distance between 3'-terminus of neighbour sequence of sequence listing upward to telomere on chrosomal short arm and 5'-terminus of this base sequence : 136120
acactggttgagtggttctgttctatctatctatctatctacctatctatctatcatctatctatcatctatctatcatctctctgcctatatctatccttctgtt

SEQ ID NO: 18660 - DNA, 143 bp, Homo sapiens
  HUMUT554
  Located on chromosome 12
  Distance between a terminus base of telomere on chromosomal short arm and 5'-terminus of this base sequence : 47013653
  Distance between 3'-terminus of neighbour sequence of sequence listing upward to telomere on chrosomal short arm and 5'-terminus of this base sequence : 102141
gtctcttgtacatcatggtgggtggcattcagctttaacacattatttcaacacacacacacacacacacacacacacacacagagctgtagaagtaggatttcattttagttgcaaatcttaaagctgtaagcaaagtgaat

SEQ ID NO: 18661 - DNA, 193 bp, Homo sapiens
  DISO7_10000071
  Located on chromosome 12
  Distance between a terminus base of telomere on chromosomal short arm and 5'-terminus of this base sequence : 47157928
  Distance between 3'-terminus of neighbour sequence of sequence listing upward to telomere on chrosomal short arm and 5'-terminus of this base sequence : 144132
tctatgacttctggtacacaagaagaaaattcctgctgtgcaataataataataataattgtcattgttattactattacactgagataaaagactatgaaaaatagtcaagaaacatacacacacacacacacacacacacacagagagagagagagagaaaaacagagaattagtatctcatgacctcagg

SEQ ID NO: 18662 - DNA, 101 bp, Homo sapiens
  DISO7_10000072
  Located on chromosome 12
  Distance between a terminus base of telomere on chromosomal short arm and 5'-terminus of this base sequence : 47196417
  Distance between 3'-terminus of neighbour sequence of sequence listing upward to telomere on chrosomal short arm and 5'-terminus of this base sequence : 38296
ttggcatatttatatgttcatgcatgcatgtatgtgtgtgtgtgtgtgtgtgtgtgtgtgtgtgtgtgtgtgtgtgtgtgtagaatctcctgccaatcaga

SEQ ID NO: 18663 - DNA, 196 bp, Homo sapiens
  DISO7_10000073
  Located on chromosome 12
  Distance between a terminus base of telomere on chromosomal short arm and 5'-terminus of this base sequence : 47251639
  Distance between 3'-terminus of neighbour sequence of sequence listing upward to telomere on chrosomal short arm and 5'-terminus of this base sequence : 55121
gctgaaggatagagacttcagactagagatgctaaaaagtaccagcatcatcatttataattatatataatttaccatattattgacatcatttataatgatgttaattatttactatgtccatatatatatatatatatatatagagagagagagagagagaacgtttcatttaaccatctccaacaccctctga

SEQ ID NO: 18664 - DNA, 464 bp, Homo sapiens
  chr12.fa.O7frz.47329976
  Located on chromosome 12
  Distance between a terminus base of telomere on chromosomal short arm and 5'-terminus of this base sequence : 47298293
  Distance between 3'-terminus of neighbour sequence of sequence listing upward to telomere on chrosomal short arm and 5'-terminus of this base sequence : 46458
tcaaggttcatccatattgtagcattatcagtaagtacttcattcttttttatgggcaaataatattccactatatggatataccacattttgtctacacactgagtaatactacttatataaaagtacaaaaagaggcaaaactaagaagttagaagttaggatagaggatacccttggaaggagcagatagtgagtgggaggggatacctgggggatcttctggcttctactgctagatctgtgagctggatatacaggtgatttgtactgttctttagaaaatgtcaaagtacatgcacaatatgattagatttttatgtatgtatatgtatatatatgtatatatatatatatacacacacacacacacaattctcagcttcttcacttgtgaaatagaggtagtaaaagtagctacttcataaaaattttgtaaggattaattgacatcaaatgtaagg

SEQ ID NO: 18665 - DNA, 230 bp, Homo sapiens
  DISO7_10000074
  Located on chromosome 12
  Distance between a terminus base of telomere on chromosomal short arm and 5'-terminus of this base sequence : 47309116
  Distance between 3'-terminus of neighbour sequence of sequence listing upward to telomere on chrosomal short arm and 5'-terminus of this base sequence : 10359
catgaagagcttccttacccttcttattttcaagtgtgtgtgtgtgtgtgtgtgtgtgtgtgtgtgtgagagagagagagagagagagagagagagagatgtaatttttgcagatcttaagtttggagagaaaagacacagcgtttgccaaacctgtgtgatttaaattaaaagtctatccttctgtttctatataatcttgtatgtgggggtgccacatgataatactt

SEQ ID NO: 18666 - DNA, 332 bp, Homo sapiens
  AC022025.4_232539
  Located on chromosome 12
  Distance between a terminus base of telomere on chromosomal short arm and 5'-terminus of this base sequence : 47371235
  Distance between 3'-terminus of neighbour sequence of sequence listing upward to telomere on chrosomal short arm and 5'-terminus of this base sequence : 61889
taaatgtaatggtgaaactacgtctctactaaaaaatacaaaaattagccaggtgtggtggcatgcgcctgtaatcccagctactcaggaggctgaggcacgagaatcacttgaacctgggaggagaaggttgcagtgagccaagatcatgccactggacccagcctgggcaacagagtgagactctatctctaaataaataaataaataaataaataaataaataaataaataaataaataaaatgtaagcaaacattctaattttttcttcccaagccccagtaggtcatattgtgcactgatctattgtcacagcatagtcagttcatc

SEQ ID NO: 18667 - DNA, 434 bp, Homo sapiens
  AC008127.10_60836
  Located on chromosome 12
  Distance between a terminus base of telomere on chromosomal short arm and 5'-terminus of this base sequence : 47380594
  Distance between 3'-terminus of neighbour sequence of sequence listing upward to telomere on chrosomal short arm and 5'-terminus of this base sequence : 9027
atacttcctggcttaaacatacagaggggcagtttttattctaaaagaagtgtgtgattcatttcttctcatatacttttagaagtgagacccacacagatgttagaaaagaggtactcccacttccagctaagatggagtaatagggaccagatttatcctcccatcaggcacacacacatacacacatacacacacatacacacacacacacacacacacacacacacacacacatatgaaacaatgattttcaagacatttaactttaggaaatgaaggacagtgatgactgaaatgatttttaacagagtttatttttagagcagttttaggttcacagcaaaattgaaagtacagagttccatacaccctctacttttccccacctcgcccctgacagacacacactgtcaacatcctaaaccagagtg

SEQ ID NO: 18668 - DNA, 282 bp, Homo sapiens
  AC009248.6_68332
  Located on chromosome 12
  Distance between a terminus base of telomere on chromosomal short arm and 5'-terminus of this base sequence : 47542427
  Distance between 3'-terminus of neighbour sequence of sequence listing upward to telomere on chrosomal short arm and 5'-terminus of this base sequence : 161399
tatgaggcttagcctggtaatatagtgagacctcatctctacaaaaacgttaaaaaattagctgagcgtggtagcatgcacttgtagttcgagctacttgaaaggctgaggcaggaggattgcttgatcccaggaagtggaggttgccgtgagccaagattgtgccactgccctccagcctgggtgacagaacaagaccctgtctcaaaaaacaagtgtgtgtgtgtgtgtgtgtgtgtgtgtgtgtgtgtgtataatatggctctagttctttgagttatg

SEQ ID NO: 18669 - DNA, 237 bp, Homo sapiens
  AC009248.6_2843
  Located on chromosome 12
  Distance between a terminus base of telomere on chromosomal short arm and 5'-terminus of this base sequence : 47607987
  Distance between 3'-terminus of neighbour sequence of sequence listing upward to telomere on chrosomal short arm and 5'-terminus of this base sequence : 65278
acctgtacctaaactgcattaaactaaaacagaccaaaaaagattgcatatatgtgttactttcacccactttagaaatcattcctcatcctttttttcttccccttttcacatatatgtgtgctctctccctctctctctgttctctctctctctctctcacacacacacacacacacacaaaactttaattgtccctgtctagactgtctccttgaaatatgccaactttaaatc

SEQ ID NO: 18670 - DNA, 466 bp, Homo sapiens
  AC008124.8_136677
  Located on chromosome 12
  Distance between a terminus base of telomere on chromosomal short arm and 5'-terminus of this base sequence : 47900817
  Distance between 3'-terminus of neighbour sequence of sequence listing upward to telomere on chrosomal short arm and 5'-terminus of this base sequence : 292593
caagtctgattgttcctgaactgcagccagctctctcacttccattctcttgtggggagcattcatattttattattattattattattattattattattattattattattattttagatggagtcttgctttgtcacccaggctggagtgcagtggtgcattctcagctcactacaacctccacctctcaggttcaagccattctcctgcctcagcctcccaagtaactggcattacaggcacgtgccaccacgcccagctaatttttgtatttttagtagagaccgggtttctccatgttggccagtctggtctcaaacttttgacctcaagtgatccacccaccttggcctcccaaagggctgggattacagccgtgagccactgcgaccagctgcatttatattttaatgcacacagcacaaagtagaaattcaaaagtgattgtcaatggctgaattag

SEQ ID NO: 18671 - DNA, 217 bp, Homo sapiens
  AC008124.8_106584
  Located on chromosome 12
  Distance between a terminus base of telomere on chromosomal short arm and 5'-terminus of this base sequence : 47930878
  Distance between 3'-terminus of neighbour sequence of sequence listing upward to telomere on chrosomal short arm and 5'-terminus of this base sequence : 29595
tgtagtccatgtcagaataattgtctatatgttatgatatataatatatagtgtcatatttatataaaagtacataatttagagctatgcatttataacactatatatacatttatctttatacacacacacacacacacacacacacctcaaacttgcaaaccaactagtctgtataagttacttacagttagtgaattaatcagccagataagtt

SEQ ID NO: 18672 - DNA, 229 bp, Homo sapiens
  AC009464.7_98361
  Located on chromosome 12
  Distance between a terminus base of telomere on chromosomal short arm and 5'-terminus of this base sequence : 48084494
  Distance between 3'-terminus of neighbour sequence of sequence listing upward to telomere on chrosomal short arm and 5'-terminus of this base sequence : 153399
gagttcctgtttatagcctttctttactaacaatgttgctttctctcccggccgttattaaaaatgtgtgtttgcgtgcgtgtgtgtgtgtgtgtgtgtgtgtatgtgtgtgtgtgtgtgttgagacgaagttttgccctatcgtccaggcagctggagtgcagtggcacaatcttggctcactgtaacctcggcctcccagattcaaacaattcttgtacttcagcca

SEQ ID NO: 18673 - DNA, 444 bp, Homo sapiens
  AC010172.19_194752
  Located on chromosome 12
  Distance between a terminus base of telomere on chromosomal short arm and 5'-terminus of this base sequence : 48297212
  Distance between 3'-terminus of neighbour sequence of sequence listing upward to telomere on chrosomal short arm and 5'-terminus of this base sequence : 212489
atactggttgtagaagctacgtacttggtgtgtggataagttcactatctcctatggggttggaatgacagaggtcttttgaagcttatcccatttccgtgtggtgtgcacttatttatttatttatttatttatttatttatttatttattccccagtattctatttactgagttgatgattcaggtctcaggtgagtagggaagattttcctcggtagaaactggttgtagctaaagcaggtgggtaagtgcaatggccagtggcgggcagagatcccagccttgatgatggtagctgggggagctctcaattagatgcactgaggtcttaacaggggaaagggtaggagccaccccagctccccctgccaggccagcaggaaagctgtccacctcccagactcactcctgtcccaatgtttcagctattcagattagacag

SEQ ID NO: 18674 - DNA, 243 bp, Homo sapiens
  DISO7_10003369
  Located on chromosome 12
  Distance between a terminus base of telomere on chromosomal short arm and 5'-terminus of this base sequence : 48399500
  Distance between 3'-terminus of neighbour sequence of sequence listing upward to telomere on chrosomal short arm and 5'-terminus of this base sequence : 101844
cactcttcatgggttcaggggaaaggagagaagagagagcgagagagagcgagcgagagagcgagagagcgagagagagagagagagagagagagagaggagaggagagagaggagaggagaggaggggaggggaggggaggggagaagaggggaggggaggagaggagaaagagggagagagagagaggcttttcaacacaccctgttttggaaagacagctctaactagattacagaggaa

SEQ ID NO: 18675 - DNA, 174 bp, Homo sapiens
  DISO7_10003370
  Located on chromosome 12
  Distance between a terminus base of telomere on chromosomal short arm and 5'-terminus of this base sequence : 48409872
  Distance between 3'-terminus of neighbour sequence of sequence listing upward to telomere on chrosomal short arm and 5'-terminus of this base sequence : 10129
ctaggcagatgtcctcacagaaatatatatatatatatatatatatagtgtgtgtgtgtgtgtgtgtgtgtgtgtgtgtgtgtgtgtgtgagtttgcagtggcctttgtgcagggttgtggttttttcagagtcttttatgatagttcttgttttcaagcatatgtgcaggaga

SEQ ID NO: 18676 - DNA, 451 bp, Homo sapiens
  chr12.fa.O7frz.48472557
  Located on chromosome 12
  Distance between a terminus base of telomere on chromosomal short arm and 5'-terminus of this base sequence : 48439519
  Distance between 3'-terminus of neighbour sequence of sequence listing upward to telomere on chrosomal short arm and 5'-terminus of this base sequence : 29473
gcggaaagagcattctattctatgctgggtgaggtgactcatacctttaatcccagcactttgggaggctgatgcggggggatcacttcagcccaggagttagagaccagcctgggcaacacagcaaggcctgtctctacaaaaattttaaaaactgctgggtatggcggtgcatgcctgtagtcccagctatttgggaggcccagttgattgaggctgcagtcatctgtgatcacgccactgcattccagcctgggtgacagagcaagactctgtctcaaaacacacaggtacacacacacacacacacacacacacacacacacaaacacttacacccccaaaaacattctacccagagggataagttacaagaaagtctctatggcaaagatatgcctggcatattcaaagaacagccaagaagccagtgtaactggaaccaattgag

SEQ ID NO: 18677 - DNA, 176 bp, Homo sapiens
  D12S1713
  Located on chromosome 12
  Distance between a terminus base of telomere on chromosomal short arm and 5'-terminus of this base sequence : 48439708
  Distance between 3'-terminus of neighbour sequence of sequence listing upward to telomere on chrosomal short arm and 5'-terminus of this base sequence : -262
ctatttgggaggcccagttgattgaggctgcagtcatctgtgatcacgccactgcattccagcctgggtgacagagcaagactctgtctcaaaacacacaggtacacacacacacacacacacacacacacacacacaaacacttacacccccaaaaacattctacccagagggat

SEQ ID NO: 18678 - DNA, 101 bp, Homo sapiens
  DISO7_10003373
  Located on chromosome 12
  Distance between a terminus base of telomere on chromosomal short arm and 5'-terminus of this base sequence : 48530769
  Distance between 3'-terminus of neighbour sequence of sequence listing upward to telomere on chrosomal short arm and 5'-terminus of this base sequence : 90885
aacctcatccagtttgcgcgcgcgcgcgcacacacacacacacacacacacagagagagagagagagagagagagaccagaagtctggctggtaagaaatt

SEQ ID NO: 18679 - DNA, 281 bp, Homo sapiens
  chr12.fa.O7frz.48682376
  Located on chromosome 12
  Distance between a terminus base of telomere on chromosomal short arm and 5'-terminus of this base sequence : 48625790
  Distance between 3'-terminus of neighbour sequence of sequence listing upward to telomere on chrosomal short arm and 5'-terminus of this base sequence : 94920
ctttccattcctgagttacttcacttagaataatagtctccaattccatccaggttgttgtgaaagccgttatttttttccttattatgactaattagtattccatggtgtgtgtgtgtgtgtgtgtgtatatatctccactcattgattgatgggcatttgagctggttccatatttttgcaattgcaaattgtaaagtaagtggattaagagcatgagataaggactagggctttagtttcagctgtactgctttctaggcaagttacttaacctgtta

SEQ ID NO: 18680 - DNA, 348 bp, Homo sapiens
  chr12.fa.O7frz.48808185
  Located on chromosome 12
  Distance between a terminus base of telomere on chromosomal short arm and 5'-terminus of this base sequence : 48812890
  Distance between 3'-terminus of neighbour sequence of sequence listing upward to telomere on chrosomal short arm and 5'-terminus of this base sequence : 186819
atgaaattagaacatactgctcacccccaggcaggtaggtgtcttgagtatcaaagggttagtatcaacagtgacagtatttaaaacgaatgtgctatcttactgagaaattaacatgtaggcagatgtataacttttaatttagttatttactaaataaataatgttttatttagtgcctgaaaatatcatacatagaaagatagttttgaccatctggaaactattttggggaaattaaaagtttggagctcaattctatcaataatcccctcctgcctttattattattattattattattattattatttccctgttgccttgtcctcaaatcagatcctaaag

SEQ ID NO: 18681 - DNA, 131 bp, Homo sapiens
  DISO7_10003377
  Located on chromosome 12
  Distance between a terminus base of telomere on chromosomal short arm and 5'-terminus of this base sequence : 48871766
  Distance between 3'-terminus of neighbour sequence of sequence listing upward to telomere on chrosomal short arm and 5'-terminus of this base sequence : 58528
tcctaagaaattatccttcctcccctcccctcccctttccttccttccttccttccttccttccttccttccatcttcctccttttctttctttctctctctctttcacaaataagactctccttagctgg

SEQ ID NO: 18682 - DNA, 268 bp, Homo sapiens
  AC008014.5_153952
  Located on chromosome 12
  Distance between a terminus base of telomere on chromosomal short arm and 5'-terminus of this base sequence : 49042209
  Distance between 3'-terminus of neighbour sequence of sequence listing upward to telomere on chrosomal short arm and 5'-terminus of this base sequence : 170312
actagatacaaacaggaccatgagagcccagaggaactagtatttaccagtctagaggagcaatagaccaggtgagcagagtgagagagaaaatgtgtgtgtgtgtgtgtgtgtgtgtgtgtgtgtgtgtgttagggttggaggactttgagagacagtcaaggggagaaagtagcctgtgaaaagaaggcatggatgatttttaaaaatattaaaatagtactgttaggggaataaatataatttgttatggtttgacacaggacat

SEQ ID NO: 18683 - DNA, 125 bp, Homo sapiens
  D12S85
  Located on chromosome 12
  Distance between a terminus base of telomere on chromosomal short arm and 5'-terminus of this base sequence : 49188734
  Distance between 3'-terminus of neighbour sequence of sequence listing upward to telomere on chrosomal short arm and 5'-terminus of this base sequence : 146257
aaatgaaagtcaaggggaacagtgagaaaagaagcgagaaaggtgcagcatcgtgtgagagtgtgtgtgtgtgtgtgtgtgtgtgtgtgtgtgtgtgtgtgtgtttgtaatggagtgagaggtgc

SEQ ID NO: 18684 - DNA, 372 bp, Homo sapiens
  chr12.fa.O7frz.49222174
  Located on chromosome 12
  Distance between a terminus base of telomere on chromosomal short arm and 5'-terminus of this base sequence : 49218583
  Distance between 3'-terminus of neighbour sequence of sequence listing upward to telomere on chrosomal short arm and 5'-terminus of this base sequence : 29724
ctgattgactataggaataccagaatggtggtggagaggggtaaggagttggtgtaatgtttcacacctcaaaggtattcaccaacactaggtcacaagctctatctctctctctttctcacacacacacacacacacacacacacacattctctggaaggtcatctcatcacagatttacagccctgtaatcacccttgaatgaacctcttcgggaggtacttgggaaagcaaggagagaagacagcttgctcattctgtcacatgcattattggatttgggcaattattttaatccccatagtagaaacttgctcatatttccatattggtacaaactcttcagtctacttaagtggatatccaaggaac

SEQ ID NO: 18685 - DNA, 107 bp, Homo sapiens
  DISO7_10003381
  Located on chromosome 12
  Distance between a terminus base of telomere on chromosomal short arm and 5'-terminus of this base sequence : 49325076
  Distance between 3'-terminus of neighbour sequence of sequence listing upward to telomere on chrosomal short arm and 5'-terminus of this base sequence : 106121
atacaacccaccgtctcacccaccatcagaaactcaattttttcctaaggtgcatcctgcgttgttgttgttgttgttgttgttttaaactccctccaacagacaca

SEQ ID NO: 18686 - DNA, 403 bp, Homo sapiens
  chr12.fa.O7frz.49426076
  Located on chromosome 12
  Distance between a terminus base of telomere on chromosomal short arm and 5'-terminus of this base sequence : 49396990
  Distance between 3'-terminus of neighbour sequence of sequence listing upward to telomere on chrosomal short arm and 5'-terminus of this base sequence : 71807
atggttactccttcgtttaactgcttgaaaaacagactattttccaaagtggctgcatcattttacatttccactagcagcacaggaggattccaatttctccacacccttgtcaacatttgttatctgaatttttgtttttagctatcttagtgggtgtgaagtggtatctcattgtagctttcatttgcatttctctgatgactaataacgttgagcatcttttcatgtacttattgaccatttgtgtatcttccttggagaaatatctatgaatatcatttttctattttttaattgggcaattaatcattttattattattattattattattatggagacagagtctcactctgtcccccaggctggagtgcagtggtgtgatcttggttcatgtaac

SEQ ID NO: 18687 - DNA, 102 bp, Homo sapiens
  DISO7_10003382
  Located on chromosome 12
  Distance between a terminus base of telomere on chromosomal short arm and 5'-terminus of this base sequence : 49410963
  Distance between 3'-terminus of neighbour sequence of sequence listing upward to telomere on chrosomal short arm and 5'-terminus of this base sequence : 13570
aagtctcaaggcagaaatatgtagtgtaggacagaggggtgtgtgtgtgcatgtgtgtgtgtgtgtgtgtgtgtgtgtgtgtgcatcttcctactgcctccc

SEQ ID NO: 18688 - DNA, 193 bp, Homo sapiens
  AC004242.1_92048
  Located on chromosome 12
  Distance between a terminus base of telomere on chromosomal short arm and 5'-terminus of this base sequence : 49565331
  Distance between 3'-terminus of neighbour sequence of sequence listing upward to telomere on chrosomal short arm and 5'-terminus of this base sequence : 154266
gctgagccagtgataatgtaagagtgtgtgtgtgtgtgtgtgtgtgaccattttccttggagaatcctgcttcttagactataatcctagatattataaatgaataaataaataaagaaccatgaaactctggttggcagcgcaggttaatgatctgattgtggcaagagaggaccttgagtcttatcaattt

SEQ ID NO: 18689 - DNA, 399 bp, Homo sapiens
  AC003670.1_81824
  Located on chromosome 12
  Distance between a terminus base of telomere on chromosomal short arm and 5'-terminus of this base sequence : 49659275
  Distance between 3'-terminus of neighbour sequence of sequence listing upward to telomere on chrosomal short arm and 5'-terminus of this base sequence : 93751
gccatattggacttctcctaaggatttcaactctggaatgtttcatcttgcatgccctcaaatacccaccccccaacacacacacacacacacacacacacacacacacacacacacacagagagagagagagagagagagagagacatgccccaatctctaggcaatcacacaatctcaagttcacagaaaattccatccaagaaaatacttgcatccagagagaaacacaatacagactcctccgtgtgcacccaagcagttgggcaaagcataacacttagttctatataaaactaaacctctcatttcaggaagtaatggaaaaaaaaaatcaaccaaaatttctgcattgagataataaaaatatcttttgttattccttaaaggcagattgta

SEQ ID NO: 18690 - DNA, 213 bp, Homo sapiens
  AC003686.1_45629
  Located on chromosome 12
  Distance between a terminus base of telomere on chromosomal short arm and 5'-terminus of this base sequence : 49711891
  Distance between 3'-terminus of neighbour sequence of sequence listing upward to telomere on chrosomal short arm and 5'-terminus of this base sequence : 52217
ctccttcaatggacctgtataaggaagaatatagtcttggaacacacacacacacacacacacacacacacacagaaagagagagagagagagtgagcagaagaggaaatcttggattctagctgtgcctgaactttcttccattgttcagttatatgagacaatatattttatcttttaagccagcctgaattgagtttctgttgctatgac

SEQ ID NO: 18691 - DNA, 382 bp, Homo sapiens
  AC003686.1_47200
  Located on chromosome 12
  Distance between a terminus base of telomere on chromosomal short arm and 5'-terminus of this base sequence : 49713283
  Distance between 3'-terminus of neighbour sequence of sequence listing upward to telomere on chrosomal short arm and 5'-terminus of this base sequence : 1179
cattggatatcagacaatggacagggatggaaaacaaatgaagtgggctatggttgtcccatattactgcctggagagactttttagtctctgtcacagggaggggggaccgagaaggagccaggtggtctccctgagttgaggagacttttctgggagggtaagaaaggaaactggagtgcacagggctgaatgctaaggaggaaaaatgagagagagtgagagagagagagagagagagagagagagagccctggggaccttcagagggttccccctgcaatcatctaactactgatcagtgcacgcagttggtgaagaaactcaaggtcaagaaactacctcctgaaaagattaaaaagaatttctggagctcacataa

SEQ ID NO: 18692 - DNA, 93 bp, Homo sapiens
  D12S1701
  Located on chromosome 12
  Distance between a terminus base of telomere on chromosomal short arm and 5'-terminus of this base sequence : 49780728
  Distance between 3'-terminus of neighbour sequence of sequence listing upward to telomere on chrosomal short arm and 5'-terminus of this base sequence : 67063
cttggttaaatgtattcccgggtgtgtgtgtgtgtgtgtgtgtgtgtgtgtgtgtgtgtgtgtgtgtgtattgtaatggaattgagttcttga

SEQ ID NO: 18693 - DNA, 189 bp, Homo sapiens
  AC004486.1_31084
  Located on chromosome 12
  Distance between a terminus base of telomere on chromosomal short arm and 5'-terminus of this base sequence : 49810496
  Distance between 3'-terminus of neighbour sequence of sequence listing upward to telomere on chrosomal short arm and 5'-terminus of this base sequence : 29675
atgaagtcacaaccatgctaacagggactataaatctgaatgtcttttgttcaggccggctgtcttccttttgtgtgtgtgtgtgtgtgtgtgtgtgtgtgtgccttgcatttctataatcattgaaagtttataaagcatatccatccaaacccactatcacccattgtcgttccaaggattgtaaac

SEQ ID NO: 18694 - DNA, 351 bp, Homo sapiens
  AC004486.1_83325
  Located on chromosome 12
  Distance between a terminus base of telomere on chromosomal short arm and 5'-terminus of this base sequence : 49862584
  Distance between 3'-terminus of neighbour sequence of sequence listing upward to telomere on chrosomal short arm and 5'-terminus of this base sequence : 51899
catctggaatgactcctgatacctgaaaggcacatctgtaacgattttttaaatggatgaatgaattaatgaatacctcagtgcctatgcacacactgttccttccatttaaaatgtcctttcccactgccttttatgatttaaaccccatttttcttccaaaactcagtttcagtatcaattcttctggaaagcttttgctatactttcccttccctacccaccacacacacacacacacacacacacacacacatgccaatgggtttacctctcttctgagctcccattacacccctaccccatgcataagtctcagaaacagttggctcttgatcaaagactgatgct

SEQ ID NO: 18695 - DNA, 306 bp, Homo sapiens
  AC004241.1_74176
  Located on chromosome 12
  Distance between a terminus base of telomere on chromosomal short arm and 5'-terminus of this base sequence : 49942002
  Distance between 3'-terminus of neighbour sequence of sequence listing upward to telomere on chrosomal short arm and 5'-terminus of this base sequence : 79067
tgcctggaactatgtataccacaggtacataaacacacacatacacatacacacacacacacacacacacacacacacactacttttcccctctcatttcactttaatttaaatgctcaaaaatacataaattaaattttaacttacttaaatttaccataaattggcatgtgagctaacctaacacgccataattggcatgttaggtaacttatggtaaaaatttaccaatttattgtaaatttttatcctgaacagcactaaaatgtaaccaatacttacttctgaatcttcagataggccata

SEQ ID NO: 18696 - DNA, 417 bp, Homo sapiens
  AC004241.1_53817
  Located on chromosome 12
  Distance between a terminus base of telomere on chromosomal short arm and 5'-terminus of this base sequence : 49962279
  Distance between 3'-terminus of neighbour sequence of sequence listing upward to telomere on chrosomal short arm and 5'-terminus of this base sequence : 19971
aggactgtaacctcaaatatcctcaaaatccagatcggtggttctcagtcttgactgagctttggaatcacttagggagtatatacatatacacgtgtgtgtgtgtgtgtgtttgtgtctgtgtgtgtgtgtgtgtgtgtgtgtgtgtgtgtgtgtgtgtgtatactgatttctgtgtcctatcccagagattctgatgtaactagtcttgagtgaagccaatcagaattttttaaagcataggatacggctgtgcatttgaagctggaagccactaacccaggcgctgatcaatgaagaactaggctggagtgctgtcttacaaggtcatatcattagcacatccttcccattgcttaattattggtatctttatattttaaaatcatagtagtcaaatcattaagtgtacgtcaa

SEQ ID NO: 18697 - DNA, 101 bp, Homo sapiens
  DISO7_10003383
  Located on chromosome 12
  Distance between a terminus base of telomere on chromosomal short arm and 5'-terminus of this base sequence : 50081092
  Distance between 3'-terminus of neighbour sequence of sequence listing upward to telomere on chrosomal short arm and 5'-terminus of this base sequence : 118396
aaagacagctgcaaggttctgaattttgtttgatatgtacataaacaaacacacacatgcacacacacacacacacacagtcaaccttcattattcatgga

SEQ ID NO: 18698 - DNA, 381 bp, Homo sapiens
  AC004466.1_80287
  Located on chromosome 12
  Distance between a terminus base of telomere on chromosomal short arm and 5'-terminus of this base sequence : 50146338
  Distance between 3'-terminus of neighbour sequence of sequence listing upward to telomere on chrosomal short arm and 5'-terminus of this base sequence : 65145
gttcttactgagtgcagaccagggtctccattgtggcttctgccttcctctgccccagatccagggatgctgatagccgtgcggctgtgttcctagtccccagaaagtggccctgaaggtaggtgctcccttttgcacttgtgggtgcttccagcgcttccacctgcccaaggcctgcccgtgagtgagagacagagatagagatagagagagagagagagagagagagagagagagagagagagagaccttttcctcccaagagaatttacccccgagtacccactctgagggtgacttgctctggttatgcaacccgcattttgtagagggcttgacagtttccagagagctcacgcagcgtttgatcctctgtggcag

SEQ ID NO: 18699 - DNA, 223 bp, Homo sapiens
  DISO7_10003388
  Located on chromosome 12
  Distance between a terminus base of telomere on chromosomal short arm and 5'-terminus of this base sequence : 50249185
  Distance between 3'-terminus of neighbour sequence of sequence listing upward to telomere on chrosomal short arm and 5'-terminus of this base sequence : 102466
tacaatatggtctattggtccctataaaagacatgagccaagtacaatggtgcatccctatagtcccagctacttgggaggctgagacaggaggatcacttgagcccaggagttaagtgtagtctgggcaacacagtgagaccccatctctcgaaaaaaagagagagagagagagagagacaaagtacagtcgaaacagggacaaagagtatctaagcctgcc

SEQ ID NO: 18700 - DNA, 182 bp, Homo sapiens
  DISO7_10003387
  Located on chromosome 12
  Distance between a terminus base of telomere on chromosomal short arm and 5'-terminus of this base sequence : 50269170
  Distance between 3'-terminus of neighbour sequence of sequence listing upward to telomere on chrosomal short arm and 5'-terminus of this base sequence : 19762
gcatagagatgtgtctgtttccctacaatttcccagatgatccatccccacctctctcccttcttcctttccctccccatccctctttctctttctctctctctttctctctctctctgtttcacacacacacagactttcccccttgggtcttatatttcagctttagtaggtctacgctg

SEQ ID NO: 18701 - DNA, 257 bp, Homo sapiens
  D12S1661
  Located on chromosome 12
  Distance between a terminus base of telomere on chromosomal short arm and 5'-terminus of this base sequence : 50499345
  Distance between 3'-terminus of neighbour sequence of sequence listing upward to telomere on chrosomal short arm and 5'-terminus of this base sequence : 229993
cagttggtcttattacagtaaccagttagaagctcaagcatgcttctctctctctctctccctccctctctctctctccccacctcccccccgccgtgtgtgtgtgtgtgtgtgtgtatgtgtgtgtgtgtgtgtgtgtgtgtgtgcgcgcgcgcgcgcgcactcaagtgaggaatggggaaggagggtggaggaaggagcttgtaaatgagcagctggtttgcagcaaaaccgcacctcactctgcacctttggat

SEQ ID NO: 18702 - DNA, 101 bp, Homo sapiens
  DISO7_10004919
  Located on chromosome 12
  Distance between a terminus base of telomere on chromosomal short arm and 5'-terminus of this base sequence : 50534279
  Distance between 3'-terminus of neighbour sequence of sequence listing upward to telomere on chrosomal short arm and 5'-terminus of this base sequence : 34677
ttatagtggtgtgagtgcctgcacacacacaacacacacacacacacacacacacacagcaagacatccaatgtgctcttaccatcagggaggtagaagat

SEQ ID NO: 18703 - DNA, 130 bp, Homo sapiens
  DISO7_10003389
  Located on chromosome 12
  Distance between a terminus base of telomere on chromosomal short arm and 5'-terminus of this base sequence : 50554085
  Distance between 3'-terminus of neighbour sequence of sequence listing upward to telomere on chrosomal short arm and 5'-terminus of this base sequence : 19705
ctattcaatggtcgccttccttctttccttccttccttccttccttccttccttccttccttcctttcttccttccttcctttcttccttccctcctttcttccttccctcctttcttccttccaagcct

SEQ ID NO: 18704 - DNA, 255 bp, Homo sapiens
  G10047
  Located on chromosome 12
  Distance between a terminus base of telomere on chromosomal short arm and 5'-terminus of this base sequence : 50593340
  Distance between 3'-terminus of neighbour sequence of sequence listing upward to telomere on chrosomal short arm and 5'-terminus of this base sequence : 39125
gaatttgagaccaccctggggcaatgaggcaaaatcctggtctcagcagcaaaataaataaataaatacataaaatctatctatctatctatctatctatctatctatctatctatctatcatctatctatctatccaattacctggagtgttaacaacaaaaattccagatccttggccaggcaggtagctcacgtttgtaatcacaacactttggaaggcctaggcaggaggatcactttcccccaggagttc

SEQ ID NO: 18705 - DNA, 465 bp, Homo sapiens
  chr12.fa.O7frz.50908312
  Located on chromosome 12
  Distance between a terminus base of telomere on chromosomal short arm and 5'-terminus of this base sequence : 50959064
  Distance between 3'-terminus of neighbour sequence of sequence listing upward to telomere on chrosomal short arm and 5'-terminus of this base sequence : 365469
catcacttaccagtcaagacagctttaaagtgttcaattaacatgtatctttcacatatacatatatacatgtatatatacgtatatatatatacatgtatatatatatatacgtatatatatatatatatatatatattttttttttgagataaggtctcactcttgtcacccaggatggagtgcagtggtgcaatcaatcacagctcactataacctttgcttcctgggctcaagcgatcctcccacgtcagcctgccgagtagctgggactacaggtgtgcaccaccccacttggttaatttttgtattttttgtagagatgggatttcaccatgttgtccaggcttgaacccctgggtttaagcgatgctcccgcctcagcctcacaaagtgctggaattaaacgcataagctactgcacctggcaatatattttaattaaagcactaaagataccaacat

SEQ ID NO: 18706 - DNA, 249 bp, Homo sapiens
  DISO7_10000076
  Located on chromosome 12
  Distance between a terminus base of telomere on chromosomal short arm and 5'-terminus of this base sequence : 50970335
  Distance between 3'-terminus of neighbour sequence of sequence listing upward to telomere on chrosomal short arm and 5'-terminus of this base sequence : 10806
gattccacagccctcaagaaaaacactaaggctgggcgtcatggttcaccactgtaatcccagcactttgaaaagctgaggtgggaagatcacctgagctcaggagttcgatcccagcctgggcaatatggagacacctcatctcaaataaataaataaataaataaataaataaataaataaatacactataggaccgataaattattaaaaaaaaaaaaaaaccttgggggttgtgctgtttccaga

SEQ ID NO: 18707 - DNA, 202 bp, Homo sapiens
  DISO7_10000078
  Located on chromosome 12
  Distance between a terminus base of telomere on chromosomal short arm and 5'-terminus of this base sequence : 51152578
  Distance between 3'-terminus of neighbour sequence of sequence listing upward to telomere on chrosomal short arm and 5'-terminus of this base sequence : 181994
actgagtctgagcaacctttccccaaagcagacttgtctctccgccccaaccacgctgcctccagcagcactgcctcttgcctcttatttggctttgctctggggaagtaaaaggtgtgtgtgtgtgtgtgtgtgtgtgtgtgtgtgtgcgcgcgcgcgtgtgtgtgtgtgcatgtgtgtacgcgtgcatgttgggtggtag

SEQ ID NO: 18708 - DNA, 441 bp, Homo sapiens
  chr12.fa.O7frz.51564346
  Located on chromosome 12
  Distance between a terminus base of telomere on chromosomal short arm and 5'-terminus of this base sequence : 51505170
  Distance between 3'-terminus of neighbour sequence of sequence listing upward to telomere on chrosomal short arm and 5'-terminus of this base sequence : 352390
gccagtgagttatctgcagggaacaaccacagggaggattgaatcaagaccagcggttccagaacgattctcaaggccagcgcagatatcgccagtcatggacaacacaattttccgttaatctgactggccccaacctgggcagaaaaggaagggcggtttttctttcttttcttttcctttttcttctcttttctatgtatgtatgtatgtatgtatgtatgtatgtatgtatgtatgtattttgagatagaatctcgctctgtcgcccagtagatggagtgcagtggcaccatctcggctcactgcaacttctacctcccgggttcaagtgattctcgtgcctcagcctcacgagtagccgggattacaggcatacaccaccacgcccaactaattttcgtatttataatagagacgggatttcaccatgttggctag

SEQ ID NO: 18709 - DNA, 357 bp, Homo sapiens
  chr12.fa.O7frz.51899683
  Located on chromosome 12
  Distance between a terminus base of telomere on chromosomal short arm and 5'-terminus of this base sequence : 51693424
  Distance between 3'-terminus of neighbour sequence of sequence listing upward to telomere on chrosomal short arm and 5'-terminus of this base sequence : 187813
catggacattggtcctataattatgattttaatttttacattatatatatatatataatgtatatatttgtaaatatatatacatatatatatttatttatatatacataaataaatatatgtatatatttagagacggggtctctctctgttgcccagcaggaatgcagtggcacagtcatggctcactgcagcctttgacctcctaggctcaagcactcctctagcctcagcctcccaaaatgctgagattacaggtgtgagccatcacacctggcttataatttttttaaaatgtagaaaactcatctgaattgtgggaatatccacaaagttctcttgcagagtttggcatta

SEQ ID NO: 18710 - DNA, 307 bp, Homo sapiens
  chr12.fa.O7frz.52005140
  Located on chromosome 12
  Distance between a terminus base of telomere on chromosomal short arm and 5'-terminus of this base sequence : 51739578
  Distance between 3'-terminus of neighbour sequence of sequence listing upward to telomere on chrosomal short arm and 5'-terminus of this base sequence : 45797
taatttgttatgaaagctccaaaaaacaccaacaaaaaatgatataaacttattattattattattattattattattttggcattaactttttttttcttgtatttttagtagagacagggtttcgccatgttgatcaggctggtctccaactcccgacctcaggtgatccgcccacctaggcctcctaaagtgctgggattacaggtgtgagacaccgtgcctggccttgaccttaactttttaaagagtctaggactagttgtcttatagaatgtcccaactctgaaattgtcttcagattgac

SEQ ID NO: 18711 - DNA, 390 bp, Homo sapiens
  chr12.fa.O7frz.52307177
  Located on chromosome 12
  Distance between a terminus base of telomere on chromosomal short arm and 5'-terminus of this base sequence : 51995691
  Distance between 3'-terminus of neighbour sequence of sequence listing upward to telomere on chrosomal short arm and 5'-terminus of this base sequence : 255806
gctttggtaacaatttcatcttcttaaaggcaaagaaagcctgcacgggccaagctgtgaagccaagagggttggaagacaaatatatatgtgtgtgtatctttgtgtatatatgtgtgtgtatgtatacgtttgtgtatatatgtatgtatttatgtagctgtggatgtatttatgtatgtatgtgcacatgtgtgtatatgtgtatgtgtgtgtataaatgtgtatgtgtgtatacatgtatgtgtatgcatgtgtatatatgtgtaagtgtgtgtgtgtgtgtgtgtgtcgggtgtttttctagtgatgaggttcactgatactatacaggagcctaattttttttaagagcaaagttgacatttctggtcaatgtattgcttctac

SEQ ID NO: 18712 - DNA, 415 bp, Homo sapiens
  chr12.fa.O7frz.52202472
  Located on chromosome 12
  Distance between a terminus base of telomere on chromosomal short arm and 5'-terminus of this base sequence : 52198541
  Distance between 3'-terminus of neighbour sequence of sequence listing upward to telomere on chrosomal short arm and 5'-terminus of this base sequence : 202460
tctgtctttcagattcttaagaagtctaccaggctgggcacagtggctcatgcctgtaatcccagcactttgggaggccaaggcgggtggattgcctgagttcaggagttagagactagtctagccaacatggtgaaaccctctctactaaaaatattttaaaaactagccaggtgtggtgacgtgcacctgtaatcccagctactcgggaggctgaggcaggggaactgcttgaaccagggaggcggagcttgcagtgagccgagaccacgccactgtactccagcctgggctacagagcaagactccgtctcaaaacaacaacaacaacaacaacaacaacaagaattctaccagtacaccagtaaagaaattcaattgtaatttttttgtagcaacaagaatactcaaagaa

SEQ ID NO: 18713 - DNA, 436 bp, Homo sapiens
  chr12.fa.O7frz.52597781
  Located on chromosome 12
  Distance between a terminus base of telomere on chromosomal short arm and 5'-terminus of this base sequence : 52326357
  Distance between 3'-terminus of neighbour sequence of sequence listing upward to telomere on chrosomal short arm and 5'-terminus of this base sequence : 127401
tgaattccataaatggagacttttcatatcatcacctgctgacagaggcacagtacaaagctatggggttgttgtggagcctgctgctaccttgtccgttcacacagaggccgactccgagtcccagggcccttacccaggggtctccgctataggggcacctgaagatctcagaatgctgctctgcccaccctgccctcagaggcctcctctccaactcctcccagccggccctccagccccagggccagccttgccttccctcttctcttctataccccagaaagagaagcagctggatgtttgggggctgggattacagtgaaaagagagaatgcttcttcgtgtgtgtgtgtgtgtgtgtgtgtgtacacaacagtgggaaggggacttctgaaaacacttggaggaaaaggaagacctgtttaatactgat

SEQ ID NO: 18714 - DNA, 452 bp, Homo sapiens
  AC074032.8_133861
  Located on chromosome 12
  Distance between a terminus base of telomere on chromosomal short arm and 5'-terminus of this base sequence : 52382992
  Distance between 3'-terminus of neighbour sequence of sequence listing upward to telomere on chrosomal short arm and 5'-terminus of this base sequence : 56199
atggtactccttccatgtactagtcttgcttttgcagctccaataaatagctgtgtaatggaggtgagttaagttcaataggacggtgtcccaaataatggatgggggttggagatgctgtctctcttacacctgcctctacccaaaataccacccacccttccaattcctctcaatctccttccctgctgcacccgccccagcgagaaggcagcaaaggaaaaggtgagtgtgtgtgtgtgtgtgtgtgtgtgtgtgtgaagcggggtggcgtgggggcgcgggttcctaactccctttcttcccaaactgtagcttccagagtagggagggatcctggggctgcacttgtaaccggagaagcttgagagctttgagagctggtgccagaaagcttgggttcgattccccgctctgccacctaggagaggtgcagtatccggttatttaat

SEQ ID NO: 18715 - DNA, 130 bp, Homo sapiens
  DISD22_0008240
  Located on chromosome 12
  Distance between a terminus base of telomere on chromosomal short arm and 5'-terminus of this base sequence : 52489439
  Distance between 3'-terminus of neighbour sequence of sequence listing upward to telomere on chrosomal short arm and 5'-terminus of this base sequence : 105995
ttaccatcctggcctgagtgtggagagacccactgaagtttctcccaggcgtgtgtgtgtgtgtgtgtgtgtttgtgtttggggaaggagcaggctggagctccaaggctgcctgcaggagggagaagaa

SEQ ID NO: 18716 - DNA, 191 bp, Homo sapiens
  DISD22_0008241
  Located on chromosome 12
  Distance between a terminus base of telomere on chromosomal short arm and 5'-terminus of this base sequence : 52603845
  Distance between 3'-terminus of neighbour sequence of sequence listing upward to telomere on chrosomal short arm and 5'-terminus of this base sequence : 114276
aaggacagggtaggagtggcgggaggtgggaagaatatgtgtgtgtgtgtgtatgtgtgtgtgtgcgtgcacgcacgcatgcatgcccttgatttccttctctctgtttttaatcccttctgattttttctctgactgaccttttgttttcttgttcaaactaatgtatttccaagctttctaatgcacat

SEQ ID NO: 18717 - DNA, 142 bp, Homo sapiens
  DISD22_0008242
  Located on chromosome 12
  Distance between a terminus base of telomere on chromosomal short arm and 5'-terminus of this base sequence : 52737446
  Distance between 3'-terminus of neighbour sequence of sequence listing upward to telomere on chrosomal short arm and 5'-terminus of this base sequence : 133410
ctggccacttaaagctggggagagggatatgatttagagacctgttatttaccctcagacacacacacacacacacacacacacacacacacacacacacacacagagctggtgggggtggggcgtccataggagggcacag

SEQ ID NO: 18718 - DNA, 298 bp, Homo sapiens
  D12S1620
  Located on chromosome 12
  Distance between a terminus base of telomere on chromosomal short arm and 5'-terminus of this base sequence : 52876114
  Distance between 3'-terminus of neighbour sequence of sequence listing upward to telomere on chrosomal short arm and 5'-terminus of this base sequence : 138526
caggaagtcgaggctgtagtgacctatgattgtgccccggcactccagcctggacgatataacaaggccctgtctcaaaagcaagcaaacaaacaaacaaacaaaaatgatctcaaatgcatttaagatgagttttatgatccacattttccaagtggtaatctgaggtacaggaagaaggaggggtttcctccaatatttctcaaggaagtaaaggaacacaaaacacacacacacacacacacgaattctgataccaaaatactcttctgtaacagacttttatcacattttagct

SEQ ID NO: 18719 - DNA, 304 bp, Homo sapiens
  AF064477.1_2042
  Located on chromosome 12
  Distance between a terminus base of telomere on chromosomal short arm and 5'-terminus of this base sequence : 53423290
  Distance between 3'-terminus of neighbour sequence of sequence listing upward to telomere on chrosomal short arm and 5'-terminus of this base sequence : 546878
ggttagtatcaggtccttggaggagaacactattgtctggggaaaacctgtgagtgaaagatctgctggatggctcaagttcagcagcctcaggtttaattttggctggcaatctctgaagactatatctatatatctatatatatatatacacacacacacacacacacacaccccatctatatctatctatctctgtctgtctgtctgtctgtccgtctatatatctatctatctatctatctatctgtctatctaatcttttttacagacagggtcttgctctgtcatctaggctccagtg

SEQ ID NO: 18720 - DNA, 253 bp, Homo sapiens
  HUMUT5046
  Located on chromosome 12
  Distance between a terminus base of telomere on chromosomal short arm and 5'-terminus of this base sequence : 53423385
  Distance between 3'-terminus of neighbour sequence of sequence listing upward to telomere on chrosomal short arm and 5'-terminus of this base sequence : -209
ttaattttggctggcaatctctgaagactatatctatatatctatatatatatatacacacacacacacacacacacaccccatctatatctatctatctctgtctgtctgtctgtctgtccgtctatatatctatctatctatctatctatctgtctatctaatcttttttacagacagggtcttgctctgtcatctaggctccagtgcagtggcacaaccatagcccactgtagccttgaattcctggggt

SEQ ID NO: 18721 - DNA, 147 bp, Homo sapiens
  DISO7_10003391
  Located on chromosome 12
  Distance between a terminus base of telomere on chromosomal short arm and 5'-terminus of this base sequence : 53494295
  Distance between 3'-terminus of neighbour sequence of sequence listing upward to telomere on chrosomal short arm and 5'-terminus of this base sequence : 70657
aaggaatagggcatactgttgttgttgttgttttgttttgttttactatttctatctttctctttttctctttgactctttctctctctctcctctgtctctctctctctctctctcccctccatctctctcttcactcctccgtcc

SEQ ID NO: 18722 - DNA, 463 bp, Homo sapiens
  chr12.fa.O7frz.53494073
  Located on chromosome 12
  Distance between a terminus base of telomere on chromosomal short arm and 5'-terminus of this base sequence : 53686459
  Distance between 3'-terminus of neighbour sequence of sequence listing upward to telomere on chrosomal short arm and 5'-terminus of this base sequence : 192017
cagcaattatgtacggaactacatagatataagaatgaacaaaataaggccaggcgcagtggctcatgtctataatcccagcactttgggaggccaaggtggacggatcacctgaggtcaaagttcgagaccagcctggccaatatggtgaaacctcctctctactaaaaatacaaaaattagccgggcgtggtggcacacgcctgtaatcccagctactccggaggctgaggcaggagaatcacttgaatcgggaaggcagaggttgcagtgagccaagattgtgccactgcactccggcctgggcaacaagagcgagactctgtctcaaaacaaaacaaaacaaaacaaaacaaaacagtatctaatgttgtaggtctcagttccctcatacattgataattgcctatgtcacaaagttgttataaggagtaaataatgctgaaacagtacttcgcattat

SEQ ID NO: 18723 - DNA, 148 bp, Homo sapiens
  D12S1635
  Located on chromosome 12
  Distance between a terminus base of telomere on chromosomal short arm and 5'-terminus of this base sequence : 53821513
  Distance between 3'-terminus of neighbour sequence of sequence listing upward to telomere on chrosomal short arm and 5'-terminus of this base sequence : 134591
tgttggttaggtgcaggtatactagagagtttgtaacaattgtatgttaatctcactgggagtttttctgtgtgtgtgtgtgtgtgtgtgtgtgtgtgtgtgtgtgtgtgtgtgttttaaaggatagtagcaaaaagtaggccagaac

SEQ ID NO: 18724 - DNA, 439 bp, Homo sapiens
  chr12.fa.O7frz.53381101
  Located on chromosome 12
  Distance between a terminus base of telomere on chromosomal short arm and 5'-terminus of this base sequence : 53900334
  Distance between 3'-terminus of neighbour sequence of sequence listing upward to telomere on chrosomal short arm and 5'-terminus of this base sequence : 78673
ctgtcacctaatccactcatacatccagctttctttggcctgttatccccccacacttcatattgttctgtgatttttttttgtttgtttgtttgtttattttattttattttattttattttattttattttattttatttttgagacggagccttgctctgccacccactgcaacctccgcctccctggttccagtgattctcctgcctcagcctcctgggtagctgggatcacaggcacacgccaccacgcccagctaatttttgtatttttagtagagatggggtttcaccatgttggccaggctcgtctcaaactcctgacctcaggtgatccacctgccccaaccttccaaagtgctgggattacaggtgtgtgccaccatgcctggctcattatgtgattctcatgtgctgccttatttacctagatactga

SEQ ID NO: 18725 - DNA, 139 bp, Homo sapiens
  DISD22_0008254
  Located on chromosome 12
  Distance between a terminus base of telomere on chromosomal short arm and 5'-terminus of this base sequence : 54062627
  Distance between 3'-terminus of neighbour sequence of sequence listing upward to telomere on chrosomal short arm and 5'-terminus of this base sequence : 161854
ttggaaatgagaagatgtatcatactaaaaacacacacacacacacaaacacacacacacacactctaaagccagcttaaattcagtcccatgttgagtttgggcgggaaatggaaaacagaccaagaatgtttcatcc

SEQ ID NO: 18726 - DNA, 261 bp, Homo sapiens
  D12S1633
  Located on chromosome 12
  Distance between a terminus base of telomere on chromosomal short arm and 5'-terminus of this base sequence : 54249855
  Distance between 3'-terminus of neighbour sequence of sequence listing upward to telomere on chrosomal short arm and 5'-terminus of this base sequence : 187089
cactgtcaacaagcaaacaagtctatatttgttttcttggttatagtgctataattctacacacacacacacacacacacacacacacacacgtatataattttaggtagtgatatgttttaagaaggtagggagtgagggagttactttatttaggatgattagagatgacttctgaggagacatctgagtagagacctgaatcaagtgagaagcaaattatgagaatatctgggagtaagaacattccagggcaggggt

SEQ ID NO: 18727 - DNA, 166 bp, Homo sapiens
  D12S1629
  Located on chromosome 12
  Distance between a terminus base of telomere on chromosomal short arm and 5'-terminus of this base sequence : 54269220
  Distance between 3'-terminus of neighbour sequence of sequence listing upward to telomere on chrosomal short arm and 5'-terminus of this base sequence : 19104
taacctaccacgcagggttgaagcacttcactgagagaatcactggcagtagtggacagcacctggtgtgtgtgtgtgtgtgtgtgtgtgtgtgtgtgtgataagcatgtcacaaatacattctctgatctaatcctcaccacacacacaatgggcactattcctt

SEQ ID NO: 18728 - DNA, 112 bp, Homo sapiens
  D12S347
  Located on chromosome 12
  Distance between a terminus base of telomere on chromosomal short arm and 5'-terminus of this base sequence : 54368714
  Distance between 3'-terminus of neighbour sequence of sequence listing upward to telomere on chrosomal short arm and 5'-terminus of this base sequence : 99328
ttttttgagtccaggccaagagataccagagcaacacacacacacacacacacacacacacacacacacacacacacacacacagaaagaaaaaaaggcaaaactctgctgg

SEQ ID NO: 18729 - DNA, 133 bp, Homo sapiens
  DISO7_10003392
  Located on chromosome 12
  Distance between a terminus base of telomere on chromosomal short arm and 5'-terminus of this base sequence : 54496131
  Distance between 3'-terminus of neighbour sequence of sequence listing upward to telomere on chrosomal short arm and 5'-terminus of this base sequence : 127305
cccagtgccacttctactctgtgtgtatgtgtgtgtgtgtgtgtgtgtgtgtgtgtgtgtgtgtgtgtgttggggagggggttgcagtggagggagagtccctagaaaagaattctctaagggtgcttacttc

SEQ ID NO: 18730 - DNA, 387 bp, Homo sapiens
  chr12.fa.O7frz.54536492
  Located on chromosome 12
  Distance between a terminus base of telomere on chromosomal short arm and 5'-terminus of this base sequence : 54541397
  Distance between 3'-terminus of neighbour sequence of sequence listing upward to telomere on chrosomal short arm and 5'-terminus of this base sequence : 45133
tctgtaacttccatttagcaactttaaaaaacagacacaacaccaccaaaaaaacccagcagaacctttaatacaaaagcttccctgataatctaatttgtagaaataaaagtagagtgactatgtttgaatcaagagttatagttccagaacgttttctcccctcacccccacacgccgcacgtggtacatctaccgcatcaacttttgaaggaaaagaaattctagggctttgcagggcagattgaaaaccaccaagttaaagtaatcctggaaataagcaccagcccaagtatctcagtacttcaaacaaacaaacaaacaaaaaagcaaggaatctcaagaaagagaacatttggggttttttatttccttgatgttaagcct

SEQ ID NO: 18731 - DNA, 234 bp, Homo sapiens
  DID22N_0007392
  Located on chromosome 12
  Distance between a terminus base of telomere on chromosomal short arm and 5'-terminus of this base sequence : 54584177
  Distance between 3'-terminus of neighbour sequence of sequence listing upward to telomere on chrosomal short arm and 5'-terminus of this base sequence : 42393
atggatggacagacggacggatggatggatgaatggacagacaaatggacggatggatggatgaatggacagacaaatggacggatggatggatggatggatggatgaatggacagatggacagatggacagatggatgaatagacagacagacggatgggtggatggatggttggatggatggatggatggatggatggatggatgatcctagaggcttgaaatggcctctgt

SEQ ID NO: 18732 - DNA, 150 bp, Homo sapiens
  DISO7_10003393
  Located on chromosome 12
  Distance between a terminus base of telomere on chromosomal short arm and 5'-terminus of this base sequence : 54690041
  Distance between 3'-terminus of neighbour sequence of sequence listing upward to telomere on chrosomal short arm and 5'-terminus of this base sequence : 105630
gcaggattctccatcaggtttttgcaaagtgctggggtcttaaaatagcataaaggcccacgcgcgcgcgcgcacacacacacacacacacacatgcatgcacacacacaaacatacacatttagactatagtgtcaattcccgtaccat

SEQ ID NO: 18733 - DNA, 232 bp, Homo sapiens
  HUMUT5029
  Located on chromosome 12
  Distance between a terminus base of telomere on chromosomal short arm and 5'-terminus of this base sequence : 55000630
  Distance between 3'-terminus of neighbour sequence of sequence listing upward to telomere on chrosomal short arm and 5'-terminus of this base sequence : 310439
gtttggtattggagttttcagtgtggactcaaggccttcaagataggcagatagacagatagatggatagatagatagatgatggatagatagatagatggtagatgatagatagatagatagatagatagatagatagatagatagatacagatttaaattgtgtagatgtatatttacataaacacatatacagatatgcacatgtatttgctaactccactgatgattt

SEQ ID NO: 18734 - DNA, 423 bp, Homo sapiens
  chr12.fa.O7frz.54912379
  Located on chromosome 12
  Distance between a terminus base of telomere on chromosomal short arm and 5'-terminus of this base sequence : 55064073
  Distance between 3'-terminus of neighbour sequence of sequence listing upward to telomere on chrosomal short arm and 5'-terminus of this base sequence : 63211
taactggactgaagtcagacagacctcaatttgaaccctgacctggctttatcactcagttgctctgtgaccctgagcatctgcaactttcagagcctcagtttccccacctgtaaaactgggtaataaggatgcctgcctatagggttgggaagattaaaggagacaatacatggagcagacctgcaacacagacctgcaacacagctaatgccagcaagcattagctggcagaaccccagcctcagacctgtatataactgtgactataaagtaatgagaagggtcccctctggggcgtgagtcccccagcacaggcacacacatacacatgcacacacacacacacacacacacacacacacagaggctgctctgtgtttctgctgtttacaaagctgcctagctacgacctgagatcag

SEQ ID NO: 18735 - DNA, 224 bp, Homo sapiens
  chr12.fa.O7frz.55086650
  Located on chromosome 12
  Distance between a terminus base of telomere on chromosomal short arm and 5'-terminus of this base sequence : 55124720
  Distance between 3'-terminus of neighbour sequence of sequence listing upward to telomere on chrosomal short arm and 5'-terminus of this base sequence : 60224
gaggataaagtgaagtttcgtttcttgaaatcccagccagtctccaataggatcattcaacttctatcttaaaatattatctctccaatcagcttcctaaccttccttccctcctcacttacactacacacacacacacacacacacaccacacagatacacacacacaccttggccaagacaatcagaaatatttcagtagatttctcatcttactctgtcac

SEQ ID NO: 18736 - DNA, 240 bp, Homo sapiens
  DISO7_11955121
  Located on chromosome 12
  Distance between a terminus base of telomere on chromosomal short arm and 5'-terminus of this base sequence : 55257548
  Distance between 3'-terminus of neighbour sequence of sequence listing upward to telomere on chrosomal short arm and 5'-terminus of this base sequence : 132604
ttgtctgagattggcagccgtggcatctgctctctgagttttcctaacaaccttgtttgtatttctctatttatgtgaggacattctattattattattattatcatcatcatcatcatcatcatcatcatcatttggtttagggattttaagatcttttacttctggtttttgagggtagagtctgcctttatgttttttgttctctttgttgtttttaggcaatttctgagaagagga

SEQ ID NO: 18737 - DNA, 152 bp, Homo sapiens
  G08922
  Located on chromosome 12
  Distance between a terminus base of telomere on chromosomal short arm and 5'-terminus of this base sequence : 55279665
  Distance between 3'-terminus of neighbour sequence of sequence listing upward to telomere on chrosomal short arm and 5'-terminus of this base sequence : 21877
agcctcccagattacatcagctgattgttaataataataattctttctctcttatctatctatctatctatctatctatctatctatctatctatccatcatctatcatctatctatatatgtgtgtgtgtgtataaccgaaaggatatctc

SEQ ID NO: 18738 - DNA, 391 bp, Homo sapiens
  chr12.fa.O7frz.55473849
  Located on chromosome 12
  Distance between a terminus base of telomere on chromosomal short arm and 5'-terminus of this base sequence : 55504931
  Distance between 3'-terminus of neighbour sequence of sequence listing upward to telomere on chrosomal short arm and 5'-terminus of this base sequence : 225114
atgtctggcctatcatagattcttagaaaatatttgtgggctagatgggtggatggatgcatgagtggatagttgaatggattgatggatgagtgaatgaacagatgaacacgtgtgtgtgtgtgcatgtgtgtgtgtgtgtgtataaatggattgtgtggatgggtgggtggatggatggatggacggaagggtggatagttgggtggattgatgaataagtgaatggatggatgtgtgtgtgtgtgtgtgtgtgtgtgtttgtgtgtgtgtgtataaatggattgtgtggatggggatggatagatgggtgcatgggtggatgggtggatggaaagtgaataattatgaatgagaatgagggtactacaccatgtatctgttgagtatt

SEQ ID NO: 18739 - DNA, 115 bp, Homo sapiens
  DISD22_0008261
  Located on chromosome 12
  Distance between a terminus base of telomere on chromosomal short arm and 5'-terminus of this base sequence : 55710030
  Distance between 3'-terminus of neighbour sequence of sequence listing upward to telomere on chrosomal short arm and 5'-terminus of this base sequence : 204708
attctgtccacactgcccctaaccaacaaacacatctacacacacacacagacacacacacacacacacacacaggctttcaagcacacacaccaccactggaacagatacctaa

SEQ ID NO: 18740 - DNA, 127 bp, Homo sapiens
  G08976
  Located on chromosome 12
  Distance between a terminus base of telomere on chromosomal short arm and 5'-terminus of this base sequence : 55860626
  Distance between 3'-terminus of neighbour sequence of sequence listing upward to telomere on chrosomal short arm and 5'-terminus of this base sequence : 150481
agtgtttggactgtcatttgccatccacccattcatccatctactcatccatccgtccatccatccatccatccatccatccatctatgatccatccatcatccatctattcatccatccatccacc

SEQ ID NO: 18741 - DNA, 226 bp, Homo sapiens
  DISO7_10003397
  Located on chromosome 12
  Distance between a terminus base of telomere on chromosomal short arm and 5'-terminus of this base sequence : 55880601
  Distance between 3'-terminus of neighbour sequence of sequence listing upward to telomere on chrosomal short arm and 5'-terminus of this base sequence : 19848
ggtatttctgctcctgcccctgttctctctctgttctctctctctctctctctctctctctctctctctgtgtgtgtgtgtgtgtgtgtgtgtgtgtgtgtctttgtctgtttctctctctctctctctccctctttctcactcctcacattggctcccaccctcctcaaccatggccagatggcaccgaggaggagacgcagcccctgtccttgaaaggtgtaag

SEQ ID NO: 18742 - DNA, 321 bp, Homo sapiens
  chr12.fa.O7frz.56396820
  Located on chromosome 12
  Distance between a terminus base of telomere on chromosomal short arm and 5'-terminus of this base sequence : 56055171
  Distance between 3'-terminus of neighbour sequence of sequence listing upward to telomere on chrosomal short arm and 5'-terminus of this base sequence : 174344
atgtctgtagtcgcagcacttcaggaggccaaggtgggaggatcacttaaggccaggagttggagactggcctgggcaacatagtgagatcctgtcttcacacacacacacacacacacacacacacacaaattttttaaaggacatggaagccaaattaaaggggctccctccggtcaaaactggaataatttgagcattaaaataagaactgaaattaattataatctattgaataaaaccaaagtccatattgataatacacatgaatgaaaaaggagtggggagggctcttttttatagtctaatgccaaatgacaa

SEQ ID NO: 18743 - DNA, 158 bp, Homo sapiens
  DID22N_0007420
  Located on chromosome 12
  Distance between a terminus base of telomere on chromosomal short arm and 5'-terminus of this base sequence : 56127184
  Distance between 3'-terminus of neighbour sequence of sequence listing upward to telomere on chrosomal short arm and 5'-terminus of this base sequence : 71692
gaatccagtcacccgaaccccacaaaaaaaagaaagaaagagagagaaagaaaagaaagagaaagaaagaagaaagaaaaaggaagaaagagaaaggaggagaaagaaagagagagagagagagagaaagaaagaactttctgaatcagaatctgacc

SEQ ID NO: 18744 - DNA, 101 bp, Homo sapiens
  DISO7_10003400
  Located on chromosome 12
  Distance between a terminus base of telomere on chromosomal short arm and 5'-terminus of this base sequence : 56212709
  Distance between 3'-terminus of neighbour sequence of sequence listing upward to telomere on chrosomal short arm and 5'-terminus of this base sequence : 85367
atctttctgttgattatgtggcgcatatatatatatatatgtatatatatataatttatataaatatttctctatgtacaaggaatacgagtggctttcat

SEQ ID NO: 18745 - DNA, 277 bp, Homo sapiens
  D12S1604
  Located on chromosome 12
  Distance between a terminus base of telomere on chromosomal short arm and 5'-terminus of this base sequence : 56531134
  Distance between 3'-terminus of neighbour sequence of sequence listing upward to telomere on chrosomal short arm and 5'-terminus of this base sequence : 318324
gggcaggagtcttttaacacctgtgttcattggcctgagtgtaatcgttagggtgcagtcgagggtgccacaggccctgagagtgtgtgtgtgtgtgtgtgtgtgtgtgtgtgtgtgtgtgtgtgtaagttgggccatctgagtgctgtgagtccaagtgataaatggtgtgtgcacaaggctgtgagatagtgaatttgtggctgagtttgggggaatagcatgcaagccaaccagatggacaccacgtcccttgtcacactctgtatccagccag

SEQ ID NO: 18746 - DNA, 144 bp, Homo sapiens
  DISO7_10000090
  Located on chromosome 12
  Distance between a terminus base of telomere on chromosomal short arm and 5'-terminus of this base sequence : 56635180
  Distance between 3'-terminus of neighbour sequence of sequence listing upward to telomere on chrosomal short arm and 5'-terminus of this base sequence : 103769
aagaacaacatcctgggctggtccaggtctgcccaaccagtgtgtgtgtgtgtgtgtgtgtgtgtgtgtgtgtgagagagagagagagagagagagtagggagtggtaggtaggtagtttgcctctcaacatcatggaaactgg

SEQ ID NO: 18747 - DNA, 103 bp, Homo sapiens
  DISO7_10000089
  Located on chromosome 12
  Distance between a terminus base of telomere on chromosomal short arm and 5'-terminus of this base sequence : 56641060
  Distance between 3'-terminus of neighbour sequence of sequence listing upward to telomere on chrosomal short arm and 5'-terminus of this base sequence : 5736
agacctaaaggactaagagactccccccaacacacacacgtgtgagggcatgcatacacacacacacacacacacacaccaagtaacaaccagcaagtggttc

SEQ ID NO: 18748 - DNA, 137 bp, Homo sapiens
  DISO7_10000202
  Located on chromosome 12
  Distance between a terminus base of telomere on chromosomal short arm and 5'-terminus of this base sequence : 56733750
  Distance between 3'-terminus of neighbour sequence of sequence listing upward to telomere on chrosomal short arm and 5'-terminus of this base sequence : 92587
tgagtgtgcactgtgttagggtgtgtgtgtgtgtgtgtgtgtgtgtgtgagagagagagagagagagagagagacagagagagagaggcaggcttccccctgggccaggctgctgtcccctgaacggtggtgaacaa

SEQ ID NO: 18749 - DNA, 129 bp, Homo sapiens
  DISO7_10000088
  Located on chromosome 12
  Distance between a terminus base of telomere on chromosomal short arm and 5'-terminus of this base sequence : 56743801
  Distance between 3'-terminus of neighbour sequence of sequence listing upward to telomere on chrosomal short arm and 5'-terminus of this base sequence : 9914
aactaaatcaaggctcatagcccatttttttcgtgtgtgtgtgtgtgtgtgtgtgtgtgtgtgtgtgtgtgtgtgtgtgtgtgtatgtgtttgtccctttctaatgccggcagccagggctaatgtatg

SEQ ID NO: 18750 - DNA, 240 bp, Homo sapiens
  chr12.fa.O7frz.57453974
  Located on chromosome 12
  Distance between a terminus base of telomere on chromosomal short arm and 5'-terminus of this base sequence : 56748815
  Distance between 3'-terminus of neighbour sequence of sequence listing upward to telomere on chrosomal short arm and 5'-terminus of this base sequence : 4885
ttaggaaatggagttatttaggtaaaatatattgtttgtttggtacatagagatgtgagaaggctgggggcttacacacacacacacacacaaacacacacactcacacacccctgcacccatcttaattacaaaaaaacccagtgacagactgcagagtttcctccattcatgcggtacacgatggggttcccctatgccccgctgccatctcctcttattcctagctcctatgaactc

SEQ ID NO: 18751 - DNA, 203 bp, Homo sapiens
  chr12.fa.O7frz.57376474
  Located on chromosome 12
  Distance between a terminus base of telomere on chromosomal short arm and 5'-terminus of this base sequence : 56858871
  Distance between 3'-terminus of neighbour sequence of sequence listing upward to telomere on chrosomal short arm and 5'-terminus of this base sequence : 109816
aaatcagcagtctgagtcaaggttatgggtctttgctttgtgcagtgggttggaggggtgcggtgcagagagatgtgtgtgtgtgtgtgtgtgtgtgtgtgtgtgtgtgtgtgtgtgtggagagagagggagagagagagagtagtgcctacaggagaacaagagggtgtgatgggggaaggtcttgtcatgctgatattgtc

SEQ ID NO: 18752 - DNA, 104 bp, Homo sapiens
  DISO7_10000087
  Located on chromosome 12
  Distance between a terminus base of telomere on chromosomal short arm and 5'-terminus of this base sequence : 56860869
  Distance between 3'-terminus of neighbour sequence of sequence listing upward to telomere on chrosomal short arm and 5'-terminus of this base sequence : 1795
tggataaacatcatacctagagaagtgtcacacacacatacacacacaaaaatgtacagaggcccctcagttgcattcctgcccacactcaacaaacactgcca

SEQ ID NO: 18753 - DNA, 209 bp, Homo sapiens
  DISO7_10000086
  Located on chromosome 12
  Distance between a terminus base of telomere on chromosomal short arm and 5'-terminus of this base sequence : 56890996
  Distance between 3'-terminus of neighbour sequence of sequence listing upward to telomere on chrosomal short arm and 5'-terminus of this base sequence : 30023
agcagagcctccacagagggcaaattcttcaggttctttttctctcagactccgtgtgtgtgtgtgtgtgtgtgtgtgtgtgtgtgtgtgtgcaagcgcgcgcgtgcgcaaaatgtgcatatgtttattccccaggaaaatttatttaaatgaaattattaaatcttcagccccaccaggcaaagggataacagagaactctgatttcc

SEQ ID NO: 18754 - DNA, 171 bp, Homo sapiens
  DISO7_10000085
  Located on chromosome 12
  Distance between a terminus base of telomere on chromosomal short arm and 5'-terminus of this base sequence : 56916229
  Distance between 3'-terminus of neighbour sequence of sequence listing upward to telomere on chrosomal short arm and 5'-terminus of this base sequence : 25024
tcctctattaagtgtgaaagttgtctataaaatctaaagtttcttctagctatagtcttaggatatatatacatacacacacacacacacacacacacacacacacacacacacacacatatgtaagatctctctctgtctctctctttcacacatattatccaagtgccc

SEQ ID NO: 18755 - DNA, 285 bp, Homo sapiens
  DISO7_10000084
  Located on chromosome 12
  Distance between a terminus base of telomere on chromosomal short arm and 5'-terminus of this base sequence : 56951795
  Distance between 3'-terminus of neighbour sequence of sequence listing upward to telomere on chrosomal short arm and 5'-terminus of this base sequence : 35395
tgacattatgtagggttcttggggtcctcaaccaccttttattttattttattttattttattttattttattttaagttctgggatgcatgtgcagaacatgcaggcttgttacataggtatacatgtgactggtggtttgctgcacctatcaacccatcatctaggttttaagccccgcatgcattaggtatttgtcctaatgttctccctccccttgcctctaccccccaacaggccccatcttttctatctgccatttggtttgacaggtacagcaatctt

SEQ ID NO: 18756 - DNA, 208 bp, Homo sapiens
  D12S325
  Located on chromosome 12
  Distance between a terminus base of telomere on chromosomal short arm and 5'-terminus of this base sequence : 57037944
  Distance between 3'-terminus of neighbour sequence of sequence listing upward to telomere on chrosomal short arm and 5'-terminus of this base sequence : 85864
agggcattgtcttactgactgacatagttttctaatgccatacttaaatatactgtgtgcgtgtgtgtgtgtgtgtgtgtgtgtgtccccaaatgatttcaagcatctggagtgtagggactgcctttcttttttactcatggcatttaatgttgtgccttacacacgtgattatgcatgtaatgtgattgaagacaccatagtgccc

SEQ ID NO: 18757 - DNA, 270 bp, Homo sapiens
  chr12.fa.O7frz.57719139
  Located on chromosome 12
  Distance between a terminus base of telomere on chromosomal short arm and 5'-terminus of this base sequence : 57464381
  Distance between 3'-terminus of neighbour sequence of sequence listing upward to telomere on chrosomal short arm and 5'-terminus of this base sequence : 426229
gtccttggaagttaagtggtagtggttaaggtatagtggaagaattggagaacataggagagtttttgaagatggctgttttactaggctgcattgagaactggtgtgcctgtgcgtgtgtgtgtgtgtgtgtgtgtgtgtgtgtgtgtgtgtgtaaacgctcttttccctctgcttagtgtgtgggtggtttagggaaggcttgctttatgcttctgcattgctactgcattcggactgcagaaacttccaagtatactaggacattca

SEQ ID NO: 18758 - DNA, 101 bp, Homo sapiens
  DISO7_10000092
  Located on chromosome 12
  Distance between a terminus base of telomere on chromosomal short arm and 5'-terminus of this base sequence : 57479188
  Distance between 3'-terminus of neighbour sequence of sequence listing upward to telomere on chrosomal short arm and 5'-terminus of this base sequence : 14537
gctccctcatgccataagtcctgtgtgtgtgagtgtgtgtgtgtgtgtgtgtgtgtgtgcgcatggcacatttgcacaggggtctgcggtatggataggat

SEQ ID NO: 18759 - DNA, 101 bp, Homo sapiens
  DISO7_10000094
  Located on chromosome 12
  Distance between a terminus base of telomere on chromosomal short arm and 5'-terminus of this base sequence : 57498954
  Distance between 3'-terminus of neighbour sequence of sequence listing upward to telomere on chrosomal short arm and 5'-terminus of this base sequence : 19665
gtgcagagcccagtagtatggagtgtgtgtgtgtgtgtgtgtctctgtactgggtagagaaacagaacatgcttttattttcccctactcagcagaacgag

SEQ ID NO: 18760 - DNA, 101 bp, Homo sapiens
  DISO7_10000093
  Located on chromosome 12
  Distance between a terminus base of telomere on chromosomal short arm and 5'-terminus of this base sequence : 57510042
  Distance between 3'-terminus of neighbour sequence of sequence listing upward to telomere on chrosomal short arm and 5'-terminus of this base sequence : 10987
tcctctgtcaccttcaaggttgggatggggtggagagaggacacacacacacacacacacacacacacacacacacagagagacggacagatgaaagtgag

SEQ ID NO: 18761 - DNA, 418 bp, Homo sapiens
  AC053540.2_88702
  Located on chromosome 12
  Distance between a terminus base of telomere on chromosomal short arm and 5'-terminus of this base sequence : 57619272
  Distance between 3'-terminus of neighbour sequence of sequence listing upward to telomere on chrosomal short arm and 5'-terminus of this base sequence : 109129
gatacacatgcaggtttgttacatgggtatattgtgtgatgctgagatttgggcttctaatgaacccatcacccatgcccaaatagtgaacacagtactcaagtttttttttctttcttgcctttatttatttatttatttatttatttatttatttagagacatagtcttgctctatcgaccaggctggagtgcggtgttgaactcctgggctcaagcgaccatcccacctcagcctcctgaggagctgggcctacagccatgtaccaccacaccaggctaatttattttattttatctgtagaggggtgggggaaggtctcacaatgttgcctaggctggtcttgaactcctggcttcaagcaatccttctacctttgcctcccaaagtgctgggattataagcatgagccacttc

SEQ ID NO: 18762 - DNA, 291 bp, Homo sapiens
  DISO7_10000101
  Located on chromosome 12
  Distance between a terminus base of telomere on chromosomal short arm and 5'-terminus of this base sequence : 57773106
  Distance between 3'-terminus of neighbour sequence of sequence listing upward to telomere on chrosomal short arm and 5'-terminus of this base sequence : 153416
gagaggcaatttacctgccccacttcaattgtttttctttcttcttttattttatggtaatatttaaggtgtaacatgaagttttgatatacatgtatttagtgaaatggttactataatcaagcaaatgaacacatccatgattttacataattagccttttgtgtgtgtgtctctctgtatgtgtgtgtgtgtgtgtgtgtgtatgtgtaagagcacccaaaatctgctcttccagcaaaaatcccaaattcaatacagtattattgactccagctcttgtgttccact

SEQ ID NO: 18763 - DNA, 149 bp, Homo sapiens
  DISO7_10000098
  Located on chromosome 12
  Distance between a terminus base of telomere on chromosomal short arm and 5'-terminus of this base sequence : 57807882
  Distance between 3'-terminus of neighbour sequence of sequence listing upward to telomere on chrosomal short arm and 5'-terminus of this base sequence : 34485
tgacaggaggtctgtagtcagttatttttgtcatggttttttaaagtctctagagtctataattaagatggaggtactaggggtagtgagagagagagagagagtgtgtgtgtgtgtgtgtgtgtgtgtaaggactgggagaataggca

SEQ ID NO: 18764 - DNA, 382 bp, Homo sapiens
  chr12.fa.O7frz.57878870
  Located on chromosome 12
  Distance between a terminus base of telomere on chromosomal short arm and 5'-terminus of this base sequence : 57834369
  Distance between 3'-terminus of neighbour sequence of sequence listing upward to telomere on chrosomal short arm and 5'-terminus of this base sequence : 26338
ttcaatccaataaagttgacactcaatattaacattatacatctatctatctatctatctatctatctatctatctatctatctatctatcatctatctatctatcatctatctatctatatctatctatatctatatctatctatctatctaatctgtctatctatctatctatctatctatctatctatctatctatctatctatctatgtagttgggcaagatacaattttgttgcttctatccattgtggaattttccataatgggataatttatttatccatttctcaagtgatggttaccaggtttgattccaactttttggattgggattagtcagttttaggatgtatgcatatttaatatcacctcagattgc

SEQ ID NO: 18765 - DNA, 119 bp, Homo sapiens
  DISO7_10000096
  Located on chromosome 12
  Distance between a terminus base of telomere on chromosomal short arm and 5'-terminus of this base sequence : 57905140
  Distance between 3'-terminus of neighbour sequence of sequence listing upward to telomere on chrosomal short arm and 5'-terminus of this base sequence : 70389
aatgccatatgattaattccttatctcattaggtcaacacacacacacacacacacacacacacacacacttcagagaattacaatctctccctcaaatacagccatttccagtcctaa

SEQ ID NO: 18766 - DNA, 208 bp, Homo sapiens
  Z67384
  Located on chromosome 12
  Distance between a terminus base of telomere on chromosomal short arm and 5'-terminus of this base sequence : 58209812
  Distance between 3'-terminus of neighbour sequence of sequence listing upward to telomere on chrosomal short arm and 5'-terminus of this base sequence : 304553
taatccaagcagtgggaatggcagggaaaacacaaacttgaaagtaattggggtatcttgggaagagggaatattctaagggacatagattggtggtcactgtgtgtgtgtgtgtgtgtgtgtgtgtgtagaagtctggttaaggatgagattgggtaaactatgacagactagaatcaacctcaggtgtatagatttggccctgctg

SEQ ID NO: 18767 - DNA, 434 bp, Homo sapiens
  chr12.fa.O7frz.58594413
  Located on chromosome 12
  Distance between a terminus base of telomere on chromosomal short arm and 5'-terminus of this base sequence : 58266688
  Distance between 3'-terminus of neighbour sequence of sequence listing upward to telomere on chrosomal short arm and 5'-terminus of this base sequence : 56668
gcaattgtattagtctatcctcacactgctataaagatatacctgagattgggtaatttataaagaaagaggtttaatttactcacagttctgtatggttggagaggcataaggaaacttacaatcatggcagaaggtgaaggggaagcaagtaccttcttcacaccgcggcatgagagagagatagtgagggggaaactgccacagacttttaaaccatcagatcttgtgagaagtcactcactatcacaagaacagcatgggggaaaccaccccatgatccaatcactcccaccacttccctccctcaacacacaaggattacaatttgagatgagatttgagtggggacacagagccaaaccatatcagcaatgcagatgtgtgtgtgtgtgtgtgtgtgtgtgtgtgcatgtaagcttatcatgtatggc

SEQ ID NO: 18768 - DNA, 153 bp, Homo sapiens
  DID22N_0007474
  Located on chromosome 12
  Distance between a terminus base of telomere on chromosomal short arm and 5'-terminus of this base sequence : 58295193
  Distance between 3'-terminus of neighbour sequence of sequence listing upward to telomere on chrosomal short arm and 5'-terminus of this base sequence : 28071
aattcacctccagggtcctttatatttttcaaaaagacgacacatttatatatatatatatatatatatatatatatatatatatatatatatatatatatatattttctaatacactttcttgtttttaagaatacctgtattgctggatca

SEQ ID NO: 18769 - DNA, 281 bp, Homo sapiens
  DISO7_00003005
  Located on chromosome 12
  Distance between a terminus base of telomere on chromosomal short arm and 5'-terminus of this base sequence : 58847274
  Distance between 3'-terminus of neighbour sequence of sequence listing upward to telomere on chrosomal short arm and 5'-terminus of this base sequence : 551928
ttggaagcctagggatctatgcaagaagttggagagggaaattgggcccctccctgaagccgggttaggatgggagtacaaaccccctccccaggaaccctgggtcaaaagagggtatcccaggggtttcttctcggctctcagttgctctcccaagccttcgcttttgcccacacagatcaaggaacacacacaaacacacacacacacacacacacacatgctctccctcccttctgccttaggcactagtttttcttttcaatcaaggtatgggctgt

SEQ ID NO: 18770 - DNA, 323 bp, Homo sapiens
  chr12.fa.O7frz.58890794
  Located on chromosome 12
  Distance between a terminus base of telomere on chromosomal short arm and 5'-terminus of this base sequence : 58988760
  Distance between 3'-terminus of neighbour sequence of sequence listing upward to telomere on chrosomal short arm and 5'-terminus of this base sequence : 141205
tagatttggcttctgattgtagtgcaggcacttagctgtgtgaccttgcagaagtgatttcacttattgaagcttcagttccccatatgtaaaacacagtggaatttccaggcagatctaagtccatatgtagcatgccttgataattcctttctcaaagtatataaaccctcaaatgatcatgagcctttattaaaaaaaatctgtctgagacccctcagtcatttgtccatccatccatccatccatccatccatccatccatccatccatccttcattcattcatccatttaagaactatttaatgagcacttaccattg

SEQ ID NO: 18771 - DNA, 212 bp, Homo sapiens
  DISO7_00000470
  Located on chromosome 12
  Distance between a terminus base of telomere on chromosomal short arm and 5'-terminus of this base sequence : 59097953
  Distance between 3'-terminus of neighbour sequence of sequence listing upward to telomere on chrosomal short arm and 5'-terminus of this base sequence : 108870
atgagccttcctgaggaagaatggcaaatattactgggcatctcttcagcctcagcacagacaagcccacatcccccaaccatgccagtatcgtaacttcctcctatactacgcaatgacaccctctacacacacacacacacgcacacacacacacacacacacacacacacacaaccccctcagccaggtgtagcactgcagtcttcagt

SEQ ID NO: 18772 - DNA, 170 bp, Homo sapiens
  DISO7_10000011
  Located on chromosome 12
  Distance between a terminus base of telomere on chromosomal short arm and 5'-terminus of this base sequence : 59183477
  Distance between 3'-terminus of neighbour sequence of sequence listing upward to telomere on chrosomal short arm and 5'-terminus of this base sequence : 85312
gtatcttcctttggctgagacttttttttttttaggttgaagctcgctttctctctctctccctctttctccctctctctctctctctcactctctctctctccatatatatatacatatatatatatatatatattttttttttaacaactggtaggataggttgggca

SEQ ID NO: 18773 - DNA, 178 bp, Homo sapiens
  DISO7_10000112
  Located on chromosome 12
  Distance between a terminus base of telomere on chromosomal short arm and 5'-terminus of this base sequence : 59272662
  Distance between 3'-terminus of neighbour sequence of sequence listing upward to telomere on chrosomal short arm and 5'-terminus of this base sequence : 89015
cctcagtttaaaatcggaggggcgtgtgtgtgtgtgtgtgtgtgtgtgtgtgtgtgtgtgtgtgtgtgtgttttcagtgaaagagagataagcaacagtggggacagcctgagtgtgtgtgtgtgtgtgtgtgtttcagtgaaagataagcaacagtggggaaagcctgagacagaca

SEQ ID NO: 18774 - DNA, 118 bp, Homo sapiens
  DISO7_10000114
  Located on chromosome 12
  Distance between a terminus base of telomere on chromosomal short arm and 5'-terminus of this base sequence : 59994826
  Distance between 3'-terminus of neighbour sequence of sequence listing upward to telomere on chrosomal short arm and 5'-terminus of this base sequence : 721986
ggtgagtaggccatgaaagtaaagcagaaatttgcttccaaataaatcatgtgtgtggtggtgtgtgtgtgtgtgtgtgtgtgtgtgtgtgttgaagagaaaggacttatcagtagct

SEQ ID NO: 18775 - DNA, 281 bp, Homo sapiens
  chr12.fa.O7frz.60090264
  Located on chromosome 12
  Distance between a terminus base of telomere on chromosomal short arm and 5'-terminus of this base sequence : 60123261
  Distance between 3'-terminus of neighbour sequence of sequence listing upward to telomere on chrosomal short arm and 5'-terminus of this base sequence : 128317
tatgcctcaataaagctgttacttaaaaaaaaaatatatatatatatatatacacacacacacacacacacacacacacacacacacaaccctaggtccagggctcaagctatgaaacagctgcagttctttcagaaaggtgactgagccagccccagcttgcagcagctgatctcaggttggcagtcttaagaagtgggctttgctaaaatcaacctgccctctgaccccattccagcaggggatttgcattgtaatattccagtttaaattagaggatg

SEQ ID NO: 18776 - DNA, 383 bp, Homo sapiens
  M12_60450207
  Located on chromosome 12
  Distance between a terminus base of telomere on chromosomal short arm and 5'-terminus of this base sequence : 60449904
  Distance between 3'-terminus of neighbour sequence of sequence listing upward to telomere on chrosomal short arm and 5'-terminus of this base sequence : 326362
aagcgtgcgttaagaatgcttaaccaggccgggcgggcccggtggctcaggcctgtaatcccagcactttgggaggctgaggcgggtggatcacgaggtcaggaattcgagcccagcctgaccaacatggtgaaaccccgtttctactaaaaatacaaaaattagccgggcatggtggcgggcgcctgtaatctcagctactcaggaggctgaggcaggagaatcgcttgaacccgggaggcggaggttgcagtgacagcgccactgcactccagcctgggtgacagagcgagactccgtctcaaataaataaataaataaataaataaataaatgcttaacccctgggaaaagctgagcggagaagagtaaggcaccacctg

SEQ ID NO: 18777 - DNA, 395 bp, Homo sapiens
  AF067572.1_2832
  Located on chromosome 12
  Distance between a terminus base of telomere on chromosomal short arm and 5'-terminus of this base sequence : 60471620
  Distance between 3'-terminus of neighbour sequence of sequence listing upward to telomere on chrosomal short arm and 5'-terminus of this base sequence : 21333
agctcagaattctggaagactctaggagtcccttggactgaagctggtctttgctctctcctcacagggcacccctcctgagactgtggtgggaaccagcacaagccggagctgctgcctgcagattcacaaggggcaagtttgaatacgaatctgctgtgttcctatctgccaagttcctatatgtttctggggtaaacactgagacacgccaagaaacaaacacacacatgcacaacttccctgaccacaagactacacacacacacacacacacacacacacacacgtgcaggcaggctcacaaacagagcccattgcaatcacaacaccacacacacacacacacacacacacacacacacacacacacagtcttgctcaacttctgagtc

SEQ ID NO: 18778 - DNA, 206 bp, Homo sapiens
  D12S1691
  Located on chromosome 12
  Distance between a terminus base of telomere on chromosomal short arm and 5'-terminus of this base sequence : 60471813
  Distance between 3'-terminus of neighbour sequence of sequence listing upward to telomere on chrosomal short arm and 5'-terminus of this base sequence : -202
ggtaaacactgagacacgccaagaaacaaacacacacatgcacaacttccctgaccacaagactacacacacacacacacacacacacacacacacgtgcaggcaggctcacaaacagagcccattgcaatcacaacaccacacacacacacacacacacacacacacacacacacacacagtcttgctcaacttctgagtcatca

SEQ ID NO: 18779 - DNA, 127 bp, Homo sapiens
  DISO7_10003405
  Located on chromosome 12
  Distance between a terminus base of telomere on chromosomal short arm and 5'-terminus of this base sequence : 60798097
  Distance between 3'-terminus of neighbour sequence of sequence listing upward to telomere on chrosomal short arm and 5'-terminus of this base sequence : 326078
ccagacagaaatcaactagctaagatctatctatctgtctgtctgtctatctatctatctatctatctatctatctatctatctgtctgtctatcttatatatatccaggatgggcagcatcctaat

SEQ ID NO: 18780 - DNA, 198 bp, Homo sapiens
  DISO7_10003406
  Located on chromosome 12
  Distance between a terminus base of telomere on chromosomal short arm and 5'-terminus of this base sequence : 60833135
  Distance between 3'-terminus of neighbour sequence of sequence listing upward to telomere on chrosomal short arm and 5'-terminus of this base sequence : 34911
gaagtgagagttagaggcatagaagattttacacacacacacacacgcacacacagatatacacaatacataaacacacacatatatatatacatatatatgtatacacatatgtatatgtatagaaattcaaatggaccagtatatgtttatacattgaggaaagagtaataaagcaagaaatgtgatagagaacaa

SEQ ID NO: 18781 - DNA, 264 bp, Homo sapiens
  DISO7_10003407
  Located on chromosome 12
  Distance between a terminus base of telomere on chromosomal short arm and 5'-terminus of this base sequence : 60945763
  Distance between 3'-terminus of neighbour sequence of sequence listing upward to telomere on chrosomal short arm and 5'-terminus of this base sequence : 112430
tgctcatgtgtatgaaatgctttatacacacacacacacacacacacagacatatatatatgtataagtatatatgcaaaatattattcctctgaactaaaaagagacaggttttatattgaatagtgcctaaaaatttcaagccaattttggaaggaaaaaaaaaaggaatttcagctagtcaaatgtaatgtaagaaaatgagttgtgcttttcctttaatacatgataaattatggctttccaaattctagctcttcgaca

SEQ ID NO: 18782 - DNA, 394 bp, Homo sapiens
  HUMUT7465B
  Located on chromosome 12
  Distance between a terminus base of telomere on chromosomal short arm and 5'-terminus of this base sequence : 61123575
  Distance between 3'-terminus of neighbour sequence of sequence listing upward to telomere on chrosomal short arm and 5'-terminus of this base sequence : 177548
gggcaacagagaaagacttcatctcaaaaaaaagcaacaaaatacacacacacatatatatatatataagtacatatatagatagatagatagatagatagatagatagatagatagatagatagatagatataatttaaagtgggggtgaaagtaagaccaggaaatgaagctagagacagaattttctgagaacaatagggcaggggaaatgtcaagtgtgtccaggtagccttcggcttttactacttcactgatccttaagataattacttccttcttactagcctccctcttctcctgtctccaggtgctgcttgcatcaatgctggttcaaagaaaaactatagctggacagcagttaaaacagtaaaaccaaatttttgcaggacta

SEQ ID NO: 18783 - DNA, 214 bp, Homo sapiens
  G08967
  Located on chromosome 12
  Distance between a terminus base of telomere on chromosomal short arm and 5'-terminus of this base sequence : 61123589
  Distance between 3'-terminus of neighbour sequence of sequence listing upward to telomere on chrosomal short arm and 5'-terminus of this base sequence : -380
gacttcatctcaaaaaaaagcaacaaaatacacacacacatatatatatatataagtacatatatagatagatagatagatagatagatagatagatagatagatagatagatagatataatttaaagtgggggtgaaagtaagaccaggaaatgaagctagagacagaattttctgagaacaatagggcaggggaaatgtcaagtgtgtccag

SEQ ID NO: 18784 - DNA, 233 bp, Homo sapiens
  Z67309
  Located on chromosome 12
  Distance between a terminus base of telomere on chromosomal short arm and 5'-terminus of this base sequence : 61162980
  Distance between 3'-terminus of neighbour sequence of sequence listing upward to telomere on chrosomal short arm and 5'-terminus of this base sequence : 39177
gattcaacatttgatagcactgtgtcctctgtgtgtgtgtgtgtgtgtgtgtgtgtgtgtgtatacaagaaaatgacatcataagagtatcagagaattcagtgatacattaatcctgtttctaggtcactgttattccctgatacattttgggagattaaacagaattttatgtacctcttcttcctctattacaactatctttgctgtcactctgccttcacgcctatttt

SEQ ID NO: 18785 - DNA, 317 bp, Homo sapiens
  AC020637.9_92879
  Located on chromosome 12
  Distance between a terminus base of telomere on chromosomal short arm and 5'-terminus of this base sequence : 61365897
  Distance between 3'-terminus of neighbour sequence of sequence listing upward to telomere on chrosomal short arm and 5'-terminus of this base sequence : 202684
ataagcactgacagtaatgaagagaaagaaaatgctggtaaaaatcaacattaacaggatagatagatgatagacagatgataatgatgaagatagataatgatagataatgaggatagattgattgataggtaggtagatagatagatagatagacaggaataataaagactgagaccaagaatttgaagcagaagagacaatgttatttttcatttattctgatattgcttcatggccagtactggttccagatgatttgagagttaattggattaagagaagatataaacctcttcagattaaaggtgaacctt

SEQ ID NO: 18786 - DNA, 376 bp, Homo sapiens
  AC053532.3_66436
  Located on chromosome 12
  Distance between a terminus base of telomere on chromosomal short arm and 5'-terminus of this base sequence : 61505162
  Distance between 3'-terminus of neighbour sequence of sequence listing upward to telomere on chrosomal short arm and 5'-terminus of this base sequence : 138948
tatttcaatgtcagctggttagcaactttaattctagctgcaacataaatttccttttggcatatatcatatcatatcatatcatatcatatcatatcataccatatcatacattcacagcttccagggattaagatgtgaacatctttaggggccattattctgcctgccacacatcatttagtccctgcaactctatgagctctgtatataattgccttcatattgctagtaagaaaataggctcagagagattgagccacatgtccaaagctagtatgtgtggagtccagctagttgtatagtttatgtgtgcataaatatctctctcacacataaaatcagggcccatctcaaacattatgtttcagacttt

SEQ ID NO: 18787 - DNA, 310 bp, Homo sapiens
  AC025420.11_21455
  Located on chromosome 12
  Distance between a terminus base of telomere on chromosomal short arm and 5'-terminus of this base sequence : 61786268
  Distance between 3'-terminus of neighbour sequence of sequence listing upward to telomere on chrosomal short arm and 5'-terminus of this base sequence : 280730
ttcacatgatccttctgagtatctgggactacaggtgcacaccatcacacctggcttatttatttatttatttatttatttatttatttattttgggtagagatgaggtttcaccatgttgcccaggttgctcttgaatttctagcctcaagcagtctgcccatcctggcctcctaaaatgctcaaattacaggcatgaggcaccgcactggccaaaagtcactttctttatgtcagaccttgctgttaatcggactgtgcaagtaacaagtgactgaatctgcatttctgttacattcatggcttaaaa

SEQ ID NO: 18788 - DNA, 323 bp, Homo sapiens
  chr12.fa.O7frz.62078491
  Located on chromosome 12
  Distance between a terminus base of telomere on chromosomal short arm and 5'-terminus of this base sequence : 61876562
  Distance between 3'-terminus of neighbour sequence of sequence listing upward to telomere on chrosomal short arm and 5'-terminus of this base sequence : 89984
ccaaccatactaaactgagttaattaaacctccttcctttataaattacccagtcttgggcagttctttatatcagtgtgtgaacagactaatattatatattgtacattatatattttatataccatattttcatatatatatatacatatatatatatatatatatatcaaaggttctgaaactctcaacctgaatcaagcatcagaatcacctggaaggcttgctaaaaagatttctgggcccactcctccctgccaacctccagcttccgctttggcgggtagggcctagaatttactaatgctgttaaattaggaacc

SEQ ID NO: 18789 - DNA, 137 bp, Homo sapiens
  DISO7_10000116
  Located on chromosome 12
  Distance between a terminus base of telomere on chromosomal short arm and 5'-terminus of this base sequence : 61887227
  Distance between 3'-terminus of neighbour sequence of sequence listing upward to telomere on chrosomal short arm and 5'-terminus of this base sequence : 10342
cttagactccctctccacatgtatttataatttataaatacacacacacacacacacacagagagagagagagagagagagagagaattctaatgacttctgattattttcaggataaagccaacatttcttgcctt

SEQ ID NO: 18790 - DNA, 148 bp, Homo sapiens
  DISO7_10000115
  Located on chromosome 12
  Distance between a terminus base of telomere on chromosomal short arm and 5'-terminus of this base sequence : 61890924
  Distance between 3'-terminus of neighbour sequence of sequence listing upward to telomere on chrosomal short arm and 5'-terminus of this base sequence : 3560
tcactttgactatgtcacctctctcatctcaacccccaagtcagcacagtgccacacacacacacacacacacacacacacacacacacaaagaattccctagggcccatggtttctacaaagaaaaaagagaaccagaggtggacac

SEQ ID NO: 18791 - DNA, 170 bp, Homo sapiens
  DISD22_0008338
  Located on chromosome 12
  Distance between a terminus base of telomere on chromosomal short arm and 5'-terminus of this base sequence : 62126836
  Distance between 3'-terminus of neighbour sequence of sequence listing upward to telomere on chrosomal short arm and 5'-terminus of this base sequence : 235764
cctagctaattcctcaaagtatcctaattttttagagaaatggtcaaatgtaaaaagatattgagaatacttatattcaccagtatagacgatctttctctctctctctgtctctctcacacacacacacacacatacatgcacacacatgcaactatttctgctatgcg

SEQ ID NO: 18792 - DNA, 161 bp, Homo sapiens
  DISO7_10000120
  Located on chromosome 12
  Distance between a terminus base of telomere on chromosomal short arm and 5'-terminus of this base sequence : 62373441
  Distance between 3'-terminus of neighbour sequence of sequence listing upward to telomere on chrosomal short arm and 5'-terminus of this base sequence : 246435
tcaagtgacaactcccagggaacctaacataagcaaacacacacacacacacacacacacacacggaacctaacataagcaaacacacacacacacatacacacacacacacacacacacacacacacacacacacacaccctattgctcctgtcctggta

SEQ ID NO: 18793 - DNA, 443 bp, Homo sapiens
  chr12.fa.O7frz.62801931
  Located on chromosome 12
  Distance between a terminus base of telomere on chromosomal short arm and 5'-terminus of this base sequence : 62664116
  Distance between 3'-terminus of neighbour sequence of sequence listing upward to telomere on chrosomal short arm and 5'-terminus of this base sequence : 290514
tgcttcttatgtatctttatccacagtgcttggcacagagcacctggacacaggcttgttaaaggaatgaaggaaagaaggggaggaagcctgggccttctgagtcagtgagaatgggactttgaataaacatgcttcgggggagacctgcttaccagtccccaagggccccagtctgtcaccaccttgcacccttacccacactgttaactcaaatggatgcttttgggctctctctctctctctctctctctctctggtgtatgtatttgcacatggagagggctctgtttctttttgcttcagggacctcgctggccctgcagtctgttcagtctggctgggctaaaaacaaaacaaaacaaaacaaaacaaccacaaaacaactcctggatcaactctggaggacccctctcagagtgtcctagatagccagcattagt

SEQ ID NO: 18794 - DNA, 118 bp, Homo sapiens
  DISO7_10003404
  Located on chromosome 12
  Distance between a terminus base of telomere on chromosomal short arm and 5'-terminus of this base sequence : 62850887
  Distance between 3'-terminus of neighbour sequence of sequence listing upward to telomere on chrosomal short arm and 5'-terminus of this base sequence : 186328
agagtattcatagcagcttctcagattagtgtgtgtgtgtgtgtgtgtgtgtgtgtgtgtgtgtgtgtgcctgtgcctatgtgtatatgtgtgtgtgatctgagtaagagttggcctc

SEQ ID NO: 18795 - DNA, 209 bp, Homo sapiens
  chr12.fa.O7frz.60707046
  Located on chromosome 12
  Distance between a terminus base of telomere on chromosomal short arm and 5'-terminus of this base sequence : 62918889
  Distance between 3'-terminus of neighbour sequence of sequence listing upward to telomere on chrosomal short arm and 5'-terminus of this base sequence : 67884
tgcaatgattaatacacagctaagtcttgaggggcacctctgcagatggctagattctctctctctctctctctctcttttctccctccctcttttctcttccttctggcacccttctctgtttattccagctttcttgatcttcctgagcttacagctgtatctccactacttagaatgactgcgtttctctacgtaagttctttcct

SEQ ID NO: 18796 - DNA, 154 bp, Homo sapiens
  DISO7_10003403
  Located on chromosome 12
  Distance between a terminus base of telomere on chromosomal short arm and 5'-terminus of this base sequence : 63014475
  Distance between 3'-terminus of neighbour sequence of sequence listing upward to telomere on chrosomal short arm and 5'-terminus of this base sequence : 95377
tgtcagtatgcttgtaacatgcttgtgtctgtgtgtgtgtgtgtgtatatatatggatatatatatatttggagatatatatatatatggatatatatatatatatggactttcaagaaaaaaataaaaagtatcagattgaaacttcctcatt

SEQ ID NO: 18797 - DNA, 373 bp, Homo sapiens
  DISO7_00033132
  Located on chromosome 12
  Distance between a terminus base of telomere on chromosomal short arm and 5'-terminus of this base sequence : 63093018
  Distance between 3'-terminus of neighbour sequence of sequence listing upward to telomere on chrosomal short arm and 5'-terminus of this base sequence : 78389
aggattgcagactgccttggaaagggcggtcgtgcccagtgccactttcccggtagggctgaggagggacttctgtagttccaattccagggaaattaaaattttacacacacacacacacacacacacacacacacacacacacacacacgagacatagaagaggaaacgaggagtggtttctctacaattgttttttgatttcctttcctgtattatttcgtgtcctccttccctcttgggtcccaaaggagatgcggcagaggaataaaatagcggacaatgatgaaagtgatgggaaaaagactggacccagaggaaagagtgactactggatgccatttcctgtcaccccatgcttcatggctaaccc

SEQ ID NO: 18798 - DNA, 320 bp, Homo sapiens
  chr12.fa.O7frz.68423982
  Located on chromosome 12
  Distance between a terminus base of telomere on chromosomal short arm and 5'-terminus of this base sequence : 63160621
  Distance between 3'-terminus of neighbour sequence of sequence listing upward to telomere on chrosomal short arm and 5'-terminus of this base sequence : 67230
tgtaattaaagacattgctcactaagttttaaagtcttcacagctggtgtctaaaaataaaaatattgtatacatttacagagtaatcatttttcattgagctctcaacatagagagatgcattgcttaagttactggcatcatgaattacaggaatttatatatatatacacacacacacacatatatgtaacttttatatacatataacttttatatatataacacgtgtgtgtgtgtgtgtgtgtgtgtgtgtgtgtgtctatgtgtgtgtgtcttggttctttctaaagtgtctgacctttgttatctttattcgg

SEQ ID NO: 18799 - DNA, 101 bp, Homo sapiens
  DISD22_0008344
  Located on chromosome 12
  Distance between a terminus base of telomere on chromosomal short arm and 5'-terminus of this base sequence : 63305659
  Distance between 3'-terminus of neighbour sequence of sequence listing upward to telomere on chrosomal short arm and 5'-terminus of this base sequence : 144718
ctcagttcaatccatcttaagcaaatacacaaacacatacacacacacacacacacacacacacacacgtatatatacaagatattagcgtacttcacaga

SEQ ID NO: 18800 - DNA, 296 bp, Homo sapiens
  DISD22_0008346
  Located on chromosome 12
  Distance between a terminus base of telomere on chromosomal short arm and 5'-terminus of this base sequence : 63440801
  Distance between 3'-terminus of neighbour sequence of sequence listing upward to telomere on chrosomal short arm and 5'-terminus of this base sequence : 135041
ttgatgtaatgctttcattcttcaaagcacatgtttttattctttgaagaacctgggcatatatacaccatatctatatacacatcatatacatatatatatatatatatatatatatatatatatatatatatacacacacacaccatatatatactatatatatatcatacacatatacaccatatatatgccatatttataatatatacatctatataccatatatatgtataaaaatatggtagatattaaaaatgaaattcaatatatgatgtgaatttaaggaagcctag

SEQ ID NO: 18801 - DNA, 368 bp, Homo sapiens
  chr12.fa.O7frz.67779070
  Located on chromosome 12
  Distance between a terminus base of telomere on chromosomal short arm and 5'-terminus of this base sequence : 63606700
  Distance between 3'-terminus of neighbour sequence of sequence listing upward to telomere on chrosomal short arm and 5'-terminus of this base sequence : 165603
taaagtggaagtgagtctcagtagacagcacatggtgaggccttgttaatttttgtttttgtttttagacacaatcaatcactctacaccttttgattgaatttacttcatttttatacagagtatttattgataggtaaggtttcaccattttcaatttgttaattgttttctggatgatttttatatcctttgttcctttcttcccctcttgctggttttgtgtgtgtgtgtgtgtgtgtgtgtgtgtgtgtgtgtgtgtggtttgaggattttatgtaatcatatgctttggttcctttctcttcatcttttgtatatctactataggtttgtgctttatggttaccgtgatgcttacatataac

SEQ ID NO: 18802 - DNA, 309 bp, Homo sapiens
  D12S1056
  Located on chromosome 12
  Distance between a terminus base of telomere on chromosomal short arm and 5'-terminus of this base sequence : 63677671
  Distance between 3'-terminus of neighbour sequence of sequence listing upward to telomere on chrosomal short arm and 5'-terminus of this base sequence : 70603
ttcttgggtgtgattagcatgagcagcattgaacatttaacattaatgaaaatatagatagatagatagatagatagatagatagatagatagatagatagatacaggtagatatagagaagtgatgatggttgaatttgaagttatatttatctgcctaacccattgtgctgaaactagcataacaccctttaatgctactcataaacttaagttggctctgaagaaaaacagaaagggaaacttgttgattacagtctgtattctagagattttctagctgtcaccattaatccccaactctttccc

SEQ ID NO: 18803 - DNA, 218 bp, Homo sapiens
  D12S1072
  Located on chromosome 12
  Distance between a terminus base of telomere on chromosomal short arm and 5'-terminus of this base sequence : 63688518
  Distance between 3'-terminus of neighbour sequence of sequence listing upward to telomere on chrosomal short arm and 5'-terminus of this base sequence : 10538
gacagcagaacgaccactctacagagcaggcccgtcccataggcagagtggcccagagtagcagtggacagcagaatgacggctcacagagcagggctgtcccgtagggagagtggctcacagtatcagtggaaagcaaaatggctgctccgtagcccagcagcccacagcagcagcagcagcagcagcagcagcagtgtacggcaatagcagcagtt

SEQ ID NO: 18804 - DNA, 305 bp, Homo sapiens
  DISO7_10003431
  Located on chromosome 12
  Distance between a terminus base of telomere on chromosomal short arm and 5'-terminus of this base sequence : 63829132
  Distance between 3'-terminus of neighbour sequence of sequence listing upward to telomere on chrosomal short arm and 5'-terminus of this base sequence : 140396
tctgtccatttgatcatgcttgtaaatactactttgatgtactatatatatatatatatatatatatatatatgtaaacatttacacaggattattttcaagatgatatagggttgctataccacaaagaatgatacttttagtggaggaaaaagtctagattaactttactctattggaggaaaagatgagcgagaaagacaattttaggatacagatctagccaggctttctgggcagtattcactgctcttctgataaatgtcaatgtctctctttaaagaaggggccaaggctgtagctac

SEQ ID NO: 18805 - DNA, 292 bp, Homo sapiens
  chr12.fa.O7frz.67321394
  Located on chromosome 12
  Distance between a terminus base of telomere on chromosomal short arm and 5'-terminus of this base sequence : 64129391
  Distance between 3'-terminus of neighbour sequence of sequence listing upward to telomere on chrosomal short arm and 5'-terminus of this base sequence : 299954
aaattggataacctaaatccagtaaaaaatgcctaggaggacaacatttttcaagataaataatgatgaaatagaaaatctgaatataccttcaactagtaagaagatttaaaccataataataataataataataataataataataaactctaaacaaagaaaatgcctgaatttgatggctttatggatgaattataccaaatattttaagaattaacaccaatatttctcggacatttcaaaaaatggaataatataaaacacttcctatctcattctatgaggccat

SEQ ID NO: 18806 - DNA, 306 bp, Homo sapiens
  chr12.fa.O7frz.67226050
  Located on chromosome 12
  Distance between a terminus base of telomere on chromosomal short arm and 5'-terminus of this base sequence : 64223903
  Distance between 3'-terminus of neighbour sequence of sequence listing upward to telomere on chrosomal short arm and 5'-terminus of this base sequence : 94220
ttgcatacagtgacaagttatagactaagagaaaatatttgcatatatatgtgtgtatatatgcagttcaaaatagtatatatatacatatatatatataaagttttagagcaaagtatatacgtgtgtgtgtgtgtgtgtgtgccttagttcatttgggctgctataaaaaataccatgcactgagtgacatgaataacagaaatttatttctcatagttctgaaagttgagaagtccaagatcaatgcaccagcagattcagtgtctggtgacagcccctttctgtctggtgtcagtacattct

SEQ ID NO: 18807 - DNA, 408 bp, Homo sapiens
  AC026082.4_107505
  Located on chromosome 12
  Distance between a terminus base of telomere on chromosomal short arm and 5'-terminus of this base sequence : 64332519
  Distance between 3'-terminus of neighbour sequence of sequence listing upward to telomere on chrosomal short arm and 5'-terminus of this base sequence : 108310
caagttgtcctggatttaattatttatattactacaagatatttcaaccataaaaatggaattttgttcgctagaaactttctggattgtatcaaatctgcaactttctggagtctattaaatttctgctgaaagagtatgaaaatgtatattctaaataagtaggaaaacttatttcttattatgactgcctcatgtttttgataattcatgatactgtcatattttttttccagatctttagagtgaaaatgttatcccattgatatatttttattattattattattattattattattatactttaagttttagggtacatgtgcacaatgtgcaggttagttacatatgtatacatgtgccatgctgctgtgctgcacccattaactcgtcatttagcgttag

SEQ ID NO: 18808 - DNA, 322 bp, Homo sapiens
  AC020647.9_113887
  Located on chromosome 12
  Distance between a terminus base of telomere on chromosomal short arm and 5'-terminus of this base sequence : 64449789
  Distance between 3'-terminus of neighbour sequence of sequence listing upward to telomere on chrosomal short arm and 5'-terminus of this base sequence : 116862
acaatttccttcttaaagccacctggggactaactaatcactgctaatctcaattacactgagtaacttattccttaacaaaatcaaagctcttataaaatagttccaaactgcttctttgaaagcagttcaaaacagcttatttgaaagcattatatatctctttttgccataaaatagctagcacttagtatttagaattgttgccaatttgatatatatatatatatatatatatacacacacacacacaaatacatatatatcattgttataatatacttttaggaaattaatagtgaaattgaaccagtgtttacat

SEQ ID NO: 18809 - DNA, 313 bp, Homo sapiens
  AC020647.9_40509
  Located on chromosome 12
  Distance between a terminus base of telomere on chromosomal short arm and 5'-terminus of this base sequence : 64523246
  Distance between 3'-terminus of neighbour sequence of sequence listing upward to telomere on chrosomal short arm and 5'-terminus of this base sequence : 73135
atacgtaagacaaatccctgactacaaaaattcaactgtatatgtaactttcaatgcaatgcaaaaaacaaggccccaaaagagagtagtaagatggtgtgcgtgcttgtgtgtgtgtgtgtgtttgtgtgtgtgtgtgtgtgtgtgtgtgtgtgtgtgttttgggggctgcaggttatgctaatccatctaacctccctctttcagctactcaggacacaggcatgaactaacaagacaattcatggattttaggggtacaatccacagtgtagaaggagatgctctcccatgttatgcactgatcgtacaa

SEQ ID NO: 18810 - DNA, 378 bp, Homo sapiens
  chr12.fa.O7frz.65954821
  Located on chromosome 12
  Distance between a terminus base of telomere on chromosomal short arm and 5'-terminus of this base sequence : 64649567
  Distance between 3'-terminus of neighbour sequence of sequence listing upward to telomere on chrosomal short arm and 5'-terminus of this base sequence : 126008
tggcttatttcacttagcatagtgtctttcagggtcatccattttgtcacaaataactggatctcctttttaaggctcaataatattcgtgtgtgtgtgtgtgtgtgtgtgtgtgtgtatcccaatttctttatttactcatctgttgacagacacttaggttgtttccatagcctggctattgtgaataatgctgcaattaacacttctaaattatccccacagcttttaatgcagaggtaggtgcaattctacttattgtaatcttacccaaaacatcaacagggacccatctgatgattatcccctttgaggttgttggttaagggtacaaacttgtagttaaaagactaataagttctggaaacctaatgtacg

SEQ ID NO: 18811 - DNA, 101 bp, Homo sapiens
  DISO7_10003427
  Located on chromosome 12
  Distance between a terminus base of telomere on chromosomal short arm and 5'-terminus of this base sequence : 64703924
  Distance between 3'-terminus of neighbour sequence of sequence listing upward to telomere on chrosomal short arm and 5'-terminus of this base sequence : 53979
cggaagaaccacattaaatgtcttcctatctctctctctctctctctctctctctctctgtcatgcagacacacacacaccccatgcaggactctagagaa

SEQ ID NO: 18812 - DNA, 290 bp, Homo sapiens
  DISO7_10003424
  Located on chromosome 12
  Distance between a terminus base of telomere on chromosomal short arm and 5'-terminus of this base sequence : 64797699
  Distance between 3'-terminus of neighbour sequence of sequence listing upward to telomere on chrosomal short arm and 5'-terminus of this base sequence : 93674
aatgcttctcctcatcatttctgtcatttttcttcagaagatgtaatatatcccccacatttgaagtatatattaaaattcaaatggttaacactttatacttcttcattctactttctccctctctctcacacacacacacacatacattctgaaccctcccccaacacacacacacacacacctaccccacatattctcaaatctcccccaccacacacatacacacacacacacacacacacacacacacaccaccttttgagggagaactagttctaaaccatcaa

SEQ ID NO: 18813 - DNA, 230 bp, Homo sapiens
  DISO7_10003423
  Located on chromosome 12
  Distance between a terminus base of telomere on chromosomal short arm and 5'-terminus of this base sequence : 64828034
  Distance between 3'-terminus of neighbour sequence of sequence listing upward to telomere on chrosomal short arm and 5'-terminus of this base sequence : 30045
tctatacacaggcatgaacataacaaaattatgttatgttatgttatgttatgttatgttatgttatgttatgttatgttatgttatgttgttttgtactagagcctcatactcctggaatcaaatgatcctttgcctcaacctcctgagtagctgaacctacaggcacctgccaccacacctggctaaataatgtattttattattaaaggaatgcatgtggataaaca

SEQ ID NO: 18814 - DNA, 163 bp, Homo sapiens
  DISO7_10003422
  Located on chromosome 12
  Distance between a terminus base of telomere on chromosomal short arm and 5'-terminus of this base sequence : 64840002
  Distance between 3'-terminus of neighbour sequence of sequence listing upward to telomere on chrosomal short arm and 5'-terminus of this base sequence : 11738
catagaatttaacatgttgccagtttaaacttaatacagtctctctctctctctcttcctctctctctctctctctctcacacacacacacacacacacacacacacacacagacgcaaacattacagaatttgcaaaaatgatctgaattctgactcctcag

SEQ ID NO: 18815 - DNA, 189 bp, Homo sapiens
  DISO7_10003420
  Located on chromosome 12
  Distance between a terminus base of telomere on chromosomal short arm and 5'-terminus of this base sequence : 64864051
  Distance between 3'-terminus of neighbour sequence of sequence listing upward to telomere on chrosomal short arm and 5'-terminus of this base sequence : 23886
tcagagtaaaggttgcttatgagtttgctttgtgtgtgtgtgtgtgtgtgtgtgtgtgtgtgtgtgtgtctgtggtttttaaggttttttttctccacgaaccattttgtaaaatccaagaggggatttcatactcacaaaaagataattttttccctctctctctcttattgccataatcaaactcac

SEQ ID NO: 18816 - DNA, 153 bp, Homo sapiens
  DISO7_10003419
  Located on chromosome 12
  Distance between a terminus base of telomere on chromosomal short arm and 5'-terminus of this base sequence : 65029837
  Distance between 3'-terminus of neighbour sequence of sequence listing upward to telomere on chrosomal short arm and 5'-terminus of this base sequence : 165597
tgggatgtgctgattctgtgtgtgtgtatgtacatgtgtatatatatatacatatatatgtgtgtgtgtgtgtgtgtgtgtgtgtgtgtgtgtgtgtgatttgctaagtccactcaaattttaggcagatttttcccttaggctcatgtagcc

SEQ ID NO: 18817 - DNA, 220 bp, Homo sapiens
  chr12.fa.O7frz.65436767
  Located on chromosome 12
  Distance between a terminus base of telomere on chromosomal short arm and 5'-terminus of this base sequence : 65201715
  Distance between 3'-terminus of neighbour sequence of sequence listing upward to telomere on chrosomal short arm and 5'-terminus of this base sequence : 171725
aggttgaaggttgtattagtcagtcagtgttttctaggagggacagaatgaataggatgtatcaatagataggatagatagatagatagatagatagatagatagatagatagatgacagatagatagatagatgatagatagatagaaggagatttattaggggaattggctcacataataatgaaggctaagaagtctcatgataggttgtctgtaag

SEQ ID NO: 18818 - DNA, 300 bp, Homo sapiens
  G08960
  Located on chromosome 12
  Distance between a terminus base of telomere on chromosomal short arm and 5'-terminus of this base sequence : 65201733
  Distance between 3'-terminus of neighbour sequence of sequence listing upward to telomere on chrosomal short arm and 5'-terminus of this base sequence : -202
gtcagtcagtgttttctaggagggacagaatgaataggatgtatcaatagataggatagatagatagatagatagatagatagatagatagatagatgacagatagatagatagatgatagatagatagaaggagatttattaggggaattggctcacataataatgaaggctaagaagtctcatgataggttgtctgtaagctggagaaccagggaagtgtaaatatgtctcagtccaagtgtaaagtcttcagaactagggaagatgatggtgtaactctcagttcaaggctgaagga

SEQ ID NO: 18819 - DNA, 462 bp, Homo sapiens
  chr12.fa.O7frz.65071433
  Located on chromosome 12
  Distance between a terminus base of telomere on chromosomal short arm and 5'-terminus of this base sequence : 65356914
  Distance between 3'-terminus of neighbour sequence of sequence listing upward to telomere on chrosomal short arm and 5'-terminus of this base sequence : 154881
gcaaagactagtttcaggatataacagaacagcgtgtctagagagcaactgccggactggagcagaggtcacgttccaggaaagaagttgctaggagagggaaaaagagagaaaaagagaatactgcaagtttgaccacatgaaaaactattgtgaagtatattttacagtgctgttttatggtatagaaagaccaaatcaagaaatatgttgaatagaagtgatgaggatcttgccttgtttttgatcttgtgagggggaatttgtttctctctacatgcacacacacacacacacacacacacacacacacacacacacacacaaaacaaaaaaaaacaaaaaaaaaacacattttcactatatgtatgctattagctataggttgttctaggtgcctttcaccagattgaggaatttctctctattcctagtttgctaagcattgttatcattaaagct

SEQ ID NO: 18820 - DNA, 463 bp, Homo sapiens
  AC048341.7_105282
  Located on chromosome 12
  Distance between a terminus base of telomere on chromosomal short arm and 5'-terminus of this base sequence : 65499560
  Distance between 3'-terminus of neighbour sequence of sequence listing upward to telomere on chrosomal short arm and 5'-terminus of this base sequence : 142184
ccacgtagtttggatttagttaacttcttataaattgatagatgtcttcccataaaaacacatgtgcatggctgcatgtggtttttaaaaccccatgatgttattttacaatcctaagaatacctaaataataatgctttgtctcttcacttaataagcctgcagatgagaaacctataaattagcagttgatattaaaatgcaaatattattattattattattattattattattattattatttgaggtggattctcactctgttgcccaggccggaatgcagtgatgcaatcttggctcactgcaatgtctgcctcccaggttcaagtgattctcccacctcagcctcctgagtagctgggactacatgcgtgcgccaccatgcccggctaattttggtatttttagtagagacggggtttcaccatgttggccaggctggtcttgacctccagacctc

SEQ ID NO: 18821 - DNA, 463 bp, Homo sapiens; identical to SEQ ID NO: 18820
  AC026677.8_143674
  Located on chromosome 12
  Distance between a terminus base of telomere on chromosomal short arm and 5'-terminus of this base sequence : 65499560
  Distance between 3'-terminus of neighbour sequence of sequence listing upward to telomere on chrosomal short arm and 5'-terminus of this base sequence : -463

SEQ ID NO: 18822 - DNA, 174 bp, Homo sapiens
  chr12.fa.O7frz.64830946
  Located on chromosome 12
  Distance between a terminus base of telomere on chromosomal short arm and 5'-terminus of this base sequence : 65662778
  Distance between 3'-terminus of neighbour sequence of sequence listing upward to telomere on chrosomal short arm and 5'-terminus of this base sequence : 162755
ataagtgattaatggagtcaacacttattgattgggaatatatataatatcatttcgtgtgtgtgtatacacacacacacacacacacacacacacacacacacacatatatatatatgaatgaaacagcaagaaaacatgtctaacacttaactcctttaagacttgactgtt

SEQ ID NO: 18823 - DNA, 228 bp, Homo sapiens
  chr12.fa.O7frz.64662037
  Located on chromosome 12
  Distance between a terminus base of telomere on chromosomal short arm and 5'-terminus of this base sequence : 65817198
  Distance between 3'-terminus of neighbour sequence of sequence listing upward to telomere on chrosomal short arm and 5'-terminus of this base sequence : 154246
gtccttgtatgtcttgatcactactacatgtatggcccataaactgtccccgacacatagagggtcagtattactatgtttatgatcctacacacacacacacagacacacacacacacacacacacacacacacacaccccttactggactatcagggtatccaggacttgtgattctgctattatggtgcaggaactgacaagtgaagataagaattcagaactca

SEQ ID NO: 18824 - DNA, 468 bp, Homo sapiens
  chr12.fa.O7frz.64181617
  Located on chromosome 12
  Distance between a terminus base of telomere on chromosomal short arm and 5'-terminus of this base sequence : 65953965
  Distance between 3'-terminus of neighbour sequence of sequence listing upward to telomere on chrosomal short arm and 5'-terminus of this base sequence : 136539
gtgctgatagtatttgtctttcagcagtttgaatatgtcaactcatttcctgctggattctgcactttctgatgacaagttagctattaatcttttttcagtatgccttttatgtgatgagtcacttttctcttgctgctttcaagattctctctgtcttgtttgtctttttgatgatttgactacaatgtgcctagatgtacatttattttagtttatactagttggatttttttgagatttttggatcagcaagttagtatttttcatcaaacttcagatgttttcagttgttatttctttaaatattatctccctcttttggggggatacccattatattgctatacttaatggtatcccacaggtctctaaggctctgttcctttgtctttattcttgttttttgtttgtttgtttgtttgtttgttttgttttcttctcctcagattcagtaagtttcaattg

SEQ ID NO: 18825 - DNA, 288 bp, Homo sapiens
  chr12.fa.O7frz.64473235
  Located on chromosome 12
  Distance between a terminus base of telomere on chromosomal short arm and 5'-terminus of this base sequence : 65963752
  Distance between 3'-terminus of neighbour sequence of sequence listing upward to telomere on chrosomal short arm and 5'-terminus of this base sequence : 9319
tatcatgataacttggagtcaaacaatgaaagttcaatggtgaaactgtgataaacttgagttagtgtgtgatatggagtgatttgctaatcttctatgagactttaataatctctcgtgtgtgtgtgtgtgtgtgtgtgtgtgtgtgtgtgagagagagagagagacaaggtctcactcttgtcacccaggctgaagtgcagtggtgcaatcttggctcactgcagccttgacttccagagctcaggtgatcctcccattttagcctatcgagtagcctgaactaca

SEQ ID NO: 18826 - DNA, 416 bp, Homo sapiens
  chr12.fa.O7frz.64366843
  Located on chromosome 12
  Distance between a terminus base of telomere on chromosomal short arm and 5'-terminus of this base sequence : 66069462
  Distance between 3'-terminus of neighbour sequence of sequence listing upward to telomere on chrosomal short arm and 5'-terminus of this base sequence : 105422
ctacaaaggacatgaactcaacattttttatggctgcaggaatggaacaatgagaacacttggacacaggaaggggaacatcacacaccagggcctgttgtggggtgggggggaggggggaaggatagcattaggagatatacctaatgtaaatgacgagctaatgggtgcagcgcaccaacatggcacatgtatacataagtaacaaacctgcacgttgtgcacatgtagcctagaacttaaagtataataaaagcatatatatatatatatatatatataaaagaaacaaacaaacaaacaaaaacaggcttaactgtgtttttattagcaatggtcatattttaaaggcatctttcttatgcagcattgaatattttaacaaactgaaacttaaccttgacagtaccactaaa

SEQ ID NO: 18827 - DNA, 273 bp, Homo sapiens
  DISD22_0008364
  Located on chromosome 12
  Distance between a terminus base of telomere on chromosomal short arm and 5'-terminus of this base sequence : 66156847
  Distance between 3'-terminus of neighbour sequence of sequence listing upward to telomere on chrosomal short arm and 5'-terminus of this base sequence : 86969
tgcaggaggttatgatcctacatataacaaataagtaagtatatatgcatatgtgtgtgtgtatatatatatatatatagagagagagagagagggagagagagagagagagagagagagagagagagagagagagagagggagagagagaaaatccacaactagaaactaaatttgtgcagttatttaatttttgattgatgtaaatttaaatttaagcagccccatttttctagtggctaccatattggggagtttcaccagttagagtga

SEQ ID NO: 18828 - DNA, 382 bp, Homo sapiens
  chr12.fa.O7frz.63856930
  Located on chromosome 12
  Distance between a terminus base of telomere on chromosomal short arm and 5'-terminus of this base sequence : 66494097
  Distance between 3'-terminus of neighbour sequence of sequence listing upward to telomere on chrosomal short arm and 5'-terminus of this base sequence : 336977
gtaaactgctcattgttcaaaccagtaaagataatagtcttcttcagaggtctcctctggagtcagacacacctagattcaaatcccaagtccatctatttctataagtgttcttggataatgttctcaactttcctgatccataaaataggaagttactttttctctaggggatacgcatgtacacattatatatatgtgtgtgtgtgtgtgtgtgtgtgtgtgtgtgtgtgtaatttctttgggtgttgtattagtcagaattctccagagaaacagaaccaacagggtggatggatgaaagaataaatagatggatggacagacgaatggatcgatggatggacggactgacagacagacagataatcggtaatttgct

SEQ ID NO: 18829 - DNA, 472 bp, Homo sapiens
  chr12.fa.O7frz.63718620
  Located on chromosome 12
  Distance between a terminus base of telomere on chromosomal short arm and 5'-terminus of this base sequence : 66618050
  Distance between 3'-terminus of neighbour sequence of sequence listing upward to telomere on chrosomal short arm and 5'-terminus of this base sequence : 123571
cattaataggtggttgaatgttaccttctttttctttttgaatctgttgatattatgttttttcttctttactctgttaatgtgatgagtaatatttatagatttcctaatatttaaccttctttgcattaaggctatcttcgttgtattttgtgtgtggtgtgtgtgtgtgtgtgtgtgtctgtctgtctgtatacaccgttggattcagtttgctaatatctagtatttttgtctttaaattcttgggaaaaaaacagacctatgattttactttttaataatgtcgctgtctatgttttttttttggaggggagggtggggagatggggcttcactttgctgcccaggctggtcttgaattcctggactcagagaattgggctcaaacaatcctcctgcctcggcctttcaaagtgctgggattacaggcatagagccatcaagcctgaccacgaatctgttatactag

SEQ ID NO: 18830 - DNA, 402 bp, Homo sapiens
  chr12.fa.O7frz.63359376
  Located on chromosome 12
  Distance between a terminus base of telomere on chromosomal short arm and 5'-terminus of this base sequence : 66776727
  Distance between 3'-terminus of neighbour sequence of sequence listing upward to telomere on chrosomal short arm and 5'-terminus of this base sequence : 158205
tcacattcttagtcactggaagctaagaatttaacatatgaattttcagggcggacacaaatcataccataacacactccatgtatattatggcactgtgccttgtaccttgcacctgatgcagtcctattcatcctttaagactcatcactcatctgtgaaggtgaccctcatcccttcctttgcctccccactgaactacttcctacttgtcattgctgaccttgaatgtatttcaattacagcactgtgtcatttcagatgtactaaaaattagcagaaagagcccccccccgccgcccacacacacacacacacacacacacacacacacacacacagagagagattgggtcaactccgtaattaattagccaagggtacagaaactcacagctagca

SEQ ID NO: 18831 - DNA, 420 bp, Homo sapiens
  chr12.fa.O7frz.63533663
  Located on chromosome 12
  Distance between a terminus base of telomere on chromosomal short arm and 5'-terminus of this base sequence : 66848608
  Distance between 3'-terminus of neighbour sequence of sequence listing upward to telomere on chrosomal short arm and 5'-terminus of this base sequence : 71479
tattcattgcttactgtagccttaaatgcctgggctcaagcaatcctcccacttcaggctcctaagtagttgggagtagaggtgcacatcgtcatggctggctaacttttaaatattttttcttcagaaatcatgtcttgctatgttgcccacgctggtcttgaactcctggtttcaagtgatcctcccacttcagcctcccaaagcactgggattacaggcatgagccaccaggcctggccctcctccacattttaaactagtttgtcctaacatcctggttttttttttttacacacacacacacacacacacacacacacacacacccctacctttcttgaccaatgttcttcttcaaatacttcccttatctttcctcctcttcacaggcaaatttctagacaatactgtccacat

SEQ ID NO: 18832 - DNA, 321 bp, Homo sapiens
  chr12.fa.O7frz.63178301
  Located on chromosome 12
  Distance between a terminus base of telomere on chromosomal short arm and 5'-terminus of this base sequence : 67104648
  Distance between 3'-terminus of neighbour sequence of sequence listing upward to telomere on chrosomal short arm and 5'-terminus of this base sequence : 255620
gtggctaacatggtgaaaccctgtctctactaaaaatacaaaaattagccagtcgtggtggcaggtgcctgtaatcccagctacttgggagactgaggtaggaggatcacttgaacccaggaggtggaggttgcagtgagccgagatcgcaccactgcactccagcctgggtgacaaagggagactctgtctcaaataaataaataaataaataaataaataccatgcaggaaggcttacatgggaaatgaaagtaaaaaaataaaaataaaaaaataaataaataaaaagaaactttcctgttacgtggagtctgtaaaa

SEQ ID NO: 18833 - DNA, 358 bp, Homo sapiens
  chr12.fa.O7frz.70229456
  Located on chromosome 12
  Distance between a terminus base of telomere on chromosomal short arm and 5'-terminus of this base sequence : 67286064
  Distance between 3'-terminus of neighbour sequence of sequence listing upward to telomere on chrosomal short arm and 5'-terminus of this base sequence : 181095
gaaagtcttaaattacaaacagctaaaagtttttgttttgtgtgtgtgtgtgtgcttgtgtgtgtgtgtgtgtgtgtgtgtgtgtgtgtaagtagcaaacctctctggagggaaacagtaatggacatgtaaaacttaatgttttagcttcaaaatcagatttccgggttcttcaatgcattaatgcttgggatctttagaataaagccaaagaattccaaaaccaaagaatgtgtgtagtagattttattttgattcagttctcccttctcgatcctcaaatcatcacttaaatttctagatttctacaaactaggggaaaaaaacccttgctgtcttatctaaaatcctcacgttt

SEQ ID NO: 18834 - DNA, 191 bp, Homo sapiens
  chr12.fa.O7frz.70512517
  Located on chromosome 12
  Distance between a terminus base of telomere on chromosomal short arm and 5'-terminus of this base sequence : 67407743
  Distance between 3'-terminus of neighbour sequence of sequence listing upward to telomere on chrosomal short arm and 5'-terminus of this base sequence : 121321
ttgagaagcttgagtctaaactataaagtgatctggatggtcaggtaactgttttgtgaattaaatgtacatcacacacacacacacacacacacacacacacatacacacacacacattatctatataacagaacagccaactcagcagaaacaaagctcaaagctctgtaaactcatttcctcagtatc

SEQ ID NO: 18835 - DNA, 477 bp, Homo sapiens
  chr12.fa.O7frz.71154696
  Located on chromosome 12
  Distance between a terminus base of telomere on chromosomal short arm and 5'-terminus of this base sequence : 67590213
  Distance between 3'-terminus of neighbour sequence of sequence listing upward to telomere on chrosomal short arm and 5'-terminus of this base sequence : 182279
gaactcagatttaacctggaattatgtggatatgaatattggtggccagaatttaaggtactttggcctcacttttattttttatttttacttatttatttatttatttatttgagatggagtttcgctgctgttgtccaggctggagtgcaatggcacagtcttagttcactgcaacctccgcctcctgggcggattcaagtgattctcctgcctcagcctcccaagtagctgggattacaggcatgtgccatcacacctggctttttttttttaattttttttttaaatttttttagtagagatgggtttcaccatgttggtcaagctggtctcgaactcctgacctcaggtgattcacctgccttggcctcccaatgtgctgggattacaggcatgagtcactgcccggcctggcctcatttttaatgaaacctgatcttctgtcccctttttctgaggcagatttagaatgta

SEQ ID NO: 18836 - DNA, 314 bp, Homo sapiens
  chr12.fa.O7frz.71251039
  Located on chromosome 12
  Distance between a terminus base of telomere on chromosomal short arm and 5'-terminus of this base sequence : 67619400
  Distance between 3'-terminus of neighbour sequence of sequence listing upward to telomere on chrosomal short arm and 5'-terminus of this base sequence : 28710
aggtttatttcaggttctactcagtttcaggtttatttcctgaaacttcaagaagttacatttatccaatgatatcaccaggaactgcaaccaagtaagtgcatgcacaggcaataataataatattatgattatcacatgtctaagaacaactataaaatgcatcccagttcacagttgttaaaatgtgtatgttggggggtagtttgtaggcattgcatgtatgtatgtatgtatgtatgtatatattagagacagggtcttactccgtcacccaggctggagtgcactggtatgatctagctcactgcaac

SEQ ID NO: 18837 - DNA, 310 bp, Homo sapiens
  chr12.fa.O7frz.66880331
  Located on chromosome 12
  Distance between a terminus base of telomere on chromosomal short arm and 5'-terminus of this base sequence : 67950476
  Distance between 3'-terminus of neighbour sequence of sequence listing upward to telomere on chrosomal short arm and 5'-terminus of this base sequence : 330762
gcctatgccttaaggtaaatagaagatagaaaggatatatatatatatatatatatatttatttgtgtgtatgtgtatatatatatatgtgcattatatatatacatatgtgtattatgcatgtatatatatacacacacacataaaaaatcaaaaaggcagagataaaaataaatcaagagaaagtaaaaatgttgtatatagacaacaggagatcttaaagaggagatccaaaacaagaaccaaattaatacttaaaattactttaaaacaacttttaaaaagctttcctgaaatactaaagatttga

SEQ ID NO: 18838 - DNA, 209 bp, Homo sapiens
  chr12.fa.O7frz.67000439
  Located on chromosome 12
  Distance between a terminus base of telomere on chromosomal short arm and 5'-terminus of this base sequence : 68013490
  Distance between 3'-terminus of neighbour sequence of sequence listing upward to telomere on chrosomal short arm and 5'-terminus of this base sequence : 62704
gctgttgatctgaatttatcagaaaaaaagaaagaatcaaggtgactcatatttctgtagtattcatatatatatatatatagagagagagagagagagagagagagagtacataacagcaagtctgggtgacgtcatagcatcttcacagttcttgacaaaatactcctgtacttctaacaaaaagctttgtatcataaagacttgtc

SEQ ID NO: 18839 - DNA, 447 bp, Homo sapiens
  chr12.fa.O7frz.66676633
  Located on chromosome 12
  Distance between a terminus base of telomere on chromosomal short arm and 5'-terminus of this base sequence : 68305507
  Distance between 3'-terminus of neighbour sequence of sequence listing upward to telomere on chrosomal short arm and 5'-terminus of this base sequence : 291808
gcaatgctattactttatgcagtaataaaaagctgttttgtaaattgattaatacctacagcaccatttatttacctaaaacggagtgaaatctcatgggactgaaaagcctcgataaaatcagattccaatcacatatacttaatgtgcttaaaatgatgctttcttagatgccatttaccttgcactgtcaaagtgttcactattctgtttcactccattctccatttagtagatttaaatggagaatggaaatatatacacacgtacatatataataaaatatatatgtgtatatatatatgtgtgtgtatgtatatatgtgtgtgtgtgtgtgtgtgtgtgtgtatctacgtttctctgtatatacaaagagatggagaaaaaaaagaaaagaccattcttgtattcataggaaatgtattgactcctgaaattggtgattat

SEQ ID NO: 18840 - DNA, 362 bp, Homo sapiens
  chr12.fa.O7frz.66527407
  Located on chromosome 12
  Distance between a terminus base of telomere on chromosomal short arm and 5'-terminus of this base sequence : 68538013
  Distance between 3'-terminus of neighbour sequence of sequence listing upward to telomere on chrosomal short arm and 5'-terminus of this base sequence : 232059
actgctctaatggatttcctagataaatgcacttgtgtgatttgtctaatcatcttcttagaatacagtaatgaaatgaaatttcagggtaaaggaaatataatttttaaaatcttaaacacatgtagaaacatttacatcaggaaatataccattttgcattgccattaacatttcttcataccttcatcaatattacataacaaaaatgaaaggatttctttcagcaatatccctcttaaggaaaatctctctctctctctctctctctctctctccctctcttctccccatctatctctctcttgctctctttctctccctgtctctctatttatttagtactaagccactcaggatta

SEQ ID NO: 18841 - DNA, 432 bp, Homo sapiens
  chr12.fa.O7frz.66761592
  Located on chromosome 12
  Distance between a terminus base of telomere on chromosomal short arm and 5'-terminus of this base sequence : 68614625
  Distance between 3'-terminus of neighbour sequence of sequence listing upward to telomere on chrosomal short arm and 5'-terminus of this base sequence : 76250
gaaggtaagcgctaaatacatcttgtcaaccatcttgaagccactcgagtatggaattttctaaaataaataaaatcacacaaataagcccgccagctacaataaaaaacaaatgaaagtcgtagagttgaatagtgtgtgtgtgtgtgtgtgtgtgtgtatgtgtgtgtctatgttagagataatagtcactaaaaatagtaaatttgaaaatgctttttaagaacttaactttaatgtacagtaatttaattaaatttaatgcaagatctctctcttcagagacagaaagtgtctgggatgtttagcagctaagtagagttgaaaaagagagaataaatgaattctggtggtatattaagcattagatcacagaaattgcccccaaaaaatttactgccagaaaggcttcattctgaatgcaatattaag

SEQ ID NO: 18842 - DNA, 358 bp, Homo sapiens
  chr12.fa.O7frz.66315365
  Located on chromosome 12
  Distance between a terminus base of telomere on chromosomal short arm and 5'-terminus of this base sequence : 68746413
  Distance between 3'-terminus of neighbour sequence of sequence listing upward to telomere on chrosomal short arm and 5'-terminus of this base sequence : 131356
agacagcattagtttgttcaacatggatatgcccccatggcataaacatctcccactaggccccacatccccaacatggctccactggcaatcaaatttcaacatgagattcaaagggaaaaaaactaaaattcaaaccatagaatcctgggactaaatgtgctcaaatggattaaaacattgtgtgtgtgtgtatgtgtgtgtgtgtgtgtgtgtgtgtgtgtgtgtgtgtgtgtgtgtgatggtgcatgtttgcaattaagtatcagaagagcttctagcttaaactaaaagaagcattatgagtttaaataaaaacaatgttctgtggaatgctaggatcctacacagttagtgg

SEQ ID NO: 18843 - DNA, 400 bp, Homo sapiens
  AC025603.1_117614
  Located on chromosome 12
  Distance between a terminus base of telomere on chromosomal short arm and 5'-terminus of this base sequence : 69215538
  Distance between 3'-terminus of neighbour sequence of sequence listing upward to telomere on chrosomal short arm and 5'-terminus of this base sequence : 468767
gcagaaagtttatggatacataataggaaaaagactagaagaaaataaacaaaaatatctaaaagaaagtggtgttaggattataaagatgtcctcctttttttctttttcttttctttttttctttctctttctttctttctttcttttcttttctttcttctctttcttcctttctttctctctctctctctctctttctttctttcttgctttttctttcttctttctttcttttttctttttttttgagactaggtctttctctgtcacccaggctggagtgcagtagtgtgatcatggctccctgcagccacgacatgctgggcttaagggctcctctcacctcagcctctcaagtagctgggactacaggcatgtactgctatgccaggctata

SEQ ID NO: 18844 - DNA, 267 bp, Homo sapiens
  AC078889.20_81038
  Located on chromosome 12
  Distance between a terminus base of telomere on chromosomal short arm and 5'-terminus of this base sequence : 69242254
  Distance between 3'-terminus of neighbour sequence of sequence listing upward to telomere on chrosomal short arm and 5'-terminus of this base sequence : 26316
gatgaggtcaaccagatacactgaggagttccatgaagcctgcctatacagtcactctggtattctctggccaggcccaggttttgggagggtgacctggcaagccagtaactcccgttgggtaatacagtatgtatgcatatatgtatgtatgtatgtatgtatgtatgtatgtatgtatgtatgtatgtattttaaggtttctgtgcagttgagctactgaaatggtatcgacagatagatttggaatggcttaagctgtttaca

SEQ ID NO: 18845 - DNA, 477 bp, Homo sapiens
  chr12.fa.O7frz.70876417
  Located on chromosome 12
  Distance between a terminus base of telomere on chromosomal short arm and 5'-terminus of this base sequence : 69246718
  Distance between 3'-terminus of neighbour sequence of sequence listing upward to telomere on chrosomal short arm and 5'-terminus of this base sequence : 4197
tgaagccttgaacttctgtccccaaacgatcctgttgcctcagcctccaaagtagctgggactataggtttgcaccgccatgcccagcttattattgtgtgtgtgtgtgtgtgtgtgtgtgtgtgtgtgtgtgtggtgatggggtctctctttgttgcttaggctggtctcaaactgctggcctcaagcaatcctcccacctcggcctcccacaactctggaattactagtgtgagccaccgtgctcattgggaggcagttcttttgtttttatttttattttttgagatggagtgtcactctgtcacccagataggagtgcagtggcacgatctcagctcactgcaacctccacctccaagtgattctcctgccacagcctccttagtagctgggattacaggcatgaaccactgcacctggccaaggtagtactttttaacgaacatactctcctacaacttacaaactcatatg

SEQ ID NO: 18846 - DNA, 463 bp, Homo sapiens
  AC025603.1_20633
  Located on chromosome 12
  Distance between a terminus base of telomere on chromosomal short arm and 5'-terminus of this base sequence : 69339326
  Distance between 3'-terminus of neighbour sequence of sequence listing upward to telomere on chrosomal short arm and 5'-terminus of this base sequence : 92131
tagtaagcttggagacaggatatttgaaaatacacagccagagaagatgaaagaaaaaaaaaagctgggccaggcatggtggctcacgcctataatcccagcactttgggaggccgaggtgggcagatcacctgaggtcaggagttcgagacaagcctggccaacatggtgaaagcccgtctctactaaaaatacaaaaaaaaaaaaaaatagctgggcatggtggtgtgcagctgtaatcccagccacttgggaggctgaggcaggagaatcgcttgaacccaggaggcagaggttacagtgggccgagattgcaccacagcactcagcctgggcatcagagtgagactctgtctcaaaacaaacaaacaaacaaacaaacaaacaaacaatgaagcacacctacaagatctaaaaaatagcctcaaaaggccaaatctaagagttatcggccttaaagacg

SEQ ID NO: 18847 - DNA, 110 bp, Homo sapiens
  DISD22_0008406
  Located on chromosome 12
  Distance between a terminus base of telomere on chromosomal short arm and 5'-terminus of this base sequence : 69443014
  Distance between 3'-terminus of neighbour sequence of sequence listing upward to telomere on chrosomal short arm and 5'-terminus of this base sequence : 103225
aagaacatgttagcagcagtggtgtatgtgtgtgtgtgtgtgtgtgtgtgtgtgtgtgtgtgtgtgtgtcagagagagcgagagaaagcatatgttggtatagggatagg

SEQ ID NO: 18848 - DNA, 468 bp, Homo sapiens
  AC025419.12_2117
  Located on chromosome 12
  Distance between a terminus base of telomere on chromosomal short arm and 5'-terminus of this base sequence : 69604363
  Distance between 3'-terminus of neighbour sequence of sequence listing upward to telomere on chrosomal short arm and 5'-terminus of this base sequence : 161239
atcatgccactgcacttagcctgggcaacagagagagaccctgtgaaaaaaaaaaaagaaaagaagaaaaagaaagaagaaagaaagaaggaaagaaggaaagaaagaagaaagaaagaaagaaagaaagaaagaaagaaagaaagaaagaaagaaagaaagaaagaaagaaagaaagaaaaaaactagtcttgaagtcacaacaggttgtttcaattgaagtggtccccttgtaacctgcatgtttttttcaaggcctcttgactctattttagttggatgtgacagtaatgcctccactttgtataataaattttcacaatggtcacaaactaaaatgtatttactgaaagtaaatgcaattggaagatgcagacacagcatggtgaagatgtgaagaagcaagtattccaacaaattatatagtgcagaaatttcctttacagttgcattaagagtagatgtttc

SEQ ID NO: 18849 - DNA, 129 bp, Homo sapiens
  DISO7_10003436
  Located on chromosome 12
  Distance between a terminus base of telomere on chromosomal short arm and 5'-terminus of this base sequence : 69703822
  Distance between 3'-terminus of neighbour sequence of sequence listing upward to telomere on chrosomal short arm and 5'-terminus of this base sequence : 98991
gtccaacagcaaggctatcttttatatagatggatgggtagatggtggatgggtagatggatggatggatggatggatggatggatggatggatggatggatggaaggatggttgaatgaagttgtggc

SEQ ID NO: 18850 - DNA, 196 bp, Homo sapiens
  chr12.fa.O7frz.69821646
  Located on chromosome 12
  Distance between a terminus base of telomere on chromosomal short arm and 5'-terminus of this base sequence : 69711383
  Distance between 3'-terminus of neighbour sequence of sequence listing upward to telomere on chrosomal short arm and 5'-terminus of this base sequence : 7432
aggctaaaactcatttacctaaactaaaaatgttgtgcggtaagctctgcataaagttgggtactttccttgatatactttgtgtgtgtgtggtgggggtgtgggtgtgtgagtacacacacacacacacacacacacataaaatttaactttgaaatcctttccgttatggctggtcactgaccatagtatttat

SEQ ID NO: 18851 - DNA, 165 bp, Homo sapiens
  DISD22_0008423
  Located on chromosome 12
  Distance between a terminus base of telomere on chromosomal short arm and 5'-terminus of this base sequence : 69902058
  Distance between 3'-terminus of neighbour sequence of sequence listing upward to telomere on chrosomal short arm and 5'-terminus of this base sequence : 190479
ttcaggaattagccatagtcagaaaattgtgtgtgtgtgtgtgtgtgtttgtgtacatactcagatatatatgagctaactgagaaacaaaattaattttctgctatgtgctaaaatatccatttgctactaaagggttttttctattcatgtcatattcagggc

SEQ ID NO: 18852 - DNA, 133 bp, Homo sapiens
  Z67200
  Located on chromosome 12
  Distance between a terminus base of telomere on chromosomal short arm and 5'-terminus of this base sequence : 70216960
  Distance between 3'-terminus of neighbour sequence of sequence listing upward to telomere on chrosomal short arm and 5'-terminus of this base sequence : 314737
gatgagcctggagagtttgaaggtaagagagaaagagaagcagcgagggagagaaggagagagagagagagagagagtgagtgtgtgtgtgtgtgtgtgtgtgtttcaaggtaacatgcaagaacaataaggt

SEQ ID NO: 18853 - DNA, 330 bp, Homo sapiens
  AC025262.11_175205
  Located on chromosome 12
  Distance between a terminus base of telomere on chromosomal short arm and 5'-terminus of this base sequence : 70236019
  Distance between 3'-terminus of neighbour sequence of sequence listing upward to telomere on chrosomal short arm and 5'-terminus of this base sequence : 18926
ttccaaattgagagtaatgactagcctgcaaagaggctttctgacctgcctcacttagccctggaaaggacaattctatataccctgttcccctggaccatggctaattggatcttagacctctgttgaaaggccattgatcaactagattttctcaaaattttatttatttatttatttatttatttatttatttatttagagacagagtctcgctctgttgcccaggctggtgtgcagtggcatgatcttggctcactgcagcctccacctcccgggttcaagtgattcttgggccttaccctcccaattagctgagattacaggtgc

SEQ ID NO: 18854 - DNA, 185 bp, Homo sapiens
  chr12.fa.O7frz.69123962
  Located on chromosome 12
  Distance between a terminus base of telomere on chromosomal short arm and 5'-terminus of this base sequence : 70321100
  Distance between 3'-terminus of neighbour sequence of sequence listing upward to telomere on chrosomal short arm and 5'-terminus of this base sequence : 84751
aatatcactgtcgttcatacaaacaggaatgcgattgagtagactgactttgaataggcttttctccagagtcaagcacttgtctgacatagctagagaaggaagaagggtgtgtaggggtgtgtgtgtgtgtgtgtgtgtgtgtgtgtgtgatttgtgtgtagctattgaaaggtggcatgtat

SEQ ID NO: 18855 - DNA, 200 bp, Homo sapiens
  DISO7_10026207
  Located on chromosome 12
  Distance between a terminus base of telomere on chromosomal short arm and 5'-terminus of this base sequence : 70391993
  Distance between 3'-terminus of neighbour sequence of sequence listing upward to telomere on chrosomal short arm and 5'-terminus of this base sequence : 70708
tgagggaattcatgtctggttttacctttacagaagaataggatttgactaggctgtgtgtgtgtgtgtgtgtgtctgtgtgtctgtgtggaggggtgcatatatatgcgagggtgttgtgtgtgtgtgtgtgtggaggggtgcacatatatgcgagggtgttgtgtgtgcgtttgtgtgttgaaggctctggtgcagag

SEQ ID NO: 18856 - DNA, 168 bp, Homo sapiens
  Z66697
  Located on chromosome 12
  Distance between a terminus base of telomere on chromosomal short arm and 5'-terminus of this base sequence : 70466326
  Distance between 3'-terminus of neighbour sequence of sequence listing upward to telomere on chrosomal short arm and 5'-terminus of this base sequence : 74133
acaaggcttgggagacaaaccaaagcctttggggagtgtgtgtgtgtgtgtgtgtgtgtatgtgtctctgtgtgtaacagtacacgttttacaatatttctctgtgatgatttgggtgaaaatctcatgcatatttgccaatagttgtggtcccatcactccttgttg

SEQ ID NO: 18857 - DNA, 110 bp, Homo sapiens
  DISO7_10003433
  Located on chromosome 12
  Distance between a terminus base of telomere on chromosomal short arm and 5'-terminus of this base sequence : 70600167
  Distance between 3'-terminus of neighbour sequence of sequence listing upward to telomere on chrosomal short arm and 5'-terminus of this base sequence : 133673
gcttaggtgtgatttggaccaaatatttatatctatacacacacacacacacacacacacacacacacacatggttttttggatgatggctctataactacagcaacgga

SEQ ID NO: 18858 - DNA, 205 bp, Homo sapiens
  DISO7_10003448
  Located on chromosome 12
  Distance between a terminus base of telomere on chromosomal short arm and 5'-terminus of this base sequence : 70733355
  Distance between 3'-terminus of neighbour sequence of sequence listing upward to telomere on chrosomal short arm and 5'-terminus of this base sequence : 133078
ttccaggtagtcaagccagaaaatggggagtcagccttgattcatcctatctatccaatccatccatccaatccacccccctaccaactcacccatctatccattcaatccacccatccatccatccatccatccatccatccatccaatccaatccaatccaatccaatccaatccatttatacatccatccaacccatcagtc

SEQ ID NO: 18859 - DNA, 475 bp, Homo sapiens
  AC073530.8_122967
  Located on chromosome 12
  Distance between a terminus base of telomere on chromosomal short arm and 5'-terminus of this base sequence : 71025996
  Distance between 3'-terminus of neighbour sequence of sequence listing upward to telomere on chrosomal short arm and 5'-terminus of this base sequence : 292436
atacttaaatactgcaccaatgatctctgaataaaaatataatactcaggccaggcgcagtggctcacgcctgcaatcccagcactttggaaggccaaggtgggtggatcacgaggtcagatcaagaccatcctggctaacacggtgaaacaccttctctactaaaaatacaaaaaattagcagggcgtggtggcgggcacctgtggtcccagctactcaggaggctgaggcaggagaatggcgtgaacctgggagacggaccttgcagtgagccgagattgggccactgtactccagcctgggcaacagagtgagactctgcctgaaaataataataataataataataataataatacttaaatactaaggctatactaacataatgtaatcttcctttggagaatcagaagccaattcttgaagtgcctgcagggcattgtttcaaaatgctttctcaactaaagcatttca

SEQ ID NO: 18860 - DNA, 476 bp, Homo sapiens
  AC012385.16_93671
  Located on chromosome 12
  Distance between a terminus base of telomere on chromosomal short arm and 5'-terminus of this base sequence : 71178108
  Distance between 3'-terminus of neighbour sequence of sequence listing upward to telomere on chrosomal short arm and 5'-terminus of this base sequence : 151637
tgcaagtaacagacaacctaacccaaatagatttaaacaagagaggaatttacagtactagaagaaagaaagaaagaaagaaagaaagaaagaaagaaagaaagaaagaaagaaagaaagaaagaaagaaagaaagaaagaaggaaagaaagaaagagggaaagaaagaaggggagaacttagttcatacacacaaaaaaggaacttactagcttatggggtgatgtcatcaggacactgtctcttcccatctctcaactctgttctcaaccatgttgtgttatttcttacactctcaggatagcaagatggccatccacaacttcaaatttcaaggttcaagtccagcaggaaagagcacatgcttcctctcaacagttgcagcaaaacttcacaaattgaatctcatgagatctgatgaaatatttgattttccaagcctgaatttcatgcccctctatggagttaggtgtcca

SEQ ID NO: 18861 - DNA, 249 bp, Homo sapiens
  D12S868
  Located on chromosome 12
  Distance between a terminus base of telomere on chromosomal short arm and 5'-terminus of this base sequence : 71256327
  Distance between 3'-terminus of neighbour sequence of sequence listing upward to telomere on chrosomal short arm and 5'-terminus of this base sequence : 77743
tctgagtggacacaggctaaaagaaagtattattgataataccaaatgactgaggccttgaggtccacacatacaaaaaaagacctgcttctttgtgtgtgtgtgtgtgtgtgtgtgttttacattaaatatggtggaaaggctattcagagcaaaaggcaattaattgtggctgaagcactaaggacagtttgatgaaagatatattaatcatggcagattggtaaaatgaaatatggcattactggg

SEQ ID NO: 18862 - DNA, 400 bp, Homo sapiens
  AC012518.11_71211
  Located on chromosome 12
  Distance between a terminus base of telomere on chromosomal short arm and 5'-terminus of this base sequence : 71318818
  Distance between 3'-terminus of neighbour sequence of sequence listing upward to telomere on chrosomal short arm and 5'-terminus of this base sequence : 62242
gtaaccaggagtttactgcactgccatccattgttctaggccaaagtgtctgtgcattttcttttttgctttctttcttttctttctttcttttctttctttctttttctttctttctttctttctttctttctttctttctttctttctttctttttctttctttctttctttttctttctttctttctcttttttctttctttctttttctttctttctctttctttcctttctttttctttctttctttcttctttttttctttcttctctttctctctctctcttttttcttttttttggagatagagtctcactcggtcgcccaggctggaatgcagtggcacagtctcggctcactgcaacctccacctcctgagttcaagctattcttatgcc

SEQ ID NO: 18863 - DNA, 347 bp, Homo sapiens
  chr12.fa.O7frz.72226493
  Located on chromosome 12
  Distance between a terminus base of telomere on chromosomal short arm and 5'-terminus of this base sequence : 71452588
  Distance between 3'-terminus of neighbour sequence of sequence listing upward to telomere on chrosomal short arm and 5'-terminus of this base sequence : 133370
tggcacataaataggacaatcctgcagtcttatcaagagagagtattacctttgtgtgtgtgtgtgtgtgagagagagagagagagagaaagagagagagagagggagacccttactatagaggatgatgagacatgcagaatttttgttaacccaattgcaactctaattcctgctctcctttccttctgctattaacgttaaaaccagagcccttttctttgaggaatagaattgaatgcagcgtgagcccagatatggctcactctggttccaagatccatgagcttattttgggtactcagtgacagcagaaatgtacataactcctttcatctaggtacttg

SEQ ID NO: 18864 - DNA, 186 bp, Homo sapiens
  G08961
  Located on chromosome 12
  Distance between a terminus base of telomere on chromosomal short arm and 5'-terminus of this base sequence : 71578250
  Distance between 3'-terminus of neighbour sequence of sequence listing upward to telomere on chrosomal short arm and 5'-terminus of this base sequence : 125315
atatttcagaaccgcagcagagcatatagatggtgtttaaacctgtctgtctgtctatctatgtatctatgtatctatgtatctatgtatctatctatctatctatctatctatctatctatctatctatctaatctatctagagggagagagattactttaagaaatcctgggtgtctagactgg

SEQ ID NO: 18865 - DNA, 236 bp, Homo sapiens
  AC007617.10_4801
  Located on chromosome 12
  Distance between a terminus base of telomere on chromosomal short arm and 5'-terminus of this base sequence : 71723633
  Distance between 3'-terminus of neighbour sequence of sequence listing upward to telomere on chrosomal short arm and 5'-terminus of this base sequence : 145197
gattacaggcgtaagccaccatgcctggctaattgtgtgtgtgtgtgtgtgtgtgtgtgtgtgtgtgtgtgtgtgtgtatttttagtagagatggggtttcaccatgctggccaggctactcacgaactcctgacctcaggtgatctgcctggctcagcctcccaaagtgctgggattacaggcttaagccactgtgcccagcctgttttggctcttataggtcctttgcatttcc

SEQ ID NO: 18866 - DNA, 463 bp, Homo sapiens
  AC007617.10_54780
  Located on chromosome 12
  Distance between a terminus base of telomere on chromosomal short arm and 5'-terminus of this base sequence : 71773436
  Distance between 3'-terminus of neighbour sequence of sequence listing upward to telomere on chrosomal short arm and 5'-terminus of this base sequence : 49567
ttcattactcctgattgtatccacacccttgattcatttattcaacaaacatatattgagcatctcctaggtgccaggcactgttccactgttcttaagggctaaggttctgtcgtcgaacatacctttccctgttctcatggagctgacattatggtggcaaggacagacacaattaattaattatatatttttagatatagtgtagttgtgtgtgtgtgtgtgtgtgtgtgtgtgtgtgtgtggagagagagacagaaagaaagaataattataagtagttgtaaaaggtatgaggaaaagttcagtagagaaggagatagaaagtgatgtgggcattattttaaagagggctcttggagacagcctctctgggcgaggttgggaggtatttgaggtgaagcctggatgacattacagagccagccttgccaatattgggagataagcattccaggcagaa

SEQ ID NO: 18867 - DNA, 255 bp, Homo sapiens
  D12S335
  Located on chromosome 12
  Distance between a terminus base of telomere on chromosomal short arm and 5'-terminus of this base sequence : 71773593
  Distance between 3'-terminus of neighbour sequence of sequence listing upward to telomere on chrosomal short arm and 5'-terminus of this base sequence : -306
tggcaaggacagacacaattaattaattatatatttttagatatagtgtagttgtgtgtgtgtgtgtgtgtgtgtgtgtgtgtgtgtggagagagagacagaaagaaagaataattataagtagttgtaaaaggtatgaggaaaagttcagtagagaaggagatagaaagtgatgtgggcattattttaaagagggctcttggagacagcctctctgggcgaggttgggaggtatttgaggtgaagcctggatga

SEQ ID NO: 18868 - DNA, 371 bp, Homo sapiens
  AC023163.16_88756
  Located on chromosome 12
  Distance between a terminus base of telomere on chromosomal short arm and 5'-terminus of this base sequence : 71876268
  Distance between 3'-terminus of neighbour sequence of sequence listing upward to telomere on chrosomal short arm and 5'-terminus of this base sequence : 102420
ctgagcttaacagtggatacagttatgttgcctggggatccactattgctgcacctatgtaacccattatgtatgtatgtatgtatgtatgtatgtatgtatgtatgtatgtatgtatccttaccccatctgaatgggagtggactgaggggaggcatacactagactgctattgctgcctgcaatctaaacagcacagcaacaacgctaacgctccttgcaaaggtttttaatgaaggatggaaaaatagtagctgaggataaaggaataaatgggttatgaagtcagggaaatccaatattacattaacacctcaaaagaggctcagagcaagagatatcattgtcgcttagctcagtggtaacagatg

SEQ ID NO: 18869 - DNA, 239 bp, Homo sapiens
  AC007286.18_78299
  Located on chromosome 12
  Distance between a terminus base of telomere on chromosomal short arm and 5'-terminus of this base sequence : 71930010
  Distance between 3'-terminus of neighbour sequence of sequence listing upward to telomere on chrosomal short arm and 5'-terminus of this base sequence : 53371
aattcaatggatttagtttgaattcatgtttgcccatataatgaatagagtgttatttatgacaacatccagaagaacagatctcaggggttggctttattacagtatgttagtttaaattaatttgccactattccctacagttattctttagtcttcccctgaagatttacacacacacacacacacacacacacacacacacacacacacacctccttccagaaatgtaagaaata

SEQ ID NO: 18870 - DNA, 323 bp, Homo sapiens
  AC005294.1_83089
  Located on chromosome 12
  Distance between a terminus base of telomere on chromosomal short arm and 5'-terminus of this base sequence : 72026779
  Distance between 3'-terminus of neighbour sequence of sequence listing upward to telomere on chrosomal short arm and 5'-terminus of this base sequence : 96530
tattcaacttaattcctgccaaaatttcagtgatacacacacacacacacacacacacacacacggcaaaattgttctaaagtaaattcagaaaataatagagatgagaaaattacaaaaactagtgcaaatactaaaatttgcagatatactaacagatctaacatattacaacatgttatatagcctctgaaataaaaacgatttgttactaggctaaaaataaaatctgcagcccagaagtagaacatattacatatagcactatagtttcataaaggagatggcattggtcaatcagaaacctgaaggtttagtcagta

SEQ ID NO: 18871 - DNA, 275 bp, Homo sapiens
  AC005294.1_86223
  Located on chromosome 12
  Distance between a terminus base of telomere on chromosomal short arm and 5'-terminus of this base sequence : 72029784
  Distance between 3'-terminus of neighbour sequence of sequence listing upward to telomere on chrosomal short arm and 5'-terminus of this base sequence : 2682
ttcatttaactatggaaactggatatatagcaaaattaacatgttcaatttagtggagtaaattcagactatttcataaatgatgttaagattgttgatccatctagaagaaagcaaaatttaatttctacctcacaactaaataaaaagtttcaactgggcttgtgtgtgtgtgtgtgtgtgtgtgtgtgtgtgtgtgttaaaatttgtttttttcttgtatcttggctttttaagtaagtctatatatatctaactccttgtttaatggaatt

SEQ ID NO: 18872 - DNA, 430 bp, Homo sapiens
  AC007458.13_14920
  Located on chromosome 12
  Distance between a terminus base of telomere on chromosomal short arm and 5'-terminus of this base sequence : 72072050
  Distance between 3'-terminus of neighbour sequence of sequence listing upward to telomere on chrosomal short arm and 5'-terminus of this base sequence : 41991
gttattggcttcatggtgtaatacctgaaatcctcctgtcacggagctactctgtgttctaactctatttcccttcccagactgtcctccccacctccactcagtaatcttatctactaaagtaaaaccagaaaagtaaactgcagtgcacctggacaggaatgtgcaaacttggggaagattcttcactggggagacatgcgggagatgccttccttccctccaggtggtccaggccaagtattcataacatcagggttacctgttcatggccgtgtgtgtgtgtgtgtgtgtgtgtgtgtgtttagtcatgaacattaaggggagcaattggaagcaagtccagagattcttactcttgaactctcagttgctacactccccgtagctctactagagtcccctggtatttggacatgtaggctatttc

SEQ ID NO: 18873 - DNA, 422 bp, Homo sapiens
  AC007458.13_25451
  Located on chromosome 12
  Distance between a terminus base of telomere on chromosomal short arm and 5'-terminus of this base sequence : 72082695
  Distance between 3'-terminus of neighbour sequence of sequence listing upward to telomere on chrosomal short arm and 5'-terminus of this base sequence : 10215
caggcttgtccttgtaaataaccattttactacttttgtgtgaatcccttgagtctttagccccctcaagtgtgtgcttgtgtgcatgttcaggtgcacatatgtatgtaagtgtgtgtgtgcatatgtgtgtgcatgtgcgcagggtaggagaggtgtctgtgtgtgtgtgtgtgtgtgtgtgtgtgtgtgcaacagatgcttttgctgccctttccagattcctttttctactgctcctagactcttggcacttcccctttccctggagaattgcccctggcaagagggagctgtgactactcccttgctctcctgggagaaggaggcaggacacacttggtcaataatgggctgacacagggatacaaaatggcctcaaggcaggacccactccggtgcaatttgtgctccagatcacc

SEQ ID NO: 18874 - DNA, 253 bp, Homo sapiens
  D12S102
  Located on chromosome 12
  Distance between a terminus base of telomere on chromosomal short arm and 5'-terminus of this base sequence : 72097620
  Distance between 3'-terminus of neighbour sequence of sequence listing upward to telomere on chrosomal short arm and 5'-terminus of this base sequence : 14503
ctttgcagaacccatgattatgacagttgtctctactctcagttaccaaatgccctgatatttataggctctctctacagacacaactgcaactgtccttctaagagtggctacaataaatcctaaagtcctgcagcctcagggagggcaggaaaatggtgggggctggctcaaattcctaaacacacacacacacacacacacacacacacacacacacacacacacacacacacacgccctctaagacaat

SEQ ID NO: 18875 - DNA, 474 bp, Homo sapiens
  AC007458.13_97932
  Located on chromosome 12
  Distance between a terminus base of telomere on chromosomal short arm and 5'-terminus of this base sequence : 72155091
  Distance between 3'-terminus of neighbour sequence of sequence listing upward to telomere on chrosomal short arm and 5'-terminus of this base sequence : 57218
ataaccattaaattgcaatgtcacaaatgagctcaacaaagctgatactccaaaggtcccaaaaactatagtaagctaaagaaagtattttcaagctaggctaaaaaatacaaaaacaaaaaacagcaaagccaccccactataaaatactgccccccaatggtacaggtttctattacatctactgtgccttcctgtagggtattattatacgagctttaaaagatagttccaaacatgtgcgagtgtgtgtgtgtgtgtgtgtgtgtgtgtgatttgattttgtgttgtaagaataaaatcaattgtgaatgtctgaatattattatgacagctataattataacagctaagttttaaacaaataatgaaatatttaaaatgtaaaaacttttcattaaccatcaataaaattttaaaagaaactcaaaaaattcacttaaaatttttaaacattccttagccagaatcata

SEQ ID NO: 18876 - DNA, 369 bp, Homo sapiens
  AJ251550.1_2909
  Located on chromosome 12
  Distance between a terminus base of telomere on chromosomal short arm and 5'-terminus of this base sequence : 72220833
  Distance between 3'-terminus of neighbour sequence of sequence listing upward to telomere on chrosomal short arm and 5'-terminus of this base sequence : 65268
tttaagtctcagtgaccatgatgcccaggatgaagagctcctttccaactggcttcccaaggattgcaataaggctcccaacccaacctttgtaccatctgcaagctacaactgcaggaggctggagaaagcatacttggaccccaaccaagggcacagaaaagcttcaatattccccacagaggcaactcgactaacattgcacagattctggctcagtgtttttgttttgttttgttttgttttgttttgttttgttttgttttgttttctgcactggtctttattgctgtggaatttttcatagaaatgtgatcacttttaccttcttaattaattctccactgcttgctatgacagtgaccatac

SEQ ID NO: 18877 - DNA, 369 bp, Homo sapiens; identical to SEQ ID NO: 18876
  AC007458.13_163651
  Located on chromosome 12
  Distance between a terminus base of telomere on chromosomal short arm and 5'-terminus of this base sequence : 72220833
  Distance between 3'-terminus of neighbour sequence of sequence listing upward to telomere on chrosomal short arm and 5'-terminus of this base sequence : -369

SEQ ID NO: 18878 - DNA, 410 bp, Homo sapiens
  chr12.fa.O7frz.73249630
  Located on chromosome 12
  Distance between a terminus base of telomere on chromosomal short arm and 5'-terminus of this base sequence : 72261338
  Distance between 3'-terminus of neighbour sequence of sequence listing upward to telomere on chrosomal short arm and 5'-terminus of this base sequence : 40136
ctttcatctagttatttcgatgacttctcgacacagccttagcaaaatcatgcattgagtaagaccaaaaattttctattcctcatcagaaactcagacaacaagggaggccagtgagtaatgagaactgatttctttggcttcagtgcctgctcctcgcacctccacacaccgcccacagagagaggacatggaaaggtgatttatgctgaatctgcaaggtaagactttatccaaaaaggtcaaggaaatgaccagagatgttcttgcttggggaagattttcggcacgatctctctctctctctctctctctctctcactctaacagcccactgttggtctcttctcccaattcccaatcctccagcctcactagaatgtctcttttcaggttctgtatgagttgag

SEQ ID NO: 18879 - DNA, 374 bp, Homo sapiens
  AC008033.8_145564
  Located on chromosome 12
  Distance between a terminus base of telomere on chromosomal short arm and 5'-terminus of this base sequence : 72380092
  Distance between 3'-terminus of neighbour sequence of sequence listing upward to telomere on chrosomal short arm and 5'-terminus of this base sequence : 118344
ccaacttcctcagtgctagtagctttggatgtgagaggaagaccacacacacacacacacacacacacacacacacagacacacacagacacacacacacacactgagtttagatcaacaagcatatactgagtgcccattaccaggtgtcatgctggaattataggcacaggtggagcctcaggagtcaagctctctgaattcacaccccagtttatctctcagtagctggatagcctcaggcaagttcctcagcctttctaagccgtagctgctttacctgcaaaacaaggatactaataacacctacttcatgggagtttgtgactatcaaataagataattcgtatacagttgcctggcatctagtatgt

SEQ ID NO: 18880 - DNA, 328 bp, Homo sapiens
  AC008033.8_113111
  Located on chromosome 12
  Distance between a terminus base of telomere on chromosomal short arm and 5'-terminus of this base sequence : 72412502
  Distance between 3'-terminus of neighbour sequence of sequence listing upward to telomere on chrosomal short arm and 5'-terminus of this base sequence : 32036
tctcctgaatcttggtacctaacattttccctttgatattgcactttatttaattgaggtggtatctatgtcacctacctcattatgcttcagtgtgtgtgtgtgtgtgtgtgtgtgtgtttcagagtaaaatgaaacctgcaagcagaacattttcataccactatttactactaagtataatacagtctaatatcatgtatcctagagcttattataagacagagtttaaaaaaacaaaaaaaacaaaaaaaaaaacctcatcataaccagtgaggaactgacaagtacccagggatctggtttctagttcagatttgccatgaat

SEQ ID NO: 18881 - DNA, 172 bp, Homo sapiens
  D12S375
  Located on chromosome 12
  Distance between a terminus base of telomere on chromosomal short arm and 5'-terminus of this base sequence : 72547785
  Distance between 3'-terminus of neighbour sequence of sequence listing upward to telomere on chrosomal short arm and 5'-terminus of this base sequence : 134955
tcttcttatttggaaaagtaaccctcaaaaccttatccaagaaaagcaccatctttgttattttctgttactttattttgctttgattcctaaaacttaccacttatctatagatagatagatagatagatagatagatagatagatagatatggagaaagaccctcaacaa

SEQ ID NO: 18882 - DNA, 223 bp, Homo sapiens
  DISD22_0008545
  Located on chromosome 12
  Distance between a terminus base of telomere on chromosomal short arm and 5'-terminus of this base sequence : 72897509
  Distance between 3'-terminus of neighbour sequence of sequence listing upward to telomere on chrosomal short arm and 5'-terminus of this base sequence : 349552
gtcctgattcctcctttcagtttgtgtgtttagaacacccctttctctaagaatgcaaagtaagaaagtaagatgtaaaaaaaaaaacaaaagaaaaccttaaagtgaaattactcaaaacacacacacacacacacacacacacacacacacacacacacacacacacacactctatatcaaataccaacatgcatttgggttaagggaaggagactaagtc

SEQ ID NO: 18883 - DNA, 355 bp, Homo sapiens
  chr12.fa.O7frz.74491490
  Located on chromosome 12
  Distance between a terminus base of telomere on chromosomal short arm and 5'-terminus of this base sequence : 73151732
  Distance between 3'-terminus of neighbour sequence of sequence listing upward to telomere on chrosomal short arm and 5'-terminus of this base sequence : 254000
tttcagtgactaaagaattggaattctatatatgagagtaatgagatgtttttcttctgtattaagcaaggtgagagatggactgatattttggggtcactcaaatttatcctatccaatctattctagatttatcctagaattccagttggctagaagaactagtatgaagcccaaaaggaaaccaaacacattttgtaatgcgtgatgcaaacatgtttttctcttctttttattaaaagtaaaaaaaaaagagggatgtatgtgtatatatatatatatatatatatatatatatatagtcataggattacatatacatgaaaagagacattgaaaccactgacagtatttc

SEQ ID NO: 18884 - DNA, 451 bp, Homo sapiens
  chr12.fa.O7frz.74266626
  Located on chromosome 12
  Distance between a terminus base of telomere on chromosomal short arm and 5'-terminus of this base sequence : 73360071
  Distance between 3'-terminus of neighbour sequence of sequence listing upward to telomere on chrosomal short arm and 5'-terminus of this base sequence : 207984
gataagacttcagaaagtgatcaggaaatagcagctttacatgttcatttgtatctgtgttttcctaatggtgaagttagaattgttccatgtgatctaattcattctattaataaaatataatgatttaagacattagaaatagagagtggaagcattttatatttttttcagccaaaccaaacccacctcttaactcattttgaggctggccccctataggcattaattttgcccactgctagtgtcacagaaatcaccaaaacctctggtttaaagagagaaagaggagggggagacagagagagagagagagagagataaaatattttaaattaaagcaaattcaaatttgaaaactatctttttgaattattatatgagtatacactaatattttcagcctttcctcttgctatatgtttaggataacattcactagaccagaaca

SEQ ID NO: 18885 - DNA, 467 bp, Homo sapiens
  chr12.fa.O7frz.74576941
  Located on chromosome 12
  Distance between a terminus base of telomere on chromosomal short arm and 5'-terminus of this base sequence : 73385039
  Distance between 3'-terminus of neighbour sequence of sequence listing upward to telomere on chrosomal short arm and 5'-terminus of this base sequence : 24517
cttaccaaggctattaggtgactaaatgagatcacatgtaaaaattgcatgacagtcaaaagataactattactactgtgttcatgtgggatgaacaaattgatgcctatcatttatattatacctcataagacatggtacaaggttttgtgtgtgtgtgtgtgtgtgtgtgtatttgtaatattataataaaaatcattcaaattaacacagatacactaggacatttttctttaaaaagaacctataattgaaaaataccactctgcctagcctagacttttgcttatttcctgtacaatactttgcatataatacttgtagaggtaatgaatgtttggaatttgtttgactgaatttattaatgttcagattttaaaataaatttaccttaagacttgctaccattaataagttaacatgttaatacattaatagtaataacgttactatctgtatgtcaatca

SEQ ID NO: 18886 - DNA, 287 bp, Homo sapiens
  AC055123.5_115417
  Located on chromosome 12
  Distance between a terminus base of telomere on chromosomal short arm and 5'-terminus of this base sequence : 73576754
  Distance between 3'-terminus of neighbour sequence of sequence listing upward to telomere on chrosomal short arm and 5'-terminus of this base sequence : 191248
attgccagtaatattagatggatatattagtctggattttccaaagaaacaaaaccaatgggagatagagagggagggagggagatagatagctatagatagatagatagatagatttattataaggagtggctcatgtggttatggaggttgagaagtcccaaggtctgcagtcagctagctggtgatccaggagaaccaatagtatagttccagtctgagtacaaaagcctgaaaaccaggagagctgatgatacaagtttaagttgtaatccaaagacatgaga

SEQ ID NO: 18887 - DNA, 243 bp, Homo sapiens
  D12S1722
  Located on chromosome 12
  Distance between a terminus base of telomere on chromosomal short arm and 5'-terminus of this base sequence : 73827775
  Distance between 3'-terminus of neighbour sequence of sequence listing upward to telomere on chrosomal short arm and 5'-terminus of this base sequence : 250734
aaggaacttgcccaagattaaatgactagggaataacagaccaagaagagtatacacacacacacacacacacacacacacacacacactcccctaaacatctagtcacatattctcttacatagtgtgcctgataataaaggtaaatgccaaggaggacatgatttgaaatccagcaatcactcctctctaatgctactgcaagattgtcctatgttggctattggggatcagagtattccc

SEQ ID NO: 18888 - DNA, 165 bp, Homo sapiens
  D12S1043
  Located on chromosome 12
  Distance between a terminus base of telomere on chromosomal short arm and 5'-terminus of this base sequence : 73882038
  Distance between 3'-terminus of neighbour sequence of sequence listing upward to telomere on chrosomal short arm and 5'-terminus of this base sequence : 54020
tgtaggaggttgggtggtaataaagaccaagaaggaaattaagttaggaaggtgggatagcaagagttggggcttacaattttatctatctatttattattattattattattattattattattattattattattatttattatttttggagacagaacctcg

SEQ ID NO: 18889 - DNA, 316 bp, Homo sapiens
  AC011612.12_80265
  Located on chromosome 12
  Distance between a terminus base of telomere on chromosomal short arm and 5'-terminus of this base sequence : 74043754
  Distance between 3'-terminus of neighbour sequence of sequence listing upward to telomere on chrosomal short arm and 5'-terminus of this base sequence : 161551
tgtaaatagaagcctatggaatattatgactcagaaacatttcctgaaaaaataaaataaaataaaataaaataaaataaaataaaagacgatgactatggaatatgggagacaaccttttcattggcatttttggttgttccacaacaccttgttccctttcttcttccttcccaaatctactcaggggtataccccgtctccaagtgacttaagagatgtaacactagccccaagtcaggggttgattctgattgttctttcttgtgattggtttaggtgtgggcaaaggaactcactgtgaacaaggatacat

SEQ ID NO: 18890 - DNA, 408 bp, Homo sapiens
  AC073099.2_122976
  Located on chromosome 12
  Distance between a terminus base of telomere on chromosomal short arm and 5'-terminus of this base sequence : 74181663
  Distance between 3'-terminus of neighbour sequence of sequence listing upward to telomere on chrosomal short arm and 5'-terminus of this base sequence : 137593
ctgaagtcttacacctacagaaacaaatgaactcacagtgaaagagagaaagaaagaaaaaagaaagaaagagaagagaagagaagagaagagaagagaagagaagagaagagaagagaagaaacaaaacgaaactccaggtttggtagttttactagtgaactctaccaaaacacttaaagaagaagtaataccaacttgacatgttttccagaaaatgggacacaaaacacttaagtcatttttgaggcattactgataccaaaactaaaaacaagaaaacaataacaaacaaaaaaaaattaaagaccaatattcctcataaatataaaggcaaaaattctcaacaaaatattagcaaatcaaattcaataaaatgcccaaagatctacgaacaagtaaggttta

SEQ ID NO: 18891 - DNA, 442 bp, Homo sapiens
  U91327.1_16141
  Located on chromosome 12
  Distance between a terminus base of telomere on chromosomal short arm and 5'-terminus of this base sequence : 74425285
  Distance between 3'-terminus of neighbour sequence of sequence listing upward to telomere on chrosomal short arm and 5'-terminus of this base sequence : 243214
ggtggctactgtattagtgcagctctataaggttaggaagacgagagagaagagagatcacacatcttcatgacacctctcacctcacatgtaggcagattaggcactcagtaagtatttgttgaatgaaataattcatctttttctttgaattttgaagaccagtgtttgtgaagtattctaaatttttggggaggagccatagatttttgaatttttttcttctatattgattttcagaatttacttttattcttacaaagacatacatcattatgtgtgtgtgtgtgtgtgtgtgtgtgtgtgtgtgtgtgtaaagaattatataatgaactaccatgtatgaccaaccactttaaaaaacagaacactgccagcacctttgatggccgttcatgtttctcactacttgtgatctctgacatactctttaagtaaccgc

SEQ ID NO: 18892 - DNA, 222 bp, Homo sapiens
  U91327.1_59602
  Located on chromosome 12
  Distance between a terminus base of telomere on chromosomal short arm and 5'-terminus of this base sequence : 74468905
  Distance between 3'-terminus of neighbour sequence of sequence listing upward to telomere on chrosomal short arm and 5'-terminus of this base sequence : 43178
gataaagcctgcttgactgtaggggattcactttttggtgtgctgctggatttggcttgcttgttattttgttgaggatttttgcatctatgtttatcaaggatattggctgaagttttctttgtgtgtgtgtgtgtgtgtgtgtgtgtgtgtgtgtgtgtgtgtgtgtctctgccaggttttggtatcaggatgatgctcacctcatagaatgagttaagg

SEQ ID NO: 18893 - DNA, 260 bp, Homo sapiens
  D12S1680
  Located on chromosome 12
  Distance between a terminus base of telomere on chromosomal short arm and 5'-terminus of this base sequence : 74469000
  Distance between 3'-terminus of neighbour sequence of sequence listing upward to telomere on chrosomal short arm and 5'-terminus of this base sequence : -127
atcaaggatattggctgaagttttctttgtgtgtgtgtgtgtgtgtgtgtgtgtgtgtgtgtgtgtgtgtgtgtctctgccaggttttggtatcaggatgatgctcacctcatagaatgagttaaggaggagtccctcctcctcagtttttttggaatagtttcagtacagatggtactagctcttcttttattcatttcttctagattttctagtttgtgtgcatagaggtgttcgtagtagtctgtgatggtattttt

SEQ ID NO: 18894 - DNA, 443 bp, Homo sapiens
  AC016153.10_51409
  Located on chromosome 12
  Distance between a terminus base of telomere on chromosomal short arm and 5'-terminus of this base sequence : 74476123
  Distance between 3'-terminus of neighbour sequence of sequence listing upward to telomere on chrosomal short arm and 5'-terminus of this base sequence : 6863
gagctcctaggatgaacactacatgggtagtgacattttaaaatactagaaggtaggctgggcatggtggctcattcctgtaatcccagcactttgggaagctgaggcaggtggatcacttgaagccagaagtttgagaccagcctggcgaacatggtgaaacctcgtctctactaaaaatacaaaaattagccagacgtggtggcatgtgcctgtaatcccagctactcgggaggctaagacagaatcacttgaacctgggaggcagaggttgcagtgagccgagattgtatcacaacactccagcctaggtgacagagtgagaccctgtctcaaaaataaataaataaataaataaataaatagtactggaaggttaaatatttcatcaatttaagttaaaaaaattcatctgttaatcatttcagtaaatccttatgaac

SEQ ID NO: 18895 - DNA, 320 bp, Homo sapiens
  U91327.1_94937
  Located on chromosome 12
  Distance between a terminus base of telomere on chromosomal short arm and 5'-terminus of this base sequence : 74504350
  Distance between 3'-terminus of neighbour sequence of sequence listing upward to telomere on chrosomal short arm and 5'-terminus of this base sequence : 27784
ttgctagaggatggtatttgatttccctgtatatgtttttatactaaactaagagtttctttgagagttctgaaggttgattgtgtgtgtgtgtgtgtgtgtgtgtgcgcgcgcgcgcgcgcgcaggtgcatgcacgctaggattgttgcccttggtactaatgaccttattgaattagctaagacagagtgactcatctgctggatttgcacatatcttagggcagacattatgggcgctccaatttaattgtctaaatttcatcaccagtgtttcttcctatagatacgtaccaagattaacaatgactccaggatag

SEQ ID NO: 18896 - DNA, 361 bp, Homo sapiens
  AC018921.9_186716
  Located on chromosome 12
  Distance between a terminus base of telomere on chromosomal short arm and 5'-terminus of this base sequence : 74515249
  Distance between 3'-terminus of neighbour sequence of sequence listing upward to telomere on chrosomal short arm and 5'-terminus of this base sequence : 10579
caggtctggtagtcctgtagtcccagctactcaggaggctgaggcaggaggatcacttgagcccaggagtttgagcccagccttgggcaacataatgtctgcctgcctgcctgcctgcctgcctgtctctgtgtctctggctgtctctctctctctctctctgtctctctctctctgtccctctctgtctctctctctctctttaaagaaggacatgaaattcctgataagccacaaagggttaatttcattattaactcttgaacaaaaattaattatttaggtaatattatatatgagaccttaagttggttttttttttagatgattttagaataggtgacctttgcaaatttaacta

SEQ ID NO: 18897 - DNA, 376 bp, Homo sapiens
  AC016153.10_154167
  Located on chromosome 12
  Distance between a terminus base of telomere on chromosomal short arm and 5'-terminus of this base sequence : 74631911
  Distance between 3'-terminus of neighbour sequence of sequence listing upward to telomere on chrosomal short arm and 5'-terminus of this base sequence : 116301
acagctgtcctttccattcaatggaagaggtttagaaatccctgtcaattgggaaaatcaaggggggagcaaaatgagattgagagagggatgaaatcacattgcaacaacatcatgcagggcaggatgtcaaccaggttttttcgtttgtttgtttttttaccataaaccatagtaagatatatgttgttcacaaaacagttattggccctgccacatgatgtgctttctgctgttctattctattctattctattctattctattctattctattctattctattctattgttctccattccattccactaaaaatgctggttacaacccgttaacctgatttaagaatcccataatgagttacaaaccacagc

SEQ ID NO: 18898 - DNA, 227 bp, Homo sapiens
  chr12.fa.O7frz.75785120
  Located on chromosome 12
  Distance between a terminus base of telomere on chromosomal short arm and 5'-terminus of this base sequence : 74771095
  Distance between 3'-terminus of neighbour sequence of sequence listing upward to telomere on chrosomal short arm and 5'-terminus of this base sequence : 138808
gatatgtcaagatgtcaccaacttattttcaaatggttcagtcaaagggtatggatatatatatatatatatatacattcagaatctaccactataggtagtgaatgcaaaggaggatagcagaggctgggaagggtaataggggttagggggtgaggggataaagaggggttgggtaatgggtgcaaaaatatatagaaggaatatgatctagtgtttggtagcac

SEQ ID NO: 18899 - DNA, 93 bp, Homo sapiens
  D12S1705
  Located on chromosome 12
  Distance between a terminus base of telomere on chromosomal short arm and 5'-terminus of this base sequence : 74780093
  Distance between 3'-terminus of neighbour sequence of sequence listing upward to telomere on chrosomal short arm and 5'-terminus of this base sequence : 8771
gactgaggaacaggcttgtgtgtgtgtgtgtgtgtgtgtgtgtgtgtgtgtgtgtgtgtaattaagaattcatttgggacattttacgtttga

SEQ ID NO: 18900 - DNA, 110 bp, Homo sapiens
  DISO7_10003453
  Located on chromosome 12
  Distance between a terminus base of telomere on chromosomal short arm and 5'-terminus of this base sequence : 74811765
  Distance between 3'-terminus of neighbour sequence of sequence listing upward to telomere on chrosomal short arm and 5'-terminus of this base sequence : 31579
gggaagaaggtgagttcaacatttttcaaggaagttacacacacacacacacacacacacacacacacaaacacacacacacacacacagagctagtaggttgccaaatg

SEQ ID NO: 18901 - DNA, 104 bp, Homo sapiens
  DISO7_10003455
  Located on chromosome 12
  Distance between a terminus base of telomere on chromosomal short arm and 5'-terminus of this base sequence : 74879989
  Distance between 3'-terminus of neighbour sequence of sequence listing upward to telomere on chrosomal short arm and 5'-terminus of this base sequence : 68114
caattaactgctatgtttagcagcaaactgtgcctttcgtgtgtgtgtgtgtgtgtgtttgtgtgtgtgtgtgtgtatgtgtgtatgtctttcttagctttgca

SEQ ID NO: 18902 - DNA, 104 bp, Homo sapiens
  DISO7_10003454
  Located on chromosome 12
  Distance between a terminus base of telomere on chromosomal short arm and 5'-terminus of this base sequence : 74923026
  Distance between 3'-terminus of neighbour sequence of sequence listing upward to telomere on chrosomal short arm and 5'-terminus of this base sequence : 42933
cagaagactcaagctcaaagggaatcaaagcacacacacacacacacacacacacacacacacacacggaagaaccaaccacaaaaggaatcaaagcaagtgca

SEQ ID NO: 18903 - DNA, 101 bp, Homo sapiens
  DISO7_10003451
  Located on chromosome 12
  Distance between a terminus base of telomere on chromosomal short arm and 5'-terminus of this base sequence : 74976881
  Distance between 3'-terminus of neighbour sequence of sequence listing upward to telomere on chrosomal short arm and 5'-terminus of this base sequence : 53751
actactcatcctgagtatccctctactaacctccactccacttgaacacacacacacacacacacacacacacacacacacacggctcttccaatgtgaca

SEQ ID NO: 18904 - DNA, 457 bp, Homo sapiens
  AC025159.14_128923
  Located on chromosome 12
  Distance between a terminus base of telomere on chromosomal short arm and 5'-terminus of this base sequence : 75061409
  Distance between 3'-terminus of neighbour sequence of sequence listing upward to telomere on chrosomal short arm and 5'-terminus of this base sequence : 84427
gactttggtgtacaatatttcaaagggttagtattaaacttgtgatttttgttttgtttttaaggaatgtaaaaaataaacgtttactaaaaatgttaaaaaaaagactccacctgaaaactctaagatttaataaatgagttcagataagttgtagaacagaaaacaatatacaaaaatcaatagcatttttatacatcagtaatgatctagctgagaaggaaatctcatttataatagctacaacaacaacaacaacaacaacaacaaaacccaccaaacctagatacaaagttaaccaaggaggtgaacaatctctacaagaactacaaaatactaatgaaagaaattgaaggtgacaaaaagaagtggaaaaacatcccatgttcatggatcagaagaattaatatcattagtatgaccatattgcccaaagcaatctacagattcaatacaa

SEQ ID NO: 18905 - DNA, 195 bp, Homo sapiens
  DISO7_10003460
  Located on chromosome 12
  Distance between a terminus base of telomere on chromosomal short arm and 5'-terminus of this base sequence : 75193827
  Distance between 3'-terminus of neighbour sequence of sequence listing upward to telomere on chrosomal short arm and 5'-terminus of this base sequence : 131961
ggcttctaagagtcaagttgcttaaaaaaataaatacaccagtgtttaaactgaagttaaggttaaaaaaacgcatacacacacacacacacacacacacacactgtaagaacagaaaaatagaatgctttgctacaaaaatcccacttaatatattttagcacaaaaatgtctaatatacactggataagcgtg

SEQ ID NO: 18906 - DNA, 122 bp, Homo sapiens
  DISD22_0008559
  Located on chromosome 12
  Distance between a terminus base of telomere on chromosomal short arm and 5'-terminus of this base sequence : 75420941
  Distance between 3'-terminus of neighbour sequence of sequence listing upward to telomere on chrosomal short arm and 5'-terminus of this base sequence : 226919
gttcctcagtttgcagccaaattcctttatttcccccttcctcctcgtctccctcacacacacacaaacacacacacacacacacacacacacacaaactgtggtgactaaccttacatgcg

SEQ ID NO: 18907 - DNA, 296 bp, Homo sapiens
  Z67145
  Located on chromosome 12
  Distance between a terminus base of telomere on chromosomal short arm and 5'-terminus of this base sequence : 75521682
  Distance between 3'-terminus of neighbour sequence of sequence listing upward to telomere on chrosomal short arm and 5'-terminus of this base sequence : 100619
gaacctggtacttcccattccaaatctctgcactaatttatggattctaaggtgcctacacacacacacacacacacacacacacacacaccctctgtgacttgcacaaaatggaaataacaaagacatacttaaaagcagaactatatagtgtagttatttttgttgctactgataataagtctattatggaaccatattttatatgtgtatgtcttcttgtaccagatagtgatgtttatcttatacccgactgttaaaatattgcatttttcaagcatatgaatagagaatgt

SEQ ID NO: 18908 - DNA, 211 bp, Homo sapiens
  D12S80
  Located on chromosome 12
  Distance between a terminus base of telomere on chromosomal short arm and 5'-terminus of this base sequence : 75602384
  Distance between 3'-terminus of neighbour sequence of sequence listing upward to telomere on chrosomal short arm and 5'-terminus of this base sequence : 80406
ccagcctggaatgatatgtattacattaagaacataataccaacaaaatttctgtcatacagaaactaaaaagtccttttcagaaagagatacagtacacacacacacacacacacacacacacacacacacttatatatgtacttactatgacctttactttcattgatattgctaacaaggagaacagccatctggtccattgacattc

SEQ ID NO: 18909 - DNA, 338 bp, Homo sapiens
  AC012018.11_66225
  Located on chromosome 12
  Distance between a terminus base of telomere on chromosomal short arm and 5'-terminus of this base sequence : 75850183
  Distance between 3'-terminus of neighbour sequence of sequence listing upward to telomere on chrosomal short arm and 5'-terminus of this base sequence : 247588
tttacctactgctatggagtgatctccaggatatattattaagtgaaaaagggcaagttttagaattgtacttatagcatgttttattttctcattttattatcatattatttatttatttatttatttatttatttatttttgagacggagtttcactcttgctgcccaggctggagggcaatggcgtgacctcagcacacggcaacctccatctcctgggttcaagtgattctcctgcctcagcctcccaagtagctgggattacaggcgcccgccatcacgcctggctaatttttgtatttttagtagagacgggtttcaccatattgaccagac

SEQ ID NO: 18910 - DNA, 260 bp, Homo sapiens
  chr12.fa.O7frz.81406522
  Located on chromosome 12
  Distance between a terminus base of telomere on chromosomal short arm and 5'-terminus of this base sequence : 76017612
  Distance between 3'-terminus of neighbour sequence of sequence listing upward to telomere on chrosomal short arm and 5'-terminus of this base sequence : 167091
atgttaatcatttggcctaatcacacgtgggattgtacagtctccaagtgtgaaatgccctgtatcatatttctttgagtgctttaaaatatgtaacaagcatttactgggagacaactacatgcttggattgtctgggaatgagacagcattcctgcccttccaggtgaatggtgaagacaatggttagcatacagacagacagacagacagacagggaatatggtgtcaggtgtaagtgcttccatgaagtgctaata

SEQ ID NO: 18911 - DNA, 226 bp, Homo sapiens
  DISO7_00000485
  Located on chromosome 12
  Distance between a terminus base of telomere on chromosomal short arm and 5'-terminus of this base sequence : 76049979
  Distance between 3'-terminus of neighbour sequence of sequence listing upward to telomere on chrosomal short arm and 5'-terminus of this base sequence : 32107
ctgagtaccttccgcatgtcaggcaggatgatagagagcaggaattcaacaacaacaacaacaacaacaataacaacaacaacaacaaaagtcagaccctcttcctgattccaggaagctcagggtctggtggagaggacaggcaggaagactggcagtttctgtgtggattcgtatgggctacactggggaagggaggagggccacctaacctgccagatggaca

SEQ ID NO: 18912 - DNA, 426 bp, Homo sapiens
  chr12.fa.O7frz.81324395
  Located on chromosome 12
  Distance between a terminus base of telomere on chromosomal short arm and 5'-terminus of this base sequence : 76204124
  Distance between 3'-terminus of neighbour sequence of sequence listing upward to telomere on chrosomal short arm and 5'-terminus of this base sequence : 153919
ctcacagtttagatggaactgtactcttaccaatatttatatcatcatgtactaagtagtacactagcctagaaacagaattttgacattcagtacaagaagtacttgatattgaggcaactttaaaaagtcatataggattaattcataatggttcatgaagtgttttccttcttatttcatttgatccttgtgattatgttatgaagtagatattgttaccttattttacggataataaaagctcagcaagctgaaataacttggttaaggtcatgtagtgtactagggttcttcagagaaacacaacacacacacacacacacacacacacacacacacacacacacacacacacacgaagtctctatttgccatttgcaagctggagtaccaagaaagctaatggtgtaattcagtctgact

SEQ ID NO: 18913 - DNA, 346 bp, Homo sapiens
  AC016256.8_16595
  Located on chromosome 12
  Distance between a terminus base of telomere on chromosomal short arm and 5'-terminus of this base sequence : 76446239
  Distance between 3'-terminus of neighbour sequence of sequence listing upward to telomere on chrosomal short arm and 5'-terminus of this base sequence : 241689
ctcacttgtaagtgagagttgaacaatgagaacacatggacacagggaggggaacatcatacaccagggcctgttggtgggtcaggggaaaggagagggatagcattagaagaaatacctaatgtagctgacaggttgatgggtgcagcaaaccaccatgacatgtgtatacctatgtaacaaaacgttacgttctgcacacgtaacccagaatttaaagcataataataataataataataataataataataatttacagagaaggaaattaaaaaaagatataccacattttatttatccattcatcaggtgagggacatttacatgtttctactttctggct

SEQ ID NO: 18914 - DNA, 468 bp, Homo sapiens
  AC025258.9_84523
  Located on chromosome 12
  Distance between a terminus base of telomere on chromosomal short arm and 5'-terminus of this base sequence : 76560716
  Distance between 3'-terminus of neighbour sequence of sequence listing upward to telomere on chrosomal short arm and 5'-terminus of this base sequence : 114131
agttgtagcatgacagtttcagaaaatatctaactgttcataagggcaacataaattgaatttgatttcttcatagcaagttgatgtgaaatcattttctgtataaaattcttattgtttttcttcatctgtgtgtatggatttgctcagcagattgaataactacagttatattatttggaaaggattattatttggaaaggattattattattattattattattattattattatgaacgtttttgttcatcctgtcatactttctatggtgtgcaaaatatatcaatttttaatacattcttttccactgacccactctgctcagttttatatgaaacagttagaatatagcctctgactcatatcatattaaactttcattccaagcttgtattaatgtgtgcctttatgctctgatacttgatatggttaattttcaactgaggtactctatgtttgtcaac

SEQ ID NO: 18915 - DNA, 200 bp, Homo sapiens
  DISD22_0008568
  Located on chromosome 12
  Distance between a terminus base of telomere on chromosomal short arm and 5'-terminus of this base sequence : 76706880
  Distance between 3'-terminus of neighbour sequence of sequence listing upward to telomere on chrosomal short arm and 5'-terminus of this base sequence : 145696
cgtcagttatattcccacctctacacacacacacacacacacacatacacacacatacatacatacacacacacacacacacacacacacacacacacacacgcagacacacatttattctcctgcccctgccctgcactccccgctagagaattttatggttatttcctgtaaagtcagttgactttgaagtcttacaa

SEQ ID NO: 18916 - DNA, 126 bp, Homo sapiens
  DISO7_10003485
  Located on chromosome 12
  Distance between a terminus base of telomere on chromosomal short arm and 5'-terminus of this base sequence : 76814009
  Distance between 3'-terminus of neighbour sequence of sequence listing upward to telomere on chrosomal short arm and 5'-terminus of this base sequence : 106929
aacactgaagactgagacaaagtctaatatttcttatctattattttagaggcttagatatatatatatatatatatatacacacacacacaaagagaaggaaaagctgcatttcttgtctaatga

SEQ ID NO: 18917 - DNA, 446 bp, Homo sapiens
  chr12.fa.O7frz.80361236
  Located on chromosome 12
  Distance between a terminus base of telomere on chromosomal short arm and 5'-terminus of this base sequence : 76890336
  Distance between 3'-terminus of neighbour sequence of sequence listing upward to telomere on chrosomal short arm and 5'-terminus of this base sequence : 76201
ctctacctctgacctcacctactccaggcttcctccatcactccttcctctgagctgccttgcacctggtatattcctcctccatggaaaccatcacacagtaattatgattattggtctgaacagctttctccccagcaatgctaagagggcagaggtcccatcttgggttttttgtactctcagaccctgttatgctgcttgatatacataatagagattcaagaaatgttcatgataaatgagtgaatgaatgaatgaatgaatgaatggagaaagtaaacatttaggaaaagaaaacattatagggaaaggccctagtggggaagcaatatttaaataatgtaaggacacatatccaaaagttattctaacacttactttggattttatatgcatatactctgtcttccaatttccctatctgtcagaatagccagtaaatg

SEQ ID NO: 18918 - DNA, 177 bp, Homo sapiens
  Z24021.1_145
  Located on chromosome 12
  Distance between a terminus base of telomere on chromosomal short arm and 5'-terminus of this base sequence : 76983231
  Distance between 3'-terminus of neighbour sequence of sequence listing upward to telomere on chrosomal short arm and 5'-terminus of this base sequence : 92449
ctccttgacagtcaacttacaataaacttttctcactgcaaaaacccagtgcttcggtgtttggctttccattgtgcatgggtaaatgaacccagtttggtgtggtaatacacacacacacacacacacacacacacagtatcattctaactcggagagcctccataagatctttct

SEQ ID NO: 18919 - DNA, 133 bp, Homo sapiens
  D12S337
  Located on chromosome 12
  Distance between a terminus base of telomere on chromosomal short arm and 5'-terminus of this base sequence : 76983266
  Distance between 3'-terminus of neighbour sequence of sequence listing upward to telomere on chrosomal short arm and 5'-terminus of this base sequence : -142
ctgcaaaaacccagtgcttcggtgtttggctttccattgtgcatgggtaaatgaacccagtttggtgtggtaatacacacacacacacacacacacacacacagtatcattctaactcggagagcctccataa

SEQ ID NO: 18920 - DNA, 101 bp, Homo sapiens
  DISD22_0008584
  Located on chromosome 12
  Distance between a terminus base of telomere on chromosomal short arm and 5'-terminus of this base sequence : 77134169
  Distance between 3'-terminus of neighbour sequence of sequence listing upward to telomere on chrosomal short arm and 5'-terminus of this base sequence : 150770
ggatgtatgccgaaatcccctttggatatggaaatatatatatatatatatatatatatatatatatatatatatatctccactcatatacgcacatactt

SEQ ID NO: 18921 - DNA, 140 bp, Homo sapiens
  DISO7_10003482
  Located on chromosome 12
  Distance between a terminus base of telomere on chromosomal short arm and 5'-terminus of this base sequence : 77270457
  Distance between 3'-terminus of neighbour sequence of sequence listing upward to telomere on chrosomal short arm and 5'-terminus of this base sequence : 136187
tcaacttgagtcctgtattctttctactattctccctctcaatccctctctctctttctctctctctctctttctctccctctctctctctcacacacacacacacacacacatacacgcttacatgtttctaccatcgt

SEQ ID NO: 18922 - DNA, 136 bp, Homo sapiens
  DISO7_10003481
  Located on chromosome 12
  Distance between a terminus base of telomere on chromosomal short arm and 5'-terminus of this base sequence : 77270457
  Distance between 3'-terminus of neighbour sequence of sequence listing upward to telomere on chrosomal short arm and 5'-terminus of this base sequence : -140
tcaacttgagtcctgtattctttctactattctccctctcaatccctctctctctttctctctctctctctttctctccctctctctctctcacacacacacacacacacacatacacgcttacatgtttctacca

SEQ ID NO: 18923 - DNA, 301 bp, Homo sapiens
  chr12.fa.O7frz.79916787
  Located on chromosome 12
  Distance between a terminus base of telomere on chromosomal short arm and 5'-terminus of this base sequence : 77318413
  Distance between 3'-terminus of neighbour sequence of sequence listing upward to telomere on chrosomal short arm and 5'-terminus of this base sequence : 47820
caaatttgattctgatagacgttaaatctctttgcaatatttttcttagggcacagctcatagcctctgattataccagaagtttgttgcttctggaaacttttagtatgttgagacatttaaatgattgccatataacattggaacagaaaagaaaaaaattgatgactctccttccctttttcccagaaaaattctctctctctctctctctctctcacacacacacacacacacacacatattgcctctttccttcattctagcagaccagctttgtgatactggttaaccttcctag

SEQ ID NO: 18924 - DNA, 478 bp, Homo sapiens
  chr12.fa.O7frz.80022837
  Located on chromosome 12
  Distance between a terminus base of telomere on chromosomal short arm and 5'-terminus of this base sequence : 77406519
  Distance between 3'-terminus of neighbour sequence of sequence listing upward to telomere on chrosomal short arm and 5'-terminus of this base sequence : 87805
tgctcagtgtcactaattatcagggaaattcaaatcaaaaccgcaatgtgatacaccttactcctgcaagaatggccataatcaaaaaatcaaaaataatagatgttggcatggatgtggtgaaaagggaacacttttacactgctgttgagagtgtaaactagtacaaccactatgaaaaacagtgtggagattcattaaagaactaaaagtagaactaccatttgatccagcaattccactgctgggtatctacccagaggaaaataagtcattatacaaaaaagatactgcacaaaaatatggaaccagctcaagtgtccatcaatcaatgagtggataaagaaactgtggtgtatatatatatatatatatatatatatatatatatatatatatatataatggaatactactcaaccttaaaaaggaacaaaataatggcattcacagaaacttggaagaaattggataacat

SEQ ID NO: 18925 - DNA, 112 bp, Homo sapiens
  DISO7_10003484
  Located on chromosome 12
  Distance between a terminus base of telomere on chromosomal short arm and 5'-terminus of this base sequence : 77430575
  Distance between 3'-terminus of neighbour sequence of sequence listing upward to telomere on chrosomal short arm and 5'-terminus of this base sequence : 23578
gaatcacagactatttccggtacaaaatatttaataatgagtgtatcgtgtgtgtgtgtgtgtgtgtgtgtgtacgtgtgtgtttaaagacaggattacttatcgttaggaa

SEQ ID NO: 18926 - DNA, 423 bp, Homo sapiens
  AC021190.5_143372
  Located on chromosome 12
  Distance between a terminus base of telomere on chromosomal short arm and 5'-terminus of this base sequence : 77606944
  Distance between 3'-terminus of neighbour sequence of sequence listing upward to telomere on chrosomal short arm and 5'-terminus of this base sequence : 176257
ctttgtaaattacaatgacctcagatagtgtgatatgaataatgagctgctctattttctaaagtctgtctgtctgtctctctttctctgcatccatccacctactatctatctatctatctatctatctatctatctatctatctatctatctatccgtctatctatccatcctgtctatcatctatttatctctatttttcatttatctttatctatttaaatgaatgactggtgaagaaggctatgaccaagaattgtttttcaaagcaaggctactttcaactcttacttttaatgcttaccaatcaacatcatcttatatttagagaaatttgtttttctctttctttaatctaaaatgcctttttgcagcactcttacatatcaattttataagtatacagcaagcttaaattgact

SEQ ID NO: 18927 - DNA, 155 bp, Homo sapiens
  D12S1052
  Located on chromosome 12
  Distance between a terminus base of telomere on chromosomal short arm and 5'-terminus of this base sequence : 77606970
  Distance between 3'-terminus of neighbour sequence of sequence listing upward to telomere on chrosomal short arm and 5'-terminus of this base sequence : -397
agtgtgatatgaataatgagctgctctattttctaaagtctgtctgtctgtctctctttctctgcatccatccacctactatctatctatctatctatctatctatctatctatctatctatctatctatccgtctatctatccatcctgtctat

SEQ ID NO: 18928 - DNA, 228 bp, Homo sapiens
  D12S869
  Located on chromosome 12
  Distance between a terminus base of telomere on chromosomal short arm and 5'-terminus of this base sequence : 77609594
  Distance between 3'-terminus of neighbour sequence of sequence listing upward to telomere on chrosomal short arm and 5'-terminus of this base sequence : 2469
gtcctctgagttggctcctaataccatttcttattgtacggaaagtgtgtgtgtgtgtgtgtgtgtgtgtgtgtgtgtgcatgactgtcatatatgtctttcatcatgaggtcaactagttaagacttattttcatagtatcaggatacagttccaagaaagagagaggaaggtagagagagagagagagcaagaatgtagaagcatactagaccatttgaagcctgg

SEQ ID NO: 18929 - DNA, 414 bp, Homo sapiens
  AC021190.5_70249
  Located on chromosome 12
  Distance between a terminus base of telomere on chromosomal short arm and 5'-terminus of this base sequence : 77636562
  Distance between 3'-terminus of neighbour sequence of sequence listing upward to telomere on chrosomal short arm and 5'-terminus of this base sequence : 26740
atgcaccagatgtttcaagaactccaagaaggcgcctcagagaagccagaaaaaaatttcccaaggtatatgatttgtagactcttttgtattatgtaactgcgctagaattatacctctattttctttatttaattacaataaaatttttatttatttatttatttatttatttatttatttatttatttatttttgagacagagtttcactcttgtcacccaggctggagtgcaatggcacagtcttggctcactgcaacctccaccttctgggttcaagtgagtctcttgtctcagcctcccaagtagctggtattacaggcacctgccaccatgaccggctaatttttgtatttttagtacagacagagtttcaccatgttgaccaggctagtcttgaactcctgacctc

SEQ ID NO: 18930 - DNA, 105 bp, Homo sapiens
  DISO7_10003476
  Located on chromosome 12
  Distance between a terminus base of telomere on chromosomal short arm and 5'-terminus of this base sequence : 77792317
  Distance between 3'-terminus of neighbour sequence of sequence listing upward to telomere on chrosomal short arm and 5'-terminus of this base sequence : 155341
tcaattcgtcaatttgcctttttcccttttgtagtctcgttttattttattaacttgtgtgtgtgtgtgtgtgtgtctgtgtatttaacatcacataatccatgc

SEQ ID NO: 18931 - DNA, 131 bp, Homo sapiens
  DISO7_10003477
  Located on chromosome 12
  Distance between a terminus base of telomere on chromosomal short arm and 5'-terminus of this base sequence : 77793995
  Distance between 3'-terminus of neighbour sequence of sequence listing upward to telomere on chrosomal short arm and 5'-terminus of this base sequence : 1573
tgaagttagtacctgaggactgactgtgtgtgtgtgtgtgtgtgtgtgtgtgtgtgtgtgtgtctgtggctgtgtgtgtgcgaattttttccttcagatctttcattttaccatggtttctctggcaataa

SEQ ID NO: 18932 - DNA, 101 bp, Homo sapiens
  DISO7_10003480
  Located on chromosome 12
  Distance between a terminus base of telomere on chromosomal short arm and 5'-terminus of this base sequence : 77888242
  Distance between 3'-terminus of neighbour sequence of sequence listing upward to telomere on chrosomal short arm and 5'-terminus of this base sequence : 94116
ctttcaacttcttgactctagcctttccttccttccttcctccctccctccctccctctctccctccttccttccttccttccttcttgtgttcattcttt

SEQ ID NO: 18933 - DNA, 148 bp, Homo sapiens
  G08947
  Located on chromosome 12
  Distance between a terminus base of telomere on chromosomal short arm and 5'-terminus of this base sequence : 78056826
  Distance between 3'-terminus of neighbour sequence of sequence listing upward to telomere on chrosomal short arm and 5'-terminus of this base sequence : 168483
aaggttatgcatgtatgtgtgcatgtatttatctatctatctatctatctatctatctatctatctatctatttatccatcaactggttgagaattttgaatgtgtgtaactaagggaagaatctggccctcctggctcaagaacttt

SEQ ID NO: 18934 - DNA, 405 bp, Homo sapiens
  AC032040.2_122100
  Located on chromosome 12
  Distance between a terminus base of telomere on chromosomal short arm and 5'-terminus of this base sequence : 78300589
  Distance between 3'-terminus of neighbour sequence of sequence listing upward to telomere on chrosomal short arm and 5'-terminus of this base sequence : 243615
cactgagaatgaacaaataggaaggaaggaaggaaggaaggaaggaaggaaggaaggaaggaaaaagaaaagaaagaagaaagaaagaaagaaaaagaaaacctgcttttgagaaaacattgtgaggtgggcaggggctggggtaaaagaggaagaaactagcaaccagaaaaaaaatgtaagaaaagcagagctctaaaaataatctactgcagaatatgaaagaaaagggaatgttatttttattctcacagaaataagaaatggcaatggcctctctgaaataggagcaaataatcattaagacaaaagaaattgaaatagaaattctctacaatgagttgaagagtcaaaaaaatagaaggatacctttaaaatgatctgatacaggaatttgacctgatt

SEQ ID NO: 18935 - DNA, 346 bp, Homo sapiens
  chr12.fa.O7frz.78883605
  Located on chromosome 12
  Distance between a terminus base of telomere on chromosomal short arm and 5'-terminus of this base sequence : 78500041
  Distance between 3'-terminus of neighbour sequence of sequence listing upward to telomere on chrosomal short arm and 5'-terminus of this base sequence : 199047
ctgactagctatggtcaatcagatttatagtaattaattcaagaatacacatatgtatcaatccaaggacaatcaacttcaggaattttgcatggcaccatcaggaaagaaacatgctctttttctctgaagttaataaatcataaaatccaagtcttgatttgctgttggtcatttttgacactttgtggggaaataacgactcagattaaagtatatatatatgtgtgtgtgtgtgtgtgtgtgtgtgtgtgtatatatatatatacacacatacatatatgtacaaaagaaagagtcagggatacataatttcttaaagatatagcttgacaagcttgataga

SEQ ID NO: 18936 - DNA, 430 bp, Homo sapiens
  chr12.fa.O7frz.78755795
  Located on chromosome 12
  Distance between a terminus base of telomere on chromosomal short arm and 5'-terminus of this base sequence : 78712461
  Distance between 3'-terminus of neighbour sequence of sequence listing upward to telomere on chrosomal short arm and 5'-terminus of this base sequence : 212074
gttagctaggcgatcataaatttatacttttaatgggacgattcttacataaaaaagtagaacatttatatccatttaaatctcaaagacacagaatttagatctaaatgtcagaatgttgtactttggaaacaagtttatttcagtaggtggctttttaatttatttattaactggattactgagttcagggcagagtccattaacaaatagggctgaagtccctcatgactcttggggctccacttgaaagacggttgaccccgaaaggggccagtggtgccttgggtatattccttaaggagactcagaatcactagaagtgattctctagaacccttcatgtgataaccagaagtgtgtgtgtgtgtgtgtgtgtgtgtgtgtgtgcgtgcgcgtttgtgtgtgtaagtaattctccattcactgc

SEQ ID NO: 18937 - DNA, 418 bp, Homo sapiens
  chr12.fa.O7frz.78648666
  Located on chromosome 12
  Distance between a terminus base of telomere on chromosomal short arm and 5'-terminus of this base sequence : 78919318
  Distance between 3'-terminus of neighbour sequence of sequence listing upward to telomere on chrosomal short arm and 5'-terminus of this base sequence : 206427
tattgcctaacattacatggacaatagagagcacagtctagacctgaatccatattaactagcttattttgcacttcatcacaattaacacaattaactaaaagctaattgaagcctgaacatccacagtttgggaactggacaatgagtatgtgtgtgtgtgtgtgtgtgtgtgtgtgtgtgtacacacacacatatatatacacatatatatatacacatacacatatgtatacatatgtatatatacacacatacacatatgtatacatacgtatatatacacacagacacatatgtatacatatgtatatatacacatatgtatacatatgtatatatacacacagacacatatgtatacatatgtatatatacacatatgtatttatatgaactttgatgcatacgattatag

SEQ ID NO: 18938 - DNA, 124 bp, Homo sapiens
  DISO7_10003468
  Located on chromosome 12
  Distance between a terminus base of telomere on chromosomal short arm and 5'-terminus of this base sequence : 78929735
  Distance between 3'-terminus of neighbour sequence of sequence listing upward to telomere on chrosomal short arm and 5'-terminus of this base sequence : 9999
gaaccattaatccaaacctctctctcatacacatcacacacacacacagacacacacacacacacacacacacacacacacacagtgttttagaacctactctatatgtaaggtcaaatgctgt

SEQ ID NO: 18939 - DNA, 113 bp, Homo sapiens
  DISD22_0008585
  Located on chromosome 12
  Distance between a terminus base of telomere on chromosomal short arm and 5'-terminus of this base sequence : 78999866
  Distance between 3'-terminus of neighbour sequence of sequence listing upward to telomere on chrosomal short arm and 5'-terminus of this base sequence : 70007
aagaattaccacaagcaaaggtttaaatatcacaggctcaaataaataaataaataaataaataaataaataaataaataaataaatatcagggtgcgattcctacccttaga

SEQ ID NO: 18940 - DNA, 285 bp, Homo sapiens
  AC013462.3_82118
  Located on chromosome 12
  Distance between a terminus base of telomere on chromosomal short arm and 5'-terminus of this base sequence : 79209132
  Distance between 3'-terminus of neighbour sequence of sequence listing upward to telomere on chrosomal short arm and 5'-terminus of this base sequence : 209153
caagcatgtagtcactccttagaaatcctttatcgtgaaaaatccctgtcacaagaatagttctgtcaccatgtagacaaacaacaacaacaacaacaaactctttgaaatatttaaagaggtttattctgagccaatatgagtgaccctgccccaggatatgtctcaagaggtcctgaaaaagtgtaccagaggcagtccagttacagattagttttatacattttagagagatgagaattgtaggtaaaattataaattaatacatgaaaggtatacatcggt

SEQ ID NO: 18941 - DNA, 176 bp, Homo sapiens
  D12S92
  Located on chromosome 12
  Distance between a terminus base of telomere on chromosomal short arm and 5'-terminus of this base sequence : 79246361
  Distance between 3'-terminus of neighbour sequence of sequence listing upward to telomere on chrosomal short arm and 5'-terminus of this base sequence : 36944
gtcaggattccccagaaaaacagaaccaataggatatgtgtgtgtgtgtgtgtgtgtgtgtgtgtacataaaatgagaaagaggcagatggagaaaaagagatttattataagaaattggttcatgcaatgatggaaactgggaagttctgtggtctgccatctgcaacttggaca

SEQ ID NO: 18942 - DNA, 299 bp, Homo sapiens
  HUMUT2404
  Located on chromosome 12
  Distance between a terminus base of telomere on chromosomal short arm and 5'-terminus of this base sequence : 79336872
  Distance between 3'-terminus of neighbour sequence of sequence listing upward to telomere on chrosomal short arm and 5'-terminus of this base sequence : 90335
tgctctttctatatatctgggtactccagtgttggggatagatagatagatagatagatagatagatagatagatagatatagatagatatttaaaattattatatactcctgctgaattgacccctttattattatataactttctttgtctttttttgtcctaaaatatatatttttttctgatataagtataactactccagttcttctttggtttccattggcatgaaatagcttttattttccttttattttcagtctatgtgtctctggatatgtgaagtatgtttcctgtag

SEQ ID NO: 18943 - DNA, 444 bp, Homo sapiens
  chr12.fa.O7frz.77905697
  Located on chromosome 12
  Distance between a terminus base of telomere on chromosomal short arm and 5'-terminus of this base sequence : 79495691
  Distance between 3'-terminus of neighbour sequence of sequence listing upward to telomere on chrosomal short arm and 5'-terminus of this base sequence : 158520
gttgtgaaagtcgtagctacattcatgcctctgaggcctcagctgctggggatgttcctcaaagtcttagatcccagccttgcaggcaatttgtattcactcatggctaggagagtgaacctgcaccccaagtcccaggaaaaattcaattcaattattcaattcaattcaattcaattcaattcaattcaattcaattcaattcaattcacagtaattccatgagaccctgagaccaggacccaggttccacagacacttttgagtacttatgtcctggaacccagcactgctgtggctgtctatggagcacatcagactcaaaaccgagagagaatctcctcacctaaaactctcaactctgatgaaaacaagaataggaggaactaaaaagccttcgacagaaaggaccctaacagcccatactgctattaccgataccac

SEQ ID NO: 18944 - DNA, 454 bp, Homo sapiens
  chr12.fa.O7frz.77777434
  Located on chromosome 12
  Distance between a terminus base of telomere on chromosomal short arm and 5'-terminus of this base sequence : 79607713
  Distance between 3'-terminus of neighbour sequence of sequence listing upward to telomere on chrosomal short arm and 5'-terminus of this base sequence : 111578
cagccaatattagactgaacaggcaaaacttggaaccttgagaactagaagaaaacaagggtgccattctcaccactcctagtcagcatagtactggaagtgctagccagagcagtcaggcaaagaaagaaatagcagacatccaaatagcaaaagaagaacttaatctatctctcttcatgaatgttacatagaaaaccctaaagactccactagaagagtactggaaataataaaagacttcagaaaagtttcaggatagaaaatcaatgtacaagagtcagtaacatgtctatacaccaataatgttaaagctgagagctaaatcaagaatgcagttcaatttacaatagacacacacacacacacacacacacacacacacacacacacaaccataggaatacatctaaccaaggaggtggaagatctctacaaggagaactacagaaca

SEQ ID NO: 18945 - DNA, 394 bp, Homo sapiens
  chr12.fa.O7frz.77609435
  Located on chromosome 12
  Distance between a terminus base of telomere on chromosomal short arm and 5'-terminus of this base sequence : 79788708
  Distance between 3'-terminus of neighbour sequence of sequence listing upward to telomere on chrosomal short arm and 5'-terminus of this base sequence : 180541
catgtattagttggtgcaaaagtaattgccatttttaccattaaaagtaatgataggagaagagggtttgaaggtgtcaggagagagaaaatacaaaattgtcttttaggaaagtaaaattatgaatcaacaaaggaatttagtataactggaaataaacatggggcccttttgtgatcattaacataaattgacaagcatcagtatgcctgtacatgcctgtgtgtgtgtgtgtgtgtgtgtgtgtgtgtgtattttcaatcatgtttatctggctgtgtgtgttttagaaaatggtagggagagaaatttattaaatcaaagttcttattttcacagagaagttcagtgaaagacatattagagtcaaagagcttgagtgtatgagctaaga

SEQ ID NO: 18946 - DNA, 102 bp, Homo sapiens
  DISO7_10003464
  Located on chromosome 12
  Distance between a terminus base of telomere on chromosomal short arm and 5'-terminus of this base sequence : 79877207
  Distance between 3'-terminus of neighbour sequence of sequence listing upward to telomere on chrosomal short arm and 5'-terminus of this base sequence : 88105
aattacattgcccttgccagaagttatctatctatctatctatctatctatctatctatctatctatctatctataaaggacactgatacctgagaaatatt

SEQ ID NO: 18947 - DNA, 373 bp, Homo sapiens
  HUMUT5045B
  Located on chromosome 12
  Distance between a terminus base of telomere on chromosomal short arm and 5'-terminus of this base sequence : 79891481
  Distance between 3'-terminus of neighbour sequence of sequence listing upward to telomere on chrosomal short arm and 5'-terminus of this base sequence : 14172
attgtagagctttattctttccaaaaaagatagatagatgatagatgatagatagatagtcagatacatagatagataaatagataggtaatagatagacagatgatagataggtaaaggtagatagataatagatagatgatagatagataatagatgatagatagatgatagatagataatagatgatagatagataatagacagatgatagatgatagatagatagatatagatagatagatagataggtaatagatagatgataggtaaaagacagatagataatagacagatgatagatagatagatagatagatagatagatagatagatagatttccctcttctgaagttcattcatggcctttac

SEQ ID NO: 18948 - DNA, 128 bp, Homo sapiens
  DISO7_10003463
  Located on chromosome 12
  Distance between a terminus base of telomere on chromosomal short arm and 5'-terminus of this base sequence : 79962195
  Distance between 3'-terminus of neighbour sequence of sequence listing upward to telomere on chrosomal short arm and 5'-terminus of this base sequence : 70341
aacagagaactaagcaagggtcccagtactagtcccttaaaatataaaataggatacacacacacacacacacacacacacacacacacacacacaaaatatacagctctgtatatgtggagatagat

SEQ ID NO: 18949 - DNA, 215 bp, Homo sapiens
  DISO7_10003462
  Located on chromosome 12
  Distance between a terminus base of telomere on chromosomal short arm and 5'-terminus of this base sequence : 80106686
  Distance between 3'-terminus of neighbour sequence of sequence listing upward to telomere on chrosomal short arm and 5'-terminus of this base sequence : 144363
gttcctgatattgggaattagtcttattagtctctctctctctctctctctctctctctctctctctctctctctgtctgtctctctctctgtctctctctctcacacacacacacacacacacacacattgttattaaccagtctttctaattttttatcaattttcttcatttttacaagaaactaatttttggcattgcttgattgtatctc

SEQ ID NO: 18950 - DNA, 307 bp, Homo sapiens
  chr12.fa.O7frz.81896801
  Located on chromosome 12
  Distance between a terminus base of telomere on chromosomal short arm and 5'-terminus of this base sequence : 80317488
  Distance between 3'-terminus of neighbour sequence of sequence listing upward to telomere on chrosomal short arm and 5'-terminus of this base sequence : 210587
ctagaactacctcagaacactcagaattacacccctcttctgtttttccccaaaactgaggatatggctggaacgaaatgattttatggcagatccttccccatttaagctctcaaaaaaagtgggcctgtggtttctgcctctgtgttaaatgttcagcttctcacctagagaggtttattagcctagtttgataagggagcacttgcacgtgtgtgtgtgtgtgtgtgtgtgtgtgtgtgtgtgtgtgtttgtgtgtcttttgagacagggtcttgccctgtcacataggctggaatgaaatcac

SEQ ID NO: 18951 - DNA, 186 bp, Homo sapiens
  DISD22_0008594
  Located on chromosome 12
  Distance between a terminus base of telomere on chromosomal short arm and 5'-terminus of this base sequence : 80498135
  Distance between 3'-terminus of neighbour sequence of sequence listing upward to telomere on chrosomal short arm and 5'-terminus of this base sequence : 180340
cagtgttacctccaggctctgtgtgtgtgtgtgtgtgtgtgtgtgtgtgtgtgtgtgtgtgtgtgtgaaggcaggggtggggtgagcatgtgtgcacgtggggatgtgtatgtgtgtgcatccatgtgcatctttgtgcctggatctgtgtatgttcatgggatgtgatgattaaacagtatgtga

SEQ ID NO: 18952 - DNA, 313 bp, Homo sapiens
  chr12.fa.O7frz.82229978
  Located on chromosome 12
  Distance between a terminus base of telomere on chromosomal short arm and 5'-terminus of this base sequence : 80561072
  Distance between 3'-terminus of neighbour sequence of sequence listing upward to telomere on chrosomal short arm and 5'-terminus of this base sequence : 62751
ccatgcaaatagtaaacaagagagagtaggagtgattatattaaacaaaacagactgtaagtaaaaaactgtcctgtcacaggagacaaggaagaacatttgtattagtcagggttctctagaggaacagaactaataggatatatatatatatatatatatatatatatgtacatatatatggacatataataaacttccatatatattattaagtcacatgatcacaaggtcccacaatagggtgtctacaagctgaagagcaaggaagccagtcagagtcccaaacctaagaactcggagtctaatgttc

SEQ ID NO: 18953 - DNA, 393 bp, Homo sapiens
  chr12.fa.O7frz.82156188
  Located on chromosome 12
  Distance between a terminus base of telomere on chromosomal short arm and 5'-terminus of this base sequence : 80648093
  Distance between 3'-terminus of neighbour sequence of sequence listing upward to telomere on chrosomal short arm and 5'-terminus of this base sequence : 86708
aatgcaagattcatttaagtgaaaattgtattgggaaggaatccacatttccagataatgagggttgaggaaggcactgcatttattttaattataaattgggatttaaatctaagaaaacatgaataaagcacccaaaggtattataaaaacacacacttatgtatatgtgtctatgtgtgtgtgtgtgtgtgtgtaaagatacacacacatacaattactcaataaataattacaaatcacctaatattttataagtttattaaccaaagttactggcacaaactcagatgcctactaggacctggcagataaaagggcatttttgaagtggttaagtacacagtagtaactgaactgcttatatgtcagtaaattcaaacgttagcagaa

SEQ ID NO: 18954 - DNA, 264 bp, Homo sapiens
  chr12.fa.O7frz.82380047
  Located on chromosome 12
  Distance between a terminus base of telomere on chromosomal short arm and 5'-terminus of this base sequence : 80806077
  Distance between 3'-terminus of neighbour sequence of sequence listing upward to telomere on chrosomal short arm and 5'-terminus of this base sequence : 157591
acttaaactacaagcaatgctaaaagaaattatttggtctagaggggaatcatatcagataaaagccagaccatctatttatatttcatatatgcttatatgttcatgtaatatacatagatagatagatagatagatagatagatagatagatgatagatagatagatagatagatagatgatagatagatagatagatagagagagagagagagcgcaagagaatgaaagagagagacatagactgacagatagacttctgg

SEQ ID NO: 18955 - DNA, 423 bp, Homo sapiens
  chr12.fa.O7frz.82546395
  Located on chromosome 12
  Distance between a terminus base of telomere on chromosomal short arm and 5'-terminus of this base sequence : 80979195
  Distance between 3'-terminus of neighbour sequence of sequence listing upward to telomere on chrosomal short arm and 5'-terminus of this base sequence : 172854
acatctcagtttgcaccagccatgtttcaagcactcagtagccacatgtgcctggtggccaccatactggacagcatagaactagagcattttcaaggacagaaatgaaatagcatgtctgggaaactacaagtgagcccatgtggttagagcatgggggagtgagtgtgtgtgtgtgtgtgtgtgtgtgtgtgtgtgtattttggtggattgcggggtaaatggaagaaaaagggaccagaaaggtagatggagcaggaatatgaaaaatgttttgactttattacattaaaattattgaaggtttcagcagaggaatgccattttcatatctgtattttaaaattataatttgggaagcagtgtgaaaatagatttaaggagggctggagattggagctaattaaggaatgtaagtgacga

SEQ ID NO: 18956 - DNA, 221 bp, Homo sapiens
  Z66885
  Located on chromosome 12
  Distance between a terminus base of telomere on chromosomal short arm and 5'-terminus of this base sequence : 81142278
  Distance between 3'-terminus of neighbour sequence of sequence listing upward to telomere on chrosomal short arm and 5'-terminus of this base sequence : 162660
aaatccatccacattcaaggggagaagacatatacctcactctcaatgggagaagtgtcaaagaatttggggccatatttctctctctctctctctctctatatatatatatatatgtgtgtgtgtgtgtgtgtgtgtgtgtgtgtgtatatatatatatatatatatatatataaaaataagttctgggatacatgtgcagaacatgcaggtttgttaca

SEQ ID NO: 18957 - DNA, 321 bp, Homo sapiens
  G09987
  Located on chromosome 12
  Distance between a terminus base of telomere on chromosomal short arm and 5'-terminus of this base sequence : 81286211
  Distance between 3'-terminus of neighbour sequence of sequence listing upward to telomere on chrosomal short arm and 5'-terminus of this base sequence : 143712
ggcacaagctgttgtttcttgagtgttctagcaatcaatacctatcctgaatcacagctgtgttgatcaaatctatctatctatctatctatctatctatctatctatctatctatctctttttagagacagggtctcattatgtagcctatgaactcatgggctcaagtgatcctcctgtctcaaccttccaagtagctgggaccatattttttacggggaaaaaaaaacttagatcaaatattgtgtgttctcattcatatgtggaaggtaaaaaagtgaatcttgtgaagatagtaaagtggtggttatgaaaggctg

SEQ ID NO: 18958 - DNA, 359 bp, Homo sapiens
  AC068797.9_96741
  Located on chromosome 12
  Distance between a terminus base of telomere on chromosomal short arm and 5'-terminus of this base sequence : 81286243
  Distance between 3'-terminus of neighbour sequence of sequence listing upward to telomere on chrosomal short arm and 5'-terminus of this base sequence : -289
aatcaatacctatcctgaatcacagctgtgttgatcaaatctatctatctatctatctatctatctatctatctatctatctatctctttttagagacagggtctcattatgtagcctatgaactcatgggctcaagtgatcctcctgtctcaaccttccaagtagctgggaccatattttttacggggaaaaaaaaacttagatcaaatattgtgtgttctcattcatatgtggaaggtaaaaaagtgaatcttgtgaagatagtaaagtggtggttatgaaaggctgggaagggaggagagaatgaaggaaaaaaagagaatataaatatatttattaccactgaactgtaggctta

SEQ ID NO: 18959 - DNA, 253 bp, Homo sapiens
  D12S326
  Located on chromosome 12
  Distance between a terminus base of telomere on chromosomal short arm and 5'-terminus of this base sequence : 81789381
  Distance between 3'-terminus of neighbour sequence of sequence listing upward to telomere on chrosomal short arm and 5'-terminus of this base sequence : 502779
cccagcagtgctagtgttgaatggcttcctagtttgctcaaatcacggcactccattttagatttccctctccaaactgcatataacaaatgatttaagcacttttaataccaggctcccctaaaagtgaagactttctttatttgggggtagggtgggaacacacacacacacacacacacacacacacacacacacacacaaagatggaagtataactaataaatcaatccttgattctccaccctagccc

SEQ ID NO: 18960 - DNA, 228 bp, Homo sapiens
  G09981
  Located on chromosome 12
  Distance between a terminus base of telomere on chromosomal short arm and 5'-terminus of this base sequence : 81871468
  Distance between 3'-terminus of neighbour sequence of sequence listing upward to telomere on chrosomal short arm and 5'-terminus of this base sequence : 81834
ttaacgatattgagtcttgaatcgattaaaatccatgaaaatggcatatctcaccttattatatatcttcatatctatctgtctatctatctatctatctatctatctatctatctatatctcaccttattttagatctttactttctctcagcagtgctttataattttcggtttatgcgtcttacacttctgttaaatttattctgaactattttacccttttaaa

SEQ ID NO: 18961 - DNA, 402 bp, Homo sapiens
  chr12.fa.O7frz.83736375
  Located on chromosome 12
  Distance between a terminus base of telomere on chromosomal short arm and 5'-terminus of this base sequence : 81983959
  Distance between 3'-terminus of neighbour sequence of sequence listing upward to telomere on chrosomal short arm and 5'-terminus of this base sequence : 112263
cagtacctcataccatgttcacatactaaacttgaatttgaataaatctgcataaatcccctaaatcgtacttttatgattattatcaaacaagtgtcctccaactttttcagttaatttacgaatgtacaaaacttgctgatcattagaaaccttgttttccgagaacattttatgatataggactatgttttctttttgatgtaaaagtaactgaagaaggtaggaaataaagctatgtaatcatgataagccaattgtgtgtatgtgtgtatgtgtgtgtgtgtgtgtgtttgtgtgtgtgtgttaaaattattggaaataaatgtgccagaatatttgtggcacttatcctagaaaacaacatataatttcaaatcatttatgctaattccaagttca

SEQ ID NO: 18962 - DNA, 128 bp, Homo sapiens
  DISO7_10003501
  Located on chromosome 12
  Distance between a terminus base of telomere on chromosomal short arm and 5'-terminus of this base sequence : 82025569
  Distance between 3'-terminus of neighbour sequence of sequence listing upward to telomere on chrosomal short arm and 5'-terminus of this base sequence : 41208
ttaattgctattctgtcaaaggacattttaattttaaaataggtttagaatgattgtgtgtgtgtgtgtgtgtgtgtgtgtgtgtgtgtgtgtttattttgtggggaggaggaaggtggagaatagca

SEQ ID NO: 18963 - DNA, 166 bp, Homo sapiens
  DISO7_10003495
  Located on chromosome 12
  Distance between a terminus base of telomere on chromosomal short arm and 5'-terminus of this base sequence : 82069154
  Distance between 3'-terminus of neighbour sequence of sequence listing upward to telomere on chrosomal short arm and 5'-terminus of this base sequence : 43457
gaacatacatgaaatggctcttagaaaagctgttaaaatattgttacttataaatttgaaactgcaaaataatatgtaaaatttgagccaaatttggtttaaaatgtgatctcgtgtgtgtgtgtgtgtgtgtgtgtgtgtgtgtgttctgtggcatggtgtgaag

SEQ ID NO: 18964 - DNA, 187 bp, Homo sapiens
  DISO7_10003494
  Located on chromosome 12
  Distance between a terminus base of telomere on chromosomal short arm and 5'-terminus of this base sequence : 82099354
  Distance between 3'-terminus of neighbour sequence of sequence listing upward to telomere on chrosomal short arm and 5'-terminus of this base sequence : 30034
cctgtcatgtagttatctttcattgatatttttgattaattaagtctgtcagaaatttcaggtctgttaaacataggagtttgaagtttgggaacatagtgtttttgatgtgtgtgtgtgtgtgtgtgtgtgcatgagtgtgtgtgtgtatgtgtgtatgcacatacatgtattatttgtctggctt

SEQ ID NO: 18965 - DNA, 186 bp, Homo sapiens
  DISO7_10003493
  Located on chromosome 12
  Distance between a terminus base of telomere on chromosomal short arm and 5'-terminus of this base sequence : 82107918
  Distance between 3'-terminus of neighbour sequence of sequence listing upward to telomere on chrosomal short arm and 5'-terminus of this base sequence : 8377
ggtagctgattcttccatgcttttagtataggttgattccaaaagttgaaaatcaataagagtgtttagataggagatatatatatacacacacacacacacacgcgcacacacacacacacacacacacacacacacactctcttcagaatcaagtaatatactctgattcttccctagttaagg

SEQ ID NO: 18966 - DNA, 195 bp, Homo sapiens
  DISO7_10003503
  Located on chromosome 12
  Distance between a terminus base of telomere on chromosomal short arm and 5'-terminus of this base sequence : 82221235
  Distance between 3'-terminus of neighbour sequence of sequence listing upward to telomere on chrosomal short arm and 5'-terminus of this base sequence : 113131
tctgtgctgtgctgtattctgtgtgtgtgtgtgtgtgtgtgtgtgtgtgtgtgtgtgtgtgtgtgaatatgtccaaacagatataatttttagctttttactcaattataatactgggaaatgacataatataattccaaagtatgtagtttacgtttaaaaatgcatttttgaaatagacctgattgctaacct

SEQ ID NO: 18967 - DNA, 135 bp, Homo sapiens
  DISO7_10003504
  Located on chromosome 12
  Distance between a terminus base of telomere on chromosomal short arm and 5'-terminus of this base sequence : 82247416
  Distance between 3'-terminus of neighbour sequence of sequence listing upward to telomere on chrosomal short arm and 5'-terminus of this base sequence : 25986
aacaatgtgcactgcagccaattttgaataaacagaagcagcatatatatatatatatatatatatatatatatatatatgatatacattacatatttatatatatgtaatatatgtgccatatagcctggtggt

SEQ ID NO: 18968 - DNA, 183 bp, Homo sapiens
  DISO7_10003505
  Located on chromosome 12
  Distance between a terminus base of telomere on chromosomal short arm and 5'-terminus of this base sequence : 82280841
  Distance between 3'-terminus of neighbour sequence of sequence listing upward to telomere on chrosomal short arm and 5'-terminus of this base sequence : 33290
tgattattggtttcttgtgtaccatttcaacatttttctattatatgctaatgtgtatatatacttaatacacacgtgcaaaagcttcctcacacacacacacacacacacacacacacacacacacacatacacacacatacggaaccaaattctaacataggggaataatcttcggagtga

SEQ ID NO: 18969 - DNA, 418 bp, Homo sapiens
  chr12.fa.O7frz.84043735
  Located on chromosome 12
  Distance between a terminus base of telomere on chromosomal short arm and 5'-terminus of this base sequence : 82367759
  Distance between 3'-terminus of neighbour sequence of sequence listing upward to telomere on chrosomal short arm and 5'-terminus of this base sequence : 86735
acatacctgagactggataatttataaaagaaagaggtttaattgactcacagttcagcaatgctggggaggccccaggaaacttgcaatcatggtatatatatatgtatatatatatatatatatatatacacacacacacacacacacacacatatgtataaatactagagatacaaggcaatatacatatatatatatacacacacagggatatagatatgtatctctagtatttttatatatatatttgatatttatatatatacacatatataaatactcgagatacaagagatatatatatatattttgagagtgaaggctatgctatatagcactctcaaaataccactaaaatataaaaggaaacaaatatttgaagataaagtttggacaaagcactgctatacttagc

SEQ ID NO: 18970 - DNA, 333 bp, Homo sapiens
  chr12.fa.O7frz.83648424
  Located on chromosome 12
  Distance between a terminus base of telomere on chromosomal short arm and 5'-terminus of this base sequence : 82430516
  Distance between 3'-terminus of neighbour sequence of sequence listing upward to telomere on chrosomal short arm and 5'-terminus of this base sequence : 62339
gttgtagctcaccgagattatgccactgcactccctcctgggccacagagtgagaccgtgtctcaaaaacaaacaaacaaacaaacaaacagcaacaacaacaacaaaaaaaccccaaaaacaaatgactttgtttgatgagtgagaaagaagcttgattcagagcaggtaacaccaactggatatttaactaaatttatttgagtaaaggcaagctgaaattaagcatttccactaatattttttgaaactcattgttattaagatatataaataaatttgctaagtataatttaatataattttacacttataaacttactggaatgcaaa

SEQ ID NO: 18971 - DNA, 184 bp, Homo sapiens
  DISO7_10003500
  Located on chromosome 12
  Distance between a terminus base of telomere on chromosomal short arm and 5'-terminus of this base sequence : 82453455
  Distance between 3'-terminus of neighbour sequence of sequence listing upward to telomere on chrosomal short arm and 5'-terminus of this base sequence : 22606
tgtctctgcccatcacacacacacatgtacacacacacatgttcgcacaaacacacacacacacacacacagctgttttgaaatatcctcagagttcctagtaaaatgctgcatgatctgaaaaagacaaatttttgaagctattgatggggtagcttttctgggtggttcctagaaaggatct

SEQ ID NO: 18972 - DNA, 367 bp, Homo sapiens
  chr12.fa.O7frz.84254819
  Located on chromosome 12
  Distance between a terminus base of telomere on chromosomal short arm and 5'-terminus of this base sequence : 82539429
  Distance between 3'-terminus of neighbour sequence of sequence listing upward to telomere on chrosomal short arm and 5'-terminus of this base sequence : 85790
gcacattgactgctagtttaacagatattataaatacttattcagttcaggagctgtgccaggctctgctaatataaaaatgaataaaacagaattcctgcctttgagacatttatatgttcccaggggaaatttttatgcagtatctactctgtagaatttcctagaaattaaatgcataactttatggccacactgatatgtctttatatgtgttttacacacacacacacacacacacacacacacagaaatatgcacatgcataatacagtcagttaggatgtgtggatatgaacctgacatgggtgtgtgagaaaatcacattgtattttatatgcaaatttaatttgtaatctgagcattc

SEQ ID NO: 18973 - DNA, 280 bp, Homo sapiens
  DISD22_0008617
  Located on chromosome 12
  Distance between a terminus base of telomere on chromosomal short arm and 5'-terminus of this base sequence : 82622445
  Distance between 3'-terminus of neighbour sequence of sequence listing upward to telomere on chrosomal short arm and 5'-terminus of this base sequence : 82649
ttatgcctcgtagcttaaagtatcctttctttgatatatcaagaaaacaaggcctgtagtcccagctacttgggaggctgaggcaaaagaaccactaggacatgggaggcagaggttgcagtgagctgagatcatgccattgcactgcagcctgggtgacagagcgagactccatcccacacacacacacacacacacacacacacacacacacaaacacacaaaagtcatgggtacatgaaaaatagtacataaaagaagagtatccagacttcttggt

SEQ ID NO: 18974 - DNA, 291 bp, Homo sapiens
  chr12.fa.O7frz.87153765
  Located on chromosome 12
  Distance between a terminus base of telomere on chromosomal short arm and 5'-terminus of this base sequence : 82756125
  Distance between 3'-terminus of neighbour sequence of sequence listing upward to telomere on chrosomal short arm and 5'-terminus of this base sequence : 133400
ctaggatcttgagataggagcttatattcttgatttgagagttttcctcttttctagtatatccatttagtgctataaatttccctctcagaactgccttagttgtgtcctccaaaattttatatgatgtactttctttttcaatcagtttgagatatatacacccagagacgtgtgtgtgtgtgtgtgtgtgtggggtgtgtgtgtgtgtgtgtgtgttttcctggatatttcctatttgacctatggattatttatttagaagtatattgattagattccaattgtttg

SEQ ID NO: 18975 - DNA, 236 bp, Homo sapiens
  G08964
  Located on chromosome 12
  Distance between a terminus base of telomere on chromosomal short arm and 5'-terminus of this base sequence : 82880856
  Distance between 3'-terminus of neighbour sequence of sequence listing upward to telomere on chrosomal short arm and 5'-terminus of this base sequence : 124440
gaatctccccataggaccactcacaacatgccagtttgcttcttccagagctattaataattctgccagagggaggggagtgtgatagacagttggatgataaacagattatagataaattagatagatagaaagatagatagatagatagatagatagatagatagatagatagagcccaagtcatattcttggtaacctaatcttggaagcaacatctcatgggttttgccata

SEQ ID NO: 18976 - DNA, 411 bp, Homo sapiens
  AC068798.8_158060
  Located on chromosome 12
  Distance between a terminus base of telomere on chromosomal short arm and 5'-terminus of this base sequence : 82920537
  Distance between 3'-terminus of neighbour sequence of sequence listing upward to telomere on chrosomal short arm and 5'-terminus of this base sequence : 39445
ctaagtgctagccattacacattcttaaaataacaatgctaaaactgaaagagtagtataattaaaagtatgtattggccaggtgtggtggctcacgcctgtaatcccaacactttgggaggccaaggcaggcagatcagtcgagcctaggagtttgaaaccagcctgggcaacatggcaaaaccctgtctctacaaataatacaaaaattagctgagcgtgattgtgcgcacctgtgatcccagctactcaggaggctgagtggcagaatcactggtagtcgaggttgcagaagaaagaaagaaaagaaagaaagaaagaaagaaagaaagaaagaaagaaagaaagaaagaaagaaagaaagaaagaaagagagaaaaaagtatggagtaggcatttacattgtattgg

SEQ ID NO: 18977 - DNA, 420 bp, Homo sapiens
  chr12.fa.O7frz.86930662
  Located on chromosome 12
  Distance between a terminus base of telomere on chromosomal short arm and 5'-terminus of this base sequence : 82956169
  Distance between 3'-terminus of neighbour sequence of sequence listing upward to telomere on chrosomal short arm and 5'-terminus of this base sequence : 35221
cactgtttcagtaggaaagaatacagcttgcccttatttaatcggaggcaaggactcagatcatggtaatgaaggggtaaaagtttaaatagctggtggtacaaaaggaatgtgtgtgtgtgtgtgtgtgtgtgtgtgtgtgtgtggtgtgtgtgtatgtatggaagtgaacctgggggcctcatggcagagcacctggaagaaccattcctttggtgattctaaccgggattggatatgctattgaggtgtggccaggaagtatgacaggaaaggctttttggccaatgagccaaaaagatttattcaggaggactaaactggtagatcttagtgataaggagttacattacaggtatatttaacttttgagctgggcttagaatgtaactctcacttaatctgcatttgatacctaag

SEQ ID NO: 18978 - DNA, 390 bp, Homo sapiens
  chr12.fa.O7frz.86802280
  Located on chromosome 12
  Distance between a terminus base of telomere on chromosomal short arm and 5'-terminus of this base sequence : 83091582
  Distance between 3'-terminus of neighbour sequence of sequence listing upward to telomere on chrosomal short arm and 5'-terminus of this base sequence : 134993
tctgcttaggagtatgtacatttctaagcctttgctcattgggggtgtagtgtcacagagtgtcatgggttgggagagcatgggggtgcacagcctgcatctcagagataaaccagtgtgaatcacagttggtaagtgttctctattatccctgcttcctgggtgaaacccaccactcaagaattagtagactgatttaaaggtatcattttcgaggaatattttcccaggcagctttgttctgttttcagacctctaaagctcatgtttgtactcctgaagatgggtgtgtgtgtgtgtgtgtgtgtgtgtgtatttaatcttcattccaacaaccatcaggacttttccccccttttggtgcagacatcaaggatcaagcagttacta

SEQ ID NO: 18979 - DNA, 173 bp, Homo sapiens
  chr12.fa.O7frz.86675382
  Located on chromosome 12
  Distance between a terminus base of telomere on chromosomal short arm and 5'-terminus of this base sequence : 83218665
  Distance between 3'-terminus of neighbour sequence of sequence listing upward to telomere on chrosomal short arm and 5'-terminus of this base sequence : 126693
attaaggttactttcaaggctagctgggtttgtctgcttagaaatttttcaaacctggttttcattttattttattttattttattttattttaacaagtccttcctaattataacagattatattataggctgcttttattaaatttgttgtaccaggaagtaaggctactc

SEQ ID NO: 18980 - DNA, 460 bp, Homo sapiens
  chr12.fa.O7frz.86537541
  Located on chromosome 12
  Distance between a terminus base of telomere on chromosomal short arm and 5'-terminus of this base sequence : 83354312
  Distance between 3'-terminus of neighbour sequence of sequence listing upward to telomere on chrosomal short arm and 5'-terminus of this base sequence : 135474
gactggatgacaaagcaagactgtttcaaaaagaaaagaaaagaaagaaaagaaaagaaaagaaaagaaaagaaaagaaaagaaaagaaaagaaagaaagaaaagaaagaagaaaggagggagggagggaaggggagggaagggaagggaaggaagggaggaagggagaaagagagagagaggaaggaagattgctacacaaaaaaacttggttgaatgtctttttctgggtaaaaaaggttacatactttataattccacttatataacattgttaaaatgaaaaaattatagaaaatggagaacagattagtggtgtccaaggggtcagaatgaggagagatgccaggatggtgggcaggaattgggtctgtctatgcaaaggcaacttgagggattattctgatggaaaggttttccatctgatatactatttgtgtacagttttgcaagatgtcac

SEQ ID NO: 18981 - DNA, 310 bp, Homo sapiens
  chr12.fa.O7frz.86342884
  Located on chromosome 12
  Distance between a terminus base of telomere on chromosomal short arm and 5'-terminus of this base sequence : 83519978
  Distance between 3'-terminus of neighbour sequence of sequence listing upward to telomere on chrosomal short arm and 5'-terminus of this base sequence : 165206
ttggaatactaaatatccaaacacagtgaagcaatgtctgcttttttgaaagtaactatgacctcaaatttttatacccagctattttatatatattatattatattatattatatatatgtacgtatctcaagtcctttccatgtgcttaaagttctactaactgctttacatatgttattctcattagcttgacactatttctataggacatttgaaaaaatatgaagtgtaaaattgttcaatttacttagagtcacaaataattgcataaagatttgacgttgtacctacttgatctgagaacttg

SEQ ID NO: 18982 - DNA, 479 bp, Homo sapiens
  chr12.fa.O7frz.85585012
  Located on chromosome 12
  Distance between a terminus base of telomere on chromosomal short arm and 5'-terminus of this base sequence : 83741986
  Distance between 3'-terminus of neighbour sequence of sequence listing upward to telomere on chrosomal short arm and 5'-terminus of this base sequence : 221698
ttccatagcatcacatctttacaaaactgagtctctgtaatgtaaaaaagaagaatcatgctccctccacccccaccacacacacacacacacacacacacacacacaaaaatcaatgtggaataggaaatgagggtagagcttctaatcggactccaagttttaagaagttgtacagtgtccaagagatgcacacatcccattagaaatgttggttacttaagaatgaagtaaaaatatttcttcaaagaattcatatattatttattcaaatggctactaagttattaggacataaatacttatactgtttggaccaaactactaagaaaataaaactatctggtatttctttagatctaaggacatcatgaaaagattacttagcccactaagagtgtgatgaacagaggaagtttgggtacctttgcagcatatgggtagaaactgaaatgacactggaactgtcactaaacttg

SEQ ID NO: 18983 - DNA, 191 bp, Homo sapiens
  DISO7_10003512
  Located on chromosome 12
  Distance between a terminus base of telomere on chromosomal short arm and 5'-terminus of this base sequence : 83987888
  Distance between 3'-terminus of neighbour sequence of sequence listing upward to telomere on chrosomal short arm and 5'-terminus of this base sequence : 245423
acttcagaaacctcaagaatacacacacaccacccacccacacccacccacacacacacacacacacacacacacacacacacacattcactcactctctctctctctttctctctctctccaattgagaaaaaggggaaaggttttggaagagaagggaaattttttttgtcatgtcatgacatggaaag

SEQ ID NO: 18984 - DNA, 413 bp, Homo sapiens
  chr12.fa.O7frz.86108963
  Located on chromosome 12
  Distance between a terminus base of telomere on chromosomal short arm and 5'-terminus of this base sequence : 84111646
  Distance between 3'-terminus of neighbour sequence of sequence listing upward to telomere on chrosomal short arm and 5'-terminus of this base sequence : 123567
attgcacaattcctcactaagaagatggatcacagagagacactcactcatgctctcctgtattagggattcacttgtggttttcagctggacccggccgtgtggggtgcctgcctaccttctctttccaagtatctttcacttttctgttgaactctcttgttctttcttggataaaatttcaaagtgtgaatctctgtacactattttgctcctttcctttttcctttcctttcctttcctttcctttcctttcctttcctttcctttcctttcctttcctttcctttcctttcctttccttccttcctctctctctctctctttgtttctttctttctttctttctttctttctttctttctttctttctttctctctttctttctcttttctgttgaactttcatgttc

SEQ ID NO: 18985 - DNA, 193 bp, Homo sapiens
  chr12.fa.O7frz.84479923
  Located on chromosome 12
  Distance between a terminus base of telomere on chromosomal short arm and 5'-terminus of this base sequence : 84449710
  Distance between 3'-terminus of neighbour sequence of sequence listing upward to telomere on chrosomal short arm and 5'-terminus of this base sequence : 337651
tctggttatgatctcatgaaagggaacatggaggaggatagaattgagagaagaaaaaaggaaggagacattattatataaaagaaaaaagcatcaaaattgtacatataatcctgttcctgtaaaactgtgtgtgtgtgtgtgtgtgtgtgtgtgtgtaagtatacatgtggataacagatcattagaggta

SEQ ID NO: 18986 - DNA, 392 bp, Homo sapiens
  AC068993.14_169247
  Located on chromosome 12
  Distance between a terminus base of telomere on chromosomal short arm and 5'-terminus of this base sequence : 84538461
  Distance between 3'-terminus of neighbour sequence of sequence listing upward to telomere on chrosomal short arm and 5'-terminus of this base sequence : 88558
cataaatgtctttggtatgcttagtagttccttaaaccccattaaagtatatgtcccctatatatttcgttttaaactggttctattactttttcctctgtccaaaattgaagttcagagcttttaaactgttataataggacatcatcatcatcatcatcatcatcatccttatccttatcaccatcatccttatcatcattatcatcatctcactttgggcaattaacagagatactcagaaaatctctacgtgttattccaggctagccttctaataaattcaaagacttctcacatgcttttatatttggtgaactattttagacaacttttgtttcatagcccaatcgaaatttttttagatcaacttattccataggcagatttct

SEQ ID NO: 18987 - DNA, 262 bp, Homo sapiens
  chr12.fa.O7frz.84678664
  Located on chromosome 12
  Distance between a terminus base of telomere on chromosomal short arm and 5'-terminus of this base sequence : 84645541
  Distance between 3'-terminus of neighbour sequence of sequence listing upward to telomere on chrosomal short arm and 5'-terminus of this base sequence : 106688
tatggtctgaagttctcactttagataatgaggtaaaacttttttctaattttcaaacagtattatttttatatacagagattgggaagcccaacattttaaaagaggactacattgatattatactctctctctctttctgtctctctttctgtatctctctctctcatacacacacacacacacacacacacacacacacacacacacagacacggtatattgctttcagaagcaattctcaagacttgagacagatacg

SEQ ID NO: 18988 - DNA, 318 bp, Homo sapiens
  chr12.fa.O7frz.84808386
  Located on chromosome 12
  Distance between a terminus base of telomere on chromosomal short arm and 5'-terminus of this base sequence : 84774111
  Distance between 3'-terminus of neighbour sequence of sequence listing upward to telomere on chrosomal short arm and 5'-terminus of this base sequence : 128308
tgtcctggaatctattctgataacagtctatggcctctgcacagatgttttcatatggattagccaccaagcagtttaatgcattaagcctactataacagcaacaaattataatttgtttgtattgatgcacatgttagatagatagatgatagatatgtgagtatagatagatagagcgatagatgatagataggtagataggtagatcgatagagagacagatgtttccacttaaatgccctcatttacataagtttaaatagacatatgaattacagctcaggctgatttgacttcatttatggttcctatacc

SEQ ID NO: 18989 - DNA, 350 bp, Homo sapiens
  chr12.fa.O7frz.84986203
  Located on chromosome 12
  Distance between a terminus base of telomere on chromosomal short arm and 5'-terminus of this base sequence : 84924538
  Distance between 3'-terminus of neighbour sequence of sequence listing upward to telomere on chrosomal short arm and 5'-terminus of this base sequence : 150109
acagattatgctaatttacaccagcacttccaataacaactaactattctgcaccccaaacacacacacacacacatacacacacaacacaccccatctactcttctctctcctgctccagtactctgtagcattagtttagtttctcttattccctcagccccactctttagacaaaaaaatagagagaaagaaagaaagaaagaaagaaagaaagaaagaaagaaagaaagaaagaaagaaagaaagaaagaaagaaaaggaaacctttccttctcatttctagggctctaagggtttgcacgctgccactctaccattcttcacacattccaattagaaacttaagg

SEQ ID NO: 18990 - DNA, 205 bp, Homo sapiens
  chr12.fa.O7frz.85131879
  Located on chromosome 12
  Distance between a terminus base of telomere on chromosomal short arm and 5'-terminus of this base sequence : 85074614
  Distance between 3'-terminus of neighbour sequence of sequence listing upward to telomere on chrosomal short arm and 5'-terminus of this base sequence : 149726
cataagtcctcaaatatcttcaactatcctgtacagagataagtaataatgtgtgtcacatctggtgtttctcacagcaaaggaaaaattaattttttgaatacgtgcctgtaataatgtgtgtatatgtgtgtgtgtgtgtgtgtgtgtgtgtgtgtgtgtgtgtacaattttagtctggctgactcaatgaaatacagaagtt

SEQ ID NO: 18991 - DNA, 479 bp, Homo sapiens
  chr12.fa.O7frz.85280687
  Located on chromosome 12
  Distance between a terminus base of telomere on chromosomal short arm and 5'-terminus of this base sequence : 85208639
  Distance between 3'-terminus of neighbour sequence of sequence listing upward to telomere on chrosomal short arm and 5'-terminus of this base sequence : 133820
atattgacatggatgtggaagtggaaggaaagaaagaaagacagatgaaaaaagacaaagaaagaaagaaaggaagaaaggaaaaaagaaagaaaggaaagaaaaagaaagaaaaaaagaaaagaaagaaaaagaaagaggaagaaagaaagagagaaggaaagaaagaaagaaagaaagaaagaaagaaagaaaaagaaagaaagaaagaaagaaaggagggagggagggagggagggaaggaagggaggaaggaaggacggacaaacaggaggaagggaggaaggtaggaaggaagaggaaggaaggaagaaaaggggaaggaaggaaagaagggacggagggaaggaaggaaggggaaggaaggaacgatggaaggaaggatctaacttgagagacatttacaaaatgagaaatatcaggacttgtgggttaaatgaataaaggaaaacaaagagaaaggaaatggagatgagtta

SEQ ID NO: 18992 - DNA, 176 bp, Homo sapiens
  DISO7_10003510
  Located on chromosome 12
  Distance between a terminus base of telomere on chromosomal short arm and 5'-terminus of this base sequence : 85309695
  Distance between 3'-terminus of neighbour sequence of sequence listing upward to telomere on chrosomal short arm and 5'-terminus of this base sequence : 100577
tgcatatagaataacaacaaggtgttccgtgtgtgtgtgtgtgtgtgtgtgtgtgtgtgtgtgcacatttgtttggggatgggggagaagaagctaaggggagaagtcaacatttatgaaatattgcctgactatttaaaaagaaaaaagtagctctccattatcacctttataca

SEQ ID NO: 18993 - DNA, 413 bp, Homo sapiens
  AC011316.13_121852
  Located on chromosome 12
  Distance between a terminus base of telomere on chromosomal short arm and 5'-terminus of this base sequence : 85530176
  Distance between 3'-terminus of neighbour sequence of sequence listing upward to telomere on chrosomal short arm and 5'-terminus of this base sequence : 220305
atggtagtggaaagtttcaaacggctgctattattctgtgttgcctagtaaataagtgactaaatgagtgtgtccttctagggtttctaacaactttaaataaaacatctcaaacacaaaaggaaattatgtgtgaattattaacatatagatctatctatgtatctatctatgtatctatgtatctatctatctatctatctatctatctatctatctatctatgatctatcaagtaagctgccatccattgcttctttttcttaagatgagatagtgaatcaaagtagatgagtatggctaaatttatttgaagtttttgttttcttttcttttatctgattcatttctcttttcctcttttttttttttgcaattactttaccgaaataggtagatgctaagtgaccata

SEQ ID NO: 18994 - DNA, 264 bp, Homo sapiens
  AC069228.5_141668
  Located on chromosome 12
  Distance between a terminus base of telomere on chromosomal short arm and 5'-terminus of this base sequence : 85594888
  Distance between 3'-terminus of neighbour sequence of sequence listing upward to telomere on chrosomal short arm and 5'-terminus of this base sequence : 64299
tggtaaataccaactgatcaagttatatttgttttttgctaggaagttttttaaaagtaaaatcattagcagtcaattatcaattaaaaaattaagtcaattaatgtatatctttttcatccatcttatttatttatttatttatttatttagtgttccaagagttcagttatttggaacttccacagttttcaagacttgagagctattgcactttcttgttaaaaatgacatgggaacaaataggtactgcagaaatccttt

SEQ ID NO: 18995 - DNA, 142 bp, Homo sapiens
  DISO7_10003513
  Located on chromosome 12
  Distance between a terminus base of telomere on chromosomal short arm and 5'-terminus of this base sequence : 85662046
  Distance between 3'-terminus of neighbour sequence of sequence listing upward to telomere on chrosomal short arm and 5'-terminus of this base sequence : 66894
taactagtagcacagatggaattgagtgtgtgtttgtgtgtgtgtgtgtgtgtgtgtctatatatatatatatatatatatatatatatatacacattggaaaaaataacagcattttgaacatagaaacatagatgaaggc

SEQ ID NO: 18996 - DNA, 141 bp, Homo sapiens
  DISO7_10003515
  Located on chromosome 12
  Distance between a terminus base of telomere on chromosomal short arm and 5'-terminus of this base sequence : 85697815
  Distance between 3'-terminus of neighbour sequence of sequence listing upward to telomere on chrosomal short arm and 5'-terminus of this base sequence : 35627
tcccaaggagaatataagctgtatatttattccaagtaaatagagagagagagacacacacacacacacaaagagtggcgggggggcagtggaaagagagagagagagagagagagagattcatataccaggattgctcca

SEQ ID NO: 18997 - DNA, 146 bp, Homo sapiens
  DISO7_10003521
  Located on chromosome 12
  Distance between a terminus base of telomere on chromosomal short arm and 5'-terminus of this base sequence : 85773970
  Distance between 3'-terminus of neighbour sequence of sequence listing upward to telomere on chrosomal short arm and 5'-terminus of this base sequence : 76014
gcctgtctgtctatccatccatccatccagctatctatctatctatctatctatctatctatctatctatctaatctgtctataatttctctatctctatttaatctatcttcatatttatccacttctaacagtatccataccct

SEQ ID NO: 18998 - DNA, 181 bp, Homo sapiens
  DISO7_10003522
  Located on chromosome 12
  Distance between a terminus base of telomere on chromosomal short arm and 5'-terminus of this base sequence : 85857085
  Distance between 3'-terminus of neighbour sequence of sequence listing upward to telomere on chrosomal short arm and 5'-terminus of this base sequence : 82969
tcataaataaccacaaggcagaattttttgtgaactgaaagcaaaaacagggcaagtggtttattaaatatatatatatatatatatatctgcttttaaaatagatacttctaataatagatatttctaatacatatttatttaaccgtatctctcccttactggaatttaggtattaagc

SEQ ID NO: 18999 - DNA, 361 bp, Homo sapiens
  chr12.fa.O7frz.87730171
  Located on chromosome 12
  Distance between a terminus base of telomere on chromosomal short arm and 5'-terminus of this base sequence : 85860315
  Distance between 3'-terminus of neighbour sequence of sequence listing upward to telomere on chrosomal short arm and 5'-terminus of this base sequence : 3049
ttacatgtagatgtttaggcctagtaaaaatatggttaagtgttgggatgtcttcttgtctctcctgtgattaggttactatagactgactttctctcttcctctctctctctctctgacacacacacacatacacaaacacagacacacacacacacacacacacacaaaacctgtctgggggaagttgccacactgtacagcttatgggaagatcaaggtagcaagaaactgatgtctcatgccaaccactagccaggaaaggaagcttgccaagctcaggttaagtgaattcagaagttgctcctcccacagtttgagcctgagctgatgtcagccctagctgatactttgattgcag

SEQ ID NO: 19000 - DNA, 235 bp, Homo sapiens
  DISO7_10003525
  Located on chromosome 12
  Distance between a terminus base of telomere on chromosomal short arm and 5'-terminus of this base sequence : 85878618
  Distance between 3'-terminus of neighbour sequence of sequence listing upward to telomere on chrosomal short arm and 5'-terminus of this base sequence : 17942
ccttccacccaagactatgaaaattgcacactctctctcacacacacacacatacacacacacaatgtacatctaatacttatcacacatgtacatgctatatattgtatttataaaatattttatatttccaaaaactgttgtaatgttttagatttaaatatttaatcaagaagttttaaattttgtttaatcaacatgtaataattacagtgacatgtaaatgatgtacagt

SEQ ID NO: 19001 - DNA, 101 bp, Homo sapiens
  DISO7_10003526
  Located on chromosome 12
  Distance between a terminus base of telomere on chromosomal short arm and 5'-terminus of this base sequence : 85884852
  Distance between 3'-terminus of neighbour sequence of sequence listing upward to telomere on chrosomal short arm and 5'-terminus of this base sequence : 5999
ctcacccagaagttcttcaactagatagtaaaatacttggaaagtaccaacacacacacacacacacacacacaagcacacacatagggcgttctcttcac

SEQ ID NO: 19002 - DNA, 238 bp, Homo sapiens
  DISO7_10003524
  Located on chromosome 12
  Distance between a terminus base of telomere on chromosomal short arm and 5'-terminus of this base sequence : 85919859
  Distance between 3'-terminus of neighbour sequence of sequence listing upward to telomere on chrosomal short arm and 5'-terminus of this base sequence : 34906
caggaggattgttctataatatgctacacacacacacacacacacacacacacacatatacagagagagagagagagacaagaaacagagagtaagagagaaagagagagagagagaaccagaaaacttctgagctccaaaacataactggtcccaagggatttagataaaaggctgggcagtatatttaaaaattaaaacttaacattttaaaggcaatcataatttagatactcca

SEQ ID NO: 19003 - DNA, 245 bp, Homo sapiens
  HUMUT5627
  Located on chromosome 12
  Distance between a terminus base of telomere on chromosomal short arm and 5'-terminus of this base sequence : 86108213
  Distance between 3'-terminus of neighbour sequence of sequence listing upward to telomere on chrosomal short arm and 5'-terminus of this base sequence : 188116
tctggagaattctgaccgatacagcacattttaaaaatcatgtatgtatgtatgtatgtatgtatgtatttgtttatttatttatttttgagatagagtctcactttgttacccaagctggagggcagtggcacgaccttggctcactgcaacctctgtctcccggactcaagtgatgctcccacctcaccctccccagtagctgggactataggcacccaccatcatgcctggctaatttttgt

SEQ ID NO: 19004 - DNA, 169 bp, Homo sapiens
  D12S1708
  Located on chromosome 12
  Distance between a terminus base of telomere on chromosomal short arm and 5'-terminus of this base sequence : 86207556
  Distance between 3'-terminus of neighbour sequence of sequence listing upward to telomere on chrosomal short arm and 5'-terminus of this base sequence : 99098
aggaacttatgtcaaggctaggaaataatggtaaatatatggattgtgtacagaataataccagttaacatgaaaataggggaagcatgccttttgaaattgtccagcacgcacacacacacacacacacacacacacacacaattgaaaacctcttgagcactagatc

SEQ ID NO: 19005 - DNA, 101 bp, Homo sapiens
  DISD22_0008621
  Located on chromosome 12
  Distance between a terminus base of telomere on chromosomal short arm and 5'-terminus of this base sequence : 86305229
  Distance between 3'-terminus of neighbour sequence of sequence listing upward to telomere on chrosomal short arm and 5'-terminus of this base sequence : 97504
cttagaatatgatagtggaaggccatatatatatatatatatatatatatatatatatatatatatatatataaaagtttcacttggaagtatgcaaagaa

SEQ ID NO: 19006 - DNA, 114 bp, Homo sapiens
  DISD22_0008625
  Located on chromosome 12
  Distance between a terminus base of telomere on chromosomal short arm and 5'-terminus of this base sequence : 86413532
  Distance between 3'-terminus of neighbour sequence of sequence listing upward to telomere on chrosomal short arm and 5'-terminus of this base sequence : 108202
ctaggcagtccaactttggaaatgagagatagatagatagatagatagatagatagatagatagatagatgagaaaagtcaagtaactatcatttcctctatctgtatgcttct

SEQ ID NO: 19007 - DNA, 358 bp, Homo sapiens
  chr12.fa.O7frz.88370140
  Located on chromosome 12
  Distance between a terminus base of telomere on chromosomal short arm and 5'-terminus of this base sequence : 86756188
  Distance between 3'-terminus of neighbour sequence of sequence listing upward to telomere on chrosomal short arm and 5'-terminus of this base sequence : 342542
ttggtatatgtttgaagttaccacagaggcacaaaactttttttaaaaaatcaagcacacacaaagaaacaaaagttgaaagttgttcactggtaacctatctttttaaaaaatagtgctaaagaaaggaattcctgggaagcatatatatatatatatatatatatatatatgtgtgtgtgtatttattgtgtatatatatttacattcttattttagacagaactattcatatgcattttattaataaaatgtttaggaacccacttcccaccttcatatgtgtgcttttaacttttgagcatcaggagtaacaactgaggaaaacgtctaagcgtgttaagtctgctcatacacc

SEQ ID NO: 19008 - DNA, 221 bp, Homo sapiens
  chr12.fa.O7frz.88482288
  Located on chromosome 12
  Distance between a terminus base of telomere on chromosomal short arm and 5'-terminus of this base sequence : 86839935
  Distance between 3'-terminus of neighbour sequence of sequence listing upward to telomere on chrosomal short arm and 5'-terminus of this base sequence : 83389
taggcaattgccttgttagagacatcgctctaaagaaagaacagaatgatttctttttttttctgagaaaatgaagaccatcatggtgatggagaaaagtgaaatatatatatatatatatatgtgtatatatatatatataaatgtatatatttaagttgattgacagttttcattttgagcaggaacatgcatttgaatgacatcctaaatcatggtta

SEQ ID NO: 19009 - DNA, 137 bp, Homo sapiens
  DISO7_10003527
  Located on chromosome 12
  Distance between a terminus base of telomere on chromosomal short arm and 5'-terminus of this base sequence : 87027564
  Distance between 3'-terminus of neighbour sequence of sequence listing upward to telomere on chrosomal short arm and 5'-terminus of this base sequence : 187408
tgtgtaggtgctgggtaggtttaaataatttttttgtagctgttttaacaagaaggtatatgcctctgtgtgtgtgtgtgtgtgtgtgtgtgtgtgtctgagagagaggggtgggggtggcagacagcgtgcttcta

SEQ ID NO: 19010 - DNA, 103 bp, Homo sapiens
  DISO7_10003528
  Located on chromosome 12
  Distance between a terminus base of telomere on chromosomal short arm and 5'-terminus of this base sequence : 87070169
  Distance between 3'-terminus of neighbour sequence of sequence listing upward to telomere on chrosomal short arm and 5'-terminus of this base sequence : 42468
tgtgttcactctgtgatagggaaagcacacacacacacacacacacacactctcacacagtgtcagattgctggagattaactgagttccttcaataccagtg

SEQ ID NO: 19011 - DNA, 101 bp, Homo sapiens
  DISO7_10003529
  Located on chromosome 12
  Distance between a terminus base of telomere on chromosomal short arm and 5'-terminus of this base sequence : 87115986
  Distance between 3'-terminus of neighbour sequence of sequence listing upward to telomere on chrosomal short arm and 5'-terminus of this base sequence : 45714
cagaaagtagtggtgtctaagtagctctgctcatctgtgtgtgtgtgtgtgtgtgtgtgtgtgtgtgtgtgtgttttaagaccatttcatgcttgtgcatt

SEQ ID NO: 19012 - DNA, 265 bp, Homo sapiens
  DISO7_10003530
  Located on chromosome 12
  Distance between a terminus base of telomere on chromosomal short arm and 5'-terminus of this base sequence : 87117355
  Distance between 3'-terminus of neighbour sequence of sequence listing upward to telomere on chrosomal short arm and 5'-terminus of this base sequence : 1268
tgtcagttcaggtcaggcttttagtttttaatacttttattgagatgtaattcacatatcataaaattgactcatttaaagaatgcagtgtattgattttgagtgtattcaaagaacttttaactatcaccatcaatcttaattttatattttggaatggaattaaggatagggattttggccctgtttcaaagatgttgtgtgtgtgtgtgtgtgtgtgtgtgtgtgtgtgtgtaattttccaagtttaacaggatctgtagtg

SEQ ID NO: 19013 - DNA, 259 bp, Homo sapiens
  DISO7_10003531
  Located on chromosome 12
  Distance between a terminus base of telomere on chromosomal short arm and 5'-terminus of this base sequence : 87120270
  Distance between 3'-terminus of neighbour sequence of sequence listing upward to telomere on chrosomal short arm and 5'-terminus of this base sequence : 2650
tgagcagtaaatgttgtagcagtttagtatcttttttcttgaccagagttgttgttggtggtgttggtattggtaatggtaatggtagtagtggtggcggtggtggtggtggtggtggtggtggtggtggtggtggtgatgatgatgatggtgattagtattcataatggtggtggtggtggtggtggtggtattagtaatggtggtggtggtggtggtggtggtagtggtggtagtgttgttgatcgggtggtagtgt

SEQ ID NO: 19014 - DNA, 447 bp, Homo sapiens
  chr12.fa.O7frz.88983330
  Located on chromosome 12
  Distance between a terminus base of telomere on chromosomal short arm and 5'-terminus of this base sequence : 87299752
  Distance between 3'-terminus of neighbour sequence of sequence listing upward to telomere on chrosomal short arm and 5'-terminus of this base sequence : 179223
ttactagatgcttccagatgagagcataaaaaagcagattggttatcattaaaggaaaataaaggaatttaaaatgctagaacacagtagagttatatctatagcgttatgagaagaaactattgaatcatttattctattagaaacattttccgtgaatggatttattcagcttttccaaagaactggaagctggagagtacatgaagatacttgatatctgagaggaaatatagagggactaaaaacaaactttacatggtttacagcattcataggctctagtggaaggggtgtgtgtgtgtgtgtgtgtgtgtgtgtatgtgtgtgtgtttaatctacttacagggtaagggataaaagtagcatttgttcaaacatcttctgtctgcctggcactatactttgcttttatgtctgtcactctgttacctctgagtgtacatc

SEQ ID NO: 19015 - DNA, 276 bp, Homo sapiens
  chr12.fa.O7frz.89166640
  Located on chromosome 12
  Distance between a terminus base of telomere on chromosomal short arm and 5'-terminus of this base sequence : 87466304
  Distance between 3'-terminus of neighbour sequence of sequence listing upward to telomere on chrosomal short arm and 5'-terminus of this base sequence : 166105
tatttactttctggtcctttacagaaaaagcttgcaaaacaaaaatgtattttattgagactgttagagatttttattgattgcactataataaggatttctgttgttggtgttcttggaagtgtgtgtgtgtgtgtgtgtgtgtgtgtgttttgggtcttaaaagtgcatctttgctttgttcatttttcaatctgttattctctctcatactagcatttcaattgattttactttaagtaaataaccagtagctgtttgtattagtcacggttc

SEQ ID NO: 19016 - DNA, 431 bp, Homo sapiens
  chr12.fa.O7frz.89823220
  Located on chromosome 12
  Distance between a terminus base of telomere on chromosomal short arm and 5'-terminus of this base sequence : 87684546
  Distance between 3'-terminus of neighbour sequence of sequence listing upward to telomere on chrosomal short arm and 5'-terminus of this base sequence : 217966
taaagatgagaaagctgtaatgtaggctgggcgcagtggcttccacctgtaatctcagcactttgggaggctgaggccagcagatcatgaggtcaggatcagcctggccaacatggtgaaaccacatctctactaaaaatacaaaaattagccgggcatggtggcaggcacctgtaatcccagctactcgggaggctgaggcaggagaatcactggaatctgggaggtggaggttgcaatgagccgagatgtgtcactgcagtccagcctgggtgacagagcgagactccatgtccaaaaacaacaacaataacaacaacaacaaaagttgaaatgtatagagattaagtaccctacctaattataaaaaaaaaaatcacaagtcagaattttgaccaatgtctctttggttacagacattctttgcagtc

SEQ ID NO: 19017 - DNA, 338 bp, Homo sapiens
  chr12.fa.O7frz.89922768
  Located on chromosome 12
  Distance between a terminus base of telomere on chromosomal short arm and 5'-terminus of this base sequence : 87756058
  Distance between 3'-terminus of neighbour sequence of sequence listing upward to telomere on chrosomal short arm and 5'-terminus of this base sequence : 71081
tcaaccttgctgtacttaagagacctcacatattttagttatcatattttatgttttaccaaccacttaagtagacttatgataaaaatgtacacatacacattttagttatcatattttatgtttttaccaaccacttaagcagccttatgataaaaatgtacacacacacatatacatatgtgtgtgtgtgtgtgtgtgtatatatatatacaaagagagagttagagacagtcagacaagagagagagacatccggagctacagttaaactggatgatcaatttattccccaatatttggagaagcacgaagtttggtggaaagacggtaactcc

SEQ ID NO: 19018 - DNA, 414 bp, Homo sapiens
  chr12.fa.O7frz.90076572
  Located on chromosome 12
  Distance between a terminus base of telomere on chromosomal short arm and 5'-terminus of this base sequence : 87924169
  Distance between 3'-terminus of neighbour sequence of sequence listing upward to telomere on chrosomal short arm and 5'-terminus of this base sequence : 167773
tgtcattagaaggaacattctaacaaatagaagtatctaaaaagttaagttgtgccttacagaacactgacattcctatccatgaaatcaaagcatttatgcaattaaagcaaacacaaattgattttcagtaagagttatggtaggaagattactcaagtgttatgtagtcataatgacaaaattttctttttactcgtgtgtgtgtgtgtgtgtgtgtgtgtcactgacagctggggagctagaccattggacatgagagctaacagaagaaaaggaatggactacatgattaagtattgattaagaacaagtaaatggattggtaaaataaataagacccaatgtgactggaggttatatgtttgtaaatatttccaatgccattttttcttgtccttagcaagttcagta

SEQ ID NO: 19019 - DNA, 462 bp, Homo sapiens
  chr12.fa.O7frz.90157319
  Located on chromosome 12
  Distance between a terminus base of telomere on chromosomal short arm and 5'-terminus of this base sequence : 88011771
  Distance between 3'-terminus of neighbour sequence of sequence listing upward to telomere on chrosomal short arm and 5'-terminus of this base sequence : 87188
tttcagcaaagttctatgatctaccacaattaaacaatggggaacttactaagtagctaccataaagccgtcaatatccaatttattaatagtctcaagtgtcattcattcggtcaaatatttacttattgactatagctttttgctcttttgtgtataaattttccttttaattaatttgacagtctcacaatcagatagatagatgatagatagatagatagatagatagatagatagatagatgtagtaatgtataagtacagacattatatagatcaatatagatatctgtacttataaatatttctttttaggcagatatttaggtagatagatatttgaaaagaagtgaagaggtgacagagatgacagagaaatatattttggaaaatttttaaaacattggtagttttgttctgttgtaaataatgagagctattcagcaatagaagatgtcat

SEQ ID NO: 19020 - DNA, 480 bp, Homo sapiens
  chr12.fa.O7frz.87256610
  Located on chromosome 12
  Distance between a terminus base of telomere on chromosomal short arm and 5'-terminus of this base sequence : 88154583
  Distance between 3'-terminus of neighbour sequence of sequence listing upward to telomere on chrosomal short arm and 5'-terminus of this base sequence : 142350
tatcattcaaatcgtcctgtagaggcatctaacaaagaattcaatatatgcaatatgtggtagacattttgtacaaaagaaaacatgagaaaggagtaagctcaaagaatttgacatgcagaaactgatctatgattttgatcttgaagaataggttcatgaagctgaaaaaggaataagaaggaaagacacttcatgctgtgtgaccaacgtacctaaacccttccttcctttcatgcgtttctttgtttcattcattctttctattcagtcagttaatcagcaaatagatattgatttcttaaaatatgtaaggtatagcaataagggcttcaaaatgaagtgaataatgagtgcacaagtataaatggtctgctcagtctaatcaacacttgtgtgtgtgtgtgtgtgtgtgtgtaaatagtcctcaacattatgaataggtgtgatggttaattctatgcatcaatttagcttgac

SEQ ID NO: 19021 - DNA, 193 bp, Homo sapiens
  Z16574.1_184
  Located on chromosome 12
  Distance between a terminus base of telomere on chromosomal short arm and 5'-terminus of this base sequence : 88452353
  Distance between 3'-terminus of neighbour sequence of sequence listing upward to telomere on chrosomal short arm and 5'-terminus of this base sequence : 297290
ctacaggtaagtggaaatatcgattgcttctattccagatgagggggtcctatacccagtgcacgaaaggtctagaaacacatttaggtggcctttcacacacacacacacacacacacacacacacacacacacaaaactcatttgaataattgaaatttctgatacccttatgatttgacatcaacagttg

SEQ ID NO: 19022 - DNA, 215 bp, Homo sapiens
  chr12.fa.O7frz.90758965
  Located on chromosome 12
  Distance between a terminus base of telomere on chromosomal short arm and 5'-terminus of this base sequence : 88720675
  Distance between 3'-terminus of neighbour sequence of sequence listing upward to telomere on chrosomal short arm and 5'-terminus of this base sequence : 268129
caactttgtagagctaaactcaacggtgggcccacttaacctggttaatcataagtgtgggcttaatcataatttcttatactgctttaacagggaccacgtttttgattctcatatatatatatatatatatatatatatatatatatatatatatatatatggtgcaccccactattagtttgctaatactatcataggcagacattaagatg

SEQ ID NO: 19023 - DNA, 339 bp, Homo sapiens
  AC018922.12_131913
  Located on chromosome 12
  Distance between a terminus base of telomere on chromosomal short arm and 5'-terminus of this base sequence : 88841304
  Distance between 3'-terminus of neighbour sequence of sequence listing upward to telomere on chrosomal short arm and 5'-terminus of this base sequence : 120414
tctacattcttgtcaaggacactggactatgggatcaggtttgattccacatatatttttaatatgtggctatgattctttaaaaaagtgtactactattactattaataataattacaattgtaatagtggtaccctatatttttgcatgattgcaacatacctagctatgttttaagtggtttggatttattattaactcatttaaatttcaaaacaataccacttaggtacataccttttttgtttgtttgtttgtttgttttgagacagagtcccactctgttgcccgggctggagtagagtggtgcgatctccactcactgtaatctcagcctc

SEQ ID NO: 19024 - DNA, 373 bp, Homo sapiens
  chr12.fa.O7frz.90420721
  Located on chromosome 12
  Distance between a terminus base of telomere on chromosomal short arm and 5'-terminus of this base sequence : 88954896
  Distance between 3'-terminus of neighbour sequence of sequence listing upward to telomere on chrosomal short arm and 5'-terminus of this base sequence : 113253
ctcctactctattcaaggagctgtgatgggagcatggcaattacaacacatagctctttcatcaacaaataatggattcagaaatgtacaatgttatcttagtatctcagtataaacttagtataaaagatggaacagaatagaaaaaccactatataagatgactttgtaaaaagatcttttatcctgctgctgaataataatatcttgggaaatatgaatttgtcagtatttattctctttggaagatctaaaaacataagccaaaaactatctatctatctctctctctctctctctctctctatctacctatctacctatctgtctattcatctatctaaaagcaaagttaatacaaacagaggcagtg

SEQ ID NO: 19025 - DNA, 251 bp, Homo sapiens
  DISO7_10003540
  Located on chromosome 12
  Distance between a terminus base of telomere on chromosomal short arm and 5'-terminus of this base sequence : 88966449
  Distance between 3'-terminus of neighbour sequence of sequence listing upward to telomere on chrosomal short arm and 5'-terminus of this base sequence : 11180
tggtgacactgacattaggggttcttgaatgggaaactcaaacataatgaagtctctctatatgtattttctctctctctctctgtctctctctctctctctctctctcagtgttttgttctttattctctttctctctttgaatacttgatttttttttgttattcgggaaagaggggcagattcaataatttataataatatgtattatgtatgtatgtgatatattacaaattgttagctctgcctct

SEQ ID NO: 19026 - DNA, 109 bp, Homo sapiens
  DISO7_10003539
  Located on chromosome 12
  Distance between a terminus base of telomere on chromosomal short arm and 5'-terminus of this base sequence : 88968526
  Distance between 3'-terminus of neighbour sequence of sequence listing upward to telomere on chrosomal short arm and 5'-terminus of this base sequence : 1826
ctggagaatcattcaaattccctcaaactatttgtgtgtgtgtgtgtgtgtgtgtgtgtgtgtgtgatcaagtcctgtttattttagaagcatgaacagtaggactagg

SEQ ID NO: 19027 - DNA, 251 bp, Homo sapiens
  DISO7_10003537
  Located on chromosome 12
  Distance between a terminus base of telomere on chromosomal short arm and 5'-terminus of this base sequence : 89030735
  Distance between 3'-terminus of neighbour sequence of sequence listing upward to telomere on chrosomal short arm and 5'-terminus of this base sequence : 62100
agaagtctgtcattctgtgatttactttttatatattctatttttaaaatctttattctcatttctacctttttttgaaattccatctatcccttttgttggaatctatctatctatctatctatctatctatctatctatcatctatctatcatctatctatctatctatcatctatcatctatctatctatcatctatcatctatctatctatctatcttctattttgcagacaagagcagtctatgca

SEQ ID NO: 19028 - DNA, 230 bp, Homo sapiens
  DISO7_10003536
  Located on chromosome 12
  Distance between a terminus base of telomere on chromosomal short arm and 5'-terminus of this base sequence : 89037843
  Distance between 3'-terminus of neighbour sequence of sequence listing upward to telomere on chrosomal short arm and 5'-terminus of this base sequence : 6857
tgaatcagtacactggcaggaaaaaaaggaaaatgtcaaccaaaattctatattcatttaaaatctccttcaaaaatagagctgaagttattattattatatatgatataaatataaataagtatatatgtatttatacacctgtatacacaaagttacacacacacacacacacacatgcatatgtataaaacaaagcttagaaaatgtgttaccaacagatccaaact

SEQ ID NO: 19029 - DNA, 106 bp, Homo sapiens
  DISO7_10003535
  Located on chromosome 12
  Distance between a terminus base of telomere on chromosomal short arm and 5'-terminus of this base sequence : 89069410
  Distance between 3'-terminus of neighbour sequence of sequence listing upward to telomere on chrosomal short arm and 5'-terminus of this base sequence : 31337
attgtcaagttctataagggagtgcataaataaataaataaataaataaataaataactgatttctctttggcctaaataatattgttcatagcactgattgttgc

SEQ ID NO: 19030 - DNA, 149 bp, Homo sapiens
  DISO7_10003551
  Located on chromosome 12
  Distance between a terminus base of telomere on chromosomal short arm and 5'-terminus of this base sequence : 89252917
  Distance between 3'-terminus of neighbour sequence of sequence listing upward to telomere on chrosomal short arm and 5'-terminus of this base sequence : 183401
aaggagactcagaaactgagcatatattcatttttaatagtagaatagtaataatgatgatgatgatgatgatgatgatgatgatgatgatgatgatgtatgtgacaattccccaatactcccatgacccctattccaattggaatcct

SEQ ID NO: 19031 - DNA, 106 bp, Homo sapiens
  DISO7_10003552
  Located on chromosome 12
  Distance between a terminus base of telomere on chromosomal short arm and 5'-terminus of this base sequence : 89269036
  Distance between 3'-terminus of neighbour sequence of sequence listing upward to telomere on chrosomal short arm and 5'-terminus of this base sequence : 15970
ctctgtaccattctctaggagatcaaaaggtaaaaataatgtgatctttacacacacacacacacacacacacacacacacccttacagtctagtggaaataatgg

SEQ ID NO: 19032 - DNA, 121 bp, Homo sapiens
  DISO7_10003550
  Located on chromosome 12
  Distance between a terminus base of telomere on chromosomal short arm and 5'-terminus of this base sequence : 89326953
  Distance between 3'-terminus of neighbour sequence of sequence listing upward to telomere on chrosomal short arm and 5'-terminus of this base sequence : 57811
ttagcctccttgtttattgaatcataaaatgtagacaacaatcaggtttgcaggaggatgatatgagctgatatatatatatatatatatacatataaaatgcttagaatgatgccttgaa

SEQ ID NO: 19033 - DNA, 158 bp, Homo sapiens
  Z24578.1_137
  Located on chromosome 12
  Distance between a terminus base of telomere on chromosomal short arm and 5'-terminus of this base sequence : 89401293
  Distance between 3'-terminus of neighbour sequence of sequence listing upward to telomere on chrosomal short arm and 5'-terminus of this base sequence : 74219
tcttccaaatacaagactgaattgtttacagtttttctaagtgtttttgtgtgtgtgtgtgtgtgtgtgtgtgtgtgtttgtttgcttgtttttgttttgagacagagtcttgctctgttgtccaggctggagtgcagtggcataatctctgcttacc

SEQ ID NO: 19034 - DNA, 253 bp, Homo sapiens
  D12S88
  Located on chromosome 12
  Distance between a terminus base of telomere on chromosomal short arm and 5'-terminus of this base sequence : 89420981
  Distance between 3'-terminus of neighbour sequence of sequence listing upward to telomere on chrosomal short arm and 5'-terminus of this base sequence : 19530
tgcaccacagcataccagtaaatcttaaggattgtgtttcagtatgaaaaggaagagcaggaagatttcctcattctgtcttaccagcaaaagtctagccttcacacacacacacacacacacacacacacacacacacacacacacacacacacagagtcatctatatgaacacgtacttgagtttcttaaacatatatgaagcaccttccatttccctttataataaatcccttagtttttgctgttcatt

SEQ ID NO: 19035 - DNA, 105 bp, Homo sapiens
  DISO7_10003549
  Located on chromosome 12
  Distance between a terminus base of telomere on chromosomal short arm and 5'-terminus of this base sequence : 89528649
  Distance between 3'-terminus of neighbour sequence of sequence listing upward to telomere on chrosomal short arm and 5'-terminus of this base sequence : 107415
aggtggtttattcagtagtattggggtgtgtgtgtgtgtgtgtgtgtgtgtgtgtgtgtgtgtgtgtgtgtgtttgtgtgtgttttgtgtgggtatgcatgctta

SEQ ID NO: 19036 - DNA, 433 bp, Homo sapiens
  chr12.fa.O7frz.91569353
  Located on chromosome 12
  Distance between a terminus base of telomere on chromosomal short arm and 5'-terminus of this base sequence : 89574195
  Distance between 3'-terminus of neighbour sequence of sequence listing upward to telomere on chrosomal short arm and 5'-terminus of this base sequence : 45441
aagtgtttatcaggtgactatcactattactaaagtaatcagaataattgtcaatcaagttaacaacaatttaattttgtcgattctacatactctactcaagaaggatttttcccatcaaacattggggcttctactggcttctttgttaaagtatcagcatacgaagatatctttacaaaacaataacagtcacacaataagaaggtgtactttgcaaaagatttattctcttactgagagttttcagaatagtaaagttttggggtgtgtgtgtgtgtgtgtgtgtgtgtgtgtgtgtgtgtgtgtgtgtttgtgtttggttttttcagttgcagcttcaagtccttgggtctgtggtctcttccctgatcttctactgcctgatctgttctttactgcaggggatgtgaagatactcttgcttcaacta

SEQ ID NO: 19037 - DNA, 114 bp, Homo sapiens
  DISO7_10003548
  Located on chromosome 12
  Distance between a terminus base of telomere on chromosomal short arm and 5'-terminus of this base sequence : 89594609
  Distance between 3'-terminus of neighbour sequence of sequence listing upward to telomere on chrosomal short arm and 5'-terminus of this base sequence : 19981
gaatggcttctcagtgggcagctgcctcacgctcccccatcacacatacacacacacacacacacacacacacacacacacacacacattgtgactacaatttccttctgctga

SEQ ID NO: 19038 - DNA, 142 bp, Homo sapiens
  DISO7_10003547
  Located on chromosome 12
  Distance between a terminus base of telomere on chromosomal short arm and 5'-terminus of this base sequence : 89603159
  Distance between 3'-terminus of neighbour sequence of sequence listing upward to telomere on chrosomal short arm and 5'-terminus of this base sequence : 8436
atgcatttaagaatatgtaatgagctttacctaattgaaatatatatatatatatatatattttaaagctcaattcctaaaaattataatttagaaatttagttggaacaattttggtttcaatctatgtgtttgttcagca

SEQ ID NO: 19039 - DNA, 160 bp, Homo sapiens
  DISO7_10003546
  Located on chromosome 12
  Distance between a terminus base of telomere on chromosomal short arm and 5'-terminus of this base sequence : 89631826
  Distance between 3'-terminus of neighbour sequence of sequence listing upward to telomere on chrosomal short arm and 5'-terminus of this base sequence : 28525
agggcctatgtcagttgggacatatatgtatgtgtatatatatatatatatatatatatatatatatatatatagagagagagagagagagagagagagagagagagagagtgtgtgtatgtgtgattccctttaaacaatacacagttacaaaccatgg

SEQ ID NO: 19040 - DNA, 158 bp, Homo sapiens
  HUMUT974
  Located on chromosome 12
  Distance between a terminus base of telomere on chromosomal short arm and 5'-terminus of this base sequence : 89720940
  Distance between 3'-terminus of neighbour sequence of sequence listing upward to telomere on chrosomal short arm and 5'-terminus of this base sequence : 88954
agtcagggttctctagagggatagaagtaatggaatatctatctatctatctatctatctatctatctatctatatgtttattaagtattaactcacatgattacaaggtcccatgtattagttctttttcacactgctgataaagacatacccgaaa

SEQ ID NO: 19041 - DNA, 454 bp, Homo sapiens
  chr12.fa.O7frz.92270423
  Located on chromosome 12
  Distance between a terminus base of telomere on chromosomal short arm and 5'-terminus of this base sequence : 89916148
  Distance between 3'-terminus of neighbour sequence of sequence listing upward to telomere on chrosomal short arm and 5'-terminus of this base sequence : 195050
tagccagtagcacagtatttagtaaatgccccaaatgccatgatctgtgctttttacagtgaaattaaaagtaggttattcttaccaaaaaagacacacacacacatacacacacacacacacacacacacacacacacacacagaataaaaaactgaattaaatgcatcttcatttttgatatttctattttccttgattttattattgcacggaatttaccttagtctgtatgtacttccctagtcacttctttttcctatttttttgcaagacaataacaaatggttgttaaggactcagaagcagaaacatttgtatacaaactccagttgttttaatcttaacagttgtgtgaattgcgcaagtgatggaagccttaattttgttgtgttatgtgcaaaatttagataataaatattgccccctaattaatggcttactgaaaggttaa

SEQ ID NO: 19042 - DNA, 413 bp, Homo sapiens
  G08971
  Located on chromosome 12
  Distance between a terminus base of telomere on chromosomal short arm and 5'-terminus of this base sequence : 89989990
  Distance between 3'-terminus of neighbour sequence of sequence listing upward to telomere on chrosomal short arm and 5'-terminus of this base sequence : 73388
gattatggggaagaggggaaaggagtgtcatgttcagatttgtatttcctgcatagaggtttcagaggattttctaccctcagcaccatcttttccttcctgatctgaagttttaatagtctagatgtagttatcctccttattcaaaggctctttgattctgagtctcctttgtttgttcttcctcctcttcaccacttttaaatagaggaatttcctaaggcttcttgataaccaatacctacatgtcttatttgctctttagtggacatctcaagcatagcatgtctaaagtacacaaagaaagaacctagtttctcttccttccttccttccttccttccttccttccttccttccttccttccttccttctctcaggcagccagacattcattcagcaaacttctgca

SEQ ID NO: 19043 - DNA, 465 bp, Homo sapiens
  chr12.fa.O7frz.92382219
  Located on chromosome 12
  Distance between a terminus base of telomere on chromosomal short arm and 5'-terminus of this base sequence : 90239793
  Distance between 3'-terminus of neighbour sequence of sequence listing upward to telomere on chrosomal short arm and 5'-terminus of this base sequence : 249390
gttacatttccaacatgaaagtacatgttcctttaacaaattaccttttcatgaagtttgactgtattgtgccccattatttccaattagcatggtgatgcttattttgcttatttttcaccttcaattgctatagctctatgcaaattctttttctcaaaaaactggccttttcacctttaccagattgctaattttctcatgaaattcctaaatatatatatatatatatatatacgcacacacacatataatattatatataatatataaaatatatattataaatatatattatatatataatctttatatattatattatataatcttttttggtttttgaataatctttattctaacctgtgcttatgaacattttatgtgccattactgtagtagatttttgtttgtattttggtcgtaagcacatattcctctttctgagtgcaatatcaccaatac

SEQ ID NO: 19044 - DNA, 170 bp, Homo sapiens
  G10269
  Located on chromosome 12
  Distance between a terminus base of telomere on chromosomal short arm and 5'-terminus of this base sequence : 90367748
  Distance between 3'-terminus of neighbour sequence of sequence listing upward to telomere on chrosomal short arm and 5'-terminus of this base sequence : 127490
aacattgtccctgtcagcatagacttcaaaacagacactttggtcttccaaggttttctaaactctctaattatctatctatctgtctattatctctatctatctatctatctatctatctatctatctatctatctatctatctaatttgtccacctatccatttccct

SEQ ID NO: 19045 - DNA, 200 bp, Homo sapiens
  DISO7_10003556
  Located on chromosome 12
  Distance between a terminus base of telomere on chromosomal short arm and 5'-terminus of this base sequence : 90559716
  Distance between 3'-terminus of neighbour sequence of sequence listing upward to telomere on chrosomal short arm and 5'-terminus of this base sequence : 191798
aggagatgttagtgactggatatgtacacacacacacacacacacacacacacacacacacacacacatgcatgcatgcacaatttccttgcttattcatttatttattgattgatttgtttgcttagttttagaaatgactttgacatatttattttacatacatgaaaaataagtattaagaaggcaacgatcatggt

SEQ ID NO: 19046 - DNA, 243 bp, Homo sapiens
  DISO7_10003557
  Located on chromosome 12
  Distance between a terminus base of telomere on chromosomal short arm and 5'-terminus of this base sequence : 90570604
  Distance between 3'-terminus of neighbour sequence of sequence listing upward to telomere on chrosomal short arm and 5'-terminus of this base sequence : 10688
tctagggagactcaagaatgcaaatatatatgtgtagatatgtatatatgcctctgtgtgtgtgtgtgtgtgtgtgtgtgtgtgtccatcctattggttatgttcctctggagaaagctaacaaatatcgggaggttttgaattaatataccaaatttcataatcaagtttgtactcaaagcaaaaaaaaatttaatatgagacactagagaaataactgcttagggaatgagggaacgtagg

SEQ ID NO: 19047 - DNA, 327 bp, Homo sapiens
  chr12.fa.O7frz.93093671
  Located on chromosome 12
  Distance between a terminus base of telomere on chromosomal short arm and 5'-terminus of this base sequence : 90578106
  Distance between 3'-terminus of neighbour sequence of sequence listing upward to telomere on chrosomal short arm and 5'-terminus of this base sequence : 7259
agacaaatgaaagtagaatgtgaggacaaggaaaagcttaaatgtttgcttctaaactttttctctttggcacagagaaacataaacatttttccgttcatttttttcatacaagtacctttattatatttgtgatagacttctgacttcttgggagaatctcaatctatagttctttgacccccccactgccccacaacacacacacacacacacacacatgcacacagacatcacatcaaattaaagttaaaactaaattttcttcccaaaatataagcagccactttcagtagcttttctgtctacagatttcagcatagaaat

SEQ ID NO: 19048 - DNA, 249 bp, Homo sapiens
  Z66887
  Located on chromosome 12
  Distance between a terminus base of telomere on chromosomal short arm and 5'-terminus of this base sequence : 90633655
  Distance between 3'-terminus of neighbour sequence of sequence listing upward to telomere on chrosomal short arm and 5'-terminus of this base sequence : 55222
tttcactacctctcgtctctgcttaagggtcacctaatcaaagacttttctgaccattctatataaagttgcaccccctactgcccactatagtccttatctccttaacctgctctatttttttcgttaccatttagtaatttaacatcccctttcaaacgtatcacacacacacacacacacacacacacacacacacgcacgatttctttcattttaaaaaaacttcccacacagaactaaactgca

SEQ ID NO: 19049 - DNA, 173 bp, Homo sapiens
  DISO7_10003553
  Located on chromosome 12
  Distance between a terminus base of telomere on chromosomal short arm and 5'-terminus of this base sequence : 90825800
  Distance between 3'-terminus of neighbour sequence of sequence listing upward to telomere on chrosomal short arm and 5'-terminus of this base sequence : 191896
tgttcttagacaggcaatatcttcttaaataagattttaaaagcaaaagacaaaaataattcatgttagatatttgatagtacaaattatacaggcagacacacacacacacacacacacacacacaggacaaaaaactccatagaaaaggatcaaatcaagagacatactgg

SEQ ID NO: 19050 - DNA, 94 bp, Homo sapiens
  D12S1593
  Located on chromosome 12
  Distance between a terminus base of telomere on chromosomal short arm and 5'-terminus of this base sequence : 90929181
  Distance between 3'-terminus of neighbour sequence of sequence listing upward to telomere on chrosomal short arm and 5'-terminus of this base sequence : 103208
tccaaattctttcacagagcctactgattgtgtgtgtgtgtgtgtgtgtgtgtgtgtgtgtgtgtgaatttaaaaggcgattggcagtttagct

SEQ ID NO: 19051 - DNA, 127 bp, Homo sapiens
  HUMUT633
  Located on chromosome 12
  Distance between a terminus base of telomere on chromosomal short arm and 5'-terminus of this base sequence : 91180439
  Distance between 3'-terminus of neighbour sequence of sequence listing upward to telomere on chrosomal short arm and 5'-terminus of this base sequence : 251164
ggcggcaagagcaagactccgtctcaaaaaataaataaataaataaataaataaataaataaataaataaataaataaatgttttacacaatatcatcttaaacttctacatgcagaagctatagaa

SEQ ID NO: 19052 - DNA, 146 bp, Homo sapiens
  D12S1033
  Located on chromosome 12
  Distance between a terminus base of telomere on chromosomal short arm and 5'-terminus of this base sequence : 91195640
  Distance between 3'-terminus of neighbour sequence of sequence listing upward to telomere on chrosomal short arm and 5'-terminus of this base sequence : 15074
aaaccaccatggcacttatatacctatgtaacaaacctgcacgttctgcacgtgtatcccagaacttaaactataataataataataataataataataataataataataataataataaaacaaaaccttctgccttttgtttc

SEQ ID NO: 19053 - DNA, 284 bp, Homo sapiens
  chr12.fa.O7frz.93616343
  Located on chromosome 12
  Distance between a terminus base of telomere on chromosomal short arm and 5'-terminus of this base sequence : 91290834
  Distance between 3'-terminus of neighbour sequence of sequence listing upward to telomere on chrosomal short arm and 5'-terminus of this base sequence : 95048
tgcataggttatttgcaaatactaatcaattttgtatgagcaacttgagcatctgtggattttggcatccgcaaggtacccttgaacaaatctctcatggatatgcaggactactctatatgtatatgcacacacgtgcacacacacccacacacacagacacacacacacacacagacacagagagacacagagagagagagagagagagagagagagagagagagaaacacatacagagagatttattgtaggggattggcttatgcaattacagaggctta

SEQ ID NO: 19054 - DNA, 101 bp, Homo sapiens
  DISO7_10003558
  Located on chromosome 12
  Distance between a terminus base of telomere on chromosomal short arm and 5'-terminus of this base sequence : 91464658
  Distance between 3'-terminus of neighbour sequence of sequence listing upward to telomere on chrosomal short arm and 5'-terminus of this base sequence : 173540
gagaatggagaacaatgaaatgtatgtgtgtgtgtgtgtgtgtgtgtgtgcatatacacacacactaatgtatatagggtgcacaagaaagactaccagga

SEQ ID NO: 19055 - DNA, 360 bp, Homo sapiens
  chr12.fa.O7frz.93936814
  Located on chromosome 12
  Distance between a terminus base of telomere on chromosomal short arm and 5'-terminus of this base sequence : 91581232
  Distance between 3'-terminus of neighbour sequence of sequence listing upward to telomere on chrosomal short arm and 5'-terminus of this base sequence : 116473
catagacatacatggtgaccattgttctaaacaaattaacacaggaacagaaaatcaagtacagcacgttctcacttataagtgggagctaaacaatggatactcatgaggatgggcgtggtggctcatgcctgtagtcccagtactttcagatgccaaggagaggcccaagagttttagaccagcatgggcaacataatgagacctcctttttatttatttatttatttatttatttatttatttattattatactttaagttttagggtacatgtgcacattgtacaggtcagttatgtatgtatacgtgtgccatgctggtgcgctgcacccactaactcgtcatctagcattaggt

SEQ ID NO: 19056 - DNA, 126 bp, Homo sapiens
  DISO7_10000137
  Located on chromosome 12
  Distance between a terminus base of telomere on chromosomal short arm and 5'-terminus of this base sequence : 91991932
  Distance between 3'-terminus of neighbour sequence of sequence listing upward to telomere on chrosomal short arm and 5'-terminus of this base sequence : 410340
aagaacaagcatgtttctgcaaaatctgtttgcctgtaatgtgtgtgtgtgtgtgtgtgtgtgtgtgtgtgtgtgtgatgataataatgagattgtggatggagagagtgatataagttcccttgc

SEQ ID NO: 19057 - DNA, 288 bp, Homo sapiens
  chr12.fa.O7frz.94716348
  Located on chromosome 12
  Distance between a terminus base of telomere on chromosomal short arm and 5'-terminus of this base sequence : 92022302
  Distance between 3'-terminus of neighbour sequence of sequence listing upward to telomere on chrosomal short arm and 5'-terminus of this base sequence : 30244
tcagctagaccgtcaagactgacttgccaccatgatatccacattatttgaggccattggaaggagaaaattagtgtattagtcagggtcctccagagaaacagaagtaggggtgtgtgtgtgtgtgtgtgtgtgtgttgtgtgtgtgtgtgtgtgtgtgtgtgtgtgtgtgtgtgtgtaaaataaggaactggctcagcaattatggagactgacaaagcccaagattgtcagtcagcaggctggagacccagaagaggctatgtatagttccagtctgagttcaaa

SEQ ID NO: 19058 - DNA, 286 bp, Homo sapiens
  DISO7_10003543
  Located on chromosome 12
  Distance between a terminus base of telomere on chromosomal short arm and 5'-terminus of this base sequence : 92201023
  Distance between 3'-terminus of neighbour sequence of sequence listing upward to telomere on chrosomal short arm and 5'-terminus of this base sequence : 178433
tggagacctcagagtccctttttttttttttttacatatatatatatgtcaaatatatatacatgtatatatatatatgtcaaatatatacatgtatatatgtcaaatatatatacatgtatatatgtaatatatatacacatatacataatatatatgcatatacataatatatatgtatatatgtaaaacgtgtgtgtatgtgtgtgtgtgtgtgtatatatatgtaaatatatatatatatgtaaatatatatatatatatatagcatgagagcctgttagga

SEQ ID NO: 19059 - DNA, 189 bp, Homo sapiens
  DISO7_10003541
  Located on chromosome 12
  Distance between a terminus base of telomere on chromosomal short arm and 5'-terminus of this base sequence : 92214994
  Distance between 3'-terminus of neighbour sequence of sequence listing upward to telomere on chrosomal short arm and 5'-terminus of this base sequence : 13685
ttctagcttcagtaacggtagcttttccaaagggtctaagcatttaaacaatttaaaaatagttttgaaagataatacaaatattatctttcaaatacaaatatttgcatgtgtatacacacacacacacacacacacacacagttttttgccaaaaaaatttgaaaatccatcatgcacacttcctca

SEQ ID NO: 19060 - DNA, 138 bp, Homo sapiens
  DISO7_10000126
  Located on chromosome 12
  Distance between a terminus base of telomere on chromosomal short arm and 5'-terminus of this base sequence : 92366226
  Distance between 3'-terminus of neighbour sequence of sequence listing upward to telomere on chrosomal short arm and 5'-terminus of this base sequence : 151043
attccttgttctgctcattgttttttgtcctttttttccccattctctctcctcccctatacacacacagacagacagacacacacacacacacacacacaaacacacacacaacttcttctgattgcatttaatgga

SEQ ID NO: 19061 - DNA, 161 bp, Homo sapiens
  DISO7_10000127
  Located on chromosome 12
  Distance between a terminus base of telomere on chromosomal short arm and 5'-terminus of this base sequence : 92517401
  Distance between 3'-terminus of neighbour sequence of sequence listing upward to telomere on chrosomal short arm and 5'-terminus of this base sequence : 151037
ccgacatttatatcttatgagcctaaataacccgatgtgtgtgtgtgtgtgtgtgtgtgtgtgtgtgtgtgtgtatacaacagaataaatattctatgttatttgtttttttgaagactaatgataatgataatatatagagggcctagtacaatgtgtac

SEQ ID NO: 19062 - DNA, 252 bp, Homo sapiens
  DISO7_10000128
  Located on chromosome 12
  Distance between a terminus base of telomere on chromosomal short arm and 5'-terminus of this base sequence : 92526052
  Distance between 3'-terminus of neighbour sequence of sequence listing upward to telomere on chrosomal short arm and 5'-terminus of this base sequence : 8490
ggctttgcagttagttagaggttggttcaatttcaagctccataacttattggtagtttgacttaggcaaattgcatggcatttgtaaacctcagtttccttttctataatgggctttatgataacacttacctaaaagattggtgtaagaactagatgactgtgtatgtgtgtgtgtgtgtgtgtgtgtgtgtgtgtacagaaagagaaagaaggtactgaaagtatcatgatctatcctatgtgctaagc

SEQ ID NO: 19063 - DNA, 471 bp, Homo sapiens
  chr12.fa.O7frz.94485874
  Located on chromosome 12
  Distance between a terminus base of telomere on chromosomal short arm and 5'-terminus of this base sequence : 92567638
  Distance between 3'-terminus of neighbour sequence of sequence listing upward to telomere on chrosomal short arm and 5'-terminus of this base sequence : 41334
gtaacaggaacatgactcaaaccaacttatgtaaacacaaaaggaatttattggctcttttatccaggaagttcaaggaatggtgctagtttaaggcatcattggctctagaggttcaaacacatattatcagaaacttatttatttttctctacctctcagcttacatttctgctgttatctcagtttttaggcaggtaaacctcacatggtaacaaagatggctattgacagttctagacttttatcaatcatccttgtctttcctggtcttagtaaactcaaacacacacacacacacacacacacacacacacacacaccacatgcctctttcctgtgagtatcagtgggagtagtgagaaggctttaattgagcaagtctcataccatgcccaactgagagcagagacttggggagggtcttgtgtgttgggagagaatcagctccacttaaactgtatggattaa

SEQ ID NO: 19064 - DNA, 141 bp, Homo sapiens
  DISO7_10000129
  Located on chromosome 12
  Distance between a terminus base of telomere on chromosomal short arm and 5'-terminus of this base sequence : 92578333
  Distance between 3'-terminus of neighbour sequence of sequence listing upward to telomere on chrosomal short arm and 5'-terminus of this base sequence : 10224
ttccatatggaatcacatgcatacatatatatatatatatatatatatatatatatatatatatatacacacatttgttttctaattacatgattataattctctacctatctgtcatttacctatctccctcagcatctt

SEQ ID NO: 19065 - DNA, 195 bp, Homo sapiens
  DISO7_10000130
  Located on chromosome 12
  Distance between a terminus base of telomere on chromosomal short arm and 5'-terminus of this base sequence : 92579824
  Distance between 3'-terminus of neighbour sequence of sequence listing upward to telomere on chrosomal short arm and 5'-terminus of this base sequence : 1350
ttacagtctcccatgtgtcagaaaagattttttaaagataattttaaaatattgatatttatgaaaatgtctaagttttaaacattaacaattttagttaaacacacacacacacacacacacacacactcagcatattagccaaacaaaaaacatctctggactttaattcttttcatgagctgtcactttgca

SEQ ID NO: 19066 - DNA, 157 bp, Homo sapiens
  DISO7_10000132
  Located on chromosome 12
  Distance between a terminus base of telomere on chromosomal short arm and 5'-terminus of this base sequence : 92603013
  Distance between 3'-terminus of neighbour sequence of sequence listing upward to telomere on chrosomal short arm and 5'-terminus of this base sequence : 22994
tgagccagaatgtgactttagtaaaggattaccactctatctcatagaaaagtagggcatatatatgtacatagatatagatatagatatagatatagatatagatatagatataggtatagataaagttttccccctgggtcagtggaaggcaaga

SEQ ID NO: 19067 - DNA, 101 bp, Homo sapiens
  DISO7_10000133
  Located on chromosome 12
  Distance between a terminus base of telomere on chromosomal short arm and 5'-terminus of this base sequence : 92628858
  Distance between 3'-terminus of neighbour sequence of sequence listing upward to telomere on chrosomal short arm and 5'-terminus of this base sequence : 25688
tcaagttccttaagaaatgcactgttaaagtaaatgtatgtgtgtgtgtgtgtgtgtgagtgagagagagagagagacagaaatatctaccaagaccagtg

SEQ ID NO: 19068 - DNA, 101 bp, Homo sapiens
  DISO7_10000134
  Located on chromosome 12
  Distance between a terminus base of telomere on chromosomal short arm and 5'-terminus of this base sequence : 92642702
  Distance between 3'-terminus of neighbour sequence of sequence listing upward to telomere on chrosomal short arm and 5'-terminus of this base sequence : 13743
ggaatttctcctcttctagctaagttagcctatctttcagtttatgtgtgtgtgtgtgtgtctgtgtgtgtgtgtgttttactatgccatgtgtctcaagc

SEQ ID NO: 19069 - DNA, 449 bp, Homo sapiens
  chr12.fa.O7frz.94599152
  Located on chromosome 12
  Distance between a terminus base of telomere on chromosomal short arm and 5'-terminus of this base sequence : 92680809
  Distance between 3'-terminus of neighbour sequence of sequence listing upward to telomere on chrosomal short arm and 5'-terminus of this base sequence : 38006
caacagccagatttacatctactccaccttccctcagattctcttacactttcaccggctcctgggccaagtgcatgtttagcttgcacttggaaagcatgacacttggaaagatgacaaagggtgccatctttccttctgcaggaaggagttgacgtggtctgcagatgataagacacagaccaggttccagtccatcctcagaggtcagatatatatatatatatatatatatatatatatatatatatatatcccactttcctgctagacagctagctctgaagtcttcatgctccagcatcagaaatgaagacaacagctatatgaaaactcatgaactaaccagctttcaaaattgcatagatctaattcttgtaataaatctcttagtgtgtgtgtgtgtgtgtgtgtgtgtgcgcgcgcacagacacctttgatcgattgag

SEQ ID NO: 19070 - DNA, 415 bp, Homo sapiens
  AC034170.3_107159
  Located on chromosome 12
  Distance between a terminus base of telomere on chromosomal short arm and 5'-terminus of this base sequence : 92786879
  Distance between 3'-terminus of neighbour sequence of sequence listing upward to telomere on chrosomal short arm and 5'-terminus of this base sequence : 105621
tccagcttgtagatcatgtaacttcttagcatctacaattgtgtgtgccaattcttcattatctatctatctatctttctatctatctatctatctatctatctatctatctatctatcctattggttctgtttctctggagaagactgattaatacatgagtgttccccagctgagccaaaaaaaaagttaaatgaattctcataaatcaataatttaggcatggtaattctgttttttgtttttggagaaaactccaaactgctttgcacagggaatgaactaatttacattcccaccaagagtgtagaagcattcccttttctctgcaacctcaccaacatctattattttttgactttttaataatggtcattctgactggtgtgagatggtatctaatacagtttggatg

SEQ ID NO: 19071 - DNA, 415 bp, Homo sapiens; identical to SEQ ID NO: 19070
  AC024941.18_85937
  Located on chromosome 12
  Distance between a terminus base of telomere on chromosomal short arm and 5'-terminus of this base sequence : 92786879
  Distance between 3'-terminus of neighbour sequence of sequence listing upward to telomere on chrosomal short arm and 5'-terminus of this base sequence : -415

SEQ ID NO: 19072 - DNA, 116 bp, Homo sapiens
  D12S1678
  Located on chromosome 12
  Distance between a terminus base of telomere on chromosomal short arm and 5'-terminus of this base sequence : 93260589
  Distance between 3'-terminus of neighbour sequence of sequence listing upward to telomere on chrosomal short arm and 5'-terminus of this base sequence : 473295
gaaacacagaccataggacatttagtgtgtgtgtgtgtgtgtgtgtgtgtgtgtgtgtatacttacagtctttcaagaagttcaaagtaaatgagttgtttcattcacctaaaaga

SEQ ID NO: 19073 - DNA, 464 bp, Homo sapiens
  AC068641.10_133743
  Located on chromosome 12
  Distance between a terminus base of telomere on chromosomal short arm and 5'-terminus of this base sequence : 93331842
  Distance between 3'-terminus of neighbour sequence of sequence listing upward to telomere on chrosomal short arm and 5'-terminus of this base sequence : 71137
tatgtactcctatttcgaagacagatttgatggcccaactagaaactgattttcagacagaaccatgtgaaatgataagagcagatatcgtgtactctacttgcttttttgtttgtttgtttgtttgtttgtttgtttgagacggagtctcgctctgtcgcccaggctggagtgcagtggcacgatctcggctcactgcaagctccgcctcctgggttcacgccattctcctgcctcagccttcggagtagctggactacaggcgcccgccaccgcgccgggctaattttttgtatttttagtagagacagggtttcaccgtgttagccaggatggtctccatctcctgacctcgtgatccccccgtctcggcctcccaaagtgctgggattacaggcatgagccaccgcgcccggcctctacttgctttttttttttttggtttaaagtcagctgagttaacc

SEQ ID NO: 19074 - DNA, 263 bp, Homo sapiens
  chr12.fa.O7frz.95599477
  Located on chromosome 12
  Distance between a terminus base of telomere on chromosomal short arm and 5'-terminus of this base sequence : 93403128
  Distance between 3'-terminus of neighbour sequence of sequence listing upward to telomere on chrosomal short arm and 5'-terminus of this base sequence : 70822
gacaaactttagtcactgattgacccaggggctcaattgatgtccaggattgacagccacatgctatctctatctctctctctctctctctctctctctctctctctctctctctctctctcctgtttgaattctctgtttgaattctgtgaagagaaaagacagattggcacataggaataaaaaaaaacagttttattactgataaaagctggaatggatgacttggtttttgtgtgacaacaacgctctagtattgaacc

SEQ ID NO: 19075 - DNA, 433 bp, Homo sapiens
  chr12.fa.O7frz.94920517
  Located on chromosome 12
  Distance between a terminus base of telomere on chromosomal short arm and 5'-terminus of this base sequence : 93436397
  Distance between 3'-terminus of neighbour sequence of sequence listing upward to telomere on chrosomal short arm and 5'-terminus of this base sequence : 33006
ctcatcgttccatttatacaatagtttttcagcgtgaaagaactgattgaatgaaaacatctctcatttgttttctaaaagttaaaattcaaggaaaattattttaaagaaattaaaccaggatagtaaatttcatgaaagcctacttcttattaaagtaacttaaataccaagtggactgtattggtccagttttgaagcagaactaataggatctatatctatctatctatctatctatctatctatctatctatctatctatcatctatctatcatctatctatctatctaatctatcaatcatcagtcgatcaatctgtcaatttgttatgagaattgtctcatgcaattagggaggctgagaagttccatgatctgctgtctgcaagctgaagaacgaggagaactaatggtgttaattcagttcaag

SEQ ID NO: 19076 - DNA, 101 bp, Homo sapiens
  DISO7_10000139
  Located on chromosome 12
  Distance between a terminus base of telomere on chromosomal short arm and 5'-terminus of this base sequence : 93466778
  Distance between 3'-terminus of neighbour sequence of sequence listing upward to telomere on chrosomal short arm and 5'-terminus of this base sequence : 29948
agtcacatgccctgaacagtggtcttggagagagagagagagagagagagagagagagagagagagctattccttactgcaccatataacatgcacgtaga

SEQ ID NO: 19077 - DNA, 247 bp, Homo sapiens
  DISO7_10000140
  Located on chromosome 12
  Distance between a terminus base of telomere on chromosomal short arm and 5'-terminus of this base sequence : 93481343
  Distance between 3'-terminus of neighbour sequence of sequence listing upward to telomere on chrosomal short arm and 5'-terminus of this base sequence : 14464
accagcattaacttcaacaatccaatcaataaattataaattatcaaaatcaaatcaaagcctgactttctcatttgtttgagggcagaaagaaagaaaaagacaaatgaaaggagggaaggaaggaaggaaggaaggaaggaaggaaggaaggaaggaaggaaggcaggcaggcaggcaggcaggcatttttataataacattaaggaaaagacaagtttagcaccccttctccaaatacagcatg

SEQ ID NO: 19078 - DNA, 267 bp, Homo sapiens
  D12S1710
  Located on chromosome 12
  Distance between a terminus base of telomere on chromosomal short arm and 5'-terminus of this base sequence : 93701290
  Distance between 3'-terminus of neighbour sequence of sequence listing upward to telomere on chrosomal short arm and 5'-terminus of this base sequence : 219700
aggtttctgggttcctgataatgcagtatctcttaaactggatattgattacctgagtgtgttcatgctctaaaattcatacaacttaagatctattcatattaatgtatgtgtgtttgtcaggattctccagagaaagagaaccaataaggtatatacatatatattatcattcacataggatacatacacatacacacacacacacacacacacacacacacacgtattaagatttactatgggaatttgctcctacgattatgg

SEQ ID NO: 19079 - DNA, 344 bp, Homo sapiens
  HUMUT2007B
  Located on chromosome 12
  Distance between a terminus base of telomere on chromosomal short arm and 5'-terminus of this base sequence : 93721470
  Distance between 3'-terminus of neighbour sequence of sequence listing upward to telomere on chrosomal short arm and 5'-terminus of this base sequence : 19913
agatagcgccactgcactccagcctgggcaacagagtgagactccgtctgaaaaataaaaaaaaaagaagaaaggaaggaagggaggaaaacgaaggaaggaaggaaggaaggaaggaaggaaggaaggaaggaaggaaggaaagaaggaagaaaggaaggaaggaaggaaggaagtgaccctcaaaagcctagtgttccagacagtgagaccctctacctcatttatgtctactcccgacccccagaaaaaaaaaagttaaaaaagttattcattcttccccaagttcagtcacaagattcagtccttgtctgaaaatgtcttacttcgtgttcgctgttacc

SEQ ID NO: 19080 - DNA, 226 bp, Homo sapiens
  D12S1071
  Located on chromosome 12
  Distance between a terminus base of telomere on chromosomal short arm and 5'-terminus of this base sequence : 93889366
  Distance between 3'-terminus of neighbour sequence of sequence listing upward to telomere on chrosomal short arm and 5'-terminus of this base sequence : 167552
acaaagtgagactgtctcaatagatagatagatagatagatagatagatagatagatagatagatagatagatagatagatagacagacagacagacagacacttttataaaaaattcaaattttcctttggctatttcttatcttcagaatacattttctataaaaacacattcccagcactcagggctctgggaccaaacagggcaggcactatttcatgtccc

SEQ ID NO: 19081 - DNA, 119 bp, Homo sapiens
  DISD22_0008671
  Located on chromosome 12
  Distance between a terminus base of telomere on chromosomal short arm and 5'-terminus of this base sequence : 93981938
  Distance between 3'-terminus of neighbour sequence of sequence listing upward to telomere on chrosomal short arm and 5'-terminus of this base sequence : 92346
tcttacaataaacactacgcgcgcgcgcgcgcacacacacacacacacacacacacacacacacttttttattggcttaagcacgtttaagttattttctgttacttgcagcagatgag

SEQ ID NO: 19082 - DNA, 338 bp, Homo sapiens
  HUMUT5541
  Located on chromosome 12
  Distance between a terminus base of telomere on chromosomal short arm and 5'-terminus of this base sequence : 94184285
  Distance between 3'-terminus of neighbour sequence of sequence listing upward to telomere on chrosomal short arm and 5'-terminus of this base sequence : 202228
tgcaaagctctgggattagtgctgtgtccgaggaatgggaaattagacagtatgtgtgcttattcactccacaatattctgttgcaaaaaccatggcagttagtggggacagcgttgactcaaaatgaacaagttatttggaaggaaggaaggaaggaaggaaggaaggaaggaaggaaggaaggaaggaaggaaggaaggagagggaaaggaaagggagaaaaaggagacagacaacaaaaaagaaggaaggagggagaaagaaaagagtcaatgtgtcctgtttacatgaaaaccttttaaagcacaatatttcttcaaggcaggcagagataaaa

SEQ ID NO: 19083 - DNA, 252 bp, Homo sapiens
  D12S316
  Located on chromosome 12
  Distance between a terminus base of telomere on chromosomal short arm and 5'-terminus of this base sequence : 94351248
  Distance between 3'-terminus of neighbour sequence of sequence listing upward to telomere on chrosomal short arm and 5'-terminus of this base sequence : 166625
ctttcacttctcggatgcaaatacaattgtgtgtgtgtgtgtgtgtgtgtgtatgtgtgtatgtgacttattttaacttcagaggtgtaagttcaggtttattacataaacttgtgtcatggggctttgttgtactgactattgcatcatccacgtattaagcctagtactcattagttatttttcctgatcctctcccccctcccaccctccactttctcaaagtctccagtgtgtgttgttccccactat

SEQ ID NO: 19084 - DNA, 195 bp, Homo sapiens
  D12S1717
  Located on chromosome 12
  Distance between a terminus base of telomere on chromosomal short arm and 5'-terminus of this base sequence : 94405158
  Distance between 3'-terminus of neighbour sequence of sequence listing upward to telomere on chrosomal short arm and 5'-terminus of this base sequence : 53658
ccagagacaatctttgtgtgtaacccactgtgattaatagcaaaattccttactgtgtgtgtgtgtgtgtgtgtgtgtgtgtgtgtgtgtgtgtgctctccaagggtgataaaggaagcagggagaaaagactgagaatggtataagggaggaagaatgagaaaaagattctatcaatttgagatttagggaata

SEQ ID NO: 19085 - DNA, 326 bp, Homo sapiens
  chr12.fa.O7frz.96086883
  Located on chromosome 12
  Distance between a terminus base of telomere on chromosomal short arm and 5'-terminus of this base sequence : 94492465
  Distance between 3'-terminus of neighbour sequence of sequence listing upward to telomere on chrosomal short arm and 5'-terminus of this base sequence : 87112
gactaagaccactgtaataccaacatttctgtaaaaaaagattaaaattcatttttttctctcatgaacatgtacattttaaagataaaatgctatatcatgggcatgttagaaatgagatgagcacacaaattactcctgccaaatgtgtgtgagagtgtgtctttagatgagtagtgtgtgtgtgtgtgtgtgtgtgtgtgtgtgtgtgtttagatgagaatttatcttttcctaaacaaagagaagctgatttctgggtttgccattttttagcagaaaatattgatgaagtgagttgaacagtttggctatctggatcatac

SEQ ID NO: 19086 - DNA, 463 bp, Homo sapiens
  chr12.fa.O7frz.96552503
  Located on chromosome 12
  Distance between a terminus base of telomere on chromosomal short arm and 5'-terminus of this base sequence : 94677742
  Distance between 3'-terminus of neighbour sequence of sequence listing upward to telomere on chrosomal short arm and 5'-terminus of this base sequence : 184951
tttcaatcctacagacaaacacgactgaatccattaaaaaaattgacttactgcaaggcactctggttgctataggatacagaaagctattaagatagttctccatttctcagcttataattttagatctgaagatagagaaatataaatatattatgttcataaaaaggcttgtgtgtgtgtgtttgtgtgtgtgtgtatgtctaaaaagttctattaagcagtttagagaaaagagaatgcattgtgggtttgcaaatataaatacattatgttaatataaaggtgtgtgtgtgtgtgtgtgtgtgtgtgtcaaaaaaagtggtattaagcagtttacagaaaagagaatggattgtgggctgggaaaatcatgtacattttatcagcaatagtgtttcacttgacagttatagattgtttacccagataaagaaaagggtatgtaaacaggctggtagaa

SEQ ID NO: 19087 - DNA, 286 bp, Homo sapiens
  chr12.fa.O7frz.97738867
  Located on chromosome 12
  Distance between a terminus base of telomere on chromosomal short arm and 5'-terminus of this base sequence : 94885616
  Distance between 3'-terminus of neighbour sequence of sequence listing upward to telomere on chrosomal short arm and 5'-terminus of this base sequence : 207411
cagacatttaatgtacctccagattttggctgattttccaggatatgctggcttcaaatagtcaaatattctttctagttgtctccatccattttaaccacatgttgattttttgttccaaaaatatgctgtatacctcgtacgcacagttaaaaaagattaagatgtatttggtttataatcatcactattttgtatctaacagaagatcaagcatatatatatatatatatatatatatgcccatctttataatgtgaaactgaagactcagaatgtgaatagt

SEQ ID NO: 19088 - DNA, 186 bp, Homo sapiens
  Z66593
  Located on chromosome 12
  Distance between a terminus base of telomere on chromosomal short arm and 5'-terminus of this base sequence : 94980576
  Distance between 3'-terminus of neighbour sequence of sequence listing upward to telomere on chrosomal short arm and 5'-terminus of this base sequence : 94674
cctgagcacaacactgaaaggcttattaacttaaaaagttgaaatccgggtatggaaataaattttgagagactatcagaagttcatacacacacacacacacacacacacacacgtggttgagagtaatgtaaatgcactagtctttgcctacacaattgtaattccttgaatcttgaaccattt

SEQ ID NO: 19089 - DNA, 127 bp, Homo sapiens
  D12S1699
  Located on chromosome 12
  Distance between a terminus base of telomere on chromosomal short arm and 5'-terminus of this base sequence : 95000335
  Distance between 3'-terminus of neighbour sequence of sequence listing upward to telomere on chrosomal short arm and 5'-terminus of this base sequence : 19573
ttcgttcacatcctggccagcatttgttatctttatcatttatgtgtgtgtgtgtgtgtgtgtgcatgtgtgtgtgtgtgtgtgtgtgtgtgtgctttaataatagccatcctaacaggcatgaggt

SEQ ID NO: 19090 - DNA, 170 bp, Homo sapiens
  D12S322
  Located on chromosome 12
  Distance between a terminus base of telomere on chromosomal short arm and 5'-terminus of this base sequence : 95066935
  Distance between 3'-terminus of neighbour sequence of sequence listing upward to telomere on chrosomal short arm and 5'-terminus of this base sequence : 66473
acttgggcaaaatacgcaaggatatttctattctgacctatatttgtagaaagtctctccccaaaacaatgatctaggcacacacacacacacacacacacacacacacacacaccccaaaccctaattcttgtgatgcctcaattcagatctgtcccagccatgaattt

SEQ ID NO: 19091 - DNA, 307 bp, Homo sapiens
  HUMUT7912
  Located on chromosome 12
  Distance between a terminus base of telomere on chromosomal short arm and 5'-terminus of this base sequence : 95324012
  Distance between 3'-terminus of neighbour sequence of sequence listing upward to telomere on chrosomal short arm and 5'-terminus of this base sequence : 256907
aaagaaaagcaagcaagcaagcaagaaagagaaagaagaaagaaagaaagaaagaaagaaagaaagaaagaaagaaagaaagaaagaaagaaagaaagaaaggaaagaaagaaagaaagaaagaaagaaagaaagaaagaaagaaagaaagaaagaaagaaagaaaaagaggagtcagaggctttgtgtgagatctgtttcagatatgctgttaatggcatctggggcagccaaatagctaattctgattagttaccatccttcaaaagttgcgtttggaaacatagatatgcaggtcagtcaatcg

SEQ ID NO: 19092 - DNA, 234 bp, Homo sapiens
  AC012514.15_85787
  Located on chromosome 12
  Distance between a terminus base of telomere on chromosomal short arm and 5'-terminus of this base sequence : 95420521
  Distance between 3'-terminus of neighbour sequence of sequence listing upward to telomere on chrosomal short arm and 5'-terminus of this base sequence : 96202
cctaatcagaaatcgtttgagtggctgcatgattcaagtttgtaaggctgcaaaagacagtctcgcattcatcttgttatagaaactatagatatctctatctatttatctatctatctatctatctatctatctatctatctatctatctatcatctatctatctatctatagatcaatcaatctatctagacagctaggttagatgtagactggaatgctacaatactgaag

SEQ ID NO: 19093 - DNA, 224 bp, Homo sapiens
  AC025164.16_164239
  Located on chromosome 12
  Distance between a terminus base of telomere on chromosomal short arm and 5'-terminus of this base sequence : 95420521
  Distance between 3'-terminus of neighbour sequence of sequence listing upward to telomere on chrosomal short arm and 5'-terminus of this base sequence : -234
cctaatcagaaatcgtttgagtggctgcatgattcaagtttgtaaggctgcaaaagacagtctcgcattcatcttgttatagaaactatagatatctctatctatttatctatctatctatctatctatctatctatctatctatctatctatcatctatctatctatctatagatcaatcaatctatctagacagctaggttagatgtagactggaatgctac

SEQ ID NO: 19094 - DNA, 251 bp, Homo sapiens
  Z23566.1_178
  Located on chromosome 12
  Distance between a terminus base of telomere on chromosomal short arm and 5'-terminus of this base sequence : 95565500
  Distance between 3'-terminus of neighbour sequence of sequence listing upward to telomere on chrosomal short arm and 5'-terminus of this base sequence : 144755
gaccaaggtccatcagtttagtttctacacatgtgccctgagcaactgagttgtttgactttgtgtgtgtgtgtgtgtgtgtgtgtgtgtgtgtgtgtaaagattaccccaagcaataactaatttttcaactaggtgaaataagttttttttaattttaaattgttttaaattgtggaataattttatttatttatttttattttcataggttattggggaacagttaatgtttggttatgtgagtcagt

SEQ ID NO: 19095 - DNA, 349 bp, Homo sapiens
  AC026113.11_91207
  Located on chromosome 12
  Distance between a terminus base of telomere on chromosomal short arm and 5'-terminus of this base sequence : 95619236
  Distance between 3'-terminus of neighbour sequence of sequence listing upward to telomere on chrosomal short arm and 5'-terminus of this base sequence : 53485
actgaccatgtttaagttgtaaagcctgccgtatgaggaagcagaaacagatgtagtagctgttccctgctggtatgtgctctatgtctttggttggttgggtggttggctggttggtttggtgtttggttgagtggatgggtgggtggttgggtggttaggtgagtggttggttggttgggtgggtgggtgggtggttgggtggttgggtgagtggttggttggttggttggttggttgggtgggtggttgggtggttgattggttggttggttttaaaattatcatgactgccttcatttttttctgtttcttcctcctcaatcttaaatgacaggactatgaatgt

SEQ ID NO: 19096 - DNA, 288 bp, Homo sapiens
  AC012083.6_154190
  Located on chromosome 12
  Distance between a terminus base of telomere on chromosomal short arm and 5'-terminus of this base sequence : 95744873
  Distance between 3'-terminus of neighbour sequence of sequence listing upward to telomere on chrosomal short arm and 5'-terminus of this base sequence : 125288
tagcaaactgtatcctttcagatatatatatatagcctccaatactatctgcaagccctcaaaagaagggcacttaccttgagtataaacggtggtccctagttataagacaacaactcaacaatgagtgtctctgtgtatatgtatgtatatatatatatatatatatatatatatatatataaatgcatggaagaagttttattcatttactgtatatagctcaaagcacataatccctcggcatgcattcctttcaatagggttcagctgtggtttctataagac

SEQ ID NO: 19097 - DNA, 398 bp, Homo sapiens
  AC012083.6_130772
  Located on chromosome 12
  Distance between a terminus base of telomere on chromosomal short arm and 5'-terminus of this base sequence : 95768280
  Distance between 3'-terminus of neighbour sequence of sequence listing upward to telomere on chrosomal short arm and 5'-terminus of this base sequence : 23119
ccaaaccatatcaagctgtaataattttcatttgctccatgcaaccacaatgctagcaagtatcaatttattaatgctgaaatatgaacattcaaacatatatgactatcatgtactctgtgtgtgtgtgtgtgtgtgtgtgtgtgtgtgtgtgtgtgagagagagagagagagagagagagagagagagagagaacagggggtggacagtagttatctctgcttaattatcctcaataaaaatgtttcttcaacctgcttcaaggcaatcatcccagctaacctgctctgaagccctttgggggcatttgaagaggagagaaggccctttgttccccctttcaacactgggctagagtctccttacctctctcagatactctgactcagtacaggct

SEQ ID NO: 19098 - DNA, 237 bp, Homo sapiens
  AC012083.6_103639
  Located on chromosome 12
  Distance between a terminus base of telomere on chromosomal short arm and 5'-terminus of this base sequence : 95795519
  Distance between 3'-terminus of neighbour sequence of sequence listing upward to telomere on chrosomal short arm and 5'-terminus of this base sequence : 26841
tccagactgagacaatagcaactgtgtgtgtttatatgtgaatatggaagatatgtgtgtgtgtgtgtgtgtgtgtgtgtgtgtgtgtgagagagagagagacagagacacagagagaaatgtgtgttctgataaagcaaggtacattagataatagcccattgcaccttgcattaagcaagcctgtctgagaaatgagcaactttctcaggccactgctcaacctagagtgttgac

SEQ ID NO: 19099 - DNA, 152 bp, Homo sapiens
  D12S95
  Located on chromosome 12
  Distance between a terminus base of telomere on chromosomal short arm and 5'-terminus of this base sequence : 95795537
  Distance between 3'-terminus of neighbour sequence of sequence listing upward to telomere on chrosomal short arm and 5'-terminus of this base sequence : -219
caactgtgtgtgtttatatgtgaatatggaagatatgtgtgtgtgtgtgtgtgtgtgtgtgtgtgtgtgtgagagagagagagacagagacacagagagaaatgtgtgttctgataaagcaaggtacattagataatagcccattgcacctt

SEQ ID NO: 19100 - DNA, 329 bp, Homo sapiens
  AC012083.6_93610
  Located on chromosome 12
  Distance between a terminus base of telomere on chromosomal short arm and 5'-terminus of this base sequence : 95805546
  Distance between 3'-terminus of neighbour sequence of sequence listing upward to telomere on chrosomal short arm and 5'-terminus of this base sequence : 9857
ttagagcctttgctcaataaatagttataacagaagagagagtggagacgtgtgtgtgtgtgtgtgtgtgtgtgtgtgtgtgtgtgtgtgtaggggtagaagatagtggtgggggagctttctgagaccctgctactcatgccagattttctggtcctgattagctactgcctggctgccagaagctgttattatcactcactcccgtgctcctgtcactgggcttgtggaaacttgcccttccttctgctctcggtctctgatgctgacagctatgctggaaaatcccatgctggccactgccacacttaccagaggcatattgtacg

SEQ ID NO: 19101 - DNA, 444 bp, Homo sapiens
  chr12.fa.O7frz.98729251
  Located on chromosome 12
  Distance between a terminus base of telomere on chromosomal short arm and 5'-terminus of this base sequence : 95937461
  Distance between 3'-terminus of neighbour sequence of sequence listing upward to telomere on chrosomal short arm and 5'-terminus of this base sequence : 131586
gaggtcaggagtttgagactagcctggccaacatggtgaaaccccatctccactaaaaatacaaaaattagctggatgtagtggtgcggacctgtaatcccagctactcaggagactgaagcacaagaatcgcttgaacctaggaggaggaggttgcagtgagccgagattgcaccactgcactccagcctgggtgacagagctggatccctctcaaaataaataaataaataaataaataaataaataaataaataaataaataaataaaaataaattaaaaaataataataaagccctgtggcaggaaggaccagggtccattcacgatgtgaacagcagtaccgagagagagactatgcccagtgaggtaaggctgacatctggggcccgggccacacaaaccaaccaaacctaggtcgtgaggaccagattgtactttat

SEQ ID NO: 19102 - DNA, 234 bp, Homo sapiens
  DISO7_10019746
  Located on chromosome 12
  Distance between a terminus base of telomere on chromosomal short arm and 5'-terminus of this base sequence : 96026366
  Distance between 3'-terminus of neighbour sequence of sequence listing upward to telomere on chrosomal short arm and 5'-terminus of this base sequence : 88461
tgccgtaatactcacccagttttgttttctaaggaattcattgattaaaaaaaagagagaaagaaagaaagaaggaaggaaggaaggaaggaaagagagaatgaaaagaaagaaagaaaaagaaagaaagaaagaagaaagaaagaaagaaagaaagaaagaaagaaagaaagaaagaaagaaagaaagaaagaaagggaaagaaaaactcttctacttaacagtttcaggtcc

SEQ ID NO: 19103 - DNA, 121 bp, Homo sapiens
  DISD22_0008680
  Located on chromosome 12
  Distance between a terminus base of telomere on chromosomal short arm and 5'-terminus of this base sequence : 96263497
  Distance between 3'-terminus of neighbour sequence of sequence listing upward to telomere on chrosomal short arm and 5'-terminus of this base sequence : 236897
ctggcttactagatggagaggataaaaaattctctctctgacacacacacacacacacacacacacacacacacacacacacacagtctaagctaaatacctgaagttgtttatgcttctg

SEQ ID NO: 19104 - DNA, 452 bp, Homo sapiens
  chr12.fa.O7frz.101189628
  Located on chromosome 12
  Distance between a terminus base of telomere on chromosomal short arm and 5'-terminus of this base sequence : 96411105
  Distance between 3'-terminus of neighbour sequence of sequence listing upward to telomere on chrosomal short arm and 5'-terminus of this base sequence : 147487
gatttgaaggtacgtattaaaagagactatgggctgggcgcggtggctcacgcctggaatcctagcactttgggaggccaaggcaggtgaatcttctgaggtcaagagtttgagcccacctggccaacatggtgaaaccccatctctcctaaagatatgaaaattagctgagtgtggtggtgcatgcctgtaatctcagctacttgggaggctgaggcaggagaattgcttgaacctgggaggcagaggttgcagtgagccaagatcatgccactgcactccagcctgggcaacagagtgagattttatcaagaaagaaagagaaagagagagagagagagagagagagagagagaggaaggaaaggaaggaaggaaggaaggaaggaaagaaggaaagaaagaaagaagaagggaggatggaaggggacttccatatgagaatagtgaacc

SEQ ID NO: 19105 - DNA, 206 bp, Homo sapiens
  chr12.fa.O7frz.101439005
  Located on chromosome 12
  Distance between a terminus base of telomere on chromosomal short arm and 5'-terminus of this base sequence : 96571037
  Distance between 3'-terminus of neighbour sequence of sequence listing upward to telomere on chrosomal short arm and 5'-terminus of this base sequence : 159480
caagagcaccattaatttgtagggatgtgtacacacgtgtatttttctgcagaaagagatcctttcttgagaccctcacacacacacacacacacacacacacacacacacacaaaactgagacacatgaacatctagctcagctagctcataacttgacacctttgaaatgatattttaaaatagtttttcagcatatcctgaag

SEQ ID NO: 19106 - DNA, 206 bp, Homo sapiens
  chr12.fa.O7frz.101558998
  Located on chromosome 12
  Distance between a terminus base of telomere on chromosomal short arm and 5'-terminus of this base sequence : 96780964
  Distance between 3'-terminus of neighbour sequence of sequence listing upward to telomere on chrosomal short arm and 5'-terminus of this base sequence : 209721
tagaactgaaattcttgattcaacgagtatagactgctagtcaaagccagtccccctacacacacacacacacacacacacacacatacacttctttgctggcagagacacattttgttccattgtttaccctgcgttctaccatgtgctcagagtgaggagcctctccccaacaaggaagagaaaggagaatcctgatagtctaa

SEQ ID NO: 19107 - DNA, 127 bp, Homo sapiens
  DISD22_0008685
  Located on chromosome 12
  Distance between a terminus base of telomere on chromosomal short arm and 5'-terminus of this base sequence : 96914400
  Distance between 3'-terminus of neighbour sequence of sequence listing upward to telomere on chrosomal short arm and 5'-terminus of this base sequence : 133230
cctcttcaagattaactgcaatctacacacacacacacacacacacacacacacacacacagagaaagagagagagaacttaatttaagaatgagatacctttagagacctaaatgaatgaacacaa

SEQ ID NO: 19108 - DNA, 326 bp, Homo sapiens
  chr12.fa.O7frz.102564908
  Located on chromosome 12
  Distance between a terminus base of telomere on chromosomal short arm and 5'-terminus of this base sequence : 97052927
  Distance between 3'-terminus of neighbour sequence of sequence listing upward to telomere on chrosomal short arm and 5'-terminus of this base sequence : 138400
tctgctagtgcaagctatttacatgcacttactctgcactttgcacacattattccccttgtggtattaccccctgtgaggtctagacctgtgctatccagtactgaatgaataagatattccacaaatacatatactatatataggtgtctatctatctatctatctatctatctatctatctatctatctgtctatctatagtctctccatattacctataatgtatattatatatatgtaacttaaaactctagatatgcagctaaaaaatgaactggctatagtctttgccctttttagtatttaactaaagacctgccttt

SEQ ID NO: 19109 - DNA, 441 bp, Homo sapiens
  chr12.fa.O7frz.102386478
  Located on chromosome 12
  Distance between a terminus base of telomere on chromosomal short arm and 5'-terminus of this base sequence : 97191435
  Distance between 3'-terminus of neighbour sequence of sequence listing upward to telomere on chrosomal short arm and 5'-terminus of this base sequence : 138182
aatctattgagcaatagaagtgacagacaaggtccctgctctcttttagcttacaagtctagtggaataataatagcgaacatttactgagcgttagcacacgccgggcactatgctccctgtccttcatgcatttatctcatcagggttctagcccaaactctacctctagccaaccagttatgtgaacttgaaaggttcactttatttatttgttttatttatttatttatttatttatttatttgtgagagatggagttttgctctgtcgcccaggctggagtgcagtggcgtgatctggactcactgcaacctctgcctcccagtttcaagcatttctcctggctcagcttcccaagtagctgggactacaagcatgcaccaccacacccagctaaattttttgtattttttagtagagacaggatttcactgtatg

SEQ ID NO: 19110 - DNA, 428 bp, Homo sapiens
  AC008128.12_115918
  Located on chromosome 12
  Distance between a terminus base of telomere on chromosomal short arm and 5'-terminus of this base sequence : 97257720
  Distance between 3'-terminus of neighbour sequence of sequence listing upward to telomere on chrosomal short arm and 5'-terminus of this base sequence : 65844
tttggacaccttaacatgtaagtcaggccgggtgtggtagctcatgcctgtaatcccagcactttgggaggccgaggcgggcggatcatgaggtcaggggttcgagaccagcctgaccaacatggtgaaaccccgtctctactaaaaatacaaaaattagctgggcgtggtggtgggcgcctgtaatcccagctactcaggaggctgaggcaggagaattgcttgaacccgggaggcagagattgcagtgagccgagatcgcgccactgcactccagcctgggcgacagagcgagactcgtctcaaaaaacaaaacaaaacaaaacaaaacaaaacaaaaaacccattattttcacaagtagatacattggggggtgagaagttgtaataactattccacaaaaaagtcactttcatgccatctataa

SEQ ID NO: 19111 - DNA, 379 bp, Homo sapiens
  AC018475.11_11727
  Located on chromosome 12
  Distance between a terminus base of telomere on chromosomal short arm and 5'-terminus of this base sequence : 97351876
  Distance between 3'-terminus of neighbour sequence of sequence listing upward to telomere on chrosomal short arm and 5'-terminus of this base sequence : 93728
taagctccagatagagaaggactggccgggcgcggtggcacatgcctgtaatctcagcactttgggaggccgaggtaggcagatcacttgaagtcaggagtttgagaccagcctggccaatacggtgaaacctcatttctactaaaaatacaaaaattagctgggcgagctggcacatgcctgtagtcccagctactcgggtggctgaggcaggagaatcgcttgagcctgggaggcggagattgcagtgagctaagattgcgccactgcactccagcctgggtgacagagctagactctatctcaaaaataaataaataaataaataaataaaagagagaaggactctgttgtcctctctttgtaatccatgtagtgc

SEQ ID NO: 19112 - DNA, 382 bp, Homo sapiens
  AC027568.2_37598
  Located on chromosome 12
  Distance between a terminus base of telomere on chromosomal short arm and 5'-terminus of this base sequence : 97351876
  Distance between 3'-terminus of neighbour sequence of sequence listing upward to telomere on chrosomal short arm and 5'-terminus of this base sequence : -379
taagctccagatagagaaggactggccgggcgcggtggcacatgcctgtaatctcagcactttgggaggccgaggtaggcagatcacttgaagtcaggagtttgagaccagcctggccaatacggtgaaacctcatttctactaaaaatacaaaaattagctgggcgagctggcacatgcctgtagtcccagctactcgggtggctgaggcaggagaatcgcttgagcctgggaggcggagattgcagtgagctaagattgcgccactgcactccagcctgggtgacagagctagactctatctcaaaaataaataaataaataaataaataaaagagagaaggactctgttgtcctctctttgtaatccatgtagtgcagt

SEQ ID NO: 19113 - DNA, 161 bp, Homo sapiens
  chr12.fa.O7frz.102059113
  Located on chromosome 12
  Distance between a terminus base of telomere on chromosomal short arm and 5'-terminus of this base sequence : 97457526
  Distance between 3'-terminus of neighbour sequence of sequence listing upward to telomere on chrosomal short arm and 5'-terminus of this base sequence : 105268
ctaactcatccactgatttcaccgtagtaatgcagattatttcctgacatttcaatacacagatacacacacacacacaccacacacacacacacacacacatctattttcagttttcaaaatattcatcactgtcactacgaacaatgaacaactagtct

SEQ ID NO: 19114 - DNA, 170 bp, Homo sapiens
  chr12.fa.O7frz.101929172
  Located on chromosome 12
  Distance between a terminus base of telomere on chromosomal short arm and 5'-terminus of this base sequence : 97569511
  Distance between 3'-terminus of neighbour sequence of sequence listing upward to telomere on chrosomal short arm and 5'-terminus of this base sequence : 111824
taaattgcagtattttgtccagctgtgttactttggtctcatttcctgccaaagcagataaatgatattttattttattttattttattttattttattttattttttgggaaatggagtctcactgtgtcgcccaggctggtgtgcagtggtgcaatcttggcttattg

SEQ ID NO: 19115 - DNA, 174 bp, Homo sapiens
  AC007298.17_109977
  Located on chromosome 12
  Distance between a terminus base of telomere on chromosomal short arm and 5'-terminus of this base sequence : 97758660
  Distance between 3'-terminus of neighbour sequence of sequence listing upward to telomere on chrosomal short arm and 5'-terminus of this base sequence : 188979
cttctaagcaccgtgattctaaatgcctgccgtggaacagaagctcattcgcacatggctctttaacccttccttgaaagacctcaattcaacattctctctctcgctcacacacacacacacacacacacaaatgcacactcacacacagtacctacaacctgatccaagata

SEQ ID NO: 19116 - DNA, 136 bp, Homo sapiens
  D12S309
  Located on chromosome 12
  Distance between a terminus base of telomere on chromosomal short arm and 5'-terminus of this base sequence : 97758701
  Distance between 3'-terminus of neighbour sequence of sequence listing upward to telomere on chrosomal short arm and 5'-terminus of this base sequence : -133
agctcattcgcacatggctctttaacccttccttgaaagacctcaattcaacattctctctctcgctcacacacacacacacacacacacaaatgcacactcacacacagtacctacaacctgatccaagatagga

SEQ ID NO: 19117 - DNA, 155 bp, Homo sapiens
  Z23489.1_68
  Located on chromosome 12
  Distance between a terminus base of telomere on chromosomal short arm and 5'-terminus of this base sequence : 97758706
  Distance between 3'-terminus of neighbour sequence of sequence listing upward to telomere on chrosomal short arm and 5'-terminus of this base sequence : -131
attcgcacatggctctttaacccttccttgaaagacctcaattcaacattctctctctcgctcacacacacacacacacacacacaaatgcacactcacacacagtacctacaacctgatccaagataggaaacaaaatgacagtatgcggcatt

SEQ ID NO: 19118 - DNA, 391 bp, Homo sapiens
  HUMUT930B
  Located on chromosome 12
  Distance between a terminus base of telomere on chromosomal short arm and 5'-terminus of this base sequence : 97776366
  Distance between 3'-terminus of neighbour sequence of sequence listing upward to telomere on chrosomal short arm and 5'-terminus of this base sequence : 17505
ctttcccttcatcttctgccatgattgtaagtttcctgaggcctccccaaccatgtttcctgtacaacctgtggaaacactagccaattaaacctcttttctttataaattacccagtctcaggtatttctttatagtaatgcaagaacagactaatacatatatccacatatatatagtcagctcaggctgctataacaaataccatatacaggtggcttaaacagcaggctcttccttccttccttcctttcttccttcctttctttcttccttccttcccttcccttctatccttccttccttcttctttctttctctctctctctctttcttttccttctttctttctttctttctctttctttttttttgatggagtctagctctg

SEQ ID NO: 19119 - DNA, 293 bp, Homo sapiens
  D12S348
  Located on chromosome 12
  Distance between a terminus base of telomere on chromosomal short arm and 5'-terminus of this base sequence : 97844198
  Distance between 3'-terminus of neighbour sequence of sequence listing upward to telomere on chrosomal short arm and 5'-terminus of this base sequence : 67441
cactactgcactccagcctgggtgacagagcaagaccctgtctcaaaaaacaaaaacaaaccaacaaacaaaacaaacaaacaaaaaacaaaaaccagatctgctcctggaatcaaaacagaaactattaattattaaaaatgattaatccaaacccctttgtgtgatgtgatgtgatgtgatgtgtgtgtgtgtgtgtgtgtgtgtgtgtgtgttattactcgtattataaggctcctgctttgggttgctgcccatttacttgaggtaagaattgccatacaacgtgaaaa

SEQ ID NO: 19120 - DNA, 360 bp, Homo sapiens
  AC008149.14_78714
  Located on chromosome 12
  Distance between a terminus base of telomere on chromosomal short arm and 5'-terminus of this base sequence : 97886679
  Distance between 3'-terminus of neighbour sequence of sequence listing upward to telomere on chrosomal short arm and 5'-terminus of this base sequence : 42188
tctatcagtggagtttccaaactttgaagttggtgttttaaattgatttttagctcaagattgctgttgttcatagccactttgaattgaggtcattcagccttttgattgaaaccatggcagtgagaccatgaaaactctagttttgccacttatagagcagccccagtaaataaaattagctgtgtgtgtgtgtgtgtgtgtgtgtgtgtgtgtgaccttctgtgaaattctaaatgtcttcaaaaatggtagattactcagtcttttaaataactattctgtgcagaaattcaactccccatggttcctgcctgaaaccaaaataaaaattgcctttcatccattactggagattta

SEQ ID NO: 19121 - DNA, 327 bp, Homo sapiens
  AC008149.14_66702
  Located on chromosome 12
  Distance between a terminus base of telomere on chromosomal short arm and 5'-terminus of this base sequence : 97898798
  Distance between 3'-terminus of neighbour sequence of sequence listing upward to telomere on chrosomal short arm and 5'-terminus of this base sequence : 11759
ttagattgtcagaaaggtccatggaccaaatatgtgaagaggaaactgccctggggatgtcattgtgtgtttgtgtgtgtgtgtgtgtgtgtgtgtgtgtgtgtgtgtgtatcagttttatgtatgtgaatatattttaggttgaatatatgagattgctggtatttaactagttttgatctctaaaaagaataatttcttacagttcaacttaatagttgtgatattatgaaacaatttgaaatatatcacaatgtgatatttataatgaaatatgattgtagcttatttttgtacgttatttatcaaagcctagcaagttaaaat

SEQ ID NO: 19122 - DNA, 326 bp, Homo sapiens
  AC008149.14_36769
  Located on chromosome 12
  Distance between a terminus base of telomere on chromosomal short arm and 5'-terminus of this base sequence : 97928686
  Distance between 3'-terminus of neighbour sequence of sequence listing upward to telomere on chrosomal short arm and 5'-terminus of this base sequence : 29561
attacctagcactgcatatgctttttttaaattacaaaacttatcgaaatatttctcatctatctactatttgagattatttacacagactccttcctcttcaaagggcacagtggagcgtttgtgtgtgtgtgtgtgtgtgtgtgtgtgtgtgtacatatgtaaacacactgtggacagccataccttttcttataggtaggtatgcctgtaacctgtcagggtaacagacagcactgaaatggaaatggaaatatgacctgctctcttggcattttctatgcagttaaagtgaaataattgagggatcctgtcacgagatcctg

SEQ ID NO: 19123 - DNA, 254 bp, Homo sapiens
  G09612
  Located on chromosome 12
  Distance between a terminus base of telomere on chromosomal short arm and 5'-terminus of this base sequence : 98056240
  Distance between 3'-terminus of neighbour sequence of sequence listing upward to telomere on chrosomal short arm and 5'-terminus of this base sequence : 127228
gcactttcatgttgagtctccaattttttgcatgtaacaagtaatcttttgctatccccagtgcaggaatgaaatatttatatctcagatagatataaattggggattgatatagatagatagatagatagatagatagatagatagatcttattaaaattcttgctgaaatttatttcatgcagccagatgacttacatttagcacaatctcagactttgctgtccctcttaatgcatgctccaaaatatcct

SEQ ID NO: 19124 - DNA, 250 bp, Homo sapiens
  AC007115.1_74911
  Located on chromosome 12
  Distance between a terminus base of telomere on chromosomal short arm and 5'-terminus of this base sequence : 98090451
  Distance between 3'-terminus of neighbour sequence of sequence listing upward to telomere on chrosomal short arm and 5'-terminus of this base sequence : 33957
agtggtccgtgactactcaagatggcttgccaattaaaggaaaaaaaaaaacaaacatacacatgtgaacacacacacacacacacacacacacgcaaacacacatgccaaaacaaaaaagccaatatgttttaaaagtacaatcaatcaacaggcccctgtgtgtgatgttcccctccctgaatccatgtgtcagaggttgaggggcgaggggagggagaacattaggacaaatacctaatgcatgtgg

SEQ ID NO: 19125 - DNA, 360 bp, Homo sapiens
  AC007115.1_119677
  Located on chromosome 12
  Distance between a terminus base of telomere on chromosomal short arm and 5'-terminus of this base sequence : 98135165
  Distance between 3'-terminus of neighbour sequence of sequence listing upward to telomere on chrosomal short arm and 5'-terminus of this base sequence : 44464
tagaatagtttctggcactcacttaggagttatttgttagatttgtagacatttatggtactaaaggtactgggatattatttatatctctcaggatttctaatctcttaaggaactctttctcctctcctctcctctcctctcctctcctgtcctctcctgtcccctcatcctccccttccagcctcctcctctctcattctcctcttcctttctcctacttttccctcccttctccgtctccttctcctcctctcctccctgcacttcccttccctcctctcctcatcatctgtcttctctgtctcctgtctctctctttctctttctcacaaaagctacatttgcttgttagtttgc

SEQ ID NO: 19126 - DNA, 354 bp, Homo sapiens
  D12S1046
  Located on chromosome 12
  Distance between a terminus base of telomere on chromosomal short arm and 5'-terminus of this base sequence : 98529987
  Distance between 3'-terminus of neighbour sequence of sequence listing upward to telomere on chrosomal short arm and 5'-terminus of this base sequence : 394462
ccataacactatttctcctgggaatccagttttggggggtgctttcagaggttgaagaatttactgtccacaactgaaagtatgtcagagaggtagaagtgtttccagctttgaaaagtatgtgatttattattattattattattattattattataaaatcagcttagcaatgcctgtaaaagaaatgatgaggaggaggcagagaatatggaaacaaagccaatttttgaagttctaattcaattctctgactctccagaaaaaaaaatgcaaatttaaggtgtaaaatatccagctaacacaatgaatacaggatcttccttgcacttgcatgttttccctctccactcc

SEQ ID NO: 19127 - DNA, 162 bp, Homo sapiens
  D12S351
  Located on chromosome 12
  Distance between a terminus base of telomere on chromosomal short arm and 5'-terminus of this base sequence : 98585701
  Distance between 3'-terminus of neighbour sequence of sequence listing upward to telomere on chrosomal short arm and 5'-terminus of this base sequence : 55360
gtgcatctgtatgtgcgtgtgtgtgtgtgtgtgtgtgtgtgtgtgttttagtctcaggattacatctttatcttgtccagcagtttaaaataatcttaatttcctggaaggtgtttggagtttattatgtgccaggatgctgagatattgagtttagagcaa

SEQ ID NO: 19128 - DNA, 458 bp, Homo sapiens
  AC013479.3_216273
  Located on chromosome 12
  Distance between a terminus base of telomere on chromosomal short arm and 5'-terminus of this base sequence : 98808149
  Distance between 3'-terminus of neighbour sequence of sequence listing upward to telomere on chrosomal short arm and 5'-terminus of this base sequence : 222286
ttcagattgagaatcaactgactattcaaattgtaaaagagcagaagtgttttggatagtctccacaaaaatacaaaaattagctgggcctggtggcacacgcctgtaatcccagcctgaggcaggagaatcgcttaaacccaggaagtggaggtcacagtgagccaagattgcaccactgcactccagcctggacgacagagcaagactcggtctcaaataaataaataaataaataaataaataaataaataaataaataaaggatgttatgcaatgtgatatgtagaatacataatcttgtcctaaaaatatagtataacaaatgtagaataaccaatggtgttaggttgtttgtttttcactttactcctttttcttgtgacagcatttccagtttgccttggagcactattggagacgatcccggtgctccaagaaccaaggtacttcgttag

SEQ ID NO: 19129 - DNA, 203 bp, Homo sapiens
  chr12.fa.O7frz.103349999
  Located on chromosome 12
  Distance between a terminus base of telomere on chromosomal short arm and 5'-terminus of this base sequence : 99055443
  Distance between 3'-terminus of neighbour sequence of sequence listing upward to telomere on chrosomal short arm and 5'-terminus of this base sequence : 246836
gttagccatcttcaagtttctaataacagctagaataatgacccccatttgttgagttcctacttaatatgctagatatatatatatatatatatatatatatatatatatatatatatatatatatttagttaaaatgatttttacaacaacagtatattacaaattgtaaaactgaagtttagctagtggtcacataggta

SEQ ID NO: 19130 - DNA, 205 bp, Homo sapiens
  D12S1716
  Located on chromosome 12
  Distance between a terminus base of telomere on chromosomal short arm and 5'-terminus of this base sequence : 99153032
  Distance between 3'-terminus of neighbour sequence of sequence listing upward to telomere on chrosomal short arm and 5'-terminus of this base sequence : 97386
gcctgccctcaagtaggtttttaatttgaatttacactacttgggttacttaagaaccttcctgagcctgcgattcttgaatgggtatgtgtgtgtgtgtgtgtgtgtgtgtgtgtgtgtgtgtgtctgtatgtatatatagtataaaattgtttatattctaggaatgccaggatgatttaacactagaaatacataatgcaat

SEQ ID NO: 19131 - DNA, 311 bp, Homo sapiens
  AC007564.9_114795
  Located on chromosome 12
  Distance between a terminus base of telomere on chromosomal short arm and 5'-terminus of this base sequence : 99434778
  Distance between 3'-terminus of neighbour sequence of sequence listing upward to telomere on chrosomal short arm and 5'-terminus of this base sequence : 281541
ttcatattggttcacatgatacagataaatttgcctaatcaattacacacgcgtacgtgtgtgtgtgtgtgtgtgtgtgtgtgtgtgtgtgtgatttgaatgaactagagtcatacagaatcagtatggagaggaggttcctaggagcagatcatgatttgaaagtggaaaatgttatcctaggtcaagatatcagatgtattatataaggagattgcaaagcagtttttcttggctgcttgggtttggtaggattttcttttttagttcaagatttttagccagacctagcatagtgcctgataaacaat

SEQ ID NO: 19132 - DNA, 292 bp, Homo sapiens
  AC007564.9_48491
  Located on chromosome 12
  Distance between a terminus base of telomere on chromosomal short arm and 5'-terminus of this base sequence : 99501065
  Distance between 3'-terminus of neighbour sequence of sequence listing upward to telomere on chrosomal short arm and 5'-terminus of this base sequence : 65976
tcatgaattaagctccaaatctactgtttcccggttctgtaacctcttctcaatacaattagacatgtgaggggtgtgtgtgtgtgtgtgtgtgtgtgtgtgtgtgtgtgactcttcttcctgatgatagcactactggaatctttcgacctgctgcttgccctggttgctctttgggccccgtgctcacctgtcatcctgggatttttctttacctttctgagactggatgtcctgtcttcctgttttggtttactcctttgtttcggtgtatcagttcctcaagtagctt

SEQ ID NO: 19133 - DNA, 477 bp, Homo sapiens
  AC007564.9_24509
  Located on chromosome 12
  Distance between a terminus base of telomere on chromosomal short arm and 5'-terminus of this base sequence : 99524905
  Distance between 3'-terminus of neighbour sequence of sequence listing upward to telomere on chrosomal short arm and 5'-terminus of this base sequence : 23548
gtccatgttgaatgatgttaagtatatttttatatgcctcttgtgaagtgactgttcaagtctgttgcccatttttatgttgggttattcgtgtttttaaaatttatttataatttcttatgtattgcaggtagattcattttggggatatgcatgttgcaaatatcttccttcagccatggcttgctgttttactccttaatacctgtttgtgtgtgtgtgtgtgtgtgtgtgtgtgtgtgtgtgtgtgtgaaactgtatgcctgtttgcgtgtgtgtgtgtgttttagtgaacagaagttcttaaatttaatgaagtctcatatgtcagtcttttcttttatgtttgttgctttttgtgttctcttgaagaatcttgcctgccccaagattttgaagatactattctgtgttttcttttagaagctttgttgttttatctttcttatttatgtttgttatgatccatttcaagtt

SEQ ID NO: 19134 - DNA, 367 bp, Homo sapiens
  AC013417.4_28725
  Located on chromosome 12
  Distance between a terminus base of telomere on chromosomal short arm and 5'-terminus of this base sequence : 99578014
  Distance between 3'-terminus of neighbour sequence of sequence listing upward to telomere on chrosomal short arm and 5'-terminus of this base sequence : 52632
gattcaatgtttctcagaccagtgtgtgggccattttgagctggacaaattatcaggtttgtagcatttcttagctgtagtaagatactaaatgcaagaaattttttcttatatataaatatatatggatagataagatagatatctatcatatgtgtgtgtgtgtctgtatgtctgtgtgtgtgtgtgtgtgtgtgcgtgtgtgcatttctctttcaaatttcaagagtcttttccaaatttggggattatgccatactttattagtcaatgttttaagtaagttacatagacttctatctgtacctttttagattttaatgcaaaaaattatgtgattatagggttagaaggcaacttacggatc

SEQ ID NO: 19135 - DNA, 479 bp, Homo sapiens
  AC007656.2_69258
  Located on chromosome 12
  Distance between a terminus base of telomere on chromosomal short arm and 5'-terminus of this base sequence : 99673132
  Distance between 3'-terminus of neighbour sequence of sequence listing upward to telomere on chrosomal short arm and 5'-terminus of this base sequence : 94751
gttgctttccaaatagtttatcatttctcttttgatttctattttggtccaaaaattttttctattttggtccaaaaattttctaagtgttcaaatttcctaatagttataatgttttgggggcaactttttatttctaattgtatcagtttataattggagaatgtagcatgtgtttttaaagtatattacagattttctctatggttaactatgtgattagttttataaatgaaccatgggccatttccctgtctcactgagggcaagcaagcatgtgtgcacacacacacacacacacacacacacacacacgcatgtatattttctatttgagaattaaaatgttcaatatagatggtatttgcttgctagagctgccatagcaaaacaccacagaccgggtgattttaacaacagaaatttattttcacagttatgaaaactgggagtccaagatcaagatgtcaacaggtttg

SEQ ID NO: 19136 - DNA, 178 bp, Homo sapiens
  AC007656.2_89506
  Located on chromosome 12
  Distance between a terminus base of telomere on chromosomal short arm and 5'-terminus of this base sequence : 99693551
  Distance between 3'-terminus of neighbour sequence of sequence listing upward to telomere on chrosomal short arm and 5'-terminus of this base sequence : 19940
tgctaaatcatttatgtattgcatttatgcatttatgcataaagacatgaatggaagcaccagatcctataattgcatttctttgtttctcattcttgaagacacttgtttacacacacacacacacacacacacacacactatgcaaaacactttgttgaacataaagctccattgt

SEQ ID NO: 19137 - DNA, 275 bp, Homo sapiens
  D12S1051
  Located on chromosome 12
  Distance between a terminus base of telomere on chromosomal short arm and 5'-terminus of this base sequence : 99777316
  Distance between 3'-terminus of neighbour sequence of sequence listing upward to telomere on chrosomal short arm and 5'-terminus of this base sequence : 83587
ctatccatctacctcttctgtcggtctatcatctatctatcttccatatttatctttatttgtttatttatctttatctatttgtctatgtgtaactcaggacttgttaggacttcttctatatctatctgtctgtctatgttcatctatctatctctattatctatctgtctgtctatctatctatctatccatctatctatctatctatctatctatctatctatctatctatctatctactctatctggagagtagttgagcagttacagat

SEQ ID NO: 19138 - DNA, 474 bp, Homo sapiens
  AC007437.16_104519
  Located on chromosome 12
  Distance between a terminus base of telomere on chromosomal short arm and 5'-terminus of this base sequence : 99853096
  Distance between 3'-terminus of neighbour sequence of sequence listing upward to telomere on chrosomal short arm and 5'-terminus of this base sequence : 75505
actcaagcatgaggaaatataagtccatttatacatgcatcaaatgagggtttcattgagactttctatatgatgatatctatatgaccctgtctatatgataaatatctgtattgatctaggggaaagaaaaagatgtggtttatgagaaccacttcttttacttcactaagaagcagagttacagagaggggtgtgtgtgtgtgtgtgtgtgtgtgtgtttgttgggaatgggggaggaggaacagagaccaaagccttatagagacattggccagtttgtctcttcattacaaaaatatttgttttaagtattgaagaaatgatggtgacagggtctctgctgtcattctcattttattgagttgacagtgtgaaaagataataaatcttgagacccccaaatcactaagctaaagggaaaagtcaagctgagaactgcttagggcaaacttccattctattcagtcatcg

SEQ ID NO: 19139 - DNA, 243 bp, Homo sapiens
  AC007437.16_118306
  Located on chromosome 12
  Distance between a terminus base of telomere on chromosomal short arm and 5'-terminus of this base sequence : 99866978
  Distance between 3'-terminus of neighbour sequence of sequence listing upward to telomere on chrosomal short arm and 5'-terminus of this base sequence : 13408
actcaagttccaatgttagtgaaccaccaaggggagtgtgggaggagctataatcaaaagcgttttccaaactcttttactcttttgatgatgaaatcgtgtgtgtgtgtgtgtgtgtgtgtgtgtgtattatgcatgcacaccatctttagaactagcgccctccccaacacacttgggcaaataccagtgttaacaagtaacacgttttcaataaaggtcatagcatatcaggaactcatt

SEQ ID NO: 19140 - DNA, 150 bp, Homo sapiens
  D12S1657
  Located on chromosome 12
  Distance between a terminus base of telomere on chromosomal short arm and 5'-terminus of this base sequence : 99866982
  Distance between 3'-terminus of neighbour sequence of sequence listing upward to telomere on chrosomal short arm and 5'-terminus of this base sequence : -239
aagttccaatgttagtgaaccaccaaggggagtgtgggaggagctataatcaaaagcgttttccaaactcttttactcttttgatgatgaaatcgtgtgtgtgtgtgtgtgtgtgtgtgtgtgtattatgcatgcacaccatctttagaa

SEQ ID NO: 19141 - DNA, 443 bp, Homo sapiens
  chr12.fa.O7frz.104403821
  Located on chromosome 12
  Distance between a terminus base of telomere on chromosomal short arm and 5'-terminus of this base sequence : 100142172
  Distance between 3'-terminus of neighbour sequence of sequence listing upward to telomere on chrosomal short arm and 5'-terminus of this base sequence : 275040
tggcactcattaatttacttaaacttctaagcagtaaaatttccaatcactgtgagtgtatccatagattagatagataaatagatagagagatagatagatatagatatagatatagatatagatatagatatagatagatacacaagtcctttttgtcccaggtgtatatatatatatatatgtgtgttttgtacacatatatcatttatgtaaggacaaaattaaatatctggcttactggaagtatatagtacatacacttctggctttcttattttctaacaatttctaacagttatacaacacttcatagctcaaaaataactctatacacattaccatatttgattttcacagcagcaagacaagacaagtaatattgcattcattttctataaagtacacggagatgttaagtgatttacctggtattacttcag

SEQ ID NO: 19142 - DNA, 148 bp, Homo sapiens
  HUMUT2299
  Located on chromosome 12
  Distance between a terminus base of telomere on chromosomal short arm and 5'-terminus of this base sequence : 100236971
  Distance between 3'-terminus of neighbour sequence of sequence listing upward to telomere on chrosomal short arm and 5'-terminus of this base sequence : 94356
gttcctccattcttccatctattcatctatccatccatttatctacatatccatccatccatccatccatccatccatccatccattactcaataaatatctattgaatgtctcccatgggccaggcactgtgctaagtgctgaggtt

SEQ ID NO: 19143 - DNA, 332 bp, Homo sapiens
  AC007424.28_146011
  Located on chromosome 12
  Distance between a terminus base of telomere on chromosomal short arm and 5'-terminus of this base sequence : 100269438
  Distance between 3'-terminus of neighbour sequence of sequence listing upward to telomere on chrosomal short arm and 5'-terminus of this base sequence : 32319
aggaaacctccagaaacttagatggggaggattttcttcttgacctcctcttctcattttctcaatgctaccatttagcaaataaaaatggttacttttggggtttcgttgttgttgttgttgttgttgttgttgttgttgttgcttaatccttggaaaatgtaggcatgctcagagaagatccttggagcccagactgcttctggttaggttagcagagggaattgcaaatattttaaaaatgcaatcatggcatttttattttaaaaagtagatttaaaaaaactatttcagctgctagcctcatcttctaacgtatttcattataagca

SEQ ID NO: 19144 - DNA, 335 bp, Homo sapiens
  AC018659.15_133518
  Located on chromosome 12
  Distance between a terminus base of telomere on chromosomal short arm and 5'-terminus of this base sequence : 100269438
  Distance between 3'-terminus of neighbour sequence of sequence listing upward to telomere on chrosomal short arm and 5'-terminus of this base sequence : -332
aggaaacctccagaaacttagatggggaggattttcttcttgacctcctcttctcattttctcaatgctaccatttagcaaataaaaatggttacttttggggtttcgttgttgttgttgttgttgttgttgttgttgttgttgcttaatccttggaaaatgtaggcatgctcagagaagatccttggagcccagactgcttctggttaggttagcagagggaattgcaaatattttaaaaatgcaatcatggcatttttattttaaaaagtagatttaaaaaaactatttcagctgctagcctcatcttctaacgtatttcattataagcaatg

SEQ ID NO: 19145 - DNA, 401 bp, Homo sapiens
  chr12.fa.O7frz.104630135
  Located on chromosome 12
  Distance between a terminus base of telomere on chromosomal short arm and 5'-terminus of this base sequence : 100395459
  Distance between 3'-terminus of neighbour sequence of sequence listing upward to telomere on chrosomal short arm and 5'-terminus of this base sequence : 125686
tttactccataaagctctgagaccccaaagtactagaaatatatgtacatacatacatacatacatatcggggggtatgcatgtaactgtgtgtatgtaggtattgtgtgtgtgtttgtgtgtgtgtgtgtgtgtgtgtgtacttcctcaagacttttggatttttatcattaattcacagaactgtcaaaaggttgctctctatgtaggcctaaattaaattaagaaaatgttgaaacaatgatcaataaataaaaacctatttttaatggattttgtattgttttacatttctatttttaaaatgtttctctgaaatgtctataacaattcaaaatgataatttattttaaattaatatatcttgttcatagatactgtactataggtctaatttgcaa

SEQ ID NO: 19146 - DNA, 382 bp, Homo sapiens
  chr12.fa.O7frz.104757770
  Located on chromosome 12
  Distance between a terminus base of telomere on chromosomal short arm and 5'-terminus of this base sequence : 100525848
  Distance between 3'-terminus of neighbour sequence of sequence listing upward to telomere on chrosomal short arm and 5'-terminus of this base sequence : 129988
tactattggtgatggaaatgacatatttttgtccttaatatttattacgtctattaaagaaaatgcaatgtgtctataatgggttaagtaatttatataaaattttctctaatactcaaaacaacccccaaaggaatatatttatttaaatatatatatttgactatatattgattacatgtatatatacccattatatatatgtacatatatacacacatatatacatattgatcgtgtagctatatatatatatatatatacacacacacacacatacatacacacaccccatcaatgtgtgcctgaaactagtattcaagctttcaaattacagatgaggaaactgaatgaattgatgttacttgctgaggtttactca

SEQ ID NO: 19147 - DNA, 154 bp, Homo sapiens
  D12S1671
  Located on chromosome 12
  Distance between a terminus base of telomere on chromosomal short arm and 5'-terminus of this base sequence : 100647038
  Distance between 3'-terminus of neighbour sequence of sequence listing upward to telomere on chrosomal short arm and 5'-terminus of this base sequence : 120808
ctctgagatttagaccagaaagcactaaatagaacaacgaattctttctctctctctctctctctctctctctctctctctcacacacacacacacacacacacacacacacagcttgggaggactgtgtgaggacacccatgtactatgccta

SEQ ID NO: 19148 - DNA, 355 bp, Homo sapiens
  AC007297.22_151892
  Located on chromosome 12
  Distance between a terminus base of telomere on chromosomal short arm and 5'-terminus of this base sequence : 100727597
  Distance between 3'-terminus of neighbour sequence of sequence listing upward to telomere on chrosomal short arm and 5'-terminus of this base sequence : 80405
tgttcaaagatttgttagtcacagatcctgggcagagagggcaccatgagtcagaagggcagtcctctgtccccaggtcacatgaggtgggaaggaagaatcaaggggggacagagagagagagagagagagagagacggacagacagacagacagacagacaactagcagtatatataatcacatgggtgattttaagtttatgagcaaatgcctgaatgatccttttaaaggatgaaatggtaaaagtgaggagcccggcctgctagtcagaaaagacacctctaagttcttacctctggcaaatggcttgagctacttggagtgtggtatagaactggaaactgtcaagact

SEQ ID NO: 19149 - DNA, 249 bp, Homo sapiens
  G08924
  Located on chromosome 12
  Distance between a terminus base of telomere on chromosomal short arm and 5'-terminus of this base sequence : 100733328
  Distance between 3'-terminus of neighbour sequence of sequence listing upward to telomere on chrosomal short arm and 5'-terminus of this base sequence : 5376
cctcacacaatgttgtaagggttataactagatagatagatagatagatagatagatagatagatagatagatagagtatatcttagaataatatgagctatttttatcacggatgttacatttcattcttataacattgaagatagactttgctgcacccattttacaaatgagaaatctgagtctcagagagacattgagaggaattgcattaacttcctcaagtcgtttaatgtcctggcattaat

SEQ ID NO: 19150 - DNA, 121 bp, Homo sapiens
  G10068
  Located on chromosome 12
  Distance between a terminus base of telomere on chromosomal short arm and 5'-terminus of this base sequence : 100733328
  Distance between 3'-terminus of neighbour sequence of sequence listing upward to telomere on chrosomal short arm and 5'-terminus of this base sequence : -249
cctcacacaatgttgtaagggttataactagatagatagatagatagatagatagatagatagatagatagatagagtatatcttagaataatatgagctatttttatcacggatgttaca

SEQ ID NO: 19151 - DNA, 372 bp, Homo sapiens
  AC027232.3_41209
  Located on chromosome 12
  Distance between a terminus base of telomere on chromosomal short arm and 5'-terminus of this base sequence : 100849348
  Distance between 3'-terminus of neighbour sequence of sequence listing upward to telomere on chrosomal short arm and 5'-terminus of this base sequence : 115899
cacgtaaactacgtcaagttagtcctccaagtcttaattgaacctggaatctctgaatagataacccaccctccttcaaccctagtaaatttttactcttcacgtcctccctacttacacagacaaagttaatcacctccattttcaagcttgcctagtcttttattcaaaccaaccaacttaacatttgtcttattgttggctagttggttggttggttggttggttggatggtcggttggttgggtcagttggttatatgcaaatctgtttcctttgcttatttgtggctgttagaatgcatgagcctctgttttaccattgtttatatgcactgtgcttgtaacagtgtaggtactctatcgatcctcg

SEQ ID NO: 19152 - DNA, 274 bp, Homo sapiens
  AC008055.6_30609
  Located on chromosome 12
  Distance between a terminus base of telomere on chromosomal short arm and 5'-terminus of this base sequence : 100887784
  Distance between 3'-terminus of neighbour sequence of sequence listing upward to telomere on chrosomal short arm and 5'-terminus of this base sequence : 38064
ttcatgaaagctgcacataatcctcctcaatcccctgtagaatggggagggaaagtgcattttaaaataatcccattttggttatcccacctcaatgctattctctccccttctagaataaaagaaaataaaaaactaaagaggcattgcccctgaagaatgtgtgtgtgtgtgtgtgtgtgtgtgtgtgtgtgtgtgtgtgtgtgtgtgtgtgtgtatgcgtgcaataattctgagtttcaggaaaggcttctaggttgaagcaacttctgaa

SEQ ID NO: 19153 - DNA, 296 bp, Homo sapiens
  AC008055.6_71423
  Located on chromosome 12
  Distance between a terminus base of telomere on chromosomal short arm and 5'-terminus of this base sequence : 100928624
  Distance between 3'-terminus of neighbour sequence of sequence listing upward to telomere on chrosomal short arm and 5'-terminus of this base sequence : 40566
atcatgaccagcttcaatctaccaacataaagtcattgaatgctgagttgagaagagatacacatattggctccagcacaccagcaaaaaggaaacacacagagctctcgctccaatttctgttttagaaacagcacacacacacacacacacacacacacacacacacaacccatcacttcattcacagctcattggccagaattactggcatggctttgcctagctgcaacaggatccagaaggaagaaactggatattggtgagcacggcaatgttctccacaaagcactatc

SEQ ID NO: 19154 - DNA, 393 bp, Homo sapiens
  AC008055.6_116551
  Located on chromosome 12
  Distance between a terminus base of telomere on chromosomal short arm and 5'-terminus of this base sequence : 100973605
  Distance between 3'-terminus of neighbour sequence of sequence listing upward to telomere on chrosomal short arm and 5'-terminus of this base sequence : 44685
ctgtatctaaagttccagcactacatatattaatgcagtacctaataaaaataggactatagctagtgttacagaaagacagttgatcatgaccccatgctttaaatataattattaaaaatgtataggctgaagtctgaccagtctgcacatggtacagcagccttggatatgtgcaacacaggccagcatggggcccgaaaactgaaaacacagaaccaagatgccaacagaaggaaaggatccaaacagggccaggatgtttcccttaggtagatatgttatattatattatattatattatattatattatattatattaatatcttagtctagcagattggcaggaaatattagctttagactctggtgctacgctttgatcagtata

SEQ ID NO: 19155 - DNA, 121 bp, Homo sapiens
  D12S1706
  Located on chromosome 12
  Distance between a terminus base of telomere on chromosomal short arm and 5'-terminus of this base sequence : 101109215
  Distance between 3'-terminus of neighbour sequence of sequence listing upward to telomere on chrosomal short arm and 5'-terminus of this base sequence : 135217
cctatgatttcccatcaagtttttcaatttgttttaaaaccacagacacacacacacacacacacacacacacacacacacacaattgcacatcctcctctcccagggctctcctaataat

SEQ ID NO: 19156 - DNA, 284 bp, Homo sapiens
  AC013418.21_48042
  Located on chromosome 12
  Distance between a terminus base of telomere on chromosomal short arm and 5'-terminus of this base sequence : 101136282
  Distance between 3'-terminus of neighbour sequence of sequence listing upward to telomere on chrosomal short arm and 5'-terminus of this base sequence : 26946
agaaactgccatttgtttaatatctgcattaaaaaaattatcccttccatcagatgaaaaataccttataatttatgatggataatacattaattcgtagcacactagaaacaagggattccttaagacacatatgtggggtttttgttgttgttgttgttgttgttgttgttatttttattatctttaaggataatttgttgggtaggggtgagttgggagtcctgattggttgggtcggagacgagacacgtaagtttaagttctataatgaaacgctttca

SEQ ID NO: 19157 - DNA, 393 bp, Homo sapiens
  AC013418.21_139516
  Located on chromosome 12
  Distance between a terminus base of telomere on chromosomal short arm and 5'-terminus of this base sequence : 101204852
  Distance between 3'-terminus of neighbour sequence of sequence listing upward to telomere on chrosomal short arm and 5'-terminus of this base sequence : 68286
aacatagtgaaacctcatttctattttaaaaatatatacttttaaaatatataacattatacagacagatagagatagatagatagatagatagatagatagatagatagatagatagatagataattttttcttttgagacagagtctcactctgttacccagactggagtgcagtggcacgatctcagttcactgtaacctcctcttcccaggttcaagtgattctcttgcctcagcctcccgagtagctgggattacagacatatgtcaccacgcccagctaatttttgtattttttaggagagacggggttttgccattttggccaggctggtcttgaactcctgacctcaggtgatccgcctgcctatgataacaatgccttcttatg

SEQ ID NO: 19158 - DNA, 373 bp, Homo sapiens
  AC026112.10_195072
  Located on chromosome 12
  Distance between a terminus base of telomere on chromosomal short arm and 5'-terminus of this base sequence : 101279108
  Distance between 3'-terminus of neighbour sequence of sequence listing upward to telomere on chrosomal short arm and 5'-terminus of this base sequence : 73863
tggtgaattcatgtagtcctagctactcaggaggctgagtgggaggattgcttgaggtcaggagacaagaggctgcagtgaggcatgatcatgccactgcactccagcttgggcaacaaaataagaccctgtctcaaaacaacaacaacaacaacaacaacaacaacaacaaacacacagaattcataaactcttatttttgaggtgaccagctctgtggatctggatatccttcacgctaggcatttgaaactggggctaatgctgtgtgggtttactttaggttattatagtgtacttaaaaacatatattgatgagagattacacatataaacacaaatatttcaagtgtatactgtaatgccagaactc

SEQ ID NO: 19159 - DNA, 341 bp, Homo sapiens
  AC026112.10_55095
  Located on chromosome 12
  Distance between a terminus base of telomere on chromosomal short arm and 5'-terminus of this base sequence : 101341048
  Distance between 3'-terminus of neighbour sequence of sequence listing upward to telomere on chrosomal short arm and 5'-terminus of this base sequence : 61567
attctgtgactttgaacaagttacaggtttttctctcatatgtaaaatggagataacaatcctttgaaataagtgctgtttccatgaagattttatttatttatttatttatttatttttgagacagagtctcactatgttgccaaggctggagtgcagtggtgtgatcttggctcactgcaacctctgcctcccggattcaaacgattctcctgcctcagcctccaaagtagctgggattataggcgcccaccaccatgcctgtctagtttttatatttttaatggagatggggtttcgtcatgttggccaggctggtctcaaactcctgatttcaagtg

SEQ ID NO: 19160 - DNA, 332 bp, Homo sapiens
  AC011248.8_84442
  Located on chromosome 12
  Distance between a terminus base of telomere on chromosomal short arm and 5'-terminus of this base sequence : 101343384
  Distance between 3'-terminus of neighbour sequence of sequence listing upward to telomere on chrosomal short arm and 5'-terminus of this base sequence : 1995
cagagttgaccattccttaatactttcttgtgaagtggaggtctctctctctctctctctctctgagaagcagccccctaacttactgaagctagattagatctgtctgtattcgagagaactgtttgccccatatcataggatttgtcacactttatagtgattatctgtttacttggttttctctcatactagtccatgtgttctgaagtatagaatagtttggaggttaaaataacataccctggctctagactgcctgggtttgaatcccagctctgctattgattagttgtgtatcataaggggaaagttatttaacttcctttgcc

SEQ ID NO: 19161 - DNA, 309 bp, Homo sapiens
  chr12.fa.O7frz.105834332
  Located on chromosome 12
  Distance between a terminus base of telomere on chromosomal short arm and 5'-terminus of this base sequence : 101575843
  Distance between 3'-terminus of neighbour sequence of sequence listing upward to telomere on chrosomal short arm and 5'-terminus of this base sequence : 232127
cagtttcattgaggtagaattaacaagcaaaacatgtacacctgtatgtattcaaggtgtatgatatgttgttttgacatacatacacactgtgaaatgatttccacaatcaagctaatgaacatatcatcccctcacatagttactctgtgtgtgtgtgtgtgtgtgtgtgtgtgtgtgtgtgtgtgtgtatgtatggtgagaatacttaagatctgctctcttagtgaatttcaagtatacaatacattattattaactatagttaccatgctatattattaggtctcctgaacttattcataactg

SEQ ID NO: 19162 - DNA, 378 bp, Homo sapiens
  chr12.fa.O7frz.106053385
  Located on chromosome 12
  Distance between a terminus base of telomere on chromosomal short arm and 5'-terminus of this base sequence : 101734934
  Distance between 3'-terminus of neighbour sequence of sequence listing upward to telomere on chrosomal short arm and 5'-terminus of this base sequence : 158782
tcagcggtagtctagttaacagtgcacatgtgacaggagacactttgaatgaatcattagaaggaatttcagtaaggcctagaatatgcagagaagtgttgctctatgattgttgctgttatcctattttgaagccctggttggagttcctgaaaaccccttttatatttatagttaagggataatctaagaactattccactaccattggagtgagaacagcagtcacaacaaaaaatagcttgatctttaggaaaatgtttccagcctcatagtctgttgtatgtgcgtgtgtgtgcatgtgtgtgtgtgtgtgtgtatgtgtgtgtatgtgtgtttgtcagtctagaatttctaattatctcagacaatggagtg

SEQ ID NO: 19163 - DNA, 172 bp, Homo sapiens
  D12S346
  Located on chromosome 12
  Distance between a terminus base of telomere on chromosomal short arm and 5'-terminus of this base sequence : 101802451
  Distance between 3'-terminus of neighbour sequence of sequence listing upward to telomere on chrosomal short arm and 5'-terminus of this base sequence : 67139
tgcccacctgcctgtaacacacatatccccaccccaatctctctttctctctctgtttctctctgtctctatccctttctgtctctctctctctctctcacacacacacacacacacacacacacacacacacacacacacacacacacacaccaggcatttaccctccatt

SEQ ID NO: 19164 - DNA, 148 bp, Homo sapiens
  DISD22_0008696
  Located on chromosome 12
  Distance between a terminus base of telomere on chromosomal short arm and 5'-terminus of this base sequence : 102101672
  Distance between 3'-terminus of neighbour sequence of sequence listing upward to telomere on chrosomal short arm and 5'-terminus of this base sequence : 299049
aacagccatttgctcctctaaatagatagatagatagatagatagacagacagacagacagacagacagacagatagatagatacatagatacatagatacatagatacatagaaagatagaagcacagtatatctgtttcctgtaca

SEQ ID NO: 19165 - DNA, 327 bp, Homo sapiens
  AC048330.12_169400
  Located on chromosome 12
  Distance between a terminus base of telomere on chromosomal short arm and 5'-terminus of this base sequence : 102217306
  Distance between 3'-terminus of neighbour sequence of sequence listing upward to telomere on chrosomal short arm and 5'-terminus of this base sequence : 115486
gagtacttgcgtgatatttgagagcagtatcttttagctattaacacaaattggtagggacagaatttagttccagaaatagcagatgatcctttgagacattgtactgttcaaagttatccagagaaataggaccaacaggatctatccatctatctatctatctatctatctatctatctatctatctatctatctatctatctagacaaagatttactgtaaggcattagctcatataattaatggagcctaagaagtccaaagatctgcagttggtaagctggaggtgcaggacagcctatgtgtagttccattgtaaatcca

SEQ ID NO: 19166 - DNA, 118 bp, Homo sapiens
  D12S1058
  Located on chromosome 12
  Distance between a terminus base of telomere on chromosomal short arm and 5'-terminus of this base sequence : 102217427
  Distance between 3'-terminus of neighbour sequence of sequence listing upward to telomere on chrosomal short arm and 5'-terminus of this base sequence : -206
cagagaaataggaccaacaggatctatccatctatctatctatctatctatctatctatctatctatctatctatctatctatctagacaaagatttactgtaaggcattagctcata

SEQ ID NO: 19167 - DNA, 268 bp, Homo sapiens
  DISD22_0008710
  Located on chromosome 12
  Distance between a terminus base of telomere on chromosomal short arm and 5'-terminus of this base sequence : 102364735
  Distance between 3'-terminus of neighbour sequence of sequence listing upward to telomere on chrosomal short arm and 5'-terminus of this base sequence : 147190
ccaggaagtcttcttagtggtcgttataaaaggtgaataatacataatacttgcctttacaacatttaatgtctgagggagagagagagagagagacagagagaagcaaaaattacaacacactacattaaatgtacacacactgttataccttttactaaatagttttgtgaaatttggacattttcccttatgaatgaagaattttgtggaaattcaactaagattaaacaaagcccaacattatatacaagccatcaacctgtga

SEQ ID NO: 19168 - DNA, 387 bp, Homo sapiens
  chr12.fa.O7frz.101640988
  Located on chromosome 12
  Distance between a terminus base of telomere on chromosomal short arm and 5'-terminus of this base sequence : 102615717
  Distance between 3'-terminus of neighbour sequence of sequence listing upward to telomere on chrosomal short arm and 5'-terminus of this base sequence : 250714
gtccaggacttctgagtgatggttgttcctcctcaagtttaataataagccctcttcacggtgatgtgcaccttagtcccagctactcgggagggtgaggcaggaggattgcttcagccccggagtttgagactgcagtgagctatgatcccactgcactccagcctgggcaacagagcaagactctgtctcaataataataataataataatattaataataataacagaagaagaagaagaagaaagaagaagaagaagaagaagaagaagaagaagaagaagaagaagaagaagaagaagaagaagaagaagaaggaagaagaagaagaagaagcagcccatcttgttattctataacccctgaactaagttgtaaacttggcc

SEQ ID NO: 19169 - DNA, 216 bp, Homo sapiens
  DID22N_0007985
  Located on chromosome 12
  Distance between a terminus base of telomere on chromosomal short arm and 5'-terminus of this base sequence : 102764846
  Distance between 3'-terminus of neighbour sequence of sequence listing upward to telomere on chrosomal short arm and 5'-terminus of this base sequence : 148742
tatggtatcttcgcatttgagaaaacagcagaagcaagaaagtctctctctctctctctctctctctctctctctctctcacctactctcccctttcttccctgaagcaggccacaaagcctagctgaccttatttattatttagttattagttatttatttttataaactcttttctcttaaatttaatctcttagtaacttgaaacttccatcc

SEQ ID NO: 19170 - DNA, 437 bp, Homo sapiens
  chr12.fa.O7frz.107148032
  Located on chromosome 12
  Distance between a terminus base of telomere on chromosomal short arm and 5'-terminus of this base sequence : 102805023
  Distance between 3'-terminus of neighbour sequence of sequence listing upward to telomere on chrosomal short arm and 5'-terminus of this base sequence : 39961
atgtgctgtagatttcagacaggactgcaacatcaactctttcctgaatttccaggctcccagcttgccttacagattgtgaacttgccagctcccataatcacatgagcgtattccttaaaataagtctctttctcactcgcattcatggtgtgtgtgtgtgtgtgtgtgtgtgtgtgtgtgtgtgtgtgtgtgtgtgtgtattctcttgtttcaatttctccaggggaccctaatgctagataccattatttaaacacagactatgtactagaaaccatgctaaattattcacatacattttctgagttagcctttacacaacccaattaaacagttgaataagcaagctataaagagaagatgtgaccagagatagggaagcttcctttagtggctgtggagagcaagcagtacagaagttagcactaggtgag

SEQ ID NO: 19171 - DNA, 451 bp, Homo sapiens
  chr12.fa.O7frz.107453896
  Located on chromosome 12
  Distance between a terminus base of telomere on chromosomal short arm and 5'-terminus of this base sequence : 102982500
  Distance between 3'-terminus of neighbour sequence of sequence listing upward to telomere on chrosomal short arm and 5'-terminus of this base sequence : 177040
catttacaggaaatactatgatcacacacacacacacacacacacacacacacacacacacacacacacagagtgcaaacactcttaatattaggggaatgctattataggtaaaatacctgtttgtgtgtgctggggagaggcatgtgttggggatttaggaggtgaacctacattatgatccttcacagcctgtttaagcatttcaacgttgcactcaaattcatgcaataactcattggcccatccattttttgttttggttgcatcactaaaatacatccaatgattacaactatctcctgtaaaatgaacaacaggtatttcattgaaaaatgtacaactttcatttattatattatagtaatgcttccaatgagatttagtcgtttattcaagaaagactttgatatctgaaaaatttacaggcttcacctacatgtaatttcga

SEQ ID NO: 19172 - DNA, 220 bp, Homo sapiens
  D12S306
  Located on chromosome 12
  Distance between a terminus base of telomere on chromosomal short arm and 5'-terminus of this base sequence : 103096555
  Distance between 3'-terminus of neighbour sequence of sequence listing upward to telomere on chrosomal short arm and 5'-terminus of this base sequence : 113604
gtgctaaatgcactgtggctcacgtctggaatcccaggaagatgggtggggaggatggtttgagcccaggagttcgagactagcctgagcaacatagcgagacccccatctacacacacacacacacacacacacacacacacacacacacacacacacaaaaaccattttttaaattagccaggcgtgggcctgcacctgtggtcccggatacttggga

SEQ ID NO: 19173 - DNA, 208 bp, Homo sapiens
  D12S1588
  Located on chromosome 12
  Distance between a terminus base of telomere on chromosomal short arm and 5'-terminus of this base sequence : 103098394
  Distance between 3'-terminus of neighbour sequence of sequence listing upward to telomere on chrosomal short arm and 5'-terminus of this base sequence : 1619
accgtctgaagaatgcgattggaagacacacacacacacacacacacacacacacacgcagccggttctctacaggattagaaaaaacttgcgcgaattaatctgcgtagttaaaaacaaatacgaaatgagcgagaaagcacatagtagtcaaatctcgccaccacataaacaggttaagtttggaagcacagcccctaacattcgg

SEQ ID NO: 19174 - DNA, 406 bp, Homo sapiens
  chr12.fa.O7frz.107267858
  Located on chromosome 12
  Distance between a terminus base of telomere on chromosomal short arm and 5'-terminus of this base sequence : 103299068
  Distance between 3'-terminus of neighbour sequence of sequence listing upward to telomere on chrosomal short arm and 5'-terminus of this base sequence : 200466
taacctgatgtgttagtttcctagggcttctataacaaagtaccataaacttggtagcttaaaacaaaataaatggattgcctcagtattctggatgctataggtctgagatcaagatgttggctgggctatgctctctctgaattttctagcagaagatcattccttaacgcctgcaggttctggtaaccccaggccttccttagtttgtggtagcacaattctgatctctacctgtatcttcacatggctctctctctctccctctgtgtgtgtgtgtgtgtgtgtgtgtgtgtgtgtgtgtgtgtgtgtctgtctgtctgtctgtctgtgtccagatttcccttttatagggacatgagtcatattggattagggtccaacctaatgacctcatcttaactta

SEQ ID NO: 19175 - DNA, 251 bp, Homo sapiens
  AC010200.7_102437
  Located on chromosome 12
  Distance between a terminus base of telomere on chromosomal short arm and 5'-terminus of this base sequence : 103483940
  Distance between 3'-terminus of neighbour sequence of sequence listing upward to telomere on chrosomal short arm and 5'-terminus of this base sequence : 184466
tttcctaattagctttctagtcgtaattgggaacaaaaatgaagcaggtgtgtgtgtgtgtgtgtgtgtgtgtgtgtgttatttacaagtatgcatattacactagacatatatcctagtatcttaaatacctctatatgacttattctgatgacgtcctcaagatggactgagcatctggttaaaaatgatactatttccttaaaaccatgtaacttgaaacttttctagaaatgacatcactccatagc

SEQ ID NO: 19176 - DNA, 329 bp, Homo sapiens
  D12S332
  Located on chromosome 12
  Distance between a terminus base of telomere on chromosomal short arm and 5'-terminus of this base sequence : 103483958
  Distance between 3'-terminus of neighbour sequence of sequence listing upward to telomere on chrosomal short arm and 5'-terminus of this base sequence : -233
agtcgtaattgggaacaaaaatgaagcaggtgtgtgtgtgtgtgtgtgtgtgtgtgtgtgttatttacaagtatgcatattacactagacatatatcctagtatcttaaatacctctatatgacttattctgatgacgtcctcaagatggactgagcatctggttaaaaatgatactatttccttaaaaccatgtaacttgaaacttttctagaaatgacatcactccatagcacagaggtcaaggtataaatccctgacacggcacacaaagccacatctgccttctgctttcctttcaaactaatctctcagcagcccaatagtttc

SEQ ID NO: 19177 - DNA, 329 bp, Homo sapiens
  AC010200.7_92076
  Located on chromosome 12
  Distance between a terminus base of telomere on chromosomal short arm and 5'-terminus of this base sequence : 103494216
  Distance between 3'-terminus of neighbour sequence of sequence listing upward to telomere on chrosomal short arm and 5'-terminus of this base sequence : 9929
cagtagctggcctagtgactagctaaaccacccatcaggaaaattgaattatttaagagaggaaaagcagtaagacttgtagaactgaatggtgccttggaggttacctgattcaacattttccccttagcctggacacacacacacacacacacacacacacaatctgtccagaaccaaaatccatatttcttgacaacataatgtctttcaaaagttgataagccacgaagatatatctcccagatcctttctcttctctccatttctcctggcagcaagcgtgacatctttgagacttcttgcctcctaagaggtgacttctgttc

SEQ ID NO: 19178 - DNA, 450 bp, Homo sapiens
  AC010200.7_58432
  Located on chromosome 12
  Distance between a terminus base of telomere on chromosomal short arm and 5'-terminus of this base sequence : 103527818
  Distance between 3'-terminus of neighbour sequence of sequence listing upward to telomere on chrosomal short arm and 5'-terminus of this base sequence : 33273
tattcatccataggagtctgcttcaataaatttgttacatccatacactattaagtagatgtaaaacaattatttagatttctatgtgctgttatggaaattttctacaatatggtgctatatgaaaaaggtaagctatagaccaatgtgtatattcacatcggtattaaacaccaactctgtgtgtgtgtgtgtgtgtgtgtgtgcgcgcacgtgcccacgtgcaaagacaaatttctgcatgatacagaagaaagtaggtggtggtgactgtgagaggtgatatttttacattatattctgggatagaagattgcataattttttttactgtttgtagtttttgccatgtgtatatgtatgtgttattttaatcattataaaacaaaggaggagctttaaaaaaaagaatacagtgcctgcaatctatctactggattcaaattcctg

SEQ ID NO: 19179 - DNA, 300 bp, Homo sapiens
  D12S871
  Located on chromosome 12
  Distance between a terminus base of telomere on chromosomal short arm and 5'-terminus of this base sequence : 103527951
  Distance between 3'-terminus of neighbour sequence of sequence listing upward to telomere on chrosomal short arm and 5'-terminus of this base sequence : -317
agctatagaccaatgtgtatattcacatcggtattaaacaccaactctgtgtgtgtgtgtgtgtgtgtgtgtgcgcgcacgtgcccacgtgcaaagacaaatttctgcatgatacagaagaaagtaggtggtggtgactgtgagaggtgatatttttacattatattctgggatagaagattgcataattttttttactgtttgtagtttttgccatgtgtatatgtatgtgttattttaatcattataaaacaaaggaggagctttaaaaaaaagaatacagtgcctgcaatctatcta

SEQ ID NO: 19180 - DNA, 315 bp, Homo sapiens
  AC010200.7_54519
  Located on chromosome 12
  Distance between a terminus base of telomere on chromosomal short arm and 5'-terminus of this base sequence : 103531650
  Distance between 3'-terminus of neighbour sequence of sequence listing upward to telomere on chrosomal short arm and 5'-terminus of this base sequence : 3399
tgttgctatctcagaaggtagttctgagtgtaaaatacggttgctgagaagcagtttcggtaagttgagtgtcattaaaagacatgtttcctaaagaacctagcaaaatcctgattttaatcatagttaattgatagttaataagtaattattaacacagtctgtcttgatgatataagtattaggatagttctttcattacaaattattatttataaacatatgctcatgttctctctctctctctgtgtgtgtgtgtgtgtgtgtgtgtgtgtgtgtgtgtgtgttataaacacttgctatttagcagtcact

SEQ ID NO: 19181 - DNA, 329 bp, Homo sapiens
  AC010200.7_20963
  Located on chromosome 12
  Distance between a terminus base of telomere on chromosomal short arm and 5'-terminus of this base sequence : 103565323
  Distance between 3'-terminus of neighbour sequence of sequence listing upward to telomere on chrosomal short arm and 5'-terminus of this base sequence : 33358
atggtagcagacttgtctttgtatctaccctttgtcttagcacagtgcctctcacagaaaaagcattgtgtaactctttgttaacgcaatcaatgagtgagctgagaaacaacttcccaaagcagcatggctgcacatgcacctgtgtgtgtgtgtgtgtgtgtgtgtgtatgtgatgtgtgcatttcccatctgtgatgtgtgtcatttgtttcccgtcacaaggtcagctagtagaagatctacattcaaacctgttagaaatgttatattttgcttctcttataaaatagcatttttgtaggtcctacaggctcctacttcctacc

SEQ ID NO: 19182 - DNA, 406 bp, Homo sapiens
  chr12.fa.O7frz.107671865
  Located on chromosome 12
  Distance between a terminus base of telomere on chromosomal short arm and 5'-terminus of this base sequence : 103634032
  Distance between 3'-terminus of neighbour sequence of sequence listing upward to telomere on chrosomal short arm and 5'-terminus of this base sequence : 68380
gagtggttccaaagtgtagttaatgttgagaacaattattataggcctattttagtccctgcacatagaaaaaataaacaaaacagacaaagccctagctttcatagaactcatatcctagtaggaaaataagcaataagcatatttttaataaggcaatttcaaagacacttgcactgcaggtttatagcagcaaaatttgcaatcacaaaaatatggaaccagctcaaatgcccatcaatcaatgtgtagataaagaaaatgtgatacacacacacacacacacacacacacacacaccatggaatttctactcagccataaaagggaatgaaataaataatggcattcacagcaacctggatggaatcagagaccattattctaagcgaagtaactcaggaat

SEQ ID NO: 19183 - DNA, 267 bp, Homo sapiens
  DISD22_0008717
  Located on chromosome 12
  Distance between a terminus base of telomere on chromosomal short arm and 5'-terminus of this base sequence : 103849224
  Distance between 3'-terminus of neighbour sequence of sequence listing upward to telomere on chrosomal short arm and 5'-terminus of this base sequence : 214786
ttgggtataacatggataggtcccagatggatggatggatggatgggtggatggatggatggatggatggtatagtgtacctgggataggtcactgaatgaatggatgggtatatacatggataggtcaccagatggatggatggatggatggatggatggatggatggacagatggatgaatagatacatggatgggtataggagtggttgtgtaggtgtataaatgaatagaggaataaatgaagtaagtggtatacactctggg

SEQ ID NO: 19184 - DNA, 445 bp, Homo sapiens
  AC063947.8_155997
  Located on chromosome 12
  Distance between a terminus base of telomere on chromosomal short arm and 5'-terminus of this base sequence : 103961424
  Distance between 3'-terminus of neighbour sequence of sequence listing upward to telomere on chrosomal short arm and 5'-terminus of this base sequence : 111933
atttaggctatgctccaaatagtacccctgtgacctaaaagaataacattagctttctaagatctctaaattctatccaggcagaggcttgtaaatctggagacttggctctaagaaaatgaaaaacaaattcatgcctctgctgtctattatcattccaagagggtgtcatttactgtaatgtagagctgtgtgctactgaaagaaagaaaaggagggaaggaaggaaggaaggaaggaagaaaggaagggagggagggaggaaggaagggaaaagaaaagaaaagagaaaagaaaagaaaagaaagctcatctgtaggttccctctaggcatatcatcgctgataatgtaatctgttagaaacatgatgctattattataatattctttactggggaaaagtaggtgtcttcaaagtaggcctgcttcatttaattcagtctg

SEQ ID NO: 19185 - DNA, 145 bp, Homo sapiens
  D12S1041
  Located on chromosome 12
  Distance between a terminus base of telomere on chromosomal short arm and 5'-terminus of this base sequence : 104044786
  Distance between 3'-terminus of neighbour sequence of sequence listing upward to telomere on chrosomal short arm and 5'-terminus of this base sequence : 82917
tgcaacaaaccaccatggcacatgtatacctgtgtaacaaacctgcacattctgcacatgtatcccagaacttaaagtattataataataataataataataataataataataaaagattagtagttcccctttttccacagtt

SEQ ID NO: 19186 - DNA, 412 bp, Homo sapiens
  AC063948.7_95832
  Located on chromosome 12
  Distance between a terminus base of telomere on chromosomal short arm and 5'-terminus of this base sequence : 104258983
  Distance between 3'-terminus of neighbour sequence of sequence listing upward to telomere on chrosomal short arm and 5'-terminus of this base sequence : 214052
gtctacttaacatcactccttgactaaaatgtaagcatctcagaccaagtatttccagtctgggcatggtggctcacccctgtaatcccagcactttgggaggccaagccaagaggactgcttgagtccagaagtttgataccagcctgggcaatatagcaagatcccatctctacaaataataataataataataataataataataataataataaaagagctgggtgtggtggtgcatgcctgtagccctagctacttgggaggctgaggtgggaggctcactttagcccaggaattgaaggctgtgaatattttcaaataattaattaatactattattgcctttctcgtttggctcccagaacagtacctggtccacagaggactctcaagaaatagttgctgaatg

SEQ ID NO: 19187 - DNA, 259 bp, Homo sapiens
  D12S1070
  Located on chromosome 12
  Distance between a terminus base of telomere on chromosomal short arm and 5'-terminus of this base sequence : 104405931
  Distance between 3'-terminus of neighbour sequence of sequence listing upward to telomere on chrosomal short arm and 5'-terminus of this base sequence : 146536
catctatttccctgccttcccattcctaaaagtatccattgccctaaattttgtgcttattattcccttgctttactcacacacacacacacacgattgatgatgatagatagatagatagatagatagatagatagatagatagatagatgatagatagatgtagacaaataatatattgtgtagttgtttatttttgaactctatagaaatcatattttaagtggttttctaggttttcctttttcactgaatatta

SEQ ID NO: 19188 - DNA, 452 bp, Homo sapiens
  chr12.fa.O7frz.108900796
  Located on chromosome 12
  Distance between a terminus base of telomere on chromosomal short arm and 5'-terminus of this base sequence : 104692804
  Distance between 3'-terminus of neighbour sequence of sequence listing upward to telomere on chrosomal short arm and 5'-terminus of this base sequence : 286614
aaacacattactccatgtcaatatgtataattcttatcattttgatggttatatgctcctttgtttgggagagggaagttttttttcttttttttaatttaatttaattttttattttatttatttatttatttatttattttgagaaaggggctcactttgttgcccaggctggagtgcagtggtgctattgcagctcactgcagcctcaagcttccaggctcaaatgatcatcctacctcaacctcccaagtagctggggcgacagacacatgccacctcacctggctaatttttttgttgttgttgttgttgttgaaatggggtatcaccatgttgcccaggctggtcttaaattcctgagctcaagcagtcctcctgctttggcctctcaaagtgctgggattacaggcgtgagccaccatgcccagtgcatatgttcctttgtatgt

SEQ ID NO: 19189 - DNA, 455 bp, Homo sapiens
  AC073833.3_236166
  Located on chromosome 12
  Distance between a terminus base of telomere on chromosomal short arm and 5'-terminus of this base sequence : 104796867
  Distance between 3'-terminus of neighbour sequence of sequence listing upward to telomere on chrosomal short arm and 5'-terminus of this base sequence : 103611
cagtaattgatttgacttggagaactgtgaaaaaattgggagaatttacccagggttgcctgctatttattttgccaagaacagacatagaaaacaaaacaaaacaaaacaaaactcacagacagccacagtggctcatgtctataataccagcactttgggaggccaaggcacgtgatcacttgagatcaggagttcaagaccagcctggccaatgtggtaaaatctcgtctctactgcaaatgcaaaaattagttgggtgtagtggcatgcacctgtaatcccagctactcaggaggctgaggcaggagaattgcttgaacctagggggtggaggttacattaagccaagatcacgccactacacctcagcctggacagcagagtgagactctgtctcaaaacaagaacaaaaacaaaaacctcacttactgttatcaccatgtcaaccatag

SEQ ID NO: 19190 - DNA, 340 bp, Homo sapiens
  AC005409.1_96392
  Located on chromosome 12
  Distance between a terminus base of telomere on chromosomal short arm and 5'-terminus of this base sequence : 104997320
  Distance between 3'-terminus of neighbour sequence of sequence listing upward to telomere on chrosomal short arm and 5'-terminus of this base sequence : 199998
gcagtgagctgactgtacaactacactccagcctgggcaacagagcaagacccggtctctaaaaataataataagtaaataaaacaagcctattaaaaatgtatggagaactatttaggggagagggagtatacaggaatttcctgtaccttccatataatttttctgtaaacctaaactgctctaaaatataaagtctactccaatttcatatatatatatatatatatatatatacacacacatacacacacacacacacacacacacacacacacacacatatatataaactaaatccacattctttcttttaaggtcaaatttagcaactgctcac

SEQ ID NO: 19191 - DNA, 326 bp, Homo sapiens
  AC005409.1_138295
  Located on chromosome 12
  Distance between a terminus base of telomere on chromosomal short arm and 5'-terminus of this base sequence : 105039483
  Distance between 3'-terminus of neighbour sequence of sequence listing upward to telomere on chrosomal short arm and 5'-terminus of this base sequence : 41823
ctaaatagctcctaaatagccgtgcttggctaatttcttggtttgtgtgtgtgtgtgtgtgtgtgtgtgtgtgtttgtttgtttgtttttctagagatggggtctcaccatgtcacccaggctggtctggaactcttgggctcaagtgatctgcccacctggacttcccaaagtgctgggtttataggcatgagccaccacacccagccctgaaaaaatgtttgaaactcatatatgttaagtgtgtgatgtacctattattaacttaaacactaaaagacaaagacaaacaacacatgataatgcttcaggactccaaatctcag

SEQ ID NO: 19192 - DNA, 236 bp, Homo sapiens
  AC063950.7_150236
  Located on chromosome 12
  Distance between a terminus base of telomere on chromosomal short arm and 5'-terminus of this base sequence : 105076592
  Distance between 3'-terminus of neighbour sequence of sequence listing upward to telomere on chrosomal short arm and 5'-terminus of this base sequence : 36783
cctattaaacctccactcagacaagaaaagagacgagatgagacgagatgagaagagaagaaggaaggaagtaaggaaggaaaggaaggaaggaaaggaaggaaggaaggaaggaaaagaaggcaggaaaaaaggaaattggagagttctagatgcacagcttggcttccttgtttactctgtgatcaagttagttttctaagaccgtttcctcatctttaagatggcaatagtga

SEQ ID NO: 19193 - DNA, 417 bp, Homo sapiens
  chr12.fa.O7frz.109510227
  Located on chromosome 12
  Distance between a terminus base of telomere on chromosomal short arm and 5'-terminus of this base sequence : 105154623
  Distance between 3'-terminus of neighbour sequence of sequence listing upward to telomere on chrosomal short arm and 5'-terminus of this base sequence : 77795
ctgttaggtgtgatcatgtaactaagttctggccaatggaatgtggacaggaagtgattatatatataaatatataatatataatatatataatgtaatacatattatatattatgacatatattatacattatatatatatatatatatatatatctggcctataaaaaccttctgcttaatctatatttttttctacatccgatagcttaatggagaggaccctgaagatctataagaggtagaattacaagacagaaggagcctaggcccctgagttgctattagggggattaatagctgactgagaacacctgcatgatactaatgcatgagttagaaataaacttttattgtgtacagtctctgaatttgggactgcttgttacaaatgttagcttatcttgactaatctaa

SEQ ID NO: 19194 - DNA, 210 bp, Homo sapiens
  chr12.fa.O7frz.109416008
  Located on chromosome 12
  Distance between a terminus base of telomere on chromosomal short arm and 5'-terminus of this base sequence : 105172536
  Distance between 3'-terminus of neighbour sequence of sequence listing upward to telomere on chrosomal short arm and 5'-terminus of this base sequence : 17496
gaactagcctagtttggtgatctccctgagctgaagagacagaattcagagttcagagaggccaaggcagctagacttcatagaggggcgaagtacaggatagaaggaagctgcaatgagagagagagagagagagagagagctccagatatctgcagagggtccctttgagtctttaggtgagtaataattagtgcataaatttgagga

SEQ ID NO: 19195 - DNA, 456 bp, Homo sapiens
  chr12.fa.O7frz.109618160
  Located on chromosome 12
  Distance between a terminus base of telomere on chromosomal short arm and 5'-terminus of this base sequence : 105419507
  Distance between 3'-terminus of neighbour sequence of sequence listing upward to telomere on chrosomal short arm and 5'-terminus of this base sequence : 246761
gaatcttggaagcttatttgagtttaacaaaaagatgctttaagtgggggtggggaacctcctaaagagttgtatcagttactgaaataacacagactagtgtaatttctattcctgcttgtcaagaaacaaggtaggcaaattaaagtcatcaggatctagcactgctgctctgcctccaacagaaaagatgagccaatgaaaagacaagccagtgaaaatacactgttactccctgtcagccccagtggccatatgcacaaacactatgcagaccaacacgtacacacacacacacacacacacacacacatataaatttatgtattttcttttgcctatgtgtctagtcagcttaaatgggtcgactcgtgttttggctcctataaccaaaccagactctttggctcagctctacctgcaaactttctggcctgcttcagtatagtgaagtgg

SEQ ID NO: 19196 - DNA, 354 bp, Homo sapiens
  AC010202.6_165434
  Located on chromosome 12
  Distance between a terminus base of telomere on chromosomal short arm and 5'-terminus of this base sequence : 105590505
  Distance between 3'-terminus of neighbour sequence of sequence listing upward to telomere on chrosomal short arm and 5'-terminus of this base sequence : 170542
tcatctacacaaacattgacgttccaaggagaggaaggattctcaagggtggacaggctttttgtttgtttgtttgttttttaataaaattttcaaggaagtgatttcttttcagtattccattggatccttagggtgaatgtgtgtgtgtgtgtgtgtgtgtgtgtgtgtgtgtgtgtctgtgtatgtagggtgggtgttaagagattttcatatccctagaagagtggattctgatggagagctgcattaactttttcaggggaactgcctcatcttaaaaagttcaaataatactttaatattatttggggaagagagaacagaaatttgacctaagtatccagtatggtc

SEQ ID NO: 19197 - DNA, 380 bp, Homo sapiens
  AC010202.6_88136
  Located on chromosome 12
  Distance between a terminus base of telomere on chromosomal short arm and 5'-terminus of this base sequence : 105667715
  Distance between 3'-terminus of neighbour sequence of sequence listing upward to telomere on chrosomal short arm and 5'-terminus of this base sequence : 76856
aaggttaaattgtgctcagtacagatttggggccaaataagttttgttaatttaaattctctcaatattggccatccatagatggtatatgcattcattattgagcagaatatttttaaccaaaacatcattccctatttttgactaaaaataatttactatggccaaaaaatggcttttgacaatactatatatcatcacagggttttgtttttgttttgtttcctcaatatgagagagagagagagagagagagagagagagagactgattccttacctggggcatatcagcagttgacacaaccacaaatagaagaaaataacagaaacagaaaaaaatatgagaatcgaagaatgaaattggctcaaatagaaacc

SEQ ID NO: 19198 - DNA, 438 bp, Homo sapiens
  AC010202.6_83192
  Located on chromosome 12
  Distance between a terminus base of telomere on chromosomal short arm and 5'-terminus of this base sequence : 105672723
  Distance between 3'-terminus of neighbour sequence of sequence listing upward to telomere on chrosomal short arm and 5'-terminus of this base sequence : 4628
gactatgccgagctgtaaaacccaactgaaatagaacatttttctttattcttctactaggctgcctgtcactgtcccctccccaccccaccactctgggagaagggtacctggggggcaaacaattttcctgttgtttgaattttccatataactcaaacctgtgtgtgtgtgtgtgtgtgtgtgtgtgtgtgtgtgtgtgtatgacagagggagtctgtgtgccagagtgtgttttctttctctgatttttgtgtattctaaataacaccagctggctagcaataccctctcgagggttatgatgtcattcaaatccctcaactgggtgactggccggcaacatggtccaagccagctgttttgctatttataatgtacacttgcctttgccattgagaattcagttctgatcttttgtcgatacagtttgtacct

SEQ ID NO: 19199 - DNA, 259 bp, Homo sapiens
  D12S1030
  Located on chromosome 12
  Distance between a terminus base of telomere on chromosomal short arm and 5'-terminus of this base sequence : 105722566
  Distance between 3'-terminus of neighbour sequence of sequence listing upward to telomere on chrosomal short arm and 5'-terminus of this base sequence : 49405
tcccacattgacctatgtaggttcattcattcactcactcatttggtcaataaaaatttatcaaaccctactaagtaccaggcactaatggagttactgaagatatagaacttcatctctctctctctctgtcatctgtctgtctctctgtctgtctgtctatctatctatctatctatctatctatctatctatctatctatctatctacatatagaacaaaacagagaaatgcctgcccttgtagcatttacactct

SEQ ID NO: 19200 - DNA, 415 bp, Homo sapiens
  AC010202.6_28134
  Located on chromosome 12
  Distance between a terminus base of telomere on chromosomal short arm and 5'-terminus of this base sequence : 105727838
  Distance between 3'-terminus of neighbour sequence of sequence listing upward to telomere on chrosomal short arm and 5'-terminus of this base sequence : 5013
ggaaatctgcaaagtgtatgagtcagtccacagagcttctccactgtgtgattgggttttgcttgggtcatcaatctgccatttcctgactcttccatcacacacacacacacacacacacacacacacacacacacacacacacagagccacagcatcatctttgagcaatgcaataaattttatgaggctttatttcccttctctttaaaacctagagaaatagaacaaagttccctttttctttcacaaaactcatgggtaacatatcaattattcaagtccatttatatgtctataaccacctcttctctctttgtttcctctggaaatctttacttttcatgcacacacacacacacacacacacacacacacagagatatgtatgtgtataacatcacgcagtaataca

SEQ ID NO: 19201 - DNA, 274 bp, Homo sapiens
  AC010202.6_8412
  Located on chromosome 12
  Distance between a terminus base of telomere on chromosomal short arm and 5'-terminus of this base sequence : 105747537
  Distance between 3'-terminus of neighbour sequence of sequence listing upward to telomere on chrosomal short arm and 5'-terminus of this base sequence : 19284
catgaaaggaactcagtaaatgtcaaactaggggctctgaagtgaagagaatattttcttacctatcttcagaaatgtacaatttagaaaagaagattataaaatatatattcctgaaaaggttttacacacacacacacacacacacacacacacacacacacacacaatttattattacccatccttggtgcttggcccagctgcagcacttattggggttattaacaaagacaaggcctagattttaacctgatatcaacctgaaagttgg

SEQ ID NO: 19202 - DNA, 324 bp, Homo sapiens
  chr12.fa.O7frz.110171754
  Located on chromosome 12
  Distance between a terminus base of telomere on chromosomal short arm and 5'-terminus of this base sequence : 105875099
  Distance between 3'-terminus of neighbour sequence of sequence listing upward to telomere on chrosomal short arm and 5'-terminus of this base sequence : 127288
gacaatgaacatttaatttggaaaggtagattgctcttcacatatttataaatatgatgatggtgatgatgacgatgatgtggatgatttaatttcccaatctgttctaggaaccgaggaggcaggtttgaatgtaatatggtaagacccatggatttttaatttcattcttcaaacaattaataatatgagaacaatcccacggaagatcagtgggtgcaccaaaattagtggtcattatttagatagggttgatacagttgttattgttgtttcaaatcaaatcagtgtggtccctcactaactcatctgttccatctctta

SEQ ID NO: 19203 - DNA, 114 bp, Homo sapiens
  DISO7_10003564
  Located on chromosome 12
  Distance between a terminus base of telomere on chromosomal short arm and 5'-terminus of this base sequence : 105945072
  Distance between 3'-terminus of neighbour sequence of sequence listing upward to telomere on chrosomal short arm and 5'-terminus of this base sequence : 69649
atgtatgcacatgcaggcatacacacacacacacacacacacacacacacacacacaaacacatggcattttaaaaagaagggagaagaccccactcacaggaatttctatgct

SEQ ID NO: 19204 - DNA, 287 bp, Homo sapiens
  chr12.fa.O7frz.110892951
  Located on chromosome 12
  Distance between a terminus base of telomere on chromosomal short arm and 5'-terminus of this base sequence : 106187321
  Distance between 3'-terminus of neighbour sequence of sequence listing upward to telomere on chrosomal short arm and 5'-terminus of this base sequence : 242135
ccatcatttggtgttgtaactatatttgattttggccactcaggtaggtgtaaggtaatatttcattattatttgaatgtacatttctttggtgtgtaatgatatggaataccttttcatagctttattcactatatatatatatatatatatatatatatatatatatatatatatatatatatataaatatctttttttgtgaaatgtctattcatatcttttgcccattgtccaactttttttccttgtttgtttttactattgatttgcagtgacttatatgt

SEQ ID NO: 19205 - DNA, 225 bp, Homo sapiens
  Z67162
  Located on chromosome 12
  Distance between a terminus base of telomere on chromosomal short arm and 5'-terminus of this base sequence : 106257199
  Distance between 3'-terminus of neighbour sequence of sequence listing upward to telomere on chrosomal short arm and 5'-terminus of this base sequence : 69591
cacacagcaggtgtttaataaatgttattttcttttctcacaggtgtgtgtgtgtgtgtgtgtgtgtgtgtgtgtgtatcaaatggtatattgaataaggcacgatatattgctataaaatgctacacagttttaaatcactactacctgtattactgcatttaccatagtgccttgtacttagcccatatgaattttgagcagagatttagataggatcgctgc

SEQ ID NO: 19206 - DNA, 262 bp, Homo sapiens
  chr12.fa.O7frz.110973186
  Located on chromosome 12
  Distance between a terminus base of telomere on chromosomal short arm and 5'-terminus of this base sequence : 106277406
  Distance between 3'-terminus of neighbour sequence of sequence listing upward to telomere on chrosomal short arm and 5'-terminus of this base sequence : 19982
aagacttgtctccttcaggtagaaaggagagcctttcatctttgcaattccattttctccacaatgttgactttcaaattccagttgtttcagcatacacatatacatatatatacacacctacatacacatacacacacacacacacacacacacacacccgacacagcctcttaatccactgatttagtaggagtgtccaaaaatatactatcaaggtttgcatacatatatgcaaatgtactcatacgaccacaaattg

SEQ ID NO: 19207 - DNA, 425 bp, Homo sapiens
  AC068643.9_1443
  Located on chromosome 12
  Distance between a terminus base of telomere on chromosomal short arm and 5'-terminus of this base sequence : 106353309
  Distance between 3'-terminus of neighbour sequence of sequence listing upward to telomere on chrosomal short arm and 5'-terminus of this base sequence : 75641
cctcaccaacatgtgaaaccctgtctttattaaaaatacaaaaatgagctgggtgtggtgatgcatgcctgtaatcccagctactggggagactgaggtgggaggatcccttgaaccagggaagtgaaggttgcaatgagctgagatcatgccactgcactccagcctggccaacagagtgagaccctgtctcaaaaaaaaaaaaaaagaaagaaagagaaaagaaagagaaagaaagaaagaaaagaaagaaagaaagagaaataaagaaagaaaagaaagaaagaaagaaagaaagaaagaaagaaagaaagaaagaaagaaaaagaaaagtaaacacaggttaacataaatgagcatgtggaggcaaaaccaatgtcacagataatatatcagaaaatgtgtgcattacagtaagttgtgct

SEQ ID NO: 19208 - DNA, 413 bp, Homo sapiens
  AC068643.9_146773
  Located on chromosome 12
  Distance between a terminus base of telomere on chromosomal short arm and 5'-terminus of this base sequence : 106472686
  Distance between 3'-terminus of neighbour sequence of sequence listing upward to telomere on chrosomal short arm and 5'-terminus of this base sequence : 118952
ccaaggacttctagaaacagactcacgtgggttgggggacctggaaactgtcagggagagaaggcaggagtcagcatctcgtggtaaaatagagttcagacacactgctcatgattgctttggaaatttcttaggctgttttgttttgttttgttttgttttgttttgttttgtttgcaatgggcacatactgttgcaataactattaactgccatcttgaatcttttgtctaggggtgtgttgatcaagttcacctttgatgttcttcttaaatggataaccttctcacaggcatttagtgggaaggcctctttcacagcataatctacccctggattagacacccttgcaaggagagaacatgatcattgcctgtaaaagtttaccagtgtcacctgaggtactgtttatg

SEQ ID NO: 19209 - DNA, 443 bp, Homo sapiens
  HUMUT5184B
  Located on chromosome 12
  Distance between a terminus base of telomere on chromosomal short arm and 5'-terminus of this base sequence : 106501321
  Distance between 3'-terminus of neighbour sequence of sequence listing upward to telomere on chrosomal short arm and 5'-terminus of this base sequence : 28222
gaaaacacagagcatgggagtatggaagaagcagtagtgggaagcctaaacatggcagaaaaaaaaaagaaagagaaagaagaaagaagaaaaagaaagaaagaaagaaagaaagagagaaaggagagagagaaagaaagaaagaaagaaagaaagaaagaaagaaagaaagaaataagcaagcaagcaagaaagaaagaaagaaagaaaaagaaaggaagaagaaagaaagaagcaagcaagcaagaaagaaagaaagaaagaaaaagaaaggaaggaaggaaggaaagaaagaaagaaagaaagaaagaaagaaagaaagaaagaaagaaagaaagaaggaaaagaaagagaaagaaagaaagaaggaaaaaaccttgtgaaaaaggatggaagcagagaattatatttcacaaagaccttggactctgcaagagggaccc

SEQ ID NO: 19210 - DNA, 88 bp, Homo sapiens
  Z67594
  Located on chromosome 12
  Distance between a terminus base of telomere on chromosomal short arm and 5'-terminus of this base sequence : 106605680
  Distance between 3'-terminus of neighbour sequence of sequence listing upward to telomere on chrosomal short arm and 5'-terminus of this base sequence : 103916
ggcgtggggagcaacttgaagttctttgtgtgtgtgtgtgtgtgtgtatggaaaaggcaattgttccaggaccatttgttgaaaagac

SEQ ID NO: 19211 - DNA, 190 bp, Homo sapiens
  D12S327
  Located on chromosome 12
  Distance between a terminus base of telomere on chromosomal short arm and 5'-terminus of this base sequence : 106674224
  Distance between 3'-terminus of neighbour sequence of sequence listing upward to telomere on chrosomal short arm and 5'-terminus of this base sequence : 68456
agagcaagaccttgtctcaaaaaaaaaatatatatatatatatgtgtgtgtgtgtgtgtgtgtgtgtgtgtgtgtgtgtgtgtgtatatatgtatatatattatgttgaatagacatgttttttcaaaaaagattttagtttccctcccctcatgaaagagtactatcgatattaccatccagaaacttt

SEQ ID NO: 19212 - DNA, 163 bp, Homo sapiens
  HUMUT6393
  Located on chromosome 12
  Distance between a terminus base of telomere on chromosomal short arm and 5'-terminus of this base sequence : 106831134
  Distance between 3'-terminus of neighbour sequence of sequence listing upward to telomere on chrosomal short arm and 5'-terminus of this base sequence : 156720
ggtgacagagcaagacactgcctccataaataaataaataaataaataaataaataaataaataaataaaaatataaaagaatagatgttttgttggctatttggtttgctcttctgtaaagagcatattcttattctttgaccatttttctgctttgtgtgt

SEQ ID NO: 19213 - DNA, 415 bp, Homo sapiens
  chr12.fa.O7frz.100507297
  Located on chromosome 12
  Distance between a terminus base of telomere on chromosomal short arm and 5'-terminus of this base sequence : 106853261
  Distance between 3'-terminus of neighbour sequence of sequence listing upward to telomere on chrosomal short arm and 5'-terminus of this base sequence : 21964
atccattacttgtacaaccagtagtaggcagaataatggcccccaaagatgtccaggtcctaatccctggaatgtgtgactgtgtcaccttacatggtgtctcagtccattttgtgttgctattacagaatactactaactgggaaatttataaagaaaataaatttattttttacagttctagagactgggcagtccagggtcaaggggcctgcatctggtgagggccttcttgctgcatcattccatggtggaagggcaagaaagcacgagggagagagagacagagagagagagagagagagagaaaggggcctaatgtatcattttatcaggaacctactcctgtgataagtaacccactcctgcaataactaacccactcctgtgataatgtcattaatccattcatgag

SEQ ID NO: 19214 - DNA, 361 bp, Homo sapiens
  chr12.fa.O7frz.99208212
  Located on chromosome 12
  Distance between a terminus base of telomere on chromosomal short arm and 5'-terminus of this base sequence : 106944344
  Distance between 3'-terminus of neighbour sequence of sequence listing upward to telomere on chrosomal short arm and 5'-terminus of this base sequence : 90668
  misc_feature (1)...(361): n = A,T,G or C
ccatttaatggagtgaattaataccaagaaatgaaactggtggtcataatgagaacattactttgggaaattataaatattgttaacacactgttgtctatcagagaacagggtgttctagtgaaactagaacagattcccttatatccctctttcatgggaacatgtgaacagagtgtagccttccatttaagcaggcataccatttgggcaccttggttttcataatggaatgtgaactctaccactcacntatgtagtttcatacacacacacacacacacacacacacacacacacacacacacctgtggtctaaaaatacgctacaatgaatcactgctaacattactgagtgctt

SEQ ID NO: 19215 - DNA, 221 bp, Homo sapiens
  chr12.fa.O7frz.99102337
  Located on chromosome 12
  Distance between a terminus base of telomere on chromosomal short arm and 5'-terminus of this base sequence : 106979344
  Distance between 3'-terminus of neighbour sequence of sequence listing upward to telomere on chrosomal short arm and 5'-terminus of this base sequence : 34639
aactatgatcatgccactgtactccagcctggttgacggaatgagaccaggaaggaaggaaaggaaggaagggagggagggagggagggaggaaaaaggaagaaagaaaaagagggggctggccatagaacggactatttgagaattaagagaaggtcctgagagaatagggagaaaagccaggctctaggcctgtgctgtccactacagtaaccattagt

SEQ ID NO: 19216 - DNA, 287 bp, Homo sapiens
  chr12.fa.O7frz.99323499
  Located on chromosome 12
  Distance between a terminus base of telomere on chromosomal short arm and 5'-terminus of this base sequence : 107197829
  Distance between 3'-terminus of neighbour sequence of sequence listing upward to telomere on chrosomal short arm and 5'-terminus of this base sequence : 218264
gtggtactcatgtgaagcatacagcagtgcttattgggggtgttactggtattttgggtggggcaactcttcattctgtaggattatccccagcccctgcccatcacatggcagtaatgctaaccctaacccccgccaatgtatgatgacagcttcacacacacacacacacacacacacacacacacacaaatgcctccacacattttcaaaggccacatagtagaggcctggggggatttagtatcacctctgactgggaactattgctaaacagaagctaaaga

SEQ ID NO: 19217 - DNA, 262 bp, Homo sapiens
  D12S1346
  Located on chromosome 12
  Distance between a terminus base of telomere on chromosomal short arm and 5'-terminus of this base sequence : 107270596
  Distance between 3'-terminus of neighbour sequence of sequence listing upward to telomere on chrosomal short arm and 5'-terminus of this base sequence : 72480
caaccccaatgtatgaatgaaaaggcaggaagtcggggggtggggagtgattagtcatctgtaggactatcaagagtgtgtgtgtgtgtgtgtgtgtgtgtgtcatgtatatggcattttatttcttggaggagatgcagatactcaataatcactgttaattaagtgatttttttaagtagatgattatgctcataagaaattcaaaatctgggacctagagtcaattcctaaggtcaggagtacagatcatgcttacctg

SEQ ID NO: 19218 - DNA, 149 bp, Homo sapiens
  D12S1037
  Located on chromosome 12
  Distance between a terminus base of telomere on chromosomal short arm and 5'-terminus of this base sequence : 107278260
  Distance between 3'-terminus of neighbour sequence of sequence listing upward to telomere on chrosomal short arm and 5'-terminus of this base sequence : 7402
gattttggacacaggcagacctggatttgtgggtgagaaacttagtcccttctctgctttgatttcctcatctgtaaaataataataataataataataataataataataataataataatacctatacctgtaacttggaaggctga

SEQ ID NO: 19219 - DNA, 259 bp, Homo sapiens
  AC012085.4_141535
  Located on chromosome 12
  Distance between a terminus base of telomere on chromosomal short arm and 5'-terminus of this base sequence : 107360187
  Distance between 3'-terminus of neighbour sequence of sequence listing upward to telomere on chrosomal short arm and 5'-terminus of this base sequence : 81778
ggatggcaaagcataaagagagaagaagccttggcctctggtaactgtggagcagtcacaccagcccacagccctggagactacttacagattgtgtgtgtgtgtgtgtgtgtgtgtgtgtgtgtgtgtcacagagagagagagagaaggatatggaggagaaacaggaggaagaggaggagaagggaaaaataaaccttccatcttgttaaaatcactgtcatttgggttttctgttaaatgttgccaaatctaattc

SEQ ID NO: 19220 - DNA, 460 bp, Homo sapiens
  AC012085.4_96787
  Located on chromosome 12
  Distance between a terminus base of telomere on chromosomal short arm and 5'-terminus of this base sequence : 107404816
  Distance between 3'-terminus of neighbour sequence of sequence listing upward to telomere on chrosomal short arm and 5'-terminus of this base sequence : 44370
ggataaaggaagctgaatttactctctttttgagccagaacatctgttttctcctgtccttggacataggacctcctggttctcaggccttcagacttgactgggaggcccatcactagctctcctggttctcctgcttgcaggtagcagattatgggatgtattggcctccgtaatagtgtgagccaattcccataatctctctctctctctctctctctctctctctctctctctctctctctctcctattggttctgtttctctggagaaccttgactaatataatagtccctgtacagcaaagccagggacaactgagagcccaaatcttaccacagcctgctttttctcttgttcccaggagcccagagttatctggtaactttacagaagtggctcctgacccaggcgaacattacttcaagacaaacaggggtacaggaacacttcaggaatg

SEQ ID NO: 19221 - DNA, 229 bp, Homo sapiens
  AC012085.4_18922
  Located on chromosome 12
  Distance between a terminus base of telomere on chromosomal short arm and 5'-terminus of this base sequence : 107482860
  Distance between 3'-terminus of neighbour sequence of sequence listing upward to telomere on chrosomal short arm and 5'-terminus of this base sequence : 77584
gaatcctgactctgtcattgattggctgggttgtgtgcctgtgtgtgtgtgtgtgtgtgtgtgtgtgtgcgagcatgcaaatctcccagcccctctggatctgaaagtcttccataaaatccataatatgtgatctaaaaagtggtttcaagctttaaaattctaagaagttaaaaaaactgggaaaggagaatacagaagacctcttaagtaaatgaaaggcctacaa

SEQ ID NO: 19222 - DNA, 355 bp, Homo sapiens
  chr12.fa.O7frz.99741711
  Located on chromosome 12
  Distance between a terminus base of telomere on chromosomal short arm and 5'-terminus of this base sequence : 107539458
  Distance between 3'-terminus of neighbour sequence of sequence listing upward to telomere on chrosomal short arm and 5'-terminus of this base sequence : 56369
cttaagtccaggagtttgagacaagcctgggcaacatagaaagaccccatctctacaaaaaattaaaaaatgagccagtgtggtggtgcgtgcttgtagttccagctacttgtgaagctaaggtgggaggatcacttgagcccaggaggttgaggctgcagtgagctgtaatcatgccactatattccagcctgagcaacagagcaagaccctatctaagaaggaaggaaggaaggaaggaaggaaggaaggaaggaaggaaggaaggaaggaaggaaggaaggaaggaaggaagggaggaaaagaaagacagacactcactgactcctgctaaatcttgaacattggcactagt

SEQ ID NO: 19223 - DNA, 399 bp, Homo sapiens
  chr12.fa.O7frz.100102126
  Located on chromosome 12
  Distance between a terminus base of telomere on chromosomal short arm and 5'-terminus of this base sequence : 107631345
  Distance between 3'-terminus of neighbour sequence of sequence listing upward to telomere on chrosomal short arm and 5'-terminus of this base sequence : 91532
attgcactcatacgtttatcacagcactagtcacaatagcaaagtcatgaaaccaacctaagtgcccaccaacagttggctgcataaagaaaatgtgagataggtagatagatagatagatagatagatagatagatagatatctcatggaacactatgcagccataaaaaagaatgaaatcatgtcctttgcagcaacgtggatagggctggaggctattattctaagtgatctaattcagaaacaggaaatcaaataccatgtgctctcacttagaagtggtagcttgacaatggcatacatggacataaagatggaaataatagacacccaaagggaggaagtttgcagggggactagggttgaaaaattacctatcaggtacgatgttcactatt

SEQ ID NO: 19224 - DNA, 342 bp, Homo sapiens
  AC004216.1_117812
  Located on chromosome 12
  Distance between a terminus base of telomere on chromosomal short arm and 5'-terminus of this base sequence : 107786745
  Distance between 3'-terminus of neighbour sequence of sequence listing upward to telomere on chrosomal short arm and 5'-terminus of this base sequence : 155001
cagctacttggaggctgagacgggaggattccttgaacccaggagcccaggagttttagaccagtctgggtaacatagtgagaccctttctcacctactctcactgcatgccccccaaaaatatatatgtgcgcgcacgcgcgcgcacacacacatacacacacacacacacacacacacacacagaggaaattgttagaaaacacacagaactgaatgtaaatagtattaggtgggaataagaagtaaagggatggtaaggaggcttggaggaggagtaaattatctgctatgggacatcagctcttcctttagagtaggtttaggtcacataccaacagg

SEQ ID NO: 19225 - DNA, 178 bp, Homo sapiens
  AC004216.1_103031
  Located on chromosome 12
  Distance between a terminus base of telomere on chromosomal short arm and 5'-terminus of this base sequence : 107801655
  Distance between 3'-terminus of neighbour sequence of sequence listing upward to telomere on chrosomal short arm and 5'-terminus of this base sequence : 14568
tttgccataatgacagtaggacaccaacccctgtgtgtgtgtgtgtgtgtgtgtgtttgcacacatgcctgagagtgctgaacaaaattatgaatttttctttttttgttttgttttgtttttttaagtcaaggtcttgcaatgttgcccaggttggagtgcagtggctatttatgag

SEQ ID NO: 19226 - DNA, 364 bp, Homo sapiens
  HUMUT5428
  Located on chromosome 12
  Distance between a terminus base of telomere on chromosomal short arm and 5'-terminus of this base sequence : 107814175
  Distance between 3'-terminus of neighbour sequence of sequence listing upward to telomere on chrosomal short arm and 5'-terminus of this base sequence : 12342
gcaaccataacccctatttagttccaaaacattttcgtcaccccaaaagaaaatcctgtttatcatacagtgacttcccattttctcctcccagacgggattttaaaaatatgcaaattagttaacatgaagaggaaaaggagattttttcatttaaattagatttcagctttctttttctccttccttctttccctccttccttccttccttcattcctttcttcccttcctctctccttccttccttccttccttccttccttccttccttccttccttccttccttccttccttccttccttctctccttccctccttctgagacagggtctcactttgttgtataggctgaagtgcaatg

SEQ ID NO: 19227 - DNA, 330 bp, Homo sapiens
  AC007425.16_115681
  Located on chromosome 12
  Distance between a terminus base of telomere on chromosomal short arm and 5'-terminus of this base sequence : 107939363
  Distance between 3'-terminus of neighbour sequence of sequence listing upward to telomere on chrosomal short arm and 5'-terminus of this base sequence : 124824
cctgctttacagtcctgttaatcatggtggcccattcttcccaaacccctagttataggggtgggtgcatgaccaggctggggcaatcagaggagacttctctgggattgaaaaatttgtggtgaagaagtatcctttccactgggtttctaagctagaagaatatgaacatggagctggaggtggctatcatgtagagtgaagccaagcagagatgaggatggctaagtgattggtgtgtgtgtgtgtgtgtgtgtgtgtgtgaaagagagagagagagagcgagagagagagagagaaagattaattaagcttctggattaaaccaag

SEQ ID NO: 19228 - DNA, 411 bp, Homo sapiens
  AC004104.1_38785
  Located on chromosome 12
  Distance between a terminus base of telomere on chromosomal short arm and 5'-terminus of this base sequence : 107954644
  Distance between 3'-terminus of neighbour sequence of sequence listing upward to telomere on chrosomal short arm and 5'-terminus of this base sequence : 14951
agaatcacttgaacctggaaggcggaggttgcagtgagctgagattgcaccactgcactccagcctgggcaacagagcaagaccctgtcgaaagaaagcagcctgggcaacagagcaagaccctgtcgaaagaaagaaagaaagaaagaaagaaagaaagaaagaaagaaagaaagaaagaaagaaagaaagaaagaaagagagagagagagaaagaaagaaagaaggaaggaaggaaggaaggaaggaaaggaaggaaggaagggaaagaaagaaagaagaaacaaacaaacacaagggcagttatgaggacaagaggaaaggatatctgaaacttgatcggccttgaatatctagggtctttgttcagtctgtgtttaaaagcagaggtaacgaaacaaatgcagtcat

SEQ ID NO: 19229 - DNA, 451 bp, Homo sapiens
  AC004104.1_115803
  Located on chromosome 12
  Distance between a terminus base of telomere on chromosomal short arm and 5'-terminus of this base sequence : 108031555
  Distance between 3'-terminus of neighbour sequence of sequence listing upward to telomere on chrosomal short arm and 5'-terminus of this base sequence : 76500
actggatctgcttattgacaactttatccccaacacctagcctagtgcctggcacttagtaggtcctcagtgggtctttttaattaattcttttggcacaggtagactattcacctgatttttaaaatatcaaaaggtatacagtggaatgtcttcctccttaccttttattcatctagttctcacttctccccagtcacctagtccagggggtcattgttatagtttattccaggataactttatgcaaagataagtaaaattgaatatatatatgtatatacacacacacacacacacacacacacacacacacacacacatacatatgcataccttgttaaatacacacatatgtgtccgtttaagtactgttgagttattggccctaatcctttactctctgatggtgttatacaggcacacccttaacagagctcatgctaggtag

SEQ ID NO: 19230 - DNA, 433 bp, Homo sapiens
  AC004104.1_125751
  Located on chromosome 12
  Distance between a terminus base of telomere on chromosomal short arm and 5'-terminus of this base sequence : 108041619
  Distance between 3'-terminus of neighbour sequence of sequence listing upward to telomere on chrosomal short arm and 5'-terminus of this base sequence : 9613
tcttcctgaagactctgtattcactaaaagttctccattcatcaaacactcctgctgcgtgtctgcatggtcccagctggtcgtggggagcatatatgtggggagtcaagagatattgatcatgggagtggtggggaggaaggtgcaatgtttcagtcatggtgattgtgtgtgtgtgtgtgtgtgtgtgtgtgtgtgtgtgtgtaagattgctattttatgcccaaattccagttttccagaagaaaggcaggctgcctaaattttggctctgacaagttacaagagacttgtgagttatttttgcccacaacaagggtagatttggttaagtaaagaccccacagttccccactatacctcacagaacacagcatgaacaagcaatgaaggaaagcccaaactgtggtccttagtgcctatcagacctgag

SEQ ID NO: 19231 - DNA, 180 bp, Homo sapiens
  AC004465.1_86181
  Located on chromosome 12
  Distance between a terminus base of telomere on chromosomal short arm and 5'-terminus of this base sequence : 108068342
  Distance between 3'-terminus of neighbour sequence of sequence listing upward to telomere on chrosomal short arm and 5'-terminus of this base sequence : 26290
aattgattcgtctactgccagcagcccggagttgcctacgcggactggaaaggaagggagaagggagagagagagagagagagagagagagagagagagagactcacagagctaaaaccttcatccatgtggaggacagtctgagggagccactgtcccttgtccactgactcactggct

SEQ ID NO: 19232 - DNA, 297 bp, Homo sapiens
  AC004465.1_28651
  Located on chromosome 12
  Distance between a terminus base of telomere on chromosomal short arm and 5'-terminus of this base sequence : 108125768
  Distance between 3'-terminus of neighbour sequence of sequence listing upward to telomere on chrosomal short arm and 5'-terminus of this base sequence : 57246
tgttgacaagtgacaaacatctgccacaggatgtgtcagcttcacacttggccctctgtcagcctcctcgggtggtcacggaggggataggtctgagaggcttgcttatggagttaggtttttattttgctttgctttttaaaagatatttcaggagtgggaagttctccagactggcagtgtgtgtgtgtgtgtgtgtgtgtgtgcatgtgtgtgtatgtgtgtgtatctttatacaacgatgggcctcagtcatgagggaaggaaagatatgtatgttaaaggtaaacggtgaaa

SEQ ID NO: 19233 - DNA, 220 bp, Homo sapiens
  D12S1616
  Located on chromosome 12
  Distance between a terminus base of telomere on chromosomal short arm and 5'-terminus of this base sequence : 108132947
  Distance between 3'-terminus of neighbour sequence of sequence listing upward to telomere on chrosomal short arm and 5'-terminus of this base sequence : 6882
tctgtaagagcccagtgtgtacagacatgcatgtaaaagtgtattcttgcatgtaggttctgatcacacatgtgcatgtgtgtgtgtgtgtgtgtgtgtgtgtgtattcatagccgtaagtacacatgcctctacaggcgtgcctgtggatatatatgtgtggatgcatgtgtcatctgtgtgtgtgtgtgtttagagatagataggcacttgagtccta

SEQ ID NO: 19234 - DNA, 147 bp, Homo sapiens
  D12S1340
  Located on chromosome 12
  Distance between a terminus base of telomere on chromosomal short arm and 5'-terminus of this base sequence : 108153896
  Distance between 3'-terminus of neighbour sequence of sequence listing upward to telomere on chrosomal short arm and 5'-terminus of this base sequence : 20729
cctatcccacccaggccccaagtcccagggatacgcacacacgtatacacacacacacgtatacacacacacacacacacacacacacacacacacacacaccagtggcatttccccccgctaaccctggtgtgcctggggcagact

SEQ ID NO: 19235 - DNA, 144 bp, Homo sapiens
  chr12.fa.O7frz.121493460
  Located on chromosome 12
  Distance between a terminus base of telomere on chromosomal short arm and 5'-terminus of this base sequence : 108405479
  Distance between 3'-terminus of neighbour sequence of sequence listing upward to telomere on chrosomal short arm and 5'-terminus of this base sequence : 251436
tacaatgatacaaggcaggtacacatagagacacacacacagtcatacaaacacacagtcactgacacacacacacacacacacacacacacacaattccattcattcatttgttcattcgtttactccataaacattcacttg

SEQ ID NO: 19236 - DNA, 426 bp, Homo sapiens
  AC021161.4_66623
  Located on chromosome 12
  Distance between a terminus base of telomere on chromosomal short arm and 5'-terminus of this base sequence : 108465569
  Distance between 3'-terminus of neighbour sequence of sequence listing upward to telomere on chrosomal short arm and 5'-terminus of this base sequence : 59946
gtggacatcagtgatggagtgcagaggcggggttgacctccagctgccactcccgcagagtccctgatgccaagttgcacccacccatggactggaagcctccagacttcttcttcttcttgttctgggcacgcaccatctcccgggtgtccggctccacatccgaggtgcattccgaggtggggaaggtgggcaggggtcttccaggtcccagctgggagggaaggacagagaggtggtgtcactccaggcacagtgggaccacagggggcagggaaggggcctgtgctgttgccctctctcccccattcaagccaatgatgcttccgccagatcacgtcacttttttgctagtaagttctcctttggctgggccaggacagaagtttagagtggggtctgcagatagactgtctcggtttgaat

SEQ ID NO: 19237 - DNA, 480 bp, Homo sapiens
  chr12.fa.O7frz.111371981
  Located on chromosome 12
  Distance between a terminus base of telomere on chromosomal short arm and 5'-terminus of this base sequence : 108595110
  Distance between 3'-terminus of neighbour sequence of sequence listing upward to telomere on chrosomal short arm and 5'-terminus of this base sequence : 129115
tctcagtaaactatcgcaagaacaaaaaaccaaacaccacatattctcactcataggtgggaattgaacaatgagatcacatggacacaggaaggggaacatcacactctggggcctgttgtggggtgggggaaggggggagggatagcattgggagatatacctaatgctagatgaggagttagtgggtgcagcacaccagcgtggcacatgtatacatatgtaactaacctgcacaatgtgcacatgtaccctaaaacttaaagtataataataaaagaaaaaaaaatttctggttggcaatgcattattaaacttatatagtaattatgttttattctgtcttctcagatgtgcacgcgcgtgcgtgcgcgcgcgcgcgcacacacacacacacacacacacacgcacacgcacacaactttctttaagccaatgatcctactactctaagtagtttaaatgagaacttccttactc

SEQ ID NO: 19238 - DNA, 243 bp, Homo sapiens
  chr12.fa.O7frz.111298706
  Located on chromosome 12
  Distance between a terminus base of telomere on chromosomal short arm and 5'-terminus of this base sequence : 108747714
  Distance between 3'-terminus of neighbour sequence of sequence listing upward to telomere on chrosomal short arm and 5'-terminus of this base sequence : 152124
attcctaccagatcagaaagagagtctggctgattgaatatatatatatatattcttgatctctgtctctatgtatgcctgtatgtatgtatacatgtatgtatgtatgtgtgtgtgtgtgtgtgtgtgtgtgtataaaatacatcaagaatgatcaagaataattcatcaaaaatccatgtggaacactttggagtcttttattaaaagtaaacctttttctaaagaaccatgataagtttg

SEQ ID NO: 19239 - DNA, 101 bp, Homo sapiens
  DISD22_0008735
  Located on chromosome 12
  Distance between a terminus base of telomere on chromosomal short arm and 5'-terminus of this base sequence : 109012866
  Distance between 3'-terminus of neighbour sequence of sequence listing upward to telomere on chrosomal short arm and 5'-terminus of this base sequence : 264909
agccataggtctgtttcattatcagacctgtgtgtgtgtgtgtgtgtgtgtgtgtgtgtgtgtgtgtgtgtgtgcccgtgcacgtatgttgcataaatgta

SEQ ID NO: 19240 - DNA, 231 bp, Homo sapiens
  DISD22_0008737
  Located on chromosome 12
  Distance between a terminus base of telomere on chromosomal short arm and 5'-terminus of this base sequence : 109130917
  Distance between 3'-terminus of neighbour sequence of sequence listing upward to telomere on chrosomal short arm and 5'-terminus of this base sequence : 117950
cctggacctctcctctttcaaacaccgcacagctcatctcatctcatctcatctcatctcatctcatctcatctcatctcatctcattccatcccattccatcccatcccatcccatcccatcccaacccacccccaccaaaaggaaaacagaccagcctcgggatcggccacctccccagcagccccgctcttgggcatctctgcgccagcccgactcggctgttactat

SEQ ID NO: 19241 - DNA, 352 bp, Homo sapiens
  HUMUT835B
  Located on chromosome 12
  Distance between a terminus base of telomere on chromosomal short arm and 5'-terminus of this base sequence : 109309842
  Distance between 3'-terminus of neighbour sequence of sequence listing upward to telomere on chrosomal short arm and 5'-terminus of this base sequence : 178694
tgggtgacaaagggagactctgtcaaaaaagaaagaaggagagaaagaaagaaagaaagagagagagagagaaagaaaagaaagaaagaaagaaagggagagagaaagaaagaaagaaagaaagaaagaaagaaagaaagaaagaaagaaagaaagaaagaaagaaagaaggaaggaaggaaggaaggaaggaaggaaggaaagaaagaaagagaaagaaaagaaagaaagaaagaaagaaagaaagaaagaaagaaagaaagaaagaaagaaagaaaaataaagagagaaagaaagaaaggaagaaagaaagaaattcttgccctggtaaacagaagacctcaatgcctcc

SEQ ID NO: 19242 - DNA, 450 bp, Homo sapiens
  chr12.fa.O7frz.111997282
  Located on chromosome 12
  Distance between a terminus base of telomere on chromosomal short arm and 5'-terminus of this base sequence : 109339083
  Distance between 3'-terminus of neighbour sequence of sequence listing upward to telomere on chrosomal short arm and 5'-terminus of this base sequence : 28889
aagccatcactagattcagttaaaaaagaaaagaaaagaaagataagaaagaaagaaagaaagaaagaaagaaagaaagaaagaaagaaaaagaaagaaagaaagaaaataagaaagaaagaaagaaagaaagtgattgattaatcatgtctgccatggttatagtatggtagggagtaataggaaatgactgggaatcaaaaagcaagataaaagagggggttcctaaaagtactgttgaatgacttaaatatgagagctgtgtaggttagtggaaatatgggctttatccttagacagagctgactgtgaatcctaattagctgtgtaatcatggggtgacttacaaaaccctatgtgtaaaacgggatagttctgcatattacaaagctattgctacataagtattaactattattattttaacacttacgtagcaattctatgtgc

SEQ ID NO: 19243 - DNA, 265 bp, Homo sapiens
  D12S338
  Located on chromosome 12
  Distance between a terminus base of telomere on chromosomal short arm and 5'-terminus of this base sequence : 109440906
  Distance between 3'-terminus of neighbour sequence of sequence listing upward to telomere on chrosomal short arm and 5'-terminus of this base sequence : 101373
aaaatgggaggtcacttctaatattagattacaaaataaccatgaattccatcttgggtcacctttctctctctctcattctgtctcactgtgtgtgtgtgtgtgtgtgtgtgtgtgtgtgtgtgtgtatctctatatctattgatctatctgtagatagatctatatatttatatatttatatctatagtcatatagagggatatagatatgtatagatatagataaatagaataaggaactgatgtctccagccaacagccag

SEQ ID NO: 19244 - DNA, 462 bp, Homo sapiens
  chr12.fa.O7frz.112134006
  Located on chromosome 12
  Distance between a terminus base of telomere on chromosomal short arm and 5'-terminus of this base sequence : 109700076
  Distance between 3'-terminus of neighbour sequence of sequence listing upward to telomere on chrosomal short arm and 5'-terminus of this base sequence : 258905
tgctagcattagatctttattgtctcttataatctatgggcaggtgcagattctgtaaggaatatctgttctttcccatccacaaaaatggcctcccaaatatattcctgtcctaatccatggaacctgtgattatgttaccttgaatggcagaagagactttgcagatgtgacccaattaaggattttgaaatggaaagattatcctggattatctgggtagacctgatgtaattacaagcattcttgtaagagggaagcaggaggtggggtggaggggagagagagagagagagagagagagagaggaagagaggaagagaggaagtgaggaggagaggaggagaagagaagaggacaagagaagaagagaagagaggaagagagagaggggaagagagaggggaagagagaggggaagagagagaggaagagagaggctatacagtggctttgaagatg

SEQ ID NO: 19245 - DNA, 108 bp, Homo sapiens
  DISD22_0008749
  Located on chromosome 12
  Distance between a terminus base of telomere on chromosomal short arm and 5'-terminus of this base sequence : 109776304
  Distance between 3'-terminus of neighbour sequence of sequence listing upward to telomere on chrosomal short arm and 5'-terminus of this base sequence : 75766
cctaggcctggactcttgaggtgtgtgtgtgtgtgtgtgtgtgtgtgtgtgtgtttctttctccataatagtcccaaccctaaacaggggtatggcacagtacttctt

SEQ ID NO: 19246 - DNA, 464 bp, Homo sapiens
  chr12.fa.O7frz.112359810
  Located on chromosome 12
  Distance between a terminus base of telomere on chromosomal short arm and 5'-terminus of this base sequence : 109953573
  Distance between 3'-terminus of neighbour sequence of sequence listing upward to telomere on chrosomal short arm and 5'-terminus of this base sequence : 177161
tcttcattgtgagtacttcctaacaattttgatttatttgtttctagcagagtctgtattgatcagcaagcttgacgcactgatttataaagccatgagtgcctctgtgtgtgtgtgtgtgtgtgtgtgtgtgtgtgtgtgtgtgtgtgtgtgtgtgtctgtggtatgtgttacatatatgttcactcaacctttattctataaaatgtgcagatgcagctttcatattttaaaagtcttctgtgggcatgtctgttatactcccaatgcctagttaggtactctgtaatggttgctaaataagacctcatctctgggttgtgttcatgtgaaagcattgatctcattgattcgtccacatttaactcaagctttctttataggcagttgttctgcttcagaaacagaggtttcaggatcaagcctaatttgatccaatatattcaaatctggatagtaagctc

SEQ ID NO: 19247 - DNA, 197 bp, Homo sapiens
  D12S1075
  Located on chromosome 12
  Distance between a terminus base of telomere on chromosomal short arm and 5'-terminus of this base sequence : 110027814
  Distance between 3'-terminus of neighbour sequence of sequence listing upward to telomere on chrosomal short arm and 5'-terminus of this base sequence : 73777
ctcttcccccaaaggactggctttcctttccttccttcttgaaggattacagaataaataggaattggtacaaaatgtggatggatggatggatggatggatggatggatggatggatggatggatagatgggtgagtgagtggatggatagatggacagataggtggatggatgagaggacatctacacagggtgg

SEQ ID NO: 19248 - DNA, 410 bp, Homo sapiens
  chr12.fa.O7frz.112542169
  Located on chromosome 12
  Distance between a terminus base of telomere on chromosomal short arm and 5'-terminus of this base sequence : 110135854
  Distance between 3'-terminus of neighbour sequence of sequence listing upward to telomere on chrosomal short arm and 5'-terminus of this base sequence : 107843
ttactcatggaatacaggtgacttcaccaagattcaggtgaatccattacttcttattcccacaaaacgtctagagctgagtctagtctctggttttggcctattgacactgacattttgatctgagggtgaaaagggattcaacctaagagtatttcatgtcttaatctagaagagaggtattagtttaaaagtcattcattgaggaaacactttccacatattttccatgcattcattctctgtgtgtgtgtgtgtgtggtgtgtgtgtgtgtagactaccttttaggattttactctatgttatataactttactttgcaacttttactttcccgaaagtgcctggataagtaatgtgtaaagtgtaaggcaaagttgtttctgttctatcttgagcagttcataaa

SEQ ID NO: 19249 - DNA, 371 bp, Homo sapiens
  chr12.fa.O7frz.112617801
  Located on chromosome 12
  Distance between a terminus base of telomere on chromosomal short arm and 5'-terminus of this base sequence : 110209723
  Distance between 3'-terminus of neighbour sequence of sequence listing upward to telomere on chrosomal short arm and 5'-terminus of this base sequence : 73459
tgtccttgtcaggttaacatacacatacacacacaaagacaaacaccactaaattttactcaatctggtaaggctttggagagaagtttgaaattggtagccacatgaggttctttacatctactgatttcattaattatgcctgtcatttagatcccttgttataatacccgggagaataatgaattggctatataaaataattaacctaagaaataaaaacaggcaattcatttattttaatatgcatgtacatatatgcttatagaagacacacaaagacagacagacgtacacacacacacacacacacacacacacacacacatattttaatactaacctacttataaccatagctgttatgacag

SEQ ID NO: 19250 - DNA, 136 bp, Homo sapiens
  DISO7_10003570
  Located on chromosome 12
  Distance between a terminus base of telomere on chromosomal short arm and 5'-terminus of this base sequence : 110439791
  Distance between 3'-terminus of neighbour sequence of sequence listing upward to telomere on chrosomal short arm and 5'-terminus of this base sequence : 229697
ccatcttaacatgatgtgagtatggtgtgtgtgtgtgtgtgtgtgtgtgtgtgtgtgtgtgtgtgtgtgtcttgcttggggttattgagagtttaagatatataagtttattatttgcttcatatgtgccaacatt

SEQ ID NO: 19251 - DNA, 248 bp, Homo sapiens
  AC016257.11_100526
  Located on chromosome 12
  Distance between a terminus base of telomere on chromosomal short arm and 5'-terminus of this base sequence : 110444976
  Distance between 3'-terminus of neighbour sequence of sequence listing upward to telomere on chrosomal short arm and 5'-terminus of this base sequence : 5049
attatacttggcactgaactgtatcaaagagataaggtttagatgtttatagagcatacagacaagtgggagactatattattgtaagcacaattggaagctgctggggtagtatttcctgcaccccatcacatacatacatacatacacatatatatatatatatatatatatcacatttttaaaaatccattcattcctctatggacatttggactgcttctgcctcttggctattgtgattaatg

SEQ ID NO: 19252 - DNA, 116 bp, Homo sapiens
  DISO7_10003571
  Located on chromosome 12
  Distance between a terminus base of telomere on chromosomal short arm and 5'-terminus of this base sequence : 110546601
  Distance between 3'-terminus of neighbour sequence of sequence listing upward to telomere on chrosomal short arm and 5'-terminus of this base sequence : 101377
ttctcttcgtgtatccacatgaaataaaattcctattcattatttccattttgtctatttgtcaactacacacacacacacacacacacacacggacctatttctgtactccagaa

SEQ ID NO: 19253 - DNA, 102 bp, Homo sapiens
  DISO7_10003572
  Located on chromosome 12
  Distance between a terminus base of telomere on chromosomal short arm and 5'-terminus of this base sequence : 110797527
  Distance between 3'-terminus of neighbour sequence of sequence listing upward to telomere on chrosomal short arm and 5'-terminus of this base sequence : 250810
atataaatcttgccttctgttgtctggtgtgtgtgtgtgtgtgtgtgtgtttgtgtacatgtgcactagtgatggagagatatacctgtcccaggactcaga

SEQ ID NO: 19254 - DNA, 291 bp, Homo sapiens
  DISO7_10003573
  Located on chromosome 12
  Distance between a terminus base of telomere on chromosomal short arm and 5'-terminus of this base sequence : 110830126
  Distance between 3'-terminus of neighbour sequence of sequence listing upward to telomere on chrosomal short arm and 5'-terminus of this base sequence : 32497
ctgtgcatggtgttaaagtatgattttccaaaggttaaaaaaatgtgactctaaaaacaaaaccaaaaaagacatgcaataacaaaagggatgcatgtcaaagattttttattcaactcatttattagagaaggagtaatatgttaaaacctgtccaaaaagcatgtaagatgcttgagatacacacacacacacacacacacgcacacacacaggcgtgtgtgtgtgtatatatatgtgtgtgtatatatatatgcaatttaatatgtattgcaatctatgggatatctt

SEQ ID NO: 19255 - DNA, 123 bp, Homo sapiens
  DISO7_10003574
  Located on chromosome 12
  Distance between a terminus base of telomere on chromosomal short arm and 5'-terminus of this base sequence : 110837213
  Distance between 3'-terminus of neighbour sequence of sequence listing upward to telomere on chrosomal short arm and 5'-terminus of this base sequence : 6796
gtgggatctcactgagccaaattcggtgtgtgtgtgtgtgtgtgtgtgtgtttttaaataaggaaaactcttttatctctgatgaagaaacagtaaatgaaaatcttaacaggcaccctcaag

SEQ ID NO: 19256 - DNA, 380 bp, Homo sapiens
  chr12.fa.O7frz.113246945
  Located on chromosome 12
  Distance between a terminus base of telomere on chromosomal short arm and 5'-terminus of this base sequence : 110915294
  Distance between 3'-terminus of neighbour sequence of sequence listing upward to telomere on chrosomal short arm and 5'-terminus of this base sequence : 77958
accatgaagatgttcctagttttctgattctcagaaactgggtgagataatacatgtttgctggtttaagccactaagttttgggataatttgttatgcagcaatagataactaatacagattgtgtgtgtgtgtgtgtgtgtgtgtgtgtgtgtgtgtgtgtgtgtgtgtgtacaagatgaatatggcttctgcaatcatggagattaaattctagtggagcataggaaggagtcagctgacaataccaatacagtgtggaaagtgctatgggaaagcacagggtgccatgggagaacatagaaggggctctgggtataactcgaaagaggtgatggtcagaggaggcttcctgtactcagttacatctaaggtgcatc

SEQ ID NO: 19257 - DNA, 443 bp, Homo sapiens
  chr12.fa.O7frz.113497449
  Located on chromosome 12
  Distance between a terminus base of telomere on chromosomal short arm and 5'-terminus of this base sequence : 111120714
  Distance between 3'-terminus of neighbour sequence of sequence listing upward to telomere on chrosomal short arm and 5'-terminus of this base sequence : 205040
gtgccaaggattgttcttagcaacagggattgagcagtgaataaaaacagaaaaagcacctgcttttgctaagcttacttactttctaatcagggagaccagccagggtggtggctcacacctggaatcccagcacttggggaggctgaggcagatggatcacttaaggccaggaatctgagaccagcctggtctggctggtacaaaaatagaaaaattagccaggtatagtggtgcatgcccatggtcccagctacttggaaggctcagatggaaggatcacctgagtccaggaggtcaaggctgcagtgagtcgtgatcatgccactgccctccagcctgggtaacatagtaagattctgtctcaaaaatagacagaatgatagatagatagatagatagatagatagatagatagatagataaaggagaccaacagtaac

SEQ ID NO: 19258 - DNA, 101 bp, Homo sapiens
  DISO7_10003577
  Located on chromosome 12
  Distance between a terminus base of telomere on chromosomal short arm and 5'-terminus of this base sequence : 111155040
  Distance between 3'-terminus of neighbour sequence of sequence listing upward to telomere on chrosomal short arm and 5'-terminus of this base sequence : 33883
tgtaatctacaagcatgtcaagtggggtgtgtgtgtgtgtgtgtgtgtgtgtgtgtgtgtgtgtgtgtcatgggagagatagctcatgtcatctgaggaca

SEQ ID NO: 19259 - DNA, 234 bp, Homo sapiens
  D12S1683
  Located on chromosome 12
  Distance between a terminus base of telomere on chromosomal short arm and 5'-terminus of this base sequence : 111161908
  Distance between 3'-terminus of neighbour sequence of sequence listing upward to telomere on chrosomal short arm and 5'-terminus of this base sequence : 6767
agtctgtggcaagaaacgtaatgacaactggtgatgtgtgtgtgtgtgtgtgtgtgtgtgtgtgtgtgtgcatgtgtgtgtctgcatgtgtgtagctgggggaggtgaacctaggacatcttatcctaccaaatagaaaggatgctactaaagactattaagggcaagtcaaaacagctcagctaccaaccttaagagctttccactggccaaagatgggacactttgagttca

SEQ ID NO: 19260 - DNA, 359 bp, Homo sapiens
  chr12.fa.O7frz.113627358
  Located on chromosome 12
  Distance between a terminus base of telomere on chromosomal short arm and 5'-terminus of this base sequence : 111249637
  Distance between 3'-terminus of neighbour sequence of sequence listing upward to telomere on chrosomal short arm and 5'-terminus of this base sequence : 87495
gcatcagtttcatctgtagactagttagaagtgccaattctcagcccccattccacacctgcaggtatgggaactctggagtggggcccagaagtgtgtatgtgcatgcatatgtgtgtgtgtgtgtgtgtgtgtgtgtgtgtgttaacttttttatattgaaataatttcagattgacagaagagttgtaaagacagtacaaagattttccttacacccatcttcccttgatgtcaacctcttactccatcgtggcacatttttcaaaactaagagattaacagttatatggcactaataactaaactgcaaactttatctggatttctctagtgttagtgatctgtggtttaacaag

SEQ ID NO: 19261 - DNA, 391 bp, Homo sapiens
  chr12.fa.O7frz.113698254
  Located on chromosome 12
  Distance between a terminus base of telomere on chromosomal short arm and 5'-terminus of this base sequence : 111290377
  Distance between 3'-terminus of neighbour sequence of sequence listing upward to telomere on chrosomal short arm and 5'-terminus of this base sequence : 40381
ctcctcataaatctgtacaggagaaaaacaagaggccagacaagaagaagcatgtctgaggtaaaaggaaaaacatgtttggtcctaatagggttgtggtggaggaagaaagggggaggaactgctctgcagcaatctgccctgaggtagggactgatctgtgaggctgccagcatctgcagcaagatgttaatgggggttatcagctgtcgctggagcccaggcagggaatatgttggcagctgaaagctctagcacagccaaaatgtgtgtgtgtgtgtgtgtgtgtgtgtgtgtgtccaagaagaaacaccagccttattgtctctagacatcctcagagaacaaatggtcttggcgagtcaagctctgaataccagttacacaagac

SEQ ID NO: 19262 - DNA, 228 bp, Homo sapiens
  AC011595.12_105182
  Located on chromosome 12
  Distance between a terminus base of telomere on chromosomal short arm and 5'-terminus of this base sequence : 111445314
  Distance between 3'-terminus of neighbour sequence of sequence listing upward to telomere on chrosomal short arm and 5'-terminus of this base sequence : 154546
acagactgatgtttatcagcctctcccagtaaaactgtcattgccactgacacaagattaatagaaatctagattagcctgtgttcttggcacttcgatgggaaagcagtattaatcaacacacacacacacacacacacacacacacacagagagagagagagagcgttctcagatcttgagccattcaaacttaggcttcggctctaagatttaatgccatacgga

SEQ ID NO: 19263 - DNA, 256 bp, Homo sapiens
  chr12.fa.O7frz.114152451
  Located on chromosome 12
  Distance between a terminus base of telomere on chromosomal short arm and 5'-terminus of this base sequence : 111685101
  Distance between 3'-terminus of neighbour sequence of sequence listing upward to telomere on chrosomal short arm and 5'-terminus of this base sequence : 239559
tacagcaaggaacttatcaaacttgactcttgctcatgagattgctgtaaatgagaactttcaattgaaacaagaggctctcccagaaaagaggtaaccggggggcatttgttgtatataaactgctgaagattctgtgtgtgtgtgtgtgtgtgtgtgtgtgtgtgtgtgtgtgtgagagagagagagagagagagagagacagagagagagatagacacatatttacactgattcctggaagttcttgtataat

SEQ ID NO: 19264 - DNA, 173 bp, Homo sapiens
  DISO7_10026401
  Located on chromosome 12
  Distance between a terminus base of telomere on chromosomal short arm and 5'-terminus of this base sequence : 111776216
  Distance between 3'-terminus of neighbour sequence of sequence listing upward to telomere on chrosomal short arm and 5'-terminus of this base sequence : 90859
ggactgatggctgctatatgtctacacacacacacacacacacacacacacacacacacacacaaatatattttacttgtgtctgtattttctaaatttcctacaatgacaatgtatcattttttttagtaagagaaaaaagggaaccagtgtgttaggcagtatgctatgct

SEQ ID NO: 19265 - DNA, 464 bp, Homo sapiens
  AL359978.14_317247
  Located on chromosome 12
  Distance between a terminus base of telomere on chromosomal short arm and 5'-terminus of this base sequence : 111796720
  Distance between 3'-terminus of neighbour sequence of sequence listing upward to telomere on chrosomal short arm and 5'-terminus of this base sequence : 20331
atacgagtctaccacagtttgtctatatattatttgtatggtttccagattttagctgctatgaatagctagtataagtatcttgagtgccctcctcctgccagcagcactgtcatctcctgggagctgattaggcattcatactcgtgggcactaccttagacctactaagctggaaattgtaagggcagggcctgcaatttgtgtgtgtgtgtgtgtgtgtgtgtgtgtgtgtgtgtgtgtgtgtttaagacagagtctcactctgtcgctcaggctggagtgtagtggcgcaatctcggctcactgcaacctctacctcctgggttcaagcagttctctgcttcagcttcccaaatagctgggattacaggcacccgccaccagacccggctaatttttgtatttttagtagagacagggtttcaccatcttggccaggctggtcttgaactccagctaat

SEQ ID NO: 19266 - DNA, 464 bp, Homo sapiens
  AC009721.9_136385
  Located on chromosome 12
  Distance between a terminus base of telomere on chromosomal short arm and 5'-terminus of this base sequence : 111895624
  Distance between 3'-terminus of neighbour sequence of sequence listing upward to telomere on chrosomal short arm and 5'-terminus of this base sequence : 98440
atggactaaacatattgcattgtcccaatccattgcagttattattcttctgatgatcagattactccctctttggccaagacaagctgttcaaaatgtctcctgagcccttttgatacaaactcagtaacacttggaaatttccttgcttccaagtatgacatgatgttccagtctcccattgtacattttctgtcccaggcctgaacccaaccttttctctaaatgagcctagtttgtgtgtgtgtgtgtgtgtgtgtgtgtgtgtgtgtgtgtgtgtgtgtgaaataatatttcaagaccacaatctaggtgttagggaaacagtactgctgagcaggtaattggttccaggcctttttgatggttaaaactaagatagatagatgagacagagcgagagcaagctgtggtctgaaagtgtccccttcaaaattcaagtgttgccaatgtgatagtattaa

SEQ ID NO: 19267 - DNA, 215 bp, Homo sapiens
  chr12.fa.O7frz.114623316
  Located on chromosome 12
  Distance between a terminus base of telomere on chromosomal short arm and 5'-terminus of this base sequence : 112057793
  Distance between 3'-terminus of neighbour sequence of sequence listing upward to telomere on chrosomal short arm and 5'-terminus of this base sequence : 161705
gaaggtaactacaactgaagtgactatttggggtgggtggtttctctctctttctctctctctctctgtctctatctctctctctctctcacacacacacacacacacacacacacacacacacacacacacatttattgcaaaaccgtgagtttaaaaatataaagatagaaatccaggccaggagaggtggctcatgcctgtaatttcagcac

SEQ ID NO: 19268 - DNA, 168 bp, Homo sapiens
  D12S330
  Located on chromosome 12
  Distance between a terminus base of telomere on chromosomal short arm and 5'-terminus of this base sequence : 112156461
  Distance between 3'-terminus of neighbour sequence of sequence listing upward to telomere on chrosomal short arm and 5'-terminus of this base sequence : 98453
agctccagacatgtgtattctatgtctctctctctctctctctctctctctctgtgtgtgtgtgtgtgtgtgtgtgtgtgtgtgtgtataaagtatataaattatttagaaacagaatcttgtttcgttgcccatgctggagtgcagtggcatgattatagtcccctg

SEQ ID NO: 19269 - DNA, 288 bp, Homo sapiens
  AC007541.9_115608
  Located on chromosome 12
  Distance between a terminus base of telomere on chromosomal short arm and 5'-terminus of this base sequence : 112327793
  Distance between 3'-terminus of neighbour sequence of sequence listing upward to telomere on chrosomal short arm and 5'-terminus of this base sequence : 171164
ctgtatgctattgtttagcctttgaaacttctgctggtgtgagtgccctcaggggttccccaggaatatcgatacaacaccaacaggtaaacgcgcgcgcccgtgtgtgtgtgtgtgtgtgtgtgtgtgtgtgtgtgtgtgtgtgtgtatgtgtgtgcgcgctcgcgcccatgcttaactttttaaaaagaaagggagaagtagcctttgataaacccatatgcatcctgttttgctttttccactttcatttctttagtctttgttagaacagatgtaccagaaacc

SEQ ID NO: 19270 - DNA, 210 bp, Homo sapiens
  AC007541.9_74127
  Located on chromosome 12
  Distance between a terminus base of telomere on chromosomal short arm and 5'-terminus of this base sequence : 112369265
  Distance between 3'-terminus of neighbour sequence of sequence listing upward to telomere on chrosomal short arm and 5'-terminus of this base sequence : 41184
taatttcgaattccttgatcagaaagaaaatagaattaaaataaatgatttttatatatattcattaagtatgttatatattgtctttgtatacaacggtgtactaggaaatataagagattaaacacacacacacacacacacacacacacacacaagctcagaaatggtccttggatggggcaaatgtatggtattgccagaaaggta

SEQ ID NO: 19271 - DNA, 126 bp, Homo sapiens
  DISD22_0008757
  Located on chromosome 12
  Distance between a terminus base of telomere on chromosomal short arm and 5'-terminus of this base sequence : 112592265
  Distance between 3'-terminus of neighbour sequence of sequence listing upward to telomere on chrosomal short arm and 5'-terminus of this base sequence : 222790
tgctgagattctgtaagagggtaaatttttaaggaaacacacacacacagacacacagacacacacacacacacacacacacacacactctcacacacacaggaaagactagctaagttagcatct

SEQ ID NO: 19272 - DNA, 411 bp, Homo sapiens
  AC007649.12_66080
  Located on chromosome 12
  Distance between a terminus base of telomere on chromosomal short arm and 5'-terminus of this base sequence : 112667574
  Distance between 3'-terminus of neighbour sequence of sequence listing upward to telomere on chrosomal short arm and 5'-terminus of this base sequence : 75183
aacttctattgagcacttgcttagggttaggtaattcccactcagtctcttcacaggctctacaaggaaggggcgattaaagttcccattttacaattgagaaattaagacccagcaaagcaaaggagcttgcccaaggtcacatagccaatatggggctgcagagccaggacttgggcccaggaaatggccccagagctcattcatgatcactgccctattctaccctcactgggaaggcactcaactgtgtgtccagctctatgcttggcagagggaggtgcaagtgtgtgtgtgtgtgtgtgtgtgtgcgtgcgtgtatatttgtgagtgtgtgtgcatatttgtgagtgtgtgtgcaagaactgggatcaggggaggaagagagtgaggattacagatgtttctttg

SEQ ID NO: 19273 - DNA, 260 bp, Homo sapiens
  D12S1613
  Located on chromosome 12
  Distance between a terminus base of telomere on chromosomal short arm and 5'-terminus of this base sequence : 112667833
  Distance between 3'-terminus of neighbour sequence of sequence listing upward to telomere on chrosomal short arm and 5'-terminus of this base sequence : -152
ctctatgcttggcagagggaggtgcaagtgtgtgtgtgtgtgtgtgtgtgtgcgtgcgtgtatatttgtgagtgtgtgtgcatatttgtgagtgtgtgtgcaagaactgggatcaggggaggaagagagtgaggattacagatgtttctttgctcttagttgtggaaggaagactgatacacaagaaagcatgatgattaattcaagatgaaatataattaagtgacaagttacatggccctgaccctagtgccttgaga

SEQ ID NO: 19274 - DNA, 226 bp, Homo sapiens
  AC007649.12_73132
  Located on chromosome 12
  Distance between a terminus base of telomere on chromosomal short arm and 5'-terminus of this base sequence : 112674816
  Distance between 3'-terminus of neighbour sequence of sequence listing upward to telomere on chrosomal short arm and 5'-terminus of this base sequence : 6723
acaatactttgcatccttcaatccaatcaagttgacacttcatactgaccatcacacctatcaattgttgctacatttgcttttttccatgtatgtacacacacacacacacacacacacacacacacacacacacacacacacttcttttgactgaatcatttgaaaagaagttgcaaataccacaacactttgcttctaactactcagcatgaatctcctaaga

SEQ ID NO: 19275 - DNA, 355 bp, Homo sapiens
  AC007649.12_120357
  Located on chromosome 12
  Distance between a terminus base of telomere on chromosomal short arm and 5'-terminus of this base sequence : 112722014
  Distance between 3'-terminus of neighbour sequence of sequence listing upward to telomere on chrosomal short arm and 5'-terminus of this base sequence : 46972
cctagtggaagtcttgcaatagtcatgttatcaaactccatgttacacatcaagaaactgaggctcagggagatgaaatgtctttagtcagtgcctgatttttatataaatgagctactgaaagtgtgtgtgtgtgtgtgtgtgtgtgtgtgtgtgtgtgtgtgtgtcaaatgtcataagggactaaggaagggagactgcttcccagttacaaaaacattgtggaattcctatttatgtatcattttcgatgacatgcctcttatgttttgtacatgttctttcattttgttcttttccttcttgaatgactatgggttgttcaccttacgtcagtaagtgtcaaattgaagct

SEQ ID NO: 19276 - DNA, 234 bp, Homo sapiens
  AC007649.12_142890
  Located on chromosome 12
  Distance between a terminus base of telomere on chromosomal short arm and 5'-terminus of this base sequence : 112744490
  Distance between 3'-terminus of neighbour sequence of sequence listing upward to telomere on chrosomal short arm and 5'-terminus of this base sequence : 22121
acctggatttgatcgtcagtgggggaggggaaggaaggagcaaagcgggtgtgtgtttgtgtgtgttggggaggggaatccgcactgatctcggagactcttcgggatctctttgccagagcccttccccgtctgctgccagccagggcacaaccctcaaagagaggatatcttcgaggccacacacacacacacacacacacacacatcctgaaatatcgactaagatggaaa

SEQ ID NO: 19277 - DNA, 214 bp, Homo sapiens
  U15223.1_142
  Located on chromosome 12
  Distance between a terminus base of telomere on chromosomal short arm and 5'-terminus of this base sequence : 112812811
  Distance between 3'-terminus of neighbour sequence of sequence listing upward to telomere on chrosomal short arm and 5'-terminus of this base sequence : 68087
ggactgggatatctaggatgactccctaaaatgtctggtgccttggtggaagatggttgcaagtgtgaggtcaggtgggatgctggggcatgtgtgtgtgtttgtgtgtgtgtgtgtgtgtgtgtgtgtgtgtgtgtgtatgtatctgtctgttctccttccctgacagaaaaccacttcctcttcccaaagcctttccatgatgtctttccat

SEQ ID NO: 19278 - DNA, 330 bp, Homo sapiens
  AC007540.3_162948
  Located on chromosome 12
  Distance between a terminus base of telomere on chromosomal short arm and 5'-terminus of this base sequence : 112931002
  Distance between 3'-terminus of neighbour sequence of sequence listing upward to telomere on chrosomal short arm and 5'-terminus of this base sequence : 117977
ctgtaacactcatgaacattgtacctattccactacattgagagtttctcaaggggaagatctatgttttaattttcattgaagtcctaatctggcacattatattgagtagattgatggaagggtagaaagatggatggatggatggatggatggatggatggatggatggatggaagagtagatgtatagatgaatagatagatgaatggaagttaagctccaagaaggaagctcctttgttttctcctgtatctcccattgcttagcacaatgagtagcacataggagatgctgaaaaaaattgtttagttaattgaaggatgatca

SEQ ID NO: 19279 - DNA, 219 bp, Homo sapiens
  AC007540.3_149756
  Located on chromosome 12
  Distance between a terminus base of telomere on chromosomal short arm and 5'-terminus of this base sequence : 112944232
  Distance between 3'-terminus of neighbour sequence of sequence listing upward to telomere on chrosomal short arm and 5'-terminus of this base sequence : 12900
gagataattatcgttggctacaaggatcaataaatgacaagggtggcaccagtccgagtttggactggcagtcgctggtcacatgtcttcatataagttgtgtgtgtgtgtgtgtgtgtgtgtgtgtgtgtgtgtgtgtataaggttaccatggccttcgtgcaaggctgtgatttttgcagaggtgttctgtgatagttcttgttatcaggcatttgt

SEQ ID NO: 19280 - DNA, 206 bp, Homo sapiens
  AC007540.3_106923
  Located on chromosome 12
  Distance between a terminus base of telomere on chromosomal short arm and 5'-terminus of this base sequence : 112987020
  Distance between 3'-terminus of neighbour sequence of sequence listing upward to telomere on chrosomal short arm and 5'-terminus of this base sequence : 42569
gatttccatgttagtgcatttatcctggcagcaatgtgaaaggattgaagagagaaactggaatcaggaaattatcatgaaaataatgcaatggtctgatcttaaaatgagtctctctctctctctatctatctctctgtgtgtgtgtgtgtgtgtgtgtgtgtgtgtgtgtgtgtgtgtgtgtttggctaatcagttaaattgag

SEQ ID NO: 19281 - DNA, 217 bp, Homo sapiens
  AC007540.3_104375
  Located on chromosome 12
  Distance between a terminus base of telomere on chromosomal short arm and 5'-terminus of this base sequence : 112989609
  Distance between 3'-terminus of neighbour sequence of sequence listing upward to telomere on chrosomal short arm and 5'-terminus of this base sequence : 2383
gaaggtttgttactgcaatttaacacaaaatttagcattgagtttcttagccgccaaggcaaaacaggaaacaggcatgatgtagctttcatcatctaatttaaatacacacacacacacacacacacacacacacacacacaaacatctttaccaaaacacagttcatgaaagatcttttctgactgcagcaagttcaatccaggtctgatactct

SEQ ID NO: 19282 - DNA, 103 bp, Homo sapiens
  D12S353
  Located on chromosome 12
  Distance between a terminus base of telomere on chromosomal short arm and 5'-terminus of this base sequence : 113060829
  Distance between 3'-terminus of neighbour sequence of sequence listing upward to telomere on chrosomal short arm and 5'-terminus of this base sequence : 71003
tggcaaatcggagagcactgattttgtgtgtgtgtgtgtgtgtgtgtgtgtgtgtgtgtgtgtgtgtgtgtggtatggtgtcctgttgccctcccaatgaatt

SEQ ID NO: 19283 - DNA, 302 bp, Homo sapiens
  AC007540.3_16200
  Located on chromosome 12
  Distance between a terminus base of telomere on chromosomal short arm and 5'-terminus of this base sequence : 113077832
  Distance between 3'-terminus of neighbour sequence of sequence listing upward to telomere on chrosomal short arm and 5'-terminus of this base sequence : 16900
ttctgcttggctatcagtaaatcaaaaagtacagtcagtctacattgtatacacacacacacacacacacacacacacacacacacacacacacagtgttctagttaaatgaggattataccaaaatctggtttctcaggacacaagcattttttttttaatcttaaactgattactttgcagaagagagggctctctctctctctgtaccaaggcagagagcctgattagccttgtgctcttctgccctcctccttgaccatggtcactcaaattgccccatgaacttgacatccacagtg

SEQ ID NO: 19284 - DNA, 186 bp, Homo sapiens
  U15221.1_120
  Located on chromosome 12
  Distance between a terminus base of telomere on chromosomal short arm and 5'-terminus of this base sequence : 113077832
  Distance between 3'-terminus of neighbour sequence of sequence listing upward to telomere on chrosomal short arm and 5'-terminus of this base sequence : -302
ttctgcttggctatcagtaaatcaaaaagtacagtcagtctacattgtatacacacacacacacacacacacacacacacacacacacacacacagtgttctagttaaatgaggattataccaaaatctggtttctcaggacacaagcattttttttttaatcttaaactgattactttgcagaag

SEQ ID NO: 19285 - DNA, 247 bp, Homo sapiens
  chr12.fa.O7frz.115896345
  Located on chromosome 12
  Distance between a terminus base of telomere on chromosomal short arm and 5'-terminus of this base sequence : 113269941
  Distance between 3'-terminus of neighbour sequence of sequence listing upward to telomere on chrosomal short arm and 5'-terminus of this base sequence : 191923
ggaaattcaataaagaggtctaagaaacaaagattaaccaaagtctcaaataatgtatctattacaatatgcattattaagcatgcaataaatacacacacacacacacacacacacacacacacacagagagagagagagagagagagagagagagaaaatataaggaagcttcctcaatctgataaagagtatccactaagattcttctgctataattatgcttaattgtgaaagattgaatgat

SEQ ID NO: 19286 - DNA, 429 bp, Homo sapiens
  chr12.fa.O7frz.116010449
  Located on chromosome 12
  Distance between a terminus base of telomere on chromosomal short arm and 5'-terminus of this base sequence : 113306827
  Distance between 3'-terminus of neighbour sequence of sequence listing upward to telomere on chrosomal short arm and 5'-terminus of this base sequence : 36639
atcaactgcatatcagaatcacttggggaggccggatgtgtggtggctcatgcctgtaatcctagcattgtgggaggctgaggcaggagtattgcttgatcccaggagtctgagaccagcctgggcaacatagtaagaccttatttctactaaaacttagaaattagccaggtgtgcttgtgctatagtctcagctactcaagaggctgaggcaagaggattgcttcagtccaggagatcgaggctgcagtgagctgtgattgcaccactgcactccagcctgggtgacagagggagaccctgtctcaaataataataataataataataataataataataataataataataataataataatttggggagctttaaaaaatgttgatgcctagaccccatcctagagattctgactaagttggtct

SEQ ID NO: 19287 - DNA, 101 bp, Homo sapiens
  DISD22_0008762
  Located on chromosome 12
  Distance between a terminus base of telomere on chromosomal short arm and 5'-terminus of this base sequence : 113500644
  Distance between 3'-terminus of neighbour sequence of sequence listing upward to telomere on chrosomal short arm and 5'-terminus of this base sequence : 193388
tccaaatggagctcattaagtggtgtgtgtgtgtgtgtgtgtgtgtgtgtgtgtgtgtgtgtgtttgtaacacccagggcctgtacttccaccagaagctc

SEQ ID NO: 19288 - DNA, 433 bp, Homo sapiens
  chr12.fa.O7frz.116197198
  Located on chromosome 12
  Distance between a terminus base of telomere on chromosomal short arm and 5'-terminus of this base sequence : 113664680
  Distance between 3'-terminus of neighbour sequence of sequence listing upward to telomere on chrosomal short arm and 5'-terminus of this base sequence : 163935
taccagaaccaatctatatgctaggttcagatccctaaactcaggcaagtggtttaacctttgtgcctttgtttccccatttaaaactgagtttggctgggcatgatggctcatgcctgtaatcccagcactttgggagagaagccaaggtgggcagatcacctgaggtcgggagttcaaggccagcctggccaacatggtgaaaccctgtctctactaaaaaatacaaaaattagccaggtgtggtggtgcacacctataaccccagctacttgagaggctgaggcatgagaatcgcttgaacctggaggcagaggttgcagtgagccgagatcacaccactgcactccagcctgggtgacagagtgagactctgtctcaaacaaacaaacaaacaaacaaacaaaaactgacttagcacgagtacttacat

SEQ ID NO: 19289 - DNA, 201 bp, Homo sapiens
  D12S1605
  Located on chromosome 12
  Distance between a terminus base of telomere on chromosomal short arm and 5'-terminus of this base sequence : 113874328
  Distance between 3'-terminus of neighbour sequence of sequence listing upward to telomere on chrosomal short arm and 5'-terminus of this base sequence : 209215
ctgagccttggagggtatgaagcctttgccaggtggagcagccgagggaaatgacatacctgcagaggaacagaggcttgaaaaagtgtggttaggggctgtgtgtgtgtgtgtgtgtgtgtgtgtgtgtgtgttaggggaggggagaaggcaggagatgtggctaaggaaagaagagggtttcagattgtgagatccctg

SEQ ID NO: 19290 - DNA, 226 bp, Homo sapiens
  AC010206.8_133519
  Located on chromosome 12
  Distance between a terminus base of telomere on chromosomal short arm and 5'-terminus of this base sequence : 113961061
  Distance between 3'-terminus of neighbour sequence of sequence listing upward to telomere on chrosomal short arm and 5'-terminus of this base sequence : 86532
ggattcatacgaaagcctaaaggactgagcaggactattcctgacagcaaggagggcgtggtctggtaggaacaaggacagggggccctgaagggaaggaggaaggagatgagcggaggaggagaaaaagcacggcacttgagtatttggggggtgtgtgtgtgtgtgtgtgtgtgaccatttcctttaaaaatcaatgagaatgtttagaatggtgaacagtgga

SEQ ID NO: 19291 - DNA, 384 bp, Homo sapiens
  AC010206.8_132387
  Located on chromosome 12
  Distance between a terminus base of telomere on chromosomal short arm and 5'-terminus of this base sequence : 113962138
  Distance between 3'-terminus of neighbour sequence of sequence listing upward to telomere on chrosomal short arm and 5'-terminus of this base sequence : 851
aacaatgagaacacttggacacaggaaggggaacatcacacaccggggtcctgttgtggggtgggggaaggggggagggatagcattaggagatatacctaatgtaaatgacgagttaatgggtgcagcacaccaacatggcacatgtatacatatgtaacaaacctgcacgttgtgcacatgtaccctagaacttaaagtataatatatatatatatatatatatatataaaagaaggagacagtgaggctggagcatcatgagggagagggagagggagtggagcgggaatcagagtgaccaagaacaacagctgggttgctacaactggctcttgtgagccactgtgattgggttactgttcattataaaggaccattgct

SEQ ID NO: 19292 - DNA, 285 bp, Homo sapiens
  AC010206.8_61778
  Located on chromosome 12
  Distance between a terminus base of telomere on chromosomal short arm and 5'-terminus of this base sequence : 114032829
  Distance between 3'-terminus of neighbour sequence of sequence listing upward to telomere on chrosomal short arm and 5'-terminus of this base sequence : 70307
agtcagtagctacaccatatcctcaacttctacagaagacaaagtataaaaggcagggactgtgctgcagaggcgagaagacgagaggggaggagagaggagtggagaggaggggaagggaggggaggggaggggaggggaggggagggaagggaagggaaggaaagggaagggaagggaaggatccctctggcattaatccgtcttagtcccaatcccaaattcccaggataaagactctacatggggaggtgtttcccctttagctaatttgctatgaatagg

SEQ ID NO: 19293 - DNA, 213 bp, Homo sapiens
  D12S84
  Located on chromosome 12
  Distance between a terminus base of telomere on chromosomal short arm and 5'-terminus of this base sequence : 114192553
  Distance between 3'-terminus of neighbour sequence of sequence listing upward to telomere on chrosomal short arm and 5'-terminus of this base sequence : 159439
gcttacagtaggtgcttaataaatgtaacacacacacacacacacacacacacacacacacacacacacacacttttgcctcccaatttgccttcagggcagcagaatttctttggggtagagttcttatctgggggaagaatctacggcccaaccttggccccactttcctggaggcagggactttaggaagaagccattagcctagagaca

SEQ ID NO: 19294 - DNA, 172 bp, Homo sapiens
  D12S1637
  Located on chromosome 12
  Distance between a terminus base of telomere on chromosomal short arm and 5'-terminus of this base sequence : 114196552
  Distance between 3'-terminus of neighbour sequence of sequence listing upward to telomere on chrosomal short arm and 5'-terminus of this base sequence : 3786
gggcctcaaagtcagagatggaaaaaaaaggaaaacagaagaaagaggaaagaggaagagaattccaggcaacagaagcccagatatcgacaatatggggtgtgtgtgtgtgtgtgtgtgtgtgtgtgtgtgtgtgtgaatgtgtgtacagcagggcacaactggcccccac

SEQ ID NO: 19295 - DNA, 145 bp, Homo sapiens
  D12S105
  Located on chromosome 12
  Distance between a terminus base of telomere on chromosomal short arm and 5'-terminus of this base sequence : 114520059
  Distance between 3'-terminus of neighbour sequence of sequence listing upward to telomere on chrosomal short arm and 5'-terminus of this base sequence : 323335
tttacctaaggctggatctgccacatctgacaatctgtctctggcttgtcatgaggacctcatgcatttattttgtattttaaaacacacacacacacacacacacacacacacacacacgttgctataatcagtgtcaactttg

SEQ ID NO: 19296 - DNA, 318 bp, Homo sapiens
  AC007637.9_40136
  Located on chromosome 12
  Distance between a terminus base of telomere on chromosomal short arm and 5'-terminus of this base sequence : 114739752
  Distance between 3'-terminus of neighbour sequence of sequence listing upward to telomere on chrosomal short arm and 5'-terminus of this base sequence : 219548
tccaacaggaatcaatgtaaacaatgtattctcacacctcataattcacaaccattgtagcacacttttgtctttatgctgcacttctctttctctctctctctctctctctctctcgttgcccaggctggagtgcagtggcgtgatcttggctcactgcaacctccccctcctgagctcaagcaattctcctgcctcagcctcctgagtacctgggactacaggcacacaccactgcccatggctaatttttatattttttgtggagacggggtttcgccatgttgcccaggcaggttgtaaactcctgagctcaag

SEQ ID NO: 19297 - DNA, 238 bp, Homo sapiens
  chr12.fa.O7frz.117355013
  Located on chromosome 12
  Distance between a terminus base of telomere on chromosomal short arm and 5'-terminus of this base sequence : 114768259
  Distance between 3'-terminus of neighbour sequence of sequence listing upward to telomere on chrosomal short arm and 5'-terminus of this base sequence : 28189
caccaacagatgactagatacagaaaatttggtgtatatatatatataattttttatggctcagtagtattcttttgtgtgtatgtgtgtgtgtggtgtgtgtgtgtgtgtatacctacatgtatacatgggtgttcctcttacaaaattaatagcttttttcttattgaaaataacacatcattgcagaacattttttaaaatatagcaaagagataacggctcttaatactttagc

SEQ ID NO: 19298 - DNA, 230 bp, Homo sapiens
  AC007637.9_169846
  Located on chromosome 12
  Distance between a terminus base of telomere on chromosomal short arm and 5'-terminus of this base sequence : 114869518
  Distance between 3'-terminus of neighbour sequence of sequence listing upward to telomere on chrosomal short arm and 5'-terminus of this base sequence : 101021
ggacattcacatttctaaatcaacctttttaacattatatatatatatatatatatatatatatatattgccatcgtgaatttatttctcagcatacacaaaagatagcaattgaagtatttggggctgatggggattatcagaattttggtggcaaaatgttcctttagaattcccaatcagagataagatattttactaattttgtttgaatgacagctttgttttac

SEQ ID NO: 19299 - DNA, 263 bp, Homo sapiens
  AC012384.16_164854
  Located on chromosome 12
  Distance between a terminus base of telomere on chromosomal short arm and 5'-terminus of this base sequence : 114880291
  Distance between 3'-terminus of neighbour sequence of sequence listing upward to telomere on chrosomal short arm and 5'-terminus of this base sequence : 10543
taaggcctttctcagttcaagtcagaggaatgttccgtgtccctagccctcgggtctgccttatctcagttcacaggcccaccctgcgatccgctcctcactctgtcttagaatcttctcacccttcccctcaccagctcccaagcgtagcaggggtgcttgtttaaaaagctcagattgactctggccctgcctcagtctctctctctctctctctctcttttttttttttttttttttgagatggagtttcactctgtcac

SEQ ID NO: 19300 - DNA, 244 bp, Homo sapiens
  AC012384.16_112226
  Located on chromosome 12
  Distance between a terminus base of telomere on chromosomal short arm and 5'-terminus of this base sequence : 114933035
  Distance between 3'-terminus of neighbour sequence of sequence listing upward to telomere on chrosomal short arm and 5'-terminus of this base sequence : 52481
gagtaacaagccacctagattcaagggagggaattagactctaccttttttttatattttattttattttattttattttattttattttattttattttattttttgagacagcatctcactctgttgttcagtctgaagtgtagtggcacaatcttggctcactgcaacctccgcctcctgggttcaagcaattctcctgcctcagcctcctgagtagccgggattacaggcatgtcaccat

SEQ ID NO: 19301 - DNA, 239 bp, Homo sapiens
  D12S1583
  Located on chromosome 12
  Distance between a terminus base of telomere on chromosomal short arm and 5'-terminus of this base sequence : 114993526
  Distance between 3'-terminus of neighbour sequence of sequence listing upward to telomere on chrosomal short arm and 5'-terminus of this base sequence : 60247
ccccttgtttacttccagtagctttatatagattttaaatttgcatttaggtctaagatgcatctcaagttcgtgtgtgtgtgtgtgtgtgtgtgtgtgtgtgtgtgtgtgtgtgtgtagtgtagtgtaatgtaatatagggactgaaatgcatttttactttctttttctatttatatatttttaagtagagatgggaatctccctgtgttgcccaggctggtctccaactcctggct

SEQ ID NO: 19302 - DNA, 212 bp, Homo sapiens
  D12S1645
  Located on chromosome 12
  Distance between a terminus base of telomere on chromosomal short arm and 5'-terminus of this base sequence : 115207462
  Distance between 3'-terminus of neighbour sequence of sequence listing upward to telomere on chrosomal short arm and 5'-terminus of this base sequence : 213697
accacatacctggctgttacagccctggcttctcttttaatctagcacagcagccctacacacacacacacacacacacacactcatacctatttttctccatgatatgacttgcttaagagacccagcggatcatcctgcagaatgctgtgtcttctacactggtcattcagaatccagcccctccacatggctttgggaggtcttgaacc

SEQ ID NO: 19303 - DNA, 268 bp, Homo sapiens
  D12S1339
  Located on chromosome 12
  Distance between a terminus base of telomere on chromosomal short arm and 5'-terminus of this base sequence : 115236583
  Distance between 3'-terminus of neighbour sequence of sequence listing upward to telomere on chrosomal short arm and 5'-terminus of this base sequence : 28909
gaagtgcatcattcaatggttgtctggatattcacagagtttgcaactagcacacaatcaattttagtacattttcatcatttccctcaaaaggaaactccctcattaatagtcacacacacacacacacacacacacacacacacacgatccatggcaaccactaacctttctgtctctctggatttacctattcttggcatttcatataaatgaaactattaacatgtggtcatttatgatgggtttctttcaccaaacatgctgt

SEQ ID NO: 19304 - DNA, 225 bp, Homo sapiens
  AC007834.25_158611
  Located on chromosome 12
  Distance between a terminus base of telomere on chromosomal short arm and 5'-terminus of this base sequence : 115405079
  Distance between 3'-terminus of neighbour sequence of sequence listing upward to telomere on chrosomal short arm and 5'-terminus of this base sequence : 168228
ttattcacctacatatccacgtactcatctgtcccccattaatctacttgtctgtccatctcttcacctacacatccagccttccatttgtttatcttcttatttatacatctgttcatccatccatccatccatccatttatccatctatcatctactcattcatttacccatctttacacttttttgtccacctatccaatctatagatccattgtccactca

SEQ ID NO: 19305 - DNA, 291 bp, Homo sapiens
  chr12.fa.O7frz.118365834
  Located on chromosome 12
  Distance between a terminus base of telomere on chromosomal short arm and 5'-terminus of this base sequence : 115777254
  Distance between 3'-terminus of neighbour sequence of sequence listing upward to telomere on chrosomal short arm and 5'-terminus of this base sequence : 371950
cctgccattcactgataagaatggctcaccttgcctaaagtatatgaagagtgtgctttatgtcgagctcctgcttgcttgcctctttctttgtctttctttcttttccttcctcccttccttccttccttccttccttccttccttccttccttccttccttccttccttcctctctctctctctttctttctttcttctttctggaattttggtacaggctaggcagaatgtgcctagatgatcagctcctagtaaaaaccttgagaactaagtctctaatgagcctcc

SEQ ID NO: 19306 - DNA, 165 bp, Homo sapiens
  AC005907.1_18385
  Located on chromosome 12
  Distance between a terminus base of telomere on chromosomal short arm and 5'-terminus of this base sequence : 116019049
  Distance between 3'-terminus of neighbour sequence of sequence listing upward to telomere on chrosomal short arm and 5'-terminus of this base sequence : 241504
aattagaggacggctgaactattttcagtgtgtgcgtgtgtgtgtgtgtgtgtgtgtgtgtgtgtgtgtgttcccagcattcaacaatatgaagttgagttgcttgatcaaaaataataaaatctggaggctgggagcagtggctcacgcctgtagtcctagcac

SEQ ID NO: 19307 - DNA, 284 bp, Homo sapiens
  AC002350.1_98015
  Located on chromosome 12
  Distance between a terminus base of telomere on chromosomal short arm and 5'-terminus of this base sequence : 116106257
  Distance between 3'-terminus of neighbour sequence of sequence listing upward to telomere on chrosomal short arm and 5'-terminus of this base sequence : 87043
tagaatctggcaggtggaccttgcactgagtcgagatcacaccactggactccagcttgggcaacagaatgagactccatctcaaaaaaaaaataataaaaacattaaagtaatgttatatgtgtatgtataaatacattcctctctctctgagggtatgtatcagagaggtttaatgaagcaattttgtagtggaaaacacaaaacattgacacacacacacacacacacacacacacacacacacacaaataattataaaaatgtgcttattgacatggaaa

SEQ ID NO: 19308 - DNA, 343 bp, Homo sapiens
  AC002375.1_17942
  Located on chromosome 12
  Distance between a terminus base of telomere on chromosomal short arm and 5'-terminus of this base sequence : 116354635
  Distance between 3'-terminus of neighbour sequence of sequence listing upward to telomere on chrosomal short arm and 5'-terminus of this base sequence : 248094
aacctatgcttacataatcaccactaagatcaagatgtagatcagtatgctgggggtctttctctctctctctctctctctctctctctctatatatatatatataatatatatatatatattttgagacagatgctctctatcactcaggctgcagtgcagtggcactatctcggctcactgcagcctctgcctcccgggttcaagcaattctcctgcctcagtcacttgagtagctgagagtataggtgtgccaccacccctggctaattttcgtatttttagtagagatggggtctcaccctgttggtcaggctggtctcgaatgcctgacctcaaatga

SEQ ID NO: 19309 - DNA, 191 bp, Homo sapiens
  AC002375.1_36100
  Located on chromosome 12
  Distance between a terminus base of telomere on chromosomal short arm and 5'-terminus of this base sequence : 116372705
  Distance between 3'-terminus of neighbour sequence of sequence listing upward to telomere on chrosomal short arm and 5'-terminus of this base sequence : 17727
cagtgagctgaggtcatgtactgcattccagcctgggtgacagagcaagactctgtctcaaaaaaacaaaaaaaacaaaaaaaaccaaaggaaatggagcatttcatgcccatcacagtgtgtgtgtgtgtttgtgtgtgtgtgtgtttgtgtgtgtgtgtgtgtgtgtgtgtcactagattgtgatgcaa

SEQ ID NO: 19310 - DNA, 211 bp, Homo sapiens
  AC002375.1_87947
  Located on chromosome 12
  Distance between a terminus base of telomere on chromosomal short arm and 5'-terminus of this base sequence : 116424672
  Distance between 3'-terminus of neighbour sequence of sequence listing upward to telomere on chrosomal short arm and 5'-terminus of this base sequence : 51776
ctttagtctcgctttgagtgacacacacgtgtgtgtgtgtgtgtgtgtgtgttccagctgaagtccaaaccacagctagtatccattgtaatagcattcatatgcctcatcagtttatgtgaaacccaacagttcccttgacacctgatcatccgagctgccactcgcatgatgtaccagtgaggaaaggttggactgcaagtaacagaat

SEQ ID NO: 19311 - DNA, 333 bp, Homo sapiens
  AC002351.1_84511
  Located on chromosome 12
  Distance between a terminus base of telomere on chromosomal short arm and 5'-terminus of this base sequence : 116503688
  Distance between 3'-terminus of neighbour sequence of sequence listing upward to telomere on chrosomal short arm and 5'-terminus of this base sequence : 78805
tgaatcatgtaatgtcataggaagagtcctcagattagtgtaaacttaagcaagtcacttatcttctggaagcctcaatttcccagctgtgaaaggaagatggcaatggtacctcccttgagggttgttacaaagattaaatgagcatagagaagaattgcaatagagagaacaacagtgctgccagcagttgaaagggacacaccccctacacacacacacacacacacaccccccacagcctctacacttagggccaagcccaggcgttgtggacatgatggaaaccccaagagatcagttaggatcatctctgcctgtaaacctctgata

SEQ ID NO: 19312 - DNA, 446 bp, Homo sapiens
  AC002351.1_57971
  Located on chromosome 12
  Distance between a terminus base of telomere on chromosomal short arm and 5'-terminus of this base sequence : 116530252
  Distance between 3'-terminus of neighbour sequence of sequence listing upward to telomere on chrosomal short arm and 5'-terminus of this base sequence : 26231
gccaatactttggtcttagatttctggcctctagaactgtgagacaatacatttctgttgtttaagccacccagtgtgtggtacttcgttatggcagccctaacaaactaatacatcactcttcttccatcttattttgttattgttggatttttttttgtctttcccccaatattttcttttcttttcttttcttttcttttcttttttttttgagacagagtctcactgtgttgcccaggctggagttcagtggtgccatctcggctcactgcaacctctgtctcccgggttcaagcaattcccctgcctcagcctcctgagtagctaggattacaggcatgcaccaccacacctggctaatttttttgcatttctaatagagatggggtttcaccatattggccaggctggtctcaaacttctgagtgatcacttcaagtgat

SEQ ID NO: 19313 - DNA, 210 bp, Homo sapiens
  AC002978.1_68290
  Located on chromosome 12
  Distance between a terminus base of telomere on chromosomal short arm and 5'-terminus of this base sequence : 116622415
  Distance between 3'-terminus of neighbour sequence of sequence listing upward to telomere on chrosomal short arm and 5'-terminus of this base sequence : 91717
ccgctgatcagtgagtctctgcaggcccaagctgtccccagatgtgtgcatgcatatgcacacacacacacacacacacacacacacacacacacagcaaggaggatgcctggctttctgagctacaacccaggacccatgcacaccacagtccatggcatcctttgctctcctttcttcctatttttattcctgtttgagtcactatgg

SEQ ID NO: 19314 - DNA, 281 bp, Homo sapiens
  AC002978.1_59954
  Located on chromosome 12
  Distance between a terminus base of telomere on chromosomal short arm and 5'-terminus of this base sequence : 116630677
  Distance between 3'-terminus of neighbour sequence of sequence listing upward to telomere on chrosomal short arm and 5'-terminus of this base sequence : 8052
cacagtaactttccatacttcgtctgtccagtggactcctgttcatccatcagggcccagcttaaagcatcacctctctgtaaaccctcagtcagcaacccctccatcctaaggctggccataaacaaagccttgctctgtgtgtgtgtgtgtgtgtgtgtgtgtgtgtgcgcgcgcgtgtgtgtgtgttattttctcatagctctggaggttagaagtttgagatcaaggtttcagcaggttctttctgaggcctctcttattggcttatagatgcctgt

SEQ ID NO: 19315 - DNA, 202 bp, Homo sapiens
  D12S1343
  Located on chromosome 12
  Distance between a terminus base of telomere on chromosomal short arm and 5'-terminus of this base sequence : 116820293
  Distance between 3'-terminus of neighbour sequence of sequence listing upward to telomere on chrosomal short arm and 5'-terminus of this base sequence : 189335
ctgggaccacaggtgtagaccaccacacccagctgtgtgtgtgtgtgtgtgtgtgtgtgtgtgtgtgtgtgtgtttgtgtgtgtgtgtggagatagggtcttgctatgttgccaggctggtcttaaactcctggactcaagtgatcctcccaccttggcctcccaagtgctgagattataggtgtgagccactgtacctggc

SEQ ID NO: 19316 - DNA, 294 bp, Homo sapiens
  AC002395.1_109896
  Located on chromosome 12
  Distance between a terminus base of telomere on chromosomal short arm and 5'-terminus of this base sequence : 116942811
  Distance between 3'-terminus of neighbour sequence of sequence listing upward to telomere on chrosomal short arm and 5'-terminus of this base sequence : 122316
ggtgaggataactacatttgagacctcaaattgagtacataataaaatcacctactatcttttacacactacaatcacagacatagtttcccctttaatagtatatacatacagcaagactcctttttaaagagcatctattaaaggattaaatttaacatttcctagcaccaaataaattatatatacacacatacatatatatatatatacacacacacacacacacacacacatatatgtatgtatgtatgtatcagcttatttttggataccaagtcatggcataattaa

SEQ ID NO: 19317 - DNA, 399 bp, Homo sapiens
  AC002395.1_89659
  Located on chromosome 12
  Distance between a terminus base of telomere on chromosomal short arm and 5'-terminus of this base sequence : 116963039
  Distance between 3'-terminus of neighbour sequence of sequence listing upward to telomere on chrosomal short arm and 5'-terminus of this base sequence : 19934
ctaggcaacatggcaaaacccatctctacaaaaaatacaaaaattagctaggtgtggtggtgtgcacctgtagcccccgctatccaggggactgagaagggaggatcgcttgagcccaggaggtcaaggctgcattgagccatgatagcgccactgcgttccagcctcagcagcaaagcaagaccctgtatcaaacacatacacacacacacacacacacacacacacacacacacacacacacaaaacacccaaaaaaacacattgaggaaatcttattaattcaggaaaaatgaaaactttatgtcagaaaggcaattattgggcactgagaaatgtcttttctgtataaattattctactttctatagtttctcaactgatagcagttaatcactc

SEQ ID NO: 19318 - DNA, 283 bp, Homo sapiens
  D12S1672
  Located on chromosome 12
  Distance between a terminus base of telomere on chromosomal short arm and 5'-terminus of this base sequence : 117131361
  Distance between 3'-terminus of neighbour sequence of sequence listing upward to telomere on chrosomal short arm and 5'-terminus of this base sequence : 167923
atcaggccactgcactccagcctgggcgacagagtgagattccatccaaaacacacacacacacacacacacacacacacacacacacacacacaaaattagattacagtaaaattatgttctaatattgtgattacattatctttcctaaaacagccaccttcaaaaatatatataacaaagaacaaaataaatcacttctgaaagtcatgaaaaactattcacacacacacacacaaagtcaaattatgaaatgtttcttaaagcagatgtgaatttccag

SEQ ID NO: 19319 - DNA, 366 bp, Homo sapiens
  chr12.fa.O7frz.119653335
  Located on chromosome 12
  Distance between a terminus base of telomere on chromosomal short arm and 5'-terminus of this base sequence : 117194657
  Distance between 3'-terminus of neighbour sequence of sequence listing upward to telomere on chrosomal short arm and 5'-terminus of this base sequence : 63013
gtacttaatgccattgaattgtacagtttagcagtttagaatggttaaaatcagaggtgtggggtgtgtgtgtgtgtgtgtgtgtgtgtgtgtgtgtgtgtgtgtgtttgtcagacaccaaaccagatccaggataaaatggtaagttttatgttacctgtacttttccacaattaaaaaaaggaaagaggctgggcacagtggctcacatctataatcccagcactttgggagcccaaggcaggaggattgtttgagctcaggagttcaagaccagcctgggcaacatagggagacccccatctctacaaataataaaaatattagccaggcttggtggcacatacctgtggttccaggtactga

SEQ ID NO: 19320 - DNA, 152 bp, Homo sapiens
  DISO7_10003582
  Located on chromosome 12
  Distance between a terminus base of telomere on chromosomal short arm and 5'-terminus of this base sequence : 117454768
  Distance between 3'-terminus of neighbour sequence of sequence listing upward to telomere on chrosomal short arm and 5'-terminus of this base sequence : 259745
gagagcagctgtttgaaggaaaaataaggctaggtccttttttagttttctgttgtgagtatgggtttccataacaaaccaattttcgtgtatatgtgtgtgtgtgtgtgtgtgtgtgtgaagcagtttttggtgggtacttacgttggtac

SEQ ID NO: 19321 - DNA, 191 bp, Homo sapiens
  DISO7_10003708
  Located on chromosome 12
  Distance between a terminus base of telomere on chromosomal short arm and 5'-terminus of this base sequence : 117839904
  Distance between 3'-terminus of neighbour sequence of sequence listing upward to telomere on chrosomal short arm and 5'-terminus of this base sequence : 384984
tgtggtgattccagtactgtgtgcgtgtgtgtgtgtgtgtgtgtctgtgtgcatgcacgtgtctgcacatatgcattcatgtatgtatgtctgggtctgcgtgcgtgggtctctgtgtgtgcatgcatatgtgtatatgcattgtgtgcccatgtgtgtgcacatctgtgtgcacctgttgagccagttct

SEQ ID NO: 19322 - DNA, 354 bp, Homo sapiens
  chr12.fa.O7frz.143027117
  Located on chromosome 12
  Distance between a terminus base of telomere on chromosomal short arm and 5'-terminus of this base sequence : 117880564
  Distance between 3'-terminus of neighbour sequence of sequence listing upward to telomere on chrosomal short arm and 5'-terminus of this base sequence : 40469
gaacggtcaactgaactacttagggcgactggcgggaatccaaccaggtctgcctgactgtgtctgcctgtgtgtctctgctgtctctccatctatctgtctgtctgtctgcctgtccatgtgtgtctgtctgtcatctgtctgcctatctgcctgtctgtgtgtctgtctgtccatctgtgtgtctgcctgtccatctatccatctgttgtccatctctccatctgtctgtctgcctgtctgtctgcacagcccctgacctcacactcaggctgcgtttgcagcagccgtttcccatctaagcatccgtgtcctccttgctgagttggaggtaggaagtcacattgaaattct

SEQ ID NO: 19323 - DNA, 191 bp, Homo sapiens
  D12S1628
  Located on chromosome 12
  Distance between a terminus base of telomere on chromosomal short arm and 5'-terminus of this base sequence : 117892914
  Distance between 3'-terminus of neighbour sequence of sequence listing upward to telomere on chrosomal short arm and 5'-terminus of this base sequence : 11996
gaggtccagcggggcttttcccataattgtaacccccccctacacacacacacacacgcacacacacacacacacacacggcttaagaagagatggagacagacagtcaccctgcaacaatcaccccctctgggcctggacaggaccagggagggcgggcatgggtgggggggttgcttgcctgatgggga

SEQ ID NO: 19324 - DNA, 350 bp, Homo sapiens
  chr12.fa.O7frz.89556521
  Located on chromosome 12
  Distance between a terminus base of telomere on chromosomal short arm and 5'-terminus of this base sequence : 118096056
  Distance between 3'-terminus of neighbour sequence of sequence listing upward to telomere on chrosomal short arm and 5'-terminus of this base sequence : 202951
gtagatttgctagcaatgaattctgtcagtttttatttatctgaaaatgtcttaatctatccattttgaatggtaaattagctagatatagaattcttggttgatagtctttttcttgcaaaacaatgaagatactatcccactgtccttttggttcaatggcttctaataaaaagtctattaatcttattgagtgttcttatgtatgtcattattctcctgctgctttcaggattttatgtttgtgtgtgtgtgtgtgtgtgtgtgtgtgtgtgtgttttccaatttgcctaagatgtgtcttggtatagatttctgagtatattctacttgagcttctttaatgagtg

SEQ ID NO: 19325 - DNA, 357 bp, Homo sapiens
  chr12.fa.O7frz.89290865
  Located on chromosome 12
  Distance between a terminus base of telomere on chromosomal short arm and 5'-terminus of this base sequence : 118096059
  Distance between 3'-terminus of neighbour sequence of sequence listing upward to telomere on chrosomal short arm and 5'-terminus of this base sequence : -347
gatttgctagcaatgaattctgtcagtttttatttatctgaaaatgtcttaatctatccattttgaatggtaaattagctagatatagaattcttggttgatagtctttttcttgcaaaacaatgaagatactatcccactgtccttttggttcaatggcttctaataaaaagtctattaatcttattgagtgttcttatgtatgtcattattctcctgctgctttcaggattttatgtttgtgtgtgtgtgtgtgtgtgtgtgtgtgtgtgtgttttccaatttgcctaagatgtgtcttggtatagatttctgagtatattctacttgagcttctttaatgagtggactagtatt

SEQ ID NO: 19326 - DNA, 318 bp, Homo sapiens
  chr12.fa.O7frz.89470270
  Located on chromosome 12
  Distance between a terminus base of telomere on chromosomal short arm and 5'-terminus of this base sequence : 118194610
  Distance between 3'-terminus of neighbour sequence of sequence listing upward to telomere on chrosomal short arm and 5'-terminus of this base sequence : 98194
agacctaatgtacaataatgcaactatagttaacaatgctgtattatttaagtggagagacctttagtattctcatcaaaaaataattattttgctgtgtgtgtgtgtgtgtgtgtgtgtgtatagagtcatcaagttgtacacctgaaatacatataaatttaaattgtcaattataccttattaaagctggggaggggcaagtcaccaaccctgattaattggtagaaaattggtacaaatttttgtactttactaagagttgatcatgctaagagaacttggggtgctgttgatctggtaatctgtccaactagc

SEQ ID NO: 19327 - DNA, 345 bp, Homo sapiens
  chr12.fa.O7frz.89395308
  Located on chromosome 12
  Distance between a terminus base of telomere on chromosomal short arm and 5'-terminus of this base sequence : 118477816
  Distance between 3'-terminus of neighbour sequence of sequence listing upward to telomere on chrosomal short arm and 5'-terminus of this base sequence : 282888
gaagctatgagacatttgactaacctataaattttaaaagcatgtcctttaagtagaagagatatttttataagtaggaatattactttgcttttattggatgatattattttctactcctcttatttttatggagtattccaatcatactgaacaagggcctaatgacttttcccagcagttatgagcagttgtttttgtgtgtgtgtgtgtgtgtgcttattatagtcatcacagttcaaattacacctagagactcaaaaataatcaggtttattataagtcactaaaagtaattgtgtatgtgcaaaaattgcagataagtggtccttaagttggatagtt

SEQ ID NO: 19328 - DNA, 465 bp, Homo sapiens
  AC073575.5_144468
  Located on chromosome 12
  Distance between a terminus base of telomere on chromosomal short arm and 5'-terminus of this base sequence : 118577396
  Distance between 3'-terminus of neighbour sequence of sequence listing upward to telomere on chrosomal short arm and 5'-terminus of this base sequence : 99235
ctagttgtcatctcctgagctcaggcaatctgcccacctcggcctcccaaagtgctgggattacaggcatgagctaccgcacctgacatttatttatttatttatttatttatttatttaatttgtttattttgagagggagtcttgctctgtcgcccaggctggagtgcaatggtgagatctcagctcactgcaacttcctcctcctagattcaagtgattctcctgcctcagcctcctgagtagctgggaatacaggcacgtaccacctcgctcggctaatttttgtatcttcagtacagactgggtttcaccatgttggccaggctggtctcgaactcctgacctcaagtgatctgcccatcttggcctcccaaagtattgggattagtgtgaactaccacgcttggccgaaagactaccttattattcatatggaaataaataccaaatggatcaaatatt

SEQ ID NO: 19329 - DNA, 373 bp, Homo sapiens
  AC073575.5_123278
  Located on chromosome 12
  Distance between a terminus base of telomere on chromosomal short arm and 5'-terminus of this base sequence : 118687195
  Distance between 3'-terminus of neighbour sequence of sequence listing upward to telomere on chrosomal short arm and 5'-terminus of this base sequence : 109334
agatgcttttcttgcttagtactatctcattaacattttgcaattatattatattatattatattatattatattatattatattatattatttttgagacggggtctttctctgtcccccaggctggagtgcggtagcatgatcagggctcactccagccctgcctcctgggctcgagggatccttccacctcagcctcccaaggaggtggaactacaggtgcgtgccaccacgcctggctaatttttgtattttttttgtagagatatggtttcattatattgcccaggctggtctctaattcctgagctcaagagatccacccgccttggcctccatattttgcaattataatctgcaatggaatcataa

SEQ ID NO: 19330 - DNA, 249 bp, Homo sapiens
  AC004031.1_52674
  Located on chromosome 12
  Distance between a terminus base of telomere on chromosomal short arm and 5'-terminus of this base sequence : 118763623
  Distance between 3'-terminus of neighbour sequence of sequence listing upward to telomere on chrosomal short arm and 5'-terminus of this base sequence : 76055
caataggataccagtatcgcaccagcacaccttcactgcggaggtacgtttctacctgcaccagttcattcacctacaataggaaaagaaaatgtctgtttgtgctgtttgcttttgttttccatgtgtgcgtgcgtgcgtgtgtgtgtgcgtgcgtgcgtgtgtgtgtgtgtgtgtgtgtgtgtgtattttcagtccaggcttttaggtattataatttgtaactaattgctatttcatagacaaacg

SEQ ID NO: 19331 - DNA, 279 bp, Homo sapiens
  DISO7_10003585
  Located on chromosome 12
  Distance between a terminus base of telomere on chromosomal short arm and 5'-terminus of this base sequence : 118826417
  Distance between 3'-terminus of neighbour sequence of sequence listing upward to telomere on chrosomal short arm and 5'-terminus of this base sequence : 62545
caagttagtgagtttacacagaagctaatttaaaaataatcacagaaaatgaaattgactataggtttagaaattagattattccatacaaagattgaaaaaattatcaccttttaaaagttattttaatcaagagaatataataaaccatctaaaattttgaaattatttaatgctcccaagatttttatatatatatatatatacacacacacacacacacacacacacatacacatatatatgtctatgtagctataactttcaggtacacatgag

SEQ ID NO: 19332 - DNA, 118 bp, Homo sapiens
  DISO7_10003586
  Located on chromosome 12
  Distance between a terminus base of telomere on chromosomal short arm and 5'-terminus of this base sequence : 118962972
  Distance between 3'-terminus of neighbour sequence of sequence listing upward to telomere on chrosomal short arm and 5'-terminus of this base sequence : 136276
ttagatgaggcagccatgttaatttttaaggcctttcaaaacaccaaggaaaaaatacacacacacacacacacacacacacacagaacctatgggggagattgattatttccgtctt

SEQ ID NO: 19333 - DNA, 161 bp, Homo sapiens
  DISD22_0008777
  Located on chromosome 12
  Distance between a terminus base of telomere on chromosomal short arm and 5'-terminus of this base sequence : 119196901
  Distance between 3'-terminus of neighbour sequence of sequence listing upward to telomere on chrosomal short arm and 5'-terminus of this base sequence : 233811
ttagggttggctcctcaggggacctatttcctcttttctcctgtgcgcgcgcgtgtgtgtgtgtgtgtgtgtgtgtgtgtccaccgcctttgtgctgagtttaggaagtgtgtgtgtgtgtgtacgtgtgtgtgtgtgtgtctaccacctttgtgctgagt

SEQ ID NO: 19334 - DNA, 339 bp, Homo sapiens
  HUMUT996
  Located on chromosome 12
  Distance between a terminus base of telomere on chromosomal short arm and 5'-terminus of this base sequence : 119332311
  Distance between 3'-terminus of neighbour sequence of sequence listing upward to telomere on chrosomal short arm and 5'-terminus of this base sequence : 135249
caatgcaggacactcttctatttatttttacctccctctcctgcttttcttttctttttcttttatcctttcttccttccttccttccttcctttctttttcttttttcccttctttctttttctctttctttctctttctttctttctttctttctttctttctttctttctttctttctttctttctttcctttctttctctctttttttgagacagtcttgctctgtcgtccaggctggagtgcagtaatgtagtaccagcttactgcaacctccgcttcccgggttcaggcgattctcctgcctcagcctcccaagtatctgggattacaggtgc

SEQ ID NO: 19335 - DNA, 131 bp, Homo sapiens
  D12S870
  Located on chromosome 12
  Distance between a terminus base of telomere on chromosomal short arm and 5'-terminus of this base sequence : 119416848
  Distance between 3'-terminus of neighbour sequence of sequence listing upward to telomere on chrosomal short arm and 5'-terminus of this base sequence : 84198
tttagggacagtctgggtcagagaaaggaaaggaccatgtgacatggcagggtgtgtgtgtgtgtgtgtgtgtgtgtgtgtgtgcacgcgtgctctggctctgtctttagcagtggcaccaacaaaagttc

SEQ ID NO: 19336 - DNA, 354 bp, Homo sapiens
  AC009772.8_184516
  Located on chromosome 12
  Distance between a terminus base of telomere on chromosomal short arm and 5'-terminus of this base sequence : 119460941
  Distance between 3'-terminus of neighbour sequence of sequence listing upward to telomere on chrosomal short arm and 5'-terminus of this base sequence : 43962
catctgcctactcactattcacccattcatttccccatcagtccatgtatccatacacccagttatccatctttcacctatctatccatccatacgttcatctatcaatgccctcctgtctgttcactcacttatccatccacatacccaccaatctatactcctttccattcatccatccatccattcatccatccatccatccatccatccatccatccatccatccatccaaatactcacccattcatccatctacccactatccattctcttacttacccacttatccatttatatacccatttatccatccacacattgacccatctatgtatccactcatctatccag

SEQ ID NO: 19337 - DNA, 372 bp, Homo sapiens
  AC009772.8_43090
  Located on chromosome 12
  Distance between a terminus base of telomere on chromosomal short arm and 5'-terminus of this base sequence : 119488312
  Distance between 3'-terminus of neighbour sequence of sequence listing upward to telomere on chrosomal short arm and 5'-terminus of this base sequence : 27017
gatcagtgaatccaaagtcatctcccagccagtcacttcctagaacatcccctttccacttcctttgtagccctcagcactatctgcagggacctccctcattttctgtgtgactttgggcagtttcttaacctctctgtgtcacatttttcttatctgtaaaatggtcatactagtacccatctcatgagattgtaatactgattaagtgagatgatgtatgtaaagtgctcagaacactgcctggtatggagtaagcagtatagaagtgttaacaattattattattattattattattattattgtgtttgatccattgtcctccacccccaactagaacatcatcttaatgaggacacatactttgtc

SEQ ID NO: 19338 - DNA, 478 bp, Homo sapiens
  AC009731.6_166217
  Located on chromosome 12
  Distance between a terminus base of telomere on chromosomal short arm and 5'-terminus of this base sequence : 119609242
  Distance between 3'-terminus of neighbour sequence of sequence listing upward to telomere on chrosomal short arm and 5'-terminus of this base sequence : 120558
tcacctggatacatagttccagacttagtagatccagaacacctgttgcaaaaccttttttctcaaaaaccctagaagagaactctggacgagaaggaagcaaacttcttggctactgagaaggacagtgtgtatgctggtcccaaggacaagaaggagagctggctcttgagtcccctgtagcagagaaggggaggttgtcaggaccccatgcactgagcatctcttctgtattccctggtcttccctctcccccaacctctctctctctctctctctctctctctctctctctctctccaggcttctccataccagttacaactacttagatctacacatatagtttaatgtggtcaccttgcacctgctgagtttacatatcctcggtcagcaacagataatttaatgtggtgatcagaaaatggacaagtgaaagtgtattcgtttggaagtctggaaggtgtactagtttcct

SEQ ID NO: 19339 - DNA, 206 bp, Homo sapiens
  AC009731.6_20018
  Located on chromosome 12
  Distance between a terminus base of telomere on chromosomal short arm and 5'-terminus of this base sequence : 119755613
  Distance between 3'-terminus of neighbour sequence of sequence listing upward to telomere on chrosomal short arm and 5'-terminus of this base sequence : 145893
taggagtttgtagctgcagtagtccattatagcaccactgcactccagcctaggtgacagaccaagacaatatctcaaaaaaaaaaaagtatacacacacacacacacacacacacacacacacacacgtactttttgctaagacaggttggttctcaatcaggcaattttgcccctgtccccacctctattcctgcaggacatct

SEQ ID NO: 19340 - DNA, 403 bp, Homo sapiens
  AC010183.6_153555
  Located on chromosome 12
  Distance between a terminus base of telomere on chromosomal short arm and 5'-terminus of this base sequence : 120093343
  Distance between 3'-terminus of neighbour sequence of sequence listing upward to telomere on chrosomal short arm and 5'-terminus of this base sequence : 337524
ggtgatctatttgagtgataaacttcatcagtttttttgttttgttttgttttgttttgttttgtttttttgttatttttgagacggagtctcactctgttgcccaggctggagtgcagtggcgcgctcttggctcactgcaagctccgcctcctgggttcactgcattctcctgcctcagcctccccagtagctgggactacaggcgcccgccaccacacccagctattttttttgcatttttagtagagacggggtttcaccgtgttagccaggatggtctcaatttcctgacctcatgatccgcccgcctgggcctcccaaagtgctgggattacaggcgtgagccaccgtgcccagccaacttcatcagtttttatttggaaatgtatttatcttacct

SEQ ID NO: 19341 - DNA, 319 bp, Homo sapiens
  AC010183.6_172120
  Located on chromosome 12
  Distance between a terminus base of telomere on chromosomal short arm and 5'-terminus of this base sequence : 120111840
  Distance between 3'-terminus of neighbour sequence of sequence listing upward to telomere on chrosomal short arm and 5'-terminus of this base sequence : 18094
gaattacatttcctaggctcctttgccctctgggtaggtttggacactgggagggctttgtaggaaactggagggtggaagaagaggcaaatccagagtcagtctctctctctctctctctctctctctctctctctctctctctctctctctctgtctttccctacactccccctcctatctccctcccagctttctctctccttcctatggcatctccagcagtgactgggtctcctctgtggctccagctcctaccagagaagtccccctccatggttgcagctcctaccaagtagccatcactatggttctagtt

SEQ ID NO: 19342 - DNA, 206 bp, Homo sapiens
  chr12.fa.O7frz.122770600
  Located on chromosome 12
  Distance between a terminus base of telomere on chromosomal short arm and 5'-terminus of this base sequence : 120179922
  Distance between 3'-terminus of neighbour sequence of sequence listing upward to telomere on chrosomal short arm and 5'-terminus of this base sequence : 67763
gatcattctatttgcagatcactgcgttgtttttcatactgtccacccatctatgaattgggccttcttatttcaaactgcaaaaacaaaacaaaacaaaacaaaacaaaacaaaacaaaaaaaacgctaaaactaaagcagtctcataagattcctggttatgtcagagattttcacttaagactaaaggatagcaacaggagtt

SEQ ID NO: 19343 - DNA, 257 bp, Homo sapiens
  D12S1646
  Located on chromosome 12
  Distance between a terminus base of telomere on chromosomal short arm and 5'-terminus of this base sequence : 120260829
  Distance between 3'-terminus of neighbour sequence of sequence listing upward to telomere on chrosomal short arm and 5'-terminus of this base sequence : 80701
accactccattgctggctagtttcttcctttacccaagcctcagtcttctgtctataaaatggggataataaaatagccacctctttggggttataaaatgaaatgatgcatggaaaggcttagcgaatatatatacatacacacacacacacacacacacacacacacacacacacacactggggacacattgctcaataaacactattttgtaaatatacattattatattttggagcagaggttcttacccagc

SEQ ID NO: 19344 - DNA, 304 bp, Homo sapiens
  chr12.fa.O7frz.123035785
  Located on chromosome 12
  Distance between a terminus base of telomere on chromosomal short arm and 5'-terminus of this base sequence : 120338763
  Distance between 3'-terminus of neighbour sequence of sequence listing upward to telomere on chrosomal short arm and 5'-terminus of this base sequence : 77677
ggttaacttgatacatttgcaaagtatggtcttttcatcagtaatctttgtacataaaaggagattctgccaaacaaaaagaagtggatgttggtggagcttgttccctggggttggtaaagagtcaggttttttttttgcttagggtcattgtagcagcttgaggacagaaatggggggctggggcagcaaggggagggagggacagggagagagggagagagagagagaaagagagagagagagagagagagagaggatatcgggaagttcagacatctcttacattccaatcagagatagc

SEQ ID NO: 19345 - DNA, 220 bp, Homo sapiens
  DISO7_10003592
  Located on chromosome 12
  Distance between a terminus base of telomere on chromosomal short arm and 5'-terminus of this base sequence : 120492211
  Distance between 3'-terminus of neighbour sequence of sequence listing upward to telomere on chrosomal short arm and 5'-terminus of this base sequence : 153144
ttatgtacttcacctgcatgcccttttcttttcctttctttctttccctttctttctctttctttctttctttctttctttctttctttctttctttctttctttctttctttttctttctttctttcttttctttctctccttctttctttctctttctttctttcttgtttctttctttctttttgctttgatgggtttctgggagatggtgattgtc

SEQ ID NO: 19346 - DNA, 205 bp, Homo sapiens
  D12S1341
  Located on chromosome 12
  Distance between a terminus base of telomere on chromosomal short arm and 5'-terminus of this base sequence : 120548440
  Distance between 3'-terminus of neighbour sequence of sequence listing upward to telomere on chrosomal short arm and 5'-terminus of this base sequence : 56009
atgaagcctgttgctttctttttctttttctttgtgtgtgtgtgtgtgtgtgtgtgtgtgtgtgtgtgtttgtgtgtgtgtgtgtgtgtgtgtgtgatggagtcttgctctgttgcccaggccggagtgcagtggcgcgatctcggctcactgcaacctccgtctcccaggttcaagtgattctcctgcctcggccacccaagta

SEQ ID NO: 19347 - DNA, 187 bp, Homo sapiens
  D12S354
  Located on chromosome 12
  Distance between a terminus base of telomere on chromosomal short arm and 5'-terminus of this base sequence : 120585296
  Distance between 3'-terminus of neighbour sequence of sequence listing upward to telomere on chrosomal short arm and 5'-terminus of this base sequence : 36651
ggtttcctaatttcaagtcaatctatatcttcaaccttctctttgtgtgtgtgtgtgtgtgtgtgtgttttacctaattactttaaaaaaaaagataatgcaatgggcattattaggccagcagaaatgaattcacaaggaaggggccaggaattttttctctcattttatctgacccagaaccacc

SEQ ID NO: 19348 - DNA, 180 bp, Homo sapiens
  DISO7_10003589
  Located on chromosome 12
  Distance between a terminus base of telomere on chromosomal short arm and 5'-terminus of this base sequence : 120625606
  Distance between 3'-terminus of neighbour sequence of sequence listing upward to telomere on chrosomal short arm and 5'-terminus of this base sequence : 40123
ccgaaacaaggtcactcagtaaaaaaggtctattggttatatgtgtgtgtgtgtgtgtgtgtgtgtgtgtgtgtgtatacacagttatatgcatgtgtgtattttatatatatatatatttttttttctttttccttttttttctgcagggaaaatcccaactctggccttaaataataa

SEQ ID NO: 19349 - DNA, 101 bp, Homo sapiens
  DISO7_10003590
  Located on chromosome 12
  Distance between a terminus base of telomere on chromosomal short arm and 5'-terminus of this base sequence : 120638078
  Distance between 3'-terminus of neighbour sequence of sequence listing upward to telomere on chrosomal short arm and 5'-terminus of this base sequence : 12292
gatagagacagggtactcaggcatgcgcgtgcatgcacgcgtgcacacacacacacacacacacacacagaggtacagacagcagagatagagtgaaatgg

SEQ ID NO: 19350 - DNA, 293 bp, Homo sapiens
  DISO7_10003593
  Located on chromosome 12
  Distance between a terminus base of telomere on chromosomal short arm and 5'-terminus of this base sequence : 120675078
  Distance between 3'-terminus of neighbour sequence of sequence listing upward to telomere on chrosomal short arm and 5'-terminus of this base sequence : 36899
agtcctcagagtttggaagggcaggattttactggactttggtgcagtttttctcccttccttccttccttccttccctccctcccttccttctttcctttctttctttctttctttctctttctttcttcctttctttctttctctttttctctttctttttctttctctttctcctttctttccttttctttcttttttctctttttctctttttcttctctcttttccctccctcccttctctctttctttgtttctgtcttgcttgcttgcttgcttcactcttcctct

SEQ ID NO: 19351 - DNA, 480 bp, Homo sapiens
  chr12.fa.O7frz.123407326
  Located on chromosome 12
  Distance between a terminus base of telomere on chromosomal short arm and 5'-terminus of this base sequence : 120750481
  Distance between 3'-terminus of neighbour sequence of sequence listing upward to telomere on chrosomal short arm and 5'-terminus of this base sequence : 75110
tgaagatgaactacatttctagaagaagacattctgtctataaattaggactcctcactcttattccagtgctcttttcttttgtttttttagagacagggtcttactttgtcaccaagtaggctggagtgcagtggggcaatcattagtaactgtagcctcaaacttcagagtagctgggattacaggtgtgtgcaaccatgcctggctagtttttttaaaaacaatttgttcagatatggggtattgctgtcctgcccaggctcatcttgaactcttggctttaagtaatccttccaccctggcctcccaaagtggcagtgttttttgtttgtttgtttgtttgtttgccttatagagtctctcaacccaaagaaatggttctagaaattgcttacttactgagtcaaagattgttttaccagtacattggtggaaagaaaaatattttgaaagctataggtaagcttactggactcc

SEQ ID NO: 19352 - DNA, 268 bp, Homo sapiens
  DISO7_10003597
  Located on chromosome 12
  Distance between a terminus base of telomere on chromosomal short arm and 5'-terminus of this base sequence : 120792595
  Distance between 3'-terminus of neighbour sequence of sequence listing upward to telomere on chrosomal short arm and 5'-terminus of this base sequence : 41634
tccttaacaatgaagtgattctatctaatctctttctctctctctctctctctctctctctctctctctctttctcattgaaacagagtcttgctttatcacccaggcttcagtgcagtggtgtgatcatgactcactgcagcctcaagctcctgggctcatgcaatcctcccaactcagcctcctgagtagctaggactacaggcattcctcaccatgcttggctaatctacctaacttttaatgaagaagtttcatcagactcaca

SEQ ID NO: 19353 - DNA, 332 bp, Homo sapiens
  AC008125.9_180018
  Located on chromosome 12
  Distance between a terminus base of telomere on chromosomal short arm and 5'-terminus of this base sequence : 120934611
  Distance between 3'-terminus of neighbour sequence of sequence listing upward to telomere on chrosomal short arm and 5'-terminus of this base sequence : 141748
acaaagacatgtcagtttggactgtgtatagacgtggcttgcctcgaagtctggtgaccagcattagaacaccaccaaaatgaaccaagtacacttggtacttctggccatcaaaatagctgaaccctaccattcaatctgccagtttagcttgtttgatccagttttcaagaaagctaggagaaaatgctgtgtgtgtgtgtgtgtgtgtgtgtgtgtgtgtgtgtgtttgtgtgtgtgtgtgtgtagggaatttgggggtcatgtaaaaggaaaatggttggaagtataattatgactgttgactttaatgatcaattaagttgaccatg

SEQ ID NO: 19354 - DNA, 155 bp, Homo sapiens
  D12S1023
  Located on chromosome 12
  Distance between a terminus base of telomere on chromosomal short arm and 5'-terminus of this base sequence : 120943369
  Distance between 3'-terminus of neighbour sequence of sequence listing upward to telomere on chrosomal short arm and 5'-terminus of this base sequence : 8426
aatgacttagtccttctgagcctcagttttctcctctgtaaaatgggaataatcattgtagatgcttcacagagttgtgaaaacataatgggtatctatctatctatctatctatctatctatctatctatctggaatgaaaatgcacctggctc

SEQ ID NO: 19355 - DNA, 174 bp, Homo sapiens
  HUMUT7928
  Located on chromosome 12
  Distance between a terminus base of telomere on chromosomal short arm and 5'-terminus of this base sequence : 120943375
  Distance between 3'-terminus of neighbour sequence of sequence listing upward to telomere on chrosomal short arm and 5'-terminus of this base sequence : -149
ttagtccttctgagcctcagttttctcctctgtaaaatgggaataatcattgtagatgcttcacagagttgtgaaaacataatgggtatctatctatctatctatctatctatctatctatctatctggaatgaaaatgcacctggctcatagtagacacttgttaactcgaag

SEQ ID NO: 19356 - DNA, 383 bp, Homo sapiens
  AC008125.9_160315
  Located on chromosome 12
  Distance between a terminus base of telomere on chromosomal short arm and 5'-terminus of this base sequence : 120954288
  Distance between 3'-terminus of neighbour sequence of sequence listing upward to telomere on chrosomal short arm and 5'-terminus of this base sequence : 10739
gcatcagctattgagagttcagacaattgttttttccaagtcagagaagtggtgtgctttgacaatttgttctaagacaatatggaagtgaatatttcttacttctgcttttgctatcagcatgtcatggccaaagataggacttagatgagtgtctaaagcagagattcaataaaatataagcaatgcgtgtaagccctgtgtgcctgtgtgtgtatatatatatatatatatatatatatatatatatatataaataattttttttctggagagtccatagaatccatcagatttttaaagaaaatggagaccaataaacatagagaactatagttctaagagaacatgggtttttcctgaccactcaatctcattatctc

SEQ ID NO: 19357 - DNA, 337 bp, Homo sapiens
  AC009770.7_166778
  Located on chromosome 12
  Distance between a terminus base of telomere on chromosomal short arm and 5'-terminus of this base sequence : 121062207
  Distance between 3'-terminus of neighbour sequence of sequence listing upward to telomere on chrosomal short arm and 5'-terminus of this base sequence : 107536
tcggtatgaaataagctaatttaagtaaagtgcttaaaatagtgcttggtacatgggaaacactaaatatttgacatgataattattttggctgttattattgccattattattattattattattttatttttttaaatattagattgttcccagtctttgcaaacctgaacaataattcagtgaacaccattttaaatgaatatctgtacgcattcataatcatttctttagaaaaaaacatttgttaggaaattttagggtcaaggagggtgcacattttaaagtctttcgatatgttaatgagctgcttctagaattaaattggttgaacgta

SEQ ID NO: 19358 - DNA, 263 bp, Homo sapiens
  AC008125.9_35336
  Located on chromosome 12
  Distance between a terminus base of telomere on chromosomal short arm and 5'-terminus of this base sequence : 121079284
  Distance between 3'-terminus of neighbour sequence of sequence listing upward to telomere on chrosomal short arm and 5'-terminus of this base sequence : 16740
agctagtaacttgttcaagtccacacggggaacaagaagcagatctggaaaaagccctcatctgcttgtttccaaagcctggctaatgtttctccatttattcttcattctcactaccttcaaaatctaagcctcagttttcccatctgtagaacagggatgctaagagtaccttccttatgggattattctgtgtataaaacacatacacacacacacacacacacacacacacacagtgcttagcctagtgcctgacatag

SEQ ID NO: 19359 - DNA, 219 bp, Homo sapiens
  D12S369
  Located on chromosome 12
  Distance between a terminus base of telomere on chromosomal short arm and 5'-terminus of this base sequence : 121083516
  Distance between 3'-terminus of neighbour sequence of sequence listing upward to telomere on chrosomal short arm and 5'-terminus of this base sequence : 3969
ggccacgcaacatactttataggttagggtaagatttggtccacccatatattcatataatatgtacttactgagtgttagtgtgtaccaggcttgcagttgctggtgcagaatcatgaattagacacatgcacacacacacacacacacacacacacacacacacacacacacacacacgtatgctttccgcccacagtgagtatgaagcctggtggg

SEQ ID NO: 19360 - DNA, 260 bp, Homo sapiens
  AC008125.9_31162
  Located on chromosome 12
  Distance between a terminus base of telomere on chromosomal short arm and 5'-terminus of this base sequence : 121083620
  Distance between 3'-terminus of neighbour sequence of sequence listing upward to telomere on chrosomal short arm and 5'-terminus of this base sequence : -115
ggtgcagaatcatgaattagacacatgcacacacacacacacacacacacacacacacacacacacacacacacacgtatgctttccgcccacagtgagtatgaagcctggtggggaaaacagatgtggaattacaccaaacattataaccagagctttctcctatactacacccagtttactctaaaagacaggcccaaactgtctgctttttgacaaatccaagatattgtggagcctatggagtgatttggaaaaca

SEQ ID NO: 19361 - DNA, 366 bp, Homo sapiens
  AC008125.9_28324
  Located on chromosome 12
  Distance between a terminus base of telomere on chromosomal short arm and 5'-terminus of this base sequence : 121086430
  Distance between 3'-terminus of neighbour sequence of sequence listing upward to telomere on chrosomal short arm and 5'-terminus of this base sequence : 2550
aatccagccttaatttacatgtaggccataatacattgcacatggaagtgcatgtgtgtttgtgtgtgtgtgtgtgtgtgagagagagagagagagagagagagcatatttgtgtattcaaatgaacagtaagtccctatatatgagagcaaaggcaagtagttctccatacacattcttggccaggctttagtttaatgaaaaaatatacacagagcttcatctggatcaagtaccattttaggtgctggggagagagatttgagaaagcagctcctgctcttggagagggttcctcatttttgccaaatctaaatatctgatgcaggtcttcatggctctgggtggagatggattctgataaca

SEQ ID NO: 19362 - DNA, 407 bp, Homo sapiens
  chr12.fa.O7frz.123808274
  Located on chromosome 12
  Distance between a terminus base of telomere on chromosomal short arm and 5'-terminus of this base sequence : 121150874
  Distance between 3'-terminus of neighbour sequence of sequence listing upward to telomere on chrosomal short arm and 5'-terminus of this base sequence : 64078
aagtctatgctctttaccataagactaaaatgcctaggacagttgaaaccagcaatcacttgtcatatggcagagaaggaggatgtgagttctaatgcaaatgtttgtatagtctgttccgaagacatatacacagaggagaaagtgagaagagagggagagggagggagagagagagagagagagagagagagagagagagagagagaaataacacaatcttaaaggccaaagagaaacagaggaaagaagatagaagagagagatccagaagtcaagaagtaactgctgtttccagctcagagtgacattttagatgttcctttggtgctgattttgtgaaacacagtctaacctggccattgatttctgggtctaaactttattgaggctaataggattagatg

SEQ ID NO: 19363 - DNA, 447 bp, Homo sapiens
  chr12.fa.O7frz.123942662
  Located on chromosome 12
  Distance between a terminus base of telomere on chromosomal short arm and 5'-terminus of this base sequence : 121337983
  Distance between 3'-terminus of neighbour sequence of sequence listing upward to telomere on chrosomal short arm and 5'-terminus of this base sequence : 186702
tacaggaagattccatagcttaattaagtcttgtttctttcactcatcaatgagttacagaaacattaattaattttattctcctttaaacccaatatggcacatacattacctataaactacatagactttaagtcatatataagtgtgtgtgtgtgtgtgtgtgtgtgtatatatatatatatctgggtatacttgtttatatgaaataattcaaaatgaaaatatgcaaaaatccccaaagataggaaaaatagtctattctttacctggacattattgtgtctggaagagatgctgagaacagtggtacatgtcttacaagtagaagaagctgctaagcttgggtccattctactctttcttctcattcttttaacaaatattctttgagcatctatgtggccagcattgggctgcatcaagaatgtaatcgtgaatgatttg

SEQ ID NO: 19364 - DNA, 382 bp, Homo sapiens
  chr12.fa.O7frz.124533002
  Located on chromosome 12
  Distance between a terminus base of telomere on chromosomal short arm and 5'-terminus of this base sequence : 121532814
  Distance between 3'-terminus of neighbour sequence of sequence listing upward to telomere on chrosomal short arm and 5'-terminus of this base sequence : 194384
aattctatggaggatagtatggagatttcttaaagcactaaaaatcaaacgatcatttgattggcaatcccactactgggtatctacccaaaggaaaagaaattgttatataaaaagacatatgcactatgaggtttaatgcagcagtattcaaaatagtaaagttatggaatcaaccaaagtgtccatcaatggatgaatggataaagaaaatgtgatatatatatatatatatatatatatatatatatatatatatgtatatatatatatatatatatatatatgcacacactatggaatactattcagccagaaaaaggatgaaattatgttttgtgcagcaacatggatggagctgtaagccattaagtgaaataac

SEQ ID NO: 19365 - DNA, 200 bp, Homo sapiens
  DISO7_10003606
  Located on chromosome 12
  Distance between a terminus base of telomere on chromosomal short arm and 5'-terminus of this base sequence : 121549625
  Distance between 3'-terminus of neighbour sequence of sequence listing upward to telomere on chrosomal short arm and 5'-terminus of this base sequence : 16429
aaatgttgaatctgtgttgtcacataaaagaaagaatgtagaacaggaaaaagaaatgtacaagagaatttagattaaagcacgcattcacacacacacacacacacacacacacacacacacacacacccccttgccaagcgcagctgtgggctggacaggggagtggtggccctgggcgggatgctgggtagccattc

SEQ ID NO: 19366 - DNA, 117 bp, Homo sapiens
  DISO7_10003605
  Located on chromosome 12
  Distance between a terminus base of telomere on chromosomal short arm and 5'-terminus of this base sequence : 121604786
  Distance between 3'-terminus of neighbour sequence of sequence listing upward to telomere on chrosomal short arm and 5'-terminus of this base sequence : 54961
tatttccatatggattatgttaaggagtgtgtgtgtgtgtgtgtgtgtgtgtgtgtgtgtgtgtgtgaatatatacacatacatacgaaagagaaatggccctattataggaagcct

SEQ ID NO: 19367 - DNA, 407 bp, Homo sapiens
  chr12.fa.O7frz.124425350
  Located on chromosome 12
  Distance between a terminus base of telomere on chromosomal short arm and 5'-terminus of this base sequence : 121640554
  Distance between 3'-terminus of neighbour sequence of sequence listing upward to telomere on chrosomal short arm and 5'-terminus of this base sequence : 35651
aagagtccttcagctcatttagttcaggcacctccattttacagatggggagactgaggccgctagttgagagggtctcactccaggtcacacagtaaacaattcttctcacccttctgaccattgtcgtcgtcttctctaaactcatttccaatgacctcagtgagctcgggggcagctggggtctgtgagagattcttgcacacaaattactggaagcacaaggagcaaggaggggaaaggttttatttatttatttatttattggcatctgtgtctcgcctttgccaactatttttataaaccaagagctggatctggctagttttgtgaggatggttaaatattgagcaagagattctttgatgagcatggcactaaatgataattactggtaagctccactt

SEQ ID NO: 19368 - DNA, 139 bp, Homo sapiens
  DISO7_10003603
  Located on chromosome 12
  Distance between a terminus base of telomere on chromosomal short arm and 5'-terminus of this base sequence : 121644114
  Distance between 3'-terminus of neighbour sequence of sequence listing upward to telomere on chrosomal short arm and 5'-terminus of this base sequence : 3153
tcccatcagaggacacttggggcttgacccttgtgtcctctaatccatccatccatccatccatccatccatccatccatccatccatccaccgacccacccatccatctaaactacatttattgagagtatgagctgc

SEQ ID NO: 19369 - DNA, 167 bp, Homo sapiens
  D12S79
  Located on chromosome 12
  Distance between a terminus base of telomere on chromosomal short arm and 5'-terminus of this base sequence : 121765223
  Distance between 3'-terminus of neighbour sequence of sequence listing upward to telomere on chrosomal short arm and 5'-terminus of this base sequence : 120970
tatgtgcacccagactaccatataatcaatataaaagtattaatgggatatcctacattctctctctgtgtgtgtgtgtgtgtgtgtgtgtgtgtgtgtgtgtgtgtgtaccaagtctttgaaatctggtatgttttacacttacagggcatctcagttcagtccaa

SEQ ID NO: 19370 - DNA, 233 bp, Homo sapiens
  G12407
  Located on chromosome 12
  Distance between a terminus base of telomere on chromosomal short arm and 5'-terminus of this base sequence : 121978543
  Distance between 3'-terminus of neighbour sequence of sequence listing upward to telomere on chrosomal short arm and 5'-terminus of this base sequence : 213153
tgggtttcaacttaacttaggcttggcatctatgtctgtctgtctatctatctatctatctatctatctatctatctatctatcatctatctacatacctataatgtatcatctacctatatatctatatctatctctctgtctgtctagctaactgtcttcttttatctatctatctgtttattttgggagggattcaatactatagggctaatgagaacattgactctgaa

SEQ ID NO: 19371 - DNA, 120 bp, Homo sapiens
  D12S1602
  Located on chromosome 12
  Distance between a terminus base of telomere on chromosomal short arm and 5'-terminus of this base sequence : 121992553
  Distance between 3'-terminus of neighbour sequence of sequence listing upward to telomere on chrosomal short arm and 5'-terminus of this base sequence : 13777
ttccctaccatcacattgtcgatttaacagggatagattatttgcaagatgtgtttgtgtgtgtgtgtgtgtgtgtgtgtgtgtgtgtgtgtggtgtgtgtgtgtgatctatacaggaaa

SEQ ID NO: 19372 - DNA, 470 bp, Homo sapiens
  chr12.fa.O7frz.124738659
  Located on chromosome 12
  Distance between a terminus base of telomere on chromosomal short arm and 5'-terminus of this base sequence : 122074595
  Distance between 3'-terminus of neighbour sequence of sequence listing upward to telomere on chrosomal short arm and 5'-terminus of this base sequence : 81922
tgatatgaatgcaaggaataagatgaaacatagccaaatttccagcatttaaagagatgttaagaaaacacttgccaaaaagccacaatcaaattctagcttgcccttcatttctaacagcagcagtggtagccgaccagttttgtttttgaaatttaatgtttattatgtacttacctacacacatacacacacacacacacacacacacataaaactatataagaacattctatacagctaagaaacacaaaaacagtttcgtagtgttaaatgacttggataatgcaaaggtgtcattcagaggcaaggattcgaattcaaagccaggagtgacccatgttttgttagctcaaagacatgaccttacacacaggatagagaaacagaaaggtcagactaaagggatgattaaagtcattagaaaatacaaaggatgtgagggagtgttgctgagtcctgtattacaa

SEQ ID NO: 19373 - DNA, 138 bp, Homo sapiens
  DISO7_10003609
  Located on chromosome 12
  Distance between a terminus base of telomere on chromosomal short arm and 5'-terminus of this base sequence : 122093911
  Distance between 3'-terminus of neighbour sequence of sequence listing upward to telomere on chrosomal short arm and 5'-terminus of this base sequence : 18846
caatttaggagtaatgtaggaatggggaaaggagaaagactaaattctcatcttctaaattcaagagaagattaaaatcactcacacacacacacacacacacacacacacacgacattaagaacagcagaataaaca

SEQ ID NO: 19374 - DNA, 188 bp, Homo sapiens
  DISO7_10003610
  Located on chromosome 12
  Distance between a terminus base of telomere on chromosomal short arm and 5'-terminus of this base sequence : 122191496
  Distance between 3'-terminus of neighbour sequence of sequence listing upward to telomere on chrosomal short arm and 5'-terminus of this base sequence : 97447
tgccagccatactgacatagtaattattttttaactgacaggttaaaatagcaaatgtagcaaaaataacatctgcagagagagagagaaagacgagagagagagagagagagagagagagacagagacagagagagacagagagagacagagagagacagagactgactgactactgtgaagacttg

SEQ ID NO: 19375 - DNA, 320 bp, Homo sapiens
  chr12.fa.O7frz.124834355
  Located on chromosome 12
  Distance between a terminus base of telomere on chromosomal short arm and 5'-terminus of this base sequence : 122197681
  Distance between 3'-terminus of neighbour sequence of sequence listing upward to telomere on chrosomal short arm and 5'-terminus of this base sequence : 5997
atgtcaagttgacaatccatactaaaaacttctttgcttgttttatttctatatctatctccatatatatggagatatctatatatatatatatatatatacggagctagatatagatatatatagatataagtagtttatcttgattttcttattttgggaaagaggagcataaaagaaaggagaaattattggaatttaggttacctcctaagaaaggaggctttgctttaagaagatggggaatgtaatactctattcgtctaaccaatcaataaccacactttgaaatctttcacttgtcttcaactagccatgta

SEQ ID NO: 19376 - DNA, 183 bp, Homo sapiens
  DISO7_10003611
  Located on chromosome 12
  Distance between a terminus base of telomere on chromosomal short arm and 5'-terminus of this base sequence : 122259630
  Distance between 3'-terminus of neighbour sequence of sequence listing upward to telomere on chrosomal short arm and 5'-terminus of this base sequence : 61629
agcattctgtttaacacctccctaaaacttgaaagaaaaaaaaccagcccaaaagcaaccgcagaacgtaacctatatatatatatatatatatatatatatatatttctatagtggtatcagagagccctaaaatccaaccacatgccttcggggaaaatgcattatgatctgtacagcacc

SEQ ID NO: 19377 - DNA, 224 bp, Homo sapiens
  Z67087
  Located on chromosome 12
  Distance between a terminus base of telomere on chromosomal short arm and 5'-terminus of this base sequence : 122349703
  Distance between 3'-terminus of neighbour sequence of sequence listing upward to telomere on chrosomal short arm and 5'-terminus of this base sequence : 89890
tcagggcttgggatgactttacattcccccaaattgccattttgggcaggatttacataactgagattccagctttctttggcctagttttgccattttctctattccgttttgcttttaaagcacacatgcattgtgtgtgcacacacatgcatacacacacacacacacacacacacacacgcatttctttcctaatggtacaagttatacatgcttcatgg

SEQ ID NO: 19378 - DNA, 336 bp, Homo sapiens
  AC025740.1_131102
  Located on chromosome 12
  Distance between a terminus base of telomere on chromosomal short arm and 5'-terminus of this base sequence : 122660997
  Distance between 3'-terminus of neighbour sequence of sequence listing upward to telomere on chrosomal short arm and 5'-terminus of this base sequence : 311070
gaggttacagtgagctgagatccagccactgcactccagcctgggcgacagagcgagattctgtctcaaaaataaataaataaataaataaataaataaataaataaataaataagcaaataaataaaaataaaagatcgctttgacttctgacccgactagagatcaaattgaagaggggcatagtagtctgttcttagggtaaacaacagaatccactctggctcttctaagcagaaaagggatttatgtattcaaggaagtgagttcactcacaaaattatctgggtggggtgcagtgaggactagagagagtcagacttgaaattaagcctt

SEQ ID NO: 19379 - DNA, 456 bp, Homo sapiens
  AC025740.1_79277
  Located on chromosome 12
  Distance between a terminus base of telomere on chromosomal short arm and 5'-terminus of this base sequence : 122718153
  Distance between 3'-terminus of neighbour sequence of sequence listing upward to telomere on chrosomal short arm and 5'-terminus of this base sequence : 56820
ctgagcataagatggtatcctgggtactgatgatttcactccctagctagtctatcattccattattattattattattattattattattattattattattattttcagatggagattcactcttttcacccaggctggactgcagtggcataatctctgctcactgcaacctccacctcccaggttcaagcgattctcctgcctcaacctcccgagtagctgggattacatgtgcatgccaccagccctggctaatttttgtatttttagtagacataaggtttcccatgttggccaggctggtctccaactcctgaccccaagtgatccgcccgccttggcccctcaaagtgctgggattacaggtgtgagccactgcacctggcctatcattccttgaaaaatacaaagttgctgctgttctagaaaacaatcaaaggtcaatcatttgtc

SEQ ID NO: 19380 - DNA, 476 bp, Homo sapiens
  chr12.fa.O7frz.125579123
  Located on chromosome 12
  Distance between a terminus base of telomere on chromosomal short arm and 5'-terminus of this base sequence : 122818598
  Distance between 3'-terminus of neighbour sequence of sequence listing upward to telomere on chrosomal short arm and 5'-terminus of this base sequence : 99989
atagcaggacttaactcataacactgttgtgagaattaaattaaataacacaagtcaagtgctggctggttagttaattattgtcattctgaggaagataagagcattagcagccatctgtttataatttaaagtgagtaagaaagttagaatctaaccaaagtcaggatcgaacagaataccgtttttcaaactatgtttctgggcccttagggagatgttaataggcattttattggtttgtttgttttctgtggggttttttttgtttgtttgtttgtttgtttgtttgtttttttgagacagagtctcactctgttgcccaggctggagtgcagtggtgcgatcttggctcattgccacctccgcctcccaggttcaagcgattctcctgcctcagcctcctgagcagctgggattacaggcacctgccaccatgcccagctaatttttgtatttgtagcagagatggagtt

SEQ ID NO: 19381 - DNA, 113 bp, Homo sapiens
  DISO7_10003617
  Located on chromosome 12
  Distance between a terminus base of telomere on chromosomal short arm and 5'-terminus of this base sequence : 122826224
  Distance between 3'-terminus of neighbour sequence of sequence listing upward to telomere on chrosomal short arm and 5'-terminus of this base sequence : 7150
gcacagttagagctgagtttgttcattcattcattcattcattcattcattcattcatcacctgggagcagagtcgtggctgcatcccagtcctcctccatcagaggttgcgt

SEQ ID NO: 19382 - DNA, 105 bp, Homo sapiens
  DISD22_0008785
  Located on chromosome 12
  Distance between a terminus base of telomere on chromosomal short arm and 5'-terminus of this base sequence : 122933914
  Distance between 3'-terminus of neighbour sequence of sequence listing upward to telomere on chrosomal short arm and 5'-terminus of this base sequence : 107577
gctgctctgcttctaggggttggctaattgtgcgtgtgtgtgtgtgtgtgtgtgtgagagagagagagagaaagaggtgtgtatctgggttatgagtcatcatac

SEQ ID NO: 19383 - DNA, 140 bp, Homo sapiens
  DISO7_10003618
  Located on chromosome 12
  Distance between a terminus base of telomere on chromosomal short arm and 5'-terminus of this base sequence : 123189654
  Distance between 3'-terminus of neighbour sequence of sequence listing upward to telomere on chrosomal short arm and 5'-terminus of this base sequence : 255635
gccacttaacactcaaccccacccccatgcaggggatccccattcacctcaccacacttgccagcaggtacagctggccatggactgtgtgtgtgtgtgtgtgtgtgtgtgtgtgtcaggcgggaggactgtatgggtgg

SEQ ID NO: 19384 - DNA, 434 bp, Homo sapiens
  U17326.1_481
  Located on chromosome 12
  Distance between a terminus base of telomere on chromosomal short arm and 5'-terminus of this base sequence : 123321479
  Distance between 3'-terminus of neighbour sequence of sequence listing upward to telomere on chrosomal short arm and 5'-terminus of this base sequence : 131685
cttccaaatgtttcaggtacatgggcgtggaccctaattatggacacacgagggattaatatgggccagggacacgtttcttggcattgagggtcttcaatgaaagcagtggcaatctaagatcgacacacttgtgcagggaagaggacggacagagacctggcccatcacacacacacacacacacacacacacacacacaggcacgcacaaccaaaatgtcatcataaaaaaggagaaagggggacttcagtggctgagggactggctcagagagcttgtgcctagttcctgcagcctttccaggggaaccccagagaaaaaaacccccacagcgacggccatgttccagtggtttcatgcacccgtgagttgcccttgtcggcaagagagggagtgggaacagagttttgtaagagccactgcagattaga

SEQ ID NO: 19385 - DNA, 158 bp, Homo sapiens
  D12S1718
  Located on chromosome 12
  Distance between a terminus base of telomere on chromosomal short arm and 5'-terminus of this base sequence : 123321589
  Distance between 3'-terminus of neighbour sequence of sequence listing upward to telomere on chrosomal short arm and 5'-terminus of this base sequence : -324
ggcaatctaagatcgacacacttgtgcagggaagaggacggacagagacctggcccatcacacacacacacacacacacacacacacacacaggcacgcacaaccaaaatgtcatcataaaaaaggagaaagggggacttcagtggctgagggactgg

SEQ ID NO: 19386 - DNA, 330 bp, Homo sapiens
  U11422.1_1511
  Located on chromosome 12
  Distance between a terminus base of telomere on chromosomal short arm and 5'-terminus of this base sequence : 123468506
  Distance between 3'-terminus of neighbour sequence of sequence listing upward to telomere on chrosomal short arm and 5'-terminus of this base sequence : 146759
aaacgaattagcagtgacgtccaacccgactggtttatgggtgtggggagggagacgtcgcaaccctcattaaaagagccgctctgggctccaaagcatacatcttttatataacctaatttccatttttttttttctatcaggaaacacacacacacacacacacacacacatacacacacacacacacacacacacacacacacaatgacaatttctgggagcctggatagggctgaatgtagtagccacgcagggcagggcaggtctatttgggcagagaaggccccatgggaggcagggatggttatttctgcctctacatcagtg

SEQ ID NO: 19387 - DNA, 160 bp, Homo sapiens
  DISO7_10003619
  Located on chromosome 12
  Distance between a terminus base of telomere on chromosomal short arm and 5'-terminus of this base sequence : 123519553
  Distance between 3'-terminus of neighbour sequence of sequence listing upward to telomere on chrosomal short arm and 5'-terminus of this base sequence : 50717
gtaaccctatgccatgagccctgggatctgtgctatttaggtaattatgcatgcatgtgtgtgtgtgtgtgggcatgcacacacacatacacacataaacacacacacacacacacacacacgctgcatccgttgttctctccatgccaatgggagaatt

SEQ ID NO: 19388 - DNA, 189 bp, Homo sapiens
  DISO7_10003620
  Located on chromosome 12
  Distance between a terminus base of telomere on chromosomal short arm and 5'-terminus of this base sequence : 123545127
  Distance between 3'-terminus of neighbour sequence of sequence listing upward to telomere on chrosomal short arm and 5'-terminus of this base sequence : 25414
gtgacactgtcacggagccctcctctgcatggctttggcatcaaatgcaaccacacacacacacacacacacacacacacacacacacagagcaggcactatgccctgctggacagaatgggctgcagggatgtgcatgaccaaaatgcaccccagacagcatgtgcacgcggaaggacactcagcgat

SEQ ID NO: 19389 - DNA, 94 bp, Homo sapiens
  DISO7_10003621
  Located on chromosome 12
  Distance between a terminus base of telomere on chromosomal short arm and 5'-terminus of this base sequence : 123586807
  Distance between 3'-terminus of neighbour sequence of sequence listing upward to telomere on chrosomal short arm and 5'-terminus of this base sequence : 41491
cacgcaattactggacataatcattacacatgtgtatgtgtgtgtgtgtgtgtgtgtgtgtgtgtgtgtttatctcgaggactcagaagtggag

SEQ ID NO: 19390 - DNA, 475 bp, Homo sapiens
  chr12.fa.O7frz.126322667
  Located on chromosome 12
  Distance between a terminus base of telomere on chromosomal short arm and 5'-terminus of this base sequence : 123642204
  Distance between 3'-terminus of neighbour sequence of sequence listing upward to telomere on chrosomal short arm and 5'-terminus of this base sequence : 55303
cttaacaagtgagtatgtaaaccagatcatggcacagagtgatgagcataaaagaggcactcaggagagactgatggaaagggaaagggaggaaacactctcatgagcccacatggcccaagtgaggtctcagaaatcctgcaaattccaccaaaggcagattccacctcctttcttctccctttgagccattagaattcaccatttcctggagttgtgtgtgtgtgtgtgtgtgtgtgtgtgtgtgtgtgtgtgtgtgtttcaagatggctctaggtggctccaaagacagaaggtatttggctccaaagaaagaaggtatttgaacactccagcctcagaaacccataagacaatcattttcgaagcctcttcatctgtcttgccatgatggatgctaccacaactctgctcatcagtagcagtgaactagccccatgttactgatgagaaacagacctaaacagaagcaata

SEQ ID NO: 19391 - DNA, 102 bp, Homo sapiens
  DISO7_10003625
  Located on chromosome 12
  Distance between a terminus base of telomere on chromosomal short arm and 5'-terminus of this base sequence : 123662739
  Distance between 3'-terminus of neighbour sequence of sequence listing upward to telomere on chrosomal short arm and 5'-terminus of this base sequence : 20060
atttgatgcctggtattgttacttgttagctgttgttgttgttgttgttgttgttgttttattgcagcggtgaggggagggtgttggttgagaagtttaagc

SEQ ID NO: 19392 - DNA, 160 bp, Homo sapiens
  DISO7_10003627
  Located on chromosome 12
  Distance between a terminus base of telomere on chromosomal short arm and 5'-terminus of this base sequence : 123714410
  Distance between 3'-terminus of neighbour sequence of sequence listing upward to telomere on chrosomal short arm and 5'-terminus of this base sequence : 51569
tctgagctcatgctccaccaccccgcctgcatccacagacctcccggagaggggaggaaaggagaggagaggagaggagaggagaggagaggagaggagagggaagcacagaggagcagggagcagccttgatgagcaggggtgacagtgccaggtgttt

SEQ ID NO: 19393 - DNA, 140 bp, Homo sapiens
  DISO7_10003628
  Located on chromosome 12
  Distance between a terminus base of telomere on chromosomal short arm and 5'-terminus of this base sequence : 123722001
  Distance between 3'-terminus of neighbour sequence of sequence listing upward to telomere on chrosomal short arm and 5'-terminus of this base sequence : 7431
ggaagcatgttcccttctctcttcagttacacacacacacacacacacacacacacacacacacacacacatcagattcctcttttgtctagaaaaatgtgtagtgctttaaagatgttggggaagctcaggcacaggag

SEQ ID NO: 19394 - DNA, 474 bp, Homo sapiens
  chr12.fa.O7frz.126437799
  Located on chromosome 12
  Distance between a terminus base of telomere on chromosomal short arm and 5'-terminus of this base sequence : 123752515
  Distance between 3'-terminus of neighbour sequence of sequence listing upward to telomere on chrosomal short arm and 5'-terminus of this base sequence : 30374
cttagatcaacgccttagtttctcatgagggctaagcatgaaatgttctcatcaaatacagtgggtggagaagcctcatcaaaaaccactctgcttgaactcttcttacaattccgaatacagcactgaaaaacaattatgtcttctggaatgtgcatgtgtatgtgcgtgtgtgtgtgtgtgtgtgtgtgtgtgtgtgtgtgtgtgtgtgtgtacagctgtccttcagtatccatagggggttggttccaggacaccccacatataccaaaatccaatatgttcaagtccctgatataaaatggcatagtcttcatatattaataacttacacaaagcctcctgtatactttaaatcacctctacattacttatgatacctaatacaatgtaaatgttatgtacatagttgttatactctattgtttaagaaataatgacaagaaaaaagtcagtacatgttcagtacagaca

SEQ ID NO: 19395 - DNA, 105 bp, Homo sapiens
  D12S1720
  Located on chromosome 12
  Distance between a terminus base of telomere on chromosomal short arm and 5'-terminus of this base sequence : 123790482
  Distance between 3'-terminus of neighbour sequence of sequence listing upward to telomere on chrosomal short arm and 5'-terminus of this base sequence : 37493
gctgattaggacaggcacacgtgcatgcacgcgcgcgcatgcgcgcacacacacacacacacacacacacacacacctgtctgccccacacatgccacatggatg

SEQ ID NO: 19396 - DNA, 335 bp, Homo sapiens
  chr12.fa.O7frz.126658276
  Located on chromosome 12
  Distance between a terminus base of telomere on chromosomal short arm and 5'-terminus of this base sequence : 123907848
  Distance between 3'-terminus of neighbour sequence of sequence listing upward to telomere on chrosomal short arm and 5'-terminus of this base sequence : 117261
tcagctcactagctgagactacaggcacgtgcctctatgcccggctaatttttttgtattttttgtagagatggggttcaccatgttacccaggctggtcttgaactcctgagctcaaagcgatctgcccaccttggcctcccaaattgctgggattacaggcatgagccactgcgcccagctgtccatgatgttgaaacaaaaagtgcaggaaaaccggagccctcatccttgaatcagttctgtctctctcggcgtgtgtgtgtgtgtgtgtgtgcatgtgtgtatatttttaaaaagatcttgctaaatgctaatacctgcatctgctaatg

SEQ ID NO: 19397 - DNA, 157 bp, Homo sapiens
  DISO7_10003630
  Located on chromosome 12
  Distance between a terminus base of telomere on chromosomal short arm and 5'-terminus of this base sequence : 124085643
  Distance between 3'-terminus of neighbour sequence of sequence listing upward to telomere on chrosomal short arm and 5'-terminus of this base sequence : 177460
aaggtcatctcttctgttaaaccttatctatggtagatcattttactgttctgcaaatattctctctccctctctcacttgcacacattctttctctctctctctctctcacacacacacacacacacacacactcaagaaacaagaataatcctgc

SEQ ID NO: 19398 - DNA, 121 bp, Homo sapiens
  DISO7_10003637
  Located on chromosome 12
  Distance between a terminus base of telomere on chromosomal short arm and 5'-terminus of this base sequence : 124219827
  Distance between 3'-terminus of neighbour sequence of sequence listing upward to telomere on chrosomal short arm and 5'-terminus of this base sequence : 134027
actggtgcctaacatgagctgtgtgttttgtgggaagtacacttcaaattgcagtgtgtgtgtgtgtgtgtatgtgtgtgtgtgtcttgagagtattatggggggatgccagacctgattc

SEQ ID NO: 19399 - DNA, 114 bp, Homo sapiens
  DISO7_10003632
  Located on chromosome 12
  Distance between a terminus base of telomere on chromosomal short arm and 5'-terminus of this base sequence : 124289333
  Distance between 3'-terminus of neighbour sequence of sequence listing upward to telomere on chrosomal short arm and 5'-terminus of this base sequence : 69385
gctcctatcagcctgtttgtgtgtgtctgtgtgtctgtctgtctgtctctctctctctctctctctcacacacacacacacacacacacacacactgccttgaccagactggtc

SEQ ID NO: 19400 - DNA, 282 bp, Homo sapiens
  chr12.fa.O7frz.127172333
  Located on chromosome 12
  Distance between a terminus base of telomere on chromosomal short arm and 5'-terminus of this base sequence : 124573627
  Distance between 3'-terminus of neighbour sequence of sequence listing upward to telomere on chrosomal short arm and 5'-terminus of this base sequence : 284180
atgatttagatgcattgatcacaggactcagccagccttcctcggtcctcccgtagttcctgtgtgtgtgtgtgtgtgtgtgtgtgtgcgcgcgcgcacttcatgtgtgtgtctatgtgtgtgtgcatgtcatatgtgtgcctatgggtgtatcgcgtgcacgtgggtgcctgttaggagatgctttccattaagaactgcatcgtgcttctttcagattgaagaggagctggctgcccttcagaaggaacgcagcgagagaataaagaacctattggaaag

SEQ ID NO: 19401 - DNA, 179 bp, Homo sapiens
  D12S349
  Located on chromosome 12
  Distance between a terminus base of telomere on chromosomal short arm and 5'-terminus of this base sequence : 124822365
  Distance between 3'-terminus of neighbour sequence of sequence listing upward to telomere on chrosomal short arm and 5'-terminus of this base sequence : 248456
attgctttgggcaatgttgacttgacaagtgtctggcttttgtgtgtgtgtgtgtgtgtgtgtgtgtgtgtgtgtgtgcttctggcttttagcaacagcaacaaaatactgcaatgggcaagtggtctactttctatgtgtagtatcttgttagattcttgtaatcacccccatgaggt

SEQ ID NO: 19402 - DNA, 134 bp, Homo sapiens
  D12S86
  Located on chromosome 12
  Distance between a terminus base of telomere on chromosomal short arm and 5'-terminus of this base sequence : 124888146
  Distance between 3'-terminus of neighbour sequence of sequence listing upward to telomere on chrosomal short arm and 5'-terminus of this base sequence : 65602
agctagtctggcatgagcagggcaggagagggctccccctacacacacacacacacacacacacacacacacacacacacacacacacacacacacacacatgccaggagtgttgggagatcatcaggggatag

SEQ ID NO: 19403 - DNA, 196 bp, Homo sapiens
  D12S1619
  Located on chromosome 12
  Distance between a terminus base of telomere on chromosomal short arm and 5'-terminus of this base sequence : 124895949
  Distance between 3'-terminus of neighbour sequence of sequence listing upward to telomere on chrosomal short arm and 5'-terminus of this base sequence : 7669
gaggggctgtcaagagcagagagagcctggaaggcagccaagggcaaggccaagtccgggagggggggcttccagatgtgtgtgtgtgtgtgtgtgtgtgtgtgtgtgtgtgtgtgtgtgtgtgtttatgtatgaaagagatagaggatggaaggatggaggttgggggacatgggctgaatttccacagcctaaa

SEQ ID NO: 19404 - DNA, 257 bp, Homo sapiens
  HUMUT8159
  Located on chromosome 12
  Distance between a terminus base of telomere on chromosomal short arm and 5'-terminus of this base sequence : 125027852
  Distance between 3'-terminus of neighbour sequence of sequence listing upward to telomere on chrosomal short arm and 5'-terminus of this base sequence : 131707
atcacaccaagggcacttacctgacacactgtgagcgtattgcctgtcctgccaccatggtgacataagctccatgaaagcaggtccatttttcttttctctttctttctttctttctttctttctttctttctttctttctttctttctttctttctttttttcttccttccttccttctttctttcttactttctttttttttaatggagtcttgctctgtcacaaggctggagtgcagtggcatgatcttgtct

SEQ ID NO: 19405 - DNA, 157 bp, Homo sapiens
  DISO7_10003640
  Located on chromosome 12
  Distance between a terminus base of telomere on chromosomal short arm and 5'-terminus of this base sequence : 125107954
  Distance between 3'-terminus of neighbour sequence of sequence listing upward to telomere on chrosomal short arm and 5'-terminus of this base sequence : 79845
tgaagtcatcagaatttgaggaaaatatatggggctgcctggctgcctggagtagtctctctctctctctctctctctctctctctcgctgtctcccccttactcttttagttcctcattactagatttttacgtgagtggactttatactgaggtc

SEQ ID NO: 19406 - DNA, 108 bp, Homo sapiens
  DISO7_10003638
  Located on chromosome 12
  Distance between a terminus base of telomere on chromosomal short arm and 5'-terminus of this base sequence : 125199374
  Distance between 3'-terminus of neighbour sequence of sequence listing upward to telomere on chrosomal short arm and 5'-terminus of this base sequence : 91263
caaacacatacacatgcacacatacacgcatacacacacacacacacacacacacacacacacaagtcttgggcatctcctgatgcccttgaggacccactggctaga

SEQ ID NO: 19407 - DNA, 117 bp, Homo sapiens
  DISO7_10003648
  Located on chromosome 12
  Distance between a terminus base of telomere on chromosomal short arm and 5'-terminus of this base sequence : 125293170
  Distance between 3'-terminus of neighbour sequence of sequence listing upward to telomere on chrosomal short arm and 5'-terminus of this base sequence : 93688
acactgagtatattaaggaacaaggagatgaggcgaggtttggagtggagagagagagagagagagagagagagagagagagagagagagagaggagatactggagcttcacattgg

SEQ ID NO: 19408 - DNA, 202 bp, Homo sapiens
  DISO7_10003646
  Located on chromosome 12
  Distance between a terminus base of telomere on chromosomal short arm and 5'-terminus of this base sequence : 125314553
  Distance between 3'-terminus of neighbour sequence of sequence listing upward to telomere on chrosomal short arm and 5'-terminus of this base sequence : 21266
tctcgccattagcagtattgaattatttatttatacagaggttttgtgtgtgtgtgtgtgtgtgtgtgtgtgtgtgtgtgtgtgtgtgtgtgtgttggggggatctcctaaattatttctgtgcatctcctttttttttctgctgttttttatggatgggatttgagaggccaaaggtgagtgggctattggccttctccct

SEQ ID NO: 19409 - DNA, 170 bp, Homo sapiens
  DISO7_10003645
  Located on chromosome 12
  Distance between a terminus base of telomere on chromosomal short arm and 5'-terminus of this base sequence : 125315850
  Distance between 3'-terminus of neighbour sequence of sequence listing upward to telomere on chrosomal short arm and 5'-terminus of this base sequence : 1095
cttaaatgcctgcttcggggaaatctctgcctctctctctctctgtctctctctctgtctctctctctgtctctctctctctctctctctctctctctctctcagtgtatttctctactttcttttacatttcctttttttctatccaaaaacaatgtgcttgttgaggc

SEQ ID NO: 19410 - DNA, 420 bp, Homo sapiens
  chr12.fa.O7frz.128196572
  Located on chromosome 12
  Distance between a terminus base of telomere on chromosomal short arm and 5'-terminus of this base sequence : 125320020
  Distance between 3'-terminus of neighbour sequence of sequence listing upward to telomere on chrosomal short arm and 5'-terminus of this base sequence : 4000
ggaactggagaactcagtagaccaatgccagatagaaatctcagctcagagttgccaaatcttcccatttttcaagagagcctgaatttttccattttaaaatctgattttaaaatatttataacttattgttttttcaaacactatgtgggtccaaaaccttacacacagacacacacacacacacacacacacacacacacacagtccacaattgagttgattctcaactggggagaaagatcaaagaaaacaggtgactgccactgctccccttgtatcctgcccagcagaaatttcccttaggagtcattggatgggataacctcctttgagtaaatccatgactatataccaccctccccaagtccccccaacacactgatttctttcttcccaaataggtttggataaagcaac

SEQ ID NO: 19411 - DNA, 217 bp, Homo sapiens
  DISO7_10003644
  Located on chromosome 12
  Distance between a terminus base of telomere on chromosomal short arm and 5'-terminus of this base sequence : 125323908
  Distance between 3'-terminus of neighbour sequence of sequence listing upward to telomere on chrosomal short arm and 5'-terminus of this base sequence : 3468
atagagtcatattgccaaatggaaaggggttggaatagatgtacacacatacacacacacacacacacacacgcacacacacacactgagcgagagagagaggatttgtttcttcccttcagtctctctcacctcaaaacctatttctagatcaaggtatcttaatctaaagaaaaccgtgccctcctgcgcttgggctttgtagagtctgtgaatc

SEQ ID NO: 19412 - DNA, 137 bp, Homo sapiens
  DISO7_10003643
  Located on chromosome 12
  Distance between a terminus base of telomere on chromosomal short arm and 5'-terminus of this base sequence : 125344876
  Distance between 3'-terminus of neighbour sequence of sequence listing upward to telomere on chrosomal short arm and 5'-terminus of this base sequence : 20751
agtcacaagcagggcatagctgtaaaagggactgtgtaagaaagaagtgaattaatcatcttaaaaggggtgtgtgtgtgtgtgtgtgtgtgtgtgtgtgtgtgtgtgtgtgtatttcacatgctccaaggccttag

SEQ ID NO: 19413 - DNA, 467 bp, Homo sapiens
  chr12.fa.O7frz.128085487
  Located on chromosome 12
  Distance between a terminus base of telomere on chromosomal short arm and 5'-terminus of this base sequence : 125421069
  Distance between 3'-terminus of neighbour sequence of sequence listing upward to telomere on chrosomal short arm and 5'-terminus of this base sequence : 76056
ctgagcattcgagaatcagagtttttaaagatagtttggtgggtagggacttgggatttggggagtactgattggtcaggttggaaatggaatcacagggtgccaaagtgaggttttctttccttccttctttccttccttccttccttccttcctcccttccttccttccttccttcctttcctccttccctccctccctccgtcccttcctttcttccttccttccttctttcctttctttctttctttcttttttttagaaggaccctctctctgtcacccaggctggagtgcaggcacactgcaacttccgccccccaggttcaagtgattctcctgcctcagcctcctgagtagctgggattacaggcacctgccactgtgcccagctaatttttgtatttttagtagaggcagggtttcaccatggtggccaggctggtctttaactcctgacctcgtgat

SEQ ID NO: 19414 - DNA, 404 bp, Homo sapiens
  HUMUT5099B
  Located on chromosome 12
  Distance between a terminus base of telomere on chromosomal short arm and 5'-terminus of this base sequence : 125658505
  Distance between 3'-terminus of neighbour sequence of sequence listing upward to telomere on chrosomal short arm and 5'-terminus of this base sequence : 236969
tgcactccagtatggacaacagagcaagactctgtctctgaaaaagaaagaaagaaggaaagaaagaaaagaaaagaaagaaagagtgaaagaaagaaaaagaagaagaaaaacagaagaagaagaaaaggaggaggaaggagaagaagaaggaaggaaggaagaaaagaaaagggagggaaggaaggaaggaaaagaaaggaaagaaagaaggagggaggaaggaaggaggaaagaaagaaagagaaagagagagaaaggaaggaaggagggaggggagggagggagggagagagaaagagagagagaaagagaaagaaagaaagaaagaaagaaagaaagaaagaaagaaagaaagaaagaaagaaagaaagcaagcaagcatgtgcaatttcaagggggta

SEQ ID NO: 19415 - DNA, 182 bp, Homo sapiens
  AC002070.1_19023
  Located on chromosome 12
  Distance between a terminus base of telomere on chromosomal short arm and 5'-terminus of this base sequence : 125682745
  Distance between 3'-terminus of neighbour sequence of sequence listing upward to telomere on chrosomal short arm and 5'-terminus of this base sequence : 23836
gtctccagacattaccaaatgtcccctgggagcaaaagtgcatgagcccccaccgtacatcatacacacacacacacacacacacacacacacacacacacacacacacactccacattgagaaccactgctttagggcaatggattcatttagagctgtgatacaatgattccagacttct

SEQ ID NO: 19416 - DNA, 403 bp, Homo sapiens
  AC068791.10_409
  Located on chromosome 12
  Distance between a terminus base of telomere on chromosomal short arm and 5'-terminus of this base sequence : 125766621
  Distance between 3'-terminus of neighbour sequence of sequence listing upward to telomere on chrosomal short arm and 5'-terminus of this base sequence : 83694
gaaggttaggcctaagacatacataataataattaattaaaaataagccgggcgcagtgattcacacctgtaatcctagcactttatgaggctgaggtgggtggatcacctaaggtcaggagttcgagaccagcctggccaacatggcgaaaccccgtctctactaaaaatacaaaaattagctgggcgtggtgacgggtgcctgtaatcccagctacttgggaggctgaggcagagaatcacttgaaccagggaggcagagattgcagtgagccgagatcacaccactgcactccagcctgggcaacagagcaagactctatctcaaaaataataataataataataacaataaataaaaatagcttatggtcttgagcacaggtctaagtgccaggtgcta

SEQ ID NO: 19417 - DNA, 394 bp, Homo sapiens
  AC002563.1_83793
  Located on chromosome 12
  Distance between a terminus base of telomere on chromosomal short arm and 5'-terminus of this base sequence : 125912516
  Distance between 3'-terminus of neighbour sequence of sequence listing upward to telomere on chrosomal short arm and 5'-terminus of this base sequence : 145492
cctggttatgtgacagaatgtcttcaatccttaggttgatatactgaagaacttggcgtcatacctgcaactaactctcaaatggttcaggaaagagagagagagagagagagagagagtgtgtgtgtgtgtgtgtgtgtgtgtgtgtgtgtgtgtgtgtgtgtgtgttaagaagacagagaaaaaaattatgacaaaatattagcaaatggtgacttgagagagatcacagagttaacagagcaagcaagctctcagaaggtcagggcccacggtggtttcgttgcaatcaggacaaagggtttggctttagatagtcttcgaggcttagcactcttcacttggcctaacagtgggatgttctttgggaatgtcagactgtgctaaactggat

SEQ ID NO: 19418 - DNA, 175 bp, Homo sapiens
  D12S321
  Located on chromosome 12
  Distance between a terminus base of telomere on chromosomal short arm and 5'-terminus of this base sequence : 125912553
  Distance between 3'-terminus of neighbour sequence of sequence listing upward to telomere on chrosomal short arm and 5'-terminus of this base sequence : -357
gatatactgaagaacttggcgtcatacctgcaactaactctcaaatggttcaggaaagagagagagagagagagagagagagtgtgtgtgtgtgtgtgtgtgtgtgtgtgtgtgtgtgtgtgtgtgtgtgttaagaagacagagaaaaaaattatgacaaaatattagcaaatgg

SEQ ID NO: 19419 - DNA, 227 bp, Homo sapiens
  AC002563.1_100042
  Located on chromosome 12
  Distance between a terminus base of telomere on chromosomal short arm and 5'-terminus of this base sequence : 125928771
  Distance between 3'-terminus of neighbour sequence of sequence listing upward to telomere on chrosomal short arm and 5'-terminus of this base sequence : 16043
ttgaccacgaggtacatttaacatttccactgtagtgttgttcttaaggccacggggtgaattcctatgtgtgttcaccaaatatacgtgtgtgtgtgtgtgtgtgtgtgtttagtattaattttattttttaaattgtttacagaggcaaaatacacgacataaaatttaccattttaaccattttttaagtgtatagttcagtggcattaagtacactcatgtta

SEQ ID NO: 19420 - DNA, 258 bp, Homo sapiens
  AC002563.1_105844
  Located on chromosome 12
  Distance between a terminus base of telomere on chromosomal short arm and 5'-terminus of this base sequence : 125934532
  Distance between 3'-terminus of neighbour sequence of sequence listing upward to telomere on chrosomal short arm and 5'-terminus of this base sequence : 5534
caaatcttactcagccttcaaggataaattcaaatgctatgatctccataaaactattcccactttctcttctcaggagcaacctcaccttgttctgtaacaaaagcataactgtatttctctcctaaatatatatatatatatatatatatatacttttttttttttgagatggagtcccactctgtcgcccaggctggagttcagtggcgtgatctcagttcactgcaacctccacctccaagattcaagcgattc

SEQ ID NO: 19421 - DNA, 293 bp, Homo sapiens
  AC002563.1_116897
  Located on chromosome 12
  Distance between a terminus base of telomere on chromosomal short arm and 5'-terminus of this base sequence : 125945566
  Distance between 3'-terminus of neighbour sequence of sequence listing upward to telomere on chrosomal short arm and 5'-terminus of this base sequence : 10776
attaacacctacaggctattaggagaaaagggaaaaaaagcaataaaggatgaagttttactctccttcatttgtcctattcccattctgaaaagatgagtattttccctcttccctccaactgactcctccccagcctactccctgacacacacacacacacacacacacacacatacacacagaaacgcacacacaggacaatagccaagacaaagggactttgtgtgtgtgttgttttttcattaaaagctgcggacattcagaaaactctacatcggccttgaaataaa

SEQ ID NO: 19422 - DNA, 238 bp, Homo sapiens
  G08945
  Located on chromosome 12
  Distance between a terminus base of telomere on chromosomal short arm and 5'-terminus of this base sequence : 125953507
  Distance between 3'-terminus of neighbour sequence of sequence listing upward to telomere on chrosomal short arm and 5'-terminus of this base sequence : 7648
ttcccagtttggttcagatactgggatccccaaacccaacaatgggcaataacttctaagaatgaaactacgttaaatatatatagatatagatagatagatagatagatagatagatagatagatagatagatagagatatagagatgtacacgtgcattacatcgaggtaaagtgtaagcaatgaatgtacatggccattcattccacggaagtaaccccaatcaaagagaggttt

SEQ ID NO: 19423 - DNA, 268 bp, Homo sapiens
  D12S1666
  Located on chromosome 12
  Distance between a terminus base of telomere on chromosomal short arm and 5'-terminus of this base sequence : 126048676
  Distance between 3'-terminus of neighbour sequence of sequence listing upward to telomere on chrosomal short arm and 5'-terminus of this base sequence : 94931
aatcccaactactcgggaggctgaggcaggagaacccgggaggcagaggttgcagtgagccgagaacacgccactgcactacagcctgggcaacacggcaagactccatctcaaaacacacacacacacacacacacacacacacacacacacacagaaaaaggaaagttatttctactatgacaaaactaggtgatggtaataagaacggtgacatcaaagtgagaaattatcaaagtgcccagatagtaccctcctgaagatgtga

SEQ ID NO: 19424 - DNA, 396 bp, Homo sapiens
  chr12.fa.O7frz.129651514
  Located on chromosome 12
  Distance between a terminus base of telomere on chromosomal short arm and 5'-terminus of this base sequence : 126167348
  Distance between 3'-terminus of neighbour sequence of sequence listing upward to telomere on chrosomal short arm and 5'-terminus of this base sequence : 118404
cagcataatgacatgaagtttcatccatattgtagcttgttaaaatttgccttatatttaagatggaatcttttatatatatatatatatatatatatatatatatatatatatatatatatatatctccccattttgtatatccacttatccatcgagggacacttggctcacttccatcttttggctactgggaataatgctgctatgaacatgagtatatatctcttccaggtcctgctttcaactcttttggatatgcctgtatcaacaatgtttttatccaacatgggcttatctctcattggcttaatttcttttaggcccagatagaggtgaggatgaactgtctactgtctccatagagaggcaagtctgataaatcagaacattctg

SEQ ID NO: 19425 - DNA, 397 bp, Homo sapiens
  chr12.fa.O7frz.129023144
  Located on chromosome 12
  Distance between a terminus base of telomere on chromosomal short arm and 5'-terminus of this base sequence : 126167348
  Distance between 3'-terminus of neighbour sequence of sequence listing upward to telomere on chrosomal short arm and 5'-terminus of this base sequence : -396
cagcataatgacatgaagtttcatccatattgtagcttgttaaaatttgccttatatttaagatggaatcttttatatatatatatatatatatatatatatatatatatatatatatatatatatctccccattttgtatatccacttatccatcgagggacacttggctcacttccatcttttggctactgggaataatgctgctatgaacatgagtatatatctcttccaggtcctgctttcaactcttttggatatgcctgtatcaacaatgtttttatccaacatgggcttatctctcattggcttaatttcttttaggcccagatagaggtgaggatgaactgtctactgtctccatagagaggcaagtctgataaatcagaacattctgg

SEQ ID NO: 19426 - DNA, 113 bp, Homo sapiens
  chr12.fa.O7frz.129768932
  Located on chromosome 12
  Distance between a terminus base of telomere on chromosomal short arm and 5'-terminus of this base sequence : 126183545
  Distance between 3'-terminus of neighbour sequence of sequence listing upward to telomere on chrosomal short arm and 5'-terminus of this base sequence : 15800
acctcatggttaagttgtagaagcctgtcattttattttattttattttattttattttatttatttgagacagggtcttgctctgtcatccaggctaaagtgcaatagcgtg

SEQ ID NO: 19427 - DNA, 151 bp, Homo sapiens
  DISO7_10026500
  Located on chromosome 12
  Distance between a terminus base of telomere on chromosomal short arm and 5'-terminus of this base sequence : 126406857
  Distance between 3'-terminus of neighbour sequence of sequence listing upward to telomere on chrosomal short arm and 5'-terminus of this base sequence : 223199
ctccctgatcgagcgaagtccagaaaggtggcagaatgtctctaaagcagctacacacacacacacacacacacacacacacacacaccccaaaaaatgccagaaaagatggaagagtaagaaaatcaggccaacatgaataatttggtaa

SEQ ID NO: 19428 - DNA, 121 bp, Homo sapiens
  DISO7_10026481
  Located on chromosome 12
  Distance between a terminus base of telomere on chromosomal short arm and 5'-terminus of this base sequence : 126406887
  Distance between 3'-terminus of neighbour sequence of sequence listing upward to telomere on chrosomal short arm and 5'-terminus of this base sequence : -121
gcagaatgtctctaaagcagctacacacacacacacacacacacacacacacacacaccccaaaaaatgccagaaaagatggaagagtaagaaaatcaggccaacatgaataatttggtaa

SEQ ID NO: 19429 - DNA, 287 bp, Homo sapiens
  D12S1721
  Located on chromosome 12
  Distance between a terminus base of telomere on chromosomal short arm and 5'-terminus of this base sequence : 126451210
  Distance between 3'-terminus of neighbour sequence of sequence listing upward to telomere on chrosomal short arm and 5'-terminus of this base sequence : 44202
agtccctgataaccctggataggggtcagtgttcaacagcccccactgccctcagcagacacctggttgactatgtttcctcaattactgcacccccaagcacaccatatacaatccacagatgactttcacacacacacacacacacacacacacacacacacacacacacacacaccagactgtcccctctcttccctcctccccagtggcaccgcgtggcatcaccctcattggcgagcaggaatcagaacagagtctacaatgtcagcaaagggctgtatgcg

SEQ ID NO: 19430 - DNA, 237 bp, Homo sapiens
  AC004263.1_56212
  Located on chromosome 12
  Distance between a terminus base of telomere on chromosomal short arm and 5'-terminus of this base sequence : 126451274
  Distance between 3'-terminus of neighbour sequence of sequence listing upward to telomere on chrosomal short arm and 5'-terminus of this base sequence : -223
ggttgactatgtttcctcaattactgcacccccaagcacaccatatacaatccacagatgactttcacacacacacacacacacacacacacacacacacacacacacacacaccagactgtcccctctcttccctcctccccagtggcaccgcgtggcatcaccctcattggcgagcaggaatcagaacagagtctacaatgtcagcaaagggctgtatgcgacagtcactgaatc

SEQ ID NO: 19431 - DNA, 409 bp, Homo sapiens
  chr12.fa.O7frz.130484616
  Located on chromosome 12
  Distance between a terminus base of telomere on chromosomal short arm and 5'-terminus of this base sequence : 126844408
  Distance between 3'-terminus of neighbour sequence of sequence listing upward to telomere on chrosomal short arm and 5'-terminus of this base sequence : 392897
gctatttataacctgcaggttctagcatcctgttgagcacacagccctgcagctacctggggcccttcttcctggactgtagggcgaggggagtaaggagcaggatgtcggggtggagggtgtctggcggccaaggagaaggccgtggctgaccctcctttctctttgctgtggactctccagtgagcacaaaatgcacatcaagggccctgtgggtcattctggggctgtctagcttgtcatcagcagagtgtctggcacctaagaggaatgaatgaatgaatgaatgaatagaagtagctttatctggtcagatcacgtcatgtctctgccccaagctcttcaatgcttccccatctccccatctcatttggagtaaaagtcaaagctcttacagtgacctacgagg

SEQ ID NO: 19432 - DNA, 111 bp, Homo sapiens
  DISO7_10000005
  Located on chromosome 12
  Distance between a terminus base of telomere on chromosomal short arm and 5'-terminus of this base sequence : 126845736
  Distance between 3'-terminus of neighbour sequence of sequence listing upward to telomere on chrosomal short arm and 5'-terminus of this base sequence : 919
catcctggcacttaagggtttttgtttatttcttttgttttgttttgttttgttttgtttctccccacaatatctgctaaaaggagaactggccaaggcctggcttgatat

SEQ ID NO: 19433 - DNA, 120 bp, Homo sapiens
  DISO7_10000144
  Located on chromosome 12
  Distance between a terminus base of telomere on chromosomal short arm and 5'-terminus of this base sequence : 127229545
  Distance between 3'-terminus of neighbour sequence of sequence listing upward to telomere on chrosomal short arm and 5'-terminus of this base sequence : 383698
acagatgcatacaactagggagaaaaaagagttgttgagttttaaagtgtgtgtgtgtgtgtgtgtgtgtgtgtgtgtgtgtgtgtgttgagtttcaagtgacagaggaatatttaagtg

SEQ ID NO: 19434 - DNA, 362 bp, Homo sapiens
  chr12.fa.O7frz.130692791
  Located on chromosome 12
  Distance between a terminus base of telomere on chromosomal short arm and 5'-terminus of this base sequence : 127241598
  Distance between 3'-terminus of neighbour sequence of sequence listing upward to telomere on chrosomal short arm and 5'-terminus of this base sequence : 11933
taaatgtcaccttctcagacaggcattttctgcctacctaatttcagagccaccccaattactattttaattgcttagaatccattatctatctatctatctatctatctatctatctatctatctatctatctatttttttgaggcacagtcttgctccgatgcctaggctagagtgcggtggtgcaatcttgctcactgcaagcctccgcctcccgggttcaagcgattcttataccttagcccccaagtagctgggaccacaggtgcatgccaccacgcccagctgatttttgtatttttagtagggatgggattttgctatgttggccaggctggtctcaaagtcctgtcattactga

SEQ ID NO: 19435 - DNA, 290 bp, Homo sapiens
  chr12.fa.O7frz.130592313
  Located on chromosome 12
  Distance between a terminus base of telomere on chromosomal short arm and 5'-terminus of this base sequence : 127290692
  Distance between 3'-terminus of neighbour sequence of sequence listing upward to telomere on chrosomal short arm and 5'-terminus of this base sequence : 48732
atgcctgtaataccagctactagtggggctgaggcaggaggatcccttgaacccgggaggtggaggctgcagtgagctgagatcgtgccaccgcactccagcccgggcaacagagtgagagtccgtctcaaacaaacaaacaaacaaacaaacaaacaaacctgctaacagctcctcctcaggcatttttagaagggtagaaaaccgtaccatgcattccaacgaaaagcagggaaagatgaggatcatccactctgctgttctttcttcatttaagtagatcatgaagg

SEQ ID NO: 19436 - DNA, 194 bp, Homo sapiens
  chr12.fa.O7frz.131021207
  Located on chromosome 12
  Distance between a terminus base of telomere on chromosomal short arm and 5'-terminus of this base sequence : 127407835
  Distance between 3'-terminus of neighbour sequence of sequence listing upward to telomere on chrosomal short arm and 5'-terminus of this base sequence : 116853
cctcttagttctgagctaggacagttggagaatctgccctcaaaaatagtcaggcccttgaagactctgtgtgtgtgtgtgtgtgtgtgtgtgtgtgtgtttgtgtaagagacacacagagagacagaagagagagagtgatagcaagggagtggggggtagggagagagagacatcgattcagtaggttctag

SEQ ID NO: 19437 - DNA, 255 bp, Homo sapiens
  chr12.fa.O7frz.130895457
  Located on chromosome 12
  Distance between a terminus base of telomere on chromosomal short arm and 5'-terminus of this base sequence : 127411696
  Distance between 3'-terminus of neighbour sequence of sequence listing upward to telomere on chrosomal short arm and 5'-terminus of this base sequence : 3667
cctgaaaggattcagttctaagacagcctttagggcaaaaagtcacaaagttgatctatctatctatctatctatctatctatctatctatctatctatctacgtgtttgcaccctaatcactggcagtaaatgcactttttttcttttcttttcttttttttgagacagggtcttgttctgtcacccaggctggagtaggtgtaaaattggagaatccatatttctttccttgttttcagatttaatgctttcc

SEQ ID NO: 19438 - DNA, 358 bp, Homo sapiens
  chr12.fa.O7frz.131590809
  Located on chromosome 12
  Distance between a terminus base of telomere on chromosomal short arm and 5'-terminus of this base sequence : 127679154
  Distance between 3'-terminus of neighbour sequence of sequence listing upward to telomere on chrosomal short arm and 5'-terminus of this base sequence : 267203
atgcagagcatgagacaaggggttgcatgaaggtggtttgttctgggaaatgatctcaaggggtaagtgtgggggattaggaagcagagaaagccaatctgaggaactctttctctttttctttctttctttctttctttctttctttcttctttctttctttctctttctttctttctttctttctttctttctttctttctttctttctttcttccttccttccttccttccttcctttctttctctttctttctgtcatctctctctctctcttttctcttcctttttttttgatgttgtcttgctcattcgcccaggctggagtgcagtggcatgatcacaactcactgtaacc

SEQ ID NO: 19439 - DNA, 378 bp, Homo sapiens
  chr12.fa.O7frz.131516054
  Located on chromosome 12
  Distance between a terminus base of telomere on chromosomal short arm and 5'-terminus of this base sequence : 127753883
  Distance between 3'-terminus of neighbour sequence of sequence listing upward to telomere on chrosomal short arm and 5'-terminus of this base sequence : 74371
ccttaatgacaattaggtagtcagagacctttcttcatggatcgcaaccccaggggcatgtgggatttcagagatgtgttttggggaaagaggtataattattcaactttcagttaattagccacttagagaaattaagtggtaggtggagttgtaaaggaaggcaaagtactgggcaggcagatgctaagtgggagactgttctaggcataagagaaatgggggtgggtatgaaaaaaagcaagagagagagagagagagagagacaagggaaatttggtttgactggataaaaaggccagtgaaaagagggagttttggtaagagctatgccatgggcagggagaagtacagagatcttcaatcatggactctata

SEQ ID NO: 19440 - DNA, 384 bp, Homo sapiens
  AC069209.16_27083
  Located on chromosome 12
  Distance between a terminus base of telomere on chromosomal short arm and 5'-terminus of this base sequence : 127798073
  Distance between 3'-terminus of neighbour sequence of sequence listing upward to telomere on chrosomal short arm and 5'-terminus of this base sequence : 43812
gaatagttagaaagacctggattcaattcctagctctaacaccattttgctgtgtgtccttgggaaaatggcttaacctctctgagtttcagtgtcctcacctgtaaaagcagaataataatttcaccaacttcatagggctgttgtaaggattaaatgagatgatacttgtacagttattgtaaggtaagccccatgcatgcctggcttacacacacacacacacacacacacacacacgcacacacacacacacacacaatctacccctagaagtgtggtggttctagaccagcactgtccaattgaacttgatgcagtgatggaaatttctgtatctgtgctgtccaatagggcagctactaggtacatgtggctattgag

SEQ ID NO: 19441 - DNA, 415 bp, Homo sapiens
  Y12854.1_1009
  Located on chromosome 12
  Distance between a terminus base of telomere on chromosomal short arm and 5'-terminus of this base sequence : 127810924
  Distance between 3'-terminus of neighbour sequence of sequence listing upward to telomere on chrosomal short arm and 5'-terminus of this base sequence : 12467
tctgaccagtttagcaacctcagtgaaaagaaaacacctctttgccagaaggttcagcaaaggtctcagacaaatgtcattggctctgattggcccactatggatgacatgcccactgctgaactaatcactgtgaccagggtcatgccatactcccagtggttagtgtcgaaccagccctaacctagcccaggggccagcagagaggccaacaccccagccccttcaacacacacacacacacacacacacacacacacacacacacactacatggactgaaaagaaaattggagtgttgccttctgaagatggaaggaaaagatgccagctatgcaaaaatcaacatatcccacgacatcctgtccaagagcatgttatctatgtaagacagtgataagcaggactagaagca

SEQ ID NO: 19442 - DNA, 265 bp, Homo sapiens
  chr12.fa.O7frz.131795778
  Located on chromosome 12
  Distance between a terminus base of telomere on chromosomal short arm and 5'-terminus of this base sequence : 128043576
  Distance between 3'-terminus of neighbour sequence of sequence listing upward to telomere on chrosomal short arm and 5'-terminus of this base sequence : 232237
tttgaccagattagctaacctagggaagacatgtctgatgaaatacacacacacacacacacacacacacacacacacacacacacacagagtcatgtgtagtttaatgacagggatacattctgaagaatgcatcattaggcaatttcgtcatagaatgtccttatacaaacctagatgatatagccctctacacacctgggctgtatggtaaagcctgttgctcctgggctgcaaacttgtacagcatgctactgtatgaata

SEQ ID NO: 19443 - DNA, 103 bp, Homo sapiens
  DISO7_10003652
  Located on chromosome 12
  Distance between a terminus base of telomere on chromosomal short arm and 5'-terminus of this base sequence : 128264462
  Distance between 3'-terminus of neighbour sequence of sequence listing upward to telomere on chrosomal short arm and 5'-terminus of this base sequence : 220621
ctctggacacatgggatggctgtggtgcttgggtgggtgggtgggtgggggtcagggggcgggagtgagctcaggggtcccaggaggaggcgtatccagtatc

SEQ ID NO: 19444 - DNA, 188 bp, Homo sapiens
  D12S1349
  Located on chromosome 12
  Distance between a terminus base of telomere on chromosomal short arm and 5'-terminus of this base sequence : 128280587
  Distance between 3'-terminus of neighbour sequence of sequence listing upward to telomere on chrosomal short arm and 5'-terminus of this base sequence : 16022
cccaagagtgacattggcacgctactgcttaatggcttcagtgcccttctcttggcctttaagactcctgatctctgcttgcctttagaccacctcccatccctgtaccccaccacacacacacacacacacacacacacacacacacacacacacacacacacacacaacttatgctccagccatgc

SEQ ID NO: 19445 - DNA, 241 bp, Homo sapiens
  DISO7_10003650
  Located on chromosome 12
  Distance between a terminus base of telomere on chromosomal short arm and 5'-terminus of this base sequence : 128428037
  Distance between 3'-terminus of neighbour sequence of sequence listing upward to telomere on chrosomal short arm and 5'-terminus of this base sequence : 147262
atgtatctcagataagacaggtcctcaaaaggccaggaccacccgggatttgttgttgttgttgttgttgttgttgttgttgtaaacagttctttcccagaaggcacaagaaaaaatgactgagaaatgccatgttttatggtagagagaaaaatccaggacagtttccttaaacgattaaaacactggaaagcatgtgtaaagaggagctttagaaagatttcagaatcattgtgcatag

SEQ ID NO: 19446 - DNA, 101 bp, Homo sapiens
  DISO7_10003651
  Located on chromosome 12
  Distance between a terminus base of telomere on chromosomal short arm and 5'-terminus of this base sequence : 128498313
  Distance between 3'-terminus of neighbour sequence of sequence listing upward to telomere on chrosomal short arm and 5'-terminus of this base sequence : 70035
gaggctcacgtatcctgcatctttcatatatatatatatatatatatatatatatatatatatatatatatatatatatcttggcgatattgacatatgtt

SEQ ID NO: 19447 - DNA, 130 bp, Homo sapiens
  chr12.fa.O7frz.132766125
  Located on chromosome 12
  Distance between a terminus base of telomere on chromosomal short arm and 5'-terminus of this base sequence : 128826736
  Distance between 3'-terminus of neighbour sequence of sequence listing upward to telomere on chrosomal short arm and 5'-terminus of this base sequence : 328322
agagcaagatcctttctattaaacacacacacacacacacacacacacacacacacacacacactttctctctcatagagtttgtaggtcaaagtctagcatgccatggatagattctttgctcaggaac

SEQ ID NO: 19448 - DNA, 446 bp, Homo sapiens
  chr12.fa.O7frz.132971445
  Located on chromosome 12
  Distance between a terminus base of telomere on chromosomal short arm and 5'-terminus of this base sequence : 128983503
  Distance between 3'-terminus of neighbour sequence of sequence listing upward to telomere on chrosomal short arm and 5'-terminus of this base sequence : 156637
ttaataacatcagaactaggcaagaaattttgttttgttttgttttgttttgttttgttttgggggggcggagtctcgctctgtcgcacaggctggagtgcagtggcatgatctccgctcactgcaagctccgcctcccgggttcatgccattctgcctcagcctccccagtagctgggactacaggcacctgccagcacgcctggctacttttttgtatttttagtagagacagggtttcaccgtgttagccaggatggtctcgatctcctggcctcgtgattcgcctgcctcggcctcccaaagtgttaggattacaggcgtgagccaccatgcctgggcacaagaaattttaaaatgctttgcctaaataatcattttaccagttatgatagtcacaaatacattatttagagtaataactactgtaattgggaaggtttact

SEQ ID NO: 19449 - DNA, 411 bp, Homo sapiens
  chr12.fa.O7frz.133107466
  Located on chromosome 12
  Distance between a terminus base of telomere on chromosomal short arm and 5'-terminus of this base sequence : 129089951
  Distance between 3'-terminus of neighbour sequence of sequence listing upward to telomere on chrosomal short arm and 5'-terminus of this base sequence : 106002
cctgtaatcgtaactactcgaaggctgaggccggaggatcgcttgagcccaggagttcaagtttgcagtgaactgtaatcatgccactatactctagcctgggcaacagagcaagcctccatctcttacacacacacacacacacacacacacacacacacacacacacacacttccaagaggttgcatgggctacttcagcttggccagaacttattttcatggccatccctaataacacaggaagttaggaaatgtcttcattctggatgtcacatggcaggaagaatcagatacaggaagagggtagaatggctttgaggggggcgggacttctggtagtctctgcttcagtctttgaaaatggaagcacagtagtgaatgttatagttgactgtgcaatactcactt

SEQ ID NO: 19450 - DNA, 105 bp, Homo sapiens
  DISO7_10003653
  Located on chromosome 12
  Distance between a terminus base of telomere on chromosomal short arm and 5'-terminus of this base sequence : 129243765
  Distance between 3'-terminus of neighbour sequence of sequence listing upward to telomere on chrosomal short arm and 5'-terminus of this base sequence : 153403
aatatgagacctgggttcatcttgggaatcacacacacacacacacacaaacacacacacactcacaatcctttcctaaccctgagaagtaaatactgttgagaa

SEQ ID NO: 19451 - DNA, 149 bp, Homo sapiens
  Z67072
  Located on chromosome 12
  Distance between a terminus base of telomere on chromosomal short arm and 5'-terminus of this base sequence : 129654624
  Distance between 3'-terminus of neighbour sequence of sequence listing upward to telomere on chrosomal short arm and 5'-terminus of this base sequence : 410754
tgccgtctgagcaatgagtctcctgttacacaatattgggaattgtttggcaagcatacttaaaacacacacacacacacacacacacacacacacacacacacacacaacctttgcatagttgaacctaaaaatcttctagccttggg

SEQ ID NO: 19452 - DNA, 443 bp, Homo sapiens
  AC068768.15_62294
  Located on chromosome 12
  Distance between a terminus base of telomere on chromosomal short arm and 5'-terminus of this base sequence : 129768955
  Distance between 3'-terminus of neighbour sequence of sequence listing upward to telomere on chrosomal short arm and 5'-terminus of this base sequence : 114182
aaagattccttgatttacttctaacttcttaaaattacaggttatggctaggcgcagtggctcacacctgtaatttcagcactttgggaggccaaggcaggtggatcatttaagctcaggagatcaagaccagcctgggcaacatggagaaaccccctctctaaaaaaattacaaaaaaaaattagccaggcacggtggtgcacgcctgtagttccagctgctcgggaagctgaggtgggaggatcccttgagcctgggaggcggaggttgcagtgaaccaagatgatgccattgcactccagcctgggcaacgtagtcagactctgtcgcaaaaatatatatatatatatatatatatatatagatagatagatagatagagatagatagatagatagataggttacttgtttattataagtaatgacagtaatcttgcagc

SEQ ID NO: 19453 - DNA, 132 bp, Homo sapiens
  D12S1603
  Located on chromosome 12
  Distance between a terminus base of telomere on chromosomal short arm and 5'-terminus of this base sequence : 129938665
  Distance between 3'-terminus of neighbour sequence of sequence listing upward to telomere on chrosomal short arm and 5'-terminus of this base sequence : 169267
gccttcacatggccttctcctgtgtctcctgtgtcctctcctcttcttcttttgcgtgtgtgtgtgtgtgtgtgtgtgtgtgtgtgtgtgtgtgtgtgtgatggagtttcacccttgtctcccaggctggag

SEQ ID NO: 19454 - DNA, 248 bp, Homo sapiens
  M12_130319585
  Located on chromosome 12
  Distance between a terminus base of telomere on chromosomal short arm and 5'-terminus of this base sequence : 130319552
  Distance between 3'-terminus of neighbour sequence of sequence listing upward to telomere on chrosomal short arm and 5'-terminus of this base sequence : 380755
cctaacacattccatctcattccatcttgggtttttgtttgtttgtttgtttgtttgttatggcctgttaaaggaaatcttgaaacacattatgaacaaaatgagtatttttgatatctttattttcaacttgcctcccctcccttggcctggatagtctctttagaggtcactcaggtcttcctaagtttcaatgccaaaatcttttacagtttgattggccttttcttgaaactatttcctggctg

SEQ ID NO: 19455 - DNA, 111 bp, Homo sapiens
  DISO7_10002089
  Located on chromosome 12
  Distance between a terminus base of telomere on chromosomal short arm and 5'-terminus of this base sequence : 130327507
  Distance between 3'-terminus of neighbour sequence of sequence listing upward to telomere on chrosomal short arm and 5'-terminus of this base sequence : 7707
caggagtaatccacaagacctactttaaaatgctcagcacatgcatgtatatatatacacccacacacacacagacacacacacacacactgcccaatagataacactgca

SEQ ID NO: 19456 - DNA, 129 bp, Homo sapiens
  DISO7_10000146
  Located on chromosome 12
  Distance between a terminus base of telomere on chromosomal short arm and 5'-terminus of this base sequence : 130460367
  Distance between 3'-terminus of neighbour sequence of sequence listing upward to telomere on chrosomal short arm and 5'-terminus of this base sequence : 132749
ctgggaatcactgaacaggtttaaacacaaacacaaagacacacacagacacacaacagacacacacagacacacacacacacacacacacacgaaaacaaaaggagaaaagagctctggcttcctagc

SEQ ID NO: 19457 - DNA, 470 bp, Homo sapiens
  AC055713.16_43170
  Located on chromosome 12
  Distance between a terminus base of telomere on chromosomal short arm and 5'-terminus of this base sequence : 130560873
  Distance between 3'-terminus of neighbour sequence of sequence listing upward to telomere on chrosomal short arm and 5'-terminus of this base sequence : 100377
gaagctgcagagtcatgatcaccaccacaccccagcctgggagacagagtaagaccctgtctcaaataaataaataaataaataaataaataaataaattttaaacaaaaaaggaggctaggcacagtggctcactcctgtaatccaagcactttgggaggctgaggcgggcagaccacttgaggccaggagttcaagatcagcctggccaacatggtgaaaccccatctccactaaaaatacaaaaattaggcaggcatggtggcacatgcctgtagtcccagctacttgggaggctgaggcagggagaatcggttgaacccggggggtggaggctgcagtgagctaagatcgtgccactgcactccagccagggcagcagagcgagactccatctcaaaaaaataaaaataaaacaacaggaagaaagagtccattggccacagcacaggcaagctacactcaagtac

SEQ ID NO: 19458 - DNA, 346 bp, Homo sapiens
  chr12.fa.O7frz.135256748
  Located on chromosome 12
  Distance between a terminus base of telomere on chromosomal short arm and 5'-terminus of this base sequence : 130836919
  Distance between 3'-terminus of neighbour sequence of sequence listing upward to telomere on chrosomal short arm and 5'-terminus of this base sequence : 275576
tagtctagtttcaggaaagcataggatatttctatctaaaggagatgggcatttaggtgggcctctgtggggacccttaacagggtgtcaggagttggcgcttattttgcggggctgtatcctgaagccttccctcctttcctatccgctgcaatacttcatgggcgttttcttttgtaaacttcaataacttattactagttgcctgtatctctagtccaactttcagccttacttatcctaaaagaacaatagagagagagagagagagagagacctgtgatccctgtaatatgaacctgcttgtttaaagatgttagaaaacctaactcaactgactttaggt

SEQ ID NO: 19459 - DNA, 216 bp, Homo sapiens
  DISO7_10000150
  Located on chromosome 12
  Distance between a terminus base of telomere on chromosomal short arm and 5'-terminus of this base sequence : 131016315
  Distance between 3'-terminus of neighbour sequence of sequence listing upward to telomere on chrosomal short arm and 5'-terminus of this base sequence : 179050
cagattggaccatccattgaatggatggatggatggatggatggatggatgggtagatggatggatggatggatggatgggtggatgggtagatggatggacaggtgaatgaacagatgggtagatggataaatggacgggtagatggataaatggacaggtagatggaaaaacagacagatgggcaaaaagaagaatagatggatagatgaacaa

SEQ ID NO: 19460 - DNA, 125 bp, Homo sapiens
  DISO7_10000149
  Located on chromosome 12
  Distance between a terminus base of telomere on chromosomal short arm and 5'-terminus of this base sequence : 131091638
  Distance between 3'-terminus of neighbour sequence of sequence listing upward to telomere on chrosomal short arm and 5'-terminus of this base sequence : 75107
gaggagctggaatagtctgtgtggtaatggggtatcctggggaagagccattgtgtgtgtgtgtgtgtgtgtgtgtgtgtgtgtgtgtgtgtgtgtgtgtttgtgtagctaccatgagatttgtg

SEQ ID NO: 19461 - DNA, 183 bp, Homo sapiens
  chr12.fa.O7frz.134977013
  Located on chromosome 12
  Distance between a terminus base of telomere on chromosomal short arm and 5'-terminus of this base sequence : 131092396
  Distance between 3'-terminus of neighbour sequence of sequence listing upward to telomere on chrosomal short arm and 5'-terminus of this base sequence : 633
ccagcactgtaatcaagataataagtgttttcatccccatcccccagctgctagattctttttggtgatgtatttagtgtgtgtgtgtgtgtgtgtgtgtgtgtgtgtatgtgtatgtgtgcgtgcacgtggtgtaccacatgttttgatatacatatgtatagtaacatgattgcaacagtc

SEQ ID NO: 19462 - DNA, 252 bp, Homo sapiens
  HUMUT1373
  Located on chromosome 12
  Distance between a terminus base of telomere on chromosomal short arm and 5'-terminus of this base sequence : 131151718
  Distance between 3'-terminus of neighbour sequence of sequence listing upward to telomere on chrosomal short arm and 5'-terminus of this base sequence : 59139
gtttcaccatgttggccaggctggtcttgaactcctggcctgaagtgacccactcaccttggcctcccaaagtgctgggattacaggcgtgagccactgagcttggccctgattgattttttgactttctattatctatctatctatctatctatctatctatctatctatctatctatctatcttatccatctgtctatctatgcatctatcaatcatctatccatctctttgcttgttgttaaggactga

SEQ ID NO: 19463 - DNA, 367 bp, Homo sapiens
  chr12.fa.O7frz.135385054
  Located on chromosome 12
  Distance between a terminus base of telomere on chromosomal short arm and 5'-terminus of this base sequence : 131316858
  Distance between 3'-terminus of neighbour sequence of sequence listing upward to telomere on chrosomal short arm and 5'-terminus of this base sequence : 164888
tcatattagtcattgagatttcaacatataaatttggggaagggggacaacacagacatttcataaaaataaaaaaataaaaaacacacaggcactcatgtttttccctacatagcaataatcctttttcttactaaacctcctagattctgttgaccaagttggtcttccttggttcagaacagcctgagtgtcagaaatgtcaagttacatgagcatccatgtccatccatccatccttccatccatccatccatctatccgtccattcatccttcagtccacccattcatccatccatccatccatccatccatccatccatccatccatccatccgtccatccatctacttatccagacaata

SEQ ID NO: 19464 - DNA, 351 bp, Homo sapiens
  DISO7_00038366
  Located on chromosome 12
  Distance between a terminus base of telomere on chromosomal short arm and 5'-terminus of this base sequence : 131446659
  Distance between 3'-terminus of neighbour sequence of sequence listing upward to telomere on chrosomal short arm and 5'-terminus of this base sequence : 129434
agccaagctccagctaaaattgttcagaggttggggagctgaggggcagccgtctgtgttggtattttcattcattcattcattcattcattcattcattcatccacccacccacccacccacgtgctggctgcctgcctgctacacacaaggctctaatgcaaataaaacaacagcagcagaaacatcaacacatcagcccgtggcacggctaactgacacacagagtttgcaaagcccttcaaagacttggttccgtctcatccttgctgtcatggctgtgaccattttcccatccccaggagggggaaatctcggttcagagggtcccgccaactcacccaagcttag

SEQ ID NO: 19465 - DNA, 252 bp, Homo sapiens
  D12S1612
  Located on chromosome 12
  Distance between a terminus base of telomere on chromosomal short arm and 5'-terminus of this base sequence : 131487523
  Distance between 3'-terminus of neighbour sequence of sequence listing upward to telomere on chrosomal short arm and 5'-terminus of this base sequence : 40513
gcatccttgatgtccctgaggactctgatgactgcattcccatgtggccagtgtgtgtgtgtgtgtgtgtgtgtgtgtgtgtgtgtgtgtgtgtacatgcaacaatcagcccaggtgccacacccttggccatcaggtgaggaatgcagaggagagggccaccggcctcctccttccagtgcagactaaacccacagccagcctctctgcgggatgtccataagtgcacagcatcggtgagacaggggctga

SEQ ID NO: 19466 - DNA, 458 bp, Homo sapiens
  AC027706.2_46645
  Located on chromosome 12
  Distance between a terminus base of telomere on chromosomal short arm and 5'-terminus of this base sequence : 131496263
  Distance between 3'-terminus of neighbour sequence of sequence listing upward to telomere on chrosomal short arm and 5'-terminus of this base sequence : 8488
cagtttgtcaatgttctaacataaggagttgaaaaaactgcacaggaatgaaggggctgggtgcagtgctcacacctgtgatcccagcgctttgggaggccgaggcgggtgcatcacctgaggtcgggagttcaagaccagcctggtcaatggagtgaaaccttctctactaaaaatacaaaaattagccgggcttggtggcgggcgcctgtaatcccagctacttgggaggctgaggcaggagaattgcttgaacccgagaggcggaggctgcagtgagtagagaccctgccactgcactccaacctgggtgacagagcgaaactccatctcaaaaataaataataaataaataaacaaataaaatgaaatgaaatgtaatgaaatgaaatgaaggcaagacttgagttgaaagactattcctgccatctacacccaacagacatttccagctacag

SEQ ID NO: 19467 - DNA, 161 bp, Homo sapiens
  D12S1611
  Located on chromosome 12
  Distance between a terminus base of telomere on chromosomal short arm and 5'-terminus of this base sequence : 131602367
  Distance between 3'-terminus of neighbour sequence of sequence listing upward to telomere on chrosomal short arm and 5'-terminus of this base sequence : 105646
actaatgggtgctgacattggaagaacctgtggcaggtgggggagcctcgggattaaaaaccaacctgccaggcagagagcgcccacggcacgagcgcgcacgcgtgcacgcgcacacacacacacacacacacacacacactcgacagaaccctctgata

SEQ ID NO: 19468 - DNA, 177 bp, Homo sapiens
  chr12.fa.O7frz.135758083
  Located on chromosome 12
  Distance between a terminus base of telomere on chromosomal short arm and 5'-terminus of this base sequence : 131738240
  Distance between 3'-terminus of neighbour sequence of sequence listing upward to telomere on chrosomal short arm and 5'-terminus of this base sequence : 135712
tttctcaaagacaaactcatttagtggcagagctgagacatgatccccaaacccctgacgcagattgtgtgtgtgtgtgtgtgtgtgtgtgtgtgtgtgtgtgtgtgtgaaaatatacatgatataaaattctccatcgtaaccatctgaaagtgtacagctcagtgacattaagtg

SEQ ID NO: 19469 - DNA, 109 bp, Homo sapiens
  DISO7_10003658
  Located on chromosome 12
  Distance between a terminus base of telomere on chromosomal short arm and 5'-terminus of this base sequence : 131840822
  Distance between 3'-terminus of neighbour sequence of sequence listing upward to telomere on chrosomal short arm and 5'-terminus of this base sequence : 102405
catcttgtaaccctgcacacatacatgcgtgtgtacacgcacacacacacacacacacacacacacacacacaaacgaaactataataaaagcttcaggaacttgctcc

SEQ ID NO: 19470 - DNA, 198 bp, Homo sapiens
  DISO7_10003657
  Located on chromosome 12
  Distance between a terminus base of telomere on chromosomal short arm and 5'-terminus of this base sequence : 131888665
  Distance between 3'-terminus of neighbour sequence of sequence listing upward to telomere on chrosomal short arm and 5'-terminus of this base sequence : 47734
ctggaggaagagggtgtgtgtgttgcggcaggaagcctgatggcagggggtgtcggggagagacagaaagaaacaggagagatagagagatggggggtagagagaggaagagacaggagagagaaagatacacacacaaacacacacacacacacacagacacacacagtgtcagagagttattaacctcttccttgg

SEQ ID NO: 19471 - DNA, 274 bp, Homo sapiens
  DISO7_10003662
  Located on chromosome 12
  Distance between a terminus base of telomere on chromosomal short arm and 5'-terminus of this base sequence : 132066668
  Distance between 3'-terminus of neighbour sequence of sequence listing upward to telomere on chrosomal short arm and 5'-terminus of this base sequence : 177805
actggtttgttgtgctggttatatttctttctaactcatattaaaataaataaaggctgggcatagtggctcactcctgtaaccccaagcactttaggagggcgacgttggaagatcacttaagcccgggaggtcgaggatgccgtgagctatgatttcaccactgcactgcagcctgggcgtcagagcgagaccctgtctctacagattgtgtgtgtgtgtgtgtgtgtgtgtgtgattaatacaaaataatttcccttgtctaccacctcaa

SEQ ID NO: 19472 - DNA, 258 bp, Homo sapiens
  DISO7_10003663
  Located on chromosome 12
  Distance between a terminus base of telomere on chromosomal short arm and 5'-terminus of this base sequence : 132076039
  Distance between 3'-terminus of neighbour sequence of sequence listing upward to telomere on chrosomal short arm and 5'-terminus of this base sequence : 9097
aagctaatgccacatctcacatctttgttgtgtgtgtgtgtgtgtgtgtgtgtgtgtgtgtgtgttttaagagacgaggtcttgctctgtaacccagactggagtgcagtggtgcaatcacagctcactgcagcctcgaactcctacgctcaagccatcctcccacctcagcctcctgagtagctggaactccaggtgcaccaccatgcatcctaccctgctaagttttattttccctcttgttagcatatgatcctt

SEQ ID NO: 19473 - DNA, 242 bp, Homo sapiens
  D12S304
  Located on chromosome 12
  Distance between a terminus base of telomere on chromosomal short arm and 5'-terminus of this base sequence : 132194861
  Distance between 3'-terminus of neighbour sequence of sequence listing upward to telomere on chrosomal short arm and 5'-terminus of this base sequence : 118564
ttcattgcattttatcctcaaactacaaaagcaattcctactagttacaaggcaacaacacaggaattgaggaaggaaaagccaagatctctcccattccagcctttgtctttctattgcccctcttttcttccatattttctgtacacacacacacacacacacacacacacacacacacacacacaaacacacaagattgataaatctagtttttaaaattgggtgttgaggatacagct

SEQ ID NO: 19474 - DNA, 172 bp, Homo sapiens
  D12S1614
  Located on chromosome 12
  Distance between a terminus base of telomere on chromosomal short arm and 5'-terminus of this base sequence : 132196961
  Distance between 3'-terminus of neighbour sequence of sequence listing upward to telomere on chrosomal short arm and 5'-terminus of this base sequence : 1858
tcaactctggggtctgcactaaagagttatttttttttcacagcaggattaaaacagatttactaaagaatagtgtgtgtgtgtgtgtgtgtgtgtgtgtgtgtgtctcactatcaataattgaactttactatgtcaaatgtggtgttaggagattgtgttcctggacgga

SEQ ID NO: 19475 - DNA, 275 bp, Homo sapiens
  Z67634
  Located on chromosome 12
  Distance between a terminus base of telomere on chromosomal short arm and 5'-terminus of this base sequence : 132446144
  Distance between 3'-terminus of neighbour sequence of sequence listing upward to telomere on chrosomal short arm and 5'-terminus of this base sequence : 249011
gcattaccgtgggacttactgcattgaaaggagagtgttgcggcaatgaggtcctgtacaagtatgagctgtcttgttctcattatttgagatagttataaaatgcctatgaacactgaattagcgagtactgaacctttgcttgtaggagaaatagacacacacacacacacacacacacacatttctaatagtctgtaatcttctattacaaaagaaatattgaagtttggaagtgttaggtgacttgtctgaggctgcctcactaacaggtg

SEQ ID NO: 19476 - DNA, 213 bp, Homo sapiens
  AC004806.1_128794
  Located on chromosome 12
  Distance between a terminus base of telomere on chromosomal short arm and 5'-terminus of this base sequence : 132446188
  Distance between 3'-terminus of neighbour sequence of sequence listing upward to telomere on chrosomal short arm and 5'-terminus of this base sequence : -231
aatgaggtcctgtacaagtatgagctgtcttgttctcattatttgagatagttataaaatgcctatgaacactgaattagcgagtactgaacctttgcttgtaggagaaatagacacacacacacacacacacacacacatttctaatagtctgtaatcttctattacaaaagaaatattgaagtttggaagtgttaggtgacttgtctgagg

SEQ ID NO: 19477 - DNA, 283 bp, Homo sapiens
  AC005146.1_16260
  Located on chromosome 12
  Distance between a terminus base of telomere on chromosomal short arm and 5'-terminus of this base sequence : 132462513
  Distance between 3'-terminus of neighbour sequence of sequence listing upward to telomere on chrosomal short arm and 5'-terminus of this base sequence : 16112
agtcctgaagatgcttcttgtgacaacttagagtcactgggagtcacacagctcctgtgtagccgcctttgctcctctgtgttaaaacccagtcagttcaaaataacaatcaaatggaaggccatgggggaagggttccttccaccatataacccacacccagatgtatataaacgcatatacatacatatacccgtgtgtgtgtgtgtgtgtgtgtgtgtgtgtgtgaatactgaagagccagacaacaaactatttagtaagaatcaacagtgactgtcaa

SEQ ID NO: 19478 - DNA, 239 bp, Homo sapiens
  D12S340
  Located on chromosome 12
  Distance between a terminus base of telomere on chromosomal short arm and 5'-terminus of this base sequence : 132462591
  Distance between 3'-terminus of neighbour sequence of sequence listing upward to telomere on chrosomal short arm and 5'-terminus of this base sequence : -205
gtgttaaaacccagtcagttcaaaataacaatcaaatggaaggccatgggggaagggttccttccaccatataacccacacccagatgtatataaacgcatatacatacatatacccgtgtgtgtgtgtgtgtgtgtgtgtgtgtgtgtgaatactgaagagccagacaacaaactatttagtaagaatcaacagtgactgtcaattgttctcagatttggcatggatactatttctca

SEQ ID NO: 19479 - DNA, 198 bp, Homo sapiens
  AC005146.1_109921
  Located on chromosome 12
  Distance between a terminus base of telomere on chromosomal short arm and 5'-terminus of this base sequence : 132556250
  Distance between 3'-terminus of neighbour sequence of sequence listing upward to telomere on chrosomal short arm and 5'-terminus of this base sequence : 93420
catctcctgacctcgtgatccacccgcctcagcctcccaaagtgctgggattacaggcgtgagctaccacgcctggccttggaatctattttttatgcaagaagctctctctgtcccagtctctctctctctctctctctctctctctgtgtgtgtgtgtgtatttcctatatccttagttttctgctcagatcaaag

SEQ ID NO: 19480 - DNA, 325 bp, Homo sapiens
  AC005146.1_144633
  Located on chromosome 12
  Distance between a terminus base of telomere on chromosomal short arm and 5'-terminus of this base sequence : 132590855
  Distance between 3'-terminus of neighbour sequence of sequence listing upward to telomere on chrosomal short arm and 5'-terminus of this base sequence : 34407
accggcaacagaataggtataaagatctatttatatgggattttgtctcatctgtcttaataaatatattggggcttatagcctgtgaagctgcaaaccttggtcattttagacctttccctcttcctcatggtttgaaaaaattttcttcagctcaaatcccagaaaacaaaaagttcttgatgtcaagacaattgagagatggtgctctcaaagcggtaataactgtgtgtgtgtgtgtgtgtgtgtgtgtgtgtgtgtgtgagcttctcacctgaaaaaaaaagaactaacatttttcctctcacttgaatcagaagcaaac

SEQ ID NO: 19481 - DNA, 270 bp, Homo sapiens
  AC005252.1_47868
  Located on chromosome 12
  Distance between a terminus base of telomere on chromosomal short arm and 5'-terminus of this base sequence : 132651728
  Distance between 3'-terminus of neighbour sequence of sequence listing upward to telomere on chrosomal short arm and 5'-terminus of this base sequence : 60548
atctaccaacatcaatacaggaatgcaccactgtgcctgctttaaaaaattttatatatatatatatatatatatatatgaatcatttattttaggcccttttagctaactgagcaaggaaatatatgtgtgtatactaacccatgcatatacatgtatctatagctatttccatatgtagtcatctctgttaaggtaaacaaattcatgttgatgttcccaactctaattcattatcacatggatagttctaggttcctcttggttacc

SEQ ID NO: 19482 - DNA, 310 bp, Homo sapiens
  AC005186.1_87523
  Located on chromosome 12
  Distance between a terminus base of telomere on chromosomal short arm and 5'-terminus of this base sequence : 132741188
  Distance between 3'-terminus of neighbour sequence of sequence listing upward to telomere on chrosomal short arm and 5'-terminus of this base sequence : 89190
atggccttcaactttgtttagtacttttttttctgattcccttcttgaaaatgcaaggatatctaaaatagttattttttatatgtatataaatatatatatatacacatgtctatatatacacacatatgtgtgtatatatatatatatatatatatatatatatatatatatatatatacttttgagacggagtcttgctctgttgcccaggctggagtgcagtggcacagtcttggctcactgcagcctctgcctcccaggttcaaacaattctcctgcttcagcctctgaagtacctcggattaca

SEQ ID NO: 19483 - DNA, 197 bp, Homo sapiens
  AC005858.1_117554
  Located on chromosome 12
  Distance between a terminus base of telomere on chromosomal short arm and 5'-terminus of this base sequence : 132945971
  Distance between 3'-terminus of neighbour sequence of sequence listing upward to telomere on chrosomal short arm and 5'-terminus of this base sequence : 204473
actggactttatgataagcagaaggaaaaacaatcacgctaatcacactaaccagataatcagacaagggtagttgacttgggaattctaccatgatgagatgaccagacacacacacacacacacacacacacacacacacacacacacccttctgcactatattaatgtcctgtatctgagatacaactcaatcc

SEQ ID NO: 19484 - DNA, 219 bp, Homo sapiens
  D12S324
  Located on chromosome 12
  Distance between a terminus base of telomere on chromosomal short arm and 5'-terminus of this base sequence : 132946007
  Distance between 3'-terminus of neighbour sequence of sequence listing upward to telomere on chrosomal short arm and 5'-terminus of this base sequence : -161
cgctaatcacactaaccagataatcagacaagggtagttgacttgggaattctaccatgatgagatgaccagacacacacacacacacacacacacacacacacacacacacacccttctgcactatattaatgtcctgtatctgagatacaactcaatccaaaaattaagtgtgagaaaattttatcagcatttactggtattttctcaagcattctg

SEQ ID NO: 19485 - DNA, 238 bp, Homo sapiens
  AC005858.1_131180
  Located on chromosome 12
  Distance between a terminus base of telomere on chromosomal short arm and 5'-terminus of this base sequence : 132959595
  Distance between 3'-terminus of neighbour sequence of sequence listing upward to telomere on chrosomal short arm and 5'-terminus of this base sequence : 13369
caattcaaacattaccttccacctttttagctatttcatatgaaggaatcttagatgtggtcagagagaacaaagtcataaagaaaatgaagttacaaagaaaaagaagtacacacacacacacacacacacacacacacacacacaggcatgggaattgcactggctctggaagccttaggaatcatgctgactgcccatggacaacccaaatggtgtaatgacatgaggacatctc

SEQ ID NO: 19486 - DNA, 302 bp, Homo sapiens
  AC005858.1_132541
  Located on chromosome 12
  Distance between a terminus base of telomere on chromosomal short arm and 5'-terminus of this base sequence : 132960995
  Distance between 3'-terminus of neighbour sequence of sequence listing upward to telomere on chrosomal short arm and 5'-terminus of this base sequence : 1162
atagcctaaccatgtagtcacaagcgctcgggtcctcagccctatccaggtatccaggaaaggatagacagacacacacacacacacacacacacacacacacacacacacacacacacagagagattgattcttaacttgggccaggagtgagctcattttggaaatgttgagggaaatctgccttccagagcagagtgggacatgagggacatgttttccgtagaaaggatgattcagttgtgagttgtgtgcttgccagagtgtgcctttttgagctaattactgtctgccgataaatt

SEQ ID NO: 19487 - DNA, 253 bp, Homo sapiens
  Z67065
  Located on chromosome 12
  Distance between a terminus base of telomere on chromosomal short arm and 5'-terminus of this base sequence : 132969704
  Distance between 3'-terminus of neighbour sequence of sequence listing upward to telomere on chrosomal short arm and 5'-terminus of this base sequence : 8407
cggcctaattcttgaccaaagcacatcgatgcaccttatacaagcccaccccagaaccacttgcctcttgttaggtgacaaaaatatttgcctgatgaggtaacctttagtcagatacagcatccaagcacacacacacacacacacacacacatacacacacacacacaacaaacaaacaaacaaacaaacacgagtggaggagcagatgtatacaccaaggattacagcacagatggtaagtggtctggca

SEQ ID NO: 19488 - DNA, 229 bp, Homo sapiens
  D12S866
  Located on chromosome 12
  Distance between a terminus base of telomere on chromosomal short arm and 5'-terminus of this base sequence : 133003156
  Distance between 3'-terminus of neighbour sequence of sequence listing upward to telomere on chrosomal short arm and 5'-terminus of this base sequence : 33199
tcatagcgtggatgcttgaggttaatgtgatgatttgtgtgtgtgtgtgtgtgtgtgtgtgtgtgtgtgtgtgtttatctcctgagtttctcttcattgaatttattccacagagttttctcattggaggtcagaagcgatgatgaagacctgactaaactaaattccataactggctgttgtgtgggtgcaaagaaagtggcagatgggggttaggattccagcagtt

SEQ ID NO: 19489 - DNA, 195 bp, Homo sapiens
  AC007368.11_43201
  Located on chromosome 12
  Distance between a terminus base of telomere on chromosomal short arm and 5'-terminus of this base sequence : 133160001
  Distance between 3'-terminus of neighbour sequence of sequence listing upward to telomere on chrosomal short arm and 5'-terminus of this base sequence : 156616
atggaggtttagtcactatgacacacacacacacacacacacacagacgattgtggactcctctgtcattttagtacgaaatttaaagtcaaggaatcagtacattgttaatcatgaccttggatatctcagcttattttcagaaataaaagtaattgtggcaacaaccaccagttagaatgccaatgagaaatg

SEQ ID NO: 19490 - DNA, 221 bp, Homo sapiens
  AC005868.1_80704
  Located on chromosome 12
  Distance between a terminus base of telomere on chromosomal short arm and 5'-terminus of this base sequence : 133291273
  Distance between 3'-terminus of neighbour sequence of sequence listing upward to telomere on chrosomal short arm and 5'-terminus of this base sequence : 131077
ctgagatagcaccattgcactccagactgggccacagaaagagactctgtctcaaaaaaaaaaaaaaaaaaaaaatatatatatatatatatatatgaactggtttgtcagaggaaaactcaccattgagtctcctgagctctctgtgcctggctgggagcaggcagcctttgtcctccgcatgcatgagtccacgggtctagacttgcagtacgaagtcc

SEQ ID NO: 19491 - DNA, 348 bp, Homo sapiens
  AC006065.3_12899
  Located on chromosome 12
  Distance between a terminus base of telomere on chromosomal short arm and 5'-terminus of this base sequence : 133319286
  Distance between 3'-terminus of neighbour sequence of sequence listing upward to telomere on chrosomal short arm and 5'-terminus of this base sequence : 27792
ctagccagatggacatattaagaggaaaattgtttcagattaattgagacccaagtaaaaattcaggtcttttttttttctttttttgagacggagtgtcgctctgtcacctcggctggggtgcagtggtgcaatttcagctcactgcaagctctgcctccccagttcatgccattctcctgcctcggcctcccgagtagctcagactacaggcgcccgccaccacacccagctaatgtgtgtgtgtgtgtgtgtgtgtgtgtgtgtgtgtgtgtgtgtgtgttttagtacagacggggtttcaccgtgttagccaggatggtcttgatctcctgacctcgtgatctg

SEQ ID NO: 19492 - DNA, 199 bp, Homo sapiens
  Z67650
  Located on chromosome 12
  Distance between a terminus base of telomere on chromosomal short arm and 5'-terminus of this base sequence : 133392288
  Distance between 3'-terminus of neighbour sequence of sequence listing upward to telomere on chrosomal short arm and 5'-terminus of this base sequence : 72654
agtcccaagtgtttgccaagggattaaaaatagatttttaagatgtggggtgtgtgtgtgtgtgtgtgtgtgtgtgtgtgtgtatgtatctatatatgtacatatcttatatatattatatataatattccacacacaatggaatattattcagtcctaaaaaggaaagagattctgacatgtgctacaacatgggtga

SEQ ID NO: 19493 - DNA, 388 bp, Homo sapiens
  AC069235.15_148569
  Located on chromosome 12
  Distance between a terminus base of telomere on chromosomal short arm and 5'-terminus of this base sequence : 133417837
  Distance between 3'-terminus of neighbour sequence of sequence listing upward to telomere on chrosomal short arm and 5'-terminus of this base sequence : 25350
aactatggctggactttagaatcccacagaaaactttgtctatctatctatctatctatctatcatatatcctttctatctattgaatctctattattctatgtatcattctattatctatatctatctatctatctgtctgtctatctatctatctatctgtctatctatctatctatctatctatctatctatctatctatctatctatctatctatcatctctgtctctcttgatgcctgtacctcatgccagaccaattgaatcagtctatctaagggctgtattgggtctgtgtctccactttgtgatggctcccctgattattctaatgtatagacagagccagagcctccaggttttacgtggcctgaagattatacaatt

SEQ ID NO: 19494 - DNA, 301 bp, Homo sapiens
  AC006065.3_174586
  Located on chromosome 12
  Distance between a terminus base of telomere on chromosomal short arm and 5'-terminus of this base sequence : 133481034
  Distance between 3'-terminus of neighbour sequence of sequence listing upward to telomere on chrosomal short arm and 5'-terminus of this base sequence : 62809
aagtgctttgcatgagttaaattatataatacagcaaccctctttccctgtctctgtctctccctctctctctacacacacacacacacacatacacacacatgcatatatataggcttgtaaatatatgtctgtatatgtgtgtatatgcatatcacacatatatgttcaacaaatatatatatatatatatatatatatatatatatatatatatgcacacatcccatttttctgataaagcaacgaaagcaagagaggcaggccagtgtcacgcaagtggttaatgacagttgacctt

SEQ ID NO: 19495 - DNA, 152 bp, Homo sapiens
  D12S1634
  Located on chromosome 12
  Distance between a terminus base of telomere on chromosomal short arm and 5'-terminus of this base sequence : 133485247
  Distance between 3'-terminus of neighbour sequence of sequence listing upward to telomere on chrosomal short arm and 5'-terminus of this base sequence : 3912
aactcccattgtgatttgccataaactccacaatgcatatgtgtgtgtgtgtgtgtgtgtgtgtgtgtgtgtgtatacacccctgacatctctaacatcgtaatgactgtagtgactgatagatcatatggcccaagtggcaaggctgtcta

SEQ ID NO: 19496 - DNA, 151 bp, Homo sapiens
  D12S307
  Located on chromosome 12
  Distance between a terminus base of telomere on chromosomal short arm and 5'-terminus of this base sequence : 133537229
  Distance between 3'-terminus of neighbour sequence of sequence listing upward to telomere on chrosomal short arm and 5'-terminus of this base sequence : 51830
ttgtccttagagacaagatgctctgcatgtgtgtgtgtgtgtgtgtgtgtgtgtgtgtgtgtgtgtgtgtgtagttgtttaactgttttacaacttggtactttaaactcaagatcttcgactggggctcagcagaaacagcagtaatctg

SEQ ID NO: 19497 - DNA, 379 bp, Homo sapiens
  AC048343.10_154837
  Located on chromosome 12
  Distance between a terminus base of telomere on chromosomal short arm and 5'-terminus of this base sequence : 133599727
  Distance between 3'-terminus of neighbour sequence of sequence listing upward to telomere on chrosomal short arm and 5'-terminus of this base sequence : 62347
tatggtgtagtgaatttccaattcccatgttcattacattttagttctatatgaagattatcctgcctgtttcgtcattggccattgcttcatctgcttgtcatcttccaaagtgtttgttttgttttattttattttattttattttattttattttattttattttattttattttattttattttatttttgagatggagtcttgctccatttcccaggctggagttcagtggcatgttctctgtcactgcgacctccgcctcccaggtgcaagagattctcctgcctcagcctctggtgtagctgggattacagacacctgccaccatggggtttcaccatgttagccaggctagtgtcaaactcctaacctcaa

SEQ ID NO: 19498 - DNA, 149 bp, Homo sapiens
  DISO7_10003659
  Located on chromosome 12
  Distance between a terminus base of telomere on chromosomal short arm and 5'-terminus of this base sequence : 133707182
  Distance between 3'-terminus of neighbour sequence of sequence listing upward to telomere on chrosomal short arm and 5'-terminus of this base sequence : 107076
gctatcacagcgaggtccggtaaatttatatttatatttatatttatgtttatatttataatattatgagatataatactcatcatctaaaacattttgagtaccatacttaaacgttttcgtttttccagacttgacctttgtacatc

SEQ ID NO: 19499 - DNA, 398 bp, Homo sapiens
  chr12.fa.O7frz.136065565
  Located on chromosome 12
  Distance between a terminus base of telomere on chromosomal short arm and 5'-terminus of this base sequence : 133728843
  Distance between 3'-terminus of neighbour sequence of sequence listing upward to telomere on chrosomal short arm and 5'-terminus of this base sequence : 21512
tctcctggtaaatcctgtctctagttacacctcacagaatcagccctgctcccgggcaacatcaaagtcagcttcccctgggaacccagtgagtgtgtgctcccatcttctccttaacgaatagccattccataggcttcaaatacagcctgccactgtctaaattgttgtatacattcacatacacacacacactcacacacacacagcagcttctgtcagcttgcggggtatccgttttgtaagcaatgcaaatgaaagctgtgatccaatttgggtgaccctcctcctcccccacttagaatcaaagcagagcgtactggggccaggggctgggggatgacgacacagccttaggaagacctgcctctaaaaagagtcaagtcttgtctgtacca

SEQ ID NO: 19500 - DNA, 102 bp, Homo sapiens
  DISO7_10003660
  Located on chromosome 12
  Distance between a terminus base of telomere on chromosomal short arm and 5'-terminus of this base sequence : 133785000
  Distance between 3'-terminus of neighbour sequence of sequence listing upward to telomere on chrosomal short arm and 5'-terminus of this base sequence : 55759
cgagaagtgatgtcctattcacacacacagagacacacactcacacacacacacacacacacacacacacacacgcggccacatgatggcacttcaggagga

SEQ ID NO: 19501 - DNA, 232 bp, Homo sapiens
  DISO7_10003661
  Located on chromosome 12
  Distance between a terminus base of telomere on chromosomal short arm and 5'-terminus of this base sequence : 133808788
  Distance between 3'-terminus of neighbour sequence of sequence listing upward to telomere on chrosomal short arm and 5'-terminus of this base sequence : 23686
gaacaaggactgtaaagtggctaaattcacacacacacacacacacacacacacacacacacacacacacgtggcctggtagggggaaaaaacaaccagcaaaagaaaaaaattaaaagaggaaagatgtttgattttaactactaaaggggctttatttacataaggccacctttttgctagccaggccaaagtgaaagcaatggctgttgccccaagctgcagttccata

SEQ ID NO: 19502 - DNA, 101 bp, Homo sapiens
  DISD22_0008815
  Located on chromosome 12
  Distance between a terminus base of telomere on chromosomal short arm and 5'-terminus of this base sequence : 134012980
  Distance between 3'-terminus of neighbour sequence of sequence listing upward to telomere on chrosomal short arm and 5'-terminus of this base sequence : 203960
tcatcaggttaagtatgtcagtagggtgtgtgtgtgtgtgtgtgtgtgcaccacacatgcatgcaccaccaaatttccccactcctctcctgggcttctaa

SEQ ID NO: 19503 - DNA, 128 bp, Homo sapiens
  Z67491
  Located on chromosome 12
  Distance between a terminus base of telomere on chromosomal short arm and 5'-terminus of this base sequence : 134259194
  Distance between 3'-terminus of neighbour sequence of sequence listing upward to telomere on chrosomal short arm and 5'-terminus of this base sequence : 246113
gccatatgttcagaaagacattaattttataagggtgtgtgtgtgtgtgtgtgtgtatctaagtatttgtctatgttgtgtggaaaaagtacagaaatgaagaagtgggcaattcttgaaggatgatg

SEQ ID NO: 19504 - DNA, 210 bp, Homo sapiens
  D12S1658
  Located on chromosome 12
  Distance between a terminus base of telomere on chromosomal short arm and 5'-terminus of this base sequence : 134309539
  Distance between 3'-terminus of neighbour sequence of sequence listing upward to telomere on chrosomal short arm and 5'-terminus of this base sequence : 50217
atctgagctgcttgggaggctggggcaagagaatcgcttgaactcgggaggtggaggttgcagtgagccgaggtcatgccattgcactccatcctggacaataaaagtgaaactccgtctcaaaaaaaaaaccacacacacacacacacacacacacacacacaaataataaaatagaaatataactaacatggcgtagagtcaagattc

SEQ ID NO: 19505 - DNA, 451 bp, Homo sapiens
  chr12.fa.O7frz.138234628
  Located on chromosome 12
  Distance between a terminus base of telomere on chromosomal short arm and 5'-terminus of this base sequence : 134386096
  Distance between 3'-terminus of neighbour sequence of sequence listing upward to telomere on chrosomal short arm and 5'-terminus of this base sequence : 76347
ttaggaaatagagccaggttaggtggcagatcacgtgaggtcaggagttcaagaccagcctggccaacatggtgaaaacctgtctctactaaaaataaaaaattagctgggtgtggtggcaggcgcctgtaatcccagctactcgggaggctgaggcatgagcatcacttgaccccgggaggcagaggttgcactgagccgagatcatgccactgaactttagccagagtgacagagtgagactccatctaaacacacacacacacacacacacacacacatacacacacacaagattaggaaatagagcctgagtctcttttttattataaccagcaagggtgaatgggaataaataatcatattttctctttgctttgcgccattatgccattacccaacttggtgggcagtttcaggaatgcccctggaacctattaacagtgaatta

SEQ ID NO: 19506 - DNA, 456 bp, Homo sapiens
  chr12.fa.O7frz.138345442
  Located on chromosome 12
  Distance between a terminus base of telomere on chromosomal short arm and 5'-terminus of this base sequence : 134468497
  Distance between 3'-terminus of neighbour sequence of sequence listing upward to telomere on chrosomal short arm and 5'-terminus of this base sequence : 81950
tatgtgctagcatttctcaaactattttaaatttatacaaggtttgaacaaataagtaaatatattgtagctatttagagccagttttctcaactgttagcaaaacaagatagccttactaaaagggaccagcttacaatgaaccttcattattggattagaatcagagatatcgctatgaactcaaatatctatctgatctatctatctatctatctatctatctatctatctatcatctatcatctatcttttctatttatctctttatatctccatgcatccctgtatctgcatctgtatctgcatgtagacaagatggatatccatctgtctatatcttgacatacatatacatataactagatagagagggttatttttatctttgcacagattagtaaacatgtatttccaagatttcctcaatgagggtagaattaatgacactgcagc

SEQ ID NO: 19507 - DNA, 233 bp, Homo sapiens
  Z67024
  Located on chromosome 12
  Distance between a terminus base of telomere on chromosomal short arm and 5'-terminus of this base sequence : 134546883
  Distance between 3'-terminus of neighbour sequence of sequence listing upward to telomere on chrosomal short arm and 5'-terminus of this base sequence : 77930
aagtgagaggctttggcaattctgcgtgactattatttgagttatttcttatgggatatgcattatcttaaaaaaaaaaaaagtgtttcttagtagccatgtgaccacacaccagccccctgcccaactcacacacacacacacacacacacactctcacactctcttttaatagtaataaggttttcttcagataaccctccattcaccatgtgcccctctaactcagtaat

SEQ ID NO: 19508 - DNA, 441 bp, Homo sapiens
  chr12.fa.O7frz.139259842
  Located on chromosome 12
  Distance between a terminus base of telomere on chromosomal short arm and 5'-terminus of this base sequence : 134820611
  Distance between 3'-terminus of neighbour sequence of sequence listing upward to telomere on chrosomal short arm and 5'-terminus of this base sequence : 273495
attagcttctatctttcaaagctcatgggctaaaactgggatagagagactttctagattgtaggacaaagaagtattgtttttattaataaacttttttttacactaagcaagcattataattttgtaaagaagaaagtcagaaatatataaatagaagtaaaaatttaaaatatttattctccatcatctctgttttcctatccccaaatcccatcctctggacacacacacacacacacacacacacacaccacaacacattcatatagacacacacacagacacatgttcacagatacacacatgcacaccctcatatttataaacacacatacccaagtattcaggtgagagtcaaagagacatagtagcagtcttgttcttttgctgcaattgtaataaattatatggtttgtgtcaaatgaatataaggccttc

SEQ ID NO: 19509 - DNA, 144 bp, Homo sapiens
  DISO7_10003679
  Located on chromosome 12
  Distance between a terminus base of telomere on chromosomal short arm and 5'-terminus of this base sequence : 134944306
  Distance between 3'-terminus of neighbour sequence of sequence listing upward to telomere on chrosomal short arm and 5'-terminus of this base sequence : 123254
caatgtctaatcaccattaaccccttccagcatgtgtgtgtgtgtgtgtgtgtgtgtgtgtgtatatgtctgtgtgtgtatgtatgtgcgtgcatgtgtgtgtgtgtgtgtgtgtattttatctcagtatctcaggcacttgga

SEQ ID NO: 19510 - DNA, 147 bp, Homo sapiens
  DISO7_10003678
  Located on chromosome 12
  Distance between a terminus base of telomere on chromosomal short arm and 5'-terminus of this base sequence : 134944306
  Distance between 3'-terminus of neighbour sequence of sequence listing upward to telomere on chrosomal short arm and 5'-terminus of this base sequence : -144
caatgtctaatcaccattaaccccttccagcatgtgtgtgtgtgtgtgtgtgtgtgtgtgtgtatatgtctgtgtgtgtatgtatgtgcgtgcatgtgtgtgtgtgtgtgtgtgtattttatctcagtatctcaggcacttggaatt

SEQ ID NO: 19511 - DNA, 148 bp, Homo sapiens
  DISO7_10003674
  Located on chromosome 12
  Distance between a terminus base of telomere on chromosomal short arm and 5'-terminus of this base sequence : 134995493
  Distance between 3'-terminus of neighbour sequence of sequence listing upward to telomere on chrosomal short arm and 5'-terminus of this base sequence : 51040
aatgtattgattctgagattcccatttctgtgctttatgtgtgtgtgtgtgtgtgtgtgtgtgtgtgtgcgcgcgcgcgcatgtggtcttctcacatcgcctttgatttctctttgcaaaggaaaactgaagtctaatggtgcaaacg

SEQ ID NO: 19512 - DNA, 119 bp, Homo sapiens
  DISO7_10003673
  Located on chromosome 12
  Distance between a terminus base of telomere on chromosomal short arm and 5'-terminus of this base sequence : 135015820
  Distance between 3'-terminus of neighbour sequence of sequence listing upward to telomere on chrosomal short arm and 5'-terminus of this base sequence : 20179
aaatgagatcctggtgttagcttttaggcagatacacacaaacacaccacacacacacacacacacacacacacacacacacacacacacacagagagatcagctttgaagaagactga

SEQ ID NO: 19513 - DNA, 121 bp, Homo sapiens
  DISO7_10003670
  Located on chromosome 12
  Distance between a terminus base of telomere on chromosomal short arm and 5'-terminus of this base sequence : 135079178
  Distance between 3'-terminus of neighbour sequence of sequence listing upward to telomere on chrosomal short arm and 5'-terminus of this base sequence : 63239
acagaaattcactgaattaaggagtaacacacacacatacacacacacacacacacacacacacttcataaaataacttcatggatacaaagcttgaccccctacattcagatgtacagga

SEQ ID NO: 19514 - DNA, 401 bp, Homo sapiens
  chr12.fa.O7frz.139032517
  Located on chromosome 12
  Distance between a terminus base of telomere on chromosomal short arm and 5'-terminus of this base sequence : 135129923
  Distance between 3'-terminus of neighbour sequence of sequence listing upward to telomere on chrosomal short arm and 5'-terminus of this base sequence : 50624
agattgtctccaaatagtccagggcttacacgaagttgagatgaggaggtcgccatgcaagaaacccgactcaggaatgtcgctttcctaccgtaggagagatgcagttcaacgatatttttggctttaaaagatccactgcatttctccttatctcagcccctttatcaaaagcctcttaaaaagatgtactgagtcaggttgcctgtttgcagtcaaatttttactcagtcctcaagatttagccttttattgtttttggttgtggtagatttattgtattgtattgtattgtattgtattattttatttttacttatcattgtggactgccatgagtgagagtatggtcaagtaggatggagagtcaggatctactagcaactagatgttaactgtgg

SEQ ID NO: 19515 - DNA, 119 bp, Homo sapiens
  DISO7_10003668
  Located on chromosome 12
  Distance between a terminus base of telomere on chromosomal short arm and 5'-terminus of this base sequence : 135165834
  Distance between 3'-terminus of neighbour sequence of sequence listing upward to telomere on chrosomal short arm and 5'-terminus of this base sequence : 35510
ctctcctatcctcagggagggagggagggagggaaggaaggaaggaaggaaggaaggaaggaaggaaggaaggaaggaaagaaggaaagaagaaaggagagaaggaacctacagaagca

SEQ ID NO: 19516 - DNA, 157 bp, Homo sapiens
  DISO7_10003664
  Located on chromosome 12
  Distance between a terminus base of telomere on chromosomal short arm and 5'-terminus of this base sequence : 135180834
  Distance between 3'-terminus of neighbour sequence of sequence listing upward to telomere on chrosomal short arm and 5'-terminus of this base sequence : 14881
ggcaacagagtgagactctgtctaaaaaaaaccaagaaacaaaaacaaaacacacacacacacacacacacacacacacaaacagttagacttgttcatcatccccgaagaaaaggtgtaattgctgcttttatttgtatatgtagacgcggtgacc

SEQ ID NO: 19517 - DNA, 181 bp, Homo sapiens
  DISO7_10003667
  Located on chromosome 12
  Distance between a terminus base of telomere on chromosomal short arm and 5'-terminus of this base sequence : 135207212
  Distance between 3'-terminus of neighbour sequence of sequence listing upward to telomere on chrosomal short arm and 5'-terminus of this base sequence : 26221
tgtcagtcagagtcagaggggaaaattattagcaaagaaacagaaacccgtgaagacacacacacacacacaccacacacatacacacacacacacacacacacacacacacacacacacacacacacagaaatcacagaaggaacccggggaggggaagggggaggaggtgtttcctgtt

SEQ ID NO: 19518 - DNA, 125 bp, Homo sapiens
  DISO7_10003666
  Located on chromosome 12
  Distance between a terminus base of telomere on chromosomal short arm and 5'-terminus of this base sequence : 135215568
  Distance between 3'-terminus of neighbour sequence of sequence listing upward to telomere on chrosomal short arm and 5'-terminus of this base sequence : 8175
aacctaatgagcaaacaatgtgaatatatttcaaacacacacacacacacacacacacacacacacacccttgtggaaattatgagtacagacaaaatgtagttttgcattgtgggcttgagtaa

SEQ ID NO: 19519 - DNA, 222 bp, Homo sapiens
  D12S1675
  Located on chromosome 12
  Distance between a terminus base of telomere on chromosomal short arm and 5'-terminus of this base sequence : 135254757
  Distance between 3'-terminus of neighbour sequence of sequence listing upward to telomere on chrosomal short arm and 5'-terminus of this base sequence : 39064
tgctgttgctgctgtaataaatcaccataaatccagcagcctaaacacacacacacacacacacacacacacacacacacacacaaaatttatgattgtatagttctttttttttatttatttttattttttgagatggagtctctctctgtcgtccaggctggagtgcactggtgcaacctctgttcactgcaacctctgcctcctgggttcaagcgattc

SEQ ID NO: 19520 - DNA, 396 bp, Homo sapiens
  chr12.fa.O7frz.138811702
  Located on chromosome 12
  Distance between a terminus base of telomere on chromosomal short arm and 5'-terminus of this base sequence : 135340935
  Distance between 3'-terminus of neighbour sequence of sequence listing upward to telomere on chrosomal short arm and 5'-terminus of this base sequence : 85956
catactgtaaagatcaccatgaagggccgggcacggtgactcatgcctgtaatcccagcactttgggaggcagaggcaggtggatcacgaggacaggagttcgagaccagcctggccaacatagtgaaatgcggtctctactaaaaacactaataattagctgggcgtggtggcaggtacccgcaattccagctactcgggaggctgaggcaggagaatcacttgaacctgggaggcggaggttgcagtgagccaagatccaccattgcactccagcctgggtgacaagagtgaaactccctctctaaatcaatcaatcaatcaatcaatcaatcaatcaatcatcatgaaggttgtgtacttgctgcagaagggtctgttccagaaaatgattct

SEQ ID NO: 19521 - DNA, 214 bp, Homo sapiens
  DISO7_10003682
  Located on chromosome 12
  Distance between a terminus base of telomere on chromosomal short arm and 5'-terminus of this base sequence : 135362456
  Distance between 3'-terminus of neighbour sequence of sequence listing upward to telomere on chrosomal short arm and 5'-terminus of this base sequence : 21125
agaatctcctgctgcagcaaatgggtaacaaagtttttctgttgcatgtgcgtgcgtgtgtgtgtgtgtgtgtgtatgtctttctctctcttttctctctttatgtttctcttgatcttactattcagctagagagtcaagacagaaaaagacagaaaccattaaaatgattgctggatgatgtttaaaaatgaaccgagacacaatacaaatg

SEQ ID NO: 19522 - DNA, 146 bp, Homo sapiens
  DISO7_10003685
  Located on chromosome 12
  Distance between a terminus base of telomere on chromosomal short arm and 5'-terminus of this base sequence : 135481407
  Distance between 3'-terminus of neighbour sequence of sequence listing upward to telomere on chrosomal short arm and 5'-terminus of this base sequence : 118737
tcctggattatgtgatgcttacattctctctctctctctctctttctctctctctctctctctctctctttctctctctcccactccccctcctctgttcatctctctcctctctctttctctcttcctcccaacagtggtctatt

SEQ ID NO: 19523 - DNA, 141 bp, Homo sapiens
  DISO7_10003684
  Located on chromosome 12
  Distance between a terminus base of telomere on chromosomal short arm and 5'-terminus of this base sequence : 135481407
  Distance between 3'-terminus of neighbour sequence of sequence listing upward to telomere on chrosomal short arm and 5'-terminus of this base sequence : -146
tcctggattatgtgatgcttacattctctctctctctctctctttctctctctctctctctctctctctttctctctctcccactccccctcctctgttcatctctctcctctctctttctctcttcctcccaacagtggt

SEQ ID NO: 19524 - DNA, 191 bp, Homo sapiens
  DISO7_10003683
  Located on chromosome 12
  Distance between a terminus base of telomere on chromosomal short arm and 5'-terminus of this base sequence : 135509283
  Distance between 3'-terminus of neighbour sequence of sequence listing upward to telomere on chrosomal short arm and 5'-terminus of this base sequence : 27735
acaaaccacctggcttatgtttaattttaattactcaattggaaaaaaaagtttctcataattaactacaagtacagttacaaaatatcactttgtgtttaaaacttctacacagttttcccagccaatgctaacacacacacacacacacacacacacacacaaaccacttcagttcttaagtgtatgtc

SEQ ID NO: 19525 - DNA, 201 bp, Homo sapiens
  D12S1679
  Located on chromosome 12
  Distance between a terminus base of telomere on chromosomal short arm and 5'-terminus of this base sequence : 135577904
  Distance between 3'-terminus of neighbour sequence of sequence listing upward to telomere on chrosomal short arm and 5'-terminus of this base sequence : 68430
attcacagaggcaagaagcctacaaacatcagctttttactaaaccccggtggtcagggtgtccatgatgactaagtttttgtcttaacttgtgtgggccacggttcccagatatttgtgcagacttgattctatacgtgtatgtgtgtgtgtgtgtgtgtgtgtgtgtgtgtgtgtgtttgggtgagattaacaaattgg

SEQ ID NO: 19526 - DNA, 245 bp, Homo sapiens
  AC061709.12_10998
  Located on chromosome 12
  Distance between a terminus base of telomere on chromosomal short arm and 5'-terminus of this base sequence : 135620344
  Distance between 3'-terminus of neighbour sequence of sequence listing upward to telomere on chrosomal short arm and 5'-terminus of this base sequence : 42239
cctggcttgtaaaccattaacactaaagaggagcccagccatgatttgtaggaggagctgaggtccctgtccaggctgccatttttgaaaaataataataataataataataataataataataataataatgccaacatttcttttgcccttatgatgacactgcttaagattaaacatcttggagaaactgtctttcagtggggaaatggttaaacaaaccgtgtaccatggaataccactta

SEQ ID NO: 19527 - DNA, 479 bp, Homo sapiens
  chr12.fa.O7frz.139816506
  Located on chromosome 12
  Distance between a terminus base of telomere on chromosomal short arm and 5'-terminus of this base sequence : 135731960
  Distance between 3'-terminus of neighbour sequence of sequence listing upward to telomere on chrosomal short arm and 5'-terminus of this base sequence : 111371
agaatctactcctggtgaagatactggaacattgtcaaaatgacaataaaagatttgtaatagtacataaacttagttaaaacagcaggaggttttgagagggttaactccaattatgaaagaagttctgctatgagtaaaatgctatcaaacagcatcgcgtactacagagaagtgattcatgaaaggaagagtcaatggattcagcaagcctcattgttgtcttattttaagacactgctacagccaccccagccttcagcaaccaccaccctgatcagtcagcagccatcaatattgaggcaagaccctccaccagccaaaaaataaataaataaataaataaataaataaataaataaataaaattgtgacttgttaaaagctcagttgatcattagcatttttagcaataaaacatttttaaattatgtacattatttttagacaccatgctgttgcacacttaatagcctaca

SEQ ID NO: 19528 - DNA, 186 bp, Homo sapiens
  D12S1609
  Located on chromosome 12
  Distance between a terminus base of telomere on chromosomal short arm and 5'-terminus of this base sequence : 135866618
  Distance between 3'-terminus of neighbour sequence of sequence listing upward to telomere on chrosomal short arm and 5'-terminus of this base sequence : 134179
caatgtatgtcacccgatgactgtagttaataatactgtgttgtttactttgaaagttgctaagagagatcataagtgtccacatacccatagacacacacacacacacacacacacacacacacacacacacacacacaactggtaactatggaaagtgatagaggtgactacggtaatcgtttc

SEQ ID NO: 19529 - DNA, 260 bp, Homo sapiens
  DISO7_10003692
  Located on chromosome 12
  Distance between a terminus base of telomere on chromosomal short arm and 5'-terminus of this base sequence : 136090291
  Distance between 3'-terminus of neighbour sequence of sequence listing upward to telomere on chrosomal short arm and 5'-terminus of this base sequence : 223487
cataggaacccatagagtattgtgttgtgtgtgtgtgttgtatgtgtgtgtgtgttgtgtgtctgtgtgttgtgtgtgtgtgtgtgtctgtgtgtgtgtgtctgtgtctgtgtgtgtgtctgtgtgtgtgtgtctgtgtgtctgtgtgtgtgtctgtgtgtgtgcgtgtaaactagtttgatagtttgaattgggtttttgtcacttgtaaaggaaagtgttctcaaaacccaaattacaaatgacacaattacatcagg

SEQ ID NO: 19530 - DNA, 460 bp, Homo sapiens
  chr12.fa.O7frz.140763447
  Located on chromosome 12
  Distance between a terminus base of telomere on chromosomal short arm and 5'-terminus of this base sequence : 136142026
  Distance between 3'-terminus of neighbour sequence of sequence listing upward to telomere on chrosomal short arm and 5'-terminus of this base sequence : 51475
agccttaatcaactcaaggtacatgggagctcagttagtacctaacaacactttcatttctgattaagctcataaaagctgagatctctctctttctctctctctctctctctctctctctctctctctctccctctctccctccccctctccctccttccctctctctctcatttatctctattatctatctatctatctatcaatcatctagtttcatcttttgcccttcaaatatccatcctctgcttccagacacacctgtgcctgacagctagtatgtgtctccacaagcccactggggaccaaaactgtccctagttggaaaccacagggctagcaagatatgcatgggtcagagcacatgaagccagcatgccatattgcccatgtgtatctggtatctgtcacaataatgctacataacaaaactcacaacctctgatggcttgaaagagtg

SEQ ID NO: 19531 - DNA, 148 bp, Homo sapiens
  DISO7_10003687
  Located on chromosome 12
  Distance between a terminus base of telomere on chromosomal short arm and 5'-terminus of this base sequence : 136194135
  Distance between 3'-terminus of neighbour sequence of sequence listing upward to telomere on chrosomal short arm and 5'-terminus of this base sequence : 51649
tttacactgtgttatcaggaaccaaaatggtataaaatctagctaatttttcaggaatttcctttgctaaatttatacacatgcaaacacacagacacacacacacacacacacacacacacacacaaatcctaggatcccagacagc

SEQ ID NO: 19532 - DNA, 392 bp, Homo sapiens
  chr12.fa.O7frz.140183319
  Located on chromosome 12
  Distance between a terminus base of telomere on chromosomal short arm and 5'-terminus of this base sequence : 136226446
  Distance between 3'-terminus of neighbour sequence of sequence listing upward to telomere on chrosomal short arm and 5'-terminus of this base sequence : 32163
caaatagatggcacgttctggctcccttgcaatgaggtgtggccatggggctgagcttcatctcataaaagtgatagggccagtacgcttccttgcagaattctatttatttatttatttatttatttatttatttttgagacaaggtgtcactctgtcactcaggctggagtgcagtggcatgattatggctccctgcagcttccacccgccaaactgaagccatcatctcacctcagcctctatgaactcctgggctcaagccatatactcacctcagcctcctgaagtgctgggattacaagtttgcctctgtcctcccaacacttaccacatcccctttcctcactaaaccacattggccttctttgtatccttcaaacagacctgat

SEQ ID NO: 19533 - DNA, 207 bp, Homo sapiens
  DISO7_10003689
  Located on chromosome 12
  Distance between a terminus base of telomere on chromosomal short arm and 5'-terminus of this base sequence : 136334633
  Distance between 3'-terminus of neighbour sequence of sequence listing upward to telomere on chrosomal short arm and 5'-terminus of this base sequence : 107795
ggagacaaagagaagagacatgtttgaaagacataaatattgtgtgtgtgtgtgtgtgtgtgtgtgtgtgtgtgtgtagcaggtagaatggaaaaaccaggaagtattttttttgaagctatgataataggtgacttttgaagtcttttcaaagaaccgagcaacagaggcccaaaaacaatctttagataccacaattcagggaca

SEQ ID NO: 19534 - DNA, 101 bp, Homo sapiens
  DISO7_10003688
  Located on chromosome 12
  Distance between a terminus base of telomere on chromosomal short arm and 5'-terminus of this base sequence : 136347090
  Distance between 3'-terminus of neighbour sequence of sequence listing upward to telomere on chrosomal short arm and 5'-terminus of this base sequence : 12250
ttggccagtctttctatgtgagtacacacacacacacacacacacacacacagagctccaaaaaaaaagagttggtcttcaccaatgcacaagtaagttgc

SEQ ID NO: 19535 - DNA, 102 bp, Homo sapiens
  DISO7_10003690
  Located on chromosome 12
  Distance between a terminus base of telomere on chromosomal short arm and 5'-terminus of this base sequence : 136347091
  Distance between 3'-terminus of neighbour sequence of sequence listing upward to telomere on chrosomal short arm and 5'-terminus of this base sequence : -100
tggccagtctttctatgtgagtacacacacacacacacacacacacacacagagctccaaaaaaaaagagttggtcttcaccaatgcacaagtaagttgctt

SEQ ID NO: 19536 - DNA, 100 bp, Homo sapiens
  D12S1659
  Located on chromosome 12
  Distance between a terminus base of telomere on chromosomal short arm and 5'-terminus of this base sequence : 136391481
  Distance between 3'-terminus of neighbour sequence of sequence listing upward to telomere on chrosomal short arm and 5'-terminus of this base sequence : 44288
agtgctgggaactaaacactgtgttcatgtgaggatatgtgcacacacacgcacgcacacacacacacacacacacacaacgttggccttgtatgtccta

SEQ ID NO: 19537 - DNA, 459 bp, Homo sapiens
  chr12.fa.O7frz.140569090
  Located on chromosome 12
  Distance between a terminus base of telomere on chromosomal short arm and 5'-terminus of this base sequence : 136460355
  Distance between 3'-terminus of neighbour sequence of sequence listing upward to telomere on chrosomal short arm and 5'-terminus of this base sequence : 68774
cacgaataagctgtccactatgtggattgcttaggcaattagccactgctatagcaggggtgggggcgagaggatgggaagcggggacattttacaccgaatactgatgaaatcagtcagagcatttgctctctgccctgtggaattagaaggcaggttggtggaagaaaggaagacatcaaagtgccggctaaagacgcaaacaccttaaaatcaccaagctctcacgtgctgctagagggattgtcattggtagtttggcacaagctttctttagaactacttggtatatatatatatatatatacatatatatatatatacatatatatatatatatacacacatacacacacatatatatattttatatttattatatagaataggtaaacatgtatatatatttattgaaatgatgcatacatatgcataaaccagagcttgtagtggtatgca

SEQ ID NO: 19538 - DNA, 209 bp, Homo sapiens
  DISO7_10003691
  Located on chromosome 12
  Distance between a terminus base of telomere on chromosomal short arm and 5'-terminus of this base sequence : 136460605
  Distance between 3'-terminus of neighbour sequence of sequence listing upward to telomere on chrosomal short arm and 5'-terminus of this base sequence : -209
tggtagtttggcacaagctttctttagaactacttggtatatatatatatatatatacatatatatatatatacatatatatatatatatacacacatacacacacatatatatattttatatttattatatagaataggtaaacatgtatatatatttattgaaatgatgcatacatatgcataaaccagagcttgtagtggtatgca

SEQ ID NO: 19539 - DNA, 124 bp, Homo sapiens
  DISO7_10003694
  Located on chromosome 12
  Distance between a terminus base of telomere on chromosomal short arm and 5'-terminus of this base sequence : 136613896
  Distance between 3'-terminus of neighbour sequence of sequence listing upward to telomere on chrosomal short arm and 5'-terminus of this base sequence : 153082
ctaacacagtgcattgaaacccatgggatttataacataatcaagtgtcttcggaaaaactccgacttgcgccatatatatatatatatatatatatatttcctaacgcaggacagatgacaga

SEQ ID NO: 19540 - DNA, 101 bp, Homo sapiens
  DISO7_10003695
  Located on chromosome 12
  Distance between a terminus base of telomere on chromosomal short arm and 5'-terminus of this base sequence : 136662526
  Distance between 3'-terminus of neighbour sequence of sequence listing upward to telomere on chrosomal short arm and 5'-terminus of this base sequence : 48506
atctcttatcccgcagtctgctttccaggcacgtggatgcacaggtttgtttgtttgtttgtttgtttgttttctcaagacagaagcaggtcttccaatat

SEQ ID NO: 19541 - DNA, 238 bp, Homo sapiens
  D12S1714
  Located on chromosome 12
  Distance between a terminus base of telomere on chromosomal short arm and 5'-terminus of this base sequence : 136723807
  Distance between 3'-terminus of neighbour sequence of sequence listing upward to telomere on chrosomal short arm and 5'-terminus of this base sequence : 61180
gtgttcgagatccacaggtgtctacatcatatgctacaaacacatctatcgagtcgtcaacaattttcacacaatagcagacccaaatctaatacctggagtttattttctaaataatacgttaagaaaattggtttatatttgtatagatatagatatagatacacacacgcacacacacacacacacacacacacacacacataacgattggctattggcagtcaactttgtggtt

SEQ ID NO: 19542 - DNA, 402 bp, Homo sapiens
  AL365443.7_216948
  Located on chromosome 12
  Distance between a terminus base of telomere on chromosomal short arm and 5'-terminus of this base sequence : 136785035
  Distance between 3'-terminus of neighbour sequence of sequence listing upward to telomere on chrosomal short arm and 5'-terminus of this base sequence : 60990
taccaggaaacttgttcattctatcataagggatgatagaaaagtatctgggttggcccaaataatgtggacaggcaaaggaggagggggttggctatgcatgatgaggatcacatcttcaccttagggaaagacacacgatatataaattgtaattgtagtaaatattatagctggggaagattggatgtccaaataaagatcttctgttacatcctagccaccaagcaattcattccatggggaagctttaattatgaaaaaatttaatctgagagtttactcctctctccctaaggagaacacttcttagacaatgcatatctatttatgtattcatccatccatccatccatccatccatccatccatccatccatccactgattgtcttagtctgtt

SEQ ID NO: 19543 - DNA, 329 bp, Homo sapiens
  chr12.fa.O7frz.141254047
  Located on chromosome 12
  Distance between a terminus base of telomere on chromosomal short arm and 5'-terminus of this base sequence : 136936081
  Distance between 3'-terminus of neighbour sequence of sequence listing upward to telomere on chrosomal short arm and 5'-terminus of this base sequence : 150644
tttagaagcatctagcacaaagatgagaaatataaaaagattgatatttcctcaaaatgaaagtatcatataatgcatttccaatcaaaataccaatgagatatgcatgcatgtgtgtgtgtgtgtgtgtgtgtgtctgtgtgtgtgtgagggggtatatcttgataaattttaaaaataattttgcaagaggaaagcgaaaaatatttgggagggggaaaagaaaaacataatagagaaagattcatcctattatatgtcaaaatgcactgcagaattgtaataataataattaaaggagaattgtgctgaaataagaatagacaaat

SEQ ID NO: 19544 - DNA, 143 bp, Homo sapiens
  DISO7_10003699
  Located on chromosome 12
  Distance between a terminus base of telomere on chromosomal short arm and 5'-terminus of this base sequence : 136987021
  Distance between 3'-terminus of neighbour sequence of sequence listing upward to telomere on chrosomal short arm and 5'-terminus of this base sequence : 50611
ccaggtaatgaccaagtaaattcatacagaaattgtgtgtgtgtgtgtgtgtgtgtgtgtgtgtgtgagagagagagagagagacagagagagaaagaaagagatatcaatttggttcaaaagactggtatgaacctgactgg

SEQ ID NO: 19545 - DNA, 137 bp, Homo sapiens
  D12S367
  Located on chromosome 12
  Distance between a terminus base of telomere on chromosomal short arm and 5'-terminus of this base sequence : 137049291
  Distance between 3'-terminus of neighbour sequence of sequence listing upward to telomere on chrosomal short arm and 5'-terminus of this base sequence : 62127
ttcctagcgtgctcctttgaaaagagcaaacatctggttttatctctgagaacatatttaatctgtgtgtgtgtgtgtgtgtgtgtgtgtgtgtgtgtggaagaggatgcatgaggcatgccaaataatcaaatctt

SEQ ID NO: 19546 - DNA, 179 bp, Homo sapiens
  DISO7_10003703
  Located on chromosome 12
  Distance between a terminus base of telomere on chromosomal short arm and 5'-terminus of this base sequence : 137283473
  Distance between 3'-terminus of neighbour sequence of sequence listing upward to telomere on chrosomal short arm and 5'-terminus of this base sequence : 234045
ttgtgtctccaggaatgcagagtgtgtgtgtgtgtgtgtgtgcgcgcgtgtgtgtgtgtaccccgaatactgagagaatgtcatattacccaagtatatgctacatttcataaatgtaaagatgtatacattagctctttattaagtaaaagtagtgtttctataacaacataatggca

SEQ ID NO: 19547 - DNA, 273 bp, Homo sapiens
  D12S97
  Located on chromosome 12
  Distance between a terminus base of telomere on chromosomal short arm and 5'-terminus of this base sequence : 137363752
  Distance between 3'-terminus of neighbour sequence of sequence listing upward to telomere on chrosomal short arm and 5'-terminus of this base sequence : 80100
gctcgaactcctcagtgaaggtcttattggttttatgctgacatccgatctctgaaaacatcaatgaacaagaagaggaacaattcctataaatctactttactcatgctggagtttgaaaataagtttgatcttttggctaaagttttgctattctgcataaaaacttccaaggcttggaaagttaaaacacacacacacacacacacacacacacacacacacacacaaaacacctttatgcaattgcgaattttccacgatgaggagtct

SEQ ID NO: 19548 - DNA, 451 bp, Homo sapiens
  chr12.fa.O7frz.141582994
  Located on chromosome 12
  Distance between a terminus base of telomere on chromosomal short arm and 5'-terminus of this base sequence : 137408745
  Distance between 3'-terminus of neighbour sequence of sequence listing upward to telomere on chrosomal short arm and 5'-terminus of this base sequence : 44720
tccagattcgagattctacagttttctaaaatgctggcaaatctgaaatctgagctcttctccccacagacgcaggagtccacgatgtgagtggcatccacagctccccgtggtgatttgaaggaatgccccttggcatcaccagcctcatcctgactgtggccatcactggaaattcatatgcaaagaaaagagtctttcttttctttcttccttcctgccttcctttcttttctttctctcttctttctcccttccttcttttctttttttcttttcttccttcttctttctttctttattcctttctttcccttttttctccttccttccttctttcttctttctttctttcttttctttctccttccttccttccttccttccttccttccttccttcttcccttccttctttcttctttctttcggtggagtttcactcttgtcac

SEQ ID NO: 19549 - DNA, 392 bp, Homo sapiens
  chr12.fa.O7frz.141675096
  Located on chromosome 12
  Distance between a terminus base of telomere on chromosomal short arm and 5'-terminus of this base sequence : 137528207
  Distance between 3'-terminus of neighbour sequence of sequence listing upward to telomere on chrosomal short arm and 5'-terminus of this base sequence : 119011
ttgtttactgagtgtttgcataaaatattcactgattcatgagtgtgggtcagtaataaaagccactccacgttgttattccaaagaggagtgagtttatccccaagattagttctagagtccctggaaggagagagagagagagagagagagagagggagagagtttgagaaaaaagaagagagctttctctctttctgtctctcaagtcaaggacacagacctggtagaaaaggccttgctttttcaattacccaggttcttggtgcccacacgaggagtaaatgctattgttttgactttctccacccgacaggccagtcgccacaggaaggaggagaagcccagcccagctggctgctcaatgtggcaccttcatcgtctgcctactg

SEQ ID NO: 19550 - DNA, 117 bp, Homo sapiens
  D12S343
  Located on chromosome 12
  Distance between a terminus base of telomere on chromosomal short arm and 5'-terminus of this base sequence : 137761361
  Distance between 3'-terminus of neighbour sequence of sequence listing upward to telomere on chrosomal short arm and 5'-terminus of this base sequence : 232762
gaatatccgaccttccagatctatagattcactgcaatatgcatgcacatgcatgccacatgcacacacacacacacacacacacacacacacacggggagtagttctaaatacgtg

SEQ ID NO: 19551 - DNA, 387 bp, Homo sapiens
  AC063926.12_52735
  Located on chromosome 12
  Distance between a terminus base of telomere on chromosomal short arm and 5'-terminus of this base sequence : 137882276
  Distance between 3'-terminus of neighbour sequence of sequence listing upward to telomere on chrosomal short arm and 5'-terminus of this base sequence : 120798
ctgtaattccgacactttgagaggctgaggcaggcagatcacgaggtcaagagtttgagacgagcctgaccaacatggtgaaaccctgtctctactaaaaatacaaaaattagccgagcgtggcggcaggtgcctataatcccagctactcaggaggctgaggcaggagaatcgcttgaaattgggaggcagaggttgcagtgagctgagattgcaccactgcactccaaactgggtgacagagcgagactccatctcaaataataataataataataataataataataataataataataataatttacaaggacgagaaagaaggaatgattctgaaaggcacgtaagcacttccaggcagtatccaactcagtgagtatgtgt

SEQ ID NO: 19552 - DNA, 393 bp, Homo sapiens
  DISO7_00038460
  Located on chromosome 12
  Distance between a terminus base of telomere on chromosomal short arm and 5'-terminus of this base sequence : 137921087
  Distance between 3'-terminus of neighbour sequence of sequence listing upward to telomere on chrosomal short arm and 5'-terminus of this base sequence : 38424
accctgacagtgaggaccaggcccccagacccatgaagctcacagcagtgaccagccacgaaccctggcagcctgcaggaggaaacacatgggaaatgacattgggtagaaatggccacagcgggcgggtgggtagtcacactgggaacagtcacagaaaacatttcctggggtccccaagccactcctgggggcttggaaaaccagctgcaaaatgctagaatttcattgtcatttcctttcatacacacacacacacacacacacacacacacacacacacctgtggtaacttcgtggtcaacattttaaaatctgggtcttttatataaaagaccagattccttcaaaaatgggaagagttggccacgcatgcctccaggaaaggactga

SEQ ID NO: 19553 - DNA, 99 bp, Homo sapiens
  D12S1599
  Located on chromosome 12
  Distance between a terminus base of telomere on chromosomal short arm and 5'-terminus of this base sequence : 137921292
  Distance between 3'-terminus of neighbour sequence of sequence listing upward to telomere on chrosomal short arm and 5'-terminus of this base sequence : -188
agctgcaaaatgctagaatttcattgtcatttcctttcatacacacacacacacacacacacacacacacacacacacctgtggtaacttcgtggtcaa

SEQ ID NO: 19554 - DNA, 145 bp, Homo sapiens
  G12398
  Located on chromosome 12
  Distance between a terminus base of telomere on chromosomal short arm and 5'-terminus of this base sequence : 138183524
  Distance between 3'-terminus of neighbour sequence of sequence listing upward to telomere on chrosomal short arm and 5'-terminus of this base sequence : 262133
acagatgatagataatagccagatgatagataatagatgatcaatagattgatagatgattaatagatatagatagatagatagatagatagatagatagatagatagatagataccaagaaaccaatgataaaaaattggggca

SEQ ID NO: 19555 - DNA, 216 bp, Homo sapiens
  chr12.fa.O7frz.142549805
  Located on chromosome 12
  Distance between a terminus base of telomere on chromosomal short arm and 5'-terminus of this base sequence : 138292259
  Distance between 3'-terminus of neighbour sequence of sequence listing upward to telomere on chrosomal short arm and 5'-terminus of this base sequence : 108590
tattacaaaggcttcaactcaggaacagccacaaagaagaggtgcacagggccaggtaaggatgggaggggcgtgcagggggtctcaggaccagactaggcagcacctcttggcctactgaaatgctaaatctgaaaatgatcttgaagatgaatccttgtgtgtgtgtgtgtgtgtgtgtgtgtgtgtgtgtgtgtgacaaggtctcattctgtc

SEQ ID NO: 19556 - DNA, 113 bp, Homo sapiens
  DISO7_10003706
  Located on chromosome 12
  Distance between a terminus base of telomere on chromosomal short arm and 5'-terminus of this base sequence : 138419422
  Distance between 3'-terminus of neighbour sequence of sequence listing upward to telomere on chrosomal short arm and 5'-terminus of this base sequence : 126947
ccagacaggcagctagtgtctcacacacacacacacacacacacacacacacacacacacacacactggagtttacacacaaagaagggccaggtgggcagatgctactggag

SEQ ID NO: 19557 - DNA, 163 bp, Homo sapiens
  D12S1723
  Located on chromosome 12
  Distance between a terminus base of telomere on chromosomal short arm and 5'-terminus of this base sequence : 138725712
  Distance between 3'-terminus of neighbour sequence of sequence listing upward to telomere on chrosomal short arm and 5'-terminus of this base sequence : 306177
aaggccatgtgagcatcatttctctggtgtgtgtgtgtgtgtgtgtgtgtgtgtgcacgtgtgccagatgctgactcagtgtgttttatgcatcttctgatatgtatttaaggtcatcctgtggcaaggtatgatgattatccccattctacagaggcgggat

SEQ ID NO: 19558 - DNA, 213 bp, Homo sapiens
  DISD22_0008922
  Located on chromosome 12
  Distance between a terminus base of telomere on chromosomal short arm and 5'-terminus of this base sequence : 139211017
  Distance between 3'-terminus of neighbour sequence of sequence listing upward to telomere on chrosomal short arm and 5'-terminus of this base sequence : 485142
tgtacgtgtctgtgatacgaacgtgtgtatctgtgtctgagtgtgtgcatgtctgtgtgtatggtatacgtgtgcatcagtgtgtgtatgtgtgtgtgtgacgtacgtgtacatcagtgtgtgtgtacgtgtgtgtgtatatgtgatgtatgtatgaatctgcgtgcatgtctgagtgtgtatatgtatgagatacgtatctgtgggtgtacg

SEQ ID NO: 19559 - DNA, 209 bp, Homo sapiens
  HUMUT7667
  Located on chromosome 12
  Distance between a terminus base of telomere on chromosomal short arm and 5'-terminus of this base sequence : 139352822
  Distance between 3'-terminus of neighbour sequence of sequence listing upward to telomere on chrosomal short arm and 5'-terminus of this base sequence : 141592
ggggggtaattttgcagttaaagatggccccaaacactgtctagtgtttttttttgttgttttgttgttgttgttgttttgttttgtttttgagacggagtttcactcttgttgcccaggctggagtgcaatggcgccatcttggctcaccgcaacctctgcctcccaggttcaagcgattctcctgcctcagcctccctagtagctgg

SEQ ID NO: 19560 - DNA, 215 bp, Homo sapiens
  D12S357
  Located on chromosome 12
  Distance between a terminus base of telomere on chromosomal short arm and 5'-terminus of this base sequence : 139543674
  Distance between 3'-terminus of neighbour sequence of sequence listing upward to telomere on chrosomal short arm and 5'-terminus of this base sequence : 190643
ccgtgtgaggacgaggatgaagacctttaggatgattcacttccacacagtgaatggcaaatatcttttctctatgattttgtgtgtgtgtgtgtgtgtgtgtgtgtgtgtgtgtgtgtgtgtgagacagggtcttgctctgttgcccaggctggagagcagtggtgcaatcacggctcactgcaaccttgacctcctgggctcaagcgaccctc

SEQ ID NO: 19561 - DNA, 365 bp, Homo sapiens
  AL163203.1_176541
  Located on chromosome 13
  Distance between a terminus base of telomere on chromosomal short arm and 5'-terminus of this base sequence : 17055866
  Distance between 3'-terminus of neighbour sequence of sequence listing upward to telomere on chrosomal short arm and 5'-terminus of this base sequence : 0
caaattctatggcatctttcactcctaatctttttttaaatgcttttgtttggtatttgataataatgtgtctatggttacttttcaactgtgcaacacatttatctccatgccgagtcaaactttctaatgaagttaatagttttatgtacatttagttattgtaaatcaaaacagtaaatttttatgatagttttaaagttactaagattgagaatatatcaatttttcactgctcatgaatctgtgggttccttaaacaattatacataaggtctatagatatgtgtctgtgtctgtgtgtgtgtgtgtgtgtgtgtgtgtgtgtgtgtgtgtaatggctcagaatcttgcctaacatattg

SEQ ID NO: 19562 - DNA, 105 bp, Homo sapiens
  DISO7_12115106
  Located on chromosome 13
  Distance between a terminus base of telomere on chromosomal short arm and 5'-terminus of this base sequence : 17451138
  Distance between 3'-terminus of neighbour sequence of sequence listing upward to telomere on chrosomal short arm and 5'-terminus of this base sequence : 394907
tgtgcaaattgtagaacttctgtagaatgcatatatattatatatatatatatataaatatgtatatgtcagtgttttctcttttacctgtgcttcctctcactc

SEQ ID NO: 19563 - DNA, 280 bp, Homo sapiens
  DISO7_00038514
  Located on chromosome 13
  Distance between a terminus base of telomere on chromosomal short arm and 5'-terminus of this base sequence : 17784651
  Distance between 3'-terminus of neighbour sequence of sequence listing upward to telomere on chrosomal short arm and 5'-terminus of this base sequence : 333408
cactggttcagtgatgggcatgtgacccaatcagaaccaatcagaactaatcccaagacctccccctgagcttgttcctcatctgagagacagagagagagatggagagagagggagagagagagagagagagagtgtgtgtgtgtgtgtgtgtgtgtgtgtgtgtgtgtgtgtgtgtgtgtgtttgtgtgaagggatgttggcggagggggacacgttttatgtgggcccatgttagaaagattgggagggaagaaaataatgagcatgatcctttcct

SEQ ID NO: 19564 - DNA, 122 bp, Homo sapiens
  DISO7_00038502
  Located on chromosome 13
  Distance between a terminus base of telomere on chromosomal short arm and 5'-terminus of this base sequence : 18067530
  Distance between 3'-terminus of neighbour sequence of sequence listing upward to telomere on chrosomal short arm and 5'-terminus of this base sequence : 282599
gaagactggcaagcagaaggaaaggaaggaagggagggaggaagggagggagggagggagggggggagggaaaaggccaaaggcctggctagatagccggaaaaatgaaggcaataggccag

SEQ ID NO: 19565 - DNA, 198 bp, Homo sapiens
  AL139327.18_59846
  Located on chromosome 13
  Distance between a terminus base of telomere on chromosomal short arm and 5'-terminus of this base sequence : 18261099
  Distance between 3'-terminus of neighbour sequence of sequence listing upward to telomere on chrosomal short arm and 5'-terminus of this base sequence : 193447
tggtccgatttaaatcttaagtagtgtgtgtgtgtgtgtgtgtgtgtgtgtgtgtgtgtatttatgtttccgtttatgtttaagtaactagattgagcgcccaaatgctttattcacctttgcaattgtgtagatgacatcaggcagaggttgacgttacagagccaggtgtcctgctgtaagctattccatgcagtt

SEQ ID NO: 19566 - DNA, 186 bp, Homo sapiens
  DISO7_00038490
  Located on chromosome 13
  Distance between a terminus base of telomere on chromosomal short arm and 5'-terminus of this base sequence : 18421529
  Distance between 3'-terminus of neighbour sequence of sequence listing upward to telomere on chrosomal short arm and 5'-terminus of this base sequence : 160232
accctcagctgttctgatgagtactcctctgactgctggaaggtgacaggaaggagttttagcaacattaaaaccactgagactggggatttgggggcatcattaatgtcagccccctccccaccaagtgcgcgcacacacacacacacacacacacacacacacactcttattctgcctcccagg

SEQ ID NO: 19567 - DNA, 148 bp, Homo sapiens
  DISO7_12105106
  Located on chromosome 13
  Distance between a terminus base of telomere on chromosomal short arm and 5'-terminus of this base sequence : 18660623
  Distance between 3'-terminus of neighbour sequence of sequence listing upward to telomere on chrosomal short arm and 5'-terminus of this base sequence : 238908
acttgctctgggaggttgcatgggtgcagaaggaccacccggaagggattggtccagctgcccaaatgaaatatttgaagcgtgtgtgtgtgtgtgtgtgtgtgtgtgtgtgtgtgtgtgtgtgtccagctggtctatcttataaacc

SEQ ID NO: 19568 - DNA, 120 bp, Homo sapiens
  DISO7_12105101
  Located on chromosome 13
  Distance between a terminus base of telomere on chromosomal short arm and 5'-terminus of this base sequence : 18935287
  Distance between 3'-terminus of neighbour sequence of sequence listing upward to telomere on chrosomal short arm and 5'-terminus of this base sequence : 274516
gataaggattatatctcaggtgggggggggggaattgtatctcccactaactatatgcatgtatatgcgcacgtgtgtgtgtgtgtgtgtgtgtgtgtgtctcaaaccttatggaccagg

SEQ ID NO: 19569 - DNA, 347 bp, Homo sapiens
  HUMUT7093
  Located on chromosome 13
  Distance between a terminus base of telomere on chromosomal short arm and 5'-terminus of this base sequence : 19050008
  Distance between 3'-terminus of neighbour sequence of sequence listing upward to telomere on chrosomal short arm and 5'-terminus of this base sequence : 114601
gttgttttcaccttttggccgttgtgaaaatgcttctgtgatcattgttgtacaggtatctatttgagtcattgctttcagttattttgggtttatatctcacaatgaaattgatgggtcatagattaatatccacatgtgactttggggaaccattaaactgttttccacagtgtggtaccattttacatttttaccagcaatacagaagagttccaatttctgaaagtctttatcagcacttttctttttttaaaatttttcctccatttttaaaatgtatgtatgtatgtatgtatgtatgtatgtatgtatgtatgtagagctggagtcttgctatgttgccc

SEQ ID NO: 19570 - DNA, 257 bp, Homo sapiens
  D13S1316
  Located on chromosome 13
  Distance between a terminus base of telomere on chromosomal short arm and 5'-terminus of this base sequence : 19182467
  Distance between 3'-terminus of neighbour sequence of sequence listing upward to telomere on chrosomal short arm and 5'-terminus of this base sequence : 132112
catgtctctgaatctctttttcatacctgtcatttctttgactctccatgctgcattctggataatttcttcgtgtgtgtgtgtgtgtgtttgtgtgtgtgtgtgtgtgtgtgtgtgtatatataatttatttacttattttttgagatggagtctctctctatcacccaggctggtatgtagtggtgcaatctcggctcactgcaacctctgcctcctgggttcaagtgattctcgtgccccagcctccccagtag

SEQ ID NO: 19571 - DNA, 166 bp, Homo sapiens
  Z17134.1_172
  Located on chromosome 13
  Distance between a terminus base of telomere on chromosomal short arm and 5'-terminus of this base sequence : 19348748
  Distance between 3'-terminus of neighbour sequence of sequence listing upward to telomere on chrosomal short arm and 5'-terminus of this base sequence : 166024
gacctaatgtacagtatggtggactatagttaataataatgtattggatacttgaatctgctgagagagtagattttaagtgctctacacacacacacacacacacacacacacacacacacacacacaatagtaacctatgtgaggtgatgcatagttatttagt

SEQ ID NO: 19572 - DNA, 113 bp, Homo sapiens
  D13S175
  Located on chromosome 13
  Distance between a terminus base of telomere on chromosomal short arm and 5'-terminus of this base sequence : 19348789
  Distance between 3'-terminus of neighbour sequence of sequence listing upward to telomere on chrosomal short arm and 5'-terminus of this base sequence : -125
tattggatacttgaatctgctgagagagtagattttaagtgctctacacacacacacacacacacacacacacacacacacacacacaatagtaacctatgtgaggtgatgca

SEQ ID NO: 19573 - DNA, 205 bp, Homo sapiens
  HUMUT6291
  Located on chromosome 13
  Distance between a terminus base of telomere on chromosomal short arm and 5'-terminus of this base sequence : 20159706
  Distance between 3'-terminus of neighbour sequence of sequence listing upward to telomere on chrosomal short arm and 5'-terminus of this base sequence : 810804
ggaaggcagaggttgcagtgagccaagattgtaccactgcacaccagcctgggagacagagcaagaccctggcaaaaaaagaaaagaaaaaaggaaggaaggaagaagaaagagaaaaagaaagaaagaaagaaagaaagaaagaaagaaagaaagaaagaaagaaagaaagaaaaccaagtatcttttccagccacaatgattt

SEQ ID NO: 19574 - DNA, 382 bp, Homo sapiens
  DISO7_00038553
  Located on chromosome 13
  Distance between a terminus base of telomere on chromosomal short arm and 5'-terminus of this base sequence : 20245281
  Distance between 3'-terminus of neighbour sequence of sequence listing upward to telomere on chrosomal short arm and 5'-terminus of this base sequence : 85370
tgaattctatgattccacgtggggggtggtggtggtggtatgggttgtttgtatgtatgtatgtatgtatgtattttatttattgagacagggtcttgctatgtcatgcaggttggagtgcagtggcgtgatagtagctcactgtggccttgaactcgtgggcttaagggatcccttctgcctcagcctcctgaatagctgtgactccaagtgtgcaccaccatgcccagctaattttgtaaaagaattttttgtagagacagagtctcattatgtagccctggcctcaagtgatcctcctgcctcaatctcccacactgctggggtaacaggcatgagccactgtgcccgtctcacatggactgtttaacttacctgccac

SEQ ID NO: 19575 - DNA, 218 bp, Homo sapiens
  DISO7_00038556
  Located on chromosome 13
  Distance between a terminus base of telomere on chromosomal short arm and 5'-terminus of this base sequence : 20328743
  Distance between 3'-terminus of neighbour sequence of sequence listing upward to telomere on chrosomal short arm and 5'-terminus of this base sequence : 83080
agtagaattctgacaggcagtgggaaggggctgactctacgccaacttcttatgttgtcaggcaggaactcacgggccgcagggtcctcatccgaacactcaaggggtgtgtgtgtgtgtgtgtgtgtgtgtgtgtgtgtgagagagagagagagcgagagagagagaatatcggggggagctagctaagtggagaaactagaactaatggctattcc

SEQ ID NO: 19576 - DNA, 101 bp, Homo sapiens
  DISD22_0008958
  Located on chromosome 13
  Distance between a terminus base of telomere on chromosomal short arm and 5'-terminus of this base sequence : 20530025
  Distance between 3'-terminus of neighbour sequence of sequence listing upward to telomere on chrosomal short arm and 5'-terminus of this base sequence : 201064
ttgtcctcagtattactcccagtgaagtggtgtgtgtgtgtgtgtgtgtgtgtgtgtgtgtgtgtgtgtctaattacacaattagcaagttacagagggta

SEQ ID NO: 19577 - DNA, 460 bp, Homo sapiens
  AL139378.15_84250
  Located on chromosome 13
  Distance between a terminus base of telomere on chromosomal short arm and 5'-terminus of this base sequence : 20775841
  Distance between 3'-terminus of neighbour sequence of sequence listing upward to telomere on chrosomal short arm and 5'-terminus of this base sequence : 245715
ctaagccaaagttgacaaagacagtttcttcacttgagcccttaaaaaagtaaccactataaaggtttcacgcggtgggttcttattgattcgctgtgtcatcacatcagctccactgttgccaaactttgtcgcatgcataatgtatgatggaggcttggatgggaatatgctgattttgttctgcacttaaaggcttctcctcctggagggctgcctagggccacttgcttgatttatcatgagagaagaggagagagagagagactgagcgctaggagtgtgtgtatgtgtgtgtgtgtgtgtgtgtgtgtgtgtgtatgtgtgtagcgggagatgtgggcggagcgagagcaaaaggactgcggcctgatgcatgctggaaaaagacacgcttttcatttctgatcagttgtacttcatcctatatcagcacagctgccatacttcgacttatcag

SEQ ID NO: 19578 - DNA, 446 bp, Homo sapiens
  AL157876.6_63178
  Located on chromosome 13
  Distance between a terminus base of telomere on chromosomal short arm and 5'-terminus of this base sequence : 20817678
  Distance between 3'-terminus of neighbour sequence of sequence listing upward to telomere on chrosomal short arm and 5'-terminus of this base sequence : 41377
ctcctaactggtactatgcttctctctgacccttcttaaaacttctatttccacataatgctttctcctcaaattcccacaaaaatccatccatccatcccatccatccatcccattcatccatccatccatccattcatccattccatccatccatccatccatccatccatccatccatccatcccattcatccatccatccatccattcatccatccatccacccatccactcacccattcatcccatccatccatcctatccatccatccatccatccacccattcattctttcaactctctacatagcattcaatatggtattttaaaaatacaaattaaaattagttcatttcattgcttaaaattatccaggagctttgcaaggcacttaagagaaaatctaaactccttcttcactattaccttcaagatcatgtcag

SEQ ID NO: 19579 - DNA, 301 bp, Homo sapiens
  AL139378.15_129326
  Located on chromosome 13
  Distance between a terminus base of telomere on chromosomal short arm and 5'-terminus of this base sequence : 20821175
  Distance between 3'-terminus of neighbour sequence of sequence listing upward to telomere on chrosomal short arm and 5'-terminus of this base sequence : 3051
cctcagtatgaattctttgcatgcctgattttatatatatatatatatatatatatattacagttcagtagtgttaagtatatttacattgttgtgcaacagatctccacagccttttcatcttgcaaaattgaaactctatatccattaataacatctctccattatatctttttactcgcaaccctgggcagctatcattctactttctgttgttatgaatttgactactttagatacttcagataagtgaactaatatagtatttgcctttttgtgactgtcttatttcacttagcat

SEQ ID NO: 19580 - DNA, 376 bp, Homo sapiens
  HUMUT7708
  Located on chromosome 13
  Distance between a terminus base of telomere on chromosomal short arm and 5'-terminus of this base sequence : 20860413
  Distance between 3'-terminus of neighbour sequence of sequence listing upward to telomere on chrosomal short arm and 5'-terminus of this base sequence : 38937
acgctttacccctgaaatccaaaatcttataagtttttaggagagaaagccacacgtcagagagaactttatggaatagtttattctatctatctatctatctatctatctatctatctatctatcatctatctatcaatcatctatcaatcatatctatcacaatctatcaatctatcctatctataatctatcaattaatcaatcatatctatcatcatctatcaatctatcctatctatcatctatctatatctatcatctatctatcatatctattctatcatatctatctaccatctatctatctataatatctatctatctaatctatctatctaacaggaatcaaataacaatttgggagattttaggt

SEQ ID NO: 19581 - DNA, 138 bp, Homo sapiens
  chr13.fa.O7frz.20001488
  Located on chromosome 13
  Distance between a terminus base of telomere on chromosomal short arm and 5'-terminus of this base sequence : 20958339
  Distance between 3'-terminus of neighbour sequence of sequence listing upward to telomere on chrosomal short arm and 5'-terminus of this base sequence : 97550
ctgttggagattgtgattacacttttcttatccctcagtgaagagtcagtttctgatgctgtgtctgccattgtgtgtgtgtgtgtgtgtgtgtgtgtgtggtgtgttgacttatttatttagctctgttaggctcag

SEQ ID NO: 19582 - DNA, 126 bp, Homo sapiens
  D13S1236
  Located on chromosome 13
  Distance between a terminus base of telomere on chromosomal short arm and 5'-terminus of this base sequence : 21324218
  Distance between 3'-terminus of neighbour sequence of sequence listing upward to telomere on chrosomal short arm and 5'-terminus of this base sequence : 365741
aaggggctggctcttcactttggtgcttgctttgtgtgcgcgcgcgcgcgtgtgtgtgtgtgtgtgtgtgtgtgtgtgtgtgtgttttaagagacagggtcttatgctgttacccaggccaagtgc

SEQ ID NO: 19583 - DNA, 387 bp, Homo sapiens
  chr13.fa.O7frz.20338021
  Located on chromosome 13
  Distance between a terminus base of telomere on chromosomal short arm and 5'-terminus of this base sequence : 21410925
  Distance between 3'-terminus of neighbour sequence of sequence listing upward to telomere on chrosomal short arm and 5'-terminus of this base sequence : 86581
gttcctctaggtcattagctctcggagggcaaagacttggctcgcgcctgtaatcccagcactttcggaggccagtgtgggcagatcacgaggtcaggagttcgagaccagcctggccaacatggtgaaaccctatctctactaaagatacacacacacacacacacacacacacaaaattagctgggcatggtggcgcatgcctgtaatcccagctactctggaggctgaggcaggagaatcgcttgaatccaggaggtggtggttgcagtgagctgagatcatgccattgcactccagcctgggcaacagggcgagactctgtctcaaaagaaaaaaaaaaaaagaaaaaattcagtaatatttgttggatagatgaacgcatac

SEQ ID NO: 19584 - DNA, 230 bp, Homo sapiens
  DISO7_00003065
  Located on chromosome 13
  Distance between a terminus base of telomere on chromosomal short arm and 5'-terminus of this base sequence : 21477321
  Distance between 3'-terminus of neighbour sequence of sequence listing upward to telomere on chrosomal short arm and 5'-terminus of this base sequence : 66009
acatttgctggtgacctgcccaggcaggctagagtacccttcctcattgcaccctgtgttcccatcctcttttccttccttccttccttccttccttccttccttcctttcttcctccatcccttatgaaaccctcgttgtgcagttacttattaggtgctgtgtgagcgtctgaagtctcccctcacccacttttccatttgggccacttggccagtgattgcatcagt

SEQ ID NO: 19585 - DNA, 208 bp, Homo sapiens
  D13S1275
  Located on chromosome 13
  Distance between a terminus base of telomere on chromosomal short arm and 5'-terminus of this base sequence : 21578998
  Distance between 3'-terminus of neighbour sequence of sequence listing upward to telomere on chrosomal short arm and 5'-terminus of this base sequence : 101447
tcagcatgaactttaccagaattcctttagagacagagagagcgtgtgtgtgtgtgtgtgtgtgtgtgtgtgtgtgtgtgtgtgtgtgtataggtatattctaaggtaatctgaagactagcattttttccaaaaaaagtatttaggatgatgtaagaagcaacaagacagttttctctattttcaaatggcttcttattcaagtgat

SEQ ID NO: 19586 - DNA, 338 bp, Homo sapiens
  chr13.fa.O7frz.20557918
  Located on chromosome 13
  Distance between a terminus base of telomere on chromosomal short arm and 5'-terminus of this base sequence : 21581730
  Distance between 3'-terminus of neighbour sequence of sequence listing upward to telomere on chrosomal short arm and 5'-terminus of this base sequence : 2524
taatcttcatccagaagtcattacaatggcaatatagagagagatgaaatccccatgcacacctgctttcaagagtttctagaaatgcgtctaccttgctttcaatcaacctttttctctcaagaggggtgtttgcctagccttcagtggtaataattactgatactaatcaaaaactgtgacagtggtttcctttttattatcattattattattattattattattattatactttaagttttagggtgcatgtgcacaacatgcaggtttgttacatatatatacatgtgccatgttggtgcactgcacccattaattcgtcatttagcattagg

SEQ ID NO: 19587 - DNA, 343 bp, Homo sapiens
  chr13.fa.O7frz.20640190
  Located on chromosome 13
  Distance between a terminus base of telomere on chromosomal short arm and 5'-terminus of this base sequence : 21663902
  Distance between 3'-terminus of neighbour sequence of sequence listing upward to telomere on chrosomal short arm and 5'-terminus of this base sequence : 81834
cctgaattacttgtttgatcagagaaaaacatcaacaaaagcaacaaaccatttagaaaacaaaaatcaggcagttgcatttggaggaaaacagactaagttcagaatgtggtagaaaggatgtgtgtgtgtgtgtgtgtgtgcgcgcgcgtgtgcataattctcattatctgtgaccatgagtaccacatgagccaaagtatgatacattagccaaaaaatacatatgaatatagtacgaacttttttttaacaagacagtgtcaaggtcaggggtgttaataatgccactgttctttgctcaagtcagaccacacttgaagtatcagtttcaatttcgtta

SEQ ID NO: 19588 - DNA, 339 bp, Homo sapiens
  chr13.fa.O7frz.20965529
  Located on chromosome 13
  Distance between a terminus base of telomere on chromosomal short arm and 5'-terminus of this base sequence : 21880492
  Distance between 3'-terminus of neighbour sequence of sequence listing upward to telomere on chrosomal short arm and 5'-terminus of this base sequence : 216247
caaagctagaatataagcagacagaaaaatgtgaaaacagagactggcctagcttcccagcctacatctttctcccgtactggatgcttcctgccctcgaacatcagactccaagttcttcagttttgcaactcagactggctctccttgttcctcagcctgcagatggcctgttgtgggaccttgtgatcatgtgagttaatacataataaactcccctttatatgtatgtatgtatgtgtgtgtgtgtgtgtgtgtgtgtgtgtatgtgtatacatatatatatacatatatatacatatatatatatattccactagttccacttaacatttcaac

SEQ ID NO: 19589 - DNA, 173 bp, Homo sapiens
  chr13.fa.O7frz.21076447
  Located on chromosome 13
  Distance between a terminus base of telomere on chromosomal short arm and 5'-terminus of this base sequence : 22031738
  Distance between 3'-terminus of neighbour sequence of sequence listing upward to telomere on chrosomal short arm and 5'-terminus of this base sequence : 150907
caaatttgtccactgtacctactttggttctccagccttaggaaaaatgtactctccatgtagttagactagaacaccacactacgttcttttcagcctctctctctcgctctctctcctctctccataaggctgtgtgttgaagataaaagaatttagaaattaaggtccac

SEQ ID NO: 19590 - DNA, 254 bp, Homo sapiens
  chr13.fa.O7frz.21178908
  Located on chromosome 13
  Distance between a terminus base of telomere on chromosomal short arm and 5'-terminus of this base sequence : 22181352
  Distance between 3'-terminus of neighbour sequence of sequence listing upward to telomere on chrosomal short arm and 5'-terminus of this base sequence : 149441
cgtcaaagtactttgtaatctgtaaggtttatctgacatgagaggaaatatacatatgctccaggatatctgtgtgcagacacacacacacacacacacacacacacaccatcacatatcaggcctggctgtgtcttcttacaaaggcgctgctaggcaccacctccagttctagaaccagaccagccagttcaccctccaggcattttacccttgacttcataaaacctttctacctaatccactagtgacag

SEQ ID NO: 19591 - DNA, 171 bp, Homo sapiens
  DISO7_10003711
  Located on chromosome 13
  Distance between a terminus base of telomere on chromosomal short arm and 5'-terminus of this base sequence : 22193804
  Distance between 3'-terminus of neighbour sequence of sequence listing upward to telomere on chrosomal short arm and 5'-terminus of this base sequence : 12198
gtgtgcattgaacaaatgcaaattttgtgaatcttcatttttaatgatctttacatatatatatgtgtatatatatatatatatatatatatattacaaaacagtaaatgatcactgtgtaacagtttaaattaccaatgtatttgattttactggagaaacctaggtgcc

SEQ ID NO: 19592 - DNA, 228 bp, Homo sapiens
  HUMUT1219
  Located on chromosome 13
  Distance between a terminus base of telomere on chromosomal short arm and 5'-terminus of this base sequence : 22257936
  Distance between 3'-terminus of neighbour sequence of sequence listing upward to telomere on chrosomal short arm and 5'-terminus of this base sequence : 63961
tggctaggggctctggaagtaaacaagggaatattagcctttactagacaccacaggagggcggtggttagtggagcagaggtcatttctggtttatctgctatctatctatctatctatctatctatctatctatctatctatctacctatttatttatttatttttagacagggtctcactctgtcgcccaggctggagtgcagtggtgcaacctcggctcactgc

SEQ ID NO: 19593 - DNA, 239 bp, Homo sapiens
  chr13.fa.O7frz.21863785
  Located on chromosome 13
  Distance between a terminus base of telomere on chromosomal short arm and 5'-terminus of this base sequence : 22355832
  Distance between 3'-terminus of neighbour sequence of sequence listing upward to telomere on chrosomal short arm and 5'-terminus of this base sequence : 97668
attgatttgcatatcaattaagagaagaagaagcatactattatactgtcttttacaattacctatgtaatacatttactagtgctgtgtgtgtgtgtgtgtggtgtgtgtgtgtgtgtgtgtgtgtgtatttgaattaatgtctttctttcggcctgaaaagcttctagtgtttcttgcaagtcaggcctacccgtctttgattctgttggagggtctttaattcttaaccatggttt

SEQ ID NO: 19594 - DNA, 236 bp, Homo sapiens
  chr13.fa.O7frz.21622087
  Located on chromosome 13
  Distance between a terminus base of telomere on chromosomal short arm and 5'-terminus of this base sequence : 22590562
  Distance between 3'-terminus of neighbour sequence of sequence listing upward to telomere on chrosomal short arm and 5'-terminus of this base sequence : 234491
catcaaccaatgagtggatttaaaaaatggtgtgtgtgtatatatatatatatggtacatataatataaaatatatataaaatataaaaatatggtgtgtgtgtatatatatatatatatatatacacacacataccacaggctactactcagccattaaaaaaacaaacaaataaaataatgtcttttgcagcaaatttggatggaactggaggtcattaattcaaagcgaagta

SEQ ID NO: 19595 - DNA, 270 bp, Homo sapiens
  Z24601.1_208
  Located on chromosome 13
  Distance between a terminus base of telomere on chromosomal short arm and 5'-terminus of this base sequence : 22813111
  Distance between 3'-terminus of neighbour sequence of sequence listing upward to telomere on chrosomal short arm and 5'-terminus of this base sequence : 222313
caggtcataatttcaagaatacagactacggggtattttaaaacagaaatgcatttctaccattgatattaatggcggaccatgctccataaacataatcacatatcccttatcctgaagcccaggctaaagatggacatactctgcctataccctccttgccctcccctcaccagacacacacacacatgtgcacacacacacacacacacacacactccttctcttgccatgatgggagggacaactctagtgcaacttggaaagtgt

SEQ ID NO: 19596 - DNA, 205 bp, Homo sapiens
  D13S292
  Located on chromosome 13
  Distance between a terminus base of telomere on chromosomal short arm and 5'-terminus of this base sequence : 22813180
  Distance between 3'-terminus of neighbour sequence of sequence listing upward to telomere on chrosomal short arm and 5'-terminus of this base sequence : -201
taatggcggaccatgctccataaacataatcacatatcccttatcctgaagcccaggctaaagatggacatactctgcctataccctccttgccctcccctcaccagacacacacacacatgtgcacacacacacacacacacacacactccttctcttgccatgatgggagggacaactctagtgcaacttggaaagtgtcaaa

SEQ ID NO: 19597 - DNA, 149 bp, Homo sapiens
  DISO7_10003714
  Located on chromosome 13
  Distance between a terminus base of telomere on chromosomal short arm and 5'-terminus of this base sequence : 22869201
  Distance between 3'-terminus of neighbour sequence of sequence listing upward to telomere on chrosomal short arm and 5'-terminus of this base sequence : 55816
aatgtataatttctccaagtcttcctttgtgtatgtgtgtgtctttgtgtgtgtgtgtgtgtgctttagtgtgtttgtggttctataaatcagagtgatatatatatatatatatatgtatgtatagacagagtgagaaatcaagaagg

SEQ ID NO: 19598 - DNA, 252 bp, Homo sapiens
  D13S787
  Located on chromosome 13
  Distance between a terminus base of telomere on chromosomal short arm and 5'-terminus of this base sequence : 23008776
  Distance between 3'-terminus of neighbour sequence of sequence listing upward to telomere on chrosomal short arm and 5'-terminus of this base sequence : 139426
acctgggaggcggagctcgcagtgagccgagattgctccactgcactccagcctgggagagactccgtctcaaaaaaaaaaaccaaacaaaaaacaacaacaacaacaaaaaaatctatatctatctatctatctatctatctatctatctatctatctatctatctgtaggcagaaatatacaaaaccagttacaactttagacccgctggatctaacaaatgttgtttggtttcctcctggaatcctgat

SEQ ID NO: 19599 - DNA, 468 bp, Homo sapiens
  chr13.fa.O7frz.22342143
  Located on chromosome 13
  Distance between a terminus base of telomere on chromosomal short arm and 5'-terminus of this base sequence : 23181189
  Distance between 3'-terminus of neighbour sequence of sequence listing upward to telomere on chrosomal short arm and 5'-terminus of this base sequence : 172161
ctattggtctatcttcaagttcaccaatgaattctgtcacctacattctgctactgagcccacatagtgatcttttatatattgttactttctaatttcctttgtatctaatagtttaacaattgattatcttgggatataattatatcatcttccagtcatgataattttaccacctgctatggtttgaatgtatctgctaaagttcacgtgttggaaacttgattcccacttcagtcaggatctctttgaaattaagaagtgtgtgtgtgagtgtgtgtgtgtgtgtgtgtgtgtccttgctgcctgagggtggaggaagaaattgtgaacaggaatcctgtatttgcttgtctgtgtcaggggaaaagaattataccccaattcttttccgctgatcctcaagcctgggaaattttaaaggagatgggaaacgaccccgccttcttatgaatatgcaacagtaag

SEQ ID NO: 19600 - DNA, 451 bp, Homo sapiens
  AL157364.4_181068
  Located on chromosome 13
  Distance between a terminus base of telomere on chromosomal short arm and 5'-terminus of this base sequence : 23324074
  Distance between 3'-terminus of neighbour sequence of sequence listing upward to telomere on chrosomal short arm and 5'-terminus of this base sequence : 142417
gttgtctgtatggaaatttaagaatagtgcctttagaaatcagctgctttttatcaccctgtgctggcagttctgaaggatgctggttataaaacactcttcccctacagggagaatttcttgtgccgtcctctccctccaggtgggaggacctgctaagagacagatcattgcgccccacctccagacttcccaattcaggaggactgggctggggccagagaatttgcattcatttctctttctctttccttctttctttctttctttctttctttctttctttctttctttctttctttctttctttctttcctttctttctttctctttctctctctttctctttctctctttccctctctctctttctctctttctttctctctttctctttctttctttctcttttttaaaagacaatgggtgtacaacctatttccattcctag

SEQ ID NO: 19601 - DNA, 295 bp, Homo sapiens
  AL157364.4_175402
  Located on chromosome 13
  Distance between a terminus base of telomere on chromosomal short arm and 5'-terminus of this base sequence : 23329962
  Distance between 3'-terminus of neighbour sequence of sequence listing upward to telomere on chrosomal short arm and 5'-terminus of this base sequence : 5437
gagattgcagtgagctgagatcacaccactgcattacagcgtgggtgacagagagagactctgtctaaataaacaaacaaacaaacaaacaaaatttgtttaaaattctaaagtgaaaaaaagtataatccgattatcttacaaaaccaaacaaataaacaagccccaaagttgttttcatagagggatgttatgtatactaaagggcactgcaagactcttagacttcaggtactgctgctgtgcccagaggcgggaaccctggttggttgtctaacgtggtaatttgttatga

SEQ ID NO: 19602 - DNA, 395 bp, Homo sapiens
  AL157364.4_69392
  Located on chromosome 13
  Distance between a terminus base of telomere on chromosomal short arm and 5'-terminus of this base sequence : 23384601
  Distance between 3'-terminus of neighbour sequence of sequence listing upward to telomere on chrosomal short arm and 5'-terminus of this base sequence : 54344
tttacctgtgaccatgtagtctagcttctcccaactaacaggctcatggaatggggaggggccctgactggagtggaggaatggaaaagagagggcttttgtaggcctaaggcaggagtcacctttgaagatgctctccttgttgtgatacttaacctgaggaaggctggtgatgccactcatgagggagctgttgaggatgacatcatcatcatcatcatcatcatcatattggtttgtgagcagagaaataatgtggacagacttattcagctttggggcaaggtatgcttagagagaagaaagaaaatagagctgagactttagctaaaaggcaagaaaatttatcttacttcaataaattagcttctaggtgaagacatgaggattgttaa

SEQ ID NO: 19603 - DNA, 437 bp, Homo sapiens
  AC013721.4_31219
  Located on chromosome 13
  Distance between a terminus base of telomere on chromosomal short arm and 5'-terminus of this base sequence : 23490217
  Distance between 3'-terminus of neighbour sequence of sequence listing upward to telomere on chrosomal short arm and 5'-terminus of this base sequence : 105221
caaactatcacgagatcagaaaagcaaacaccgcatgttctcactcataagtgggagttgaataatgagaacacgtggacacagggaggggaacatcacacaccagggcctgtcgggggcggtggggggctaggggaggagaaatagctaatgtaggtgatgggttgaggagcgcagcaaaccaccatggcacgtgttatagctatgtaacaaaactgcacgtcctgcacatgtaacccagaacttcaggtataataaaaaaaaaagaaagaaagaaggaatgaaggaaggaaggaaggaaggaaagaaaagaaaaagagagaaagaaagaaagaaaggaaggaagaaagaaagaagaaagaaagaaagaaagaaagaaagaaagaaagaaagaaagaaagaaagaaggaaagattagtcttcctattcaagaacag

SEQ ID NO: 19604 - DNA, 473 bp, Homo sapiens
  AC013721.4_182304
  Located on chromosome 13
  Distance between a terminus base of telomere on chromosomal short arm and 5'-terminus of this base sequence : 23626781
  Distance between 3'-terminus of neighbour sequence of sequence listing upward to telomere on chrosomal short arm and 5'-terminus of this base sequence : 136127
tccaacattagaggttaatcatagcactaattaaatatcatgcaaccattagaatactgttctgtccttcattttattttactttattttattttattttattttattttattttattttgagatggagtttcactcttgttgcccaggctggagtgcaatggtgcgatatcagctcactgcaacctctgcctcccaggttcaagcaattctcctgcctcagcctcctgagtagctgggattacaggtgcccaccaccacgcctggctaattttttgtatttttagtagagatggggtttcaccatgttggccaggctggttttgaactcctgacctcaggtgatccaccctccttggcctcccaaagtgctgggattacaggtgtgagccaccatgcccacccctgtccttcattctctcaacaagtaaatatctctcagtggtaatttatgtgcagccttgcttagtatac

SEQ ID NO: 19605 - DNA, 211 bp, Homo sapiens
  chr13.fa.O7frz.22711235
  Located on chromosome 13
  Distance between a terminus base of telomere on chromosomal short arm and 5'-terminus of this base sequence : 23715871
  Distance between 3'-terminus of neighbour sequence of sequence listing upward to telomere on chrosomal short arm and 5'-terminus of this base sequence : 88617
ggtagagaaatttggtattgaatataggagtgtttgtctttgtcctctattttttatctatcacctatttatctccttttgtgtgtaaaattttataacaaaaaatgaaaatcttatatattcagaaatacaatacacacacacacacacacacacacacacactactgtggtcccagtgtgagggcagaagacctgatttcattaatggt

SEQ ID NO: 19606 - DNA, 254 bp, Homo sapiens
  D13S1243
  Located on chromosome 13
  Distance between a terminus base of telomere on chromosomal short arm and 5'-terminus of this base sequence : 23799181
  Distance between 3'-terminus of neighbour sequence of sequence listing upward to telomere on chrosomal short arm and 5'-terminus of this base sequence : 83099
ctcttgtgcaggtataggggtatgattccatctacctccccccttatttttaatgagaaaatcctatttaatggtatctcactagagaaactattctagaaatgagccactggaaagttcaaaactacaggtatacgataattttatttagattctgcatttgtagaaataatcttatcagtgtgtgtgtgtgtgtgtgtgtgtgtgtgtgtgtgtgtgtgtttaagtgtataaagttctgtagcctgtcagca

SEQ ID NO: 19607 - DNA, 389 bp, Homo sapiens
  chr13.fa.O7frz.23342311
  Located on chromosome 13
  Distance between a terminus base of telomere on chromosomal short arm and 5'-terminus of this base sequence : 24018747
  Distance between 3'-terminus of neighbour sequence of sequence listing upward to telomere on chrosomal short arm and 5'-terminus of this base sequence : 219312
tggatagcattgacatcttaacaattttaagtcatcttatccatgaacaccggatttttttcatttagttagatcttatttaatatctttcaacagttttgtgtggttttcagcataacaatttttggcccatttgctcaagtttattcttaattcttttagatgttgttgtaaacggaattgcttttttaaatttcctcttcaatttgctcatttactaatgtattaaaacacaactgatttttacatgtgaattttgtgtctagcaactttgctgaattaatttggtagccctaacggggtgtgtgtgtgtgtgtgtgtgtgtgtgtgtgtgtgtgtgtgtgtgtataatttggggggattttcttacatagaagatcatgtcatcc

SEQ ID NO: 19608 - DNA, 432 bp, Homo sapiens
  chr13.fa.O7frz.23444064
  Located on chromosome 13
  Distance between a terminus base of telomere on chromosomal short arm and 5'-terminus of this base sequence : 24158602
  Distance between 3'-terminus of neighbour sequence of sequence listing upward to telomere on chrosomal short arm and 5'-terminus of this base sequence : 139466
ccaatcactacatgcataaataattattaataatcttttctagttgcaatactattgtgtgtgtgtgtgtgtgtgtgttttcgtttgttttttgttttttgagacagagtctcactgtcacccaggctggagtgcagtggcgtgatctcggctcacggcaacctctgtctcccaggttcaagtgattcttgtgcctcagcctcccgagtagctgggactataggcacatgccatcatacccagctaatttttgaatttttagtagagatggggtttcactatattagccaggctggtctcaaactcctggcttcaagtgatctgcctgcctgggcctcccaaagtgctggattacaggcatgagccactgcacccggcctgttgtttatgtcttttaaaggccaacatgtttgagtgttatcatgaaccact

SEQ ID NO: 19609 - DNA, 129 bp, Homo sapiens
  D13S283
  Located on chromosome 13
  Distance between a terminus base of telomere on chromosomal short arm and 5'-terminus of this base sequence : 24230456
  Distance between 3'-terminus of neighbour sequence of sequence listing upward to telomere on chrosomal short arm and 5'-terminus of this base sequence : 71422
gccattccaagcgtgtttgtttcatttgtttttttttcctaccttaagcccagtctaggtgagttctgggtgctgtgtgtgtgtgtgtgtgtgtgtgttttaattgcagtaagaatattgaatatgaga

SEQ ID NO: 19610 - DNA, 112 bp, Homo sapiens
  DISO7_10003718
  Located on chromosome 13
  Distance between a terminus base of telomere on chromosomal short arm and 5'-terminus of this base sequence : 24235530
  Distance between 3'-terminus of neighbour sequence of sequence listing upward to telomere on chrosomal short arm and 5'-terminus of this base sequence : 4945
ctggattaggattaagtaggagcatttttacaattaaatgtgtgagaagatgtgatagatatatatatatatatatatgtatatatatattaggtagccaagaggttactcc

SEQ ID NO: 19611 - DNA, 435 bp, Homo sapiens
  chr13.fa.O7frz.23647903
  Located on chromosome 13
  Distance between a terminus base of telomere on chromosomal short arm and 5'-terminus of this base sequence : 24304450
  Distance between 3'-terminus of neighbour sequence of sequence listing upward to telomere on chrosomal short arm and 5'-terminus of this base sequence : 68808
agatgtttcaccagatttgacaatgcgttccatggagtagtgttgcctctgagaagcagctgcttgtttagaggctgtgtgtcccagctcctttctgcatcaggacagggcatgtcactagcccttacccaggggatgttagtgggagtgatgcatgtctttcaaggcaaggcagttaagaaactgatgggctctccaatgtcactttccccatccactgggtgaagaacattgcaattccttgagagaggagccacaggacagagggagtgtgcatgtgtgtgtgtgtgtgtgtgtgtatatatatacgtatacacacacacatatatatatatatagagagagagagagagagagatacggtcttgttttgtcttccatattggagtacagaggtgggatcatagctcactgtagtcttgaattcctaggctc

SEQ ID NO: 19612 - DNA, 101 bp, Homo sapiens
  DISO7_10003716
  Located on chromosome 13
  Distance between a terminus base of telomere on chromosomal short arm and 5'-terminus of this base sequence : 24378067
  Distance between 3'-terminus of neighbour sequence of sequence listing upward to telomere on chrosomal short arm and 5'-terminus of this base sequence : 73182
ttgagaacttaacgtcgtcgtcatcatcatcatcatcatcatcatcatcacatcatcatcacatcatcatttccttttttagggtgccttcaaagcagtcc

SEQ ID NO: 19613 - DNA, 240 bp, Homo sapiens
  chr13.fa.O7frz.23834746
  Located on chromosome 13
  Distance between a terminus base of telomere on chromosomal short arm and 5'-terminus of this base sequence : 24574902
  Distance between 3'-terminus of neighbour sequence of sequence listing upward to telomere on chrosomal short arm and 5'-terminus of this base sequence : 196734
aatagatcaagtgaccttggacaagtcatcttacctctcgatggttttgttttatgaaagaaggtgtgtgtgtgtgtgtgtcgatgggtgtgtgtgtgtgtgtgtcgatgggtctgtgtgtgtgtgtgtgtgtgtcgatgggtgtgtgtgtgtgtgtgtgtgcgtgcgggggttgagaaggttgctgttaaggttccctagggctacctgcagctttaatatgcgtagttagaatgtcag

SEQ ID NO: 19614 - DNA, 249 bp, Homo sapiens
  DISO7_10003719
  Located on chromosome 13
  Distance between a terminus base of telomere on chromosomal short arm and 5'-terminus of this base sequence : 24639424
  Distance between 3'-terminus of neighbour sequence of sequence listing upward to telomere on chrosomal short arm and 5'-terminus of this base sequence : 64282
gaacaagaatcttatttatgcttcccctaaattttattttaaactgtagactaaaatgatcttatgaaaaatgtcacgcagttaagaaaaagcatcgtgtgtgtgtgtgtgtgtgagtgtgtgtgtgtgtgtgtgagtgtgtgtgtgtgtgtgtgtatgtgtgtgtgagtgtgtgtatgtgtgtgtgtctttcagactaaatttaagccaccggcaatctttttattgggtcatagccataaagcttca

SEQ ID NO: 19615 - DNA, 405 bp, Homo sapiens
  chr13.fa.O7frz.23925350
  Located on chromosome 13
  Distance between a terminus base of telomere on chromosomal short arm and 5'-terminus of this base sequence : 24665273
  Distance between 3'-terminus of neighbour sequence of sequence listing upward to telomere on chrosomal short arm and 5'-terminus of this base sequence : 25600
accaggaaatttcagctaatagaaatttaagtgattatttccttgagatgggagttgggatataatcaggttgtgaattgcaaaagaacttaatttatataagggctcagcaaaccatggcctgtaaagtaagactggtttttacgtttttaaagatgtgtgaggaagaagaagaaggagaagaagaaggaggaggaggaggaggaggaggaggaagaaggagactatgagatagagaccatatgtggccacaaagcctaaaatattcaccaactgacactttacagaaaaatttgccaacccttgatttatgtaatcgatttctattttgcagataaggaaaccaaggctcagatggtagcctgcttacctaagctcacaagaagcaacctgttctattaaagg

SEQ ID NO: 19616 - DNA, 169 bp, Homo sapiens
  DISO7_10003720
  Located on chromosome 13
  Distance between a terminus base of telomere on chromosomal short arm and 5'-terminus of this base sequence : 24713702
  Distance between 3'-terminus of neighbour sequence of sequence listing upward to telomere on chrosomal short arm and 5'-terminus of this base sequence : 48024
agcctagagctcacagtacaagacaagaaatttctttctctctctgactccctgcctttgtctgttcccgtctgtctgtaacacacacacacacacacacacacacacacacacacacacacacacagagaatgttgaaataaatggatggattacagattgtacactt

SEQ ID NO: 19617 - DNA, 159 bp, Homo sapiens
  AL136438.10_126914
  Located on chromosome 13
  Distance between a terminus base of telomere on chromosomal short arm and 5'-terminus of this base sequence : 25026538
  Distance between 3'-terminus of neighbour sequence of sequence listing upward to telomere on chrosomal short arm and 5'-terminus of this base sequence : 312667
gtttacaggaacatgttcttttcttgccaggtgcttgatactaaaacacacacacacacacacacacacacacacacacacacacacacttttttccccttcttgctgtgactgcttcacagtgctttgtgtgtctcataggccatatacttgaagact

SEQ ID NO: 19618 - DNA, 251 bp, Homo sapiens
  D13S1294
  Located on chromosome 13
  Distance between a terminus base of telomere on chromosomal short arm and 5'-terminus of this base sequence : 25364199
  Distance between 3'-terminus of neighbour sequence of sequence listing upward to telomere on chrosomal short arm and 5'-terminus of this base sequence : 337502
gaccccaattctatgtgttcagcccagacctcttcctgaaccacaggcccacgctggttgagtgaatttccagttttcagtacgacatttcctcctaaatgtctgtggtctttcggtccctgaaaatcaactgtcaaactattaactgactttatacatcctcagcatgcacacacacacacacacacacacacacacacacgtaaatgcacatggcaggggttggggcacaaagtagataaaaactcctg

SEQ ID NO: 19619 - DNA, 235 bp, Homo sapiens
  D13S221
  Located on chromosome 13
  Distance between a terminus base of telomere on chromosomal short arm and 5'-terminus of this base sequence : 25464156
  Distance between 3'-terminus of neighbour sequence of sequence listing upward to telomere on chrosomal short arm and 5'-terminus of this base sequence : 99706
gagatcatgcagcacttgtcttactgtgcccggtttatttcatttagcatagtgtcctcttggtttatccatgttatagcaaacgataggatgtcctttttaaggctgaatagtattccactgtgtgtgtgtgtgtgtgtgtgtgtgtgtgtgtgtgtgtgtgtgtgtatgtaccacagtttcttcatccactcattcattgatggacacctaggttgatttcctatcatggcta

SEQ ID NO: 19620 - DNA, 440 bp, Homo sapiens
  chr13.fa.O7frz.24655144
  Located on chromosome 13
  Distance between a terminus base of telomere on chromosomal short arm and 5'-terminus of this base sequence : 25619036
  Distance between 3'-terminus of neighbour sequence of sequence listing upward to telomere on chrosomal short arm and 5'-terminus of this base sequence : 154645
caaacaagtcatcctcagtaacaatcaaagaagtgaaaacaaacagatatttttcactttgcaggttgacaaagattaaaaggattgaccaattccagcatcagtgaggacatgaagaaatgtgaatcctcaagctgacagcataatctttctggaagattatttgacacttgtataaaagtataaacagagtgtgtcctttggtctagaaactttactctggttaatttattgtagttgcccacagaataagagatagcataaagagaaaaagagatggatggatggatggatggatggatggatggatggatggatagatggatagatggatggctagctagctagaagatagatagatagatagatagatagatagatagatagatagaagaagtcattggatggataaatagatgaatagatggacggatagctag

SEQ ID NO: 19621 - DNA, 402 bp, Homo sapiens
  chr13.fa.O7frz.24859085
  Located on chromosome 13
  Distance between a terminus base of telomere on chromosomal short arm and 5'-terminus of this base sequence : 25823436
  Distance between 3'-terminus of neighbour sequence of sequence listing upward to telomere on chrosomal short arm and 5'-terminus of this base sequence : 203960
tcagaccataggaatgatttatactaaatcaacatctaagtattaaagacttggttttgatgtattttctaagaaaattaattgaaagtagagtagtagttatatgactggcctagtagccattaatttttgtaaagtacatgtattagagttctccagagaaacagagtcaataggatagataggtagatgtatgtgtggatgatagatgatagatggatggatggatggatggatggatggatggatggatggatggatagatagatgaatgacagagcatttgctagaggaatcggcttatgcaattatggaggctgagaagtcccatgatatgccaactgccagctgaagaaacagggaagctggttgcatggttcagtctaaatccagatgacctga

SEQ ID NO: 19622 - DNA, 443 bp, Homo sapiens
  chr13.fa.O7frz.25072789
  Located on chromosome 13
  Distance between a terminus base of telomere on chromosomal short arm and 5'-terminus of this base sequence : 25952749
  Distance between 3'-terminus of neighbour sequence of sequence listing upward to telomere on chrosomal short arm and 5'-terminus of this base sequence : 128911
tttcggctaagtagaatatgttaaaattgatgtctttcgattctttctacttttttaaaacagggctgctggaaatttttagattatctctagtctatacggtgatgacgcctacattttctaactctagcctctggtctctaggttttagaatgttgtactaatcagggttctccagagaaacagaactaatagtgtgtgtgcatgtacgtgtgtgtgcgtccgtgtgtgtgtgtgtgtgtgtgtgtgtgtgtagaggtttattctaggtaattggtccatgtgattataggggttggcacatctgaaatttgaagggcaggctggcagcctgcagactcaggaaagaggtgatgttgctggagtctggagggagactgctggcagaattccttcttccatgggagacctcggtcattttctcttaaggccttcaactaatc

SEQ ID NO: 19623 - DNA, 446 bp, Homo sapiens
  chr13.fa.O7frz.25416323
  Located on chromosome 13
  Distance between a terminus base of telomere on chromosomal short arm and 5'-terminus of this base sequence : 26257132
  Distance between 3'-terminus of neighbour sequence of sequence listing upward to telomere on chrosomal short arm and 5'-terminus of this base sequence : 303940
gtcctatgtcgatttaatttgtagaccaaccaaagaactagaagggtagaaggaagcaatatttcctcctctacagagacagggatacagggagagggagagtggggacttctgaggctggacatgtaggtagaggccagaacaaaaaaggccataacactatcacaggccctttgtagctcaggctgaggtctggtggctgtcgctctgttctgcacacgaacattctagtgctacagggtattccgtgtgtgtgtgtgtgtgtgtgtgtgtgtgtgtgtgtgtgtgtgtgcaggtggagaggactcaggagaataatggtactgttccagcactgttttacgattcctaataaccaaattctcctaagcaaaggctggtatgtagatgatagtgtcacactgcaagaaacatttgattaagttattgagtgatcaaatgatctt

SEQ ID NO: 19624 - DNA, 159 bp, Homo sapiens
  D13S1304
  Located on chromosome 13
  Distance between a terminus base of telomere on chromosomal short arm and 5'-terminus of this base sequence : 26257354
  Distance between 3'-terminus of neighbour sequence of sequence listing upward to telomere on chrosomal short arm and 5'-terminus of this base sequence : -224
acattctagtgctacagggtattccgtgtgtgtgtgtgtgtgtgtgtgtgtgtgtgtgtgtgtgtgtgtgcaggtggagaggactcaggagaataatggtactgttccagcactgttttacgattcctaataaccaaattctcctaagcaaaggctggt

SEQ ID NO: 19625 - DNA, 224 bp, Homo sapiens
  D13S1254
  Located on chromosome 13
  Distance between a terminus base of telomere on chromosomal short arm and 5'-terminus of this base sequence : 26405724
  Distance between 3'-terminus of neighbour sequence of sequence listing upward to telomere on chrosomal short arm and 5'-terminus of this base sequence : 148211
ctattggggactgcagagagcagaagagaagcgtgtgtgtgtgtgtgtgtgtgtgtgtgtgtgtgtgtgtgtgtgtgcgtgcgtaggaatttcccttcttgagagaccctatcaagtcactagactggtagaacagatcaaagacagacataatatttctggttttcaggaagaccatttcataatatttcagggagaatgttatcgtcaagatgaagtaattt

SEQ ID NO: 19626 - DNA, 82 bp, Homo sapiens
  Z67165
  Located on chromosome 13
  Distance between a terminus base of telomere on chromosomal short arm and 5'-terminus of this base sequence : 26458253
  Distance between 3'-terminus of neighbour sequence of sequence listing upward to telomere on chrosomal short arm and 5'-terminus of this base sequence : 52305
cacctgcctcactggatcacgtgtgtgtgtgtgtgtgtgtgtgtgtattaaatgaggtaagatgcgcaaagcacttagcatt

SEQ ID NO: 19627 - DNA, 455 bp, Homo sapiens
  chr13.fa.O7frz.25855778
  Located on chromosome 13
  Distance between a terminus base of telomere on chromosomal short arm and 5'-terminus of this base sequence : 26548431
  Distance between 3'-terminus of neighbour sequence of sequence listing upward to telomere on chrosomal short arm and 5'-terminus of this base sequence : 90096
ttaatgaacaactcaattcaactatttgatggggccaaataacacagacatctgtacaggcaggagagggggaagtcaaagcagaggggaaggggctgtgtgtgtgtgtgtgtgtgtgtgcgtgtgtgagagtgtgtgtgtgtttatgcatgtgtgtgcatacagggagcgggggcaggaaggcagagagaataagctgggttaacaaaaggtgcaccgaccaaataagtaaatatagtggggagggatgtgtgtgtgtgtgtgtgtgtgtgtgtgtgtgcgcgcacgctcgtgtgcatgcagggagcgggggcaggaaggcagagagaataagctgggttacctaaaggtgcaatgaccaaataagtaaatctagtaaggataatagcagccaactgtactgtcagaaaaaggaattacaaatactgtggtggtggctacaagattatcactgt

SEQ ID NO: 19628 - DNA, 303 bp, Homo sapiens
  chr13.fa.O7frz.26159920
  Located on chromosome 13
  Distance between a terminus base of telomere on chromosomal short arm and 5'-terminus of this base sequence : 26794835
  Distance between 3'-terminus of neighbour sequence of sequence listing upward to telomere on chrosomal short arm and 5'-terminus of this base sequence : 245949
ataagcattgtggaactgtaatacaattatacaatttgaagttgctgttctctcttgcatgcatatgcatgtatgtatgtatacatatatacacacatatattacataagtaatacattcttctagtaatagatccaatgatatacaaatgtttctgttcccacagactgctcaatgtgcaattctccagtcccctttctatgcattttaagcacatttatatatatatatatatatatacacatacatatatatatatctagtcacatatcaacaaaactgagatcaggttatctaatctga

SEQ ID NO: 19629 - DNA, 434 bp, Homo sapiens
  chr13.fa.O7frz.26312392
  Located on chromosome 13
  Distance between a terminus base of telomere on chromosomal short arm and 5'-terminus of this base sequence : 26946496
  Distance between 3'-terminus of neighbour sequence of sequence listing upward to telomere on chrosomal short arm and 5'-terminus of this base sequence : 151358
ttatttcaggaaacaagaaataagacaattataagtagtattcttagaaatatccaggcatggcctggcgcagtggctcaggccggtaatctcagcactttgggaggctgaggcaggcagatcacttgaggccgggggttcgagaccggcctggccaacatggagaaacacagtctctactgaaaatacaaaaattagccagtcatggtggtgcacacctgtagtcccagctacttgggaggctgaggcaggaggatcacttgaacctgggaggtggaggttgcagtgagcagagattgtgccactgcactccagcctgggcaatagagggagactctctctgtgtgtgtgtgtgtgtgtgtgtgtgtgtgtgtgtgtgtatagtttttggatatgtatatatccaagcagatattccttcaataaagcaagag

SEQ ID NO: 19630 - DNA, 96 bp, Homo sapiens
  D13S1244
  Located on chromosome 13
  Distance between a terminus base of telomere on chromosomal short arm and 5'-terminus of this base sequence : 27134267
  Distance between 3'-terminus of neighbour sequence of sequence listing upward to telomere on chrosomal short arm and 5'-terminus of this base sequence : 187337
tcaacaagtggattaagaaactgtgatacacacacacacacacacacacacacacacacacacacatatgatggcatacttctcagccataaacag

SEQ ID NO: 19631 - DNA, 155 bp, Homo sapiens
  HUMUT558
  Located on chromosome 13
  Distance between a terminus base of telomere on chromosomal short arm and 5'-terminus of this base sequence : 27175305
  Distance between 3'-terminus of neighbour sequence of sequence listing upward to telomere on chrosomal short arm and 5'-terminus of this base sequence : 40942
ttttgtaatgcctcaaccatgaattcagtatacaaataagatggagctatatttattcattcaacaagtatttatttatttatttatttatttatttatttatttatttatttttgagacagagtctcactctgtcgcccaggcagaagtacagt

SEQ ID NO: 19632 - DNA, 401 bp, Homo sapiens
  AL390738.4_3467
  Located on chromosome 13
  Distance between a terminus base of telomere on chromosomal short arm and 5'-terminus of this base sequence : 27177383
  Distance between 3'-terminus of neighbour sequence of sequence listing upward to telomere on chrosomal short arm and 5'-terminus of this base sequence : 1923
ggtaaggcttcagttacagtaagaagccaacttagtaggttatgaatcactttcgtgggacatgactgagctttaaaaaaactaaaagagaatgtatataaaagaacagaaaatataagagcataatattggatgaggtttagataaaattgttttgtaaaattattttttgtttagtgtgtgtgtgtgtgtgtgtgtgtgtgtgtgtgtgtgtactggatatagacataaaatccatttcttattgtgggttggagtgagaagagtttgaaagccacagcattaggtgattataggaccctatggcgacaagaatccctatggtgatgaatggcctgggtggcttggaaatgggaagaaaagtgaggcatgatgggattaatgccattgatctagtaagg

SEQ ID NO: 19633 - DNA, 386 bp, Homo sapiens
  AL390738.4_86357
  Located on chromosome 13
  Distance between a terminus base of telomere on chromosomal short arm and 5'-terminus of this base sequence : 27260228
  Distance between 3'-terminus of neighbour sequence of sequence listing upward to telomere on chrosomal short arm and 5'-terminus of this base sequence : 82444
gtctgcacagcctaagacatacaggttgaaagcctagggcagtcagaggcctgctggctgaacagaatttacagggcttctagagtctttccaagaatatcctatccatatatttcatggccctgtagacaataggctccctctgcagtcaggtccatgagtacccacaaggccaacctttggaggaaaaattttaggaggctgaggtggcatctctcaagtctctctctctctctctctctccccaccccccccccccacacacacacacatacactcgccaccacaattagggttcttcttgaagcacatataggcatttgttaacaccttctctcttgaagacattgttttgttaatgcctacatgtctgaaactgaacttca

SEQ ID NO: 19634 - DNA, 437 bp, Homo sapiens
  AL353195.3_180363
  Located on chromosome 13
  Distance between a terminus base of telomere on chromosomal short arm and 5'-terminus of this base sequence : 27300558
  Distance between 3'-terminus of neighbour sequence of sequence listing upward to telomere on chrosomal short arm and 5'-terminus of this base sequence : 39944
aaaccttgctaggttgctatagcattttgatttgcttccatccaacatccaaagtatgatttggtcaagaaaggctgggtgcagtggctcacgcctgtaatcccagcactttgagaggccgaggcaggcggatcacaaggtcaggagatcgagaccatcctggataacacggtgaaaccccgtctctactaaaaatacaaaaaaatgagccgggtgtggtggagggcgcctgtagtcccagctacttgggaggctgaggcaggagaatggcatgaacccgggaggcggagcttgcagtgagccgagattgcgccactgcactcccgcctgggtgacagagtgagactcctcaaaaataaaataaaataaaataaaataaaataaaataaaataaaataaaataaaataaaaaagtatgatttggtcaagaacatcta

SEQ ID NO: 19635 - DNA, 388 bp, Homo sapiens
  AL353195.3_202476
  Located on chromosome 13
  Distance between a terminus base of telomere on chromosomal short arm and 5'-terminus of this base sequence : 27326971
  Distance between 3'-terminus of neighbour sequence of sequence listing upward to telomere on chrosomal short arm and 5'-terminus of this base sequence : 25976
acgatgacaggtacctgtagtcccagctattcggaagactgaggcaggagaattgcttgaacccaggagttggaggttgcagtaagccgagatcatgccattgcactccagcctgggtgacagagcgagacttcttctcaaaataataataataataataataataataataataataatatccacctctcagagctgttatggccattaaataaattaatatgtgggcagtacccgatagagtgcctagcacatgctgggtgttatgtaactgattgctattattatttatcacggtggagaaccaacagagaatgctgaaactgaaaaaaaaaaatcaagaagtaaccattcaattatattatttacagacctggacataaatacc

SEQ ID NO: 19636 - DNA, 194 bp, Homo sapiens
  AL390738.4_173670
  Located on chromosome 13
  Distance between a terminus base of telomere on chromosomal short arm and 5'-terminus of this base sequence : 27347723
  Distance between 3'-terminus of neighbour sequence of sequence listing upward to telomere on chrosomal short arm and 5'-terminus of this base sequence : 20364
atgagatttaggtggagacaaagagccaaactctatctctgtgtgtgtgtgtgtgtgtgtgtgtgtgtttgtgtgtgtacatacacatattttaaagaggatgaaaagacatgtcacatgggagaaaatatttgtaaaccacgtatgcaatagaagacttgaatctagaatatgtaaagaactcacgaaacttg

SEQ ID NO: 19637 - DNA, 348 bp, Homo sapiens
  chr13.fa.O7frz.26816623
  Located on chromosome 13
  Distance between a terminus base of telomere on chromosomal short arm and 5'-terminus of this base sequence : 27519779
  Distance between 3'-terminus of neighbour sequence of sequence listing upward to telomere on chrosomal short arm and 5'-terminus of this base sequence : 171862
gatttaggaatcatgcattctatttaaattttatagatttgttccgttcccacagcccttgttactgtctacttctttttctttgtttttgacagttttaatgtgaactgtccagactgcctcctacacttcacttttctttctagaaaattgtgtgtgtgtgtgtgtgtgtgtgtgtgtgtgtgtatcctttgacccaaaatatatccattgtgaaccaggtgttgcacaatgacagctttgcttgtaccctgaaggatgaacagtaactactcatgcgtgccttttgtgaagtagacatagcagttagttagcatttgttgaacctgttgaatccaaatgtacatc

SEQ ID NO: 19638 - DNA, 339 bp, Homo sapiens
  chr13.fa.O7frz.26906303
  Located on chromosome 13
  Distance between a terminus base of telomere on chromosomal short arm and 5'-terminus of this base sequence : 27659745
  Distance between 3'-terminus of neighbour sequence of sequence listing upward to telomere on chrosomal short arm and 5'-terminus of this base sequence : 139618
aaatttacattggaatagaagtgtataaagtcaaaataaatcagtctcctcatcttattgtccagggttaatcattattaatagtctgtgtgtttagatcttttctacacattgtatggtatagacatatatctagtatatatattaaaatatatgtataccatatatacctaaatatatatattttttcctctttctctgtctctctctctctctctctctctctcatattagcttgggttgccaaaagaaaatattataggctgggtagttaacttccccctgcccctcctccccccatagatccaggaacttgagtggctaggtggtttaaataac

SEQ ID NO: 19639 - DNA, 162 bp, Homo sapiens
  D13S1250
  Located on chromosome 13
  Distance between a terminus base of telomere on chromosomal short arm and 5'-terminus of this base sequence : 27863033
  Distance between 3'-terminus of neighbour sequence of sequence listing upward to telomere on chrosomal short arm and 5'-terminus of this base sequence : 202949
ctccacagtgacagtgaggtttaatgcggccttgctgtacacacacacacacacacacacacacacacacacatgcgcacacgcacacacacacacacgcacacattcttgcttatgctgcaaataaattttgtggaatttgattgggattgggatcctctc

SEQ ID NO: 19640 - DNA, 345 bp, Homo sapiens
  chr13.fa.O7frz.27309217
  Located on chromosome 13
  Distance between a terminus base of telomere on chromosomal short arm and 5'-terminus of this base sequence : 27994813
  Distance between 3'-terminus of neighbour sequence of sequence listing upward to telomere on chrosomal short arm and 5'-terminus of this base sequence : 131618
gaacctaagccagttaacagtctcccagcaggaaggctcatctcaaggaaaatatctcctgggaagcaattctctagaagatgggcagtgtagatcctcattctcaatcctgagtctacagtcgagtcaggagaacatggccagcttagccaaaaatgagaaaatggtcactggacctagaagataacccaaatggaaggaacagaatattgcctgtgtattgggagaattgttgccagctcctggccatatttctcctaacctcctccgcttatacacacacacacacacacacacacacacacacacacacacatacacgtacttagaaggtgaaccaatgag

SEQ ID NO: 19641 - DNA, 244 bp, Homo sapiens
  D13S1242
  Located on chromosome 13
  Distance between a terminus base of telomere on chromosomal short arm and 5'-terminus of this base sequence : 28084581
  Distance between 3'-terminus of neighbour sequence of sequence listing upward to telomere on chrosomal short arm and 5'-terminus of this base sequence : 89423
gtgcccagccagattctttatgttttaagagacaatgtcaacaacgacaaaaaaattcttggtggggtaaagaagtattttatcataggcgcacgcacacacacacacacacacacacacacacacacacacacacacaatgtgtatatattgttttgtgtactaaagtgaaggacttgtttggacaattggagagtgagtttgtggcacttcctgaggaaatatgcaaaacctgactgggggc

SEQ ID NO: 19642 - DNA, 459 bp, Homo sapiens
  AL359454.2_16653
  Located on chromosome 13
  Distance between a terminus base of telomere on chromosomal short arm and 5'-terminus of this base sequence : 28097952
  Distance between 3'-terminus of neighbour sequence of sequence listing upward to telomere on chrosomal short arm and 5'-terminus of this base sequence : 13127
tcagtcctaatctgtaaaacgtaggggctgaaggaggaagcgggatggagtggagaccattagaattaatgtatgaggccaggcgcagtggctcacacctgtaatcccagcactttgggaggccaagacaggcagatcaggaggtcaggagatcgagaccatcctggctaacatggtgaaaccccatctctactaaaaatacaaaaaattatccaggcgtggtggcacgtgcctgtagtcccagctactcgggaggctgaggcaggagaattgtttgaatatggggggccaaggttgcagtgagccaagatcgtgccactgcactccagccggggcaacagagagagactccatctcaaaataataataataataataataataataataataataataataataaatgtataaaaagtgaagtccctggtacctgttaaatgttcagtaggtgtttgt

SEQ ID NO: 19643 - DNA, 378 bp, Homo sapiens
  AL359454.2_121619
  Located on chromosome 13
  Distance between a terminus base of telomere on chromosomal short arm and 5'-terminus of this base sequence : 28100908
  Distance between 3'-terminus of neighbour sequence of sequence listing upward to telomere on chrosomal short arm and 5'-terminus of this base sequence : 2497
ggaaggcatgtgacatacttcctccctccctacactaaatgttccttacttcctatctctctccacagggctcacctcctattgtattttggcccttgtttctttcttcttcttcttcttcttcttcttcttcttcttcctcttcttcttcttcttcttcttcttcttcttcttcttcttcttcttcttcttcttcctcatcgtcgtcttcttcttcttcttcttctttcttttttgaaacagggtctttgctgtgtcacccaggctagagtgcagtggcatgatcacagctcactgtagcctcaaactcctgggttcaagtgatcttcccatctcagcctcctgagtagctgggagtagctgagtagctacaggtgc

SEQ ID NO: 19644 - DNA, 172 bp, Homo sapiens
  D13S217
  Located on chromosome 13
  Distance between a terminus base of telomere on chromosomal short arm and 5'-terminus of this base sequence : 28311388
  Distance between 3'-terminus of neighbour sequence of sequence listing upward to telomere on chrosomal short arm and 5'-terminus of this base sequence : 210102
aacctggtggacttttgctgtcttttccctatttcactctgtgtgtgtgtgtgtgtgtgtgtgtgtgtgtgtgtgtgagagagagagagagagagagagagagagaaattgtaaagcataagtaaaaactgaaagatggccaggcagtggctcatgcctgtgatcccagcat

SEQ ID NO: 19645 - DNA, 119 bp, Homo sapiens
  DISO7_10003723
  Located on chromosome 13
  Distance between a terminus base of telomere on chromosomal short arm and 5'-terminus of this base sequence : 28682487
  Distance between 3'-terminus of neighbour sequence of sequence listing upward to telomere on chrosomal short arm and 5'-terminus of this base sequence : 370927
tttgcagacaccacaacacacatttgtctcctttcactttatgaatctgtgtgtgtgtgtgtgtgtgtgtgtgtgtgaagaatatgttataatgccagtatcatttctaggtcatgtac

SEQ ID NO: 19646 - DNA, 104 bp, Homo sapiens
  DISO7_10003722
  Located on chromosome 13
  Distance between a terminus base of telomere on chromosomal short arm and 5'-terminus of this base sequence : 28684734
  Distance between 3'-terminus of neighbour sequence of sequence listing upward to telomere on chrosomal short arm and 5'-terminus of this base sequence : 2128
aacacaggatctcatttagcaggaaggcttggtgagtgagtgagagagagagagtgtgtgtgtgtgtgtgtatgtgtgtgtgttgggtgggtaattgtagcgaa

SEQ ID NO: 19647 - DNA, 200 bp, Homo sapiens
  DISO7_10003721
  Located on chromosome 13
  Distance between a terminus base of telomere on chromosomal short arm and 5'-terminus of this base sequence : 28695290
  Distance between 3'-terminus of neighbour sequence of sequence listing upward to telomere on chrosomal short arm and 5'-terminus of this base sequence : 10452
actcggttaccagggttgtttactctaataataaattcatatgagtgattttaataggttttctaataaaggattttaaaaggcattttgaaatttctgttatatgtagagctttttcagaaatcattataatttatatactactgtgtgtgtgtgtgtgtgtgtgtgtgtgtgtgtgtactggagtgtttgatcaggac

SEQ ID NO: 19648 - DNA, 158 bp, Homo sapiens
  DISO7_10018881
  Located on chromosome 13
  Distance between a terminus base of telomere on chromosomal short arm and 5'-terminus of this base sequence : 28795012
  Distance between 3'-terminus of neighbour sequence of sequence listing upward to telomere on chrosomal short arm and 5'-terminus of this base sequence : 99522
tgcacatacacataagcgaactgtgtgtgtgtgtgcatgtatgtatgtatgtctgtgtgtgtgtgtgtgtgtgtgtgtgtgtgcatgcaggctgctcctggcttttgtggagccccgtttagtgcacgggatttgtgtgacagatatttatgcagtga

SEQ ID NO: 19649 - DNA, 238 bp, Homo sapiens
  chr13.fa.O7frz.27994483
  Located on chromosome 13
  Distance between a terminus base of telomere on chromosomal short arm and 5'-terminus of this base sequence : 28896804
  Distance between 3'-terminus of neighbour sequence of sequence listing upward to telomere on chrosomal short arm and 5'-terminus of this base sequence : 101634
taaatgacatacaagtcatagcaaatggcaaacacaagtttaaatgataggaaaattgagtgtgtgtgtgtgtgtgtgtgtgtgtgtgtgtgtgtatttatttttctcatgcaggtctttaggcagtgtaatgcctaccagccatcttagtaaaaatcatattttaaaatagatgtgaatactaaaggaaaaggaaacatgtgaggtctattttaagttcatggtcatctcaagtatg

SEQ ID NO: 19650 - DNA, 467 bp, Homo sapiens
  chr13.fa.O7frz.28068316
  Located on chromosome 13
  Distance between a terminus base of telomere on chromosomal short arm and 5'-terminus of this base sequence : 29065531
  Distance between 3'-terminus of neighbour sequence of sequence listing upward to telomere on chrosomal short arm and 5'-terminus of this base sequence : 168489
cacctttgtttctgacatttacaaggtagtagcagcctcataaacaaggtgcttacttatagcctaatcctccccaggaacttgaagcttatgggcagcccctccttcctccttaattcttatttcaaggcaggctgctcaaagttgcttacatgtggcaaaggtcactggctatatcccccagaagtccttctgattaagaactctgtgtgggctgctgagcctaagtatgtgtgcattcctaatatagccatagtctcagaattaacgatatgaactgcctcaaatgactgttaagaatgtaagagagtgggagacaagtcaggtgagggtcattacacacacacacacacacacacacacacacacagacacacacacacactttccctcaactgaagagttttccctctattttttgtgataaaatatcaatgataatgatgaagactccatactcagtaaac

SEQ ID NO: 19651 - DNA, 377 bp, Homo sapiens
  chr13.fa.O7frz.28290034
  Located on chromosome 13
  Distance between a terminus base of telomere on chromosomal short arm and 5'-terminus of this base sequence : 29255342
  Distance between 3'-terminus of neighbour sequence of sequence listing upward to telomere on chrosomal short arm and 5'-terminus of this base sequence : 189344
accactcaggaactgtttaatctccctcccttgggaagaggggtcaagatgacgtgggttcaggttgtaggagataggtgtccaggagtaggggcaatatgtggagtgagtggcaattactagaaaaaaaaccgcaaggcagtcccaggccagggtcagaatcaaccagcagggccaggcctcccagacacgtgaatctgggccaaggttttatgtgtgtgtgtgtgtgtgtgtgtgtgtgtgtgtgtgtgtgtgtaagagaaggcaccaatgcactgaagagaacaaaaaagatagaaataggataaaagtctggagtcattcctgaccccaaattaggccacttaagtgctttgtttgttaaagtagcatccatg

SEQ ID NO: 19652 - DNA, 357 bp, Homo sapiens
  chr13.fa.O7frz.28384453
  Located on chromosome 13
  Distance between a terminus base of telomere on chromosomal short arm and 5'-terminus of this base sequence : 29349919
  Distance between 3'-terminus of neighbour sequence of sequence listing upward to telomere on chrosomal short arm and 5'-terminus of this base sequence : 94200
ttagcagttcttagcaactagaaggataaaagagagagaggactgccaattctacagcacaaaacagcaaaaataaataaataaacaaataaataaataaataaataaaataaaaccagggtacgaaaagaaaaggcaattaggctacctatgagagaacagcaatatcagaccaaatttcccatggaaaacaactataaaagtgatataaaatgcccctaaatccccagctatttgaaggtttccggagaacaaccaagggtcaggacttgaggagccaagatcccttagagaagggaaacactttgaagatctcccttcaattcccccttgaggtatttgccaattaccagtaca

SEQ ID NO: 19653 - DNA, 155 bp, Homo sapiens
  AL139188.14_74740
  Located on chromosome 13
  Distance between a terminus base of telomere on chromosomal short arm and 5'-terminus of this base sequence : 29438614
  Distance between 3'-terminus of neighbour sequence of sequence listing upward to telomere on chrosomal short arm and 5'-terminus of this base sequence : 88338
gcagaaagttctgagtgcttcttgagggaaagcataagccatcagcagagagggagagagtcagagcaagagcgagagcgagcgagagagagagagagagagagagagaatgggcctcccaatctacaaagtccctgcaccagaagtaaggacat

SEQ ID NO: 19654 - DNA, 179 bp, Homo sapiens
  AL139188.14_72108
  Located on chromosome 13
  Distance between a terminus base of telomere on chromosomal short arm and 5'-terminus of this base sequence : 29441263
  Distance between 3'-terminus of neighbour sequence of sequence listing upward to telomere on chrosomal short arm and 5'-terminus of this base sequence : 2494
cagatctggatttgctctacagggtgtgcatctcttatcagatttggaatatatatatatatatatatatatatatatatatatatatatattggattttggaatatttgcatatacataatgaggtatcttggtggtgggacccaagtctgaacaaacacgaaattcatttatgtttc

SEQ ID NO: 19655 - DNA, 446 bp, Homo sapiens
  AL354674.5_135369
  Located on chromosome 13
  Distance between a terminus base of telomere on chromosomal short arm and 5'-terminus of this base sequence : 29515079
  Distance between 3'-terminus of neighbour sequence of sequence listing upward to telomere on chrosomal short arm and 5'-terminus of this base sequence : 73637
gcaggtacaaactcatgtagatggaatctcctgtcctaacaataataatacatttgatttaataatagcactttggccaggcatggtggcacatgcctgtagttctagctacttgggagcctgaggcaggagaatcacttgggcccagaaggtcaaggatgctgtgagctatgatgttgccactgcactctagcctgtgtggcagagcaagaccctgataataataataataataataataataataataataataataatagcacttaccattgttgatcatttattattgccaggcattaattcaggcaccttaaactgtacctgtccaattgtatgaaatgggtacagttatggtgcctgcattagtctgttttctgttgcttataacagaatatctgaaactggataatttataaagaaaaggcacttactgcttacagtta

SEQ ID NO: 19656 - DNA, 203 bp, Homo sapiens
  D13S1299
  Located on chromosome 13
  Distance between a terminus base of telomere on chromosomal short arm and 5'-terminus of this base sequence : 29533925
  Distance between 3'-terminus of neighbour sequence of sequence listing upward to telomere on chrosomal short arm and 5'-terminus of this base sequence : 18400
cgatgagtgacagggcttcacagccaacgtgcttctctgtagtagttttggccattagcaattagcactgtagttgtaagaacggagggggctttctctctttttgtctctttatgacctctctctctctctctctctctctacacacacacacacacacacacacacacagcctggtagcctgatttattccacccacgagg

SEQ ID NO: 19657 - DNA, 441 bp, Homo sapiens
  HUMUT6870B
  Located on chromosome 13
  Distance between a terminus base of telomere on chromosomal short arm and 5'-terminus of this base sequence : 29537696
  Distance between 3'-terminus of neighbour sequence of sequence listing upward to telomere on chrosomal short arm and 5'-terminus of this base sequence : 3568
gttgaggcaagagaatcacttgaacctgggaggcggaggttgcagtgagccgagatcatgccactgaactccagcctgggcgacagagcgagactctgtccaaagaaaggaaggaaggaagggagggaggaaggaagggagggagggaaggagggaaagaaaggagagagaaagagagaaaggaaggaaggaaggaaggaaggaaggaaggaaggaaggaaggaaggaaggaaggaaggaaagaaagaaaagaaagaaaaaagaaagagagaaagaaagaaagagaaaagaagggaaagaaagggaggaaagaaagaaaagaaggaagtaaagaaataaaaaaaggaaataaagaaaagaaggaaagaaagaaagaaaacggggctgaagatgtggccaactggctagcataggccatttgccaccctggtgtaaatgtgc

SEQ ID NO: 19658 - DNA, 337 bp, Homo sapiens
  chr13.fa.O7frz.28708435
  Located on chromosome 13
  Distance between a terminus base of telomere on chromosomal short arm and 5'-terminus of this base sequence : 29673860
  Distance between 3'-terminus of neighbour sequence of sequence listing upward to telomere on chrosomal short arm and 5'-terminus of this base sequence : 135723
atgtctctatcagtgaattggagagaaactcatccctgtggctgattaagataaaataaagttatgatgagatgttactagggacctacaattcttccctggggaaaaggtcacacacacacacacacacacacacacacacacacatacacacactctctctctcttttgctagaacgggctggaactgttcttgcaaagactgggctgagatgcatgagtaaatctgacgtgtccaccctcatctctacaggatcagccccagctctggggcccaggactgcttggctcatcgaagaatcccgccatgcaggtatgacctggatagtacttgaca

SEQ ID NO: 19659 - DNA, 355 bp, Homo sapiens
  AC002402.1_114393
  Located on chromosome 13
  Distance between a terminus base of telomere on chromosomal short arm and 5'-terminus of this base sequence : 29842468
  Distance between 3'-terminus of neighbour sequence of sequence listing upward to telomere on chrosomal short arm and 5'-terminus of this base sequence : 168271
actcagagacaaccactgtcttaccgctcatcagcatcatctgcctttgcttgttcttggactatgccacatgtatttttgtgtggcttgcttcttttgctcagtgtgaagatattttagttgtgtcaatgctgttgtgtatattagtagttctttttttcattgttgagttgtattgcattgtgtatgtaaataagtgtgatagattatatacatctatattgtaatatatagagagattatatatatatatatatatacacacatatctcataatttgtttatccattatcctgttgatggatatttgggtggtttccaagttttgactataatgagtaaggctggtatgaac

SEQ ID NO: 19660 - DNA, 399 bp, Homo sapiens
  AL161893.17_12287
  Located on chromosome 13
  Distance between a terminus base of telomere on chromosomal short arm and 5'-terminus of this base sequence : 29947904
  Distance between 3'-terminus of neighbour sequence of sequence listing upward to telomere on chrosomal short arm and 5'-terminus of this base sequence : 105081
ggctgcattgaactatgatggcaccactgcactccagcctaggcaaaagagaaagaccttgtctctggaaaaaaacaaaaccaaaaaccaccaccaccaccaccaacaccaccaccaccaccaccaccaacaaaaaactcagaaaacaaaagtaaaacaatggactttttaatcctaaagtgaggtaatatacctgaacacccatatatttttggatatccacaacagcaaagcagaaaaggtgaggtgaaggagagatgcttgtgggggccccttcttttccatcattttagaatcaacttgttttctctgtatttgagaagtatttgaggccatcacccccaagaggccaatccaactgtaatggagtcacacagactcacatgatcagatagactt

SEQ ID NO: 19661 - DNA, 327 bp, Homo sapiens
  AL353648.15_55674
  Located on chromosome 13
  Distance between a terminus base of telomere on chromosomal short arm and 5'-terminus of this base sequence : 30012001
  Distance between 3'-terminus of neighbour sequence of sequence listing upward to telomere on chrosomal short arm and 5'-terminus of this base sequence : 63698
tggacaagtttgatggtattctcttggaatttatattctcactgacttttccttgtcccactgggatgcagcaggagcgggaggggctggagagggataagagctgtggtgggtatcaggagagatggctaggcttgcttcctttgcaaggtctacatcactcactctatccctttatgccccccaccaccccacgtctagctatagagtaggacacaatttcaatgattcttgccccaaatacacaaatctaggcaaaggaatcagcaaattattattattattattattattattattattattattaagacgaagtcttgcttt

SEQ ID NO: 19662 - DNA, 205 bp, Homo sapiens
  D13S1246
  Located on chromosome 13
  Distance between a terminus base of telomere on chromosomal short arm and 5'-terminus of this base sequence : 30045041
  Distance between 3'-terminus of neighbour sequence of sequence listing upward to telomere on chrosomal short arm and 5'-terminus of this base sequence : 32713
agtggctattcattgctacaggaatatttaaagatgtagcgcacccacgctggaagtggaactctcataacaaccactaactactcggaactgctatgctaggtaacatatacgtgtgtgtgtgtgtgtgtgtgtgtgtgtgtgtgtgtgtgtgtgtgtgttttcagcgaaatttttttcctgaatatgaaagtcacacatgctc

SEQ ID NO: 19663 - DNA, 248 bp, Homo sapiens
  D13S289
  Located on chromosome 13
  Distance between a terminus base of telomere on chromosomal short arm and 5'-terminus of this base sequence : 30205209
  Distance between 3'-terminus of neighbour sequence of sequence listing upward to telomere on chrosomal short arm and 5'-terminus of this base sequence : 159963
ctggttgagcggcattgaaaacagtgtagggagagaaaaactcattcctggctcacccttttgagtcccactatctcaataatctgatgttatatgacacacacacacacacacggaggaatcctggaagactccatatcaaggtggtgatgaaggtgaccagtgggtgataggattataggtgtgtgtttatttatttattttaattacctttttttagagacagggtctctgtcatccaggctgca

SEQ ID NO: 19664 - DNA, 153 bp, Homo sapiens
  D13S1238
  Located on chromosome 13
  Distance between a terminus base of telomere on chromosomal short arm and 5'-terminus of this base sequence : 30285934
  Distance between 3'-terminus of neighbour sequence of sequence listing upward to telomere on chrosomal short arm and 5'-terminus of this base sequence : 80477
gccaacgtaattgacaccataaggctggatgattcttgtaattttcagcctcagaaaaaggctggggagaggagtcaggggaaaggaggtggtgtgtgtgtgtgtgtgtgtgtgtgtgtgtgtgtgtgtggtacggtggatgcctgctgagag

SEQ ID NO: 19665 - DNA, 176 bp, Homo sapiens
  D13S290
  Located on chromosome 13
  Distance between a terminus base of telomere on chromosomal short arm and 5'-terminus of this base sequence : 30507139
  Distance between 3'-terminus of neighbour sequence of sequence listing upward to telomere on chrosomal short arm and 5'-terminus of this base sequence : 221052
ccttaggccccataatcttgtgagccaattccttaaaaccaatttcttatatataaaagacacacacacacacacacacacactcctcctattggctctgttttttttggagaaccctgactgatatatcttctaacaatcctataattattttcattttgcaattgaggaatttg

SEQ ID NO: 19666 - DNA, 268 bp, Homo sapiens
  AC002982.1_33778
  Located on chromosome 13
  Distance between a terminus base of telomere on chromosomal short arm and 5'-terminus of this base sequence : 30507164
  Distance between 3'-terminus of neighbour sequence of sequence listing upward to telomere on chrosomal short arm and 5'-terminus of this base sequence : -151
caattccttaaaaccaatttcttatatataaaagacacacacacacacacacacacactcctcctattggctctgttttttttggagaaccctgactgatatatcttctaacaatcctataattattttcattttgcaattgaggaatttgagcctcagagatgttaggagacttgttcacaatcacacagctagtaaaaggtagggctatgccagtttctaagatctgtactttttaatgtcacaatacatggactcacgaggatag

SEQ ID NO: 19667 - DNA, 268 bp, Homo sapiens; identical to SEQ ID NO: 19666
  AC004088.1_1646
  Located on chromosome 13
  Distance between a terminus base of telomere on chromosomal short arm and 5'-terminus of this base sequence : 30507164
  Distance between 3'-terminus of neighbour sequence of sequence listing upward to telomere on chrosomal short arm and 5'-terminus of this base sequence : -268

SEQ ID NO: 19668 - DNA, 135 bp, Homo sapiens
  D13S1229
  Located on chromosome 13
  Distance between a terminus base of telomere on chromosomal short arm and 5'-terminus of this base sequence : 30562064
  Distance between 3'-terminus of neighbour sequence of sequence listing upward to telomere on chrosomal short arm and 5'-terminus of this base sequence : 54632
ggtcattcagggagccattcattcaatacttaaaagtcaaaattaccattaactacgacacacacacaaacacacacacacacacacacacacatgttttttcctataaagcagcctcttggtgaaatataatgg

SEQ ID NO: 19669 - DNA, 440 bp, Homo sapiens
  chr13.fa.O7frz.29590509
  Located on chromosome 13
  Distance between a terminus base of telomere on chromosomal short arm and 5'-terminus of this base sequence : 30640635
  Distance between 3'-terminus of neighbour sequence of sequence listing upward to telomere on chrosomal short arm and 5'-terminus of this base sequence : 78436
taaagtaaggcttcggtaaatgaagagccagtgcagtcttataaaagaagattcaggccgggcacgttggctcacgcctgtaatcccagcactttgggaggccaaggcaggcggattacgaggtcaggagatcgagaccatcctggctaacacggtgaaaccccgtctctactaaaaatacaaaaaaattagccgggcgtggtggcgggcgcctgtagtcccagatactcgggaggctgaggcaggagaatggcgtgaacccgggaggtggagctggcagtgaaccaagattgcgccactgcactccagcctgggcaacagagcgagactccatcttaaaaaataaataaataaataaataaataaaagaagattcaacattgtaaaaatgccacttcttcctaaattgacataaagttaacaccagtagaatttcgaac

SEQ ID NO: 19670 - DNA, 254 bp, Homo sapiens
  chr13.fa.O7frz.29466423
  Located on chromosome 13
  Distance between a terminus base of telomere on chromosomal short arm and 5'-terminus of this base sequence : 30765034
  Distance between 3'-terminus of neighbour sequence of sequence listing upward to telomere on chrosomal short arm and 5'-terminus of this base sequence : 123959
agacggttaatgaatttaaatttccttccagaaggtttgcatgcatatgtatctatatacatgtgtatacagggacacatacacacacacacacacacacaacacaatacctaattttcagaactcagtttttttctttgtctctcttgaacaactttgcaaataatcacatttgaacaactttgcaaataatcatatttaaaataatcatttttaaatggctatgtaatgttccattaaatacatttcttgaa

SEQ ID NO: 19671 - DNA, 234 bp, Homo sapiens
  D13S1287
  Located on chromosome 13
  Distance between a terminus base of telomere on chromosomal short arm and 5'-terminus of this base sequence : 30793632
  Distance between 3'-terminus of neighbour sequence of sequence listing upward to telomere on chrosomal short arm and 5'-terminus of this base sequence : 28344
tatgccagtatgcctgctttaattacaactagcactatgctgatgagtgccttttaaaatttccttattgaacttggagtacatatatatatactccatacacatacatacacacacacacacacacacacacacacattattactatccacctttgaattgtatcatttctcataagcaactttgcaaggtaaaaagagatgagtcttaaagtagcaaatggactgatgtgac

SEQ ID NO: 19672 - DNA, 101 bp, Homo sapiens
  DISO7_10003726
  Located on chromosome 13
  Distance between a terminus base of telomere on chromosomal short arm and 5'-terminus of this base sequence : 31027625
  Distance between 3'-terminus of neighbour sequence of sequence listing upward to telomere on chrosomal short arm and 5'-terminus of this base sequence : 233759
gattatgatgactgtcctttatggtttatgtctgtgtgtgtgtgcgtgtatatatatatatatatatatagtcccccaaaattgttagcataacgggagcc

SEQ ID NO: 19673 - DNA, 362 bp, Homo sapiens
  AL161616.10_10686
  Located on chromosome 13
  Distance between a terminus base of telomere on chromosomal short arm and 5'-terminus of this base sequence : 31078340
  Distance between 3'-terminus of neighbour sequence of sequence listing upward to telomere on chrosomal short arm and 5'-terminus of this base sequence : 50614
ggagtatcttagatattggcctaggatgcctgtgtggggctgcaatcaccccaggactactgagccagaaacagacctctactaaagattgtgcttgaatcacccagggatataggtgaccatttgtcctattcttaatgacagtatcattccataagtctcattttttgcatatcatcatcatcctcatcctcatcctcatcatcatcatcatcatcatcatacaataaccagattctagcaattcttccctcatggttcattttagagtaattcttctgcctttacttaccaacttcttatacaccccaacattataaactctctaataccatttgctattgctcaagactaattgtctt

SEQ ID NO: 19674 - DNA, 457 bp, Homo sapiens
  AC020573.5_10928
  Located on chromosome 13
  Distance between a terminus base of telomere on chromosomal short arm and 5'-terminus of this base sequence : 31114010
  Distance between 3'-terminus of neighbour sequence of sequence listing upward to telomere on chrosomal short arm and 5'-terminus of this base sequence : 35308
aagacaatttcagtggaacttcagctagaattaattatttatttatttatttatttatttatttatttatttatttgaggcagggtctcattctgtcgcccatgctggagtatagtggccaatcttggatcactgcaacctctgcctcctgggtccaagcaattctcatgcctcggcctcctgagtagccgggattacaggcgtgcaccaccatgcctggctaattcagctagaattaaagttgtacattatggaactacataaatgaggagaagctttaaagtatttccactaagaggagaggttctccattctactctctacctccatgaggtcaatttttttagctcccacatatttgtgagaatatgcatatgtcgctatttctttacttatacatttaacatatttctactaactctccactatgaaagatgaggatttacttccattactt

SEQ ID NO: 19675 - DNA, 178 bp, Homo sapiens
  G09018
  Located on chromosome 13
  Distance between a terminus base of telomere on chromosomal short arm and 5'-terminus of this base sequence : 31141731
  Distance between 3'-terminus of neighbour sequence of sequence listing upward to telomere on chrosomal short arm and 5'-terminus of this base sequence : 27264
atattgcacaactttgtgtagagcataaaatactttttccttctgtctttgcactattgtcttcacacatttgtatctgtctatctatctatctatctatctatctatctatattatgtactccttaatacgtcattattttttaaaaccagtcgttattttttaaggagattagcaa

SEQ ID NO: 19676 - DNA, 225 bp, Homo sapiens
  D13S1226
  Located on chromosome 13
  Distance between a terminus base of telomere on chromosomal short arm and 5'-terminus of this base sequence : 31150254
  Distance between 3'-terminus of neighbour sequence of sequence listing upward to telomere on chrosomal short arm and 5'-terminus of this base sequence : 8345
gtgcattcacagaccagtcatttttctatttcttggaatttattaaccctaagaggagcagtccatccgggaataagatgccaaagtatcaaatacaaaatattagaaaacttggtgtgtgtgtgtgtgtgtgtgtgtgtgtgtaagatacattatatatattatatattacatataccatctttattagtttgttttcatactgcccaaaataaagacataccc

SEQ ID NO: 19677 - DNA, 456 bp, Homo sapiens
  AC013464.2_263173
  Located on chromosome 13
  Distance between a terminus base of telomere on chromosomal short arm and 5'-terminus of this base sequence : 31188306
  Distance between 3'-terminus of neighbour sequence of sequence listing upward to telomere on chrosomal short arm and 5'-terminus of this base sequence : 37827
cctgctattctaggaaatctaatctatcaacagctgaaaacttcacctaaacaccacggactgggtgaagaaaggaaacagatgatgatttttaattactgccttgagtcaggtgcccagaaacgtctccccactcactgtcctgcaaatggtttttagggtgtaaggagagctatgcatattttggttagtaagagtaaatctgtgtgtgtgtgtatgtgtgtgtgtgtgtgtgtgtgtgtgtgtgtgtgtgtgttttgatgtactccctgattccttctgtgagcttcaatttcattttgtcagctccaggatatctgttctcaagaaaggaaatttgagacacctgaattttgctgtgtttattgctgttaatctttagtgcctctcccctccaagtatttactgaaaacattgtgtaacttatttggaagaatgtcgatacctgtataacat

SEQ ID NO: 19678 - DNA, 338 bp, Homo sapiens
  chr13.fa.O7frz.30304826
  Located on chromosome 13
  Distance between a terminus base of telomere on chromosomal short arm and 5'-terminus of this base sequence : 31273837
  Distance between 3'-terminus of neighbour sequence of sequence listing upward to telomere on chrosomal short arm and 5'-terminus of this base sequence : 85075
ccatgcattgtaagatgattagaagaaagaaaaggaaataaaaaatagtaaacgtataactgggaagccagtaaagtaggaaatattctagaagtatatgaagaaattgtagatcatgctgacaattttacaagctataaataataaaactgttcacattttggtccaagaaaaagatacataaaataagaaactatatatatatatatatatatatatatatatgaaaatggatgtgtggagtctctttaaaaaagctggcagtatcaccataattttttaaatgaccttccccccaccataaattgaagagaaactaaggtctacaagtctgcata

SEQ ID NO: 19679 - DNA, 196 bp, Homo sapiens
  DISD22_0008996
  Located on chromosome 13
  Distance between a terminus base of telomere on chromosomal short arm and 5'-terminus of this base sequence : 31511277
  Distance between 3'-terminus of neighbour sequence of sequence listing upward to telomere on chrosomal short arm and 5'-terminus of this base sequence : 237102
gtcctctggtcatttctatggtttatgtcttttgtagagtgtgtgtgtgtgtgtgtgtgtgtgtgtgtgtgtactcagtactctctgatatatcgtttttgttttagaacatatatttgtataatattttttctaagattattttgaatatttacattttgatttttgaaacttataggcatattagatgagtcca

SEQ ID NO: 19680 - DNA, 255 bp, Homo sapiens
  chr13.fa.O7frz.34303840
  Located on chromosome 13
  Distance between a terminus base of telomere on chromosomal short arm and 5'-terminus of this base sequence : 31605474
  Distance between 3'-terminus of neighbour sequence of sequence listing upward to telomere on chrosomal short arm and 5'-terminus of this base sequence : 94001
cgtcaactttgaatgtcataagcttttaattatgaaattgagaagtttattgctagccattttgtccatagaaaaaatttacttaaatatttacctacattaatatgtgtgtgtgtgtgtgtgtgtgtgtgtgtgtgtgtgtgtgtatatatatatatatatatgtagaccctcactaatttaaaattgttttttacttttttgcaacagaccaagtttaaattttttgcaaccttaacctgcatttgataaaca

SEQ ID NO: 19681 - DNA, 441 bp, Homo sapiens
  AL390071.7_123862
  Located on chromosome 13
  Distance between a terminus base of telomere on chromosomal short arm and 5'-terminus of this base sequence : 31684228
  Distance between 3'-terminus of neighbour sequence of sequence listing upward to telomere on chrosomal short arm and 5'-terminus of this base sequence : 78499
tcagctgtctctagatcactttaccttcaaaaccaaagtgccatataaaaacattaaattggatggtttaattaaaaagtttttttaatgaagaaacatatccagtgtttctgagatctcatttactgtttcacttttattatttgagtagattagtgtcataggcttgcggtatttaatattcatcttccaagataaattcttataagcatagttagcaaaataaagtgtatgtgtgtgtgtgtgtggagatagatagatagatagatagatagatagatagatagatagataatctccacacacacaaatatatatatttacttaccactgctggaaaaggaaaggaccctaccaattatagcaccagtgtatttactaaatatcaactatcctaaagaaaaaacaaaacaattagtaattaaacatctaggtatgcca

SEQ ID NO: 19682 - DNA, 215 bp, Homo sapiens
  Z67601
  Located on chromosome 13
  Distance between a terminus base of telomere on chromosomal short arm and 5'-terminus of this base sequence : 31973246
  Distance between 3'-terminus of neighbour sequence of sequence listing upward to telomere on chrosomal short arm and 5'-terminus of this base sequence : 288577
ccagtcaaatgtctcaaccttccttttgagaaaacagctcatgttcctgtattttaaaatgggggcaaggcgcgcgtgtgtgcatgtgtgtgtatgtgtgtgtgtgtgtgtgtgtgtgtgtgtgttggggtgggggcagtcaactcattttcttggccatgttgctaggcaacacagaaggaaaaaatagaagtagctactgttttccaatctgc

SEQ ID NO: 19683 - DNA, 350 bp, Homo sapiens
  chr13.fa.O7frz.34767438
  Located on chromosome 13
  Distance between a terminus base of telomere on chromosomal short arm and 5'-terminus of this base sequence : 32080945
  Distance between 3'-terminus of neighbour sequence of sequence listing upward to telomere on chrosomal short arm and 5'-terminus of this base sequence : 107484
tgtattccaaatgagacatgtccatgtcctggattcaacccgtgggcaggcagtttgtagtctccaggggagaattccagcagccatggttaacatgtgcagagccagtactcttggctgtttctatgatctcaggggagactaccagcttccggacacttcagctcctgtaatttccaaaggcagggtagggcacaatcaagacccaccactcctagaaattagagctcatgaaaaaaccaatacagcaagtcgtgtgtgtgtgtgtgtgtgtgtgtgtgtgtgtgtgtgtgcacctgtgtgtgcatgtttatgtgcacatgtacatgagtgcatctacatgtgcttac

SEQ ID NO: 19684 - DNA, 449 bp, Homo sapiens
  chr13.fa.O7frz.35052208
  Located on chromosome 13
  Distance between a terminus base of telomere on chromosomal short arm and 5'-terminus of this base sequence : 32365730
  Distance between 3'-terminus of neighbour sequence of sequence listing upward to telomere on chrosomal short arm and 5'-terminus of this base sequence : 284435
ccaatagaaacattagatgctaagtatctaacgagcttctctggtaggtaaaacttcatgtactgtcatacctgttgttgcaattttttgctggaggaattaagtatttcttatgtgaccctaacttggagaaaactttcggaagcttgagcctagttttctgagaattcatcccatgtgccttatgcctttgttgattttgctttgtattccttagctataaattccctgtgaggtacatggattagagaaagaaagaaaaaaagaaagaaagagaggaaggaaagaaggaaggaaggaaggaaggaagggaggaaggaaatatatattagccataagtacaaatatatgccaatccttatgaattcttctagtgcatcattgaatatggcagtggtcttggggactctgacagtatagaattcttctagtgaaccactgaatatgga

SEQ ID NO: 19685 - DNA, 115 bp, Homo sapiens
  DISO7_10003737
  Located on chromosome 13
  Distance between a terminus base of telomere on chromosomal short arm and 5'-terminus of this base sequence : 32484671
  Distance between 3'-terminus of neighbour sequence of sequence listing upward to telomere on chrosomal short arm and 5'-terminus of this base sequence : 118492
aatcaggtgttgagttaaataagcatctctctctctctctctctctgtccctctttttgtctgtctctctttctttctctctctctctctctgaactctagagaaatgctgagct

SEQ ID NO: 19686 - DNA, 458 bp, Homo sapiens
  AL359767.1_60985
  Located on chromosome 13
  Distance between a terminus base of telomere on chromosomal short arm and 5'-terminus of this base sequence : 32573051
  Distance between 3'-terminus of neighbour sequence of sequence listing upward to telomere on chrosomal short arm and 5'-terminus of this base sequence : 88265
aataactaatgcaaggaaatttgtggttatagagcagttaagccacaaaagccacctcgaaatcctaggcttgagtaatcctcccacctcagcctcccaagtagttgagattacaagcatgcaacaccatgcatgtgtgctctttcgctttctttctttctttctttctttctttctttctttctttctttctttctttctttctttctttctctttctttttctttctttctttttctttccttctttctttctttctctttctttttctttctttctttctttttctttccttccttctttctttttcttccttccttcctttcttccttctttccttcctttctttttctttctttctttccttccttccttccttccatccttctttccttccttcctccctccctctgtcccttccttccttccattcattcgtaacgacaggtcctcaaaca

SEQ ID NO: 19687 - DNA, 429 bp, Homo sapiens
  HUMUT5177B
  Located on chromosome 13
  Distance between a terminus base of telomere on chromosomal short arm and 5'-terminus of this base sequence : 32573077
  Distance between 3'-terminus of neighbour sequence of sequence listing upward to telomere on chrosomal short arm and 5'-terminus of this base sequence : -432
ttatagagcagttaagccacaaaagccacctcgaaatcctaggcttgagtaatcctcccacctcagcctcccaagtagttgagattacaagcatgcaacaccatgcatgtgtgctctttcgctttctttctttctttctttctttctttctttctttctttctttctttctttctttctttctttctctttctttttctttctttctttttctttccttctttctttctttctctttctttttctttctttctttctttttctttccttccttctttctttttcttccttccttcctttcttccttctttccttcctttctttttctttctttctttccttccttccttccttccatccttctttccttccttcctccctccctctgtcccttccttccttccattcattcgtaacgacaggtcctcaa

SEQ ID NO: 19688 - DNA, 127 bp, Homo sapiens
  D13S219
  Located on chromosome 13
  Distance between a terminus base of telomere on chromosomal short arm and 5'-terminus of this base sequence : 32705788
  Distance between 3'-terminus of neighbour sequence of sequence listing upward to telomere on chrosomal short arm and 5'-terminus of this base sequence : 132282
tccttctgtttcttgacttaacattttcttctataagtcttttggttgtgtgtgtgtgtgtgtgtgtgtgtgtgtgtgtgtatacatacattgtagcaattgacatggcaattttgcatatttgctt

SEQ ID NO: 19689 - DNA, 224 bp, Homo sapiens
  chr13.fa.O7frz.35533413
  Located on chromosome 13
  Distance between a terminus base of telomere on chromosomal short arm and 5'-terminus of this base sequence : 32777720
  Distance between 3'-terminus of neighbour sequence of sequence listing upward to telomere on chrosomal short arm and 5'-terminus of this base sequence : 71805
tctaaatggcaattagattcacaacggcattctcaataacctcaattaaaggtatcaaacagcagaataacatctgcaaaatgctgacaaaagtaagtgtcaacctaggattatatgcctggctacatacacacacacacacacacacacacacacacaccggtggaaaaaataaaacatttagaaaacagaaaattaaaagtctaccactaattgatcctcat

SEQ ID NO: 19690 - DNA, 303 bp, Homo sapiens
  chr13.fa.O7frz.35849043
  Located on chromosome 13
  Distance between a terminus base of telomere on chromosomal short arm and 5'-terminus of this base sequence : 32966341
  Distance between 3'-terminus of neighbour sequence of sequence listing upward to telomere on chrosomal short arm and 5'-terminus of this base sequence : 188397
taggatcacctaaacttgtcatacagttctgctattaaaatcgtaacagggaaagacaaaatgtgaaatgcatgttatattttgctttatttgttgaatatatatgtgtgtgtgtgtgtatatatatatatatatatacacactaaatatttgggacacaaagttaagcaggtgcttacagtctatcaagtgatatttatgaaatgtttttgttgctgttttgttgctgttatgggaacatccatatccttagaagacaataaaaaagaggattctaaatgctagatggttggctaacttctc

SEQ ID NO: 19691 - DNA, 458 bp, Homo sapiens
  chr13.fa.O7frz.35937833
  Located on chromosome 13
  Distance between a terminus base of telomere on chromosomal short arm and 5'-terminus of this base sequence : 33248609
  Distance between 3'-terminus of neighbour sequence of sequence listing upward to telomere on chrosomal short arm and 5'-terminus of this base sequence : 281965
gacaataagcagttatgtagcattggcaaaagtcctgcatctagttctaaagagatgtagccccactgtgtatctcaaatttcctcttgacctgacctttctctttgccctggcttaacttatctgagtttgctggtggtgccaagttccttctgcttgtgagctgaattaatgaaaaggcatcaacatcaacttcccttcctgtaatacacacacacacacacacacacacacacacacacacacaccatcatcatcatcatcattatcatcatcatcataatcatatcgttggggaaagttttcatgttgacttttttgggggagacggttatgaaggtagcatgaggaaggtgagggtaataatagaaattcagtagatcttgcaggacaaattgcctgattcaaatggtgagctactctcattatattcagagtaggcgacataatgtattcac

SEQ ID NO: 19692 - DNA, 178 bp, Homo sapiens
  DISO7_10003742
  Located on chromosome 13
  Distance between a terminus base of telomere on chromosomal short arm and 5'-terminus of this base sequence : 33364521
  Distance between 3'-terminus of neighbour sequence of sequence listing upward to telomere on chrosomal short arm and 5'-terminus of this base sequence : 115454
cagtggtgaccatctagtagtaatgaaagaacgggtgacttctattatttctctctacttttatgttttatatatatatatatatatatatgtgtatatatatatatgtgtatatatgtatatatatatatgtattatatatatttatatatatatgtattgcagtgagcatgtttaa

SEQ ID NO: 19693 - DNA, 146 bp, Homo sapiens
  DISO7_10003743
  Located on chromosome 13
  Distance between a terminus base of telomere on chromosomal short arm and 5'-terminus of this base sequence : 33430392
  Distance between 3'-terminus of neighbour sequence of sequence listing upward to telomere on chrosomal short arm and 5'-terminus of this base sequence : 65693
ttgtatgagccgttacatttcccccaccttttttttttttttttttttttggcttaagccaaacctctgtgtgtgtgtgtgtgtgtgtgtgtgtgtgtgtgtgtttaacttacaactaaaaaagtgtcctaaccaatatgtcttca

SEQ ID NO: 19694 - DNA, 475 bp, Homo sapiens
  chr13.fa.O7frz.36242554
  Located on chromosome 13
  Distance between a terminus base of telomere on chromosomal short arm and 5'-terminus of this base sequence : 33518555
  Distance between 3'-terminus of neighbour sequence of sequence listing upward to telomere on chrosomal short arm and 5'-terminus of this base sequence : 88017
aagctggataaagaaacaagacacaatgatacgctgtctcttgggcagcataggctcaaaataaaggaatgcagaaaaatctaccaagcaagtggaaaacagaaaaaaaaactggggttgctatcctaatctcatataaaacaaactttaaacaaacaaaaataaacacgcagacacacacacacacacacacacacacacacacacacacacacaaagaagggcattacgtaatggtaaaaggtgcaattcaacaagaagacctaattctctcttaaatatgtaagcacccaacacaggagcaccccgattcataaagcaagttctcagagacctataaagacacttagatttccacataataatagtggaagacttcaacatccctctgacagtattagacaaatcatcgaggaagaaaattaaccaagatatttaggacttaaactctgtacttgaccaaatgaacctaata

SEQ ID NO: 19695 - DNA, 298 bp, Homo sapiens
  AL136220.4_151391
  Located on chromosome 13
  Distance between a terminus base of telomere on chromosomal short arm and 5'-terminus of this base sequence : 33644286
  Distance between 3'-terminus of neighbour sequence of sequence listing upward to telomere on chrosomal short arm and 5'-terminus of this base sequence : 125256
gtaatgtatcctggtgtgaattattttgtctttattctgctgtggttgatcttatttgatctataggttgatagtttaaacatatttttaaaattattattattattattaattcagataatttttgcctacctctctgtcattgacacatacagattttctgaggtgccaactacatgcatgttaggtcacttattttcccactggtcactgaagctctgcccattttttcccattgttttctccccttgttttacttttgttagtttctactgttatgtcttcaaattcaatgatc

SEQ ID NO: 19696 - DNA, 368 bp, Homo sapiens
  chr13.fa.O7frz.36457980
  Located on chromosome 13
  Distance between a terminus base of telomere on chromosomal short arm and 5'-terminus of this base sequence : 33772017
  Distance between 3'-terminus of neighbour sequence of sequence listing upward to telomere on chrosomal short arm and 5'-terminus of this base sequence : 127433
atccaagtgactaatgaatatgagtgttaatttccaaaacattactatgagaactttcaaaattagaacacaaagtgaggaaggcgtgaagaatgatttgtcttatgtcaatggtatggctgcaccaaaagcttcacgtggtgtatcttctgctggaattgcttgaaaccctgatttccaaaatgatgaaagggaaataccatcttccagtttaccaggagcatggctctgggcagtccccgccccctcacctttctctctctctcttctgtctctctctgtctctctctctctctctctatacacacacacacacacacacacatatatatatatttagatgcctaaattcttggcatctaatatga

SEQ ID NO: 19697 - DNA, 261 bp, Homo sapiens
  chr13.fa.O7frz.36558085
  Located on chromosome 13
  Distance between a terminus base of telomere on chromosomal short arm and 5'-terminus of this base sequence : 33890291
  Distance between 3'-terminus of neighbour sequence of sequence listing upward to telomere on chrosomal short arm and 5'-terminus of this base sequence : 117906
ttacaagttctgtagcaaccagctaagacattaagagacttcttaacttctattttaatgtgcaaatacacacatacgaacacacacgcacacacacacacacacacacacatcaggataggtggtcgggggcaacattttactagaagaaaaaaaattagggactgatttctcacctctcatgccccacagaaaatatactgaaggagctaaatcctaggaagaagcaaagactcccagtagagtgccagtacattgaaa

SEQ ID NO: 19698 - DNA, 475 bp, Homo sapiens
  chr13.fa.O7frz.36701583
  Located on chromosome 13
  Distance between a terminus base of telomere on chromosomal short arm and 5'-terminus of this base sequence : 34029075
  Distance between 3'-terminus of neighbour sequence of sequence listing upward to telomere on chrosomal short arm and 5'-terminus of this base sequence : 138523
ctgtcttcagttgtatttggagaaaaacaaaacaaacagaaaagaaacaaactgggttgtgatatgtccactgcttaagcaaactagtataagttaatgacaaaaaggaaagatgataatgcacagctaccatttttttcaacattgctcttaaaggaaataattttcaaactatagaggtcagaacaaacccaattatttaggagttgaaaaatacggggtaaattatcatttagcaaatgatccctgaagcaaacactcgtactttctctctaaaatacttaagaaaacaaaatgcccactacaaattcagtaacactgaattcattaaaagaatagtaaaagaatttgcacacacacacacacacacacacacacacacacacacacacacaaaggtacaagactgaaaaatgacagaaatggagcaaacttcccaggttgaaaaggctttacaaagcctcttagctgttac

SEQ ID NO: 19699 - DNA, 465 bp, Homo sapiens
  AL356495.8_18752
  Located on chromosome 13
  Distance between a terminus base of telomere on chromosomal short arm and 5'-terminus of this base sequence : 34088914
  Distance between 3'-terminus of neighbour sequence of sequence listing upward to telomere on chrosomal short arm and 5'-terminus of this base sequence : 59364
cataagcttagtggctgtaaacaatagagacttattgttttagaagtcaaaagttcaaaatgagcctcagtgagctgaaatcaagatgtcagcaggagtgcattcctttttagaggctctacagggtaattcattttcttgctcttttttttttttttcttccttccttccttccttccttccttccttccttccttccttccttccttccttccttccttccttttatcctttcttttttccttgccttttctagtttctagaggctgccttcattccttggcttgtggcccccttacatcttcacagccagcactggcaggtcagtctttctaacattacatcattctgacactgactctcctgtctttccttttactcaaaggacccctgtgattacaccccccccccgataatccagaataatcctattttatggataactgattagcaatcttaattcca

SEQ ID NO: 19700 - DNA, 130 bp, Homo sapiens
  G09021
  Located on chromosome 13
  Distance between a terminus base of telomere on chromosomal short arm and 5'-terminus of this base sequence : 34111011
  Distance between 3'-terminus of neighbour sequence of sequence listing upward to telomere on chrosomal short arm and 5'-terminus of this base sequence : 21632
aagcacacacagatgctaggtagatagaagatagatagatagatagatagatagacagacagacacacagacacacagatagataaagagtgtacttattgattagtttttgagattatggaggctgagg

SEQ ID NO: 19701 - DNA, 156 bp, Homo sapiens
  DISO7_10003744
  Located on chromosome 13
  Distance between a terminus base of telomere on chromosomal short arm and 5'-terminus of this base sequence : 34205645
  Distance between 3'-terminus of neighbour sequence of sequence listing upward to telomere on chrosomal short arm and 5'-terminus of this base sequence : 94504
gtgttctatacttcactgaaactggtaaaatacacacacacacacacacacacacacacacacacacacagagagagcgcaacctgtatacaataatatatatatataatatatatagagagagacctatatccaagttatacaaagagatgcatt

SEQ ID NO: 19702 - DNA, 198 bp, Homo sapiens
  G09022
  Located on chromosome 13
  Distance between a terminus base of telomere on chromosomal short arm and 5'-terminus of this base sequence : 34286078
  Distance between 3'-terminus of neighbour sequence of sequence listing upward to telomere on chrosomal short arm and 5'-terminus of this base sequence : 80277
cactacagcagattgcaccattatttataggacaactgtctgagaagcaaaataaactcttaaagttgtcaccagcataatttgagatatgctaaagtgcacaattctgtagatagatagatagatagatagatagatagatagatagatagatagatagatatagacggattgacaattatatttacagcaagcacc

SEQ ID NO: 19703 - DNA, 103 bp, Homo sapiens
  DISO7_10003747
  Located on chromosome 13
  Distance between a terminus base of telomere on chromosomal short arm and 5'-terminus of this base sequence : 34316462
  Distance between 3'-terminus of neighbour sequence of sequence listing upward to telomere on chrosomal short arm and 5'-terminus of this base sequence : 30186
ttatggcagaacacagaaggaatgtataaaaagttaaatttctgagactatatatatgtgtgtgtgtgtgtgtgtgtgtcatctttctatcctcattcttgac

SEQ ID NO: 19704 - DNA, 122 bp, Homo sapiens
  DISO7_10003750
  Located on chromosome 13
  Distance between a terminus base of telomere on chromosomal short arm and 5'-terminus of this base sequence : 34329440
  Distance between 3'-terminus of neighbour sequence of sequence listing upward to telomere on chrosomal short arm and 5'-terminus of this base sequence : 12875
ttgattcttcaaagccagcaaaggagagagagagagagcaaaggagagagagagagagagagagagagagagagagagagagcaaacgaggagagagagagcgcgcaactctagcaagttaa

SEQ ID NO: 19705 - DNA, 189 bp, Homo sapiens
  D13S218
  Located on chromosome 13
  Distance between a terminus base of telomere on chromosomal short arm and 5'-terminus of this base sequence : 34579900
  Distance between 3'-terminus of neighbour sequence of sequence listing upward to telomere on chrosomal short arm and 5'-terminus of this base sequence : 250338
gtcgggcactacgtttatctactcagtagaagcagtcttctaatgactatcctacttttgcatgtttcaggtcttttattgctccctgcagggtatgtgtgtgtgtgtgtgtgtgtgtgtgtgtgtatactcatgtatgtgtatatatgtacatatgtaattttaaaatggactgctcattttcaaatc

SEQ ID NO: 19706 - DNA, 470 bp, Homo sapiens
  chr13.fa.O7frz.37352473
  Located on chromosome 13
  Distance between a terminus base of telomere on chromosomal short arm and 5'-terminus of this base sequence : 34668392
  Distance between 3'-terminus of neighbour sequence of sequence listing upward to telomere on chrosomal short arm and 5'-terminus of this base sequence : 88303
tgttgagttggaaactgtaaactcttggtttttaaacacggatggatgggtacagacagagatgcagattacatgggcctacacgtgcctgtgtgtgtgtgtgtgtgtgtgtgtgtgtgtgtgtgtgtgtgtgtgttcctagttcttcctgctgagaaggtctggaagcctagtagcaagaaacacacttggcacccagatcttggatactaaatactccactaaataaagccaagactccagggaaaatgcgtgattccagagcagggaaagtgtaagatgggactggaacattttgcagtatcacaatgaaaagaaggaatcaaagaatatatggatatgtcaaaagagcagaggagccatcttgaaggggctcttactgtccaaacttgggacaattaggacagcaaataaataatgataataataaaatataacccatggagtaaaataagaatccatgagtcaat

SEQ ID NO: 19707 - DNA, 475 bp, Homo sapiens
  chr13.fa.O7frz.37473836
  Located on chromosome 13
  Distance between a terminus base of telomere on chromosomal short arm and 5'-terminus of this base sequence : 34789692
  Distance between 3'-terminus of neighbour sequence of sequence listing upward to telomere on chrosomal short arm and 5'-terminus of this base sequence : 120830
gaatcaacctaagtgtctatcagtgaatgaacggataaagaaaatgttgcagatagatagataggtagatagatagatgatatatagatagatggagagagagagagagagagagagagagagagagagagagagaaaatgctattcagccacacacataaataaaaccacgtcatttgcaacaacatgaatatacctggaggatactatgctaagtgaaaaaaaattaggcatagaaagacaaatcctgcagggtctcatttatatgtgtaacctgaaaaaagttaaatttgtagaaacagaaagcagaatggtggttaccagagtaccagagactgatatgggggttaggagatagtggggcagttgcagagatgttggtcaaagagccaaagtttcagctaaacaaaaggaagacattctggagatcgattgtacagcatggtgactgtagttaataccgtgaagtttgcta

SEQ ID NO: 19708 - DNA, 421 bp, Homo sapiens
  chr13.fa.O7frz.37560593
  Located on chromosome 13
  Distance between a terminus base of telomere on chromosomal short arm and 5'-terminus of this base sequence : 34876241
  Distance between 3'-terminus of neighbour sequence of sequence listing upward to telomere on chrosomal short arm and 5'-terminus of this base sequence : 86074
cactgatttacctcatgcatagaatgtggaaatacctaaattgcagggttgctgtgagatgcattgagataatgtgcgtattatcaaaatcaccctgaccatggccctcaatctgtccagctctcctctgcaggcattttcagagtcgccaaggctgagctgaattcagccagtttatacctgcacttgagttccagttgtttttgatgagtgttatggtttctcttttttgtgttttgattgtccaatgcctatattatgccagttctgattggtcaaagcccatgccactggttggtcaagatgatgatgatgatgatgatgatgatgatgatgatgatgatgattattattattattattagagatggagtctcgctctgtcacccaggctggagtgcagtggtacgatctcagctca

SEQ ID NO: 19709 - DNA, 192 bp, Homo sapiens
  D13S1288
  Located on chromosome 13
  Distance between a terminus base of telomere on chromosomal short arm and 5'-terminus of this base sequence : 35070842
  Distance between 3'-terminus of neighbour sequence of sequence listing upward to telomere on chrosomal short arm and 5'-terminus of this base sequence : 194180
ctggaaaaatcagttgaatcctagcctttaacttcacaggtgtgtgtgtgtgtgtgtgtgtgtgtgtgtgtgtgtgtctgtgtgtctgcacacgcgcacgcacccatgtgcgggcggagtcatctggcctgttgaaagtaaggcaatggcccctcttttaaaaccaaagaggcagccgtgatggtctctgaa

SEQ ID NO: 19710 - DNA, 381 bp, Homo sapiens
  chr13.fa.O7frz.37887955
  Located on chromosome 13
  Distance between a terminus base of telomere on chromosomal short arm and 5'-terminus of this base sequence : 35165817
  Distance between 3'-terminus of neighbour sequence of sequence listing upward to telomere on chrosomal short arm and 5'-terminus of this base sequence : 94783
tgctaagttcaacatacctcacagtgttacacttgattcagctggtcgggtacaaatacagcgtcattgtgtctgggactttgtgtctgaatatgtttgtgtgtgtgtgtgtgtgtgtgtgtgtgtgtgtgtgtgtctgggcatgtatatatagattgtggtatacatgtgtgtctgggcatgtggatacatgtgtgttagtgggtatgtctgggtaattactctggggctgggtgtgcacacatactttcttacaagtgtttgagtcctatagtgagggggttccccaaacatttagaaaggagcaaaatggatttcctgtaccatttaaaaggatagaaggcacaaataatggatctgaacataaagttacctgaaaga

SEQ ID NO: 19711 - DNA, 166 bp, Homo sapiens
  DISO7_10003752
  Located on chromosome 13
  Distance between a terminus base of telomere on chromosomal short arm and 5'-terminus of this base sequence : 35251416
  Distance between 3'-terminus of neighbour sequence of sequence listing upward to telomere on chrosomal short arm and 5'-terminus of this base sequence : 85218
ttacactctccactctcctttgatttattttcagcccattttcctttcctagggtagagattgtttttgtatccacacacacacacatgcacacacacacacacacacacacacacacacacctctactaagacatcattttgattttccacaggcacatcaaact

SEQ ID NO: 19712 - DNA, 255 bp, Homo sapiens
  chr13.fa.O7frz.38025529
  Located on chromosome 13
  Distance between a terminus base of telomere on chromosomal short arm and 5'-terminus of this base sequence : 35336122
  Distance between 3'-terminus of neighbour sequence of sequence listing upward to telomere on chrosomal short arm and 5'-terminus of this base sequence : 84540
tctaatgtcaggcatttctaagacaacaactctaacttttttaacaacactgcaaagtagattttagtatctctattttatataatacaatcatctgtgcttcaaatacacacacacacacacacacacacacacacacacactgtccaatttaatctttacaacaattctctagggtagatattgttatttttattttatagccaaaagtaattgagcgtcatcgaggagaagtaactcatcttggctcattta

SEQ ID NO: 19713 - DNA, 223 bp, Homo sapiens
  chr13.fa.O7frz.38146116
  Located on chromosome 13
  Distance between a terminus base of telomere on chromosomal short arm and 5'-terminus of this base sequence : 35443893
  Distance between 3'-terminus of neighbour sequence of sequence listing upward to telomere on chrosomal short arm and 5'-terminus of this base sequence : 107516
tttgttaagtatcgtggctaagcattcagtcttgggttttggtaaacaattttttttcttgttctgtctaaaatcctattctaagattctagaggagtctatttctttactggctgtgtgtatgtgtgtgtgtgtgtgtgtgtgtgtgtgtacatgattgtaataaagactgaaaagtgctcaattcagttgctgctttttctttaacagaaacaaagctcaa

SEQ ID NO: 19714 - DNA, 439 bp, Homo sapiens
  chr13.fa.O7frz.38218315
  Located on chromosome 13
  Distance between a terminus base of telomere on chromosomal short arm and 5'-terminus of this base sequence : 35519237
  Distance between 3'-terminus of neighbour sequence of sequence listing upward to telomere on chrosomal short arm and 5'-terminus of this base sequence : 75121
gtgacgaaggtaaagtaaggtcatatatccctctttcctctggcatctcagggtttggctacttgttctccactttttgtttttagaattgtggagtttctcctctccaaatgcacagactgttattctgaagccaatgtttgtatttccatataaactctatttctgggagcttcggaaagaagctctttggaaagaaacttgttccgggagccacggaaagaaaataatttccgttgtcttccttttgttggaaagggggggttactcagaaaggcccaatctattctgaaattaccatttatttagagccgtaactaatgaattattttgagatctaggaaagtcagactttgtgtgtgtgtgtgtgtgtgtttgtgtgcatttgtgtagagagagacagaagcagtaactctgctgaacagcattagaatgacat

SEQ ID NO: 19715 - DNA, 138 bp, Homo sapiens
  D13S1253
  Located on chromosome 13
  Distance between a terminus base of telomere on chromosomal short arm and 5'-terminus of this base sequence : 35693943
  Distance between 3'-terminus of neighbour sequence of sequence listing upward to telomere on chrosomal short arm and 5'-terminus of this base sequence : 174267
cagagccgtggtagtatattttttaaactctgtgtgtgtgtgtgtgtgtgtgtgtgtgtgtgtgtgtgtgtgacagtccccagtgagaatcagtctgagacctctttccagaaacatatacacgtacacaaatgcagg

SEQ ID NO: 19716 - DNA, 241 bp, Homo sapiens
  AL138702.8_70275
  Located on chromosome 13
  Distance between a terminus base of telomere on chromosomal short arm and 5'-terminus of this base sequence : 36026314
  Distance between 3'-terminus of neighbour sequence of sequence listing upward to telomere on chrosomal short arm and 5'-terminus of this base sequence : 332233
ggtcaatatcagaatttgagcttttaatctgaaatgggtggccattccagttttgtaggtatttgtgtgtgtgtgtgtgtgtgtttgtgtgtgtgtgtgtgtgtgtgtgttagtcagggttctctaaagggacaaaactaataggatatttgtatatatgaaggggagtttattaaggagaattgactcacatgatcacaaggtaaagtcccacgataggacatctgtaagctgaggatca

SEQ ID NO: 19717 - DNA, 420 bp, Homo sapiens
  AL138702.8_102780
  Located on chromosome 13
  Distance between a terminus base of telomere on chromosomal short arm and 5'-terminus of this base sequence : 36058689
  Distance between 3'-terminus of neighbour sequence of sequence listing upward to telomere on chrosomal short arm and 5'-terminus of this base sequence : 32134
gattactttgaaagctggttgtatgtaaagtggctagaccaagcctggcttgtggttgttacccattaaatgttagagcctacccctctgcttcttgactgtgttcaggagagctaaggtgctacttcagcacacactggcatgttgtgccactatgcagaattgcagtgagttgaaatgcagtttctggtgtggtcaggaaatgacaatacaattgtgtgtgtgtgtgtgtgtgtgtgtgtgtgtgtgtgtgtgtgtgtattaattaaccttttatctctcactcacatgtgtttagcactaaatgtctttctgataatcagaaaaaggcatctgtgtaaaaactagagatcgtctagtttctgttcaatatttggccattggccaagctttccccagttcagctctatgcgtatgact

SEQ ID NO: 19718 - DNA, 302 bp, Homo sapiens
  AL138702.8_165052
  Located on chromosome 13
  Distance between a terminus base of telomere on chromosomal short arm and 5'-terminus of this base sequence : 36121057
  Distance between 3'-terminus of neighbour sequence of sequence listing upward to telomere on chrosomal short arm and 5'-terminus of this base sequence : 61948
atttccaagttccaaacctaacaagccctctcctgctcacatatttctgacctacaaaacaatcaagccattgaaaggcaggtatattagtcaggattctccagagaaacagaaccaatgagagagagagagagagagagagagagagagagagagagagagagagattagacgtgttagagacgatatactatgaaaattgactcacatgataatagaagccggaaagtcccacaacgtgccatctgtaaactgaagaatcagggaagctggaggtggtataatccagtctgagttggaag

SEQ ID NO: 19719 - DNA, 335 bp, Homo sapiens
  chr13.fa.O7frz.38854020
  Located on chromosome 13
  Distance between a terminus base of telomere on chromosomal short arm and 5'-terminus of this base sequence : 36225122
  Distance between 3'-terminus of neighbour sequence of sequence listing upward to telomere on chrosomal short arm and 5'-terminus of this base sequence : 103763
agactgtttcaggacatatgatagaaactctcgctactgtctttttaaaaagaatctcagatgattctgatgattcagacaggtttgggaaccattctcctggtacatacgtgtatacacacacacacacacacacacacacacgactacattgtatgtagataggactacatagatatgactgtgttgtcatagcagaaataaaaaaccagaaaagaatcgtgcatgtgtggagtcttgtgtgggaaggcgggagatcttccattaatgaataaaatgatctggagtaaatcccttctctgccccaggcctcatctggaaagtaagaatttaga

SEQ ID NO: 19720 - DNA, 263 bp, Homo sapiens
  D13S1248
  Located on chromosome 13
  Distance between a terminus base of telomere on chromosomal short arm and 5'-terminus of this base sequence : 36307555
  Distance between 3'-terminus of neighbour sequence of sequence listing upward to telomere on chrosomal short arm and 5'-terminus of this base sequence : 82098
cagacatggaactgagatttttttcacatttatgtatactaaaattaatatatatgtgtgtatgtatatgtacatgtgtgtaaatatatacatatatacacatagacatatatttatgtatatatgtttatatgtgcatatacattgtatatttaattcagaacatatatgtgtgtgtgtgtgtgtgtgtgtgtgtgtatatatatatgtatgttgggtatgtgtgtatgtacgtgtgtattcaactaatcccacataaggga

SEQ ID NO: 19721 - DNA, 396 bp, Homo sapiens
  chr13.fa.O7frz.40136511
  Located on chromosome 13
  Distance between a terminus base of telomere on chromosomal short arm and 5'-terminus of this base sequence : 36400113
  Distance between 3'-terminus of neighbour sequence of sequence listing upward to telomere on chrosomal short arm and 5'-terminus of this base sequence : 92295
taaattgttctaccgtaaagacacatgcacagccaggtgcagtgactcacgcctgtaatcccagcactttgggcggctgaggcaggcggatcaccctgagctcaggagttggagaccagccggggcaacatggcaaacacacacacacacacacacacacacacacacacacacacactagctgggcatagtggcgagtgcctgtagtcccagctacttgggatgctgaggtgcgaggatcaattgagcctgggagacaggttgcagtgagccaagatcatgccactgcactccagcctgggcaacaaactgcctcaaaaaaaaaaaggacacatgcacgtgtatgttcatcgcagcactattcacaataaaaagacatggaagtaacctagatgc

SEQ ID NO: 19722 - DNA, 325 bp, Homo sapiens
  chr13.fa.O7frz.39926892
  Located on chromosome 13
  Distance between a terminus base of telomere on chromosomal short arm and 5'-terminus of this base sequence : 36605549
  Distance between 3'-terminus of neighbour sequence of sequence listing upward to telomere on chrosomal short arm and 5'-terminus of this base sequence : 205040
gagacatttagacttggactgagccacatgaccaggatcccagactttccagctgcagtgggacttcacagcctccataatctcatgagccagttcccctaataaggggagttccctaataagccagttccactcatctatctatctatctatctatctatctatctatctatctatccatccatcaatcatctgtgtgtctatctacctatccatctatccagccatcttattggttctgtctctctggaagtccttgatgaatatactcctagttttcttttccagtgttatcaattttgtgtgtatcctttcaggcttattt

SEQ ID NO: 19723 - DNA, 342 bp, Homo sapiens
  chr13.fa.O7frz.39657266
  Located on chromosome 13
  Distance between a terminus base of telomere on chromosomal short arm and 5'-terminus of this base sequence : 36847367
  Distance between 3'-terminus of neighbour sequence of sequence listing upward to telomere on chrosomal short arm and 5'-terminus of this base sequence : 241493
gtttagtgcaaatcaagtgaacatatatgtataggtctgtttctgggctttttgtcctttcattatgacgtgtctatacttaagtccagaccacagttttaattattatggctttatagtgagtcttgaaaacttgggtataagtcctccaactttgtacttccttgtttaaaaactatcttggctctcctagattttttgaatttccgtataaattttagaatcatcttggcaatttacatacacacccaaactcacacacacacacacacacacacacacacacagacagtattttgacctagggattgactatgtaacttaatttggagacaattgaca

SEQ ID NO: 19724 - DNA, 367 bp, Homo sapiens
  chr13.fa.O7frz.39538000
  Located on chromosome 13
  Distance between a terminus base of telomere on chromosomal short arm and 5'-terminus of this base sequence : 36967574
  Distance between 3'-terminus of neighbour sequence of sequence listing upward to telomere on chrosomal short arm and 5'-terminus of this base sequence : 119865
ctgaaataaccatcgtcaatagtttgatatatgtcctctcactcgacattaaatggcagttacagatttatctgctgttttatttgacttgtatgggagcataccatacatatattgtcctgcagtgtgtgtgtgtgtgtgtgtgtgtgtgtgtgtgtgtgtgtgtgtgtattttgttacttagcaatatatcttgaaagcatttccttgtcagtacatagagatagaccttattcattttatagttctatatgtcccattgttatgaatgcagactataatttcttttaccattttccttttgaatgatggagctatagtagatccttttacacatgttcttgtgtacatgtttgagtacaattca

SEQ ID NO: 19725 - DNA, 441 bp, Homo sapiens
  AL355132.6_25937
  Located on chromosome 13
  Distance between a terminus base of telomere on chromosomal short arm and 5'-terminus of this base sequence : 37048430
  Distance between 3'-terminus of neighbour sequence of sequence listing upward to telomere on chrosomal short arm and 5'-terminus of this base sequence : 80489
gcagctaaatgtagcatcttattaagggctgaaagttacctgaatctatttgagagctaaaacattttgttcagaaattccaaaatagatgccaaattggaatacttcatttcagactcccaagagctttactttttacgcatggttttgtggcatgtccttggttgaggggatggcgagaagagtggcctctttttgaatgattctcatttttgttgttgttgttgttgttgttgttgttgttgttgttgtttttctgagccagggtctcactctgttgcccaggctggagtgtagtggcttgatctcagctcactgcaacctctgcctgcccctggctcaagtgatcctcccacctcagcctcccgaatagttgggattatcggcacgagccactgctcatggactagttttttttaagtgacaaacacttgactattg

SEQ ID NO: 19726 - DNA, 358 bp, Homo sapiens
  AL355132.5_25937
  Located on chromosome 13
  Distance between a terminus base of telomere on chromosomal short arm and 5'-terminus of this base sequence : 37048516
  Distance between 3'-terminus of neighbour sequence of sequence listing upward to telomere on chrosomal short arm and 5'-terminus of this base sequence : -355
agatgccaaattggaatacttcatttcagactcccaagagctttactttttacgcatggttttgtggcatgtccttggttgaggggatggcgagaagagtggcctctttttgaatgattctcatttttgttgttgttgttgttgttgttgttgttgttgttgttgtttttctgagccagggtctcactctgttgcccaggctggagtgtagtggcttgatctcagctcactgcaacctctgcctgcccctggctcaagtgatcctcccacctcagcctcccgaatagttgggattatcggcacgagccactgctcatggactagttttttttaagtgacaaacacttgactattgaaa

SEQ ID NO: 19727 - DNA, 300 bp, Homo sapiens
  AL133318.7_28198
  Located on chromosome 13
  Distance between a terminus base of telomere on chromosomal short arm and 5'-terminus of this base sequence : 37242649
  Distance between 3'-terminus of neighbour sequence of sequence listing upward to telomere on chrosomal short arm and 5'-terminus of this base sequence : 193775
gaaggtaaatctagaactggtaagtagagctcattgaaaggcaggaccttctcaccagtgggtggcctgactgtgacgggtttaataaatattaactgcgttatgttatgttatgttatgttatgttatgttatgttatgttatgttatgttatgttatgttatgttattgagattcagggctcagctgccctcacctaagcctatctctggaatgcattttctgcctatcttctaactgcctgcttctgcatcggtcttcccaaccagatgatgatggtgtcttattcatttctgcatc

SEQ ID NO: 19728 - DNA, 345 bp, Homo sapiens
  AL158134.9_63039
  Located on chromosome 13
  Distance between a terminus base of telomere on chromosomal short arm and 5'-terminus of this base sequence : 37404478
  Distance between 3'-terminus of neighbour sequence of sequence listing upward to telomere on chrosomal short arm and 5'-terminus of this base sequence : 161529
gctaaaagcctagaaagttatcactggggctttaaaatggcttttgaattgagttgctgttcgaactgagtacatcattgtaataataataataataataataatcttggagatctcttattttcaacaattgaaaaaaggtttaaattaaaagaaggacgcataatgtcatggctagccttagaaaactctcttaagcagtgaaaatccttcacaaactcaaaaatgactgctccaggctccttcttggaagaataatggtgactgtcctgtgctgtctctcagtagctaaggtattgccctttcacaatggtaactgcctcgtgctgtagctcagtagctaaa

SEQ ID NO: 19729 - DNA, 401 bp, Homo sapiens
  AL158134.9_20087
  Located on chromosome 13
  Distance between a terminus base of telomere on chromosomal short arm and 5'-terminus of this base sequence : 37447275
  Distance between 3'-terminus of neighbour sequence of sequence listing upward to telomere on chrosomal short arm and 5'-terminus of this base sequence : 42452
ttctaagaccaaataactgcatttgctatttgtttctatcttcttttcaaaacaaagtacaagttcagattcttttttgccttactttcttgctgttttgtttatttcttctattttccccttttctcctttttctcttgctccctctctccttccttccctccctccctcttcccttcccttcccttctccttccttccttccttcatctatctatctatctatctatctatctatctatctatctatctatctatctacctatctatctatcaaaattccaggttttaatactattcaatggactgtgttctcctactgtcattgtgtctgttgcgccactgagtctgtcttgtctgcgttatgtttttctcagtagtctttaacatatacctgcatcc

SEQ ID NO: 19730 - DNA, 393 bp, Homo sapiens
  chr13.fa.O7frz.30193668
  Located on chromosome 13
  Distance between a terminus base of telomere on chromosomal short arm and 5'-terminus of this base sequence : 37590083
  Distance between 3'-terminus of neighbour sequence of sequence listing upward to telomere on chrosomal short arm and 5'-terminus of this base sequence : 142407
atacttcaaggatgtaaccagagaaaatctttttaagatgatgacatttggattgagaaagaaagaaagaaagaaagaaagaaagaaagaaagaaagaaagaaagaaagaaagaaagaaagaaagatactgtgaaatattctggaggggcagaattccaggcaaaggcaacatcaagtgcaaaggcccaaggctgactgaaacaggatgatgtgtttgatggtgtgtggctcaagcagagtgaacaggggtatacacatggaatgaaggggtaaccagagaccagatcccagagcatcttacaggccaatttcacctctgtttattgaaacctaaaaaatatttttctctggaggaaactgatgccaagagaggctgacatgtctagttaatc

SEQ ID NO: 19731 - DNA, 165 bp, Homo sapiens
  D13S260
  Located on chromosome 13
  Distance between a terminus base of telomere on chromosomal short arm and 5'-terminus of this base sequence : 37693458
  Distance between 3'-terminus of neighbour sequence of sequence listing upward to telomere on chrosomal short arm and 5'-terminus of this base sequence : 102982
cccagatataaggacctggctatgtactaaagacttaaagacgtgatgtgtgtgtgtgtgtgtgtgtgtgtgtgtgtgtgtgtgtgtgtgtccacagaaataatctttcttggtacatgcttagcaatctgaaaaaaattttttcatggaacggagacaatatct

SEQ ID NO: 19732 - DNA, 307 bp, Homo sapiens
  U73331.2_22671
  Located on chromosome 13
  Distance between a terminus base of telomere on chromosomal short arm and 5'-terminus of this base sequence : 37693466
  Distance between 3'-terminus of neighbour sequence of sequence listing upward to telomere on chrosomal short arm and 5'-terminus of this base sequence : -157
taaggacctggctatgtactaaagacttaaagacgtgatgtgtgtgtgtgtgtgtgtgtgtgtgtgtgtgtgtgtgtgtgtgtccacagaaataatctttcttggtacatgcttagcaatctgaaaaaaattttttcatggaacggagacaatatctccattttttattccatcttttacaatatttatttgggcattgcaagcagatccatttttgcctgtgacaaacacctatagttttcttgttcaaaacttctatatagctgtggtgacagtggctataaatagcttattaggagccatttga

SEQ ID NO: 19733 - DNA, 293 bp, Homo sapiens
  U73331.2_25546
  Located on chromosome 13
  Distance between a terminus base of telomere on chromosomal short arm and 5'-terminus of this base sequence : 37696143
  Distance between 3'-terminus of neighbour sequence of sequence listing upward to telomere on chrosomal short arm and 5'-terminus of this base sequence : 2370
tagataagccgttcagatgaagtgaaaaatcaataggtcagcaagagctatacccagagcaagagtgacgtgaatgctctgccatcattattgttagccagggaaaagcagttagagagcaccactctgtctgctctactgatgggtatgataatttcatcatgtgtggttttagattatactgtcttaatgagatctgcagcgagggggagttgaaccgcagagaatgattttgtgtgtgtgtgtgtgtgtgtgtgtgtgtgtgtgtgtaagtagcatcctaatgattctga

SEQ ID NO: 19734 - DNA, 359 bp, Homo sapiens
  AC002525.1_44501
  Located on chromosome 13
  Distance between a terminus base of telomere on chromosomal short arm and 5'-terminus of this base sequence : 37746858
  Distance between 3'-terminus of neighbour sequence of sequence listing upward to telomere on chrosomal short arm and 5'-terminus of this base sequence : 50422
tgatacatgctacttggtactgacattgcaggtcaagtaggggaaatgattgataatcagtaatggtgctgggatatttggttttctatatgaaaaaatatgtgtgtgtgtgtgtgtgtgtgtgtattttttaacctcataccacatacaaaaatacattccacagggcttaaaaagctaaatggtgttgataaaaaagccgaactctgtaaaatatttaaagaggtttattctgagctaatatgagtgaccatggcccagggaacagtttcaggaggtcctgagaaattgagaccaaagtgttcaggttagtttggttttgtacattttagggatactgaagttacaggcaaagacat

SEQ ID NO: 19735 - DNA, 291 bp, Homo sapiens
  U73330.1_1489
  Located on chromosome 13
  Distance between a terminus base of telomere on chromosomal short arm and 5'-terminus of this base sequence : 37844659
  Distance between 3'-terminus of neighbour sequence of sequence listing upward to telomere on chrosomal short arm and 5'-terminus of this base sequence : 97442
ttcttgattggctaaggagttaaccccaggatgtgtgtgtgtgtgtgtgtgtgtgtgtgtgtgtgtgtgtgtgtgtgtgaatgatatatatacatacctatacacacacacgtttgtttaatgaaatgggagagaagttgagacatacctttttgtgcttcaatgtgagcctgtgagagttagtagtttagctgatacaaaacccctttgtaatctattatgcagcctgttattagcaatcagtcctacaagtgctattattttcatcctccaagtaaagcataggagttg

SEQ ID NO: 19736 - DNA, 154 bp, Homo sapiens
  U73330.1_6332
  Located on chromosome 13
  Distance between a terminus base of telomere on chromosomal short arm and 5'-terminus of this base sequence : 37849477
  Distance between 3'-terminus of neighbour sequence of sequence listing upward to telomere on chrosomal short arm and 5'-terminus of this base sequence : 4527
tgccttatgtatttcttggtattctctctttctctctctctctgtatttcttggtattctctctctctctctctctgtgtgtgtgtgtgtgtgtgtgtgtgtgtgtgtgtgtgtctgtgtctgtctgtctgtctctgtcactttcaggtagcat

SEQ ID NO: 19737 - DNA, 324 bp, Homo sapiens
  U73330.1_24326
  Located on chromosome 13
  Distance between a terminus base of telomere on chromosomal short arm and 5'-terminus of this base sequence : 37867312
  Distance between 3'-terminus of neighbour sequence of sequence listing upward to telomere on chrosomal short arm and 5'-terminus of this base sequence : 17681
aggatggtagtaagctccataaacccctcccccagtccaggtgataattgcattgtttgttttaatcactcaaaggaccaaaggataaagaacactgtgaggaacttagtgctttataggtactttcatttttagttttgttggctgatgtccctgccagttcttagccttcttcaccctctctccttccctccctgctctttgtctctctgtttctctctctctctgttttacacacacacacacacacacacacacacacaaacacacacacacgtgctggagagcaccatcccctcagcataggcctatttgaaagacctt

SEQ ID NO: 19738 - DNA, 316 bp, Homo sapiens
  AC000062.1_37460
  Located on chromosome 13
  Distance between a terminus base of telomere on chromosomal short arm and 5'-terminus of this base sequence : 37915153
  Distance between 3'-terminus of neighbour sequence of sequence listing upward to telomere on chrosomal short arm and 5'-terminus of this base sequence : 47517
ttctgtcctcattgaattacagtaattagtatagactaaactagtaaataccagaatatattacaggttttaagggtaaacattttatgatactttcagttgtgcatgtgcataccagaccatagtgtattttttatggtggtggggtaggggcagagattttctcttaagttgaagaagcaatgtgttagcctataagttccttggaggcaatatctgtgtgggatgcatcttgacacatacacacatgcaaacacacacacacacacacacacacatatcccatgtccccatgtttaggacagtgtttgcgtat

SEQ ID NO: 19739 - DNA, 225 bp, Homo sapiens
  AC002483.1_21501
  Located on chromosome 13
  Distance between a terminus base of telomere on chromosomal short arm and 5'-terminus of this base sequence : 38009970
  Distance between 3'-terminus of neighbour sequence of sequence listing upward to telomere on chrosomal short arm and 5'-terminus of this base sequence : 94501
tagaatttgtgttccaggtgagaattgcattcattttgctgtattaaatttgtgtgtgtgtgtgtgtgtgtgtgtgtgtgtgtgtgtgtttcctgaaatgatggcagtgccttgggatatggttcagtactttgaaactgttataatgggatcatcctttgattaaaggaaccatcagttaccatgttacctctttttcacttgtattcaacttatttcaggcca

SEQ ID NO: 19740 - DNA, 413 bp, Homo sapiens
  chr13.fa.O7frz.31244472
  Located on chromosome 13
  Distance between a terminus base of telomere on chromosomal short arm and 5'-terminus of this base sequence : 38281164
  Distance between 3'-terminus of neighbour sequence of sequence listing upward to telomere on chrosomal short arm and 5'-terminus of this base sequence : 270969
taagacagaatcttgctctgttacccaggctggagtgcagtgatgtgatcacagctcactgcagcctctacctccagggttcaagtgattctcctgtctcagactccagagtagctgggactacagcagcgccaccatgcctggctctttttctttccttcctttccttcccttctttcccttgtttcccttccttccctccctccctcccaccccatccccttctctctctctctctctctctctctctctttctgacgtgttctccatgctgtccaggctggtctcgaactcctggattcaaatgatctgcctgcctcagcctcccaaagtgctgggaatacaggtgtgagccaccgcacctggcctaaaatgtgatacttaaagggatatttgcataaacattcacatta

SEQ ID NO: 19741 - DNA, 402 bp, Homo sapiens
  Z75889.1_44479
  Located on chromosome 13
  Distance between a terminus base of telomere on chromosomal short arm and 5'-terminus of this base sequence : 38510258
  Distance between 3'-terminus of neighbour sequence of sequence listing upward to telomere on chrosomal short arm and 5'-terminus of this base sequence : 228681
ctcaaatttgcagtgcttagacagcttgctctgagcttctgctctacagcattgaccttagggccatccattcttcctcccatctttgctctccccttccatcctcctcccttctttttccctcctttcctcttcgtctgtgagtgtgtgtgtgtgtgtgtgtgtgtgtgtgtgtctgtttctacacctcccctttctccttccctttttctctggatgttcctttttctttagcatccttttcttgtgttgctaatacagtattttctctgagagtgtcaatggtaggtagttttttggggaatttttctttttcttccaaaatgtctgtatctgctatttgtttttttcaccttatatttgcttttgtctttttttccatgttaaaggctttcctcaaat

SEQ ID NO: 19742 - DNA, 428 bp, Homo sapiens
  Z75889.1_98580
  Located on chromosome 13
  Distance between a terminus base of telomere on chromosomal short arm and 5'-terminus of this base sequence : 38564219
  Distance between 3'-terminus of neighbour sequence of sequence listing upward to telomere on chrosomal short arm and 5'-terminus of this base sequence : 53559
taaattcacttgtttcaacatcagaaggatgcaaaaaagaatatacggtgaaaagttcccccacccatgtatccccagccacttagtttcctttcccagaggcagagccattgttagtagtttctaaacgtacttttccagagatattttattcatatacaagtaagggcatgtaaatatgcacgtgcacacatgcatgcacatacacacgcatattttgtttccctctctctccttatgccaatggcatattttagtcacccttctgatttcaaaaattaaaacacacacacacacacacacacacacacaaacatatattttgttttctttttttttttctgagatagagtcttgctctgtcatccaggctggagtgtagtggcgtgatctctgctcactgcaacctccacctttcttgttcaagt

SEQ ID NO: 19743 - DNA, 373 bp, Homo sapiens
  Z75889.1_106295
  Located on chromosome 13
  Distance between a terminus base of telomere on chromosomal short arm and 5'-terminus of this base sequence : 38572116
  Distance between 3'-terminus of neighbour sequence of sequence listing upward to telomere on chrosomal short arm and 5'-terminus of this base sequence : 7469
gtagacctcatgtcaatccactaccaagatatgaaggccaaaaatacatacattaaatattgttattttctagctgtaatttcttataaaccctttcagtctgtgtgtgtgtgtgtgtgtgtgtgtgtgtgtgtgtgtgtgtgtatttgtttatagttcgtattacgaactaccttttcacattgttctagctggaggttatgatactagttttgcagacttgtacaatagccccacctttacatcaatgaatgatgcttgatactttgagtctcagtataaacctgtttttctcggcattggtctcaagctgcagtttttgtatacttgaaagcagcactggactagaaggtaggccacttaccaacttacc

SEQ ID NO: 19744 - DNA, 383 bp, Homo sapiens
  Z84572.1_58676
  Located on chromosome 13
  Distance between a terminus base of telomere on chromosomal short arm and 5'-terminus of this base sequence : 38638079
  Distance between 3'-terminus of neighbour sequence of sequence listing upward to telomere on chrosomal short arm and 5'-terminus of this base sequence : 65590
atccaagttcaaacgtctcagcatccttgcttgtcctcatcattgcaaaatggctgcagcagctcagtcatcacatgttattgtgatcatgtcagcagcagaagggggattttcctgtgtgtgtgtgtgtgtgtgtgtgttgttgttaaaaaaaaataccctttttgtactgccctccccaaccaccagatttttcttagtatttcaatgaccagagttgtatgccccatgccctcacctgttactggtaagaggaataaaactatcatggctcctatttaactgctatcttgttttatttcacaagtttattcatatagacataataagaggtgttaactaataaataaataccttttttttggtatggctaacaaagctag

SEQ ID NO: 19745 - DNA, 207 bp, Homo sapiens
  Z67106
  Located on chromosome 13
  Distance between a terminus base of telomere on chromosomal short arm and 5'-terminus of this base sequence : 38638165
  Distance between 3'-terminus of neighbour sequence of sequence listing upward to telomere on chrosomal short arm and 5'-terminus of this base sequence : -297
tcatgtcagcagcagaagggggattttcctgtgtgtgtgtgtgtgtgtgtgtgttgttgttaaaaaaaaataccctttttgtactgccctccccaaccaccagatttttcttagtatttcaatgaccagagttgtatgccccatgccctcacctgttactggtaagaggaataaaactatcatggctcctatttaactgctatcttg

SEQ ID NO: 19746 - DNA, 298 bp, Homo sapiens
  Z84572.1_78210
  Located on chromosome 13
  Distance between a terminus base of telomere on chromosomal short arm and 5'-terminus of this base sequence : 38657687
  Distance between 3'-terminus of neighbour sequence of sequence listing upward to telomere on chrosomal short arm and 5'-terminus of this base sequence : 19315
ttctggaatttgtgtcttgaaggccttctgttcgttttactctgtgtgtgtgtgtgtgtgtgtgtgtgtgtgtgtgtttatatgtgcggaggggaaccctgaaggaattgctgatgaacgaacgtccagcaggcctaactcagggtgactgctcttctatcttgcctaaagatgcccattgagtctgtggtgggaggttatctctccccactgtgagtggattaaagacaacagggaccaacaggagacggtttgagccttgccagatattgggtgctgaacgaggtgactagtgtct

SEQ ID NO: 19747 - DNA, 366 bp, Homo sapiens
  Z84572.1_93463
  Located on chromosome 13
  Distance between a terminus base of telomere on chromosomal short arm and 5'-terminus of this base sequence : 38672872
  Distance between 3'-terminus of neighbour sequence of sequence listing upward to telomere on chrosomal short arm and 5'-terminus of this base sequence : 14887
tggtcctaagcatttcagataagggatactctttgtgtgtgtgtatgtgtatgtgtgtgtgtgtgtgtgtttgtatatattatcaaaggaaagagtattgtgtgtgcgcgcgcgcacacacacacacacacacacacaatactctttcctttgataatattaaccctcatctacatttagatgacttctcccttgctctcaaacttcaatttcacatttctaaataccctgtggctggcagcctctgagatagaccctaatgattcctgcctcctggtactgatgactttgtaagattatattccctttgagtaacttgcttctaacaaatatggcaatatgagagatgtcacttccatgattagg

SEQ ID NO: 19748 - DNA, 353 bp, Homo sapiens
  Z92540.1_63381
  Located on chromosome 13
  Distance between a terminus base of telomere on chromosomal short arm and 5'-terminus of this base sequence : 38779916
  Distance between 3'-terminus of neighbour sequence of sequence listing upward to telomere on chrosomal short arm and 5'-terminus of this base sequence : 106678
ggtcaaagtgaataaggtgataacttaccagcatgtgagctatctttttatttttagaatagctctttctaaggtttattgcttttggaaagaagttttaggatattattatatttgtatgttctaatgcctgggtatcatcccctacacacacacacacacacacacacactcactcacacacatcatggctttgttaagctattgagtctcagatcacctgtaaaaggtattaagtagggcaatgattcttaaactttaatgaacatataaatcatcatgccaaaaagcagatccttaggtgaggtgaagctcaagattctgtcttcctaacagacttctgatccagaaat

SEQ ID NO: 19749 - DNA, 378 bp, Homo sapiens
  chr6.fa.O7frz.162749796
  Located on chromosome 13
  Distance between a terminus base of telomere on chromosomal short arm and 5'-terminus of this base sequence : 38789989
  Distance between 3'-terminus of neighbour sequence of sequence listing upward to telomere on chrosomal short arm and 5'-terminus of this base sequence : 9720
tttgaaactctgtagcctatgaatgggggacaagtggctcacaaaagaaaccccaggagcttctgtcagcaaagcagggatgcatactacaacaaaaagacaaagaaaccaaaaaatcaaacaacaagtgtctaccacattaaggggcttagtttcattgtttcttgaaccctcagggcttggtatcatgtagaataaacactgtttgtttaattactgaatgaatgaacgcataaacaaaggctgggagatgactcagataactgcttgaggtccttctaaccccatattctgaagggcgtgtgtgtgtgtgtgtgtgtgtgtgtgtgtgtgtgtgtgtacattaaataggtaggtgatcatgactacagagttggc

SEQ ID NO: 19750 - DNA, 330 bp, Homo sapiens
  Z84483.1_42572
  Located on chromosome 13
  Distance between a terminus base of telomere on chromosomal short arm and 5'-terminus of this base sequence : 38905787
  Distance between 3'-terminus of neighbour sequence of sequence listing upward to telomere on chrosomal short arm and 5'-terminus of this base sequence : 115420
agtaatcaaatgaaagctgcacgtatttgttggtgatatatacatggacacccagggccgcctttcacgtaagcacagggtagatcatacgcagacccagagccttttcttcacacacatacctaccgacttacctacacacacacacacacacacacacacacacacacaccctcagctgattctgcagcagccttcacccagctgtacttttgtaatggccttgctgaattgggttcccatttctgctgttttgcagaccccttcagaaagcaatagtaaacatcctctacatctaatagaaaagagttaagcaagtcaaagctagca

SEQ ID NO: 19751 - DNA, 307 bp, Homo sapiens
  Z73358.1_19229
  Located on chromosome 13
  Distance between a terminus base of telomere on chromosomal short arm and 5'-terminus of this base sequence : 39011603
  Distance between 3'-terminus of neighbour sequence of sequence listing upward to telomere on chrosomal short arm and 5'-terminus of this base sequence : 105486
tgtttactctacctctaaggtgctctcccttagcccaagaagaagataacactatgccccttggaggcctaaggcatatcagctttgtcctgctctgtctcccgtgggctatcaatttctgactttggaatttggagacatagatattctatctctgtctttcactcacacatacatacacacacacacacacacacacacatattcatgcacatggattctgtaaatatgtcttaggtaaaactgcaaacatccttaaataaatatgtggattttgtatcctcttaaattttgacattgcaggtac

SEQ ID NO: 19752 - DNA, 368 bp, Homo sapiens
  Z73358.1_35279
  Located on chromosome 13
  Distance between a terminus base of telomere on chromosomal short arm and 5'-terminus of this base sequence : 39027809
  Distance between 3'-terminus of neighbour sequence of sequence listing upward to telomere on chrosomal short arm and 5'-terminus of this base sequence : 15899
tgtaagcgtactggttgaaaactcagttctatagacagatttaggcagggttaattattgaagaatatagctatttggtgtgaattgagttatctctatagacaaaggaagagagttgtgtgtgtgtgtgtgtgtgtgtgtgtgtgttttcaatagacctcttaagcgtcagcccaataaaacttgtttgtatcgcaagtgggcttattgtcagagttaaatatttacgctatctcattctctcagatctgatgaaggaacaaactttataaatattctctttcctctccgtcagcgagccaattccacttcggtctgcccagcattcgacacagtgctgctgctgacgcagtaagtgctaatgtatg

SEQ ID NO: 19753 - DNA, 267 bp, Homo sapiens
  Z73358.1_44237
  Located on chromosome 13
  Distance between a terminus base of telomere on chromosomal short arm and 5'-terminus of this base sequence : 39036676
  Distance between 3'-terminus of neighbour sequence of sequence listing upward to telomere on chrosomal short arm and 5'-terminus of this base sequence : 8499
aacgctgccagtctatcacaaaccaaggggggtgctccttctcctaggcacccccaccgctagtgtcaggtgccttccttatataacacatcccattttaagttagcctaaaacttcacaggaagggaagaagtgttttaaaccaagcttaggtttttccatgcctaataagactcgaaagaagatgcccatgactgaaacacacacacacacacacacacacacacacccataaataatttttaatctgttaatactgtgcaaacc

SEQ ID NO: 19754 - DNA, 205 bp, Homo sapiens
  chr13.fa.O7frz.32102068
  Located on chromosome 13
  Distance between a terminus base of telomere on chromosomal short arm and 5'-terminus of this base sequence : 39111767
  Distance between 3'-terminus of neighbour sequence of sequence listing upward to telomere on chrosomal short arm and 5'-terminus of this base sequence : 74824
atcctacttcagtggacttgactgcaatccggattatgctgttttctaagcatttaaaataaaataaaaagtataatagtgtgataagttctttcacaaagcaagcaatcacatttatgtttctacttacatttgggttttccaaatatgtgtgtgtgtgtgtgtgtgtgtgtgtgtgtgtgtatgtagactttaaacatggtgc

SEQ ID NO: 19755 - DNA, 230 bp, Homo sapiens
  G09025
  Located on chromosome 13
  Distance between a terminus base of telomere on chromosomal short arm and 5'-terminus of this base sequence : 39265297
  Distance between 3'-terminus of neighbour sequence of sequence listing upward to telomere on chrosomal short arm and 5'-terminus of this base sequence : 153325
acctgttgtatggcagcagtctattgggagcaagggataaaatagtgaacaagacatggactttctagcctattggaaaggaagaaaggaagggagggaaggaaagaaggaaggaaggaaggaaggaaggaaggaaggaaggaaggaaggaaggaaactataagttctgacaagtgctctgaagaaatagagattgcagccatagaaactagttggggaaagagtcaact

SEQ ID NO: 19756 - DNA, 292 bp, Homo sapiens
  AL138999.7_127973
  Located on chromosome 13
  Distance between a terminus base of telomere on chromosomal short arm and 5'-terminus of this base sequence : 39265355
  Distance between 3'-terminus of neighbour sequence of sequence listing upward to telomere on chrosomal short arm and 5'-terminus of this base sequence : -172
gactttctagcctattggaaaggaagaaaggaagggagggaaggaaagaaggaaggaaggaaggaaggaaggaaggaaggaaggaaggaaggaaggaaactataagttctgacaagtgctctgaagaaatagagattgcagccatagaaactagttggggaaagagtcaacttctttagctagagtgagcagagaaggatttttaaaacaggtggcatttaggtttcaagagaaggagacagccaagctaagttatgggacagcaatgctgaagtcacctgaaatcttaagg

SEQ ID NO: 19757 - DNA, 273 bp, Homo sapiens
  chr13.fa.O7frz.32430412
  Located on chromosome 13
  Distance between a terminus base of telomere on chromosomal short arm and 5'-terminus of this base sequence : 39458541
  Distance between 3'-terminus of neighbour sequence of sequence listing upward to telomere on chrosomal short arm and 5'-terminus of this base sequence : 192894
cgactcactgcaacctaattttaggctatttctaagacagtcatcttttggttgaacaaggtaatgagttgggataaatatatcttttttcattcctggactctctctcttgtaaaacacacacacacacacacacacacacacacacacacacacacaccacatgcatcatggacacatatacttctaatgtttttcttttatttatcccagaaattgaactagggatgcccctgtctctattctttctgctctgtacctggtactaattaa

SEQ ID NO: 19758 - DNA, 476 bp, Homo sapiens
  chr13.fa.O7frz.32506388
  Located on chromosome 13
  Distance between a terminus base of telomere on chromosomal short arm and 5'-terminus of this base sequence : 39556457
  Distance between 3'-terminus of neighbour sequence of sequence listing upward to telomere on chrosomal short arm and 5'-terminus of this base sequence : 97643
gaggcttaaagaacaaaagtttaggccgggcaaggtggctcacacctgtaatcccagtaatttgggaggtcaaggcaggtggatcacctgaggtcaggagttcgagaccagcctggccgacatggtgaaaccctgtgtctactaataatacaaaaaaattagccaggcgtggtggcttacacctgtaatcccagctacttgggaggctgaggcaggagaatcgcttaaactcgggaggtggagattgcagtgaaccaaggtcgcgccattgcacttcagcctggtgacagagtgagaccctgtctctaaaaaaaaaagaaagaaagaaagaaagaaagaaagaaagaaagaaagaaaagaacaggacagaagtttattttctacaggttctggaggatagaaatccaacatccaggtgccagtagggttggtttctggttgcaaatggtcaccatcttgctatgtccttacatggt

SEQ ID NO: 19759 - DNA, 424 bp, Homo sapiens
  chr13.fa.O7frz.32685611
  Located on chromosome 13
  Distance between a terminus base of telomere on chromosomal short arm and 5'-terminus of this base sequence : 39738897
  Distance between 3'-terminus of neighbour sequence of sequence listing upward to telomere on chrosomal short arm and 5'-terminus of this base sequence : 181964
ctgtggttatctgtgatttcagaggcagctcactgggttctctatgatgtagaaagcttgaaccctagttctcacggagatcatcagctccacaaaattggctggagaattattattattgcagagaaggagggcaattgtcagggtttgttagtctgtattctataatagtctgtgtattggtcagggttcgccagagaaaaagaacacacaggagatacacacacacacacacacacacacacacacacacacacacacgctttaatatgaggaattgtctcaagaaatatggaggccaagaagtctcagaatctatagtttgggcaagctggatattcagaagtgaaaatggtttagatcctgtttaagtccaaaggcctgagaaccagaagagccaatgacataagttctaacctgaaag

SEQ ID NO: 19760 - DNA, 362 bp, Homo sapiens
  chr13.fa.O7frz.32765495
  Located on chromosome 13
  Distance between a terminus base of telomere on chromosomal short arm and 5'-terminus of this base sequence : 39823216
  Distance between 3'-terminus of neighbour sequence of sequence listing upward to telomere on chrosomal short arm and 5'-terminus of this base sequence : 83895
tgtctttcagattgataccaacattagtataaactaaagaaaaatgaaaatatattcgtgcagctgtttctgcatatcacctttaatcttccatgcacgttaaaatatgtgcttctcaaagaggaagaaagagaaacagagagagagagagagagagagagagagatctatttttgctttatgtgaatataaaagtaatttgttgccatggtgatatattttttccatcctgtattttccaaacacaggctttgcttcaggttttgggtacacagtctctcttgctgtcctccatttacaatgtcatgctccactgaccactgcaggtcaggcacaagctagtctacaagatcaaacgtcac

SEQ ID NO: 19761 - DNA, 121 bp, Homo sapiens
  chr13.fa.O7frz.32850747
  Located on chromosome 13
  Distance between a terminus base of telomere on chromosomal short arm and 5'-terminus of this base sequence : 39905428
  Distance between 3'-terminus of neighbour sequence of sequence listing upward to telomere on chrosomal short arm and 5'-terminus of this base sequence : 81850
tagtttggtaattctggaaattacattctcctacttcaccattcttggttatgtgtgtgtgtgtgtgtgtgtgtgtgtacactgttacaggctgtctctgtactgaggataagcctgaagt

SEQ ID NO: 19762 - DNA, 292 bp, Homo sapiens
  chr13.fa.O7frz.33042468
  Located on chromosome 13
  Distance between a terminus base of telomere on chromosomal short arm and 5'-terminus of this base sequence : 40091945
  Distance between 3'-terminus of neighbour sequence of sequence listing upward to telomere on chrosomal short arm and 5'-terminus of this base sequence : 186396
cagtgagccgagaacataccactgcactccagcctgggagacagagtgaaactccatttcaaaaaataaataaataaataaataaataaataaaagatcatttgcaatttgttacaaaaggaggcagctgtaagccaaattaaatttaacaatttcctcctttttgtcagtctttttaattttgagaaattgactaaaatcttggacattgacctcactctctttcccatgataatggactggttttgtcacaaaatgaaattcagaatttaccatgtcaggttagttgaat

SEQ ID NO: 19763 - DNA, 374 bp, Homo sapiens
  AL356321.9_147011
  Located on chromosome 13
  Distance between a terminus base of telomere on chromosomal short arm and 5'-terminus of this base sequence : 40105994
  Distance between 3'-terminus of neighbour sequence of sequence listing upward to telomere on chrosomal short arm and 5'-terminus of this base sequence : 13757
aggataatcgtttgaatggtggaggcagagattgcagtgagccgagatcttgccactgcactccagcctgggtgacaaaatgagaaaatgaaagaaagaaaagaaaaaagaaagaaagagaaggaaagaaagaaagaaagaaagaaagaaagaaagaaagaaagaaagaaagaaagaaagaaaagaaaggaagaaagaaagagaaagaaagaaaacagtgaaagaactgagcttcccatgagacaacgtaagagcacagtatgagagtgtggagtctgaggcggaaagactgtgaggacatgacctgggaattctcagaaatcgtgggaaggagtttgggattttaacagccctggataattatccagatcctc

SEQ ID NO: 19764 - DNA, 338 bp, Homo sapiens
  chr13.fa.O7frz.33230134
  Located on chromosome 13
  Distance between a terminus base of telomere on chromosomal short arm and 5'-terminus of this base sequence : 40222860
  Distance between 3'-terminus of neighbour sequence of sequence listing upward to telomere on chrosomal short arm and 5'-terminus of this base sequence : 116492
cataaactcaggtatggttgagaggagtttgttatgaataatgaaagatgtttctgttactcaggaaattccaagagattctaagctttgtaccaggaaccaaagacaaagatagattgatagatgatagatagatgatagatagatagatagatagataatagagatatataaaattataccataatgtgataattataaggttttgcaaaagtgctgttaagtatgaaaatgttaacaatgtcaatgtgcctctgtctgtgttcttttggctccaataatggtagatatatccatctcacatggacatatcctgctttgtttcactgccactataa

SEQ ID NO: 19765 - DNA, 388 bp, Homo sapiens
  chr13.fa.O7frz.33338525
  Located on chromosome 13
  Distance between a terminus base of telomere on chromosomal short arm and 5'-terminus of this base sequence : 40330671
  Distance between 3'-terminus of neighbour sequence of sequence listing upward to telomere on chrosomal short arm and 5'-terminus of this base sequence : 107473
aatatcagaattgcaggacacatctagaggacataggattttgcaaaaaaaaacaaaagaaagaaagaaagaaaagaaagaaagaaagaagaaagaaggaaggaaggaaggaaggaaagaaagaaagaaagaaagaagaaagaaggaaggaaggaaagaaataaaaagaaagaagaaagaaggaaggaagggaagaaacaaagaaagaaagaaaaagaaagaaagaaagaaagaaagagaaagaaagaaaagaaagaaagagaaagaaagaaagaaaagaaaagaaagaaagaaagaaaaagaaagaaagaaaagaaagaaagagaaagaaagaaagaaagaaaagaaaagaaagaaagagagagaaagatggacttcacctctacaa

SEQ ID NO: 19766 - DNA, 192 bp, Homo sapiens
  D13S220
  Located on chromosome 13
  Distance between a terminus base of telomere on chromosomal short arm and 5'-terminus of this base sequence : 40425973
  Distance between 3'-terminus of neighbour sequence of sequence listing upward to telomere on chrosomal short arm and 5'-terminus of this base sequence : 94914
ccaacatcgggaactgcaattcgaaatgagatttgggtggagccacagagccaaactatacacacacacacacacacacacacacatatgtatatgtatacacacacacgtgcgcgcacacacacacacacacacacacgcagaggggagggggaggtctagaaagtcttggacatggacttaaagaatgca

SEQ ID NO: 19767 - DNA, 215 bp, Homo sapiens
  Z66618
  Located on chromosome 13
  Distance between a terminus base of telomere on chromosomal short arm and 5'-terminus of this base sequence : 40511713
  Distance between 3'-terminus of neighbour sequence of sequence listing upward to telomere on chrosomal short arm and 5'-terminus of this base sequence : 85548
gtgcatgataatccaggccacattctttgattggttctgttgttgctgaaacagatatggtcatattaggagtggggaatattttttaaggattttaactaaagaaaaacttaaatgaagtttaaaaaactgatccaatcaacatactgtgtgtgtgtgtctgtgtgtgtgtgtgtgcgtgtgtgtgtgtgtgctcacaagagccttgggctgta

SEQ ID NO: 19768 - DNA, 256 bp, Homo sapiens
  chr10.fa.O7frz.61557346
  Located on chromosome 13
  Distance between a terminus base of telomere on chromosomal short arm and 5'-terminus of this base sequence : 40682597
  Distance between 3'-terminus of neighbour sequence of sequence listing upward to telomere on chrosomal short arm and 5'-terminus of this base sequence : 170669
tctgtgtctgacttacttcacttaccaaaatgtccttcaggttcatccatgttgtcacaagtgacaagatttcctgctttttaatagccaaataatattctattatggatatatatgtgtgtgtatatatatatatatatatatatatatacacatatatgtgtcttgtataatattgtctttatccattcatccattgatggacacttaggttgttaccataccttggctatcgtgaataatgctgcaataaaca

SEQ ID NO: 19769 - DNA, 101 bp, Homo sapiens
  DISO7_10003733
  Located on chromosome 13
  Distance between a terminus base of telomere on chromosomal short arm and 5'-terminus of this base sequence : 40686612
  Distance between 3'-terminus of neighbour sequence of sequence listing upward to telomere on chrosomal short arm and 5'-terminus of this base sequence : 3759
agaagtcaactcataatagttgcagtccttaaacacacacacacacacacacacacacacacacacacacacacacctgacctggcagagaaatgtaatat

SEQ ID NO: 19770 - DNA, 110 bp, Homo sapiens
  DISO7_10003730
  Located on chromosome 13
  Distance between a terminus base of telomere on chromosomal short arm and 5'-terminus of this base sequence : 40875094
  Distance between 3'-terminus of neighbour sequence of sequence listing upward to telomere on chrosomal short arm and 5'-terminus of this base sequence : 188381
acagcaggctgtgttgtggtgtgtgtgtgtgtgtgtgtgtgtgtgtgtgtgtgtgtgtgttctgggaatatgtaaaatctattttacatttctgctaagacagcttaatt

SEQ ID NO: 19771 - DNA, 161 bp, Homo sapiens
  DISO7_10003729
  Located on chromosome 13
  Distance between a terminus base of telomere on chromosomal short arm and 5'-terminus of this base sequence : 40877641
  Distance between 3'-terminus of neighbour sequence of sequence listing upward to telomere on chrosomal short arm and 5'-terminus of this base sequence : 2437
tgcctgaactaattgcttaaatactaaaatccgaaaggttagtatagggtttaactcttcatttgaaattgtgtgtgtgtgtgtgtgtgtgtgtgtattttttttaacagcaagcacttagaaatctttgactactttgagattatttattagccacctgc

SEQ ID NO: 19772 - DNA, 233 bp, Homo sapiens
  chr13.fa.O7frz.33931617
  Located on chromosome 13
  Distance between a terminus base of telomere on chromosomal short arm and 5'-terminus of this base sequence : 40943949
  Distance between 3'-terminus of neighbour sequence of sequence listing upward to telomere on chrosomal short arm and 5'-terminus of this base sequence : 66147
caacaaagtttcacctacttgttttagtttgttgatgattcttactagattatctttattgtgatgactgacaaatgatattttctaagacattaattaagttggcatatctactgtaaggaagaacttgttttactcctccactcatctatctatctatctatctatctatctatctatctatctatctgtctgtctatcatcttttatatcagtatggactcatgtattca

SEQ ID NO: 19773 - DNA, 438 bp, Homo sapiens
  chr13.fa.O7frz.34030037
  Located on chromosome 13
  Distance between a terminus base of telomere on chromosomal short arm and 5'-terminus of this base sequence : 41042420
  Distance between 3'-terminus of neighbour sequence of sequence listing upward to telomere on chrosomal short arm and 5'-terminus of this base sequence : 98238
taagcaaacattaccttatctgtcatgattaaagaccattcctagaagagactggccctcattcttggagtaagattgtgtatacgtgtacacacacacacacacacacacacacgtatgtattcacagtttttatagaagtataacacaaatatagaatataaaagcttattgaaagaatgaacacactcatcatcaacaaagtcaacaaatagactgtacaccaggaacgcctactttgcacttttttcccagtcactgttcttgcttttcttccaattccttaccctgacttttaatactaagctagttttgtcctttttgaattttatgtaaatgtaagtacatcctatgtatttctttgtctctggcttcttttgttcaacattatttttatgagattcatctactattgttgcatataacgagtttattcat

SEQ ID NO: 19774 - DNA, 393 bp, Homo sapiens
  chr13.fa.O7frz.34121581
  Located on chromosome 13
  Distance between a terminus base of telomere on chromosomal short arm and 5'-terminus of this base sequence : 41134762
  Distance between 3'-terminus of neighbour sequence of sequence listing upward to telomere on chrosomal short arm and 5'-terminus of this base sequence : 91904
cacaaatacaggtcaacagtattatattgtcattgaacaaattcaggaattacattgccttgacaaaagcaattctctgtgtgtgtgtgtgtgtgtgtgtgtgtatatctgtgtgtgtgtgacggagtcttgggttgtcacccagactggagtgcattggcgcggtattggctcactgcaacctctgcctcctgattcaagcaattctcttgcctcagcctcccgagtagctgggattataggtgctcaccaccacacccggctaatttttgtatgacaaaagcagttcttgaagggaaaacatataattgcagtgatacatttttattcagaatgttttcataagtcttctgtgttcagaatctctctctgtaggctgataaagttactgtt

SEQ ID NO: 19775 - DNA, 124 bp, Homo sapiens
  DISD22_0009007
  Located on chromosome 13
  Distance between a terminus base of telomere on chromosomal short arm and 5'-terminus of this base sequence : 41334146
  Distance between 3'-terminus of neighbour sequence of sequence listing upward to telomere on chrosomal short arm and 5'-terminus of this base sequence : 198991
ggaacaggtaacgtccaagttaaaagaggtatgtgtgtatgtgtgtgtgtgagagagagagagagagagagaaagagagagaaataagaacatttttaaaggcaaagaaagttgtggcaatgga

SEQ ID NO: 19776 - DNA, 204 bp, Homo sapiens
  DISD22_0009013
  Located on chromosome 13
  Distance between a terminus base of telomere on chromosomal short arm and 5'-terminus of this base sequence : 41406237
  Distance between 3'-terminus of neighbour sequence of sequence listing upward to telomere on chrosomal short arm and 5'-terminus of this base sequence : 71967
actaattggagaaatggtaagatgtagaaatcataaattataaattcaacattttatgagattactgaaatgtgatctcttttcccatttttggttgttttaagataaaataaaccatagttcatgaatgtgtgtgtgtgtgtgtgcgtgcgtgtgtgtgtgtgtgtgtgcgcgtttatgagatgctaacagttagtttatcca

SEQ ID NO: 19777 - DNA, 252 bp, Homo sapiens
  AL136527.9_3780
  Located on chromosome 13
  Distance between a terminus base of telomere on chromosomal short arm and 5'-terminus of this base sequence : 41597711
  Distance between 3'-terminus of neighbour sequence of sequence listing upward to telomere on chrosomal short arm and 5'-terminus of this base sequence : 191270
attaatttgaagcatgtttgactcttgattacaggcacatagatgcacacacagacacacacacacacacacacacacacacacacagagagagagagagagagagagagagaaataagtatcatgataaggaggtatccatccattcctattttactgaatattttgatcagtaggaatatttatcaaaagcatttttggaatttacagagatgctaatttttttttctcttgaccaatttacatggtaac

SEQ ID NO: 19778 - DNA, 195 bp, Homo sapiens
  D13S1247
  Located on chromosome 13
  Distance between a terminus base of telomere on chromosomal short arm and 5'-terminus of this base sequence : 41619968
  Distance between 3'-terminus of neighbour sequence of sequence listing upward to telomere on chrosomal short arm and 5'-terminus of this base sequence : 22005
ttcctcaatgtcttgcagttgcaaagtgttagactgcaattcatattcaggtttgttgatgccagaatctttacccttaacacacacacacacacacacacacacacacacacacacacacacacacacacactcagagagagagagtgagtgatattcaaggagggtgtggttaatagagccaaatgctgaaga

SEQ ID NO: 19779 - DNA, 394 bp, Homo sapiens
  chr13.fa.O7frz.41284535
  Located on chromosome 13
  Distance between a terminus base of telomere on chromosomal short arm and 5'-terminus of this base sequence : 41730632
  Distance between 3'-terminus of neighbour sequence of sequence listing upward to telomere on chrosomal short arm and 5'-terminus of this base sequence : 110469
caggtgctgtactatgtcatttatgtgtattaattcatttcatcatttcaacaatcccatgaaatacgttctacttttgtcacgccgtttaacacttgccaaggtttcacattagagctggtaaatgagagaaatgggacgtgaactcaggcagtctgtctcgagtccaagcctttaaccactatgcgatactgcccactaaattattagcctgctgtagtctagatactgtgtacatatatatgtgtgtgtgtgtgtgcatatatatatatgtgtgtgtgtgtgtgtgtgtgtactccacccttgagaattgcgttgatatgattctctgggtccatcttacaatgccatattatgattccacaatatgagattgtccattatcctattacaa

SEQ ID NO: 19780 - DNA, 209 bp, Homo sapiens
  D13S325
  Located on chromosome 13
  Distance between a terminus base of telomere on chromosomal short arm and 5'-terminus of this base sequence : 41831622
  Distance between 3'-terminus of neighbour sequence of sequence listing upward to telomere on chrosomal short arm and 5'-terminus of this base sequence : 100596
tctctctcagaagtttggaagcagaaagaagaataaatgttatctccagaatccttccagctaataacagttgaaattatgttattgcctctatctatctatctatctatctatctatctatctatctatctatcatctatctatctatctatctatctatctatctatctgtctatctcaaagccctcctctctagacacttaaagaa

SEQ ID NO: 19781 - DNA, 175 bp, Homo sapiens
  D13S1297
  Located on chromosome 13
  Distance between a terminus base of telomere on chromosomal short arm and 5'-terminus of this base sequence : 41852582
  Distance between 3'-terminus of neighbour sequence of sequence listing upward to telomere on chrosomal short arm and 5'-terminus of this base sequence : 20751
accatgcaatgccaggccctgtgtgtgtgtgtgtgtgtgtgtgtgtgtgtgtgtgtgtgtgtgtcttttaaaccaggatcaatgcttaagaaatatctacatttgtttcttttcaaagatccatgacagcatatgtctcatggttaaaaactgtgaactgggcagtagcgggaca

SEQ ID NO: 19782 - DNA, 418 bp, Homo sapiens
  chr13.fa.O7frz.41381565
  Located on chromosome 13
  Distance between a terminus base of telomere on chromosomal short arm and 5'-terminus of this base sequence : 42002014
  Distance between 3'-terminus of neighbour sequence of sequence listing upward to telomere on chrosomal short arm and 5'-terminus of this base sequence : 149257
ggttatttaaccttcatttacctccatttgctcataggaaagaatggcaatattaacagtatatacctcatagtattgttgagaggcttaaatgagtgtgtgtgtatatatatgtatatacatatacatatatatatatatatatacatagcctagaatggtatgtagtaaggaacagttatataagaattgaccaattttcttattttcaggaaagggcaggatggcctggtgggggtgctggtgagatgggtgagtgagtaatatacggctttcagaataaaaggattatagagtcggtgacccagtgtaatgcttaaacacccggtacagtgtcctcatcaagtgagcctatttttcttaagacttctggcaatatgaagctcattctttcctaagtctgttcattccattagaa

SEQ ID NO: 19783 - DNA, 178 bp, Homo sapiens
  D13S1270
  Located on chromosome 13
  Distance between a terminus base of telomere on chromosomal short arm and 5'-terminus of this base sequence : 42021925
  Distance between 3'-terminus of neighbour sequence of sequence listing upward to telomere on chrosomal short arm and 5'-terminus of this base sequence : 19493
ggcctcaaatgttttaagcaaagcacataaaactatactaagcagtgagtcagttcatcatacaaaggcatagtattgcattagttatatttaatggttattttcatcaccagagattttgtgtgtgtgtgtgtgtgtgtgtgtgtgtgtgttaaaaatcagtcaccagtgctcatgt

SEQ ID NO: 19784 - DNA, 174 bp, Homo sapiens
  D13S1276
  Located on chromosome 13
  Distance between a terminus base of telomere on chromosomal short arm and 5'-terminus of this base sequence : 42074188
  Distance between 3'-terminus of neighbour sequence of sequence listing upward to telomere on chrosomal short arm and 5'-terminus of this base sequence : 52085
aggatagcttgagcccgggaggtagaggctgcagtgagctgtgattgcacaattgcactccagcctgggtgagagaatgagaccctacctcaaaaaaagaaaatatgtgtgtgtgtgtgtgtgtgtgtgtgtgcgcgcgcatgtgtgtttgtgtgtgacctagacctgcaaaac

SEQ ID NO: 19785 - DNA, 132 bp, Homo sapiens
  D13S1227
  Located on chromosome 13
  Distance between a terminus base of telomere on chromosomal short arm and 5'-terminus of this base sequence : 42201253
  Distance between 3'-terminus of neighbour sequence of sequence listing upward to telomere on chrosomal short arm and 5'-terminus of this base sequence : 126891
aagccatcactgtgttcccatagaactctggcattacaggtttgctacttgcagaaaatcagaaaaaaaaaaaaatacacacacacacacacacacacacacacacacaattaaatgcattccacccaagca

SEQ ID NO: 19786 - DNA, 374 bp, Homo sapiens
  chr13.fa.O7frz.41818773
  Located on chromosome 13
  Distance between a terminus base of telomere on chromosomal short arm and 5'-terminus of this base sequence : 42283943
  Distance between 3'-terminus of neighbour sequence of sequence listing upward to telomere on chrosomal short arm and 5'-terminus of this base sequence : 82558
ttcctgagttacttcgcttagaataatggtctccaactccatccaggttgctgcaaatgccgttatttgttcatttttatggctgagtagtacttcatggtgtgtgtgtgtgtgtgtgtgtgtgtgtatatatatcacattttctttatccgctctttgatgagcatttgggctggttccatatttttgcaattgtgaattgtgctgccataaacatgcatgtgcagtatctttttcatatgattgcttattttcctctggttggatacccaagagtgggattgctggatcaaacagcagttctacttttagttctttaaggaatcttcatactgtttttcataggggttgtactagtttaccttcctaccagc

SEQ ID NO: 19787 - DNA, 405 bp, Homo sapiens
  chr13.fa.O7frz.41913154
  Located on chromosome 13
  Distance between a terminus base of telomere on chromosomal short arm and 5'-terminus of this base sequence : 42339753
  Distance between 3'-terminus of neighbour sequence of sequence listing upward to telomere on chrosomal short arm and 5'-terminus of this base sequence : 55436
tatggattgaccacagtcttatcttccaccattaagctgtataacaataaaatgttaatagtcttgctttttattatcttttaaagatctccttaaattctataactgatcttttttcttattttgtttgtgacattcatacatttttaagatttttgttatgttctgaattcccccctacacacacacacacacacacacacacacacacgtgcaaaaaatatgatcaagaatgcaattgggatttgtgagcaatgagtagacctcttattgtttatatttgtaccctcattgtcaatttttttttagggaatttgggactctgcctatataaggtgttttaaatgtcttgagaacaagcactggctgatacctcttggagatatgatctgaaatgtaatggaa

SEQ ID NO: 19788 - DNA, 447 bp, Homo sapiens
  chr13.fa.O7frz.42261796
  Located on chromosome 13
  Distance between a terminus base of telomere on chromosomal short arm and 5'-terminus of this base sequence : 42642842
  Distance between 3'-terminus of neighbour sequence of sequence listing upward to telomere on chrosomal short arm and 5'-terminus of this base sequence : 302684
tgaatttgatagcattttgaagaacttaataaatatcctaaatataatgttttaaaactcagcctttgtatttcctttgtctcctactttccctggtctcttatccattttcatattctttcttattatattaaaaaagaaaccatatatattatatatatgtgtatacacatatacacatacacacatgtacacacacacacacacacacacacacatattactacagttaatttggaatttttcatttatggccactattgaccaaaaagaaacacaacaaaaaacaaatgcttggtcaactcagcatgaagtgcacaggtatgtgggagtagaacttagcacattccaaatgcgattggtttctatttaatgaacaccatctaccctcacctactttgatggccaaaaagtgaatttttcttctgccactgtaacaatgactac

SEQ ID NO: 19789 - DNA, 278 bp, Homo sapiens
  HUMUT5230B
  Located on chromosome 13
  Distance between a terminus base of telomere on chromosomal short arm and 5'-terminus of this base sequence : 42951523
  Distance between 3'-terminus of neighbour sequence of sequence listing upward to telomere on chrosomal short arm and 5'-terminus of this base sequence : 308234
tttaattcccactggcaaccattccctgaaggtctggagctagttactcttctaagtatttgtttccacaaagcttcttaagcctcttctattactgcctattagaagtcaggtgtccttcagcagtgttaactgtgtttttatacctaccactgagttgtagtactccatatatattcattcaaatacacacacacacacacacacacacacacacacacacacacacacaccagcaatcgcacattcaaggttaggtgtgggctttggtttctgtg

SEQ ID NO: 19790 - DNA, 103 bp, Homo sapiens
  DISO7_10003757
  Located on chromosome 13
  Distance between a terminus base of telomere on chromosomal short arm and 5'-terminus of this base sequence : 43167126
  Distance between 3'-terminus of neighbour sequence of sequence listing upward to telomere on chrosomal short arm and 5'-terminus of this base sequence : 215325
aattcaatgttagtcatatctttggtaagaactatctatctatctatctaactatctatctatctttgatagagcccttttccttctttgtgttgttcatctt

SEQ ID NO: 19791 - DNA, 274 bp, Homo sapiens
  DISO7_10003759
  Located on chromosome 13
  Distance between a terminus base of telomere on chromosomal short arm and 5'-terminus of this base sequence : 43198656
  Distance between 3'-terminus of neighbour sequence of sequence listing upward to telomere on chrosomal short arm and 5'-terminus of this base sequence : 31427
ctataattctctggccattagttcttttaacatataaatatatggaatactctacataattaaatcacggacatatttctatttcaataaacataaaccttatacatcattttttataattcagtttgaaataatttcaaatttaaagaacaccatatccctttcacgcagatttccctatattaatattttaccacatttacttcttcatcctctccatttctctctctctctctctctctctgtgtgtgtgtgtacaatctccatcaccatt

SEQ ID NO: 19792 - DNA, 390 bp, Homo sapiens
  chr13.fa.O7frz.43010716
  Located on chromosome 13
  Distance between a terminus base of telomere on chromosomal short arm and 5'-terminus of this base sequence : 43287499
  Distance between 3'-terminus of neighbour sequence of sequence listing upward to telomere on chrosomal short arm and 5'-terminus of this base sequence : 88569
taagcagatattacttatcagcctggagagacaggattggatatttttaggagatctcattaagaatacataggccaccaccaccaccatcaaacacacacacacacacacacacacacacacacacaatatatatatatatatcactttaacagcaacaacaaaaataactcccctttcccaagtcctcgtcttgtatttctctgcctgaccttccactgaaacaataagataatattcttatggaatgggattcccacttgtggcaatacctttatagagggcatcaacaactgtgaatgagttcatcacagtttctgggctctgacagagagggaccaataacgtgctactgtcaaccaaaaagtatctgagacaggtctaaatcaa

SEQ ID NO: 19793 - DNA, 247 bp, Homo sapiens
  D13S291
  Located on chromosome 13
  Distance between a terminus base of telomere on chromosomal short arm and 5'-terminus of this base sequence : 43477423
  Distance between 3'-terminus of neighbour sequence of sequence listing upward to telomere on chrosomal short arm and 5'-terminus of this base sequence : 189534
atggacagacttcccactgcagaattgaggcagataaaaggaaaaagaagtgctctcacagcaagacagcaataccttcatatacctgcacacacacacacacacacacacacacacacacacacacacacgccatttgggtgcagagtaaatacctatttgacatatcttttctgaaatacagattttgaaaccacacaaacctggttttgatccctctctaccacttgttagcatgtgagcctgg

SEQ ID NO: 19794 - DNA, 198 bp, Homo sapiens
  Z24420.1_108
  Located on chromosome 13
  Distance between a terminus base of telomere on chromosomal short arm and 5'-terminus of this base sequence : 43477484
  Distance between 3'-terminus of neighbour sequence of sequence listing upward to telomere on chrosomal short arm and 5'-terminus of this base sequence : -186
caagacagcaataccttcatatacctgcacacacacacacacacacacacacacacacacacacacacacgccatttgggtgcagagtaaatacctatttgacatatcttttctgaaatacagattttgaaaccacacaaacctggttttgatccctctctaccacttgttagcatgtgagcctggataagttgatta

SEQ ID NO: 19795 - DNA, 442 bp, Homo sapiens
  AL138960.14_66586
  Located on chromosome 13
  Distance between a terminus base of telomere on chromosomal short arm and 5'-terminus of this base sequence : 43590295
  Distance between 3'-terminus of neighbour sequence of sequence listing upward to telomere on chrosomal short arm and 5'-terminus of this base sequence : 112613
atatcagtagaaacactttgcaagcctgggcaacatagggagaccctgtctctacacaaagtaaaaatcaattagctgggcatggtagaacatgcctacagtctcagctactactacggaggcagaagcaggaggatcacttgagccctggagttcaaggctgtaatgagctgtgattgcagcactgcaccccagcctgagtaacagaacaagaccctggaaagaaagagagagaaagaaaggaaaggaaaagagaagaggagaggagaggagagaaaaaggaaggaaggaaggaaggaaggaaggaaggaaggaaggaaggaaggaaggaaggagaagaggaaggggaagagaagaagaaaagaagaaaaggaccttgcagactgaggggaaaaaagatgataaaatataaaaacggggatacaattggaatttatctgca

SEQ ID NO: 19796 - DNA, 217 bp, Homo sapiens
  D13S757
  Located on chromosome 13
  Distance between a terminus base of telomere on chromosomal short arm and 5'-terminus of this base sequence : 43681199
  Distance between 3'-terminus of neighbour sequence of sequence listing upward to telomere on chrosomal short arm and 5'-terminus of this base sequence : 90462
ggtctacctcatcaactgttggatggagcatagaaccaaatgctgattcaatatagtgtgccctagaagtgcacaccagaaattctagatccgtgtgtgtgtgtgtgtgtgtgtgtaagatgttagacctggaagaataaagggaccataaagtgaaatgcccttctgctgatctcaacggagccacagtattcattgaaagccacccattttacag

SEQ ID NO: 19797 - DNA, 250 bp, Homo sapiens
  D13S1272
  Located on chromosome 13
  Distance between a terminus base of telomere on chromosomal short arm and 5'-terminus of this base sequence : 43743909
  Distance between 3'-terminus of neighbour sequence of sequence listing upward to telomere on chrosomal short arm and 5'-terminus of this base sequence : 62493
tttatcgctaacatctggcatataactaattgacatatagtaattgttcaatatgacaatccaaaaacacctatccatctaaatgacagctttctgaataaaaagaaatacacacacacacacacacacacacacacacacttttttgttgttgttaaacaatcaggaatcagacaaccaagccaaaaaacctgggaatctctgaagtagaatttatgattttttttaaatgctgccaccaatgaatgct

SEQ ID NO: 19798 - DNA, 299 bp, Homo sapiens
  chr13.fa.O7frz.43560040
  Located on chromosome 13
  Distance between a terminus base of telomere on chromosomal short arm and 5'-terminus of this base sequence : 43891445
  Distance between 3'-terminus of neighbour sequence of sequence listing upward to telomere on chrosomal short arm and 5'-terminus of this base sequence : 147286
gaagtacaaccaagcacattatattagcacttagaatgtgccaagcaagaaagatacaaagagtataaagatgatgctgtggaactcaaggaggctacaatcttgttatgtctgtagaggtacaggacacacacacacacacacacacacacacacacacacacacagagcaacaaaaaaaggtgattgtaataaatatcaaatggatggtgcagaagtttttatacaataggagttacaaggagggaaaacaagaactgcagtttggagtaaaggaatgtacactcagtggacagatt

SEQ ID NO: 19799 - DNA, 461 bp, Homo sapiens
  chr13.fa.O7frz.43745990
  Located on chromosome 13
  Distance between a terminus base of telomere on chromosomal short arm and 5'-terminus of this base sequence : 44056068
  Distance between 3'-terminus of neighbour sequence of sequence listing upward to telomere on chrosomal short arm and 5'-terminus of this base sequence : 164324
ctttacattctaaattgctttcacttgtcaacagcattatgtgtaaacccatctcctcacagttttatttatttatttatttatttatttatttatttatttatatttttttgataccgagtctcacttcgtcgcccaggctggagtgctgtggtgtgatctcagctcactgcaacctccgccttcccagttcaagcaattcttgtgcctcagtctcctgagtagctgggattacaggtgccaccaccatgcccagctcatttttgtatttttagtagagatggggttttgccatattggccaggctggtcttgaattcctgaactcaagtgatctgcccgcctcagcctccaaagtgtttggattacaggcatgagccatcgcgcccagccccacagttttattttgaaagagttggctgtagtgtgggtttctcagcctcagaactatggacatttgag

SEQ ID NO: 19800 - DNA, 369 bp, Homo sapiens
  chr13.fa.O7frz.43945126
  Located on chromosome 13
  Distance between a terminus base of telomere on chromosomal short arm and 5'-terminus of this base sequence : 44256448
  Distance between 3'-terminus of neighbour sequence of sequence listing upward to telomere on chrosomal short arm and 5'-terminus of this base sequence : 199919
atttatgataggacaggcaatctatatttcttttcaacccatcagtgctggagaccagcaatcttcaagtgtttttgcttggtatcccctaaaactctgtgtgtgtgtgtgtgtgtgtgtgtgtgtgtgtgtgtgtgtgtgtgtgtgtgtgtgtgtgttttgagactgagtctcaatcttcaagtgtttttgcttggtatcccctaaaactctgtgtgtgtgtgtgtgtgtgtgtgtgtgtgtgtgtgtgtgtgtgtgttttgagactgagtctcgctctgctccattgcccaggctggagtgcagtggcgcgatctcggcttactgcagtctccacctcctgggtttaagtgattctcctacctcaga

SEQ ID NO: 19801 - DNA, 386 bp, Homo sapiens
  chr13.fa.O7frz.44167602
  Located on chromosome 13
  Distance between a terminus base of telomere on chromosomal short arm and 5'-terminus of this base sequence : 44473505
  Distance between 3'-terminus of neighbour sequence of sequence listing upward to telomere on chrosomal short arm and 5'-terminus of this base sequence : 216688
ataccacagaccactgcactctccaacctgggcaacagaatgagaccttgccttaaaaaaaagtaaataaatataaaatatatatatatatatatatatctgcattcttaaatagttagaagatctgataataaacactgtgcctacattcctacagggtgataaacagctagagctgagtacttgctacccacctggggtggagcatattctctattttctggttcactctagccccagcttctctctcttatgttctactgcactggacaggcccctgtagacatttgagtttgtgattctcttccaccatccaatagattttctgcaatggtagaagtgtgttatatctttgttgtccagtatgatagccactagctacatgt

SEQ ID NO: 19802 - DNA, 195 bp, Homo sapiens
  chr13.fa.O7frz.44272759
  Located on chromosome 13
  Distance between a terminus base of telomere on chromosomal short arm and 5'-terminus of this base sequence : 44581635
  Distance between 3'-terminus of neighbour sequence of sequence listing upward to telomere on chrosomal short arm and 5'-terminus of this base sequence : 107744
tgtaggcctaaccttcatattcagttcagtaaaaataagcctactggtaggtggaacaaagggctcctgcctcacagcttgcttgcttgctgtctgtcttttctttctttctttctttctttctttctttctttctttctttctttctttctttctttcttctctaatgaagtcataacttaacagctttctgag

SEQ ID NO: 19803 - DNA, 399 bp, Homo sapiens
  chr13.fa.O7frz.40679472
  Located on chromosome 13
  Distance between a terminus base of telomere on chromosomal short arm and 5'-terminus of this base sequence : 44699515
  Distance between 3'-terminus of neighbour sequence of sequence listing upward to telomere on chrosomal short arm and 5'-terminus of this base sequence : 117685
aggtccttactctattccagtaatgcctgtcctctcactgtggtttatttatttattattattattattattattattattttttgagacagagtcttgctctgtcgcccaggctggagtgcagtggctcaatcttggctcactgcagcctctgcctcccaggttcaagcgattctcctacctcagcctcccgagtagctgggattacaggctcacgccacattgcctagctaatttttgtatttttttagtagagacagggttttaccctgttggcccaggctggtcttgaactcctgacctcaggtgatccacccaccttggcctccaaagtgctggtattacgggcatgagccactgcacccagcctcactgtggtgtaagtttgcatttctctga

SEQ ID NO: 19804 - DNA, 477 bp, Homo sapiens
  chr13.fa.O7frz.40551654
  Located on chromosome 13
  Distance between a terminus base of telomere on chromosomal short arm and 5'-terminus of this base sequence : 44806373
  Distance between 3'-terminus of neighbour sequence of sequence listing upward to telomere on chrosomal short arm and 5'-terminus of this base sequence : 106459
gaaatgtttgtctttcaatagaagttgttaattatgaaaaccaatagcttatattaaagggagtgcttttctttctcttaggaaggtttttattttgatgcaaaggtttattagaaattggcagtggctcatacctgtaatcttgccactttgggaggctgaagtgtgaggattgctggaggccaggagttcaagaccagactggacaacagagtgagaacttgtctctacaaaatattttttaaaaatctctatctatctatctatctatctatctatctatctatctatctatcatctatctgcacgtgtgtgtttattaaaaatgaagaatggctctttctaatatgatggtatacagagtttaggtgataaaatttaactgagctagtcttctaagaaatatcaagtatttcccatgttctatccctccgaagattgaaaagaggaagaacatttctggtctatagctttggt

SEQ ID NO: 19805 - DNA, 464 bp, Homo sapiens
  chr13.fa.O7frz.40430306
  Located on chromosome 13
  Distance between a terminus base of telomere on chromosomal short arm and 5'-terminus of this base sequence : 44965836
  Distance between 3'-terminus of neighbour sequence of sequence listing upward to telomere on chrosomal short arm and 5'-terminus of this base sequence : 158986
atttgaatttatccaggacatcctggatacttcattccaaccagaaattgtaataaaagatggatggatggatggatggatggatggatgaatagataaatatataattctaatcagaaattgtcatcaaagattagatagagaaacagacaaaaatcttaaaaagcttgggttttgtgttggggagttttttttaagagaacttggtggccaagattttataaaatgggatattttacaaatagctatttcactagggccaactcacatagaagttgtgtggagtggtggccagagcatagattttagtgctaaagaggcctgggtttgaagccatctccatcactctccagctgtatcaccccaaataagtcatattgttacattacctctataagcctcagtttcttcatctctcagacaagaattattagtctttgttgttgtcagtatcagaagcactc

SEQ ID NO: 19806 - DNA, 164 bp, Homo sapiens
  AL354833.9_156020
  Located on chromosome 13
  Distance between a terminus base of telomere on chromosomal short arm and 5'-terminus of this base sequence : 45046779
  Distance between 3'-terminus of neighbour sequence of sequence listing upward to telomere on chrosomal short arm and 5'-terminus of this base sequence : 80479
atttcagtgctgaaatcataagacaaagtgtcacaaaccacaagatgattggtttttgtcaagtttatttattctgtctttagtgctacagatgtgtgtgtgtgtgtgtgtgtgtgtgtgtgtgtgtgtgtgtgtgtactttctggttaagcaagtatttcctg

SEQ ID NO: 19807 - DNA, 257 bp, Homo sapiens
  AL354833.9_123031
  Located on chromosome 13
  Distance between a terminus base of telomere on chromosomal short arm and 5'-terminus of this base sequence : 45079742
  Distance between 3'-terminus of neighbour sequence of sequence listing upward to telomere on chrosomal short arm and 5'-terminus of this base sequence : 32799
gcacttggctgtcttaagataaaattacatgtctgctgatgggcacattgaaaatcaaaaaggatcaggaattggaaaactactgcgtgccaagagctgacctttgttctgcagctgaacaatgagtaattgtgtgtgtgtgtgtgtgtgtgtgtgtgtgtgtttgtgtgtgtaactgttaaatcctgtaaacaaaatttcctccagagagtaaaaaatgcttgccaagcaaacatctcaagttgaggatgacatga

SEQ ID NO: 19808 - DNA, 315 bp, Homo sapiens
  AL354833.9_81375
  Located on chromosome 13
  Distance between a terminus base of telomere on chromosomal short arm and 5'-terminus of this base sequence : 45121493
  Distance between 3'-terminus of neighbour sequence of sequence listing upward to telomere on chrosomal short arm and 5'-terminus of this base sequence : 41494
atttgctgagtagaccttaaatgttttcaccacacacacacacacacacacacacacacacacacacagagtaactaaggtgatgaatgagttaactgatttgattgtggctatcatttcacaatgtatatgtacatcaaatcatcacattgtacaccctgaattttattgtatagattcaattttttatattgaatctataatctaaacaattatacttcgataaagctgaaaaaataaaacttaaatgcaggaattgtttactggttggcatttttacacagaacatctgatattcaggaacagatgactgag

SEQ ID NO: 19809 - DNA, 151 bp, Homo sapiens
  D13S263
  Located on chromosome 13
  Distance between a terminus base of telomere on chromosomal short arm and 5'-terminus of this base sequence : 45136714
  Distance between 3'-terminus of neighbour sequence of sequence listing upward to telomere on chrosomal short arm and 5'-terminus of this base sequence : 14906
cccagtcttgggtatgtttttatcagaagcatgaaaacagactaacacacacatatatatgtgtgtgtgtgtgtgtgtgtgtgtgtgtgtgtgttccttttatacatttagtaatctgttctaagataacaataaaaactaacaggccagg

SEQ ID NO: 19810 - DNA, 299 bp, Homo sapiens
  AL354833.9_46175
  Located on chromosome 13
  Distance between a terminus base of telomere on chromosomal short arm and 5'-terminus of this base sequence : 45156580
  Distance between 3'-terminus of neighbour sequence of sequence listing upward to telomere on chrosomal short arm and 5'-terminus of this base sequence : 19715
ttgaactaacataggcagtagaaagggagtggttacagcaggcctcagacaagacccagtgctgtgctagcttcaggtctgacccagagcagtcctagggttggtggccacaagggtgcttgtgtcactccactcctagctccaggtggctcagaacaaagagagagagagagagagagagcacccatttgtttgggaaacaataagagaagagaacaagagtctctgcctggaaacccagataattcttccagatcttgtccgagactatcaaggtggtacttctatgagtctggaag

SEQ ID NO: 19811 - DNA, 357 bp, Homo sapiens
  AL139326.7_58896
  Located on chromosome 13
  Distance between a terminus base of telomere on chromosomal short arm and 5'-terminus of this base sequence : 45461550
  Distance between 3'-terminus of neighbour sequence of sequence listing upward to telomere on chrosomal short arm and 5'-terminus of this base sequence : 304671
cacttaatctcaggagttcaagaccagcctgggcaacatggcaagaaaccccatctctactaaaaatacaaaaattcaccaggtgtgatggtgtgctcctgtgatcccagctactcaggaggttgagatgggaagattacttgagcccgggaggtggaggtttcagggagccgagatcacgccattgcactccagcctgggtgacagagccagaccctgtctcaacaacaacaacaacaacaacaacaacaacaacaaagtatgaccactcaaggctaagcaggacggaatataactttacactcctgaagtttaatagattctgggttactccttctaagtagcagaaaccaatga

SEQ ID NO: 19812 - DNA, 406 bp, Homo sapiens
  chr13.fa.O7frz.44630714
  Located on chromosome 13
  Distance between a terminus base of telomere on chromosomal short arm and 5'-terminus of this base sequence : 45574623
  Distance between 3'-terminus of neighbour sequence of sequence listing upward to telomere on chrosomal short arm and 5'-terminus of this base sequence : 112716
gtagcctattgcttctatgctacaagctggacagcatgttactgtactgaatgctgtaggcaattgtaacaatggtaagaatttgtgcatctaaacatatctaaacatagaaaaggaagagtgaaaatatggtattataatcttatgggactactgttgtatacacggtctgtcaagtgaaatgttatgtggcaggactgtgtgtgtgtgtgtgtgtgtgtgtatatatatatttatatataatatacatttatatgcaaaagatattttacagactaggtctaatcaaggacaggggtttcctatatgcttgggaagagacaacaaatagttactttatatgaaccccatttttcttggcaatactgatgttttaccataagtaatcatgttgagttggatagtt

SEQ ID NO: 19813 - DNA, 326 bp, Homo sapiens
  chr13.fa.O7frz.44860083
  Located on chromosome 13
  Distance between a terminus base of telomere on chromosomal short arm and 5'-terminus of this base sequence : 45814803
  Distance between 3'-terminus of neighbour sequence of sequence listing upward to telomere on chrosomal short arm and 5'-terminus of this base sequence : 239774
gctagaagctggtgtcattattacacaagccaggcaaatcctgctccagtacacagagcgcatctaaccagcaggaaggaaataagccaaaatcctcccgacaccacacacacacacacacacacacacacacacacacacacacacacgagtctgaggacaaggacaaacactttgcagaaagaaccctccccccaccccaccgacgtccaagtccctgtttcaggattcctcaccccccagtagcttctaaaatcctcgtgtttgaccacctctcccaacacatgggacagagagaatttggctaacttcaaatcctgtctcct

SEQ ID NO: 19814 - DNA, 187 bp, Homo sapiens
  DISO7_00000505
  Located on chromosome 13
  Distance between a terminus base of telomere on chromosomal short arm and 5'-terminus of this base sequence : 45897344
  Distance between 3'-terminus of neighbour sequence of sequence listing upward to telomere on chrosomal short arm and 5'-terminus of this base sequence : 82215
gataacagatagccagggctggggtgggaagatggagagagagaaagagagacagagagacagagagagagagagagagagagagaactctgagggcactgcccgagctgctggcttcagctgtgcctgaactttccaagtcatataagcagagctgccacctcttcctctagcagatgcacccaga

SEQ ID NO: 19815 - DNA, 339 bp, Homo sapiens
  AL137141.10_128854
  Located on chromosome 13
  Distance between a terminus base of telomere on chromosomal short arm and 5'-terminus of this base sequence : 46087224
  Distance between 3'-terminus of neighbour sequence of sequence listing upward to telomere on chrosomal short arm and 5'-terminus of this base sequence : 189693
cagtctgaaataggctgatctaaggcaggctaagagtttacccggtctttacaatggagatcacaactgtgctcccagggacagactagggctgtgtgtgtgtgtgtgtgtgtgtgtgtgtgtgtgtgtgtgtgtgtgtgaatgtgagtctaggtgaacaaaatcactaagttgactgatactttaaaaggtcatataatccaatgcattgcatcagaccaacccagatgtcataatttccagacaggaatccattctattctaaatactccgcaggtaggtctatttcacaacttatctcacaattacttctttctgttcagcatttcctacattcag

SEQ ID NO: 19816 - DNA, 377 bp, Homo sapiens
  AL137141.10_116117
  Located on chromosome 13
  Distance between a terminus base of telomere on chromosomal short arm and 5'-terminus of this base sequence : 46099943
  Distance between 3'-terminus of neighbour sequence of sequence listing upward to telomere on chrosomal short arm and 5'-terminus of this base sequence : 12380
atacaggttaagctccagcacacagcacacaaggccctttacaatttggctctagtattcttttccagcacatctgtgatttccttcttccctctctgcttccttgcccatcgtgtgctacacacacacacacacacacacacacacacacacacacaaagacctatacacatttcaaccacacagaaccatcagcagctccccaggcacacctccatcctccttctgcctcctgcttctgggactcatctgtactcactacctgggcccccttcccttctagtgaattcctaatcatttgaacaatcctcagctcaagtatcacttttccagcttgcacagtgtattcatcagtattggtatacttgcttcaaacc

SEQ ID NO: 19817 - DNA, 272 bp, Homo sapiens
  AL137141.10_75327
  Located on chromosome 13
  Distance between a terminus base of telomere on chromosomal short arm and 5'-terminus of this base sequence : 46140787
  Distance between 3'-terminus of neighbour sequence of sequence listing upward to telomere on chrosomal short arm and 5'-terminus of this base sequence : 40467
ttcactttagcttatccagtcaagaaggagtgtgtgagtgagtgtgtgtgtgtgtttccgtgtatgtgtgtttatttgtgtgtgtgtgtgtgtgtgtgtgtgtgagagagcgagagagagagagggagggagaccctcccttctgtccatgtaacagatgctgaaataagaatcaatgctgcaaccacagaactgtgggtttgctagttccccaatttaacatagcttttccttccgccagaaagaacaactgaccatctttgagtaacagg

SEQ ID NO: 19818 - DNA, 477 bp, Homo sapiens
  chr13.fa.O7frz.45329456
  Located on chromosome 13
  Distance between a terminus base of telomere on chromosomal short arm and 5'-terminus of this base sequence : 46257848
  Distance between 3'-terminus of neighbour sequence of sequence listing upward to telomere on chrosomal short arm and 5'-terminus of this base sequence : 116789
tggatagctgagtcactgtaagtaaagggggagtctaggccacacaggtgcagtcactgttcatgcttctacatatattgcatgtggctggacgtggtggctcaaacctgtaatcctagcactttgggaggctgaggcaggcggagcacttgatgtcaggagttcgagaccagactggccaacatggtgaaacttcatctctattaaagctggatgtggtggcgcatgcctatagtcccagctacttgggaggctgaggcaggagaatcgcttgaacctgggaggtggaggttgcagtgacccgagatcacgccagtgcactccagcctgggtgacagagtgagactccatctcaaataaaataaaataaaataaaataaaataaaataaaataaaataataaaataaaataaaataaaataaaataaaataaaataaaataaaataaaataaataacattgcatgtttagaaagtg

SEQ ID NO: 19819 - DNA, 228 bp, Homo sapiens
  chr13.fa.O7frz.45439422
  Located on chromosome 13
  Distance between a terminus base of telomere on chromosomal short arm and 5'-terminus of this base sequence : 46365132
  Distance between 3'-terminus of neighbour sequence of sequence listing upward to telomere on chrosomal short arm and 5'-terminus of this base sequence : 106807
gttgcagagtcataaatttgactatttttaaaaattttattttctttttagactaaaaagactagatctgagagaatattttaaattgacgttgcggagagagaaacacaggactctagcctttgttttggtcatcatagcatagatagatacacacacacacacacacacacacccttttatagtataaatgaaatgataaatgtaaagtacttagcacagtgccta

SEQ ID NO: 19820 - DNA, 210 bp, Homo sapiens
  DISO7_00003103
  Located on chromosome 13
  Distance between a terminus base of telomere on chromosomal short arm and 5'-terminus of this base sequence : 46463001
  Distance between 3'-terminus of neighbour sequence of sequence listing upward to telomere on chrosomal short arm and 5'-terminus of this base sequence : 97641
agactgcatggcctactgtgtacaaacttgtctcggaacaccagagcctctgccatgggggacttagagctgctggggcccaacacccatggacattataactatacaccccctatacatacacacacacacacacacacacacacacacacacacacacacacggcaactgggggtgtggaggaaaccattgtccagtaggaagctgag

SEQ ID NO: 19821 - DNA, 135 bp, Homo sapiens
  chr13.fa.O7frz.45657073
  Located on chromosome 13
  Distance between a terminus base of telomere on chromosomal short arm and 5'-terminus of this base sequence : 46570061
  Distance between 3'-terminus of neighbour sequence of sequence listing upward to telomere on chrosomal short arm and 5'-terminus of this base sequence : 106850
aaaggactcaggacaatttaacatttcaagtcattgaaatatcctttaaatgctcaaactctaattttaaccttatgtgtgtgtgtgtgtgtgtgtgtgtgtgtgtataagtcgttctaaagtacttaaccttct

SEQ ID NO: 19822 - DNA, 271 bp, Homo sapiens
  D13S328
  Located on chromosome 13
  Distance between a terminus base of telomere on chromosomal short arm and 5'-terminus of this base sequence : 46645766
  Distance between 3'-terminus of neighbour sequence of sequence listing upward to telomere on chrosomal short arm and 5'-terminus of this base sequence : 75570
gataggtcagttgaaatctctacgagaactgaatgtcagaagaaattaccttaaagttttaccacaaggtaaaaaagaaagagggaaaatgaagaaaatgggagacttgcattattttatgttttggggggtttacttttgtgaagagggtcgatctttgtgtgtgtgtgtgtgtgtgtgtgtgtgtgcctactacttaattaggatttgaatttcacatacagataacaaaaaagtgatgttcaggctgtgattctagtcaagggctaca

SEQ ID NO: 19823 - DNA, 398 bp, Homo sapiens
  AL359880.2_161966
  Located on chromosome 13
  Distance between a terminus base of telomere on chromosomal short arm and 5'-terminus of this base sequence : 46765016
  Distance between 3'-terminus of neighbour sequence of sequence listing upward to telomere on chrosomal short arm and 5'-terminus of this base sequence : 118979
aagaatcagctgttaggtagaaatccccgcagatatgccatcttggccttattgcaaggaccattatatccacaagtcaccccaaatttccctttctgtttgcctccctatatgaaaacaatttagaaattccattttctttttcccatgtcctccctccagctctctctctcaatagacagataaatggatctatctatctatctatctatctatctatctatctatctatctatctacagtcatgagttgctttatgacagggatgtgttctgagaaatgcattgatagctgattctgtcactatgggaatatcacagggtatacttacacaaacctagatggtatagccttctacccacctaggctacatggtatagtctgttgctcctaggcta

SEQ ID NO: 19824 - DNA, 356 bp, Homo sapiens
  AL136958.7_37916
  Located on chromosome 13
  Distance between a terminus base of telomere on chromosomal short arm and 5'-terminus of this base sequence : 46793951
  Distance between 3'-terminus of neighbour sequence of sequence listing upward to telomere on chrosomal short arm and 5'-terminus of this base sequence : 28537
gaagtcttgtctcattgcatatttgctgggacaaatgcatcattaatgttcttagtttagaatgaaatcttcaaagtcttgaatgtttctttcaaaatcatcattattattgtggattaaattcaatattaagttataaaactttatataagttatgaagtgtttgaagatacttgtttttttgttgttgttgttggtcatttcagggataccaagaaaacatttcttgtccccaaattttcttctcacttgtctccttgatgcctaacatttttcctttgatttctgccttttgggttttcatcatggtgggctgctgaagagatgtcaatgatacacaatggcatatcagcttc

SEQ ID NO: 19825 - DNA, 470 bp, Homo sapiens
  AL136958.7_95186
  Located on chromosome 13
  Distance between a terminus base of telomere on chromosomal short arm and 5'-terminus of this base sequence : 46837092
  Distance between 3'-terminus of neighbour sequence of sequence listing upward to telomere on chrosomal short arm and 5'-terminus of this base sequence : 42785
aaatgatcttcagttatgagtgattatttttgcatctattttactttcttttttttttttaaccttggaaccagtttattctggtgctaagaagaactgtaaaatagttaaaatgtcctatcaagtaattcactgattacatagacaccacttttgttttttattccattttttgttttaactcatgtggtagtgatatttaatactttctgatcaaataggttcaaagcgaatctttaaatttcaaatttctttttttaattgtgataatacattttatttaacacagtatatccaaaacattcccaactgtaatataaaatttattattattattattattattattattattattatactttaagttttagggtatatgtgcacaatgtgccggttagttacatatgtatacatgtgccatgttggtgtgctgcacccattaactcgtcatttacattaggtgtatc

SEQ ID NO: 19826 - DNA, 412 bp, Homo sapiens
  chr13.fa.O7frz.46178158
  Located on chromosome 13
  Distance between a terminus base of telomere on chromosomal short arm and 5'-terminus of this base sequence : 47090560
  Distance between 3'-terminus of neighbour sequence of sequence listing upward to telomere on chrosomal short arm and 5'-terminus of this base sequence : 252998
tggtagcagtacataccagaaggacctctcttctgggagctgtggcccatttaaatctaactagtgtacacaggtcaggcctgcagaaccacagcacatttgaccaatttcatcatcctcctgacattacctcttgacatcatatgggcaaaggttctggctccttccctgtaggaatcagagaagaaaacttgctttctctctctgtctctgcctctctctctctctgtcatacacacacacacacacacacacacacacacacacacacacacactgagcagctttcaaccatagtatagtagagtctcagatctatcttcccactcacccagcttccataatcataacaacacggatgattagagagtcaatatcaaggaaatttgtctatttagaagtccttattcgg

SEQ ID NO: 19827 - DNA, 100 bp, Homo sapiens
  D13S161
  Located on chromosome 13
  Distance between a terminus base of telomere on chromosomal short arm and 5'-terminus of this base sequence : 47173816
  Distance between 3'-terminus of neighbour sequence of sequence listing upward to telomere on chrosomal short arm and 5'-terminus of this base sequence : 82844
cttaaattaacgtatttggggttttgtgtgtgtgtgtgtgtgtgtgtgtgtgtgtgtgtgtgtgtgtgtgacattcacatttagaattgtgtgcagtgtg

SEQ ID NO: 19828 - DNA, 183 bp, Homo sapiens
  D13S168
  Located on chromosome 13
  Distance between a terminus base of telomere on chromosomal short arm and 5'-terminus of this base sequence : 47201280
  Distance between 3'-terminus of neighbour sequence of sequence listing upward to telomere on chrosomal short arm and 5'-terminus of this base sequence : 27364
gcctagcccagtggtgtccacctcatattctcatattctccagggatctcaggaagaaggaggctcatgatgctggactggacatttcttcctcctcttaaacacacacacacacacacacacacacacacacagagagagagagagagagagagagagaaaacaagaacataggcacaagca

SEQ ID NO: 19829 - DNA, 149 bp, Homo sapiens
  D13S287
  Located on chromosome 13
  Distance between a terminus base of telomere on chromosomal short arm and 5'-terminus of this base sequence : 47278542
  Distance between 3'-terminus of neighbour sequence of sequence listing upward to telomere on chrosomal short arm and 5'-terminus of this base sequence : 77079
acagtgtagggctgatatagaagtagacaaatatatcaatggaacagaataaagaatcctgaaataaacctatatatatatatgtgtgtgtgtgtgtgtgtgtgtgtgtgtgtgtattgatttttaataaatgtctcaaagcaattcag

SEQ ID NO: 19830 - DNA, 338 bp, Homo sapiens
  chr13.fa.O7frz.46443748
  Located on chromosome 13
  Distance between a terminus base of telomere on chromosomal short arm and 5'-terminus of this base sequence : 47358306
  Distance between 3'-terminus of neighbour sequence of sequence listing upward to telomere on chrosomal short arm and 5'-terminus of this base sequence : 79615
gtgccttcaatgtggtaatagtggtgtgtcacctctttgttcatgcaactggctttccacattgcatgattttaataacattttaataaaatgatgcgtggcaaaactttggttcattgtagtgtgtgtgtgtgtgtgtgtgtgtgtgtgtgtgtgttgtttgtaaggatatttttgtctatgaacatttcaatgtagactgtttttaaggagcatatgtcaattgtacataggtaatatgatcatattattttaaaaatggattgtccaattaccctcagaacctctttcctaaattatttacagattgggttgtcaagttagacttctcaaatctg

SEQ ID NO: 19831 - DNA, 404 bp, Homo sapiens
  chr13.fa.O7frz.46553092
  Located on chromosome 13
  Distance between a terminus base of telomere on chromosomal short arm and 5'-terminus of this base sequence : 47496554
  Distance between 3'-terminus of neighbour sequence of sequence listing upward to telomere on chrosomal short arm and 5'-terminus of this base sequence : 137910
tgcgtacaacttaatgaaattcaaaaaaaaatacagtatatagttggaaaagtctccaaggaaatagatatcataaagaaaagacaattacaacatcttgaagtgaaaaacacacttagagaaatagaaaatacactggaaagtttcaacaatagactggaacaagtagaagaaagaacttcagagctcaaagataaggcttttgaattacccaatctgacaaagacaaaaaaaatttatgtccagcaggaaaatatcacaattctaaatatatatatatatatatatatgcctaacccaagagctcccaaatttataaaacaattataactacaacttagaaatgagatagacagcaacacattaatagtgggggacttcaatactccattgacagcactaga

SEQ ID NO: 19832 - DNA, 458 bp, Homo sapiens
  chr13.fa.O7frz.46772070
  Located on chromosome 13
  Distance between a terminus base of telomere on chromosomal short arm and 5'-terminus of this base sequence : 47715599
  Distance between 3'-terminus of neighbour sequence of sequence listing upward to telomere on chrosomal short arm and 5'-terminus of this base sequence : 218641
gaaagcagattatcctccatagctgggcttcatgcaatttttgatagcctgaagagaaaagatctaggtcccctgaagaggaaagaattctgcctccagattgccactggactcaggactgcatcatcaacccctgctggaatttccagcccacttgccctgtagacttgctagcccccacaattaagtgagccatctccttaacattctctctctctctctctctctgtgcccctaacctctagttatgctctctggagaaccataatatagcccccacagtggtttccctaccagagctctcctgtctggtctccacaaggtagccagactgttggtttttaaagcataaattatatcatgtcattttccagtgtaaaacatgtctgtcgctttccatcacatttagaataaaatccaaaatccttaaaatgctcttcaaatcttgacatgatctg

SEQ ID NO: 19833 - DNA, 213 bp, Homo sapiens
  chr13.fa.O7frz.46895095
  Located on chromosome 13
  Distance between a terminus base of telomere on chromosomal short arm and 5'-terminus of this base sequence : 47833669
  Distance between 3'-terminus of neighbour sequence of sequence listing upward to telomere on chrosomal short arm and 5'-terminus of this base sequence : 117612
ttatgtactgagcaatttcctaacaggagaagcttagctcaggtcccaaatgctgaacatggctcgtgagtgtgtgtgtgtgtgtgtgtgtgtgtgtgtgtgtgtgtgtgtgttgatcaacagtggctctcaatcttgtctccaaattaaaatcacccctggggagctttcaaaagtcccaatgcccagtctacatttcagaccaattaaatc

SEQ ID NO: 19834 - DNA, 331 bp, Homo sapiens
  chr13.fa.O7frz.46992289
  Located on chromosome 13
  Distance between a terminus base of telomere on chromosomal short arm and 5'-terminus of this base sequence : 47911028
  Distance between 3'-terminus of neighbour sequence of sequence listing upward to telomere on chrosomal short arm and 5'-terminus of this base sequence : 77146
ttctgactcaagaaacgtaaagatgagcctgaaacattttatcataccagatagagggcttctcagaaggatgcaacagttaacctgaagaggttcccaaagaccaaaggttggacaatttcaatcacaacttacatgaactgaactacatcaatgttttaagtcataagttcaaaacagtatgccagtggaacacacatgtgtatgcatgtgtatgcacacacgcacaatacacacacacacacacacacacacacctgaaaacaaaaagtaaacaaaatacaaaaaaaacaaaaaacaaaaaaaaccctaggtcacctttattggacat

SEQ ID NO: 19835 - DNA, 455 bp, Homo sapiens
  chr13.fa.O7frz.47165764
  Located on chromosome 13
  Distance between a terminus base of telomere on chromosomal short arm and 5'-terminus of this base sequence : 48104716
  Distance between 3'-terminus of neighbour sequence of sequence listing upward to telomere on chrosomal short arm and 5'-terminus of this base sequence : 193357
tgcctgtaatgccagttactcgggaggctgaggcaggagaatcgcttcaacccaggaggcggaggttgcagtgagccgagatcacaccattgcactctagcctgggagacaagagtgaaactctgtcacacacacacacacacacacgcacgcacacacacacacacacacaaaagcttttttaaaaagcagggtgtagtatggcttttaggcagaaacaaatcatcctaagctgatatttacttcttagaaaagagggaggaacaaaagcttcagtactagtagaaaactaaaagaaaaagatcacagagacatggagaattcaacctccaccgaattcctgaaggagccagatggtattcccgttttccagaaggcacaggatactgccttttgagggaaggtcaaagaagggtttgctgtagctgggaacactatgccaaatctaagtccac

SEQ ID NO: 19836 - DNA, 217 bp, Homo sapiens
  D13S164
  Located on chromosome 13
  Distance between a terminus base of telomere on chromosomal short arm and 5'-terminus of this base sequence : 48219132
  Distance between 3'-terminus of neighbour sequence of sequence listing upward to telomere on chrosomal short arm and 5'-terminus of this base sequence : 113961
attacaggcgtgacacaccatgcctggccctgtgcattcacattttgtatacccttagtctttattgtgtgtgtagtgtgtgtagtgtgtgtgtgtgtgtgtgtgtgtgcgcgcgcgtgtgcgtgcgcgcacgtgtacatgtactgtgtgtttggctttttttgagatggggtctcactctgtcatccaggctggagtgcggtggtgcaatcacagc

SEQ ID NO: 19837 - DNA, 236 bp, Homo sapiens
  D13S153
  Located on chromosome 13
  Distance between a terminus base of telomere on chromosomal short arm and 5'-terminus of this base sequence : 48280622
  Distance between 3'-terminus of neighbour sequence of sequence listing upward to telomere on chrosomal short arm and 5'-terminus of this base sequence : 61273
agcattgtttcatgttggtgtacgtctatacagggctatgtataaccgactcctgtttctcctccctgcaaccacagaaccatcacacacacacacacacacacacacacacacacacacacacacacacacacacacacacacacacggatacacgcacagatacgctcctttccacaaatgcacgcaaaccgggacgcaaacccacaactcgagggcttagaccttcactgctg

SEQ ID NO: 19838 - DNA, 170 bp, Homo sapiens
  Z16494.1_123
  Located on chromosome 13
  Distance between a terminus base of telomere on chromosomal short arm and 5'-terminus of this base sequence : 48280631
  Distance between 3'-terminus of neighbour sequence of sequence listing upward to telomere on chrosomal short arm and 5'-terminus of this base sequence : -227
tcatgttggtgtacgtctatacagggctatgtataaccgactcctgtttctcctccctgcaaccacagaaccatcacacacacacacacacacacacacacacacacacacacacacacacacacacacacacacacacggatacacgcacagatacgctcctttccaca

SEQ ID NO: 19839 - DNA, 239 bp, Homo sapiens
  chr13.fa.O7frz.47682864
  Located on chromosome 13
  Distance between a terminus base of telomere on chromosomal short arm and 5'-terminus of this base sequence : 48489238
  Distance between 3'-terminus of neighbour sequence of sequence listing upward to telomere on chrosomal short arm and 5'-terminus of this base sequence : 208437
atttgtaacatgcataatggacagcttggaaaggatccatacacaaaatatataaagaatgcctgcaaatcagtaagaataaaacaaacgacacaattcaaaagtgagcaaaggattcatgatatatatatatatatatatatatatatatatatatatatatatattcagttatatatgtatatataactgaaatttcacaaaataattcttactcctcctacatgagatgcttgata

SEQ ID NO: 19840 - DNA, 126 bp, Homo sapiens
  D13S1307
  Located on chromosome 13
  Distance between a terminus base of telomere on chromosomal short arm and 5'-terminus of this base sequence : 48688078
  Distance between 3'-terminus of neighbour sequence of sequence listing upward to telomere on chrosomal short arm and 5'-terminus of this base sequence : 198601
tccttcaaacagactctgacatatacatctctctctgtgtgtgtgtgtgtgtgtgtgtgtgtgtgtgtgtgtgtgtgtgtgttcagcccatttatcagtgaggaccataggctggtttggagtcta

SEQ ID NO: 19841 - DNA, 448 bp, Homo sapiens
  AL139182.24_97845
  Located on chromosome 13
  Distance between a terminus base of telomere on chromosomal short arm and 5'-terminus of this base sequence : 48826762
  Distance between 3'-terminus of neighbour sequence of sequence listing upward to telomere on chrosomal short arm and 5'-terminus of this base sequence : 138558
ctcgagtatatgaaagatgaccacaaaataatgaaaccaactgtcatgtgtggctcacatgtacttagttcctataaagggtcatggctacacttatataaaacttcaaacaaaattaatctgacaaatagtatttgaaacattagtatatttatatctaatcctgttctagaaaatatttgtaatatttgaatatatattcaaaaacatatattattataaactatataaatatatgtgtatgtgtgtgtgtgtgtgtgtgtgtgtatatatatatatatatgattgaggaagattggtacacatgtggaagcaatagggacctacacagttactaaaatttgttcagaaattggccctgagtctcctggaaaccaaagctgaaagagaaacatgaccacttacaaaattcatgtttgccataaggaaagagcataccagatcttcc

SEQ ID NO: 19842 - DNA, 438 bp, Homo sapiens
  chr13.fa.O7frz.48032990
  Located on chromosome 13
  Distance between a terminus base of telomere on chromosomal short arm and 5'-terminus of this base sequence : 48976412
  Distance between 3'-terminus of neighbour sequence of sequence listing upward to telomere on chrosomal short arm and 5'-terminus of this base sequence : 149202
aagaatacaccaagtcttggtatctggtaagcaaaccatcccaccttattctttgagaaggtcttggtattcttgggcctttacatttacatataaattttagaattagcttatcaatacacacacacacatgcacacacacacaacacctgctgagtttgatttagattgccttgaatctatagattgattgagggaagaattggtggcatctttacaatattgaatttttcaattgttgaagttggtgtattcatgcatttatgtaggtttttaatgtcacagtgaagttttataatttttcccataaaggtcttgattatcttttgttaaatttattcctgggcacttgggtttttatatgcaattataaatgtgtgtgtgtgtgtgtgtgtgtgtgtgtgtgtgtatcattttctgttcctggtgagttagaaa

SEQ ID NO: 19843 - DNA, 185 bp, Homo sapiens
  D13S165
  Located on chromosome 13
  Distance between a terminus base of telomere on chromosomal short arm and 5'-terminus of this base sequence : 49315203
  Distance between 3'-terminus of neighbour sequence of sequence listing upward to telomere on chrosomal short arm and 5'-terminus of this base sequence : 338353
gttgacaataaaatacgccacattataaaggtgactaaattgtgtgtgtgtgtgtgtgtgtgtgtgtgtgtgtgtgagtgactacttaagttactttactttagactcaaggaaaaggcaaaatgttccaggcaaagggaaaaaactgttcaaaggctccatggcaagaacaggcttggcgaaac

SEQ ID NO: 19844 - DNA, 398 bp, Homo sapiens
  chr13.fa.O7frz.48732704
  Located on chromosome 13
  Distance between a terminus base of telomere on chromosomal short arm and 5'-terminus of this base sequence : 49619609
  Distance between 3'-terminus of neighbour sequence of sequence listing upward to telomere on chrosomal short arm and 5'-terminus of this base sequence : 304221
agagtttgcaaaggaaatttacagtataaacaacactggggaggtatcttagtccattttgtgctgctgtaacagaaaatctgggtctggataatttataaaacacagatttatctggctcatggttctcaaggctggaagttcaagattgagggactgtgtctggtgagggagttctgctgtgtcatctcatggcagaagggtggaaaggcaaaagggcacaagcatgagagagagagagagagagagactgaaagagagacagaaagagggagccaaactcatccttttatcaggaagttgctctgctgtgataactaacccgctcagcattaatggcattaatccattcatgagagcacagccctcatgacctaatcacctcttaaaggtcctac

SEQ ID NO: 19845 - DNA, 255 bp, Homo sapiens
  D13S273
  Located on chromosome 13
  Distance between a terminus base of telomere on chromosomal short arm and 5'-terminus of this base sequence : 49701453
  Distance between 3'-terminus of neighbour sequence of sequence listing upward to telomere on chrosomal short arm and 5'-terminus of this base sequence : 81446
atctgtatgtcctcctttcaatgaaatgactcttcacatctttttaaattagactgttttgttttttcttactattaagtgtgtgtgtctgtgtgtgtgtgtgtgtgtgtgtgtgtgtgtgtgtgtgtgtgtgtgtgtgtaagagccaggggtctcactatgttgcccaggctagagtgcagtgactgtccataggcaacatcatagcatactgcagcctccaactcccgggctcaagagttgtttttgcctcag

SEQ ID NO: 19846 - DNA, 428 bp, Homo sapiens
  AL136123.15_31272
  Located on chromosome 13
  Distance between a terminus base of telomere on chromosomal short arm and 5'-terminus of this base sequence : 49789539
  Distance between 3'-terminus of neighbour sequence of sequence listing upward to telomere on chrosomal short arm and 5'-terminus of this base sequence : 87831
ttcataggctttagaatggttaaaatggctttaaatgttgaactttttgtgtagtttaaaatcttaagattggctgggcatggtggctaacacctgtaatcccagcactttgggaggccaacgcaggcagattgcttgagcaggagtttgagaccagcctgagtaacatgatgaaatcccatctctacaaaaaatacaaaaattagctggatatggtggcatgcacctgtaatcccagatacttgggaggctgacatgggaggatcgcttgagcccaggaagtggagattgcagtgagctgagactgtaccactccaccccagcctgggtgacagtgagaccctgtctcaaaatcaatcaatcaatcaatcaatcaatcaatcaatcaatcttaaaattatagagtggttctcatctatagaatgtca

SEQ ID NO: 19847 - DNA, 397 bp, Homo sapiens
  chr13.fa.O7frz.48997338
  Located on chromosome 13
  Distance between a terminus base of telomere on chromosomal short arm and 5'-terminus of this base sequence : 49883942
  Distance between 3'-terminus of neighbour sequence of sequence listing upward to telomere on chrosomal short arm and 5'-terminus of this base sequence : 93975
cgattggttacaagttgataattgtttgaagctggctgatgggtatatgagggtttattatactattctttttacttctgtacatgtttggaattttctataataaaaattaaggtaggccggatgcagtggttcatgcctgtaatcccaatagtggtgcacacttgtagtcccagctactggggtggctgaggtgggaggattgcttgaacccaggagtttgaggctgcagtgagctgtgatcgggccactgcactccagcctgggggacacagcaagactctgtcgcaaaacaaaacaaaacaaaacaaaacaaaacaaaaaaacaaaaaattaaagttaaaattaaaattctaagtcactatttccctcagaagagcattaacatttaaggaat

SEQ ID NO: 19848 - DNA, 157 bp, Homo sapiens
  DISD22_0009044
  Located on chromosome 13
  Distance between a terminus base of telomere on chromosomal short arm and 5'-terminus of this base sequence : 50218316
  Distance between 3'-terminus of neighbour sequence of sequence listing upward to telomere on chrosomal short arm and 5'-terminus of this base sequence : 333977
  misc_feature (1)...(157): n = A,T,G or C
aggtgtacctatcaacatcacctgtatntcagccatttaaaaatctctcattttacacacacacacacacacacacacacacacacacacatctttgctctaatcaaatatttccacttaaaantcaaatgtttcccttgaaggaagatattgtact

SEQ ID NO: 19849 - DNA, 149 bp, Homo sapiens
  DISD22_0009062
  Located on chromosome 13
  Distance between a terminus base of telomere on chromosomal short arm and 5'-terminus of this base sequence : 50653472
  Distance between 3'-terminus of neighbour sequence of sequence listing upward to telomere on chrosomal short arm and 5'-terminus of this base sequence : 434999
tcaacatcacctgtattcagccatttaaaaatctctcattttacacacacacacacacacacacacacacacacacacacacacacatctttgctctaatcaaatatttccacttaaaattcaaatgtttccttgaaggaagatattgt

SEQ ID NO: 19850 - DNA, 179 bp, Homo sapiens
  DISD22_0009063
  Located on chromosome 13
  Distance between a terminus base of telomere on chromosomal short arm and 5'-terminus of this base sequence : 50729745
  Distance between 3'-terminus of neighbour sequence of sequence listing upward to telomere on chrosomal short arm and 5'-terminus of this base sequence : 76124
agatgggttgctggattgcattgatttttaaacagatatatatacacacacacatacatggaagcacacatacatataagtatatatatctgtgtatatgttacatgtgtatatatatatgtatatacatatatatgggtgtgtgattacataagcaatgtaaagtgattgtagagaat

SEQ ID NO: 19851 - DNA, 254 bp, Homo sapiens
  AC005949.12_42974
  Located on chromosome 13
  Distance between a terminus base of telomere on chromosomal short arm and 5'-terminus of this base sequence : 50874895
  Distance between 3'-terminus of neighbour sequence of sequence listing upward to telomere on chrosomal short arm and 5'-terminus of this base sequence : 144971
acttcaactcagtgagcatgtcttctcatctgtgaaaggggaataataataacatccttttatgatccataggataacaatgtacatatataaatgtcaaaattttttcaattgtgaagtgctaacaaataaagatactataataccataactgccatacctgaacttaaagcagacagcaaagactcactgccaatataaacacacacacacacacacacacacacacacttgagtattgttcaagtacacca

SEQ ID NO: 19852 - DNA, 255 bp, Homo sapiens
  chr13.fa.O7frz.49672617
  Located on chromosome 13
  Distance between a terminus base of telomere on chromosomal short arm and 5'-terminus of this base sequence : 50960173
  Distance between 3'-terminus of neighbour sequence of sequence listing upward to telomere on chrosomal short arm and 5'-terminus of this base sequence : 85024
acatttcaagattaatcagtcaacaaatatttaactagtgtctgctgtgagagtctgcaaggctatttcacttttgtgcatgtgcatgtgcaagtgtgtgtgtgtggatccacatccacacacacacacacacacatgtgtggatccacatacacacacacacacacacacacacacacacagacagagagaaagcttggcatctgaaataaaccttctgagatttggcctttgtaggcagataaatgactctcc

SEQ ID NO: 19853 - DNA, 213 bp, Homo sapiens
  D13S1269
  Located on chromosome 13
  Distance between a terminus base of telomere on chromosomal short arm and 5'-terminus of this base sequence : 51032370
  Distance between 3'-terminus of neighbour sequence of sequence listing upward to telomere on chrosomal short arm and 5'-terminus of this base sequence : 71942
aacttcctgttgaagctatgtgattattttgtggttcactaattataaaagtataatgtagtcagagatgacagagagagtaaagagaacacaatcctttcccatttttaatatttgaagtttatttttagtgtgtgtgtgtgtgtgtgtgtgtgtgtgtgtgtgtgtaaaatagagatggggtcttgctatgtgctcagggtggtctcaaac

SEQ ID NO: 19854 - DNA, 378 bp, Homo sapiens
  AC007304.11_45806
  Located on chromosome 13
  Distance between a terminus base of telomere on chromosomal short arm and 5'-terminus of this base sequence : 51040668
  Distance between 3'-terminus of neighbour sequence of sequence listing upward to telomere on chrosomal short arm and 5'-terminus of this base sequence : 8085
ttccatttcctctgcagacttgcaacaactgttgtttttgagaaaagtttgtttttcaaatgattattaagaatcctttgtggaaaaaaatctgcaaagtccaaaggccacgtgtgtgtgtgtgtgtgtgtgtgtgtgtgtgtgtgtgtgtgtggtgaggtgagggtggcagagggtggtggtgctgggtatgggtgaatatgggtatttgcaggggaaagcttgggtgggctggggtaataacagcattatcttgcattctataaaatactcatctgaaattcaaatgcctcctttctctaaggagctcagcttcctttataagctaagctttcccaggtaggaaggaggaggctctgagctgactaattacggatg

SEQ ID NO: 19855 - DNA, 374 bp, Homo sapiens
  AC007304.11_84703
  Located on chromosome 13
  Distance between a terminus base of telomere on chromosomal short arm and 5'-terminus of this base sequence : 51079392
  Distance between 3'-terminus of neighbour sequence of sequence listing upward to telomere on chrosomal short arm and 5'-terminus of this base sequence : 38346
cattagtgattaggaaaggttcagatgtcctgagaactggcattcatctactcattcattttgcaaatctttattgaatactttctgatattcagtcttgaaaggagaagacaagtgtgtgtctaggatagtggttctcaaacttgtgtatacgtcagcatcgtggggagctttataagaataaatagtctctctctaaaacaaacaaatacaactccctctctctctctctctctctctctctctctctcacacacacacacacacacacacacacacacacacacacacacacacacagtgcctttgcaggtctgggatgagaccactacatatttgagatggtgattctgatatgcagtcagcattaagga

SEQ ID NO: 19856 - DNA, 293 bp, Homo sapiens
  D13S262
  Located on chromosome 13
  Distance between a terminus base of telomere on chromosomal short arm and 5'-terminus of this base sequence : 51079586
  Distance between 3'-terminus of neighbour sequence of sequence listing upward to telomere on chrosomal short arm and 5'-terminus of this base sequence : -180
tctaaaacaaacaaatacaactccctctctctctctctctctctctctctctctctcacacacacacacacacacacacacacacacacacacacacacacacacagtgcctttgcaggtctgggatgagaccactacatatttgagatggtgattctgatatgcagtcagcattaaggaaacattttattagagaaactctctgtgcaccaaaataccaagtgaacagacttttttagagaaagactttcctataattgtgggaaaagcatgtggcacatgacttcatcttg

SEQ ID NO: 19857 - DNA, 366 bp, Homo sapiens
  chr13.fa.O7frz.49985213
  Located on chromosome 13
  Distance between a terminus base of telomere on chromosomal short arm and 5'-terminus of this base sequence : 51137973
  Distance between 3'-terminus of neighbour sequence of sequence listing upward to telomere on chrosomal short arm and 5'-terminus of this base sequence : 58094
tacttaaactcatgcgatgttcataagcttaagctgaaaattcttaacatgatctacaagttcttaggtgatctggtccctttctacctctctatcctcattctggacatctcccagtgagcagcctctaaaaaataatacacacacacacacacacacacacacacacacacacacacacgcacacacacacaaacactggccacactggcctgatttctgttcttcttatcatgttctttcctgccttgcggctttaccagggacctaccctaccaggaatgctcttcctttatttcctcctctcctcccacctagctcaatcctactcattcttcagcagttagatacaagactgctttctca

SEQ ID NO: 19858 - DNA, 331 bp, Homo sapiens
  chr13.fa.O7frz.50061019
  Located on chromosome 13
  Distance between a terminus base of telomere on chromosomal short arm and 5'-terminus of this base sequence : 51213660
  Distance between 3'-terminus of neighbour sequence of sequence listing upward to telomere on chrosomal short arm and 5'-terminus of this base sequence : 75321
ggatagttacaatccaattgtaagtaatgattacatgtctaacattagacaaagaaacaaaaagaacataaagaacccaattgggccaaccaacatggctgtggggaatcaaggttctgtatcttgattgtggtggtagttatacaaatctatacactacatagaactacacacacacacacacacacacacacactcgcatgaaaactgatgaaaacagttttcatcagtttttacatgtattcatgtgagtgtgtgtgtgtgtgtgtgtgtgtgtagttctatgcaatttaatcctgtgtatgtactgtaccaatccagttaacagtac

SEQ ID NO: 19859 - DNA, 277 bp, Homo sapiens
  AL137881.12_63627
  Located on chromosome 13
  Distance between a terminus base of telomere on chromosomal short arm and 5'-terminus of this base sequence : 51319025
  Distance between 3'-terminus of neighbour sequence of sequence listing upward to telomere on chrosomal short arm and 5'-terminus of this base sequence : 105034
ggccaatacatattagctgttatttttgattttacattcattagacacaattgtctctttgtcactggtatgttttctttaaagtacagatgtcaggaaagtagcaatcagagattccttgtttgttgagggtgttttgttttgttttgttttgttttgttttgttttgttttgttttgacagagtcttgctctgtcgcccaggctggagtgcagtggcgtgatctcggctcactctaactgcctcctgggttcaagtgattcttatcaagcgattc

SEQ ID NO: 19860 - DNA, 298 bp, Homo sapiens
  AL137881.12_91006
  Located on chromosome 13
  Distance between a terminus base of telomere on chromosomal short arm and 5'-terminus of this base sequence : 51346449
  Distance between 3'-terminus of neighbour sequence of sequence listing upward to telomere on chrosomal short arm and 5'-terminus of this base sequence : 27147
gtactgagaatccaaatgctttagaattaatgatgataaattctgctgagttagttgtttaagtttaagtattttattagtttgggagtgtgtgtgtgtgtgtgtgtgtgtgtgtgtgtgtgtgtatgtagaactatgtatatagaacaatatgtatgtatagaactatatatatatatttcagggttcttataaagcaaatacctagtagtagagacatggtattttatttctcttaaatgagtacactcattactgttgaataattagatttattctttattgaagcaggcttaga

SEQ ID NO: 19861 - DNA, 446 bp, Homo sapiens
  chr13.fa.O7frz.50266777
  Located on chromosome 13
  Distance between a terminus base of telomere on chromosomal short arm and 5'-terminus of this base sequence : 51513662
  Distance between 3'-terminus of neighbour sequence of sequence listing upward to telomere on chrosomal short arm and 5'-terminus of this base sequence : 166915
ggtctggcttatttcacttatcataatgtcctccaggttcacttgtggtgagtggcagaatcttcttttttaaagctaaataatattctactacagatagatgatagatagatagatagatagatagatagatagagatagacagacagacagacagacagacagacagacagacagacagacagcttcttgatccattcatccatcagtgaacactttggttgtttccgtatcttggctattgtgagtaatgctgcaatgtgcagatatgtaggatgaacaagtctaggactctaacgtacaacatgaggagtacatcaaataataatgtgttgtatttgagatttctgccaaaagaataggttttaggtgttcttgtcaaaaaaggagggagatggataaccatgtgggatgacagatatgttcatttgcttcactgtagtaac

SEQ ID NO: 19862 - DNA, 291 bp, Homo sapiens
  AL157817.13_145741
  Located on chromosome 13
  Distance between a terminus base of telomere on chromosomal short arm and 5'-terminus of this base sequence : 51671578
  Distance between 3'-terminus of neighbour sequence of sequence listing upward to telomere on chrosomal short arm and 5'-terminus of this base sequence : 157470
aaacagtgtctatgcctagatgagagagtggaaaaattggtttagaagtttgtacagaaagcaattgacaggagtcgacaaattaaagaccacaggccaaatctggcctgccacctatttttgtaaataaagccttatacacacacacacacacacacacacacaccagttgaaccaccagatcagctacctcttccccttcccatcagaaggccaaagcttactctctggaaagatggaccagggacctagaccacaggacaccaagcacagtcaaggtaggagtgctag

SEQ ID NO: 19863 - DNA, 298 bp, Homo sapiens
  D13S268
  Located on chromosome 13
  Distance between a terminus base of telomere on chromosomal short arm and 5'-terminus of this base sequence : 51714296
  Distance between 3'-terminus of neighbour sequence of sequence listing upward to telomere on chrosomal short arm and 5'-terminus of this base sequence : 42427
tctctcaagcacaaacgcaaagagtttccttggggcgtactctcctcccccaccctccaaaatgtctcattccaaaaagcaacacaaagcaaagaaagtctgaaatctagttcccacattctccccagaaggaagagatgcttcattgaataccctgcttccctcaaccccctacacacacacacacacacacacacacacacacacacacacacagacatacagagacatcagaattaatctctcccttccatatgcttatacttcctttgggcttcctctgtgagtgcctttcatg

SEQ ID NO: 19864 - DNA, 268 bp, Homo sapiens
  D13S788
  Located on chromosome 13
  Distance between a terminus base of telomere on chromosomal short arm and 5'-terminus of this base sequence : 51717640
  Distance between 3'-terminus of neighbour sequence of sequence listing upward to telomere on chrosomal short arm and 5'-terminus of this base sequence : 3046
gattgaggtagggtcccaagcagacccaagagatttcgggagtcatagtctagctccttgacaagggctagtgtactagttggtgtcctccaaacagaaccaataggagattatctatctatctatcatctatctatctatctatctatctatctatctatctatctatctatctatctgtacacacacacacacacacacacatacctattgagagagtgagattaagagatttattataagctactggctcacacaattatggagg

SEQ ID NO: 19865 - DNA, 369 bp, Homo sapiens
  AL354820.6_30020
  Located on chromosome 13
  Distance between a terminus base of telomere on chromosomal short arm and 5'-terminus of this base sequence : 51808151
  Distance between 3'-terminus of neighbour sequence of sequence listing upward to telomere on chrosomal short arm and 5'-terminus of this base sequence : 90243
ctccatagcatttgagtatcacagagtttgagtctacgccttccccagactaagtctactaattaaattccttttggccattagaagttaagcagagcatcagggtcatattttataacgtgtgcttaatgatcttgacctttttagcaccatgagtttgaaaaatgtaatttcagctgggcacagtggaggcagaggttgtagtgagccgagattgcaccactgcactccagcctgggtgacagagtgagaatccgtctcaaataataataataataataataataataataataataataataataataatagtataacttcaaggtatactaaagactctgagtatttcattcgtactttctagga

SEQ ID NO: 19866 - DNA, 285 bp, Homo sapiens
  chr13.fa.O7frz.50698621
  Located on chromosome 13
  Distance between a terminus base of telomere on chromosomal short arm and 5'-terminus of this base sequence : 51898444
  Distance between 3'-terminus of neighbour sequence of sequence listing upward to telomere on chrosomal short arm and 5'-terminus of this base sequence : 89924
tgtagtcatctaagttcggactagggttggaggagctgctttcagtctcgctcacatggttgttgcagaccttagttccttaccatgtgggtctctccatgggactgcttgacacagaagctggcttccccaaagtgagaattccagagagactctgagacagggaggtggtggtagggaatggggagagagagggggtgaggagatagagagagagagagagagagagaatgtgaacaagaaggaagctgcagtgatttttaggatctaatctcagaagtaacg

SEQ ID NO: 19867 - DNA, 378 bp, Homo sapiens
  chr13.fa.O7frz.50954366
  Located on chromosome 13
  Distance between a terminus base of telomere on chromosomal short arm and 5'-terminus of this base sequence : 52069402
  Distance between 3'-terminus of neighbour sequence of sequence listing upward to telomere on chrosomal short arm and 5'-terminus of this base sequence : 170673
taatttctggtgagttgaagttagaaggatctgtgtgtcaatctgtttactcctctgatccataaaagaaaaggaagactttactgtaacaacaaatcgaggcatcaatattcttttgaatcggctctctgcttctttgatctaccaggggccaatccaaggcctgttcctgtgggagtgtcacagttggaaaatggtttgaggagcattgtacgtctcacctactgtgcgcacatgcacacacacacacacacacacacacacacacacacacacacacacacagatgtttgcctggtgttttcccaaatgcctgtttgaaggggtggttatgcctttggatgtgcctgggagctaatgctgtctaactctgacact

SEQ ID NO: 19868 - DNA, 484 bp, Homo sapiens
  chr13.fa.O7frz.51084497
  Located on chromosome 13
  Distance between a terminus base of telomere on chromosomal short arm and 5'-terminus of this base sequence : 52201026
  Distance between 3'-terminus of neighbour sequence of sequence listing upward to telomere on chrosomal short arm and 5'-terminus of this base sequence : 131246
ctccacactgatccgtattagagacgaatgtttgctgaggctggctcctctgggttgaacctcttcctcaaactccagactgggagtgctgccaagcgggcagtaccagcctggcctgcaggacatgtccccgccctctgtcctctgccttggatcttgccttccatacaagaattccatcctggtccgatctgttgttaataagacttgtcttttatgtactctgccccttattggggaagcattttattttcactctagaaatcagtctctagatatcagtctctatttttcacacacacacacacacacacacacacacacacacacacacacacacacgactttcccaaggtcaccagaaggtaggtgatcttcttcaacacccagcctcggtgccaaagggcagtccccagacaagctgcatcagcatcatctggaaacctgttggaaatgccctgcctactgactcagaagtgattgc

SEQ ID NO: 19869 - DNA, 161 bp, Homo sapiens
  D13S1325
  Located on chromosome 13
  Distance between a terminus base of telomere on chromosomal short arm and 5'-terminus of this base sequence : 52303053
  Distance between 3'-terminus of neighbour sequence of sequence listing upward to telomere on chrosomal short arm and 5'-terminus of this base sequence : 101543
tcctatgacaccatttgggtttctccaacagtcttccacgtgtgtgtgtgtgtgtgtgtgtgtgtgtgtttagaaagaagcatctggtcaccagaaactcaaaggccaataactcttaacaaaaatacattcacactggacaagtgaacactcaatctaac

SEQ ID NO: 19870 - DNA, 421 bp, Homo sapiens
  chr13.fa.O7frz.51395960
  Located on chromosome 13
  Distance between a terminus base of telomere on chromosomal short arm and 5'-terminus of this base sequence : 52509661
  Distance between 3'-terminus of neighbour sequence of sequence listing upward to telomere on chrosomal short arm and 5'-terminus of this base sequence : 206447
gtgtaatatcttcctgtcatgaatatgttttagtcctagagaaatctgtacaaaccaaccgaggatctatagagagaacacaaaacaaagccactgaatagcctggtagtcactgaaatgtcttcatggtaacatgcaaaaagatagaaattatacacacacacacacacacatacacacatatagtgtatgtgtatttataggaatgaagttaataggtacactttatcatattattattttcattctacaactaaaaaaatggaggcacagaaaagtaatccaaatatcactggtaaaatcaagggaaattccacatgcagaaaaagataagtagaagcaagggaaagaggcatgccgttcatgtttttctttttttcctacttaaccctggggtgctaactgcatcgtgaatagtaca

SEQ ID NO: 19871 - DNA, 431 bp, Homo sapiens
  chr13.fa.O7frz.51652660
  Located on chromosome 13
  Distance between a terminus base of telomere on chromosomal short arm and 5'-terminus of this base sequence : 52532602
  Distance between 3'-terminus of neighbour sequence of sequence listing upward to telomere on chrosomal short arm and 5'-terminus of this base sequence : 22520
agctgaaaggctataggtgtagggctcaatcaggaattttataatcatattgtaaggcattacccatcccagacaaaagatcaggatataaatatccatttatgatgaaaagtaatataagaggtccctactaaatctgaaattatcatggtctaatttaaatcacacacacacacacacacacacacacacacccccaaccccagctacagctttctatgcatatcacaacgtacgtgtcctcctcatctagcccaggctcaagtcgctctggatccaaaatgacagaatcgtgacctccatcaacactgtccgatgcttctgtttcttcagacagggggcctttcaagaacccttctgaaccttcaggagatattaacagaaaatataccaatttaaacagtatttacttatttcatgcagtttgatta

SEQ ID NO: 19872 - DNA, 176 bp, Homo sapiens
  DISD22_0009076
  Located on chromosome 13
  Distance between a terminus base of telomere on chromosomal short arm and 5'-terminus of this base sequence : 52631644
  Distance between 3'-terminus of neighbour sequence of sequence listing upward to telomere on chrosomal short arm and 5'-terminus of this base sequence : 98611
aaagtgcggtactgtctggtatataaaagggtttttgaaaagtttatttccccttttctttctcttttaaaatacacctcccccacaacacacacacacacacacacacacacacacacacacacacacacacacacgggagtcacccaaaaacagtctttgtgatgttctgcaag

SEQ ID NO: 19873 - DNA, 105 bp, Homo sapiens
  DISD22_0009079
  Located on chromosome 13
  Distance between a terminus base of telomere on chromosomal short arm and 5'-terminus of this base sequence : 52839583
  Distance between 3'-terminus of neighbour sequence of sequence listing upward to telomere on chrosomal short arm and 5'-terminus of this base sequence : 207763
ttccatcatattaacaagccacaacacacacacacacacacacacacacacacacacacctttctagtacgattttattcatgtagaaacttacctcaatctggc

SEQ ID NO: 19874 - DNA, 181 bp, Homo sapiens
  D13S773
  Located on chromosome 13
  Distance between a terminus base of telomere on chromosomal short arm and 5'-terminus of this base sequence : 52973249
  Distance between 3'-terminus of neighbour sequence of sequence listing upward to telomere on chrosomal short arm and 5'-terminus of this base sequence : 133561
tttttgtaattgtttttatgtgggtaggattttttctttatcttttctttcctatatcattattattattattattattattattattattattattattattctttccctttccctcctccttaggtgatgtgactttagagcaatgctaggtaggtcttttggccttgcttctatatgc

SEQ ID NO: 19875 - DNA, 134 bp, Homo sapiens
  D13S1305
  Located on chromosome 13
  Distance between a terminus base of telomere on chromosomal short arm and 5'-terminus of this base sequence : 53005127
  Distance between 3'-terminus of neighbour sequence of sequence listing upward to telomere on chrosomal short arm and 5'-terminus of this base sequence : 31697
gatggcaccattgcactccagcctgggtgacagagagagatcttgtctcttacacacacacacacacacacacacacacacacacacagagtgtaattttcttttacaactttcagccttgtttggatgtgctg

SEQ ID NO: 19876 - DNA, 338 bp, Homo sapiens
  HUMUT5570
  Located on chromosome 13
  Distance between a terminus base of telomere on chromosomal short arm and 5'-terminus of this base sequence : 53172404
  Distance between 3'-terminus of neighbour sequence of sequence listing upward to telomere on chrosomal short arm and 5'-terminus of this base sequence : 167143
agaaagaatttgaggcaagtccatagagcaaagtgaaagcaagtttattaagaaagtaaaggaaataaagaaatttctttcccctccttctctccctccctccctccttccctccctctttccttccttccttccttccttccttccttccttccttccttccttccttccttccttccttccttcgttccttcttcctctctgtctctctgtctctctctctttctctctctctcgacagggtcttctgctgctgcccaggctggagtgcactggtactatcacagctcactgtagcctctacctctggaactcgggtgattattccacctcagcct

SEQ ID NO: 19877 - DNA, 278 bp, Homo sapiens
  AC004090.24_27858
  Located on chromosome 13
  Distance between a terminus base of telomere on chromosomal short arm and 5'-terminus of this base sequence : 53186483
  Distance between 3'-terminus of neighbour sequence of sequence listing upward to telomere on chrosomal short arm and 5'-terminus of this base sequence : 13741
aagcactgtaaattgaccaaaggcagacagcaaattgtgaagcttttattcctgaaaaactgctggagcttcgggtaagaacagcaggagtctttggccttcttgcctggagctgctccatcttctcccacaagcccagctggccagaactggacctttaaaagcgcagggctggccatgaaaatgagcaatttgctgccaggagggatggactcacttcacggggtgtgtgtgtgtgtgtgtgtgtgtgtgtgtgtgtaaacctgtggctttgctag

SEQ ID NO: 19878 - DNA, 295 bp, Homo sapiens
  chr13.fa.O7frz.51903834
  Located on chromosome 13
  Distance between a terminus base of telomere on chromosomal short arm and 5'-terminus of this base sequence : 53282482
  Distance between 3'-terminus of neighbour sequence of sequence listing upward to telomere on chrosomal short arm and 5'-terminus of this base sequence : 95721
caactatggactccataattgagcccaagagaggggcctgttcccacagcctaaggaatttcagaagtagagagacttttctacaagttaagcaaaatataaataaataaataaataaataaaaagaaagaaggaaagagaacaaaaccactatcattttcctcttttactcttcacttccttttcccattccttcaagaaatcctttcgggtgcctctatgtgacaagttttgtgttagggattgattaggggttcaaatgtgatcaagaggctggctcttattcaagaatctt

SEQ ID NO: 19879 - DNA, 285 bp, Homo sapiens
  chr13.fa.O7frz.51990590
  Located on chromosome 13
  Distance between a terminus base of telomere on chromosomal short arm and 5'-terminus of this base sequence : 53369040
  Distance between 3'-terminus of neighbour sequence of sequence listing upward to telomere on chrosomal short arm and 5'-terminus of this base sequence : 86263
tcattgccaaatctaagactagattattctctctctctccctctttctccttctcctcctcccccttctttctctgtcttctctcttcactactctcccaaccctgcagtccaggtttctgctatctctttcctgaactactatcctattctccccattggtatcccaacagccgctcttgcccacctttaattctttcagcagccagaggatgtacacacacacacacacacacacacacacacacacacacacacacaactctgctgactcgcttacttccaa

SEQ ID NO: 19880 - DNA, 181 bp, Homo sapiens
  D13S1251
  Located on chromosome 13
  Distance between a terminus base of telomere on chromosomal short arm and 5'-terminus of this base sequence : 53493281
  Distance between 3'-terminus of neighbour sequence of sequence listing upward to telomere on chrosomal short arm and 5'-terminus of this base sequence : 123956
gttggccgatttagatgtgaaaataattattgcaaatatatatatatatatatatatagtgtgtgtgtgtgtgtgtgtgtatacacacactttgcttctttttttcatcattgtgaaagtctttcttgggttctgataattccttcaatgattattcttgcaactgaatttcaacattgcc

SEQ ID NO: 19881 - DNA, 186 bp, Homo sapiens
  D13S1274
  Located on chromosome 13
  Distance between a terminus base of telomere on chromosomal short arm and 5'-terminus of this base sequence : 53526254
  Distance between 3'-terminus of neighbour sequence of sequence listing upward to telomere on chrosomal short arm and 5'-terminus of this base sequence : 32792
tctaccacattggtgccctactttgttttttgctatctttaatattactaaaattgcatatgccattcacacacacacacacacacacacacacacacacacacacacacacatctatctatctatctatctatctatctatctatctatctatctatctattttaggattaagataccttgacag

SEQ ID NO: 19882 - DNA, 269 bp, Homo sapiens
  D13S1228
  Located on chromosome 13
  Distance between a terminus base of telomere on chromosomal short arm and 5'-terminus of this base sequence : 53578341
  Distance between 3'-terminus of neighbour sequence of sequence listing upward to telomere on chrosomal short arm and 5'-terminus of this base sequence : 51901
gcaagttttctcatgggctaactggacatggtgacaagtttagaggtatcttgaaagtccactgcctaagagatctgatggtcagtacaagatggtttcaatagtcaggctgaatggcatattctactggggtagggaagtgaggtgcatagtctgggaatggtgttggagatgctgtgcgtgtgtgtgtgtgtgtgtgtgtgtgcgcgcacacatgtgtttgtgtatgttttgggttgaggtctttccccatagtcctgtgtccagaa

SEQ ID NO: 19883 - DNA, 347 bp, Homo sapiens
  AL136359.13_94113
  Located on chromosome 13
  Distance between a terminus base of telomere on chromosomal short arm and 5'-terminus of this base sequence : 53578408
  Distance between 3'-terminus of neighbour sequence of sequence listing upward to telomere on chrosomal short arm and 5'-terminus of this base sequence : -202
aagagatctgatggtcagtacaagatggtttcaatagtcaggctgaatggcatattctactggggtagggaagtgaggtgcatagtctgggaatggtgttggagatgctgtgcgtgtgtgtgtgtgtgtgtgtgtgtgcgcgcacacatgtgtttgtgtatgttttgggttgaggtctttccccatagtcctgtgtccagaatttattccttctggtgggttcttggtcttgctgacttcaagaatgaagattgagaggtgaagccagctggacttcctgggttgagtggggactcggagaacttttctgtctagctagaggattgtaaacgtaccaatcagcactc

SEQ ID NO: 19884 - DNA, 101 bp, Homo sapiens
  DISO7_10003761
  Located on chromosome 13
  Distance between a terminus base of telomere on chromosomal short arm and 5'-terminus of this base sequence : 53633660
  Distance between 3'-terminus of neighbour sequence of sequence listing upward to telomere on chrosomal short arm and 5'-terminus of this base sequence : 54905
tgtctcctctattccttcacctgtgtgtgtgtgtgtgtgtcagagagagagagagagagagagagagagagggagagtcctgtgaggttgtatttctcgaa

SEQ ID NO: 19885 - DNA, 404 bp, Homo sapiens
  chr13.fa.O7frz.52619804
  Located on chromosome 13
  Distance between a terminus base of telomere on chromosomal short arm and 5'-terminus of this base sequence : 53814269
  Distance between 3'-terminus of neighbour sequence of sequence listing upward to telomere on chrosomal short arm and 5'-terminus of this base sequence : 180508
ttatcttgcactgaccaagtaggcaacacaggccatgtatgcccagggaaacataatccagcagtggagagataagcaacagaggggcactggtgctgagccaggagagatagcaaggataaactactgaggtggaccttgggctccaatacgagttcaaaggcaggtaagaaatagtgaggaaattatcaaatctagactcttctacctttaatttttttagtggtgatttagtgattacttaaagtaagcgcgcgcgcacacacacacacacacacacacacacacacacacacacacacacgtatatatataaactccccccaacaagagaagacactgaatggctcacttcaaagttcaggcagtgagtctctttttaagttgtcagtgaaatacaccta

SEQ ID NO: 19886 - DNA, 212 bp, Homo sapiens
  D13S155
  Located on chromosome 13
  Distance between a terminus base of telomere on chromosomal short arm and 5'-terminus of this base sequence : 53998172
  Distance between 3'-terminus of neighbour sequence of sequence listing upward to telomere on chrosomal short arm and 5'-terminus of this base sequence : 183499
ggtatattctcagagcctggatttaaatctgtttctttgacctcagattgtgtgtgtgtgtgtgtgtgtgtgtgtgtgtgtgtgtgagagagagagagagaaggagagtctgggtctatggaaggctgtgtgagagagagaaattgtgctaggtttccttctaataaatatatcattttgcctcatatatgatcaataaatgtgctggctgt

SEQ ID NO: 19887 - DNA, 154 bp, Homo sapiens
  Z16517.1_180
  Located on chromosome 13
  Distance between a terminus base of telomere on chromosomal short arm and 5'-terminus of this base sequence : 53998184
  Distance between 3'-terminus of neighbour sequence of sequence listing upward to telomere on chrosomal short arm and 5'-terminus of this base sequence : -200
gagcctggatttaaatctgtttctttgacctcagattgtgtgtgtgtgtgtgtgtgtgtgtgtgtgtgtgtgtgagagagagagagagaaggagagtctgggtctatggaaggctgtgtgagagagagaaattgtgctaggtttccttctaata

SEQ ID NO: 19888 - DNA, 398 bp, Homo sapiens
  chr13.fa.O7frz.52896176
  Located on chromosome 13
  Distance between a terminus base of telomere on chromosomal short arm and 5'-terminus of this base sequence : 54085878
  Distance between 3'-terminus of neighbour sequence of sequence listing upward to telomere on chrosomal short arm and 5'-terminus of this base sequence : 87540
gctgtttgattagattgtgagtttttctaaggctggaataaacttttatttgtttgtttcacacagctcacagcacagtgactgaagcaagctaggtcttaaaaaaatcgtgatgaatgaattgttaaagtgtattcttcaaaagggcaatatgatgatgactcatataaatataaaataaatgcatcaaaattttattcagcttgttaattaatgataaaatcagtaagatctcaaaaccagttcaaagagcatttgagaagctggtgtgtgtgtgtgtgtgtgtgtgtgtgtgtgtgtaatttaataagggaagttaggaatatttttggcttagattcaaaacaggttaatgtctcacagtggaataaattaaaacatttaaggttacctattcc

SEQ ID NO: 19889 - DNA, 462 bp, Homo sapiens
  chr13.fa.O7frz.53171006
  Located on chromosome 13
  Distance between a terminus base of telomere on chromosomal short arm and 5'-terminus of this base sequence : 54355308
  Distance between 3'-terminus of neighbour sequence of sequence listing upward to telomere on chrosomal short arm and 5'-terminus of this base sequence : 269032
gaaaataacaatcgacattcatagttgcttagaaaaaagctcataatttggtagaggaaagagatactaaatgtataaatcaagaatgatttgaaaatcctaaagtagaaatacgttttactttatttttcatgacccaggaatttcatatgatcttctcatgctttcaaaacaaatatcagataaacaattacgttttcctgtttaaacccacattgtatatattcttggtttgagaaaaacttactttttcttaaattttttccctttctgtatttcaactttcatgccaacatacatgcaaacacacacacacacacacacacacacacacaccatttttcctctagaaatacatttcctctttctctactgcaaatcataccattcccatccagatgatctttaaaactaacacattctttgaagctttctcaggaacagcctgaaagacaattagta

SEQ ID NO: 19890 - DNA, 157 bp, Homo sapiens
  AL355485.9_25432
  Located on chromosome 13
  Distance between a terminus base of telomere on chromosomal short arm and 5'-terminus of this base sequence : 54579841
  Distance between 3'-terminus of neighbour sequence of sequence listing upward to telomere on chrosomal short arm and 5'-terminus of this base sequence : 224071
attgaggaacaccattctcactgaatatatatatatatatatatatatatatatatatatatatatatatatatatatttctaaagttatccaggaaaagattcatgccaaacctcattgaaaaccctatgttcttagcatagtatggaaccaatgt

SEQ ID NO: 19891 - DNA, 322 bp, Homo sapiens
  AL355485.9_123099
  Located on chromosome 13
  Distance between a terminus base of telomere on chromosomal short arm and 5'-terminus of this base sequence : 54677367
  Distance between 3'-terminus of neighbour sequence of sequence listing upward to telomere on chrosomal short arm and 5'-terminus of this base sequence : 97369
ggaacgtttactgtgctatgattgctgatggatgtatccctatttggtattattttatctggaatttttttctatcataacataataagataaatatattgagtttggaacccttggagtcctgttgtctctctctctctctctctctctctctctctctctctctatatatatatatatatatatatatatgtatatatatatatatatatgtatatatatatatttgactcaatatagatagaagggaaaatgggcacagagctttttctgaagcacgttccactctgtctttttcttgtcatttctttaggcagaaatg

SEQ ID NO: 19892 - DNA, 469 bp, Homo sapiens
  chr13.fa.O7frz.53509594
  Located on chromosome 13
  Distance between a terminus base of telomere on chromosomal short arm and 5'-terminus of this base sequence : 54816589
  Distance between 3'-terminus of neighbour sequence of sequence listing upward to telomere on chrosomal short arm and 5'-terminus of this base sequence : 138900
gctcaacatcactaatgatcagggaaatgccattcttgcaggcaataccaccttactcctgcaagaatggtcataatcaaaaaaataaaaaaatagatgttgccatgaatgtggtgttcagggaacacttctacactgctgttgggatggtgaactagtacagccattagggaaaacagtctggacattccttaaggaactaaaagtagaactaccatttgatccaacaatcccactacagggtatcaacccagaggaaaagaagtcattatacaaaaaagatacttgcacatgcatgtttatggcagtacaattcacaattgcaaaatcgtggaaccaactcaaatgcccatcaatcaactagtggataaaaaaactgtgagatatgtatatgtgtatatatatatatatatatatatgaaggatggaatactagtcagccataaaaaggaatgatttaacgtcattt

SEQ ID NO: 19893 - DNA, 340 bp, Homo sapiens
  HUMUT1222
  Located on chromosome 13
  Distance between a terminus base of telomere on chromosomal short arm and 5'-terminus of this base sequence : 54834652
  Distance between 3'-terminus of neighbour sequence of sequence listing upward to telomere on chrosomal short arm and 5'-terminus of this base sequence : 17594
cttttcaaacttacctccataaaagtcatctacatgtataaagcatttacttgtgtgtgtgtgtgtgtgtgtgtgtgtatgtgttgtgtagatagatagatagatagatagatagatagatagatagagatgtattttctcctaatcacataaataaaaattttaagtgactggaatagtatgtatatacactttgtaatatgcatgcatatatacatacacaaacatatatatgacttggtatatgcaaatatattatataacatgcacataatgtatacatttgcaagtaaaacacctgttaagttaaactacccaaagtaaaagctaatgaaagcag

SEQ ID NO: 19894 - DNA, 196 bp, Homo sapiens
  D13S784
  Located on chromosome 13
  Distance between a terminus base of telomere on chromosomal short arm and 5'-terminus of this base sequence : 54935348
  Distance between 3'-terminus of neighbour sequence of sequence listing upward to telomere on chrosomal short arm and 5'-terminus of this base sequence : 100356
tttggtaagaaaaacatctcccttctgtttttatttatccatgtatctatctatctatctatctatctatctatctatctatctatctgtctgtctatctatcatctatcatctattgtctatctatttatatatttagttctgactctgtcacctaggctggagtgcagtgtcataatgacagctaactgcagcc

SEQ ID NO: 19895 - DNA, 357 bp, Homo sapiens
  chr13.fa.O7frz.53818035
  Located on chromosome 13
  Distance between a terminus base of telomere on chromosomal short arm and 5'-terminus of this base sequence : 55059721
  Distance between 3'-terminus of neighbour sequence of sequence listing upward to telomere on chrosomal short arm and 5'-terminus of this base sequence : 124177
aattcacttccatgtaaatacaatgtttgttaaggaaaagttatagatattttcatttctaccacacatacacatatatattagataacatatacataatattatattatacaatcctacattatagtattaaaattccacaataaccagaacaattgtttaaaacttatgtcacaaaaatgtttgttgttgttgttgttgttgttgttgttgttggggaagaacattttctcactgaccttgattaaaatcaccaggacatgacaattacaataaataatgagttttacttgtttttattacgtttttaaaaattgcctatgcacaatcacctcctaatgctgtatgagctctgaa

SEQ ID NO: 19896 - DNA, 359 bp, Homo sapiens
  chr13.fa.O7frz.53926291
  Located on chromosome 13
  Distance between a terminus base of telomere on chromosomal short arm and 5'-terminus of this base sequence : 55167965
  Distance between 3'-terminus of neighbour sequence of sequence listing upward to telomere on chrosomal short arm and 5'-terminus of this base sequence : 107887
agactctaactcctgaactcaatcgatcctctcaccttggcctctctagtcgctgggattataggcacgagccaccatacccagcaacaaaagatttgaagagccatgagtatataaaaatggctcaaaatcagtagtcattagggaggtataaattaaaaccatgatgaaatagcactacaaacacataagaacagccacacacacacacacacacacacacacacacacacacacacaagattgataataccaaagctggcaaactagaaaaactgaagttttcatatattgctatagggaatgtgaaatgctgcaactacttcggaaaactgtttgtcagatagtgaaaatgtaaa

SEQ ID NO: 19897 - DNA, 208 bp, Homo sapiens
  chr13.fa.O7frz.54054678
  Located on chromosome 13
  Distance between a terminus base of telomere on chromosomal short arm and 5'-terminus of this base sequence : 55304817
  Distance between 3'-terminus of neighbour sequence of sequence listing upward to telomere on chrosomal short arm and 5'-terminus of this base sequence : 136493
gaattgaacaatcagtctagctaccacaatgcacagtttccaagtctacccagcttaaagcataccagatgatgatgatgataatgacgatgatgatgatcatgatgattactactttaatctacttcttttaaaacctacttaagaatcactttgtttaaatgtgttctttgaattaatactggggtcttgccttcctattcatagt

SEQ ID NO: 19898 - DNA, 457 bp, Homo sapiens
  chr13.fa.O7frz.54182991
  Located on chromosome 13
  Distance between a terminus base of telomere on chromosomal short arm and 5'-terminus of this base sequence : 55373374
  Distance between 3'-terminus of neighbour sequence of sequence listing upward to telomere on chrosomal short arm and 5'-terminus of this base sequence : 68349
taatcagtaattgccagaatttaggtcagaagagggaaagataggcagagcagagaggatttttaggtcagtaaacatattcttatataatactgtaataacgaataaatgttagtatacatttgtccaaacccataatatatacaacactggcagtgaaccctaatgaaaactattgttttggagtaaaaatgatgtggcaatgtaggttctatcaattgggacaatagaggactctgttaggaatattgataatgagggaggctatgtatgtttgggggcagtggatatgtgggaaatctctgtaacttctcaattttactgtgaacctgaaacttttctaaaaaatgaagtctattacaacacacatgtacattcacacacacacacacacacacacacacacacacagagattaagttataagtattaaatgtctgatctacaaggctcagta

SEQ ID NO: 19899 - DNA, 343 bp, Homo sapiens
  chr13.fa.O7frz.54327163
  Located on chromosome 13
  Distance between a terminus base of telomere on chromosomal short arm and 5'-terminus of this base sequence : 55449557
  Distance between 3'-terminus of neighbour sequence of sequence listing upward to telomere on chrosomal short arm and 5'-terminus of this base sequence : 75726
ctatgttggtttacaatggagtacctttaataacctgaagtcttttatgaaataaggtgaggtataaatacataagaataaaaaaactgttcactattgtagaattacattttgttgtttttctagtaggaagattaagatgatggagaatgaaatgtaaatcaattagcagagtcttcagatgattaaacccctcctgatttgccagcacgctctcaataaacaacaactactttttcttcttcttcttcttcttcctcttcctcttcctcttcctcttcttcttcttcttcttcttcttcctcttcttcctatttctttgtagttgctgtgtaggaacaaa

SEQ ID NO: 19900 - DNA, 232 bp, Homo sapiens
  D13S1237
  Located on chromosome 13
  Distance between a terminus base of telomere on chromosomal short arm and 5'-terminus of this base sequence : 55480965
  Distance between 3'-terminus of neighbour sequence of sequence listing upward to telomere on chrosomal short arm and 5'-terminus of this base sequence : 31065
cgtaatacacttttggccccaaaactttcaccttatttcttcttctcttattttgactttttcctcttcaggtaattttcagtggaaataaaagaaagtgtgtgtgtgtgtgtgtgtgtgtgtgtgtgtgttttagaaatggaacaattgaaaaacacacaagaaatatttttaacttcttcagttactggatatcttgaatttcactgtaggaatctttccagagatgtca

SEQ ID NO: 19901 - DNA, 353 bp, Homo sapiens
  chr13.fa.O7frz.54822105
  Located on chromosome 13
  Distance between a terminus base of telomere on chromosomal short arm and 5'-terminus of this base sequence : 55591157
  Distance between 3'-terminus of neighbour sequence of sequence listing upward to telomere on chrosomal short arm and 5'-terminus of this base sequence : 109960
taacaatgcaaatgtacttatcactatttactcccatgtaatttatgagaattgtttacataatttaggaaaaaatatctttattccacaaaaggcaaacatgtattacttttctttaatagaatggagaatggattaagaattaagtgaaatatgtgtgtgtgtgtgtgtgtgtatatatatatatatatatatatatatatatatatatatatatgtatctataaaactttaatttcttgaaagtctaacccaggcatgagagatacaaatcataatacaacatgatgttcgaggtggtaatatcactttaaagagccatttgtaagtatatttcaaatgtacttcggatt

SEQ ID NO: 19902 - DNA, 336 bp, Homo sapiens
  chr13.fa.O7frz.54734039
  Located on chromosome 13
  Distance between a terminus base of telomere on chromosomal short arm and 5'-terminus of this base sequence : 55650361
  Distance between 3'-terminus of neighbour sequence of sequence listing upward to telomere on chrosomal short arm and 5'-terminus of this base sequence : 58851
acctagaaatcacctacaaagaacacacacacacacacacacacacacacacacagaaagaaggagttacaaaacaaccagaaaacaaacagcaaaatgtcattagtaagtccttacctattaatattaatcttgattgtaaatgggataaattattcaattaaaaggcatagaggaccttaactgattttaaaagaaagattcaattatatgatgcctacagtaaactcatttcatttatatagacacacatagacttaaatgaagggaaggaaaaatatattttatgcaaatggaaattttctaaaaagcaggaatagctatgcttgtattaga

SEQ ID NO: 19903 - DNA, 198 bp, Homo sapiens
  Z66990
  Located on chromosome 13
  Distance between a terminus base of telomere on chromosomal short arm and 5'-terminus of this base sequence : 55856077
  Distance between 3'-terminus of neighbour sequence of sequence listing upward to telomere on chrosomal short arm and 5'-terminus of this base sequence : 205380
atggcctattatgtgaccttgtaatcatgtgagttaatacttaacaaactcccctttatgtgtgtgtgtgtgtgtgtgtgtgtgtgtgtgtgtgtgtgtgtgtttgtatttgtattccgttagttcggttcctctacagaaccctgacaaatatagaggtcattcaggttgttagtacaactcgctttcttgcagtag

SEQ ID NO: 19904 - DNA, 383 bp, Homo sapiens
  chr13.fa.O7frz.55053969
  Located on chromosome 13
  Distance between a terminus base of telomere on chromosomal short arm and 5'-terminus of this base sequence : 56047631
  Distance between 3'-terminus of neighbour sequence of sequence listing upward to telomere on chrosomal short arm and 5'-terminus of this base sequence : 191356
aatgctaggattacaggtgtgagccgctgcgccaggctcccttacctaatttttaccctttaatttgcactgaagaaaccttcagttttcttactgcccccctcaccccgtctcccccacgtgcacatgcgcacgcgcgcatgcacacacacacacacacacacacacacacatacacagtaactgtgagatgatcagtgtgttaagtaacttgattgtgattcctttcacaatgtatatgtatatcaaaacatcacattatatgccttaaatacataccatttttatttgtcaattatcccttagtaaaactagagaagaaaatccattacgtaaaaaaacaaacaacaaaaaagaatataaaggaaactgtgctaattcta

SEQ ID NO: 19905 - DNA, 445 bp, Homo sapiens
  chr13.fa.O7frz.55385275
  Located on chromosome 13
  Distance between a terminus base of telomere on chromosomal short arm and 5'-terminus of this base sequence : 56312616
  Distance between 3'-terminus of neighbour sequence of sequence listing upward to telomere on chrosomal short arm and 5'-terminus of this base sequence : 264602
acgtaagaacatgaaatgtgactgcaaggtatttctttccaagaaaactgagtgtatgtttccaaaacaaagaactgtatatgagtggcatccctatttataataataaaacatagaaacgataaaaatttccatcaactgggaattgatgaaaacattctggaacatatatatatatatagagagagagagacagagagagagagagagagatgaaatatgttgcaggactatagaggaagaaactactatatcaagcaacttagattaatcttaaaaatattactctaagtgaaaggaactaagtatggagaagtctataccatatgattccatttgttttacaatatgggaaataaaaaattataggtacaaaatcatacatatggttgccatgaattagaaatgggaaaagaaatttgttacaaagatgcatgagataact

SEQ ID NO: 19906 - DNA, 295 bp, Homo sapiens
  G10101
  Located on chromosome 13
  Distance between a terminus base of telomere on chromosomal short arm and 5'-terminus of this base sequence : 56412230
  Distance between 3'-terminus of neighbour sequence of sequence listing upward to telomere on chrosomal short arm and 5'-terminus of this base sequence : 99169
gtaccacgtcttggttttgggatcacttagaggtacaaaaaaagttttaattttaatttctttaaaattgaaagaaaaaaatgaatacaatatttgcaaatatataataataaatgcaatctgaattataatcatttttataccaacatgttcattgtagatagatggatggatggatagatagatagatagatagatagatagatagatagatagatagatagagatatatagagctctctctctctcaaagagagagagatacctttatagagagagacaaccttctgggctc

SEQ ID NO: 19907 - DNA, 206 bp, Homo sapiens
  G08990
  Located on chromosome 13
  Distance between a terminus base of telomere on chromosomal short arm and 5'-terminus of this base sequence : 56412370
  Distance between 3'-terminus of neighbour sequence of sequence listing upward to telomere on chrosomal short arm and 5'-terminus of this base sequence : -155
taccaacatgttcattgtagatagatggatggatggatagatagatagatagatagatagatagatagatagatagatagatagagatatatagagctctctctctctcaaagagagagagatacctttatagagagagacaaccttctgggctccaacaatcttcctgcctcagcatctggagtggatgggtccacaggtgtatg

SEQ ID NO: 19908 - DNA, 471 bp, Homo sapiens
  AL138683.5_7886
  Located on chromosome 13
  Distance between a terminus base of telomere on chromosomal short arm and 5'-terminus of this base sequence : 56443022
  Distance between 3'-terminus of neighbour sequence of sequence listing upward to telomere on chrosomal short arm and 5'-terminus of this base sequence : 30446
gtgaacagtaggtttagaatcaagctattgagtcaatagaaaacattcaaagtatttccattgtgtgatctaaaagaactgtttgaattataaaaatattatatacatatatatatatggtctgggtgtggtggctcatgtctgtaatcccagcactttgggaagttgaggtgggaggatcacttgagtccaggaggtagatcaattgagctgagagcatgtcactgcacttcagtctgggagacagagtgagatcctgtttcagaataaataaataaataaataaataaataaataaataaatagtgttacaggtgggtctttgttcttagagctcccaagatggggcaggctgctcccaagatggcagcaagccttttgttctctcacctgatgttcttggcctcatggattcgaaggaatggaaccttggtctatgcggtgagtgttacagctctattagaagccttg

SEQ ID NO: 19909 - DNA, 266 bp, Homo sapiens
  D13S1327
  Located on chromosome 13
  Distance between a terminus base of telomere on chromosomal short arm and 5'-terminus of this base sequence : 56552564
  Distance between 3'-terminus of neighbour sequence of sequence listing upward to telomere on chrosomal short arm and 5'-terminus of this base sequence : 109071
cctgtctgtgccatattaaaacatttttctcaaccatcagaatcataaagaaatgataactgacagattacatttttctaattattaccaaataaaggtagaaaacatgtgtatcagtttgggttatactaaactaacattttatgtttgtgtgtgtgtgtgtgtgtgtgtgtgtgtgtgtgtgtgtagagaaagtgagagagagagttgtgaagctttttcaagaaattattttatacaattgttggggtccatttaggcaaatc

SEQ ID NO: 19910 - DNA, 205 bp, Homo sapiens
  chr13.fa.O7frz.55798582
  Located on chromosome 13
  Distance between a terminus base of telomere on chromosomal short arm and 5'-terminus of this base sequence : 56653183
  Distance between 3'-terminus of neighbour sequence of sequence listing upward to telomere on chrosomal short arm and 5'-terminus of this base sequence : 100353
actataacatgttgctcataggagtgtgaattgaacagtcttaaaaaaacacagacacatggatgtatcctctaaacttaaaaatacgactctcctatgattcagcaattgtttgcctacttatatactgaatagaaatgaatatatatatatatatatatatatatatatatatatatgaataacagtaacagctttgtcaaga

SEQ ID NO: 19911 - DNA, 229 bp, Homo sapiens
  chr13.fa.O7frz.55879475
  Located on chromosome 13
  Distance between a terminus base of telomere on chromosomal short arm and 5'-terminus of this base sequence : 56734103
  Distance between 3'-terminus of neighbour sequence of sequence listing upward to telomere on chrosomal short arm and 5'-terminus of this base sequence : 80715
tggcactaagatacttaatacgtacatttttcatgtcaacaaataactaaattaatgaataaattaacagaagtttgaccttaccttagaatagccacatctccagttctaatacatcacacacacacacacacacacacacacacacacacacacactagagatcgctgatcaccaatctagggaagtacgttttcatggtgtttactaatgactatttgatgttgcc

SEQ ID NO: 19912 - DNA, 410 bp, Homo sapiens
  chr13.fa.O7frz.56006304
  Located on chromosome 13
  Distance between a terminus base of telomere on chromosomal short arm and 5'-terminus of this base sequence : 56860760
  Distance between 3'-terminus of neighbour sequence of sequence listing upward to telomere on chrosomal short arm and 5'-terminus of this base sequence : 126428
acttatgcagtgaatttgatttagtgttctgtagggagctacagagagattcttcttataaggtagctgagaactctgtgttgacagcagagctagctatttatttacaaaggcactaagaatttgggaagaaaatgaaagtttatttaattataccaataacacttaaataatttgtaatgctagatttaaaacacaaatttgacaaaaaaggtagtgaatttttaaattttaattataagtttaatattacttggggatatagagttaaatttttatcttttgaatcattacaactacacacacacatacacacacgtgcataggcacactttatttatttatttatttacttatttatttatttatttatatcaaaccttactctctgaggatacctttctcaactt

SEQ ID NO: 19913 - DNA, 223 bp, Homo sapiens
  D13S1301
  Located on chromosome 13
  Distance between a terminus base of telomere on chromosomal short arm and 5'-terminus of this base sequence : 56944788
  Distance between 3'-terminus of neighbour sequence of sequence listing upward to telomere on chrosomal short arm and 5'-terminus of this base sequence : 83618
ttttgtccaggagtgttgcactgaaattttagatagatagattagcatgtacttttttttctttgaaaaatttggtttcaagtttattccacttttattaaagttagtcatagagtagtcttaagttattccctgaaaaaaaaatgtgtgtgtgtgtgtgtgtgtgtgtgtgtgtgcatgtgtgttctgaatgtgatttgcagagtagttgaagggaccagca

SEQ ID NO: 19914 - DNA, 245 bp, Homo sapiens
  AL390375.6_18600
  Located on chromosome 13
  Distance between a terminus base of telomere on chromosomal short arm and 5'-terminus of this base sequence : 56966728
  Distance between 3'-terminus of neighbour sequence of sequence listing upward to telomere on chrosomal short arm and 5'-terminus of this base sequence : 21717
caagtatatcgtgatagtccaaacattgttcttcagagaagcaaagaccaattctaaagtggaatctagagtgaaatcatatctatctatctatctatctatctatctatctatctatctatctacacatatatgaacctttgacattatcttccattagaaattgcaccgattggtcatcaaaaggaagaagaaacagattgttgaaaacacattaatggttcttgaaactgttctaatcagca

SEQ ID NO: 19915 - DNA, 172 bp, Homo sapiens
  DISO7_10003764
  Located on chromosome 13
  Distance between a terminus base of telomere on chromosomal short arm and 5'-terminus of this base sequence : 57060596
  Distance between 3'-terminus of neighbour sequence of sequence listing upward to telomere on chrosomal short arm and 5'-terminus of this base sequence : 93623
gactgccacatattctcccaaactgtgaaagggatcgtgtgtgtgtgtgtgtgtgtgtgtgtgtgtgtgtgtatggcatatattgtaataaagaacattgaaaattactttagtataatatgatcataaaagtaaaattaaattgactacaccaatgtagatagaaattcca

SEQ ID NO: 19916 - DNA, 198 bp, Homo sapiens
  D13S163
  Located on chromosome 13
  Distance between a terminus base of telomere on chromosomal short arm and 5'-terminus of this base sequence : 57186955
  Distance between 3'-terminus of neighbour sequence of sequence listing upward to telomere on chrosomal short arm and 5'-terminus of this base sequence : 126187
ccagcatcgccaaagtcagacaaaggataccacaagcaaaatacaccaccacacacacacacacacacacacacacacacgccagtatctctgataaacattaatgtgcaaattcttaatgaaatatagcaaactgaatttaaaaagattctacattatagccaaaagaaatttacctctgtcaatcaaggtaggttt

SEQ ID NO: 19917 - DNA, 332 bp, Homo sapiens
  AL355576.11_52358
  Located on chromosome 13
  Distance between a terminus base of telomere on chromosomal short arm and 5'-terminus of this base sequence : 57225986
  Distance between 3'-terminus of neighbour sequence of sequence listing upward to telomere on chrosomal short arm and 5'-terminus of this base sequence : 38833
tcttaaatatggcaaatgctataaatggggatgtagaagtatagggcaataaaataaatcttttttatgaaaccagggcattttaattttgtggtttttcttatttttgtgtctttctttctttctttctttctttctttctttctttctttctttctttctttcttcttttctgcttgagtaattttttttctaattgtggggaagcattgtatggtgatgaaataaaactctggaaatgtattcttattttatagttatcaggtagggctaatactggagtccaagtttttctggaggaagctatgttgaattatctaactatctgagcc

SEQ ID NO: 19918 - DNA, 232 bp, Homo sapiens
  DISO7_10003766
  Located on chromosome 13
  Distance between a terminus base of telomere on chromosomal short arm and 5'-terminus of this base sequence : 57314008
  Distance between 3'-terminus of neighbour sequence of sequence listing upward to telomere on chrosomal short arm and 5'-terminus of this base sequence : 87690
tagctaagtgacacccaagggatcctgtgacatatatatatatatatatatatatatatatatatatatatgatatgtacatatagagatatataggttaaatacatatatgtgtatatatacatatatcatacaatatatattatatatacatatatactatatactatatattgtgtgtgtgtatatatatgtatatcaaagcaaatagctttatgcagataggtggtac

SEQ ID NO: 19919 - DNA, 193 bp, Homo sapiens
  D13S1319
  Located on chromosome 13
  Distance between a terminus base of telomere on chromosomal short arm and 5'-terminus of this base sequence : 57489051
  Distance between 3'-terminus of neighbour sequence of sequence listing upward to telomere on chrosomal short arm and 5'-terminus of this base sequence : 174811
acatggaacttattcccgttgagacaagttaggcttccaacacacacacacacacacacacacacacacacacacacacacacacacaataggaaaaagattaacaagaaaactttgtgctgtcttttactttcttctttattttgtgtaaaggatatgaaatatcaaaccatgaagtcaatcatctctcacg

SEQ ID NO: 19920 - DNA, 335 bp, Homo sapiens
  chr13.fa.O7frz.57045051
  Located on chromosome 13
  Distance between a terminus base of telomere on chromosomal short arm and 5'-terminus of this base sequence : 57727314
  Distance between 3'-terminus of neighbour sequence of sequence listing upward to telomere on chrosomal short arm and 5'-terminus of this base sequence : 238070
ctcattgtttagttccgacttataattgagcacatgctgtttttgaccttctgtttctgagtcatttcactaaagataatggtctccagttctattcgtgttgctgcaaaaggcatgatttcattctctgttatggctgagtagtatcccatggtgtgtgtgtgtgtgtgtgtgtgtgtgtgtgtgtatatacataggtgtgtatatatatatgtatacacacacatatatgtatatatgtatacctatacacacacacacacacacacacatatatatgttgatattggcaacaacaacacctagaaatatatttaaccaaggagttatgagac

SEQ ID NO: 19921 - DNA, 445 bp, Homo sapiens
  AL157360.8_122488
  Located on chromosome 13
  Distance between a terminus base of telomere on chromosomal short arm and 5'-terminus of this base sequence : 57822347
  Distance between 3'-terminus of neighbour sequence of sequence listing upward to telomere on chrosomal short arm and 5'-terminus of this base sequence : 94698
tcattcaagctgaagttctaacaccaaaagcttgataattttggcagatttcattctttgagcaatattcaaatattacactacttagaacagtgtaaaatatttttataataactctcctctgagagaaatggtacaagaatacttaggcttaggacattacaaataaaaagtcctagaatagccttgaaaaggtagtattgagggtttttgttttgttttgttttgttttgttttgttttgttttgtttttgagacagaattttgctcttgtcgcccaggctggtgtgcagtggtgcaacctcagctcactgcaacctctgcctccaggttcaagcaattctctgcctcagcctcccaagtagctgggattacaggcgggtgccaccacgcccagctaatttttgtattgttagtaaagatggggtttcactacgttggctga

SEQ ID NO: 19922 - DNA, 279 bp, Homo sapiens
  AL157360.8_74019
  Located on chromosome 13
  Distance between a terminus base of telomere on chromosomal short arm and 5'-terminus of this base sequence : 57870889
  Distance between 3'-terminus of neighbour sequence of sequence listing upward to telomere on chrosomal short arm and 5'-terminus of this base sequence : 48097
cagtgtattgcttaaggaatgataagttaaaaaaaaagtctgtatgtgttcagaacagatgcaaattttttccaaatatttttgatccatggttggttgaatcaacaaatgtggaacctgcagatatggagggccaactgtgtaagtacacacacacacacacacacacacacacacactcttaaagaatggggaaaaagtagctgaattgtaaacaaaatgttatcttaaatgcagtaaaatttaaataatataaaaatgtaaaactggacaggcacg

SEQ ID NO: 19923 - DNA, 207 bp, Homo sapiens
  AL157360.8_43943
  Located on chromosome 13
  Distance between a terminus base of telomere on chromosomal short arm and 5'-terminus of this base sequence : 57901033
  Distance between 3'-terminus of neighbour sequence of sequence listing upward to telomere on chrosomal short arm and 5'-terminus of this base sequence : 29865
aaagatgccataaggcatactaaaggtgagaatggctgcagatctccatcacacacacacacacacacacacacacacacacacacacacacacacacacacacacacacaaagcttccaattcctaccagaaactcaatcagttatttaattttaagatattggggtacatcataaagaaattagtttagcgctgtactgtcattt

SEQ ID NO: 19924 - DNA, 234 bp, Homo sapiens
  AL157360.8_4501
  Located on chromosome 13
  Distance between a terminus base of telomere on chromosomal short arm and 5'-terminus of this base sequence : 57940454
  Distance between 3'-terminus of neighbour sequence of sequence listing upward to telomere on chrosomal short arm and 5'-terminus of this base sequence : 39214
cataagtacttgtcctcatggttccaataaagaaaaacaaaatggaaaaataaaacccttatcaggaaatatttccagctttctgattttctgatacacacacacgtatgcacacacacacacacacacacaaatgcacacacaaatatatatatatatacacatatatatacatatttctctttcagacctcccagtctgatggagaaaatgaactagacttcaggataaacc

SEQ ID NO: 19925 - DNA, 200 bp, Homo sapiens
  D13S1303
  Located on chromosome 13
  Distance between a terminus base of telomere on chromosomal short arm and 5'-terminus of this base sequence : 58053469
  Distance between 3'-terminus of neighbour sequence of sequence listing upward to telomere on chrosomal short arm and 5'-terminus of this base sequence : 112781
caccaataagaaggtgacataacttttttagttatgttataaaacaaaacatataattaagtaacttgtaaaaaaaagagtttttcaagcccagatgagatgtaaatatttgagatttctggacccttgattgtgtgtgtgtgtgtgtgtgtgtgtgtgtgtgtgtgtgtgtgtaataacagatactccagagatggagc

SEQ ID NO: 19926 - DNA, 463 bp, Homo sapiens
  chr13.fa.O7frz.57542257
  Located on chromosome 13
  Distance between a terminus base of telomere on chromosomal short arm and 5'-terminus of this base sequence : 58234928
  Distance between 3'-terminus of neighbour sequence of sequence listing upward to telomere on chrosomal short arm and 5'-terminus of this base sequence : 181259
catacactctaatgaaagatggactgcaaaattataattgattggttagtaggttggtgaacctccagcataaatctctatctttctctctctccgtctctctctctctctctctctctctctctctctctctctctctctatatatatatatatatatatatatatatatatatatatacacaccacatatatttccctccctctttctttttgtctgctgtaatacctggttgctgctatggtttggatatggtgtatttgtccccacttaacctcatgctgaagtttgatcctctgtgtgttgatgttgggaagcggggcatagtggaagtgtttgggtcatgaaggtggatctctcatgaagggcttggagtcatcctagcagcagtgagtgattttttgctcttgcaaaactgaattagtgccggcggagtgaattaacttctgagaggataggttgt

SEQ ID NO: 19927 - DNA, 365 bp, Homo sapiens
  chr13.fa.O7frz.57638815
  Located on chromosome 13
  Distance between a terminus base of telomere on chromosomal short arm and 5'-terminus of this base sequence : 58331529
  Distance between 3'-terminus of neighbour sequence of sequence listing upward to telomere on chrosomal short arm and 5'-terminus of this base sequence : 96138
tagcatacagcaggttagtaagacgtcatagatggctttcactctagtatttcaaaggatacattttttctgttcagggattactctcaaggtcttccgtgtgtgtgtgtgtgtgtgtgtgtgtgtgtgtgtgtgtgtgtagcatgtcttttcatatatatatgtgtgtgtgtgtatatatatatacatgtgtatatatgtatatttgtgtatatatatacatgtatatatgtatatttatgtatatatatgtgtatatatatgtgtgtgtatatatatatgtgtgtgtatatatatatttttttttcctagcagggtaaaagacgatttagtcagaaaatattactagcttcctttgcataaag

SEQ ID NO: 19928 - DNA, 383 bp, Homo sapiens
  chr13.fa.O7frz.57756727
  Located on chromosome 13
  Distance between a terminus base of telomere on chromosomal short arm and 5'-terminus of this base sequence : 58444242
  Distance between 3'-terminus of neighbour sequence of sequence listing upward to telomere on chrosomal short arm and 5'-terminus of this base sequence : 112348
atcattgtactgttggcaatagttctccattaagtgtcagggtcatagacttagaaaaataatacaaaatgtcaaaaatgtgttaatattcttcatctgtagctacacaagttaattttccaagtcaattcaatttcaaatatttacaatcatggaaataaagtgactaaagcagatgacagtaactgatgaacctaaggtatggaggtgctagagagtaagtttggaaatggtagaatcttgaaactgagagtcccaagaaaagtgtgtgtgtgtgtgtgtgtgtgtgtgtgtgtgtgtgtgtgcatgtgtgtatgtatgtgtgtctgtgtctgtgtgtagtgtgttttcaatgaagccatgttaagtttgctgaaaagcag

SEQ ID NO: 19929 - DNA, 206 bp, Homo sapiens
  chr13.fa.O7frz.58031630
  Located on chromosome 13
  Distance between a terminus base of telomere on chromosomal short arm and 5'-terminus of this base sequence : 58766420
  Distance between 3'-terminus of neighbour sequence of sequence listing upward to telomere on chrosomal short arm and 5'-terminus of this base sequence : 321795
tattgcaaagaaccatgagtagaaatcaaaaactcataggatgatcggctaaaagcaggaactaggctgcttgaaaagaaataatagtaattaataataataataataataataataataaaagagctaacaccattgaatgctattctcttctggggattttttaagtgcatgacatacagtctctcactaaatcttccaaacaa

SEQ ID NO: 19930 - DNA, 372 bp, Homo sapiens
  chr13.fa.O7frz.58147183
  Located on chromosome 13
  Distance between a terminus base of telomere on chromosomal short arm and 5'-terminus of this base sequence : 58881991
  Distance between 3'-terminus of neighbour sequence of sequence listing upward to telomere on chrosomal short arm and 5'-terminus of this base sequence : 115365
agcagtatggactaatacaatcagtgatcaattttaccaaaaatttgcaacacaaaaaacatgtcattcttctaatacacacacacacacacacacacacacacacatctatatgaccatgcacatatatctatatgaacacacgtgcatatgcatatctctctgtgatgattaatcttatgtgtcaacttggctaggccattgtaccaagatagtttggcaaatactactctgatattgctgtgaaagttttctttttagaaattaaaatttaaatcattagactgactaaagataattatcctccataaaatgggtgggtctcattcaatctcttaaaagaaaagaaactaatgtcttccaacctagagg

SEQ ID NO: 19931 - DNA, 425 bp, Homo sapiens
  chr13.fa.O7frz.58252557
  Located on chromosome 13
  Distance between a terminus base of telomere on chromosomal short arm and 5'-terminus of this base sequence : 58989662
  Distance between 3'-terminus of neighbour sequence of sequence listing upward to telomere on chrosomal short arm and 5'-terminus of this base sequence : 107299
gtccttaaacttactgttgaacaaaaagagcaatccgcaacatgaaaaccaatcagtagcacacttgagtacataaacttaaaattaccaattctttaaaagattacaagaatgtaactgtctactcttttggtgcttcaaatctgtattcatttgaatctaatatctttaattttaaattcctgtctgaatgtgtctgagtctatccacgttgaagtgtgtgtgtgtgtgtgtgtgtatgtgcgtgtatgtgtatgtacgtgtgtgtgtgtgtgtgtgtgtgtgtgtgttaaagagagagagatctaaagagaggggttttattaaacaaatttcctatatagagtttgcaactacattccctctaccttcccacaaaatgtgagggattatgccagaaagaggctaaattacaggttgtattt

SEQ ID NO: 19932 - DNA, 102 bp, Homo sapiens
  DISO7_10026775
  Located on chromosome 13
  Distance between a terminus base of telomere on chromosomal short arm and 5'-terminus of this base sequence : 59131553
  Distance between 3'-terminus of neighbour sequence of sequence listing upward to telomere on chrosomal short arm and 5'-terminus of this base sequence : 141466
attagccgtattctacattgtttccattatatatatatatatatatatatatataatatatataattaaaattaatatgttaattgttgactttcctgaatt

SEQ ID NO: 19933 - DNA, 324 bp, Homo sapiens
  chr13.fa.O7frz.58626509
  Located on chromosome 13
  Distance between a terminus base of telomere on chromosomal short arm and 5'-terminus of this base sequence : 59307989
  Distance between 3'-terminus of neighbour sequence of sequence listing upward to telomere on chrosomal short arm and 5'-terminus of this base sequence : 176334
tagtttctaatctgccattcagccataaggtttttatttcacattttgtatttttcaggtctagaattttcatttggctctttcttatagtttttgtttctactttgattacattcatattttttccaagtcatatatatacatacacacatgcacacacatatacacacacatatatgtgtgtgtatgtgtgtgtgtatatatatatatactgaagtccattaattcttatttcatcatttctgtcattcatgagtttttattctattcagtgactttccttctggttataggatacaagttcttgccttatcacatatctaa

SEQ ID NO: 19934 - DNA, 139 bp, Homo sapiens
  chr13.fa.O7frz.58754473
  Located on chromosome 13
  Distance between a terminus base of telomere on chromosomal short arm and 5'-terminus of this base sequence : 59462650
  Distance between 3'-terminus of neighbour sequence of sequence listing upward to telomere on chrosomal short arm and 5'-terminus of this base sequence : 154337
gagaacagcattcactaatcacacaggtgagaaacagctgtgtgtgtgtgtgtgtgtgtatgtatttctgtgtttgaatagtaagcatctcttgattgttagggcatgaaatgtaaactctgcaatagtacagcaagag

SEQ ID NO: 19935 - DNA, 411 bp, Homo sapiens
  chr13.fa.O7frz.58539354
  Located on chromosome 13
  Distance between a terminus base of telomere on chromosomal short arm and 5'-terminus of this base sequence : 59493553
  Distance between 3'-terminus of neighbour sequence of sequence listing upward to telomere on chrosomal short arm and 5'-terminus of this base sequence : 30764
acagtttgtcaccagtcatacttgcaaaatagaaatagaaaagcacagagaatagactagatgatgtccaaggttctcccagctccgaagttttattattatattaagaaaaatatagaatagaaaataaatgtcaaataaatgtcaaaagatgaagaatggcaatctctactactttcatatatcctacatcatttgactcatatgtggagattatgtgtatatatatacacacacacacacacacacacacacacacacacacacacacatatatacatacatgaaatttaccagcactaagttttcatactgaaaaataagagaattgggttggaggaagagtgacattcttgtcttcccttcttaattatttaattttttaaaaggaatgagaacatttatcagtag

SEQ ID NO: 19936 - DNA, 229 bp, Homo sapiens
  chr13.fa.O7frz.58860582
  Located on chromosome 13
  Distance between a terminus base of telomere on chromosomal short arm and 5'-terminus of this base sequence : 59574617
  Distance between 3'-terminus of neighbour sequence of sequence listing upward to telomere on chrosomal short arm and 5'-terminus of this base sequence : 80653
gtgttaccagcttcaactcaccactccctgactcatgctgtactctgcatcgatgaaagaaagactgtaatctttcctgcacactgtgtatacacacacacacacacacacacacacacaccatatatatagtatttatatttagttatgttaaatttccaaaggtacacagacacacaccttcaataatttaatggttttgagtggttgaactttacaatcattggtc

SEQ ID NO: 19937 - DNA, 386 bp, Homo sapiens
  chr13.fa.O7frz.59276944
  Located on chromosome 13
  Distance between a terminus base of telomere on chromosomal short arm and 5'-terminus of this base sequence : 59759382
  Distance between 3'-terminus of neighbour sequence of sequence listing upward to telomere on chrosomal short arm and 5'-terminus of this base sequence : 184536
atcaatggaagattacattatgagaagggaagtaatgggatatgtttatatattcatggaaataatcaagggaggtgggagagattaagaatgttggaaaatgtatatatacatatgtatgtatgtgtatatatatgtgtgtgtgtgtgtgtgtgtgtgtgtgtgtgtgtatatatatatcagaaaagggggtgtccttgacagtcagcagagagatttcagagccccagtagagagattggcctccatagtaacgggtgggaatgtaacggtgatgggggcacaggaatttaggtttctagatttagttgtgggcagatggagttttcattctgttttctattttctgaatgaaaaatgaagtgaagtattcagctaagaatgag

SEQ ID NO: 19938 - DNA, 254 bp, Homo sapiens
  chr13.fa.O7frz.59542733
  Located on chromosome 13
  Distance between a terminus base of telomere on chromosomal short arm and 5'-terminus of this base sequence : 59895717
  Distance between 3'-terminus of neighbour sequence of sequence listing upward to telomere on chrosomal short arm and 5'-terminus of this base sequence : 135949
tagtcttattgccaaagttcaggcaagaagggaagacaatagaatgagctatgtgtcctgaaacaaaacaaaagatctctcctctctctcagtctctctctctctctctatacacacacacacacacacacacacacacacacacacacgtatatatgtgtgtgtgtgtgtgtgtacatatatatacaaacatacatacatacagggtctcattctgttgcccaggctggagtgcactggcacaatcatagctc

SEQ ID NO: 19939 - DNA, 166 bp, Homo sapiens
  HUMUT1997
  Located on chromosome 13
  Distance between a terminus base of telomere on chromosomal short arm and 5'-terminus of this base sequence : 60038069
  Distance between 3'-terminus of neighbour sequence of sequence listing upward to telomere on chrosomal short arm and 5'-terminus of this base sequence : 142098
aggaaggtaggtaggaagcaaggaaggaaggaaggaaggaaggaagggagggagggagggagggcagaaggaaggaaggaagagaaagaaaaaggaagagagagagagaaagaaaacaaaagaaaaaagagaaaagaaaggcttatggggatactaagccttatag

SEQ ID NO: 19940 - DNA, 374 bp, Homo sapiens
  chr13.fa.O7frz.59665894
  Located on chromosome 13
  Distance between a terminus base of telomere on chromosomal short arm and 5'-terminus of this base sequence : 60071773
  Distance between 3'-terminus of neighbour sequence of sequence listing upward to telomere on chrosomal short arm and 5'-terminus of this base sequence : 33538
aaggacatatctaagacctgaaactatgaaagtactagaagaaaacatttggaaattgctgcaagacattgatctgggcaaagatttttttgtgtgtaaaagacctcaaaagcacaggcaaccaaagcaaaaatagacaagtaggattatatcaagctaaaaagcttctgaagagcaaaggaaagaataaagaggcaacccatggaatgggagaaaatatttgtaaactattcatctgacaagagattaataaccagaataaacaaggagtttaaactcaatagcaaacacacacacacacacacacacacacacacacaaatattctgattttaaaatgggtaaaagacctgaataaacatttcttgaaagaa

SEQ ID NO: 19941 - DNA, 331 bp, Homo sapiens
  chr13.fa.O7frz.59757775
  Located on chromosome 13
  Distance between a terminus base of telomere on chromosomal short arm and 5'-terminus of this base sequence : 60162988
  Distance between 3'-terminus of neighbour sequence of sequence listing upward to telomere on chrosomal short arm and 5'-terminus of this base sequence : 90841
tattgctatagctttagtgcctagaccgtccttggtgcaaagtaggtgctcaataaatatgtgttgggtaaagaaattatttccatactctgtgacacaagataaactttagtttgaatactaatgacattaatttctttcttgaacgaaaccaagaaggaaagtttctaatcagaatttttagtcagtggttttccttcagagaaataatgaacttggtaggcaaattattaaaactatatatatacacatatatatatatgtatgtatacacacacacacacacacacacaaaacacatacatacataccatcttatgaatagcctgta

SEQ ID NO: 19942 - DNA, 331 bp, Homo sapiens
  AL354829.8_30378
  Located on chromosome 13
  Distance between a terminus base of telomere on chromosomal short arm and 5'-terminus of this base sequence : 60293541
  Distance between 3'-terminus of neighbour sequence of sequence listing upward to telomere on chrosomal short arm and 5'-terminus of this base sequence : 130222
gttctatttggttaccattcaaaggcaaaccagtgatcacctttaccacaagcagacaggaggaatgatgccaaagcagggaggctgttatggacgtagatgccaactgaaccagaaagagggcatatgcacagaagggtggccgaagctggcttccttcatcgaaggaagaagggagataagaagagatcatggaagggaatttcaaacacaaataacaactctctactgaaattactggaaatatgcacacacacacacacacacacacacacacacacacacacacacacagaaggagaattgactacattgttaaccatcaggtagg

SEQ ID NO: 19943 - DNA, 217 bp, Homo sapiens
  D13S176
  Located on chromosome 13
  Distance between a terminus base of telomere on chromosomal short arm and 5'-terminus of this base sequence : 60434088
  Distance between 3'-terminus of neighbour sequence of sequence listing upward to telomere on chrosomal short arm and 5'-terminus of this base sequence : 140216
atattcagacaaaagccaagttaacaatgaaatggctctttatctaggtttgttgtggatccctgtatatacatattgacttatattgactaaggcaaagtcaccttttattttctagttaaacaatacatatgtatatgtatctacagggagaatgaggcgtgtgtgtgtgtgtgtgtgtgtgtgtgtgtgtgtgtatcactaaggaatcccacag

SEQ ID NO: 19944 - DNA, 266 bp, Homo sapiens
  HUMUT7729
  Located on chromosome 13
  Distance between a terminus base of telomere on chromosomal short arm and 5'-terminus of this base sequence : 60578237
  Distance between 3'-terminus of neighbour sequence of sequence listing upward to telomere on chrosomal short arm and 5'-terminus of this base sequence : 143932
agcccaggagttcagtattacagtaagctatcatcactactgcactccagcctgggtgacagagcaagaccctatggatggacagatggatggatggatggatggatggatggatggatggatggatggatggatgaataaactatagtctgaggatgcacttttgagtgatagatagatagacagatagatagatagatagatagatagatagatagatagatagatagatagatagaaagaataaactatagtccgcagaggca

SEQ ID NO: 19945 - DNA, 458 bp, Homo sapiens
  chr13.fa.O7frz.60288395
  Located on chromosome 13
  Distance between a terminus base of telomere on chromosomal short arm and 5'-terminus of this base sequence : 60712333
  Distance between 3'-terminus of neighbour sequence of sequence listing upward to telomere on chrosomal short arm and 5'-terminus of this base sequence : 133830
gacatctcatccaagctaaatattctttgagtgaaagaattaatacacagaactttcttggatggctcggcaaaagctgtgatataaacagaagaaaggcaaagctatgggtcagcagaagtctagagtgagaaaaaggtatgaggtgaacagagagtcaggagaatctgcggtgtcaagaaaagtagaagccaagacagagagaaacactggaagcctgtggatgaagagggtgaaataatgagacacaaccatgtggtagctgaagggtgttccagttctccttgaggtgtgacttggtgagcaaagggctattatcctgaaggcctggttgttttgtttaactcctggatgtttttctgtgtgtgtgtgtgtgtgtgtgtgtgtgtgtgtgtgtgtgtgcgtttaccttacctaccttccttccttatttttaacgtaccttacaaataactcct

SEQ ID NO: 19946 - DNA, 448 bp, Homo sapiens
  chr13.fa.O7frz.60465541
  Located on chromosome 13
  Distance between a terminus base of telomere on chromosomal short arm and 5'-terminus of this base sequence : 60883323
  Distance between 3'-terminus of neighbour sequence of sequence listing upward to telomere on chrosomal short arm and 5'-terminus of this base sequence : 170532
atgttaggatggtttatggaagtggagacagggttgcgtaggtggttggagggtggataatgtgttatccaaagcttaggctcaaaccccagctctgccactgaccaactatgcatgcaaatttgggccttagtttcctgatctgcaaaatgaggactttagacacacacacacacacacacacacacacacacacacacacacctctaatagctttgttgctaggattaaatgatctaatacataaaaaggtgtggctctcattgcaggaactttccttatttaggtcatggaagagttatgcaccaagttttttcaaaaagtgctaactggataaagcgatctccacccaacacctcccttaatccctgcttacatgatactcctctacatgagctggtttgtttctaaaggtcattctcaagaagtggagcatagatgttaattg

SEQ ID NO: 19947 - DNA, 325 bp, Homo sapiens
  chr13.fa.O7frz.60540284
  Located on chromosome 13
  Distance between a terminus base of telomere on chromosomal short arm and 5'-terminus of this base sequence : 60936640
  Distance between 3'-terminus of neighbour sequence of sequence listing upward to telomere on chrosomal short arm and 5'-terminus of this base sequence : 52869
gaccagtcttaaattactgatcactatccattagtaaaaatttaaaaacaaattatatttttatttcttttaagattttgtataatataaaatgattcaccaagtagatattatcttgcatttacttaagtaaatagggattttatgtgtgtgtgtgtgtgtgtgtatttatgtgtgcatatgtatgtgtgcgtgggtaggtagatgctttgaaaattatttttaaagttttacaggctaaaagttttcctgtattattattttttgttgttcaatataacagcattcttggacccagtcatcgtcctagcaatcctgatacaat

SEQ ID NO: 19948 - DNA, 476 bp, Homo sapiens
  chr13.fa.O7frz.60772091
  Located on chromosome 13
  Distance between a terminus base of telomere on chromosomal short arm and 5'-terminus of this base sequence : 61191535
  Distance between 3'-terminus of neighbour sequence of sequence listing upward to telomere on chrosomal short arm and 5'-terminus of this base sequence : 254570
atttctagtgaggttgaacatcttttcatatatttattgattatttgagttttcccttttatgaattaccttttaatatcatgcccatatttctttctttctcccttcctttctcccttcctttcttccttcctttcttctttcccttccttcccttccttcctttccttctcttccttctcttccttctctttcttcccttccttcccttcctcccttccctcccttcccttccttcccttcctcctttcctcccttcctttcccctctctctctctcactctgaaacagggtctcactctgtcaactaggctggagtgtagtggcacgatcatagctcactgcagccttgaactcctgggctctaatgatcttcctattttagcttcccaaagtgctgggattacaggcataaatgaccgcacctggcaatgcccatgtttttctattggcttgctcattgtagatattgatct

SEQ ID NO: 19949 - DNA, 436 bp, Homo sapiens
  chr13.fa.O7frz.60891557
  Located on chromosome 13
  Distance between a terminus base of telomere on chromosomal short arm and 5'-terminus of this base sequence : 61310688
  Distance between 3'-terminus of neighbour sequence of sequence listing upward to telomere on chrosomal short arm and 5'-terminus of this base sequence : 118677
gttgatgtgaaggattgtataaactgattttcaaatcttaaactggcctgcatacctggcataaaccctgctttgtcatggtgtctgattcgtttcacacattgctggactctatttgttagtattttgttaaggatatttctgtttatattcataaggaataagagtctgtagttttctttgtactgtcttttttctggttttcatatcagggcaatactacactagtttcataaaatgaattggaaagtcttccatcttcaattttctggaagagattgtatgaattgctcccctcctcctccctcccttcctcccttccttcttcccttccttcctcccttccttcctccctcccttccgtccttctttctttccttcccttcttcctcttccttcttttttttcttctttctttcagtcaaatttagcagtg

SEQ ID NO: 19950 - DNA, 290 bp, Homo sapiens
  DISO7_10000155
  Located on chromosome 13
  Distance between a terminus base of telomere on chromosomal short arm and 5'-terminus of this base sequence : 61443442
  Distance between 3'-terminus of neighbour sequence of sequence listing upward to telomere on chrosomal short arm and 5'-terminus of this base sequence : 132318
ctaggttaggagtagtttcattgggaggcaagtgaatcatcaggagttcaagaccagcctggccaacatggtgaagatgtttagtagagatggggatctccactagaaaaaaaaattatatatatatatatatacatatatatatgctataagctgggtgtggccacatgcacgtataattccagctacttgagaaactgaggcaggagaattgcttgaactcaggaggtggaggctgcagtgagcagagtagtttccatgaacagataaagtatttccagcaactgcct

SEQ ID NO: 19951 - DNA, 198 bp, Homo sapiens
  DISO7_10000158
  Located on chromosome 13
  Distance between a terminus base of telomere on chromosomal short arm and 5'-terminus of this base sequence : 61525585
  Distance between 3'-terminus of neighbour sequence of sequence listing upward to telomere on chrosomal short arm and 5'-terminus of this base sequence : 81853
aaagattcctgcatcctatatctaccacacaaacaatcacaaacacagacacacacatatacagatacatagagacatatacatacactgacacacaaatactgaaatgtacacagactttgtatacacacacacacacacacacacacacacacacacacacacacacgtatccctagtctttgtagaatcagcttc

SEQ ID NO: 19952 - DNA, 127 bp, Homo sapiens
  DISO7_10000159
  Located on chromosome 13
  Distance between a terminus base of telomere on chromosomal short arm and 5'-terminus of this base sequence : 61621900
  Distance between 3'-terminus of neighbour sequence of sequence listing upward to telomere on chrosomal short arm and 5'-terminus of this base sequence : 96117
aacatctcacatgaaatacaacttcttaaattattgtcctattttgggatatatatatatatatatatatatatatatatatatatatatggcaaggaaaatgtaacatgaaactgtaatgatctcg

SEQ ID NO: 19953 - DNA, 189 bp, Homo sapiens
  DISO7_10000162
  Located on chromosome 13
  Distance between a terminus base of telomere on chromosomal short arm and 5'-terminus of this base sequence : 61649069
  Distance between 3'-terminus of neighbour sequence of sequence listing upward to telomere on chrosomal short arm and 5'-terminus of this base sequence : 27042
taccaccatgcaaagtgtggactgaataaacacacacacacacacacacacacacacacacaaatataagaatttgaattgttttatactataattcaaaatcaatgtgtatttttattatagatgattttagtgtttactaatagttgtttatgttatactttctcattcttaagctcatacatttgc

SEQ ID NO: 19954 - DNA, 245 bp, Homo sapiens
  DISO7_10000160
  Located on chromosome 13
  Distance between a terminus base of telomere on chromosomal short arm and 5'-terminus of this base sequence : 61676416
  Distance between 3'-terminus of neighbour sequence of sequence listing upward to telomere on chrosomal short arm and 5'-terminus of this base sequence : 27158
cgaactcatgcaatatttaattatcttctagtattatcttgaatttatttggagaaaattttcacttttacttccaaaatattattatgaacattttcagacacaaaagttgaaaaattgtaccacgaacccccatatatatatatatgggtctagtcatcactaaattttaaaggataaaggttatacacacacacacacacacacacacacacacaaacacagacatacaacaaagaataaca

SEQ ID NO: 19955 - DNA, 238 bp, Homo sapiens
  chr13.fa.O7frz.87308791
  Located on chromosome 13
  Distance between a terminus base of telomere on chromosomal short arm and 5'-terminus of this base sequence : 62048736
  Distance between 3'-terminus of neighbour sequence of sequence listing upward to telomere on chrosomal short arm and 5'-terminus of this base sequence : 372075
agaggctagaagtttaagttcaagatacatgactggtttttggtgaggcttctctttctggcatgtagatagccaccatctcattgtgcatcacatagtctgtcctctgcttttgcagagaaagagagagagagagagagagatctatctggtgtctcttcctcttcttataaggccacaaatgctatctaactagggacccaccccaatgacctcatttaaccttaactacctcact

SEQ ID NO: 19956 - DNA, 299 bp, Homo sapiens
  chr13.fa.O7frz.87198675
  Located on chromosome 13
  Distance between a terminus base of telomere on chromosomal short arm and 5'-terminus of this base sequence : 62125788
  Distance between 3'-terminus of neighbour sequence of sequence listing upward to telomere on chrosomal short arm and 5'-terminus of this base sequence : 76814
tatgttgcactatgaagttatcacagctgtgatgttcctaagtgataggaaattttcagctccattattatcttatgcagtgcatcattgaccaagatgtcattatgtggcacataacgtgtgtgtgtgtgtgtgtgtgtgtgtgtgtgtttatttacaagacatagtgtaggtcttttaatatatggtaaagactgttaagtactacactgcatcattacattaggggggtcacatagcttaagatttgttttgttacattatgatatatcactctgttcagcttaatagtgacaatc

SEQ ID NO: 19957 - DNA, 199 bp, Homo sapiens
  DISO7_10026791
  Located on chromosome 13
  Distance between a terminus base of telomere on chromosomal short arm and 5'-terminus of this base sequence : 62141468
  Distance between 3'-terminus of neighbour sequence of sequence listing upward to telomere on chrosomal short arm and 5'-terminus of this base sequence : 15381
cagtggagtaagaagtggtcagattctgaatacatatacatatacatatacatatacatatacatatacatatacatatacatatacgtattttaagccatggggctatatgagaagactaaatgagtaattatacaaagagagaagagaagagaaaaaagttctgggtcctgggcagccaaagagcatggacaacatt

SEQ ID NO: 19958 - DNA, 345 bp, Homo sapiens
  chr13.fa.O7frz.62094849
  Located on chromosome 13
  Distance between a terminus base of telomere on chromosomal short arm and 5'-terminus of this base sequence : 62314924
  Distance between 3'-terminus of neighbour sequence of sequence listing upward to telomere on chrosomal short arm and 5'-terminus of this base sequence : 173257
cagtaacgtgcaatttacctacacatgaacccctgaaagtaaactaaaataaaaataaatagatatctgggataatgaatgtgtgtgtgtgtgtgtgtgtgtgtgtgtgtgtgtgtgtgtgtgtgtctatacactcaaacaaatagaggggaagggggaaggagggagggaggggaaaagaaaggatgagagaattataaagcaaatgagtaagtttataattatgtcaaaatacataagttatcccataagttatattaataaacatcccataagttatattaataaatactttgaataatgacacaattacaagtggagatgatttcaaatggctcagattat

SEQ ID NO: 19959 - DNA, 181 bp, Homo sapiens
  AL353765.3_107566
  Located on chromosome 13
  Distance between a terminus base of telomere on chromosomal short arm and 5'-terminus of this base sequence : 62391823
  Distance between 3'-terminus of neighbour sequence of sequence listing upward to telomere on chrosomal short arm and 5'-terminus of this base sequence : 76554
taggttatcttgatctttctgcagtttattttcgtgtgtgtgtgtgtgtgtgtgtgtgtgtgtgtgtgtgtgtgtgtatgaaatattgaaatgagtatacaggaacccattttgaactatttgaactaacatagaaaacaattatactcgaggagttgtgtctgcatgtctgagtgtacaa

SEQ ID NO: 19960 - DNA, 438 bp, Homo sapiens
  chr13.fa.O7frz.62398599
  Located on chromosome 13
  Distance between a terminus base of telomere on chromosomal short arm and 5'-terminus of this base sequence : 62627530
  Distance between 3'-terminus of neighbour sequence of sequence listing upward to telomere on chrosomal short arm and 5'-terminus of this base sequence : 235526
tatcattaatttggcctagctaaaatatagtcatgagattttaaaatatttttttaaaggagctcaatgggtaaaggtcagcttaattagaagctaacattcatgatatgtgtgtgtgtgtgtgtgtgtgtgtgtgtgtgtgtgtgtgtgtattaaaaggcctttctatttttttttttctctcctaggatcttgtcttttttgagcaaattttttttcttctcagttgactgaattctgttttattcatttacttctcttgtctctcctttcttttcctaccctttgttgcatgaagggtctaaaatagtttctaatagactggggttccttaaataaattggagaaggtgccactctcccttttaggaagaaacctcttttccttatggaaccccaagagtgtaaacagacaagtccgtctcagatcataaactac

SEQ ID NO: 19961 - DNA, 206 bp, Homo sapiens
  D13S1261
  Located on chromosome 13
  Distance between a terminus base of telomere on chromosomal short arm and 5'-terminus of this base sequence : 62730373
  Distance between 3'-terminus of neighbour sequence of sequence listing upward to telomere on chrosomal short arm and 5'-terminus of this base sequence : 102405
tcatcctctgcctgttgatattagttaatgctgcagagaataataaatgcagataaatgtgatagaatgtgatgtatatgtatatgtatttgtgtttgtctgtgtgtgtgtgtgtgtgtgtgtgtgtgtgtgtgtgtgcctggtatggagcagctggatgaattttctaaacaaagttaaatgaaaagtttgaccatcagggtaaa

SEQ ID NO: 19962 - DNA, 93 bp, Homo sapiens
  D13S1313
  Located on chromosome 13
  Distance between a terminus base of telomere on chromosomal short arm and 5'-terminus of this base sequence : 62835334
  Distance between 3'-terminus of neighbour sequence of sequence listing upward to telomere on chrosomal short arm and 5'-terminus of this base sequence : 104755
ttaacatattccttatccctcatagttaccatttgtgtgtgtgtgtgtgtgtgtgtgtgtgtggtaagaacgcttaatactactgtcttagca

SEQ ID NO: 19963 - DNA, 427 bp, Homo sapiens
  chr13.fa.O7frz.62656237
  Located on chromosome 13
  Distance between a terminus base of telomere on chromosomal short arm and 5'-terminus of this base sequence : 62840106
  Distance between 3'-terminus of neighbour sequence of sequence listing upward to telomere on chrosomal short arm and 5'-terminus of this base sequence : 4679
aaaggtagaatggtgattcattggaccaaagtaaagaattattcgagcttttatttatatctgttataaatctaaagtatgaaataaattaagttgtaataatatctaatatataaattgatacatatcagaaagtgatgtatttgattagattgaaaagagaaataagaaaactgcatgaattagccaaatttatttagtgatgtgtgtgtgtgtgtgtgtgtgtgtgtgtgtgtgtgtgccttacaaactccacttaataatctccactacctgattaggaatccattgtactctgatatccagatattattgagttaacagaaaagcactaatatatttcttcttccttagacaataatgaaagagcttatagagttaaaatacacgtaagacagaaagacgctttgcatatgtaatgtcaacc

SEQ ID NO: 19964 - DNA, 205 bp, Homo sapiens
  chr13.fa.O7frz.62867816
  Located on chromosome 13
  Distance between a terminus base of telomere on chromosomal short arm and 5'-terminus of this base sequence : 63084237
  Distance between 3'-terminus of neighbour sequence of sequence listing upward to telomere on chrosomal short arm and 5'-terminus of this base sequence : 243704
atccaaatggtaggatagaaagtataacgacttaccctcaattataacagagttgatttgcaatgtaaagaaaagtgtgtgtgtgtgtgtgtgtgtgtaggagagaaacagaaagagggagacctggggagagagaacagggcatggacagtgaggaaaggtgtatggagaactgtagtctctctgtagattaatactggacagg

SEQ ID NO: 19965 - DNA, 264 bp, Homo sapiens
  D13S1259
  Located on chromosome 13
  Distance between a terminus base of telomere on chromosomal short arm and 5'-terminus of this base sequence : 63249240
  Distance between 3'-terminus of neighbour sequence of sequence listing upward to telomere on chrosomal short arm and 5'-terminus of this base sequence : 164798
caataataaaaacattgagatatgggaaaacattaatttgttttatacacacacacacacacacacacacacccctaaaatatttaaaaaataaaaaaggaaaagaaatgattaactttttctctgcttataacaacttataagtggttatgatttttctttatttctacttaatcttttctttctgttatataaacatcaattggtcagtatttaagaactaatagttactaagccttctttcttcagatgtatgactctcgt

SEQ ID NO: 19966 - DNA, 441 bp, Homo sapiens
  chr13.fa.O7frz.63193612
  Located on chromosome 13
  Distance between a terminus base of telomere on chromosomal short arm and 5'-terminus of this base sequence : 63291474
  Distance between 3'-terminus of neighbour sequence of sequence listing upward to telomere on chrosomal short arm and 5'-terminus of this base sequence : 41970
aaggtttcacttactaatccaatcacattgggggtttcaattttgacatataaattttggggaggatacaagcattcagtccataacattatatatatatatatatatatatatatatatatatatatatatatatatatggctggggcagtgataaagtgttccatattatatatatatatgttatatatgtttcttatatatgttatatgttatatatgtttcatatatatgttatatattatatgtttcatatatatgttatatattatatatgtttgatatatgtcatatattatgtatgtttcatatatgttatatattatatatgtttcatatgtatatatgaaaattaagcagataaaattccattttccatccttccaagaagaaggggtgagtcttctattaaggatctacttgctaaacttaaaagcctgt

SEQ ID NO: 19967 - DNA, 272 bp, Homo sapiens
  chr13.fa.O7frz.63300169
  Located on chromosome 13
  Distance between a terminus base of telomere on chromosomal short arm and 5'-terminus of this base sequence : 63430523
  Distance between 3'-terminus of neighbour sequence of sequence listing upward to telomere on chrosomal short arm and 5'-terminus of this base sequence : 138608
ctttcattgtagtactgtttggactttattctttattttaagaagccaatggatatccccgttttttaatattgcctatgataaatatgttctgtaaaatacaataatatatctaaaatttcaggagtctaatggcagatagatagatagatagatagatagatagatagatagatagacagatatagatatatatacctagcaacagattaattactgggagttttcttcactacagaagtagcccactcattctcaagataaagatgttg

SEQ ID NO: 19968 - DNA, 117 bp, Homo sapiens
  D13S1273
  Located on chromosome 13
  Distance between a terminus base of telomere on chromosomal short arm and 5'-terminus of this base sequence : 63668315
  Distance between 3'-terminus of neighbour sequence of sequence listing upward to telomere on chrosomal short arm and 5'-terminus of this base sequence : 237520
ccaccatgtactgggaaccatatgtgtgtgtgtgtgtgtgtgtgtgtgtgtgtgtatgtattttttttttacaaattaggaagtaaaatttggaggactgatgagttatccaagtca

SEQ ID NO: 19969 - DNA, 262 bp, Homo sapiens
  D13S1320
  Located on chromosome 13
  Distance between a terminus base of telomere on chromosomal short arm and 5'-terminus of this base sequence : 63724255
  Distance between 3'-terminus of neighbour sequence of sequence listing upward to telomere on chrosomal short arm and 5'-terminus of this base sequence : 55823
tgaagtaactctgaacactcaatacttgagtgtgtgtgtgtgtgtgtgtgtgtgtgtgtgtgtattcataggcttttatttcacttgggtaaaaacctagaagtgtaattgtgggcatacatggtaatatagtaatgcatgtttataagaaacttctcaactgtgttctagatttgctgtaccatttcccattttcactaacaatgtataagattccctgttaccctgtatcctcaccagtaattggcattacctgtttttc

SEQ ID NO: 19970 - DNA, 177 bp, Homo sapiens
  Z17162.1_220
  Located on chromosome 13
  Distance between a terminus base of telomere on chromosomal short arm and 5'-terminus of this base sequence : 63743798
  Distance between 3'-terminus of neighbour sequence of sequence listing upward to telomere on chrosomal short arm and 5'-terminus of this base sequence : 19281
aggagttccttaaactggtttaaggccatatatttctataataaacaatgtcccaaaggctttgcccatcacttttcagtccaggtcccctgaaaagcaaatgccaagatgtggtgagatgcacacacacacacacacacacacacacacacaatgtatgaggtgaactgcctttaa

SEQ ID NO: 19971 - DNA, 135 bp, Homo sapiens
  D13S172
  Located on chromosome 13
  Distance between a terminus base of telomere on chromosomal short arm and 5'-terminus of this base sequence : 63743872
  Distance between 3'-terminus of neighbour sequence of sequence listing upward to telomere on chrosomal short arm and 5'-terminus of this base sequence : -103
ttcagtccaggtcccctgaaaagcaaatgccaagatgtggtgagatgcacacacacacacacacacacacacacacacaatgtatgaggtgaactgcctttaagaaaaagtaaagagagacgcaggagtggctag

SEQ ID NO: 19972 - DNA, 404 bp, Homo sapiens
  chr13.fa.O7frz.63721677
  Located on chromosome 13
  Distance between a terminus base of telomere on chromosomal short arm and 5'-terminus of this base sequence : 63878021
  Distance between 3'-terminus of neighbour sequence of sequence listing upward to telomere on chrosomal short arm and 5'-terminus of this base sequence : 134014
gatttgcattatcgttagacataccatctatgccaggtgttacatgttctctgcatctgccctgaaattcatttaaaagcttataaatctttatgaccatatgatgtatttctatgatcggtgggatccttaaaaagcttctgaaatatatattataaaattaagttgttttttatttaacttttttatacaacgcagtacctatgggattaattttaattcttttacttttcattatgttcaattttattttgaagtactactgctatatatatatatatatataaactaatacatatatggagattataatattttaatatgcaatatgatgtagagatttgcaatccaatccctggaaaggaaatcacttcatattttctagacctgtttcctaatctaca

SEQ ID NO: 19973 - DNA, 247 bp, Homo sapiens
  chr13.fa.O7frz.63846046
  Located on chromosome 13
  Distance between a terminus base of telomere on chromosomal short arm and 5'-terminus of this base sequence : 63977581
  Distance between 3'-terminus of neighbour sequence of sequence listing upward to telomere on chrosomal short arm and 5'-terminus of this base sequence : 99156
ataaatagtttacagcatgcgaaaactgtctcaaactattcaatttgcttcattctttaaagtttgtttggttttgtctacaaagtagtttataattctgttaagggattacaatgtgatttaaaaataattcatttacttatagggctattgactcaattctagtaatatttcctttgtatatatatatatatatatatatatatatatatatatagcaattcagttcaaccactctttagacctt

SEQ ID NO: 19974 - DNA, 408 bp, Homo sapiens
  chr13.fa.O7frz.63953939
  Located on chromosome 13
  Distance between a terminus base of telomere on chromosomal short arm and 5'-terminus of this base sequence : 64085579
  Distance between 3'-terminus of neighbour sequence of sequence listing upward to telomere on chrosomal short arm and 5'-terminus of this base sequence : 107751
accttagtactgtacagcagacacgcaaaagaaaaaaaaaggatatttatataagatagatgcaattcctttatgtttgatgaaataagcgctccaaggctattgttgtttaagtgcctatttaccctttgtattttcaacaaacattgatgatttcacaagccctggccctgattctcatcacacacacacacacacacacacacgcacacgcacatacacacacaccccctaataactacatacaaagtgttttggcatttttttctcaaaacattattaacatccagaatcaaaagtttagttgctgatgtaactataaatttgcatcttaatatagttttgttttttgtgggttctatattatttgtgagataaattgaaatggagtcatagactattttgcta

SEQ ID NO: 19975 - DNA, 379 bp, Homo sapiens
  chr13.fa.O7frz.64064147
  Located on chromosome 13
  Distance between a terminus base of telomere on chromosomal short arm and 5'-terminus of this base sequence : 64189020
  Distance between 3'-terminus of neighbour sequence of sequence listing upward to telomere on chrosomal short arm and 5'-terminus of this base sequence : 103033
agcagtttccaataaaggataccaatttgaataataaaaaagctattactgtaaattcattctactccttgagctaaagaaataggcatctcttaagtgtctgctgggtagacacttcatgtacagaatggccaatgcagttttttattcaaatcactaagaagcattggtatacatactttttgtattaatctgggttttccagggaaacagaatagaagaagaagaataaatgatagatagatagatagatagatagatagatagatagatagatagaactggctcacagcattatggaggctgagatatctcaagaattgcagccagcaagctgaagatccagaaaagctgatgggacagttccagtttgagtctg

SEQ ID NO: 19976 - DNA, 104 bp, Homo sapiens
  DISO7_10003769
  Located on chromosome 13
  Distance between a terminus base of telomere on chromosomal short arm and 5'-terminus of this base sequence : 64312696
  Distance between 3'-terminus of neighbour sequence of sequence listing upward to telomere on chrosomal short arm and 5'-terminus of this base sequence : 123297
aagagaattcaataattctctttgcgtgtgtgtgtgtgtctgtgtgtgtgtgtgtgtgtgtgtgtgtatacacacatgcacaggggccaagactggactgcgta

SEQ ID NO: 19977 - DNA, 105 bp, Homo sapiens
  DISO7_10003770
  Located on chromosome 13
  Distance between a terminus base of telomere on chromosomal short arm and 5'-terminus of this base sequence : 64429144
  Distance between 3'-terminus of neighbour sequence of sequence listing upward to telomere on chrosomal short arm and 5'-terminus of this base sequence : 116344
ccaccatgacactcctccttttggaactctctgtgtgtgtgtgtgtgtgtgtgtgtgtgtgtgtgtgtgtgtgtgtgtgttagattctgttatttggtaccacaa

SEQ ID NO: 19978 - DNA, 313 bp, Homo sapiens
  AL354736.10_39669
  Located on chromosome 13
  Distance between a terminus base of telomere on chromosomal short arm and 5'-terminus of this base sequence : 64541699
  Distance between 3'-terminus of neighbour sequence of sequence listing upward to telomere on chrosomal short arm and 5'-terminus of this base sequence : 112450
ataaatatgtccatcactttccacagtttcgtgtgtgtgtgtgtgtgtgtgtgtgtgtgtgtgtgtgtgtgtgtgtgtattaagagcaccaaaacttactctctcggcacattttctatatacaatacaacataattaactatagttctcctgccatacataagatctccagattatttatcttatgtaattgtaagtttgcaccctttgaactacttcttcctatttccctcccctccccaccctggtagccgccattctactttgtttttatatagtcaatttttttctttagattccatatgcaagtgag

SEQ ID NO: 19979 - DNA, 374 bp, Homo sapiens
  AL354736.10_89337
  Located on chromosome 13
  Distance between a terminus base of telomere on chromosomal short arm and 5'-terminus of this base sequence : 64591126
  Distance between 3'-terminus of neighbour sequence of sequence listing upward to telomere on chrosomal short arm and 5'-terminus of this base sequence : 49114
ttgaggtcaggagttcgagaccagcctggccaacagggtgaaaccccatttctactaaaaatacgaaaattagccaagcttggtggtgggcacctgtaatcccagctactgaggaagctgaggcaggagaatcgcttgaacccaggaggtggaggttgcagtgagccgagatcatgccactgcactccagcctgggcaacagagtgatactccatctcaaaaaaataaaacaaaacaaaaaacaacaactatctatgtgtgtgtgtgtgtctgtgtgtgtgtgtgtgtgtgtgtgtgtgtatatatatatatatatatatatacatacatacacaaaggcttttaaagtcctattgtcgacaaatatttcacct

SEQ ID NO: 19980 - DNA, 406 bp, Homo sapiens
  AL354736.10_104388
  Located on chromosome 13
  Distance between a terminus base of telomere on chromosomal short arm and 5'-terminus of this base sequence : 64606254
  Distance between 3'-terminus of neighbour sequence of sequence listing upward to telomere on chrosomal short arm and 5'-terminus of this base sequence : 14754
gaatgacattcaattttcagaaacttttaaataaaaatagtactctagtgaaccaaaaatacttatttacattcaggaaaatggaactctttattcttctgaacttcagttttccttatgtatttttattttaaatttaccactagagtttggagagggaatgaaacacaagaaagctacacacagacacacagacacacacacacacacacacacacacacacacacacatttccttcaaacatagatatacaatcaattcaaataacacatttctgaatgtgattgaatatgtctctcaatatattgtctgtgttagtcttttattttcttattttctgagttgtcccaggatacctatgttcgtaaaaacaatatgccatggtcttggctgcacttaatgtac

SEQ ID NO: 19981 - DNA, 164 bp, Homo sapiens
  AL354736.10_151143
  Located on chromosome 13
  Distance between a terminus base of telomere on chromosomal short arm and 5'-terminus of this base sequence : 64653110
  Distance between 3'-terminus of neighbour sequence of sequence listing upward to telomere on chrosomal short arm and 5'-terminus of this base sequence : 46450
atttcagaatgatttcatctgaagattcttgtcttaattacatctgaaaagatgtagttttcaaaatgaagtaggtttcctgtgtgtgtgtgagtgtgtgtgtgtgtgtgtgtgtgtgtccaaacaaggtcttatttcccaggttctggtgattaggactcaaa

SEQ ID NO: 19982 - DNA, 453 bp, Homo sapiens
  chr13.fa.O7frz.64695289
  Located on chromosome 13
  Distance between a terminus base of telomere on chromosomal short arm and 5'-terminus of this base sequence : 64795192
  Distance between 3'-terminus of neighbour sequence of sequence listing upward to telomere on chrosomal short arm and 5'-terminus of this base sequence : 141918
aagcagactagctctaaatgactaaaagtatgcttatttgggctatatttaaagcaattgtatgtgtattttgtttagtgtctgtggacttttgagctaacaggcccagcctgctgtaaagaagttaacagcatagagatcaatatacagggactatctttaacctatttataatacacacacacacacacacacacacacacacaaatataagcaaaaatcaattgagcattaaattagggaaccaatttgatttataatagcatcaagtaaaataaaatacaagggaatatatttaaccaaaccagcctgtaagctgaaaagtacaaaatattcctgagagagatttaataagatgtgaataattgagataattccatatccataaatgggaagactcaatgttgcacacatgctaattctccacaaattgacctatcaatttaataccag

SEQ ID NO: 19983 - DNA, 287 bp, Homo sapiens
  chr13.fa.O7frz.64809799
  Located on chromosome 13
  Distance between a terminus base of telomere on chromosomal short arm and 5'-terminus of this base sequence : 64910340
  Distance between 3'-terminus of neighbour sequence of sequence listing upward to telomere on chrosomal short arm and 5'-terminus of this base sequence : 114695
tatcacgtaggcaaagtgttaatatattcaatttctgtgaatatactttaacgattttgatttgagtaaaaagcaaaagttatatatataaaaaatatatatatatacacacacacacatatatatatgtgtgtgtatatatatatatatatatatatatatatatatatatatatttttttttttttttgctgggggaacagagtctcatgttgttacccatgctgaagtgcagtggtataatcatagctcactgcagccaggaattcataagctggagtaattct

SEQ ID NO: 19984 - DNA, 273 bp, Homo sapiens
  Z67282
  Located on chromosome 13
  Distance between a terminus base of telomere on chromosomal short arm and 5'-terminus of this base sequence : 65042937
  Distance between 3'-terminus of neighbour sequence of sequence listing upward to telomere on chrosomal short arm and 5'-terminus of this base sequence : 132310
ccctttatactctagcaatgttgtccttggccatctctctttacaatcacaaaatgactattacagtttttcctagtacataaaaacacaagaacatccaccatatatatgtgtgtattcattctcactgtgtgcgtgtgtgtgtgtgtgtgtgtgtgtgtgtggtgtggggagttgtatcttattatgtgtttcttttcaaccctttttcattccctaaaagttgctcagcaaactccccctcctccccctcacaccttattaactacagct

SEQ ID NO: 19985 - DNA, 145 bp, Homo sapiens
  D13S1260
  Located on chromosome 13
  Distance between a terminus base of telomere on chromosomal short arm and 5'-terminus of this base sequence : 65075683
  Distance between 3'-terminus of neighbour sequence of sequence listing upward to telomere on chrosomal short arm and 5'-terminus of this base sequence : 32473
aaaatacatggtgctgcttctccaattgcatatgtgtgtgtgtgtgtgtgtgtgtgtgtgtgtttgcttgtgtatgtatgtatttaaagttaacaaagagtagaagtacaggtgatgtattgaaataacggcttgaatgactcac

SEQ ID NO: 19986 - DNA, 401 bp, Homo sapiens
  chr13.fa.O7frz.65333802
  Located on chromosome 13
  Distance between a terminus base of telomere on chromosomal short arm and 5'-terminus of this base sequence : 65174673
  Distance between 3'-terminus of neighbour sequence of sequence listing upward to telomere on chrosomal short arm and 5'-terminus of this base sequence : 98845
ttttcctagactaacaatgttcagcattgtgtgtgtgtgtgtgtgtgtatgtgtgtgtgtgagagagagagagagaaagagagtgagatagggtgtcagcctgtgcaatggcatcatcttagctcactgcaacctctacttcccaggctcagattatcctcccacctcagtctgctgagaagctggggactataagtgcacgctaccatgcccagctaatttttgtagagatgggttcaaccatgttgcccaggctggtcttgaactcctgagctcaagcgatccaccctccttagccttccaaagtgctgggattacaggcatgagccactgtgcctggccaacatcttttcatgggattatgggccatttgtatatgctgtttaaagaaatgtctatta

SEQ ID NO: 19987 - DNA, 394 bp, Homo sapiens
  chr13.fa.O7frz.65038411
  Located on chromosome 13
  Distance between a terminus base of telomere on chromosomal short arm and 5'-terminus of this base sequence : 65276578
  Distance between 3'-terminus of neighbour sequence of sequence listing upward to telomere on chrosomal short arm and 5'-terminus of this base sequence : 101504
agtggcctgatcatacctcacaaaaaccataaattcctgggctcaagggatactcctgcctcagcttaccaagttgctgggactacaggagcacaaaaccatgcctgattattattattattattattattattattattattattattttatctttgtggagccagtgtctctctctgtttcccaggctggtctcaaattcctggcctcaagcaatactcctgcctcagcctcccaaagtgttgggattacaggcatgagccaccacacctggcctgagcacacttttcctatttgcttgggaaatacctgggagttggtttactgggttatattgtaagtttttgttttaacttcaaaataaactgaaaaatacatttgcaaagtggctata

SEQ ID NO: 19988 - DNA, 466 bp, Homo sapiens
  chr13.fa.O7frz.65191576
  Located on chromosome 13
  Distance between a terminus base of telomere on chromosomal short arm and 5'-terminus of this base sequence : 65375555
  Distance between 3'-terminus of neighbour sequence of sequence listing upward to telomere on chrosomal short arm and 5'-terminus of this base sequence : 98583
gtcagttatttctgaaagtttcaccgatctgtctgcgtgagtctctccattaaagtcacagaaacaggcagcttgagtagacactttatccacacttaagccctactcttgagcctctttttgtgacaataaagtgattttgctttcatggccaaatctggttttgtccatgtatgctttatatatatgtagattgatgattagatagatgacagatagatagatagatagatagatagatagatagatagatagatgatagatagataaaatctgtcatttattgcccagttgatggcaatgaagatagtaagctgattttaatcatctgaccatccggtctctgtcaggaggactaggagagggaacaaattttccgtaatgagccaatcaattcagaatctagttttctttatagttttatcaattttgtttgtctttcctgttctgagaattgagttaccta

SEQ ID NO: 19989 - DNA, 430 bp, Homo sapiens
  chr13.fa.O7frz.65554761
  Located on chromosome 13
  Distance between a terminus base of telomere on chromosomal short arm and 5'-terminus of this base sequence : 65681306
  Distance between 3'-terminus of neighbour sequence of sequence listing upward to telomere on chrosomal short arm and 5'-terminus of this base sequence : 305285
gaagctgactgtggatatcacaatcatatagaaatttctaactctctctctctctctctctctctctctatatatatatatatacacacacacacacacacacacacatatacatacatatattgctttttgctcttagaatatttcagttgttaaatttgaatcccaaaatctatctttacttaaatgtaatttgttaaaagaatatattgaaatataatatatatatatatggggagagagtgagagagagatagagtaagagagagaattttctcacccaaccagccacatgcttgaaaatgactaaaatggtgacttccggaagttgatttggccatgttcttacctgtagacattctatctaaatttcaaggttcatttaaaatgttgctaatgccaggatatcttcactgattgacagaattgt

SEQ ID NO: 19990 - DNA, 423 bp, Homo sapiens
  chr13.fa.O7frz.65639612
  Located on chromosome 13
  Distance between a terminus base of telomere on chromosomal short arm and 5'-terminus of this base sequence : 65785310
  Distance between 3'-terminus of neighbour sequence of sequence listing upward to telomere on chrosomal short arm and 5'-terminus of this base sequence : 103574
gatttatgtgagcaaactttgtacactggacctgcctgagggcagtgtcaaggagtgacaagtggttgcctgggacactttgtgcctacaaggtccatgtaggtgtcaatcatggaatatttcctagaagagtggaagaaggaactccggcccctgttgactatttttttggcattcttctgtagtagataaaattctgttctttttcacagtcatctgtaagtgaaagatcaaagtgagcatagatctcagttaatcgggtaataattaaaaagtagtaattagatgggatgatggttatctatctatctatctatctgtctgtctatctgtgacgtgggaaatgaagaggctaatgcatcttttcttatgaggggtcttggtttatctggaaagaaaatctttcctcataaggagaaacac

SEQ ID NO: 19991 - DNA, 413 bp, Homo sapiens
  chr13.fa.O7frz.65758268
  Located on chromosome 13
  Distance between a terminus base of telomere on chromosomal short arm and 5'-terminus of this base sequence : 65904078
  Distance between 3'-terminus of neighbour sequence of sequence listing upward to telomere on chrosomal short arm and 5'-terminus of this base sequence : 118345
ctatgattgcctcatcgtatagttacataagattccccaggccacgcagggagtagtatccagtagagtatgtattggaatccttgtgttgagtagataaaagtgagaattcaaggataccaaggtggctagagattttcgaacagattacggaggagagcatgctgatgagtaaactatctgaaagtgtgtgtgtgtgagtgtgtgtgtgtgtgtgtgtgtgtgtgtgtgtgttgggaggtgagcagtggtggggagaaggattatcatttgaaaggattggagaaaagtatccagttatcacacagattcaggatagtgcctgtccctaacagtcagattaaagaaactcataatttatggaaaattggtagaatagtcaggagtttcttaattctaagtgcacaatgatt

SEQ ID NO: 19992 - DNA, 241 bp, Homo sapiens
  chr13.fa.O7frz.65939465
  Located on chromosome 13
  Distance between a terminus base of telomere on chromosomal short arm and 5'-terminus of this base sequence : 66092105
  Distance between 3'-terminus of neighbour sequence of sequence listing upward to telomere on chrosomal short arm and 5'-terminus of this base sequence : 187614
atagcggccaaagttaaaccaaggtgggagacaagcaggaagaaacaaataaaggtaaacatttttaaaaggatatacatatatatatatatatatatatatatatataacttaatagatcgcctgaatgcatttgttacctcatgacaataagtgtcaggacatatatatgcaggagtaaataaattgagtgaaagaatgcattatataataatttctaaatggagttcttcattgacta

SEQ ID NO: 19993 - DNA, 300 bp, Homo sapiens
  DISD22_0009088
  Located on chromosome 13
  Distance between a terminus base of telomere on chromosomal short arm and 5'-terminus of this base sequence : 66222614
  Distance between 3'-terminus of neighbour sequence of sequence listing upward to telomere on chrosomal short arm and 5'-terminus of this base sequence : 130268
aagcaaatagcacgtggagtaaaaatgcttataaatataagaaacgtataacgaattttactattttaagtaatacaataacgatttattttataattctatgaatttgggtgctgaatttgggtaaaaaacagaacctaagtttttttttcaaaatgaataattgagttacttgtacattaaacatacatatgtacataatacaataaaatatctgttttgaaaatatgaacatttcagttactctatgtgtgtgtgtgtgtgtgtgtgtgtgtgtgtactgttcaggtaatgaaggcc

SEQ ID NO: 19994 - DNA, 253 bp, Homo sapiens
  chr13.fa.O7frz.66516247
  Located on chromosome 13
  Distance between a terminus base of telomere on chromosomal short arm and 5'-terminus of this base sequence : 66356757
  Distance between 3'-terminus of neighbour sequence of sequence listing upward to telomere on chrosomal short arm and 5'-terminus of this base sequence : 133843
agccataaattctaagttctgagactagatagatagatagatagatagatagacagatagatagatagtttgatagattgtattaattatctccagagcaactgggatacaggcatgcaattatattgacatatatgtttatatatatatattatttatatatatattatttatatatatatatatatatatatagagagagagagagagagagagagagagtagtcccaccttatccatgcaagatgtattc

SEQ ID NO: 19995 - DNA, 290 bp, Homo sapiens
  chr13.fa.O7frz.66265305
  Located on chromosome 13
  Distance between a terminus base of telomere on chromosomal short arm and 5'-terminus of this base sequence : 66483521
  Distance between 3'-terminus of neighbour sequence of sequence listing upward to telomere on chrosomal short arm and 5'-terminus of this base sequence : 126511
tctccatgtctatgatagcaactttttaagtgtgatatttgtctttctgtgcctggcttatttcacctaacataacataacacaacataacacaacacaacacaacacaacaacataacacaacataacacaacataacacaacataacacaacataacacaacataacataacataacataacataacataacataacataacataacataacataacataacataacaacgtactctccgggctcattgatattgcagcaaataatgtccattaggttaatccatgtt

SEQ ID NO: 19996 - DNA, 275 bp, Homo sapiens
  DISO7_10003773
  Located on chromosome 13
  Distance between a terminus base of telomere on chromosomal short arm and 5'-terminus of this base sequence : 66593545
  Distance between 3'-terminus of neighbour sequence of sequence listing upward to telomere on chrosomal short arm and 5'-terminus of this base sequence : 109734
tacattgcctccagaccctacctgggtgcacatttgaattatctgggaactttaaaatattctgctgccttgaccaattaaatcagattctgagtggcggcccaagcatctgtctcttttcaaagttttccccaggggtaggcttacttcacccctcaaatgtatatgatctatatatgtacacacacacacacacacacacacacacacacacactttcttatttgtattgtcaaaaacatgaaaatgtgtaggaataagtcatatgggtatga

SEQ ID NO: 19997 - DNA, 142 bp, Homo sapiens
  DISO7_10003776
  Located on chromosome 13
  Distance between a terminus base of telomere on chromosomal short arm and 5'-terminus of this base sequence : 66788459
  Distance between 3'-terminus of neighbour sequence of sequence listing upward to telomere on chrosomal short arm and 5'-terminus of this base sequence : 194639
tggagaactcactcaatttcctatattattacttatacatacagctacacacacacacacacacacacacacatgcacacacactgatattcttatatcctatatcagaaaaaaattatttcatataatgccagttagccaa

SEQ ID NO: 19998 - DNA, 105 bp, Homo sapiens
  DISO7_10003777
  Located on chromosome 13
  Distance between a terminus base of telomere on chromosomal short arm and 5'-terminus of this base sequence : 66853218
  Distance between 3'-terminus of neighbour sequence of sequence listing upward to telomere on chrosomal short arm and 5'-terminus of this base sequence : 64617
actacgggccacaatagcatcttggaaaaggtgtgtgtgtgtgtgtgtgtgtgtgtgtgtgtgtgtgaaggagtacaaaaatggggctaagatgctagagaattc

SEQ ID NO: 19999 - DNA, 244 bp, Homo sapiens
  DISO7_10003778
  Located on chromosome 13
  Distance between a terminus base of telomere on chromosomal short arm and 5'-terminus of this base sequence : 66977776
  Distance between 3'-terminus of neighbour sequence of sequence listing upward to telomere on chrosomal short arm and 5'-terminus of this base sequence : 124453
tacagaatcaggtggcccaaaataaatctaatgtacaatttgtggtaaaaatatgcttcaatcattctctctctctctctttgccatatatgcatatatatatatatatatatatgtttgtgcatacatacacacaatcacacatagaaacatatatatgttttgttttgttttttaaatttaaatggtaactgctgttataggaaaacaatatattaatatacacactcatagccatctcaaa

SEQ ID NO: 20000 - DNA, 219 bp, Homo sapiens
  D13S1317
  Located on chromosome 13
  Distance between a terminus base of telomere on chromosomal short arm and 5'-terminus of this base sequence : 67077299
  Distance between 3'-terminus of neighbour sequence of sequence listing upward to telomere on chrosomal short arm and 5'-terminus of this base sequence : 99279
attttgccacctagaacggaacagattttggccaaggaaatggtgtgtgtgttgggtgagggcaggagatattgtgtgtgtgtgtgtgtgtgtgtgtgtgtgtgtatgagagagagagactgtgctcagtgaatatgtagtgaggaactacagtactgtgatcagcgaggaatgtaaatatcccatattagagcgttaagtgacttgttggtttccaag

SEQ ID NO: 20001 - DNA, 414 bp, Homo sapiens
  AL136999.26_92781
  Located on chromosome 13
  Distance between a terminus base of telomere on chromosomal short arm and 5'-terminus of this base sequence : 67299423
  Distance between 3'-terminus of neighbour sequence of sequence listing upward to telomere on chrosomal short arm and 5'-terminus of this base sequence : 221905
tcattctctacttcaaagcttcactctctctcccaacaaaagagatgattacccctcattataaaccacatgtaaatttcaatattgcaacattttagattattctttaagatcatctctgcaaagcctaattacatatatatatataaattgtgtttgtgtatatatatataaagtgtgtgtgtgtgtatatatatatatatatatatatatataatgtacacacacatccagttgactcttgaacaacacaggtttgaattgcatgggtcaaatagacatatcttcttacctctccaccacctctagtatagtaagaccaacccctcttacttttattcctcttcagcttactcaacatgaagacaatgaagataaacatctttaagtctattaaatctacatgaggcaagc

SEQ ID NO: 20002 - DNA, 443 bp, Homo sapiens
  chr13.fa.O7frz.67305384
  Located on chromosome 13
  Distance between a terminus base of telomere on chromosomal short arm and 5'-terminus of this base sequence : 67460781
  Distance between 3'-terminus of neighbour sequence of sequence listing upward to telomere on chrosomal short arm and 5'-terminus of this base sequence : 160944
atcaaatcctctgttaaattgttaaaatgtttcagacttaaaagtctattaattttttttctccatcagagtttttgaggtaaggaggcagataatatattgtgtgtacaaaagcagcagtgtgtgtgtgtgtgtgtgtgtgtgtgtgagagagagagagagagagagacagagagatatgtagaagggggagggaggaggagataatgagaagttatcagaattttggtatctttaggggaattgacacttcataaatacatgaaataaaaaaataacttcaggccactaactaacatctattgtaccacctacagggtcagtatcaacatctcccctaaaggagctagacttgattataaaactttttcaaatatgatgccagcggcattcaaacagcaagatgactttgataattcaagtagcataattcaaacacatgg

SEQ ID NO: 20003 - DNA, 134 bp, Homo sapiens
  D13S1268
  Located on chromosome 13
  Distance between a terminus base of telomere on chromosomal short arm and 5'-terminus of this base sequence : 67525333
  Distance between 3'-terminus of neighbour sequence of sequence listing upward to telomere on chrosomal short arm and 5'-terminus of this base sequence : 64109
tgtaaacaagtaagaatcccaaaggataatttttacttaataaacttctaagaaaggtgaggtcactttaaaatatatgtgtgtgtgtgtgtgtgtgtgtgtgtgtgtgtgacggagtcttgctctgttgccca

SEQ ID NO: 20004 - DNA, 209 bp, Homo sapiens
  AL160254.6_103864
  Located on chromosome 13
  Distance between a terminus base of telomere on chromosomal short arm and 5'-terminus of this base sequence : 67706062
  Distance between 3'-terminus of neighbour sequence of sequence listing upward to telomere on chrosomal short arm and 5'-terminus of this base sequence : 180595
atttctgaagagttgaagactttctactgtttcccaagcctatgtatgtttatagtgtgtgaattaaaagcaagccttttaaattcagctgcatgtaatgctcatgcattaaataataataataataataataataataaagggtctgaattgatatcctgaaaaaggctgatacatccagaaaagtcacttagatctgcattattgtt

SEQ ID NO: 20005 - DNA, 192 bp, Homo sapiens
  chr13.fa.O7frz.67744372
  Located on chromosome 13
  Distance between a terminus base of telomere on chromosomal short arm and 5'-terminus of this base sequence : 67838298
  Distance between 3'-terminus of neighbour sequence of sequence listing upward to telomere on chrosomal short arm and 5'-terminus of this base sequence : 132027
tttgaacaaatggagtgataacatcataatcagcaccttagtcctgctctcccttctcttcataagcgtatgaaaattactagagcagtgaggaccagggccctgcctagcatgtgtgtgtgtgtgtgtgtgtgtgtgtgtgcatgagcgtttgtgcgtgtgttttcaactcctaaatagttagcattacca

SEQ ID NO: 20006 - DNA, 175 bp, Homo sapiens
  DISO7_10003784
  Located on chromosome 13
  Distance between a terminus base of telomere on chromosomal short arm and 5'-terminus of this base sequence : 68010438
  Distance between 3'-terminus of neighbour sequence of sequence listing upward to telomere on chrosomal short arm and 5'-terminus of this base sequence : 171948
tatatggaactacaatccaccccgccccctaccacctctctctctcttttgctctctctctctctctctctctatatatatataaatttatatatatatcaattttttatctatatcaattttatatgtatcaattatatatatatatatatatgctgaattagtcatgcatgtg

SEQ ID NO: 20007 - DNA, 335 bp, Homo sapiens
  chr13.fa.O7frz.68156749
  Located on chromosome 13
  Distance between a terminus base of telomere on chromosomal short arm and 5'-terminus of this base sequence : 68235244
  Distance between 3'-terminus of neighbour sequence of sequence listing upward to telomere on chrosomal short arm and 5'-terminus of this base sequence : 224631
actcagtaatggtagtttagcaagatgtagaagaaaagatgcatttattttctgtcactatagtgacttatagcacctattactcctgataggaagtcttatgtcagattataatcttttcacttttgtactttttaatatttttccattttccttaattttttaataatttattttttctaagcatttttcaaaaattgtatatatttaaagtatgcaatgtaatttttctattttatatatatatatatatatatatatatatatatatatatatatatatatatatagtcatccctcagtctctgcaggcgatttgttctaggacctcatgt

SEQ ID NO: 20008 - DNA, 182 bp, Homo sapiens
  chr13.fa.O7frz.68235769
  Located on chromosome 13
  Distance between a terminus base of telomere on chromosomal short arm and 5'-terminus of this base sequence : 68297340
  Distance between 3'-terminus of neighbour sequence of sequence listing upward to telomere on chrosomal short arm and 5'-terminus of this base sequence : 61761
attcatgtcacaagatgctaagtaatataaaattatatttattaatataaatatatactgtatatgtaaaatgtatcttatttatatgtatcctgtgtgtgtgtgtgtgtgtgtgtgtgtgtgtatctcccaagacaaagaacgttgcatttatcttcgtgtaaagttgtaaccattgcaaa

SEQ ID NO: 20009 - DNA, 283 bp, Homo sapiens
  chr13.fa.O7frz.68312758
  Located on chromosome 13
  Distance between a terminus base of telomere on chromosomal short arm and 5'-terminus of this base sequence : 68373736
  Distance between 3'-terminus of neighbour sequence of sequence listing upward to telomere on chrosomal short arm and 5'-terminus of this base sequence : 76214
gtatctgagcattatgaaccttacctcgttctgaaaaggagctgaagtaaagtgagagaaatggtctgctggctcctaattcgtgaagtgacaatgatgaatgaatgggagttagctccagctgtagctgcattttagctcttgcatactttcagctgctagagacactgaaaacacacacacacacacacacacacacacacacacacacacacacaatttcctagtagcaacaccaaaaaaaatgccttttctaaagtagtgtctaaacagtctccatgaa

SEQ ID NO: 20010 - DNA, 357 bp, Homo sapiens
  chr13.fa.O7frz.68498367
  Located on chromosome 13
  Distance between a terminus base of telomere on chromosomal short arm and 5'-terminus of this base sequence : 68559330
  Distance between 3'-terminus of neighbour sequence of sequence listing upward to telomere on chrosomal short arm and 5'-terminus of this base sequence : 185311
atctccaatcagtacatagacaaggatattcaaaatgataattagaattactttattctaatatcaagaaataatatgcataatgacattaaaatacaggattaaaacagtatttcaaagactagtcaaaaatatttctaggctgcaaagaaaattagaactaccatgtagtttatctgggctgaaaatgtgtgtgtgtgtgtgtgtgtgtgtgagtgtgttttctatttagttattttattttattttatagatttaggggatacaagtgcagatttataacatgaatatattgtgtagtattggggtctgggcttctgttgtatccatcacctgaagaatgaacattgtacctag

SEQ ID NO: 20011 - DNA, 478 bp, Homo sapiens
  HUMUT7875B
  Located on chromosome 13
  Distance between a terminus base of telomere on chromosomal short arm and 5'-terminus of this base sequence : 68656305
  Distance between 3'-terminus of neighbour sequence of sequence listing upward to telomere on chrosomal short arm and 5'-terminus of this base sequence : 96618
ttcagataggcagattcaataggataaatagacagatgaaagaaagaaagagagagagagaaagagagagagagaaagagagagaaagagagagaaagaaagagaaagaaagagagaagaaagaaagaaagaaagaaagaaagaaagaaaggaagaaaggaagaaagaaaagaaagaaagagaaaggaaggaaggaaagaaggaaggaaggaaagaaagatgacagatgactaaataggggaattggctcatatgattacagaggttgagaactctcacaatagtctgcaaactggagaaccaggaaagccagtagtgtggcaacattcaaatccaaaaagcctcagcaccagtgaagttgacaatgaaactctcaatctgaggccaaagacttgagaacctgaggggttactggtgtgaatcctagagtccaaaagccagagaacttggaattctgatatcaatgggaagaagaagg

SEQ ID NO: 20012 - DNA, 166 bp, Homo sapiens
  chr13.fa.O7frz.68860190
  Located on chromosome 13
  Distance between a terminus base of telomere on chromosomal short arm and 5'-terminus of this base sequence : 68779417
  Distance between 3'-terminus of neighbour sequence of sequence listing upward to telomere on chrosomal short arm and 5'-terminus of this base sequence : 122634
cattaaacattggcgtaaataggtgattgtcttttaaaaaagttttatttatatgtgcaataagatatttacatagctctacacatacacacacacacacacacacacacaatgacatattatagttttttacctcaatatagtaagatcagtgttccagttacat

SEQ ID NO: 20013 - DNA, 175 bp, Homo sapiens
  chr13.fa.O7frz.69058374
  Located on chromosome 13
  Distance between a terminus base of telomere on chromosomal short arm and 5'-terminus of this base sequence : 68969805
  Distance between 3'-terminus of neighbour sequence of sequence listing upward to telomere on chrosomal short arm and 5'-terminus of this base sequence : 190222
ttgcaagattagtggtcattacaatatttttttctttgtataaaataagcatttcccctaactgtccaaatacatatatttgtcagatgtgtgtgtgtgtgtgtgtgtgtgtgtgtgtgtgtgtgtgtgtcagatttcagcagggcaattgctaacgcttaagtctgagtcacta

SEQ ID NO: 20014 - DNA, 202 bp, Homo sapiens
  D13S276
  Located on chromosome 13
  Distance between a terminus base of telomere on chromosomal short arm and 5'-terminus of this base sequence : 69021714
  Distance between 3'-terminus of neighbour sequence of sequence listing upward to telomere on chrosomal short arm and 5'-terminus of this base sequence : 51734
ccttggttgtgtatatgcttaatctacatacattgtattaagaaatgtgtgtgtgtgtgtgtgtgtgtgtgtgtgtgtctgtacagttttgtgccggtaagtgtttaacaactggcttcttgaaaaaataaaatttgatttgtgatgtttactggtttccgtggaataaatagacatacccaccatagccaaattggagtta

SEQ ID NO: 20015 - DNA, 459 bp, Homo sapiens
  chr13.fa.O7frz.69172695
  Located on chromosome 13
  Distance between a terminus base of telomere on chromosomal short arm and 5'-terminus of this base sequence : 69084750
  Distance between 3'-terminus of neighbour sequence of sequence listing upward to telomere on chrosomal short arm and 5'-terminus of this base sequence : 62834
gtcattatgtccatggaactatacaacacaagacacatagaactgtccaacatggagagggatgcatgatataaagtttacgctgtggttaataataatgtgtcagtattggttcatcaataggaagaaatgtacctcatcaatagaatatgttaataatagagggaaatctgtgtgtgtgtgtgtgtgtgtgtgtgtgtgtgtgtgtgtgtgtgttctgcacaggggtgcatttatagaactctatgtactgtctgcttaattaactatttggtcaggaaaaaaccgacaatggcagatctctcccaaactgagagtctgccccactaaatctatgtcatgtaggataaagacagacaagcttcctacaggttggttaactttaaatttatcatgtaagataaagaaagaccagcttcctggaggtcagttaactttaacctttaaaggtcagtaaac

SEQ ID NO: 20016 - DNA, 288 bp, Homo sapiens
  Z66770
  Located on chromosome 13
  Distance between a terminus base of telomere on chromosomal short arm and 5'-terminus of this base sequence : 69225197
  Distance between 3'-terminus of neighbour sequence of sequence listing upward to telomere on chrosomal short arm and 5'-terminus of this base sequence : 139988
ggtctttagcagaggtttggtactagaaagacatcaacgcatgaaagcataagtactttaatttttttcccatggcaatgcccaactgaaagaaagttaagagaatgtaataatacctacagatcattgaacagatgtacacacacacacacacacacatacacacacacacagaattgtcgccttttcattaaaaaaaaaagtaagaagccaatgttagaagtttaatatatgaagaaaagatgaagaaaagaaaaagaaagactgaacatgaaagaatctgaagct

SEQ ID NO: 20017 - DNA, 444 bp, Homo sapiens
  AL355611.4_75892
  Located on chromosome 13
  Distance between a terminus base of telomere on chromosomal short arm and 5'-terminus of this base sequence : 69255127
  Distance between 3'-terminus of neighbour sequence of sequence listing upward to telomere on chrosomal short arm and 5'-terminus of this base sequence : 29642
ctgctttctgacactatagcttacattttcagtattatttttattttattttattttattttattttattttattttattttattttattttagtcagagagtctcactgtgtcacccaggctggagtgcagtgggtgatcttgtcactgcaacctccacctccctggttcaaatgattctcctgcctcagcctcctgagtagctgggaatacagtcacaagccaccacacctggctaatttttgtattattagtagagacagggtttcgccatgttggctagggtggtctcgaaactctggacctcagatcatccaccagcctcagcctcccaaagtgctgggattacaggtgtaagccactatgcctggcccccctttttaatataaatttatataaatgatattctacagtattaatctttttttgtccagcttctgtcac

SEQ ID NO: 20018 - DNA, 273 bp, Homo sapiens
  chr13.fa.O7frz.69441358
  Located on chromosome 13
  Distance between a terminus base of telomere on chromosomal short arm and 5'-terminus of this base sequence : 69353442
  Distance between 3'-terminus of neighbour sequence of sequence listing upward to telomere on chrosomal short arm and 5'-terminus of this base sequence : 97871
ggaataagtcagatacttcctttccttcactgtttttttaagaacaatttaaaaagggcacacataacatccatgctcttcaagctacaacatataatttgggaagcagcagagaaagcaagaaagcaagaaagcaagaaagcaagaaggaaggaaggaaggaaggaaggaaggaaagaaagaaagaaagatctggcctctgtatccatctcttttcctcaaaggagaagatatgatgggaacgagtgtcctattaggaccaactattgctgt

SEQ ID NO: 20019 - DNA, 263 bp, Homo sapiens
  chr13.fa.O7frz.70002831
  Located on chromosome 13
  Distance between a terminus base of telomere on chromosomal short arm and 5'-terminus of this base sequence : 69649486
  Distance between 3'-terminus of neighbour sequence of sequence listing upward to telomere on chrosomal short arm and 5'-terminus of this base sequence : 295771
tttagaatgttggatcaaacagattaaacatatatatatatatatatatatatattgcaccttaaatcatattcagggaccagatcccaactctgctcagaaggaattcttagactcataaattaggtcatggaagattgtacaaacaagaattaattttgacataatttgaaaagcacaggatatagtttcaaatccaataatcaaaacataattatatatagaaatcctggtaagttctataatttcaaccaggtcataaa

SEQ ID NO: 20020 - DNA, 244 bp, Homo sapiens
  D13S275
  Located on chromosome 13
  Distance between a terminus base of telomere on chromosomal short arm and 5'-terminus of this base sequence : 69750574
  Distance between 3'-terminus of neighbour sequence of sequence listing upward to telomere on chrosomal short arm and 5'-terminus of this base sequence : 100825
ttgtgcagggcatcaacattgtttacccttgcattgttcaaaggtcaaccacacacacacacacacacacacacacacacaatttaaagtggaatattattccacttcaaaagggaagaaaattatgtcatctatgacaacatgtatacacctgaaaaattatgctaagtgactaggaatagaaagaaaaactgcatgatctcacttacatatggattctaaaatagccaaattcttggaagca

SEQ ID NO: 20021 - DNA, 478 bp, Homo sapiens
  AC016709.5_132782
  Located on chromosome 13
  Distance between a terminus base of telomere on chromosomal short arm and 5'-terminus of this base sequence : 69779758
  Distance between 3'-terminus of neighbour sequence of sequence listing upward to telomere on chrosomal short arm and 5'-terminus of this base sequence : 28940
ctagcaacagatctggatgtatctctagatagagatctagcactctgtcagcaacaaaatttcttatatcctcatatcctcatatactctttagggttgcttaatttctctactcaaaaccaagttgtcaggctgggcatggtggctcacacatgtaatctcagaactttgagaggctggggtagctatacatacatatatgtatgtatgtatgtttgtctctctctctctttctctctctcgctatgtatctatgtatctatctatctatctatctatccatctatctatcaatcatctatagataaagatatagaccatttcttactgtatacttactgcaatcacttttagttccaggaagcatctctcctctggattatatctttttatctgccctcttcacaagcattcttgcctttctacagtctcacttttgcatatggaatccagtgtatctccactcaaatcttatcaa

SEQ ID NO: 20022 - DNA, 478 bp, Homo sapiens; identical to SEQ ID NO: 20021
  AL356111.5_3180
  Located on chromosome 13
  Distance between a terminus base of telomere on chromosomal short arm and 5'-terminus of this base sequence : 69779758
  Distance between 3'-terminus of neighbour sequence of sequence listing upward to telomere on chrosomal short arm and 5'-terminus of this base sequence : -478

SEQ ID NO: 20023 - DNA, 200 bp, Homo sapiens
  chr13.fa.O7frz.70166645
  Located on chromosome 13
  Distance between a terminus base of telomere on chromosomal short arm and 5'-terminus of this base sequence : 69986898
  Distance between 3'-terminus of neighbour sequence of sequence listing upward to telomere on chrosomal short arm and 5'-terminus of this base sequence : 206662
ccaagtacacatgattatggactatcatgaggaaatttaagaattctgcagggaaaaacaaacaaacaaaaaaacaaaacaaaaaaacaaaaaacaaaaaaaccagcaacaacagtttttcagtttcttaagtgcatttcaccaagcagaactgaacagtataaataacaaggaacaatatgattataccaaggttggac

SEQ ID NO: 20024 - DNA, 476 bp, Homo sapiens
  chr13.fa.O7frz.70276649
  Located on chromosome 13
  Distance between a terminus base of telomere on chromosomal short arm and 5'-terminus of this base sequence : 70085573
  Distance between 3'-terminus of neighbour sequence of sequence listing upward to telomere on chrosomal short arm and 5'-terminus of this base sequence : 98475
cataaacatctcctgagatcatacataatcttcaaataaagaatagtaaggtcggctgggagcggtggctcacgcctgcaatcccagcactttgggaggccaaggcaggcggatcatgaggtcagatccttgctaacatggtgaaaccccgtctctgctaaaaatacaaaaaattagccaggcatggtggcacacgcctgtagtcccagctacttgggaggctgaggagggagaatcacttgaacatgggaggcagaggttgcagtgagctgagatcacaccactgcactccagtctgggtgacagagcgagactccatctcaaaataataataataataataataataataacaataatgtcacaattatgcctaacataatacaattattatttgtacaaccagaaatgcaacactttccaacccaaatactattatgtaacactaacaatacttaaatgttgagctgatagga

SEQ ID NO: 20025 - DNA, 432 bp, Homo sapiens
  chr13.fa.O7frz.70375044
  Located on chromosome 13
  Distance between a terminus base of telomere on chromosomal short arm and 5'-terminus of this base sequence : 70183937
  Distance between 3'-terminus of neighbour sequence of sequence listing upward to telomere on chrosomal short arm and 5'-terminus of this base sequence : 97888
tacaggcttcatgtaatttacttcatatttcatcggtgaaagaaatttgaattcacaattatatataaagatgcatttgaaactcagaatcaagcaatcataaggaaaggatgacttcatattgcattcaaaagctattcaagttaaattaccattatcttaagtcatttttaaagatgttttagaaagctgaaaaagatgtgtttgcttatttataaaattactacatatataagaaattattgctgctttgaaaatttatatatatgtgtgtgtgtgtgtgtgtatatatatatatatatatatatatatatatatatatatatatatatatatctgtcccacagaataaatattaatgtctcaggtttaccaaagttcagttcatgaacacaactgaaatgtcagctgtcctcagtaagaactgattcc

SEQ ID NO: 20026 - DNA, 432 bp, Homo sapiens
  chr13.fa.O7frz.70649792
  Located on chromosome 13
  Distance between a terminus base of telomere on chromosomal short arm and 5'-terminus of this base sequence : 70441142
  Distance between 3'-terminus of neighbour sequence of sequence listing upward to telomere on chrosomal short arm and 5'-terminus of this base sequence : 256773
tggcactaagtactagtcaagaaccataaaacagactgtctactagttagagtgtagaaagactttgtgtcagagagtgatgccagaacggctgctggactaagtattttatcactcgtactaattttagatagatagatagatagatagatagatagatagatagatagatagatagatagatagacagacagatagatacatagagagatagatctatagatagagatagagatagatagagatacagatagagatagagacagagatagagatatgatatgatatggtttggttgtgtccccacccaaaatctcatcttgaattctaatccccataatttccacatatcaagggagaggaaagagaccacgtggaaataatgtaatcttgggggcggtttttctgctcatgatagtgagttctcaagag

SEQ ID NO: 20027 - DNA, 298 bp, Homo sapiens
  AL353738.16_87041
  Located on chromosome 13
  Distance between a terminus base of telomere on chromosomal short arm and 5'-terminus of this base sequence : 70525242
  Distance between 3'-terminus of neighbour sequence of sequence listing upward to telomere on chrosomal short arm and 5'-terminus of this base sequence : 83668
aaactgtacaattgaaatggcttttagattctctacaaagctgttaaatatacacactcatatatatacatatacatacatatatatatatatatatatatatatatatatatatatacacacacacacgcacacacatacagggaataaaagggaaaaatataaaataggcttcaattttttccataaaatcatactggcatagccacaccaagtacaatatgctgtgacggagaggtttaaaaaatgcagaaaaatgtataaaagggcagctgtggaagtgaatgtacaaaggtag

SEQ ID NO: 20028 - DNA, 319 bp, Homo sapiens
  AL353738.16_94729
  Located on chromosome 13
  Distance between a terminus base of telomere on chromosomal short arm and 5'-terminus of this base sequence : 70532914
  Distance between 3'-terminus of neighbour sequence of sequence listing upward to telomere on chrosomal short arm and 5'-terminus of this base sequence : 7374
aattgcaattacttttgtaccaacttatcatatgaaaaacatatttttaatatcttaaaaacttgagcctgccatacaaaattgtgtgtgtgtgttgtgtgtgtgtgtgtgtgtgtgtgtgtgtgtgtgtgtgtgtgtgtgaagatcttcttcctattccgtcactgtggctaattcttgtgtgtttccatcaccccttgtgaacattctgaaccctgttgatatctctattatactctcttcctttaagctctttcagtgtttcatttgttttctgctgggactctgactgataaagtgaatattggatgtggacagt

SEQ ID NO: 20029 - DNA, 272 bp, Homo sapiens
  D13S318
  Located on chromosome 13
  Distance between a terminus base of telomere on chromosomal short arm and 5'-terminus of this base sequence : 70587498
  Distance between 3'-terminus of neighbour sequence of sequence listing upward to telomere on chrosomal short arm and 5'-terminus of this base sequence : 54265
gtatgatttatttcaggtttgcaagaacatttaaacattgggatatctatctatgatctatgtgtctatctatctatctatctatctatctatctatctacctatcatctttctactgaaacattgggatatctatctattatctatctatctatctatctatctatctatctatctatcatctttctactatcttcctatcttaaatagatcatattagtgtattttaatatccatataataaaactatgtcagtagaccatgaaatcaaa

SEQ ID NO: 20030 - DNA, 226 bp, Homo sapiens
  D13S1296
  Located on chromosome 13
  Distance between a terminus base of telomere on chromosomal short arm and 5'-terminus of this base sequence : 70668157
  Distance between 3'-terminus of neighbour sequence of sequence listing upward to telomere on chrosomal short arm and 5'-terminus of this base sequence : 80387
tgcagaaatgtgagccaattgaacatcttttctttataaattacccagtttcaagtatttctttatagcagtgcaagaatggaataatatagtcactctagagtttaaccaggagcccttcctccttggacctgtcacacacacacacacacacacacacacacacacacacacacacacacacacacacacaaaggaaccatagtaggtagttgctctaggtgga

SEQ ID NO: 20031 - DNA, 439 bp, Homo sapiens
  chr13.fa.O7frz.71019665
  Located on chromosome 13
  Distance between a terminus base of telomere on chromosomal short arm and 5'-terminus of this base sequence : 70777473
  Distance between 3'-terminus of neighbour sequence of sequence listing upward to telomere on chrosomal short arm and 5'-terminus of this base sequence : 109090
ttagcctttgaatgtacagtctacaagcaacagcccacctgagctgataaacaaagcaaacggggcaccagcaattccttcctccataatatttgagagaaacaaattccacagaaagcaaatcagacccttctctactgatttcatgtagagatttaatgcaaaatgagaaatatatctttgttcttctaacactcaattcaatgactcttctgccgtgtgtgtgtgtgtgtgtgtgtgtgtgtgtgtgtgtacacacacgcatatagggattcatgcatatattttggttggatttttaaacaaagtaatttaatatgactaagctatatatgattatatgttttctatggaatataatgcatactaaaacatagatttgcaaataagtcatcaattacatccatttaataattaagaatcctctcaggtagaccta

SEQ ID NO: 20032 - DNA, 365 bp, Homo sapiens
  chr13.fa.O7frz.71127736
  Located on chromosome 13
  Distance between a terminus base of telomere on chromosomal short arm and 5'-terminus of this base sequence : 70845494
  Distance between 3'-terminus of neighbour sequence of sequence listing upward to telomere on chrosomal short arm and 5'-terminus of this base sequence : 67582
tgttatggactcaacgtagaagaagcctatctttaagcagaaataagaatcccttatattgcagatttgtaggataaaaagtcaacagcttctgtcctagatgagatgtgtatttgtgcatgtgtagaaagatagttggatgtatagatagatagatagatagatagatagatagatagatagatagatagagatagatgtatagatagatagatagatggatagatagatggatagatagatagatagatagatagatagacagacagacagacaaagttttctagggctgatataacaaattaccacaaacttggtggcttgaaacaaaaaataataattatctcatagttaaggaagctagc

SEQ ID NO: 20033 - DNA, 316 bp, Homo sapiens
  chr13.fa.O7frz.71237943
  Located on chromosome 13
  Distance between a terminus base of telomere on chromosomal short arm and 5'-terminus of this base sequence : 70976155
  Distance between 3'-terminus of neighbour sequence of sequence listing upward to telomere on chrosomal short arm and 5'-terminus of this base sequence : 130296
tctaggtggttcagttgtagatacagacctctgaaaggcagtgtaactgcagagcaaagagctgttttatttatttatttatttatttatttatttatttatttatttcctttctctgtctctctttcccccgccccacgcccccctttcacagacagggtctcgttctgttgcccagctggaatgcatcatagctcactataacctcaaactcctggtctcaagcatgagccaccatgcctgaccccatataatttcaatactaaattagggtttcatttttgctgctggtgttgaatagattcataccacagat

SEQ ID NO: 20034 - DNA, 361 bp, Homo sapiens
  chr13.fa.O7frz.71485329
  Located on chromosome 13
  Distance between a terminus base of telomere on chromosomal short arm and 5'-terminus of this base sequence : 71134930
  Distance between 3'-terminus of neighbour sequence of sequence listing upward to telomere on chrosomal short arm and 5'-terminus of this base sequence : 158459
aaattatggatccaagctaaatgcccattaatcaataagtggataaaaaaaactatggtgtgtgtatatatatatatatatatatatatatatatatagtgtatatatatatggtgtatatatatatggtgtgtatatatatatatggtgtatatatatatatggtgtatatatatatatatatagtctccaatatcatctaggtcactgtgaatgccattaattcattcctttttgtggctgagtagtatttcatcatatatatcatatatagacgttttataaaaattcaagacaagctataattctagttaatttctactacattgaagaagcagaatcatttcaaatgaagtatctg

SEQ ID NO: 20035 - DNA, 272 bp, Homo sapiens
  D13S1308
  Located on chromosome 13
  Distance between a terminus base of telomere on chromosomal short arm and 5'-terminus of this base sequence : 71223329
  Distance between 3'-terminus of neighbour sequence of sequence listing upward to telomere on chrosomal short arm and 5'-terminus of this base sequence : 88038
catgatggctgacacagaaccatgttctctatggcttgtgattttactctaatgagttatgtgaaaagtatttagaccaaatacacacacacacacacacacacacacacacacgtgggtatgtgtatgtctgtatatacatacacacatatgtgtgtgtatatgtatataattgttatatatatatatacttatatgtgtatgggtatacatacgtacacagacacacacacacaaacacactcacacacgcggtgccatactttttggaa

SEQ ID NO: 20036 - DNA, 431 bp, Homo sapiens
  chr13.fa.O7frz.71687027
  Located on chromosome 13
  Distance between a terminus base of telomere on chromosomal short arm and 5'-terminus of this base sequence : 71335977
  Distance between 3'-terminus of neighbour sequence of sequence listing upward to telomere on chrosomal short arm and 5'-terminus of this base sequence : 112376
attgtatcagctcaagaagtacactaataaaattatttaggagtcatatactacttctgcacacacacacacacacaaactcactttttttcattaacttaaatcaaagatgtcttttgactaaatttaagactgagtcgagaacaaaagatacatcatccttcaagctactgaagatcggggggctgcctctctctcaggagtagaaatctctcagatccctatcagtgagacttggttctggaaatatttgtcctttctgaatatcagccagaggctgatagaaaagcaggaggcaaataaagatatttcttaactttgcaagctctttcttctctggagctttttccaaagaatagtttttatgtgaaacaaactgatagcttcaagttatagcccattgaaagtggtctgcttactattatctgcac

SEQ ID NO: 20037 - DNA, 290 bp, Homo sapiens
  chr13.fa.O7frz.71810966
  Located on chromosome 13
  Distance between a terminus base of telomere on chromosomal short arm and 5'-terminus of this base sequence : 71415341
  Distance between 3'-terminus of neighbour sequence of sequence listing upward to telomere on chrosomal short arm and 5'-terminus of this base sequence : 78933
ccagtatttcaagactagccttggcaatatagtgagacctcatctgtataaaaaatacaaaaattagctgggagtggtggtgcatgcttgtggtcccagatgcttaggaggctgaggcagcaggattgattgagtccaggaagctgaggctgcagtgagccgtgttctggccactacgctccagcctgggcaacagattgagatgccatctccaaaataataatgataataataataataataataataataaggtaaaataaaataaatggaactatgtgaggtgataa

SEQ ID NO: 20038 - DNA, 291 bp, Homo sapiens
  AL139001.14_50334
  Located on chromosome 13
  Distance between a terminus base of telomere on chromosomal short arm and 5'-terminus of this base sequence : 71581861
  Distance between 3'-terminus of neighbour sequence of sequence listing upward to telomere on chrosomal short arm and 5'-terminus of this base sequence : 166230
gaaggatgtattcctgaaagacaaacatttactggctattttttagtctgttgttttgttttgttttgttttgttttgttttaactaaatgcatttcaaatctatgcacagcttagacagtatgaatctaaaacctgactctttgagatgtaagacagagacaaagacaatcagagaagctagacatttatgaggcattatatagaaacaaagataacaaagagaggctaagaccaaaatctgtgtataaactatacccaaacagctggctgactatcaaactatgcagct

SEQ ID NO: 20039 - DNA, 342 bp, Homo sapiens
  AL139001.14_75498
  Located on chromosome 13
  Distance between a terminus base of telomere on chromosomal short arm and 5'-terminus of this base sequence : 71606835
  Distance between 3'-terminus of neighbour sequence of sequence listing upward to telomere on chrosomal short arm and 5'-terminus of this base sequence : 24683
tgaactgaatcattgagtcctcctgggttgtgagcctgccagcatttatcccatcagctctcctggttctcgggtcttcagactcagactgcaggcataccatttgcctcttttgggacctcagcttgctgactatagatcttgggccttgtcaaccttcataatcatgtgaaccaattccttacttttttctttctccttttctttcaagatatatattttttctctcttcatatataatgtgtgtgtgtgtgtgtgtgtgtgtgtagttctctaagaaactctaatacaaagggtatcagtttcttgctacaagaaccctccgattaatcatacttggaa

SEQ ID NO: 20040 - DNA, 241 bp, Homo sapiens
  D13S279
  Located on chromosome 13
  Distance between a terminus base of telomere on chromosomal short arm and 5'-terminus of this base sequence : 71606976
  Distance between 3'-terminus of neighbour sequence of sequence listing upward to telomere on chrosomal short arm and 5'-terminus of this base sequence : -201
ttgggccttgtcaaccttcataatcatgtgaaccaattccttacttttttctttctccttttctttcaagatatatattttttctctcttcatatataatgtgtgtgtgtgtgtgtgtgtgtgtgtagttctctaagaaactctaatacaaagggtatcagtttcttgctacaagaaccctccgattaatcatacttggaagtagtataatcggatattgtgtgctttctgcaacaaacca

SEQ ID NO: 20041 - DNA, 173 bp, Homo sapiens
  AL139001.14_97720
  Located on chromosome 13
  Distance between a terminus base of telomere on chromosomal short arm and 5'-terminus of this base sequence : 71629223
  Distance between 3'-terminus of neighbour sequence of sequence listing upward to telomere on chrosomal short arm and 5'-terminus of this base sequence : 22006
aaagcttgcctattcttttcagctatcaaacacctccttttactctttcttatgaatctagacttgccatgctttctctctctctctctctctctcgttgttttgcaatggataaatgctatgataaatgaattcattgcaaagtgacatcagctccattgagtaaactttca

SEQ ID NO: 20042 - DNA, 170 bp, Homo sapiens
  AL139803.12_62121
  Located on chromosome 13
  Distance between a terminus base of telomere on chromosomal short arm and 5'-terminus of this base sequence : 71721504
  Distance between 3'-terminus of neighbour sequence of sequence listing upward to telomere on chrosomal short arm and 5'-terminus of this base sequence : 92108
ctatacagccaggataatcaagactgtgtagtatcagtataaggatatagatgattttatatatatatgtatatatatatatgtatatatatgtgtatatgtgtgtatgtgtgtgtgtgtgtgtgtgtgtggatataataaatggagtagaattgacagcctattggtac

SEQ ID NO: 20043 - DNA, 226 bp, Homo sapiens
  D13S288
  Located on chromosome 13
  Distance between a terminus base of telomere on chromosomal short arm and 5'-terminus of this base sequence : 71761549
  Distance between 3'-terminus of neighbour sequence of sequence listing upward to telomere on chrosomal short arm and 5'-terminus of this base sequence : 39875
caagcctgtttaggtcaatgacctatttagcgtaaatgatcacgtgtgtgtgtgtgtgtgtgtgtgtgtgtgtaaaaagaaacacttgaattggttctttcatgttttgaacaactaaagaaagagtataatttttaaaacaagtcaatttgaatatgatttttggaatgtaatttctacttcataaaattaactaataaaatgtagcactttaatgtgtagacaa

SEQ ID NO: 20044 - DNA, 288 bp, Homo sapiens
  AL139803.12_22134
  Located on chromosome 13
  Distance between a terminus base of telomere on chromosomal short arm and 5'-terminus of this base sequence : 71761568
  Distance between 3'-terminus of neighbour sequence of sequence listing upward to telomere on chrosomal short arm and 5'-terminus of this base sequence : -207
gacctatttagcgtaaatgatcacgtgtgtgtgtgtgtgtgtgtgtgtgtgtgtaaaaagaaacacttgaattggttctttcatgttttgaacaactaaagaaagagtataatttttaaaacaagtcaatttgaatatgatttttggaatgtaatttctacttcataaaattaactaataaaatgtagcactttaatgtgtagacaattcaaaatcaaacagagaaaagcaatgaaaatcatacttagtcctataatttgaacagttattggcttattgtagatccag

SEQ ID NO: 20045 - DNA, 337 bp, Homo sapiens
  chr13.fa.O7frz.72350095
  Located on chromosome 13
  Distance between a terminus base of telomere on chromosomal short arm and 5'-terminus of this base sequence : 72003905
  Distance between 3'-terminus of neighbour sequence of sequence listing upward to telomere on chrosomal short arm and 5'-terminus of this base sequence : 242049
ttacaaatgctttggctactagggctcttttttggttcaatataaattttaaggttttttttttttctaattctgtgaaacaaatgaccatgataattagataggaattgctttgggtggtatggccattttaatgatattgattcttccaatcaatgaggatgggatgcctttctatttgtttgtgtcatctactaattctttcatcaatgttatatagttctccttttagagatctttcattttcttggttaaatgtattcctaggtatttgtgtgtgtgtgtgtgtgtgtgtgtgtgtgtgtatgtgtgtgtagctattacaaatggaattgag

SEQ ID NO: 20046 - DNA, 242 bp, Homo sapiens
  D13S1324
  Located on chromosome 13
  Distance between a terminus base of telomere on chromosomal short arm and 5'-terminus of this base sequence : 72303400
  Distance between 3'-terminus of neighbour sequence of sequence listing upward to telomere on chrosomal short arm and 5'-terminus of this base sequence : 299158
tgcagatagcagttcatgcctcattgattagtttgctaaggtggtgaccagaaatgaaaacactgcaaggacctgtgtgtgtaatcacacacacacacacacacacacacacacacacacacacattaattctatgcctctatgcccgcttagatttgtttcttatttacacatttttatgttttttcgttaaattgcgtttccattcataatttaaattgtccatttcgtaactctcaggg

SEQ ID NO: 20047 - DNA, 190 bp, Homo sapiens
  D13S1291
  Located on chromosome 13
  Distance between a terminus base of telomere on chromosomal short arm and 5'-terminus of this base sequence : 72450032
  Distance between 3'-terminus of neighbour sequence of sequence listing upward to telomere on chrosomal short arm and 5'-terminus of this base sequence : 146390
ttacattctgcacgaccaagaactccaattatctgagtaaatgacgtttagtgatcttgcttccgcgacccccaccaccccccatctttactgccacctgtccatacttttgagcgcgcgcgcgcacatacacacacacacacacacacacacacacacacacaacatttaccccaaaatagtcgaaggt

SEQ ID NO: 20048 - DNA, 364 bp, Homo sapiens
  AC021535.2_20620
  Located on chromosome 13
  Distance between a terminus base of telomere on chromosomal short arm and 5'-terminus of this base sequence : 72484598
  Distance between 3'-terminus of neighbour sequence of sequence listing upward to telomere on chrosomal short arm and 5'-terminus of this base sequence : 34376
aattgcaaactattcatctaacaggggactattatccacagtataaaagaaactcaaacaacttaacagcaaaacaaaacaaaacaaaacaaaaatcccattaaaaattaggcaaaaaatcaaagtagatatttctacaaagacgacacacaaatgaccaacgtgtatatgaaagagtgttcaacaatactaatcatcaggtaaatgcaaatcaaaaccacagtgggatatcatcttatcccaattaggatgtctaatattaaaaaaaaaaacaaaaaattacagctgctggagaggatgtaaaggaaagggaattcttatacactgttgatgggaatgtaaattagtacagccactatggaaa

SEQ ID NO: 20049 - DNA, 256 bp, Homo sapiens
  D13S1318
  Located on chromosome 13
  Distance between a terminus base of telomere on chromosomal short arm and 5'-terminus of this base sequence : 72506453
  Distance between 3'-terminus of neighbour sequence of sequence listing upward to telomere on chrosomal short arm and 5'-terminus of this base sequence : 21491
ggctgtgctcttccaaaatatatacttttttaagatctggtgtctgactccatgtgaaatggtgtgtgtgtgtgtgtgtgtgtgtgtgttagagcctggagaaagagcaaaatcaaactctatagagacttggggagactgaagtacagaaaaatttactttttctttaattcttactcccaccaccataactttaagccaacatattgattctgttgtacttcatggcatagtgattaagagcaagggctttgcc

SEQ ID NO: 20050 - DNA, 402 bp, Homo sapiens
  AC021535.2_41435
  Located on chromosome 13
  Distance between a terminus base of telomere on chromosomal short arm and 5'-terminus of this base sequence : 72523711
  Distance between 3'-terminus of neighbour sequence of sequence listing upward to telomere on chrosomal short arm and 5'-terminus of this base sequence : 17002
ctgttaaattccacaataggtaagttaaaacctacctgctgcttttttaaactataactttatttttgacaaaattctgtcttcacgtttaagtattgacctttcctatattcttaacaatttctgtctacagaattgcattcactagggtgaagtttctccgtgggtttttgtttgtttgtttgtttgtttgtttgtttttcaatgtttgaattaagaaaacaaccatcctttctgcattcgaggaaatccaaggataacctaaacattttccttaggaaattcataggtgattgaggctcctgccaacatgaaaagttcactcacccaggaaaacttaaaacatttatttaattattatttgagtggctcctatgagtcagatacttaaacagtacagcc

SEQ ID NO: 20051 - DNA, 315 bp, Homo sapiens
  chr13.fa.O7frz.72987845
  Located on chromosome 13
  Distance between a terminus base of telomere on chromosomal short arm and 5'-terminus of this base sequence : 72581780
  Distance between 3'-terminus of neighbour sequence of sequence listing upward to telomere on chrosomal short arm and 5'-terminus of this base sequence : 57667
ctggagtacagtggttattcacaggcatgattatagctcactgaagtcttggacccctggcctcaagtggtccttctgcctcaacctcccaagtagctgaaaatacaggcatgcaccaccacactgggtgacatttccttccttttaagactgagaaatactgcattgtgtgtgtgtgtgtgtgtgtgtgtgtgtgtgtgtatcacatttcatgtatctatttatcttttaacagacacttgagtttctttcaccttttggctattgcaaatcatgacgctatgaacatggatgtacaattatctgattgagtcc

SEQ ID NO: 20052 - DNA, 396 bp, Homo sapiens
  chr13.fa.O7frz.73215697
  Located on chromosome 13
  Distance between a terminus base of telomere on chromosomal short arm and 5'-terminus of this base sequence : 72719014
  Distance between 3'-terminus of neighbour sequence of sequence listing upward to telomere on chrosomal short arm and 5'-terminus of this base sequence : 136919
gtatgcatacttgctttctacatataatgaaacagaattatattattctttatatagttgggtatctgtcacattgtctgtgtaaatatacacaggttatcagttaagtttcttatagcctttcttgtggtctgtgaaacggtaggttttccttttctgcatctacaaaaataaaggtcatctgaaaaatcccatgttgttaaaatgagaaatatatatatatatatatatatatatatatgaatgatacatgttccatattgggaacttcagaatatatagtataatttaaaggtaattgcaaatgagatttttttcaattcaatatagcactattactaacaaaaattgaattgcatacatctgcatagaaacagtacaaattcctttaggatt

SEQ ID NO: 20053 - DNA, 124 bp, Homo sapiens
  D13S1302
  Located on chromosome 13
  Distance between a terminus base of telomere on chromosomal short arm and 5'-terminus of this base sequence : 72803409
  Distance between 3'-terminus of neighbour sequence of sequence listing upward to telomere on chrosomal short arm and 5'-terminus of this base sequence : 83999
ctgcaaaacacatggtttcattctttttatgtctgaataatattctttgtatttgtgtgtgtgtgtgtgtgtgtgtgtatgtgtgtgtgtcatttgtttatacattcatctgtcgatggacact

SEQ ID NO: 20054 - DNA, 463 bp, Homo sapiens
  AL355174.11_135639
  Located on chromosome 13
  Distance between a terminus base of telomere on chromosomal short arm and 5'-terminus of this base sequence : 72836286
  Distance between 3'-terminus of neighbour sequence of sequence listing upward to telomere on chrosomal short arm and 5'-terminus of this base sequence : 32753
caattcctagttgaacatgttaacatgtctcaagaaagaaaatacaaaacatgaaagtgggagtaagttggcagcctcagttgttgaggaaaaggagtgatggagatgaacattagtcccacccacctaggagctgcccagagcacagaaaaatttcaccacttggacttaatcgccatggttcctttgggattatcatccatacaggtgtctcagctaaaaaaatttaagactaacttgttggtttttatttcatacccatcagaacaaattttgatattcctttccaaatagtttctctattgagataagtatattttggtaatctctatctatctatctatctatctatctatctatctatctatctatctatctacctgtctatctgtttatttccaggttgagctatttcaccaaatcaagttctcagtattgagtacttaacctataccatgcacag

SEQ ID NO: 20055 - DNA, 479 bp, Homo sapiens
  chr13.fa.O7frz.73521398
  Located on chromosome 13
  Distance between a terminus base of telomere on chromosomal short arm and 5'-terminus of this base sequence : 73024579
  Distance between 3'-terminus of neighbour sequence of sequence listing upward to telomere on chrosomal short arm and 5'-terminus of this base sequence : 187830
tcagtgttaatgttctgatcttaataacagtgctacggctatataagtgaatgtccttgttcttactcttaggaaataattagggggaaggtagtatgatgtctccaagttattttcaagtagtttagaaacacacatgcacacacacacacacacacaccccaaccaccccacatacatatatacatatatatgtatacacatattcatatacatgtacatatgtgagtacatatatatatgtatatatgtatgtggggtgtgtatgtatttctaaactatgtgtatgtggggtgtgtatgtatttctaaactatatacatacatgttttatatatatatatatacacacacacacacacacacacacagagaaaaatgataaaacaaatgtggcaaaatgtttaaaaatggtgaacttggatatagggtatacaggaggggttttggtggtgttttttgtttgcaattcttgcaact

SEQ ID NO: 20056 - DNA, 468 bp, Homo sapiens
  chr13.fa.O7frz.73636552
  Located on chromosome 13
  Distance between a terminus base of telomere on chromosomal short arm and 5'-terminus of this base sequence : 73137907
  Distance between 3'-terminus of neighbour sequence of sequence listing upward to telomere on chrosomal short arm and 5'-terminus of this base sequence : 112849
ctacaaggtggaagtcagtattccttttcataaaatcaacaattccttttcataaaatcaacaagccctatgagggctgctgtagcaaagtgccagaaactgggtgacttaaacaacagaaatgtactgtctcacagttctggagatgagaagtctgagatcaagctgttggcagggttggttccttataagggctatgaggaagactctgtctgatgtctctttcctcttctggtggcttgctgacaatctttggccttccttggcttatatacacatcacccaatctctgagttttcatatggtgctttccgtgtgtgtgtgtgtgtgtgtgtgtgtgtccacctttccccttttttataaggacacaagtcatattggattagggcccaccctaaaagacctgattatagcttgattacctttgtaaagaccctatctgaggttctgagaattagaacttcaatg

SEQ ID NO: 20057 - DNA, 406 bp, Homo sapiens
  chr13.fa.O7frz.74192089
  Located on chromosome 13
  Distance between a terminus base of telomere on chromosomal short arm and 5'-terminus of this base sequence : 73275916
  Distance between 3'-terminus of neighbour sequence of sequence listing upward to telomere on chrosomal short arm and 5'-terminus of this base sequence : 137541
tcaggttcacttgattaaagatagaaacactttagagcaagaatgagtgagcctagattttattttactttgggttgctaaatttattaatatcacgcatgaacctggaatttattataatgcctgaaatcatgccttcccagaggttgaaagtgctccctaactcatattagtcatcgtgtgtgtgtgtgtgtgtgtgtgtgtgtgtgtgtgtccgcctgcatgtgtagacagtgagacagagacagagatagagaagcagagagagagaagaacagagattttaagaaattagctcaagaaattgtggaggctgggaagccagaagtcctcaaatcaggctggctggctgcagattctagtaggagttgaagtcttcagtctgaaagcagtctagaggttatgg

SEQ ID NO: 20058 - DNA, 143 bp, Homo sapiens
  D13S152
  Located on chromosome 13
  Distance between a terminus base of telomere on chromosomal short arm and 5'-terminus of this base sequence : 73446262
  Distance between 3'-terminus of neighbour sequence of sequence listing upward to telomere on chrosomal short arm and 5'-terminus of this base sequence : 169940
tctgtagttcgctttccctgtgtttttttaggggtgtgtgtgtgtgtgtgtgtgtgtgtgtgtgtgtgtgtgtgtgtgacagtagagagacagagaatctactgaagttattttgagtatagagtgcctatgttgcctatgtg

SEQ ID NO: 20059 - DNA, 371 bp, Homo sapiens
  AL139181.6_82217
  Located on chromosome 13
  Distance between a terminus base of telomere on chromosomal short arm and 5'-terminus of this base sequence : 73455490
  Distance between 3'-terminus of neighbour sequence of sequence listing upward to telomere on chrosomal short arm and 5'-terminus of this base sequence : 9085
atacgtaatgctaaatgacgagttaatgggtgcagcacaccagcatggcacatatatacatgtgtaactaacctgcacattgtgcacatgtaccctaaaacttaaagtataataataataataaaaaataaataataaaaaaataaaaaataaagcattccacttataagaaagttattagctctgatcgcctctctttattcttatgtatgagttttcattccacaagttttagacactgtttataaagtataaggtataccaaggcatagctaaaggttgtggctacttaaccccccacctccacacacacacacatatatatatatctttaatgatagagaccactagagcagtattgacttaaatgg

SEQ ID NO: 20060 - DNA, 189 bp, Homo sapiens
  D13S745
  Located on chromosome 13
  Distance between a terminus base of telomere on chromosomal short arm and 5'-terminus of this base sequence : 73541325
  Distance between 3'-terminus of neighbour sequence of sequence listing upward to telomere on chrosomal short arm and 5'-terminus of this base sequence : 85464
aggtgcaaacaccaggtcatataaatgtgtgtgtttgtgtgtgtgtgtgtgtgtgtgtgtgtatgtgcacattaccaaatgccaaccaccactgaagtgggaaaaacaatgacttatttataaattatattctgtttatacgtcaaacaaataaggtaattgtttaaattttttacctgccggttgttc

SEQ ID NO: 20061 - DNA, 259 bp, Homo sapiens
  AL354720.14_112364
  Located on chromosome 13
  Distance between a terminus base of telomere on chromosomal short arm and 5'-terminus of this base sequence : 73633170
  Distance between 3'-terminus of neighbour sequence of sequence listing upward to telomere on chrosomal short arm and 5'-terminus of this base sequence : 91656
aaagacataacggcagtaatgttctttctgacattttcatttaaagctctggagcctcgtgtgtgtgtgtgtgtgtgtgtgtgtgtgtgtgtgtgtgtgttgtcttcattctcatacattcaaagcatttagtgtgctacacggcagaaactgcaccatgggtgtagaataaaaacaagtttgataactgtggtaactgtggtggcacctaagacatcgaggccatcatgacagagaaatgactagtccatgaagacag

SEQ ID NO: 20062 - DNA, 294 bp, Homo sapiens
  D13S791
  Located on chromosome 13
  Distance between a terminus base of telomere on chromosomal short arm and 5'-terminus of this base sequence : 73886618
  Distance between 3'-terminus of neighbour sequence of sequence listing upward to telomere on chrosomal short arm and 5'-terminus of this base sequence : 253189
ttgtgggacttctcagcttccttaattatatgagtcaataccttgtaataaatctctatctatctatctatctatctatctatctatctatctatctgtcatctagctatttacctacctacctacctctctatctcagttctgtatctgtttctctatttatatatctatctacctacctacctacctatctcagtcctgtttctctgaagatccctgactaatacagtggagttcatctactctgaagtttgtccaaggcccagcatacactgccggtcttgttgtagctta

SEQ ID NO: 20063 - DNA, 461 bp, Homo sapiens
  chr13.fa.O7frz.74547885
  Located on chromosome 13
  Distance between a terminus base of telomere on chromosomal short arm and 5'-terminus of this base sequence : 73988829
  Distance between 3'-terminus of neighbour sequence of sequence listing upward to telomere on chrosomal short arm and 5'-terminus of this base sequence : 101917
acttctgagttgaacatatttcacacacacacacacacacacacacacacacacacacacgcacacacacatatatatatatatatatatatatatatatatatatatttagatggagtcttgctctgtcacccaggctagagtgcagtggtgtgatctcagctcactgcaacttccgcctcccaggttcaagcaattctcctgcctcagcctccgcagtagctgggattacaggtgcatgctaccacaccagctaatttttgtatttttaatagagatggggtttcaccatcttggccaggctggtcccaaactcctgacctcaggtgatcccccttggccttggcctcccaaagtgctgggattacaggcgtaagccactgtggctggccccgtatttctaatatttaacagcaaattggggtttctcttttttttggttgcctgtttatatcctttgt

SEQ ID NO: 20064 - DNA, 244 bp, Homo sapiens
  D13S1249
  Located on chromosome 13
  Distance between a terminus base of telomere on chromosomal short arm and 5'-terminus of this base sequence : 74088277
  Distance between 3'-terminus of neighbour sequence of sequence listing upward to telomere on chrosomal short arm and 5'-terminus of this base sequence : 98987
cacaaggaaatgccaaattctaacatcaaacagttatacccagagcaaataaaatttttccacattctcctttgcagaccagtcattgttactattacccattatatttgtaagaatgtacccaatttcttgatatactcctaggcatttgaacacacacacacacacacacacacacacacacacacacacacacacacacacacatatattttgagacatggtctcattttgttgcccaggc

SEQ ID NO: 20065 - DNA, 141 bp, Homo sapiens
  D13S1326
  Located on chromosome 13
  Distance between a terminus base of telomere on chromosomal short arm and 5'-terminus of this base sequence : 74166771
  Distance between 3'-terminus of neighbour sequence of sequence listing upward to telomere on chrosomal short arm and 5'-terminus of this base sequence : 78250
tgctttcaaaggatttaacacacacacacacacacacacacacacacacacagagtcacataaatctgaacagcaaatattttctatgtatttacacacacagaggcaaaccctgcagagtacatgtgtgcgggtgcatta

SEQ ID NO: 20066 - DNA, 284 bp, Homo sapiens
  chr13.fa.O7frz.74805519
  Located on chromosome 13
  Distance between a terminus base of telomere on chromosomal short arm and 5'-terminus of this base sequence : 74238289
  Distance between 3'-terminus of neighbour sequence of sequence listing upward to telomere on chrosomal short arm and 5'-terminus of this base sequence : 71377
aggtccacagataatgacaatataatattgggtatatatatatatatatatatgtatttgtgtgtgtgtgtgtgtgtgtgtgtgtgtgtgtgtgtgtgtgtgtgtgtgtgtatgcacactgtcagtagtatccatcccagccttgggaagaaatggatcttgaacttaccagcagaagcttccctgaagttagaatacctagggacaaggagaagtagcccaacaaaaaaggggtggttaacataggctgtggatggagaaaagtggtccacagtactcaactt

SEQ ID NO: 20067 - DNA, 450 bp, Homo sapiens
  chr13.fa.O7frz.74989740
  Located on chromosome 13
  Distance between a terminus base of telomere on chromosomal short arm and 5'-terminus of this base sequence : 74416842
  Distance between 3'-terminus of neighbour sequence of sequence listing upward to telomere on chrosomal short arm and 5'-terminus of this base sequence : 178269
cctgcacctagaaatgttaacctacagcttaaggctgttgtttttcaggctgcaggatgctaaagaaatgaaaatacatgatacagtactataatatcaatatttagcaacatggaattacctcacgcaattcatacacacacacacacacacacacacacacacacacgcatacttattttacatacagaatagatttcatatataataaattttaatccttgtcaaaaaactgaatgatttaaaaacataatgccacctaatttgaggaattatggaattggatatttaaaactgacacattctctagataattaaggcatactttttaaagcatcaagcctaagtacagcaaaatggctatggagtatttagaaattctgacttaattcaaggctctaccactcttaagctgtgcccttataagtggtacagaaagtgatatgagtc

SEQ ID NO: 20068 - DNA, 117 bp, Homo sapiens
  D13S166
  Located on chromosome 13
  Distance between a terminus base of telomere on chromosomal short arm and 5'-terminus of this base sequence : 74627648
  Distance between 3'-terminus of neighbour sequence of sequence listing upward to telomere on chrosomal short arm and 5'-terminus of this base sequence : 210356
agctatgaaattccccagatcgctgatttacacacacacacacacacacacacacacacacacacacacaccccttcaaaacagaaaagaaaacactcagggcagaatagcaaagtt

SEQ ID NO: 20069 - DNA, 193 bp, Homo sapiens
  AL139036.5_56442
  Located on chromosome 13
  Distance between a terminus base of telomere on chromosomal short arm and 5'-terminus of this base sequence : 74635830
  Distance between 3'-terminus of neighbour sequence of sequence listing upward to telomere on chrosomal short arm and 5'-terminus of this base sequence : 8065
gttctgcaatagtatctttggaagaaacagtaccccaatcctctgacatgtcctaacactgttgcttgccatctgaactcagtaaatgaatcaatttggataccatgagatttctggtgatggtggttttgttgttgttgttgttgttgttgtttttaattccctaaaggaaggacttacgtttacagaatga

SEQ ID NO: 20070 - DNA, 458 bp, Homo sapiens
  AL139036.6_56442
  Located on chromosome 13
  Distance between a terminus base of telomere on chromosomal short arm and 5'-terminus of this base sequence : 74635832
  Distance between 3'-terminus of neighbour sequence of sequence listing upward to telomere on chrosomal short arm and 5'-terminus of this base sequence : -191
tctgcaatagtatctttggaagaaacagtaccccaatcctctgacatgtcctaacactgttgcttgccatctgaactcagtaaatgaatcaatttggataccatgagatttctggtgatggtggttttgttgttgttgttgttgttgttgtttttaattccctaaaggaaggacttacgtttacagaatgatagggcccactgagtatcctgcaaaacttgacaaaaacaggccacataaaggcatgtcattgagaaattcagaacatctggaacaagacacttctacaagatttcagagagaaagaaaaaaaaagagtggggagagaaaagtaactgacaaatgtattgggaatcttaatggcatcccaatgtaatctagagtggaaggatgctttgaaatcccaaaggaaaattatttccaatcttcagttatagaccatactacattatcggtct

SEQ ID NO: 20071 - DNA, 282 bp, Homo sapiens
  D13S156
  Located on chromosome 13
  Distance between a terminus base of telomere on chromosomal short arm and 5'-terminus of this base sequence : 74669341
  Distance between 3'-terminus of neighbour sequence of sequence listing upward to telomere on chrosomal short arm and 5'-terminus of this base sequence : 33051
attagcccaggtatggtgacgcgtgcctgtagtccccgctactcaacaggctgaggtgggaggatcacctgagccccagaagtcaaggctgcactgaaccgtgattgtgccattgcactccagcctgggcgataggagacacacacacacacacacacacacacacacacacacacacacacacaaacatttaatacattctcatgtacaaaaactctaagtactctaggagagatacataaatccaagtctaagatgtgtttaagtaactcataccacagc

SEQ ID NO: 20072 - DNA, 330 bp, Homo sapiens
  G09019
  Located on chromosome 13
  Distance between a terminus base of telomere on chromosomal short arm and 5'-terminus of this base sequence : 74831117
  Distance between 3'-terminus of neighbour sequence of sequence listing upward to telomere on chrosomal short arm and 5'-terminus of this base sequence : 161494
ttttggtatttgggtagccagtattattatttattgagacagatacaagaaaagaagaaggttttcaattttgaacatgaacgtttgtgatgaatttgggacatacaggtgagacatttggtaggaagctgtatatcaggtttgaagaatgggagataagtttatctatctatctatctatctatctatctatctatctatctatctatcatctacaacattttggtattaaaagtctgaaagtggaaattaaagctatgggagtagatgaaattgctaggaaagtaatataggatcagagagagaaattgttgcatggaaaaatgagac

SEQ ID NO: 20073 - DNA, 277 bp, Homo sapiens
  AL356319.6_91800
  Located on chromosome 13
  Distance between a terminus base of telomere on chromosomal short arm and 5'-terminus of this base sequence : 74831241
  Distance between 3'-terminus of neighbour sequence of sequence listing upward to telomere on chrosomal short arm and 5'-terminus of this base sequence : -206
gaagctgtatatcaggtttgaagaatgggagataagtttatctatctatctatctatctatctatctatctatctatctatctatcatctacaacattttggtattaaaagtctgaaagtggaaattaaagctatgggagtagatgaaattgctaggaaagtaatataggatcagagagagaaattgttgcatggaaaaatgagacaggttttaaaacaaagcagatctagtaggaggaaaataaagacctgtgaaggaatgttaacattgtaaatg

SEQ ID NO: 20074 - DNA, 274 bp, Homo sapiens
  AL356319.6_156984
  Located on chromosome 13
  Distance between a terminus base of telomere on chromosomal short arm and 5'-terminus of this base sequence : 74838820
  Distance between 3'-terminus of neighbour sequence of sequence listing upward to telomere on chrosomal short arm and 5'-terminus of this base sequence : 7302
aaatacgttagaagttcaagtcacctctttgcagagacaaattattccagcaaaaaactagaaatatccggtctagattatccctatgtataacttatgtatttaaaagccttggaatccatctattatctatctgtcatctgtctatctatctatctatctatctatctatctatctatctatctatctgtctgtctatctacctatctatctatcatctatctatcatctttaaacccttggaatccatctattaactgtcatctatccacc

SEQ ID NO: 20075 - DNA, 130 bp, Homo sapiens
  D13S269
  Located on chromosome 13
  Distance between a terminus base of telomere on chromosomal short arm and 5'-terminus of this base sequence : 74844115
  Distance between 3'-terminus of neighbour sequence of sequence listing upward to telomere on chrosomal short arm and 5'-terminus of this base sequence : 5021
caaagtggttcatcttggtctattactgtgtttgtgtgtgtgtgtgtgtgtgtgtgtgtgtgtgtgtgtgtgtgtagtaaaaccaaagtttcctattatttttgaaggtatttggccctgctggaagaca

SEQ ID NO: 20076 - DNA, 384 bp, Homo sapiens
  chr13.fa.O7frz.75554408
  Located on chromosome 13
  Distance between a terminus base of telomere on chromosomal short arm and 5'-terminus of this base sequence : 74966816
  Distance between 3'-terminus of neighbour sequence of sequence listing upward to telomere on chrosomal short arm and 5'-terminus of this base sequence : 122571
ttataatcggctacagtccagggcttgctttggaggaatttatgaaaataaagtctcttcttttcttcttttttgtaaaaacagtaaaagaaagaaagaaaggaaagaaagaaagaaagaaagaaagaaagaaaaaatatcattttcttttgtgtgtgtgttcatttgtatatctttcttttttaatttattttttatttcaataggttttatgggaacaggtggtgtttggctacatgaataagttctttagtggtgatttctgagattttggtgcatcatcactcaagcagtgtacactgtacccaatgtggagtcttttatccctcatcccctcccaccctttttcccaagtccccaaagtccactgtatcattcttatgc

SEQ ID NO: 20077 - DNA, 455 bp, Homo sapiens
  chr13.fa.O7frz.75673508
  Located on chromosome 13
  Distance between a terminus base of telomere on chromosomal short arm and 5'-terminus of this base sequence : 75085948
  Distance between 3'-terminus of neighbour sequence of sequence listing upward to telomere on chrosomal short arm and 5'-terminus of this base sequence : 118748
gttcatctacagttaatgcgattactaatgtaagattccgatttgtcagtttgctttatttatttatttatttatttgggacagagtcttgctctgtcaccaagctggagtgcagtggcatgatcatggctcattgcagcctatgtcccagactcaagtgattctcacacctcaaccttccacgtagctgggactacaggcacatatcaccatgctaggctacttttatttttattttttgtagagatgaggtctccctatgttgcccaggctggtcttgaattcctgggctcaagcaatcctcccacctctgcctcccaaccagtttgctatttgttttctaattgccccatatattctttgtttactttttcccatttttttgcctttttattactaatcagtactcttttatatctctatctcttttgttggattacttgctataactctgt

SEQ ID NO: 20078 - DNA, 304 bp, Homo sapiens
  D13S792
  Located on chromosome 13
  Distance between a terminus base of telomere on chromosomal short arm and 5'-terminus of this base sequence : 75164233
  Distance between 3'-terminus of neighbour sequence of sequence listing upward to telomere on chrosomal short arm and 5'-terminus of this base sequence : 77830
tccagcactatggcaggaggggataaagtggactgccctacctcctgtaatctctaacatgtagatatgttgtataatattctatctatctatctatctatctatctatctatctatctatctatctatctatgaaaggaataatgggaatcttcagatgcaaagaggaaactcaaagcttgagaagtctgcatacgagcctacactggggcagctttggggtgatgtaagtttcagtcacaagcccaatgccgaggcctgaaatttcattgcccatgcagggtcaaaggcatgacaaggaact

SEQ ID NO: 20079 - DNA, 367 bp, Homo sapiens
  chr13.fa.O7frz.75971398
  Located on chromosome 13
  Distance between a terminus base of telomere on chromosomal short arm and 5'-terminus of this base sequence : 75383151
  Distance between 3'-terminus of neighbour sequence of sequence listing upward to telomere on chrosomal short arm and 5'-terminus of this base sequence : 218614
atcaacatagcaagacctcatttctataaaagaagcatatatattagctggggatgatagtgcaaacctgtgatcccagttacttaggagtttgaagtgggagaaccagttaagcccagttggtcagggctgcagtgagttgtcatcatgccactgccctccagcctgggcaacagcgtgagaccctgtctcaaataataataataataataataataataataataataataataataataacaattatattggatcctcatatatttttatttaactaaagtatttacagcctttaggaataaaaattatagatatttcctcagagatcaaatttatagaaatgatatttgacagatttgctaat

SEQ ID NO: 20080 - DNA, 182 bp, Homo sapiens
  D13S771
  Located on chromosome 13
  Distance between a terminus base of telomere on chromosomal short arm and 5'-terminus of this base sequence : 75383313
  Distance between 3'-terminus of neighbour sequence of sequence listing upward to telomere on chrosomal short arm and 5'-terminus of this base sequence : -205
agcctgggcaacagcgtgagaccctgtctcaaataataataataataataataataataataataataataataataataacaattatattggatcctcatatatttttatttaactaaagtatttacagcctttaggaataaaaattatagatatttcctcagagatcaaatttatagaaa

SEQ ID NO: 20081 - DNA, 249 bp, Homo sapiens
  AL139375.18_5070
  Located on chromosome 13
  Distance between a terminus base of telomere on chromosomal short arm and 5'-terminus of this base sequence : 75430656
  Distance between 3'-terminus of neighbour sequence of sequence listing upward to telomere on chrosomal short arm and 5'-terminus of this base sequence : 47161
ttcctacatctttgagcttcagttttcttatacttagaatgggtaagcattctaaagagagagagagagagagagagaaatgaggaggggaattggctcacatgattatagaggatgagaagtcccaccataggtcctctgcaagctggagaaccagggaaactggtagtgtggctcagtccaaggccaaaggccttaaaaccagggaaactgatggtgtgaccctcggtctgaggtcaaagttccaac

SEQ ID NO: 20082 - DNA, 381 bp, Homo sapiens
  AL139375.18_81142
  Located on chromosome 13
  Distance between a terminus base of telomere on chromosomal short arm and 5'-terminus of this base sequence : 75506528
  Distance between 3'-terminus of neighbour sequence of sequence listing upward to telomere on chrosomal short arm and 5'-terminus of this base sequence : 75623
tcagataagatgttctcggaagaacacttgcccaggaataatgacatctccaccagtgaactgacaattctggctttgaacttctagagccagtgaactctgtttctaagcagcttatgcaaatttctttttgcgaataaaagcttccctttagccttcccctcacggaatgccttgccatttcatgcagtctggattataatccttatttatattcctgagtaaacaaaacatatttacagaaaattttctctagtgtgtgtgtgtgtgtgtgtgtgtgtgtgttttcaggttgacatgggcctgtccagtttgccataggaatctgaagttctcaccctttggagtttccactaggggttaaagccttggtctaggaga

SEQ ID NO: 20083 - DNA, 192 bp, Homo sapiens
  AL139375.18_137711
  Located on chromosome 13
  Distance between a terminus base of telomere on chromosomal short arm and 5'-terminus of this base sequence : 75563265
  Distance between 3'-terminus of neighbour sequence of sequence listing upward to telomere on chrosomal short arm and 5'-terminus of this base sequence : 56356
ccttcatggtaatgaaatagttctgcatcttgattgattagtggtcccatggatgtatacatggaatcaaatttcatagaactgcaaacacacacacacacacacacacacacacacacacacacacaccattagtgatttaaaaacaggtcaaataagatctatagtctagttaacagcattgtatcgatg

SEQ ID NO: 20084 - DNA, 244 bp, Homo sapiens
  AL157361.6_31219
  Located on chromosome 13
  Distance between a terminus base of telomere on chromosomal short arm and 5'-terminus of this base sequence : 75663981
  Distance between 3'-terminus of neighbour sequence of sequence listing upward to telomere on chrosomal short arm and 5'-terminus of this base sequence : 100524
ttaccataaagcttcatgctaaacacatcaccaaaactgagctgaatgtggtcagtatttactagctaaaagtaaatatcattatgagacattttatagacacacacacacacacacacacacacacacatctcctgtaatcttcatcttcttcaggagcaactatgttcaaattttacttctgtaattgacttcaaaatttctcagtaataggtgtattctgctatcactacatcaatttcag

SEQ ID NO: 20085 - DNA, 474 bp, Homo sapiens
  chr13.fa.O7frz.76799801
  Located on chromosome 13
  Distance between a terminus base of telomere on chromosomal short arm and 5'-terminus of this base sequence : 75846807
  Distance between 3'-terminus of neighbour sequence of sequence listing upward to telomere on chrosomal short arm and 5'-terminus of this base sequence : 182582
atcacctaaggtcaggagttcgagaccagcctgaccaacatggtgaaaccccatctctactaaaaatacaaaaattaaccaggcatggtggcgcacacctgtaatcccagctactcaggaggctgaggcaggagaatcgcttgaacccgggaggcagaggttgcagtgagccaagatcgagccattgcactccagcctaggcaacagagtgagagcgagactccgtttaaaaaaagtaacaataataaattagccaggcgtggggtgtgtgcccgtaatcccagctactcaggaggctgaggtgggaggattgcttgaacctgggaggcagaggctgcagtgagccaagatggcgccactgcactccagcatgggtgacagagcgagattccctctcaaataaataaataaataaataaataaataaataaataaatgcccatttcccagaaagtctaaatcattctatcaagg

SEQ ID NO: 20086 - DNA, 192 bp, Homo sapiens
  D13S162
  Located on chromosome 13
  Distance between a terminus base of telomere on chromosomal short arm and 5'-terminus of this base sequence : 75988515
  Distance between 3'-terminus of neighbour sequence of sequence listing upward to telomere on chrosomal short arm and 5'-terminus of this base sequence : 141234
gcaatctgaaacattctccatttaaaagatcatttgtctaccccaatctatacattttacttggtacatacacttttactttaaaaacaatttcattttccatgtggtcttccatccctagtaaacacacacacacacacacacacacacacacacacacacacacagtatcatgcattatctgtgatgaaa

SEQ ID NO: 20087 - DNA, 411 bp, Homo sapiens
  AL137244.23_73453
  Located on chromosome 13
  Distance between a terminus base of telomere on chromosomal short arm and 5'-terminus of this base sequence : 76149064
  Distance between 3'-terminus of neighbour sequence of sequence listing upward to telomere on chrosomal short arm and 5'-terminus of this base sequence : 160357
taagcatactaatagcaaaggaactgtcatgggtacctcattatcctttatgtatgtatgtatgtatgtatgtatgtatgtatgtatatatatgtttatgtttacttattttttgagacagcatctcactctgtcgcccaatctggagtgcagtggtgcgatctcagttcattgcaacccatgcctcccaggtacaagtgattcttctgcctcagtctctggagtagctgggatttcaggcgtgtgccactatacctggctaattttttgtatttttagtagagacagggtttcaccatgttggtcaggctggtcttgaactcctgattttgaatgatctgcccactttggtctcccagagtgctgggattataggtgtgactcattaccctttaaagtcaatcatggtgg

SEQ ID NO: 20088 - DNA, 427 bp, Homo sapiens
  chr13.fa.O7frz.77304758
  Located on chromosome 13
  Distance between a terminus base of telomere on chromosomal short arm and 5'-terminus of this base sequence : 76282029
  Distance between 3'-terminus of neighbour sequence of sequence listing upward to telomere on chrosomal short arm and 5'-terminus of this base sequence : 132554
tccttacatttccagtaaagaaccgaagctggccgggcgctgtggctcatgcctgtaatcccagcactttgggaggtcaaggcgggtggatcacgaggtcaggagattgagaccagcctggccaatgtggtgaaaccctgtctctactaaaaatacaaaaatgagccgggcatggtggtgtgtggctgtagttccagctacttgggaagctgaggcaggagaatggcttgaacctgggaggcgcaggttgcagtgatccgagattgtgccattgcactccagcctgggcgacagagtgagactccatctcaaaaaaacaaacaaacaaacaaacaaacaaaaacccgaagcatttaaagctgtgagatgagatgatgatttagtacaaattgtttcatataaggaaatcaagtctcataagaacctt

SEQ ID NO: 20089 - DNA, 322 bp, Homo sapiens
  chr13.fa.O7frz.77178251
  Located on chromosome 13
  Distance between a terminus base of telomere on chromosomal short arm and 5'-terminus of this base sequence : 76408691
  Distance between 3'-terminus of neighbour sequence of sequence listing upward to telomere on chrosomal short arm and 5'-terminus of this base sequence : 126235
cagatgttcctcatacattacttcggcagtgtgttgctacaattatttttagaaactatatatatatatatatatatatatatatatatagtttctaaaaattatatatatataataaaatatatatatatatatataaaacttttgctccagcaagcctacttttggaaatctgtgctataaaaataaaagttccaattataaagagttatagatatttgttgcagtagttttggaagtgacagaacatttcaaacaactttaaatgcacatcaaatgaataaattgttgatgtccatactatggaacattcagcaagtaa

SEQ ID NO: 20090 - DNA, 208 bp, Homo sapiens
  Z66820
  Located on chromosome 13
  Distance between a terminus base of telomere on chromosomal short arm and 5'-terminus of this base sequence : 76611257
  Distance between 3'-terminus of neighbour sequence of sequence listing upward to telomere on chrosomal short arm and 5'-terminus of this base sequence : 202244
agaaatatgagccagacactgacttctggtgtgtgtgtgtgtgtgtgtgtgtgtgtgtttgtgtaatttccaaatatgtgggcaccttatgtagatacacataagattcaactaggcatcttatcttaaaaatcactcaaaagtaaaataactttatacaaagttggaatatcaatcgaaagcatatacgccacaacagaagaactat

SEQ ID NO: 20091 - DNA, 405 bp, Homo sapiens
  chr13.fa.O7frz.77750454
  Located on chromosome 13
  Distance between a terminus base of telomere on chromosomal short arm and 5'-terminus of this base sequence : 76813127
  Distance between 3'-terminus of neighbour sequence of sequence listing upward to telomere on chrosomal short arm and 5'-terminus of this base sequence : 201662
cagtttacagatgctacaggagcactaactcatgggtgtgatcatcatggctctggagctggatgcttgaagctctgatgagaaaagtccccaaggggagttgtggtcccagaggaaatccaatctaagattgtcctgtgctacttaatccagctgtcacatgtaacttcctgggtcccccttctaccatattcttctttccaatgtaaataattacaaacacaattactggactgtcaaaaggcagtactgtgatatttatatagaagagtcaaaaattcctggaggaaaaactatcatcacacacacacacacacacacacacacacacaaacacacacacacacagctctatgccttataatgacattttggtcaatgatagactgtatagctgatggaagt

SEQ ID NO: 20092 - DNA, 346 bp, Homo sapiens
  chr13.fa.O7frz.77845485
  Located on chromosome 13
  Distance between a terminus base of telomere on chromosomal short arm and 5'-terminus of this base sequence : 76918029
  Distance between 3'-terminus of neighbour sequence of sequence listing upward to telomere on chrosomal short arm and 5'-terminus of this base sequence : 104497
tttaccactaggtatgattctcataactgtgagccaaagcattgcatttcctggatctaagccaacataaaaataaagtctgaaacccacagctgggagtctctttagaatgccttctttaaacattggttcatggaggggaagtgccaagaaaaaaaataaaagtgtgtgtgtatgtgtgtgtgtgtgtgtgagagagagagagggagagaagaaagaagatctcaaagaagtgccataagatccagatagtcacattgcctccaaccatttttggtatagttatgagtttggagaaaagaaataataatctcaaccacttgcctgtcttaactccagatgctta

SEQ ID NO: 20093 - DNA, 250 bp, Homo sapiens
  D13S782
  Located on chromosome 13
  Distance between a terminus base of telomere on chromosomal short arm and 5'-terminus of this base sequence : 77145887
  Distance between 3'-terminus of neighbour sequence of sequence listing upward to telomere on chrosomal short arm and 5'-terminus of this base sequence : 227512
ccaaggagcttggactacaagcatgtgctaccacacttagctattattattattattattattattattattattattattattgtatttcttgtagagactgggttttgccatgttgcccaagctggtctcgaactcctgggctcaagcgatccacctgccttggcctcccaaagtgctgggattacaggcatgcaccactgtgcctggcctgattcttaagagatcagaattccaatgtttgccaaaa

SEQ ID NO: 20094 - DNA, 135 bp, Homo sapiens
  DISO7_10003787
  Located on chromosome 13
  Distance between a terminus base of telomere on chromosomal short arm and 5'-terminus of this base sequence : 77284634
  Distance between 3'-terminus of neighbour sequence of sequence listing upward to telomere on chrosomal short arm and 5'-terminus of this base sequence : 138497
tctgctgaggctcttcatctgttttctttcctggtgtgtgtgtgtgtgtgtgtgtgtgtgtgtgttgccctgctttacttatcccctcataaagctttgcatccctataaatgacatttgctaacatcttagtgc

SEQ ID NO: 20095 - DNA, 125 bp, Homo sapiens
  DISO7_10003788
  Located on chromosome 13
  Distance between a terminus base of telomere on chromosomal short arm and 5'-terminus of this base sequence : 77304993
  Distance between 3'-terminus of neighbour sequence of sequence listing upward to telomere on chrosomal short arm and 5'-terminus of this base sequence : 20224
actaccacctccatgttggcatcaccccagcactacctctacacacacacgcatacacacacgcgcatacacacacacacatacacacacacatatacagacacaccagtgacagaagtaaggtc

SEQ ID NO: 20096 - DNA, 192 bp, Homo sapiens
  AC000403.1_32296
  Located on chromosome 13
  Distance between a terminus base of telomere on chromosomal short arm and 5'-terminus of this base sequence : 77494391
  Distance between 3'-terminus of neighbour sequence of sequence listing upward to telomere on chrosomal short arm and 5'-terminus of this base sequence : 189273
gacaatggctccatgaaaccaaatgaaagaggagctcaaagaataaattatagcccaaaatgtttaagcacacagaattttttaatgtactcttcaacaccccttctctctctctctctctctctctctctcacacacacacacacacacacacacacacacacatttttctacatcaacagtaaccatcaa

SEQ ID NO: 20097 - DNA, 287 bp, Homo sapiens
  AC000403.1_101556
  Located on chromosome 13
  Distance between a terminus base of telomere on chromosomal short arm and 5'-terminus of this base sequence : 77563631
  Distance between 3'-terminus of neighbour sequence of sequence listing upward to telomere on chrosomal short arm and 5'-terminus of this base sequence : 69048
gagtctcagcctcttgttactaaactttgtatttcactaaagtatatgctaagattctaaacattctctcttcgtatgttgttttataaaattgaataatagctcctatctgatataccatatatacatacatatatgagcttagaatctcatatatatatatatatatatatatatatatatatatatatatatatatatgagaaaagactttgaatattctgaagggcaagaaagatgcagatgcagatacaggctgggcatggtggctcatacctgtaatagca

SEQ ID NO: 20098 - DNA, 455 bp, Homo sapiens
  AC001226.1_102681
  Located on chromosome 13
  Distance between a terminus base of telomere on chromosomal short arm and 5'-terminus of this base sequence : 77657056
  Distance between 3'-terminus of neighbour sequence of sequence listing upward to telomere on chrosomal short arm and 5'-terminus of this base sequence : 93138
ggtcttaaattaagctatcggaacaccaagtcatcaaagaaatgtatcataaggaaaaatataaaggctaaaattttatagagcttattatgtgcacgctgttcttctaagtgccacatatgtatatatgtgtgtgtatatatatatatgcatgcacgtgtgtgcacacgcacacacacacacacacacacacacacacacacacacaaatcttatctaatcttcgcaacaaccccagaaggtaaattgtaatattttgcctactttacaggtaagaaaactgaggtaagaaactcttttgtttaagaatcaaaaatgatgcttggttttacatttcttaagatagagagccagaagagaatgtccctttcgccctaacaatgaggaaaaacctgatcatctacaaaaccaaaactttttttttggagtccattagaatgttgagatcagctacc

SEQ ID NO: 20099 - DNA, 197 bp, Homo sapiens
  D13S1306
  Located on chromosome 13
  Distance between a terminus base of telomere on chromosomal short arm and 5'-terminus of this base sequence : 77657137
  Distance between 3'-terminus of neighbour sequence of sequence listing upward to telomere on chrosomal short arm and 5'-terminus of this base sequence : -374
agcttattatgtgcacgctgttcttctaagtgccacatatgtatatatgtgtgtgtatatatatatatgcatgcacgtgtgtgcacacgcacacacacacacacacacacacacacacacacacacaaatcttatctaatcttcgcaacaaccccagaaggtaaattgtaatattttgcctactttacaggtaagaa

SEQ ID NO: 20100 - DNA, 327 bp, Homo sapiens
  chr13.fa.O7frz.78769712
  Located on chromosome 13
  Distance between a terminus base of telomere on chromosomal short arm and 5'-terminus of this base sequence : 77752775
  Distance between 3'-terminus of neighbour sequence of sequence listing upward to telomere on chrosomal short arm and 5'-terminus of this base sequence : 95441
aaagcaattcctaaaatctaagataaaataaatgactctctaagtgtatatccaatgaatgcataatcatgcagagggagcattccaacttactttaaacacagtaatttgacatacacttagatgggatatacttcaaagacaaaacacacacatacacacacacacacacacacacacacacacacacacacacacacacacaccaaatgaaataatttaatgattttctaattctgatattcccagtgtcactaataggaattttagatataagagaaaggagactgaggtgtgtctgtggtccttgtttgaattagtatcaac

SEQ ID NO: 20101 - DNA, 398 bp, Homo sapiens
  chr13.fa.O7frz.79804238
  Located on chromosome 13
  Distance between a terminus base of telomere on chromosomal short arm and 5'-terminus of this base sequence : 77814591
  Distance between 3'-terminus of neighbour sequence of sequence listing upward to telomere on chrosomal short arm and 5'-terminus of this base sequence : 61489
tataattggccatttaagtatgagcacatctgtattttccctaagatgaatatgttgtgtgtgtgtgtgtgtgtgtgtgtgtgtgtgtgtgtataccatgtaacactgaaactacagtagctacaaagccttggcaactatgtaactaaaatattatatgtatgtacacattatatataattatatacacatatttgtatacacagagaaaaaagagggttcagtatctaagggactctaacttctaattttaatttttactaaaatctatacttttggagggtaatcctacagtcatgcatataacagaaactaccacagaacacagtgagtacttggagcaaaatcattaaaacaaatcagcaaggacaaaagtagttgcaatttactaagcactt

SEQ ID NO: 20102 - DNA, 457 bp, Homo sapiens
  chr13.fa.O7frz.79692251
  Located on chromosome 13
  Distance between a terminus base of telomere on chromosomal short arm and 5'-terminus of this base sequence : 77903670
  Distance between 3'-terminus of neighbour sequence of sequence listing upward to telomere on chrosomal short arm and 5'-terminus of this base sequence : 88681
atcacgaggtcaggagttcgagaccatcctggtccacatggtgaaaccccgtctctactaaaaacacaaaaattagctgggcgtggtgatgtgcacctgtagtcccagcaactcaggaggctgaggtaggagaactgcttgaacccgggaggcggaggttgcagtcagctgagatcacgccattgcactccagcttgggcaacagagcaagactccgtctcaaaacataacataacataacataacataacataacataacataacataacataacataacataacataacagtgggtcccttattctgaaatgatccctgtagtagaggatcaaacatcctgcaagccctcaaacagtagtcctgggtgagaccctgctggaaagacaaattcagacccagaatatgtctcaaatccaatcaaaatgaatcatggtcctttccactgtataaggac

SEQ ID NO: 20103 - DNA, 437 bp, Homo sapiens
  chr13.fa.O7frz.79895223
  Located on chromosome 13
  Distance between a terminus base of telomere on chromosomal short arm and 5'-terminus of this base sequence : 77982696
  Distance between 3'-terminus of neighbour sequence of sequence listing upward to telomere on chrosomal short arm and 5'-terminus of this base sequence : 78569
tttaggctcattaagtgtaagaacaggactaattttaaagttatactattttactctaaattaaaaattcggtttatcaatttcatagtgaaaacagttataaatgtatttttgtgtggaattaagcatctaatttttttgtaaaccaccttcctctcttctttcctttcttccttcttccttccttcctccctcccttctttccttccttcctcccttctttccttcctctctttctttccctccgttcctccctgccttccctacctacctccctgttccttccttcctctctttctctttcttctttccttctccctttctttttttctctctcttctccccttccttccttctctccttccttccttcctgccttccttcctgcctctcttctttttttgttaaattttaactacagttagaagtcattggtg

SEQ ID NO: 20104 - DNA, 468 bp, Homo sapiens
  chr13.fa.O7frz.80005756
  Located on chromosome 13
  Distance between a terminus base of telomere on chromosomal short arm and 5'-terminus of this base sequence : 78105380
  Distance between 3'-terminus of neighbour sequence of sequence listing upward to telomere on chrosomal short arm and 5'-terminus of this base sequence : 122247
gtgccattgtagctcattatagcctccaattcctgggctcaagagatcctccctcttcagccttctgagtagctgggaccataggtgtgtgccaccttgcccagcctttttttttttatttatttttctgtagatatggggttttgttgatgttgctcaggctggtctcaatctcctggcctcaggccactctcttgccttggacttccaaagtgttgggattacaggcatgagccaccatacctggcccagaatttctttcttttcttttctttcttttccttccttccttccttccttccttccttccttccttccttccttccttcccttccttccctccctccctccctccctcctttctttctttctttcttttctattttctttgtaaaataatatacttaaaatagtacttatgttattctttttaatttataattgtgtattctgctttataagatcaaa

SEQ ID NO: 20105 - DNA, 280 bp, Homo sapiens
  chr13.fa.O7frz.80123474
  Located on chromosome 13
  Distance between a terminus base of telomere on chromosomal short arm and 5'-terminus of this base sequence : 78223136
  Distance between 3'-terminus of neighbour sequence of sequence listing upward to telomere on chrosomal short arm and 5'-terminus of this base sequence : 117288
caacttctgataggtgagtatgtctttatttccatacataaaaagtacacacatacagacacacacacacatatatatatatatatacacacacacaggcacacacacatatatataaatatatatacatatatataaatatatatacatatataaacatatatacatatataaacatatatacatatataaacatatatacatatataaatatatatacatatataaataaatatatatatatatatatttcttgctgttctttgtacttggagatggt

SEQ ID NO: 20106 - DNA, 213 bp, Homo sapiens
  G12416
  Located on chromosome 13
  Distance between a terminus base of telomere on chromosomal short arm and 5'-terminus of this base sequence : 78240508
  Distance between 3'-terminus of neighbour sequence of sequence listing upward to telomere on chrosomal short arm and 5'-terminus of this base sequence : 17092
gggcacagatcaaaaccatatcatctagcttggttaaatcctcaatcactggactcccagtctatctatctatctatctatctatctatctatctatctatctatctatctatctgatagataatagatgtacatatattcagggtacatgtgataatttgatacattcatataacctataaagatcaaatcagggtaactggggtattgacc

SEQ ID NO: 20107 - DNA, 243 bp, Homo sapiens
  chr13.fa.O7frz.80306788
  Located on chromosome 13
  Distance between a terminus base of telomere on chromosomal short arm and 5'-terminus of this base sequence : 78324020
  Distance between 3'-terminus of neighbour sequence of sequence listing upward to telomere on chrosomal short arm and 5'-terminus of this base sequence : 83299
atttaggtaactgcttggagactgacctttgaagttttttagtatctgttgccaaatgttgattaaaggaatgactctagatgttgtaaacgttgggcatctgaatcattctggagcactacacacacacccacacacacacacacatatacacatacatatatacatatacatatatatacacatatatacatatacatatatatatatttttttctcaggtacacggcattacttatgaag

SEQ ID NO: 20108 - DNA, 345 bp, Homo sapiens
  chr13.fa.O7frz.80379054
  Located on chromosome 13
  Distance between a terminus base of telomere on chromosomal short arm and 5'-terminus of this base sequence : 78396330
  Distance between 3'-terminus of neighbour sequence of sequence listing upward to telomere on chrosomal short arm and 5'-terminus of this base sequence : 72067
tcagtactgatcaggatttgatgtgaaaaagtacacacacacacacacacacacacacacacacacacacacacacagagagagagagagagagagagagagaaacttgagcaactacctagagtgcaaagactccaatagtggttatatatgtcaccataagctttgacagtgaagctcagaataagctagtatacttggcatagatcatactttagataggacacatttttttaaaatcatactctcttctaccacctcgtggcagacttgaggcattgagctgtccccttggctttccatttacgaatggtggcttattcctgccatagtttacagaaagtg

SEQ ID NO: 20109 - DNA, 283 bp, Homo sapiens
  D13S1281
  Located on chromosome 13
  Distance between a terminus base of telomere on chromosomal short arm and 5'-terminus of this base sequence : 78474607
  Distance between 3'-terminus of neighbour sequence of sequence listing upward to telomere on chrosomal short arm and 5'-terminus of this base sequence : 77932
caaatctgaacctcttacctcagtatataagaccctttctgactttgcttatgttgaacacacacacacacacacacacacacacacacacacacacacacctttcagaagtcatgttctttctcatctctgggttatgtgcatgctgtcccctctcctgggaaatatttctctgttcttgtgctccccactggccaacttactcactctagactccagttgaaatgtcacttaccctaagaagactttcttaagtgccacagattccaagtgactctgtgct

SEQ ID NO: 20110 - DNA, 114 bp, Homo sapiens
  HUMUT7663
  Located on chromosome 13
  Distance between a terminus base of telomere on chromosomal short arm and 5'-terminus of this base sequence : 78541761
  Distance between 3'-terminus of neighbour sequence of sequence listing upward to telomere on chrosomal short arm and 5'-terminus of this base sequence : 66871
ctctattctgttccattggggtgtgtgtatgtgtgtgtgtatctatctatctatctatctatctatctatctatctatctatctatctatttttatgccagtaccatactgttt

SEQ ID NO: 20111 - DNA, 464 bp, Homo sapiens
  chr13.fa.O7frz.80830541
  Located on chromosome 13
  Distance between a terminus base of telomere on chromosomal short arm and 5'-terminus of this base sequence : 78631771
  Distance between 3'-terminus of neighbour sequence of sequence listing upward to telomere on chrosomal short arm and 5'-terminus of this base sequence : 89896
agtgctacaaagcatacagtaattgcatttttctcttcatatatggttttttagtttttaatgaatgttttcatatatactattaattataaaattcctgtgaaatattcattgttaccctatttttcgcatatgggaactgagcaaaaggggttgttcaaggccactccaccaataagagccaaatttggaaggagagtgcaggtctcacagctgctgctccaggatgcaacccgttgtgttgcactgtcccttgataattggattttaatcaggtctgtggataagtctcacacacacacacatacacacacacatgcaaaacagaactttggataagatacaagaaaaatgatctcaccaagaatgtactttagtgagaggaagcagttacttcaacatagacaaaggcgaacagcagacaaggaggaagcaattaaatagaaggagtccactagtttgtt

SEQ ID NO: 20112 - DNA, 158 bp, Homo sapiens
  D13S789
  Located on chromosome 13
  Distance between a terminus base of telomere on chromosomal short arm and 5'-terminus of this base sequence : 78760496
  Distance between 3'-terminus of neighbour sequence of sequence listing upward to telomere on chrosomal short arm and 5'-terminus of this base sequence : 128261
agttttaaatcacaaaaatagatcgatgatagatagatagatagatagatagatagatagatagatagagtcacctggcctgttgcaatgtattttcagtgttctaaagcaacatggggaacaggagataagtcagaaacctggctgttgacaatttc

SEQ ID NO: 20113 - DNA, 215 bp, Homo sapiens
  chr13.fa.O7frz.81183946
  Located on chromosome 13
  Distance between a terminus base of telomere on chromosomal short arm and 5'-terminus of this base sequence : 78967859
  Distance between 3'-terminus of neighbour sequence of sequence listing upward to telomere on chrosomal short arm and 5'-terminus of this base sequence : 207205
tgaagtctgatacataatgcatactagcctcaaagaaagcacccaaaaagaccaccccaacaaaatatctagtttcttgtgtggaaagcacacagggagtaacatgaaagcatgtatgcacgcacatgcacgcatgcgtgcgcgcgcgcacacacacacacacacacacacacacacacacaattgcgttcttcatgacataatcacttaagttc

SEQ ID NO: 20114 - DNA, 400 bp, Homo sapiens
  chr13.fa.O7frz.81274364
  Located on chromosome 13
  Distance between a terminus base of telomere on chromosomal short arm and 5'-terminus of this base sequence : 79024165
  Distance between 3'-terminus of neighbour sequence of sequence listing upward to telomere on chrosomal short arm and 5'-terminus of this base sequence : 56091
ctactgcttaactttgatgcattgcaatcactggttttcttcactaaagtgcttttacacacccctcccataaattgacttaagagttagaaatggaacatacgacacaacttggatgctcaatggaaaattgcctaagaaagtattttatgttaggtttacaaagtaatacatacacacacacacacacacacacacacacacacacacacacactttttctagaaggcctggtttgaggatgttgtgtttctttgttgatttgtgtctgtgtatatgtgtgtttttctacgatataagctgtttctctgagtcaatataacttgcattttcttaaatttcaagtgatcatattcaaagatcagataaaaggatccagttgtcagtctttaaacagcat

SEQ ID NO: 20115 - DNA, 190 bp, Homo sapiens
  Z67792
  Located on chromosome 13
  Distance between a terminus base of telomere on chromosomal short arm and 5'-terminus of this base sequence : 79189827
  Distance between 3'-terminus of neighbour sequence of sequence listing upward to telomere on chrosomal short arm and 5'-terminus of this base sequence : 165262
ctattgtctaagggtgggcaccttttagaataaaaaagacgagatgcgcgcacgcccctctatgtgtgtgtgtgtgtgtgtgtgtgcgtgcgtgtgtgtgtatgtgtgtatgtttcttctccctgatagcaagccttgaatatatgagcattacttaggcattcctcctcttcgggatgcctaacaagct

SEQ ID NO: 20116 - DNA, 229 bp, Homo sapiens
  D13S160
  Located on chromosome 13
  Distance between a terminus base of telomere on chromosomal short arm and 5'-terminus of this base sequence : 79190421
  Distance between 3'-terminus of neighbour sequence of sequence listing upward to telomere on chrosomal short arm and 5'-terminus of this base sequence : 404
cgggtgatctaaggcttctagtaatcaaaaggaaaaaacagttaacagggtgtagttgggatccttcctcccctcagcgtacacacacacacacacacacacacacacacacacacactttatgctgggaactccaggaaaactgcttcagagaaaagggaataagatgttgaaaagagaactttcttttcccttccatctttttggctttttgcctcatatctctgcc

SEQ ID NO: 20117 - DNA, 453 bp, Homo sapiens
  chr13.fa.O7frz.81560712
  Located on chromosome 13
  Distance between a terminus base of telomere on chromosomal short arm and 5'-terminus of this base sequence : 79324119
  Distance between 3'-terminus of neighbour sequence of sequence listing upward to telomere on chrosomal short arm and 5'-terminus of this base sequence : 133469
ccttactgagctgtgaatctataggatatgagttaataccttatctctttggccacaggggttggcttaaagatgaatgaccttcatgccaatttagtctaattaatgaccctgggattttgctgggactatcgggaaactggcacttgctttccactgggtttatgaattgaaatgataatctaaattggtagctgctggtcttcatctttgccacataaaggcaactccaagaaaggcagcctgagaaatgcccagagagaagcagagctggatgacacatatttgaatctttggctcctcatggagcctcttacacacacacacacacacacacacacagagagagagagagagagagagagagagagattacccaggcctggtggtacagtgggaggatcacttggagcccggtgtttgaggctgcagtaagctactgtgccactgtac

SEQ ID NO: 20118 - DNA, 400 bp, Homo sapiens
  chr13.fa.O7frz.81580298
  Located on chromosome 13
  Distance between a terminus base of telomere on chromosomal short arm and 5'-terminus of this base sequence : 79343852
  Distance between 3'-terminus of neighbour sequence of sequence listing upward to telomere on chrosomal short arm and 5'-terminus of this base sequence : 19280
agctatcacctacgtttaggacacatcttttgcattggccaaaacagaaacagcctttattttgtgtatactgttacttacagactccaatcatcctgagttgggtggtaaacagatgcatactgaaattctagaccatattttgttataaggtaaagatcaagcccagacacacacacacacacacacacacacacacacaccacatccatatttatatatggttgtgcacatgtgcccttggtaacattttggagaatttggaaactataatttgtaaggttatataggccaaattttctcaccaaaataaatgagaaattctatttttaaaaatctagatagaaatgttcaggcccttaaaagctaaaaaataccgtcctaaaacctggttaacaga

SEQ ID NO: 20119 - DNA, 141 bp, Homo sapiens
  DISO7_10003791
  Located on chromosome 13
  Distance between a terminus base of telomere on chromosomal short arm and 5'-terminus of this base sequence : 79376631
  Distance between 3'-terminus of neighbour sequence of sequence listing upward to telomere on chrosomal short arm and 5'-terminus of this base sequence : 32379
tgttggttgctgtctgaagtttgatccttccttccttccttccttccttccttccttccttccttccttccttccttccttccttccctcctctgaagagaattttcagttctcttcagactctatacattaaccttggaa

SEQ ID NO: 20120 - DNA, 175 bp, Homo sapiens
  DISO7_10003793
  Located on chromosome 13
  Distance between a terminus base of telomere on chromosomal short arm and 5'-terminus of this base sequence : 79557544
  Distance between 3'-terminus of neighbour sequence of sequence listing upward to telomere on chrosomal short arm and 5'-terminus of this base sequence : 180772
gtctatatcctgcgagaaagctatataggtattttacatgtatatgtgtgtgtgtgtgtatatgtgtgtgtgtgtatatatgtgtgtgtgtatatttatacagacatgtattttatatataatttatacatatatttatacagacatgtatttttgatcatcagttcctccttgc

SEQ ID NO: 20121 - DNA, 157 bp, Homo sapiens
  DISO7_10003795
  Located on chromosome 13
  Distance between a terminus base of telomere on chromosomal short arm and 5'-terminus of this base sequence : 79586846
  Distance between 3'-terminus of neighbour sequence of sequence listing upward to telomere on chrosomal short arm and 5'-terminus of this base sequence : 29127
tgtctcatggattgcagatcattaatgtaaattagactatttctatatttgatttcttaatttttaaaaggaaaagaacagctcactctcacacacatacacacacacactctcttttttttcttgaaaattttaaatggctctccagacacctctt

SEQ ID NO: 20122 - DNA, 141 bp, Homo sapiens
  DISO7_10003796
  Located on chromosome 13
  Distance between a terminus base of telomere on chromosomal short arm and 5'-terminus of this base sequence : 79696983
  Distance between 3'-terminus of neighbour sequence of sequence listing upward to telomere on chrosomal short arm and 5'-terminus of this base sequence : 109980
gtagctgtcataaagtcagaatctctatcgaaagaaagaaagaaagaaagaaagaaagaaagaaagaaagaaagaaagaaagaaagaagaaagaaaacttgctaaaatactgtcttctttttagctgagctaatggcttcc

SEQ ID NO: 20123 - DNA, 101 bp, Homo sapiens
  DISO7_10003798
  Located on chromosome 13
  Distance between a terminus base of telomere on chromosomal short arm and 5'-terminus of this base sequence : 79739338
  Distance between 3'-terminus of neighbour sequence of sequence listing upward to telomere on chrosomal short arm and 5'-terminus of this base sequence : 42214
aactcatcctaacttgaaatgaacttgctaatacacacacacacacacacacacacacacacacacacacacacacctcagctctgtgcctcatactgttt

SEQ ID NO: 20124 - DNA, 171 bp, Homo sapiens
  D13S1255
  Located on chromosome 13
  Distance between a terminus base of telomere on chromosomal short arm and 5'-terminus of this base sequence : 79815412
  Distance between 3'-terminus of neighbour sequence of sequence listing upward to telomere on chrosomal short arm and 5'-terminus of this base sequence : 75973
catctgggtgtaatgcatgtaaattcacaaccctactacacaagtggcctcatatatgtgtgtgtgtgtgtgtgtatgtgtgtgtgtatatatatgtgcatgtgtgtgtgtgtgtgtgtgtgtgtgtgtgtgtgtgtatatatgatacatatacaggtaacttctgaagct

SEQ ID NO: 20125 - DNA, 257 bp, Homo sapiens
  DISD22_0009090
  Located on chromosome 13
  Distance between a terminus base of telomere on chromosomal short arm and 5'-terminus of this base sequence : 79902069
  Distance between 3'-terminus of neighbour sequence of sequence listing upward to telomere on chrosomal short arm and 5'-terminus of this base sequence : 86486
ctaagccagaatttcacgcaggaaatttttgttttaaaaggctaatatagacttttgtaagtggggcaggtgtgtgtgtgtgtgtgtgtgtgtgtgtgtgtgtgtgtgttgggtggagcttacaaaatttatataaattctagaagaactaaaactaattttctatcagtctacattgtgtgtaaggagggaaaagaaaacatattgataaagtttgcttcatactctaaaatagccagtgatatttcaacatgcca

SEQ ID NO: 20126 - DNA, 263 bp, Homo sapiens
  DISD22_0009092
  Located on chromosome 13
  Distance between a terminus base of telomere on chromosomal short arm and 5'-terminus of this base sequence : 80007221
  Distance between 3'-terminus of neighbour sequence of sequence listing upward to telomere on chrosomal short arm and 5'-terminus of this base sequence : 104895
gaatacgagaaatgttggcctttgtttgtgctttttcatgaaaaatacttaaaccgaaaaggaaagaaattattacatgagatttgttgttctttcattttctcaaataatggatgtctttaaaacattttcacctaattttagtgactttgtttttttttttttggcaataatataagattactgtctcgtgtgtgtgtgtgtgtgtgtgtgtatataaaatacagaagattcttgaaaaatggcaacttagccataactcc

SEQ ID NO: 20127 - DNA, 213 bp, Homo sapiens
  DISD22_0009094
  Located on chromosome 13
  Distance between a terminus base of telomere on chromosomal short arm and 5'-terminus of this base sequence : 80155669
  Distance between 3'-terminus of neighbour sequence of sequence listing upward to telomere on chrosomal short arm and 5'-terminus of this base sequence : 148185
tttctattccttgcattaactctctccctagtatttttgttttgtttttctttcatgttggaagttttctttaaatttgggtgttccttccatgcccatttaaatcctttatctgtggggggtgtgtgtgtgtgtgtgtgtgtgtgtgtgtgtgtatgtgtgtacttgttgatcttggtttcaaagttttatcatgtcttggtgaaccagcct

SEQ ID NO: 20128 - DNA, 331 bp, Homo sapiens
  AL136442.12_62501
  Located on chromosome 13
  Distance between a terminus base of telomere on chromosomal short arm and 5'-terminus of this base sequence : 80275797
  Distance between 3'-terminus of neighbour sequence of sequence listing upward to telomere on chrosomal short arm and 5'-terminus of this base sequence : 119915
tgttgaaagtccatctaggtagacaaaacaggtatctctgacacatgttcctgtttgttggggtctgagctagatagtggtctttctactgtgtgtgcactcagtaaagtgggggagaaaaatatgaacggtgacaaatggcaaaggggaaagttctggggcgggggggcaggcccaaaatgccacagcccagaggacatattttgcttggggaagcctagaatcccttctcagagatggtgacatgaagagtggatgggagtttccagggggtgtgtgtgtgtgtgtgtgtgtgtgtatgtgtgtgtgtagcattcaatacacgtttgtt

SEQ ID NO: 20129 - DNA, 199 bp, Homo sapiens
  chr13.fa.O7frz.82596242
  Located on chromosome 13
  Distance between a terminus base of telomere on chromosomal short arm and 5'-terminus of this base sequence : 80402960
  Distance between 3'-terminus of neighbour sequence of sequence listing upward to telomere on chrosomal short arm and 5'-terminus of this base sequence : 126832
acatcttacaggtatgaatggtactaggtttaccattttaaaaagtcacagttgagcttccagcctctgtgtgtgtgtgtgtgtgtgtgtgtgtgtgtgtgtgtgtgtgttttcctttcattaatgggttctttccaagtcaggaaatcaacaagagacaaaatttatagctagactaagttaaagaatgctgttctga

SEQ ID NO: 20130 - DNA, 215 bp, Homo sapiens
  DISO7_10003801
  Located on chromosome 13
  Distance between a terminus base of telomere on chromosomal short arm and 5'-terminus of this base sequence : 80442731
  Distance between 3'-terminus of neighbour sequence of sequence listing upward to telomere on chrosomal short arm and 5'-terminus of this base sequence : 39572
acctctttccttatcatatcacagtttacccttttatactcatttgtatttccatagaacttattctagtttatattgttatatgtgtgtgttgacttatttattttataacaaaactctttccctgtcttcccctaacctaagacacacacacacacacacacacacacacacacacacaactataggctttatgaaatcatggacttgctgag

SEQ ID NO: 20131 - DNA, 111 bp, Homo sapiens
  DISO7_10003802
  Located on chromosome 13
  Distance between a terminus base of telomere on chromosomal short arm and 5'-terminus of this base sequence : 80448747
  Distance between 3'-terminus of neighbour sequence of sequence listing upward to telomere on chrosomal short arm and 5'-terminus of this base sequence : 5801
atccactagggtggacctactgattgattgattgattgattgattgaaagattcaatcaataggtgagagagcctgtaccatgtatctgagggggatggctgaaacctgag

SEQ ID NO: 20132 - DNA, 177 bp, Homo sapiens
  DISO7_10003800
  Located on chromosome 13
  Distance between a terminus base of telomere on chromosomal short arm and 5'-terminus of this base sequence : 80462630
  Distance between 3'-terminus of neighbour sequence of sequence listing upward to telomere on chrosomal short arm and 5'-terminus of this base sequence : 13772
aagctgtatgatctgggagcacattatatatatatttatatatatttatatatacacttgtacacacacaaaaaaaagtgtgtgtgttcaaatatgtatgtatgtggtatgtgtgtgtatttccaaatacatatatacaaatcatgtacaaaaaggcatgtaaatatgaagcttacc

SEQ ID NO: 20133 - DNA, 379 bp, Homo sapiens
  chr13.fa.O7frz.82719677
  Located on chromosome 13
  Distance between a terminus base of telomere on chromosomal short arm and 5'-terminus of this base sequence : 80473019
  Distance between 3'-terminus of neighbour sequence of sequence listing upward to telomere on chrosomal short arm and 5'-terminus of this base sequence : 10212
atttgctgaactcattacttctaattattttttaaagtaaatttcttgggatttttaatgacaagatcatgtcatctgcagatataattttatttcattcttttcaattttggtacccctttcctttcctttcctttcctttcctttttcctttcctctttcctttcctctttcctttccctttccctttccctttccctttcccttttccttttccttttcctttcctttccttcctttcctttcctttcctttccttctaaattgccttggctaaaacctctagaacgacattgaataaaattgacaagagtgaacatacctatttgttcctgatcttagggtaaaacatccagttattcaccattaactatggtgt

SEQ ID NO: 20134 - DNA, 218 bp, Homo sapiens
  HUMUT2347
  Located on chromosome 13
  Distance between a terminus base of telomere on chromosomal short arm and 5'-terminus of this base sequence : 80764083
  Distance between 3'-terminus of neighbour sequence of sequence listing upward to telomere on chrosomal short arm and 5'-terminus of this base sequence : 290685
cccaggaattccagtttacatgagctatgattgtgccactgcacttcagccttggcaacagagcaagaccctgttgaaagagagagagaaacaaggaaggaaagaaggaaggaaggaaggaaggaaggaaggaaggaaggaaggaaggaaggaaggaaggaaggaaggaaggaaagaaggaaggagaaaaatgtccattcgtgtcctttgcccttttt

SEQ ID NO: 20135 - DNA, 260 bp, Homo sapiens
  D13S1263
  Located on chromosome 13
  Distance between a terminus base of telomere on chromosomal short arm and 5'-terminus of this base sequence : 80906545
  Distance between 3'-terminus of neighbour sequence of sequence listing upward to telomere on chrosomal short arm and 5'-terminus of this base sequence : 142244
tctcacactgcaccaggttggcccatgtattcaatagcatacagtagaagtaataatatgtcacttctgacattaggttataaaaaagactgtgacttttttctgagactcctctcctctctctctctctttcatacacacacacacacacacacacacacacacacacacacacacacagagctggggccacccagttgacaatgacattgaatcagtcaatagggaagccatatggcaagaaatggaagtctctggcc

SEQ ID NO: 20136 - DNA, 159 bp, Homo sapiens
  Z17086.1_60
  Located on chromosome 13
  Distance between a terminus base of telomere on chromosomal short arm and 5'-terminus of this base sequence : 81193057
  Distance between 3'-terminus of neighbour sequence of sequence listing upward to telomere on chrosomal short arm and 5'-terminus of this base sequence : 286252
tagatgactagaactggcttttcttccccttgacatcacattgtcttttaaggcaggagtcatgtccaatgcaatgtgtgtgtgtgtgtgtgtgtgtgtgtgtgtgtgtgtgtgtgtgcgtgcccatgtgcctatgtgtttatctccacagtgcaatgt

SEQ ID NO: 20137 - DNA, 121 bp, Homo sapiens
  D13S170
  Located on chromosome 13
  Distance between a terminus base of telomere on chromosomal short arm and 5'-terminus of this base sequence : 81193092
  Distance between 3'-terminus of neighbour sequence of sequence listing upward to telomere on chrosomal short arm and 5'-terminus of this base sequence : -124
tcacattgtcttttaaggcaggagtcatgtccaatgcaatgtgtgtgtgtgtgtgtgtgtgtgtgtgtgtgtgtgtgtgtgtgcgtgcccatgtgcctatgtgtttatctccacagtgcaa

SEQ ID NO: 20138 - DNA, 113 bp, Homo sapiens
  D13S264
  Located on chromosome 13
  Distance between a terminus base of telomere on chromosomal short arm and 5'-terminus of this base sequence : 81275479
  Distance between 3'-terminus of neighbour sequence of sequence listing upward to telomere on chrosomal short arm and 5'-terminus of this base sequence : 82266
tgaagttttgttgggataatgtaataatctatatggttgtgtgagtgtgtgtgtgtgtgtgtgtgtgtgtgtgtatttagatgtgcttggcatccagagcagttattttgcca

SEQ ID NO: 20139 - DNA, 129 bp, Homo sapiens
  DISD22_0009105
  Located on chromosome 13
  Distance between a terminus base of telomere on chromosomal short arm and 5'-terminus of this base sequence : 81501119
  Distance between 3'-terminus of neighbour sequence of sequence listing upward to telomere on chrosomal short arm and 5'-terminus of this base sequence : 225527
ttcccactaacagcaacgcaaaagctggtgtatgtgtgtgtgtgtgtgtgtgtgtgtgtgtgtgtgtgcacgtgcatgtgtatcagagatacgaaatctgtttatctttcatcactgatgggacaagac

SEQ ID NO: 20140 - DNA, 176 bp, Homo sapiens
  DISO7_10003804
  Located on chromosome 13
  Distance between a terminus base of telomere on chromosomal short arm and 5'-terminus of this base sequence : 81589761
  Distance between 3'-terminus of neighbour sequence of sequence listing upward to telomere on chrosomal short arm and 5'-terminus of this base sequence : 88513
ttgaataacatgaatgatacatttgtaatagagaatgtagaatagaatggaacagaacagaatagaatagaatagaatagaatagaatagaatagaatagaatagaatagaatagaataggttacaaatctaaagtaatatatccgctgaaaaacttacctgaataaactggttgc

SEQ ID NO: 20141 - DNA, 200 bp, Homo sapiens
  DISO7_10003805
  Located on chromosome 13
  Distance between a terminus base of telomere on chromosomal short arm and 5'-terminus of this base sequence : 81610034
  Distance between 3'-terminus of neighbour sequence of sequence listing upward to telomere on chrosomal short arm and 5'-terminus of this base sequence : 20097
gctgcttataccctagacagcattttaaagctattttcatttagtagtatatgatactaagtgcactcatgttaatatatattatcacaaaatttattgttattactaaatatatatattatatatatatgtactaagtatgtgtgtatatacatatatatatatatatatccctgtcaataataactttaagtgaccgg

SEQ ID NO: 20142 - DNA, 101 bp, Homo sapiens
  DISO7_10003806
  Located on chromosome 13
  Distance between a terminus base of telomere on chromosomal short arm and 5'-terminus of this base sequence : 81885445
  Distance between 3'-terminus of neighbour sequence of sequence listing upward to telomere on chrosomal short arm and 5'-terminus of this base sequence : 275211
cactggcctgttcagatgcaaaattaacccctcagccaccttacacacacacacacacacacacacacacacacgcacactctcacgtccatgtatatgta

SEQ ID NO: 20143 - DNA, 107 bp, Homo sapiens
  DISO7_10003807
  Located on chromosome 13
  Distance between a terminus base of telomere on chromosomal short arm and 5'-terminus of this base sequence : 81889324
  Distance between 3'-terminus of neighbour sequence of sequence listing upward to telomere on chrosomal short arm and 5'-terminus of this base sequence : 3778
gattgcctctgtgggaagggaaatgggtgcttttgtgtgtgtgtgtgtgtgtgtgtgtgtgtgtgtgtgtgcatgtaattttcacagaccaatcaataatgtaaact

SEQ ID NO: 20144 - DNA, 290 bp, Homo sapiens
  DISO7_10003809
  Located on chromosome 13
  Distance between a terminus base of telomere on chromosomal short arm and 5'-terminus of this base sequence : 81914069
  Distance between 3'-terminus of neighbour sequence of sequence listing upward to telomere on chrosomal short arm and 5'-terminus of this base sequence : 24638
acttgccaattgtatgcttcttgttctatacatatttatatatatatgtgtgtatatgtgtgtgtgtatatatatacacacacacacacacacacacacacacacacacacacacatatatggagagagagagaaagagagagagctgtcaccaggctggagtgcagtggcacaatcttggctcactgcaacctctgcctcctgggttcaagccatgcttctgcctcagcctcccaagtaactgggattacaggcatgccccaccgatattaggtctccttagagatcca

SEQ ID NO: 20145 - DNA, 342 bp, Homo sapiens
  chr13.fa.O7frz.84321528
  Located on chromosome 13
  Distance between a terminus base of telomere on chromosomal short arm and 5'-terminus of this base sequence : 82030783
  Distance between 3'-terminus of neighbour sequence of sequence listing upward to telomere on chrosomal short arm and 5'-terminus of this base sequence : 116424
gaatttgcagatctattaatcaactgagccataccatgagctggaacatctttgaatcaagagccccccttagttaaggcaggtgcagtaacatcccctatgagctgtttagctccctctggcaaggcagttagttacttatacctggagtaggttgacttcctgggaccctgatctgaatccttcttggaggtatcatttttatttaataatggagctttggtgagtgtgcccttattttattttattttattttattttattttattttattttattttattttattttattattgtatcagtaggattcatgaaaatctgtatgaagataggcatctca

SEQ ID NO: 20146 - DNA, 377 bp, Homo sapiens
  chr13.fa.O7frz.84487949
  Located on chromosome 13
  Distance between a terminus base of telomere on chromosomal short arm and 5'-terminus of this base sequence : 82192202
  Distance between 3'-terminus of neighbour sequence of sequence listing upward to telomere on chrosomal short arm and 5'-terminus of this base sequence : 161077
atatcctggcaaattctagtattctctacagagtgttgtattatttctatgtgactgattgcacacacacacacacacacacttcacttttgtgtacttggggttttcaatccattgtaatcatcattcttttggaagcacaaatggttttaatgtcgaacagtgagagcatcttcatactggctcttggaccttctgaatggacttaataatctaatctgtttgtaacctcctgtcttagtctgtgttggctactataacaaatgaccataaactggatgacttcaagaaccaacatttagtttttacaattctagggaatgggaagtccaaaatcatggtgctagtattttcagttctagtaatggcctatttcc

SEQ ID NO: 20147 - DNA, 168 bp, Homo sapiens
  D13S1277
  Located on chromosome 13
  Distance between a terminus base of telomere on chromosomal short arm and 5'-terminus of this base sequence : 82343966
  Distance between 3'-terminus of neighbour sequence of sequence listing upward to telomere on chrosomal short arm and 5'-terminus of this base sequence : 151387
acatcagagacattcacgttaatgtgtgtgtgtgtgtgtgtgtatatctatatgcttctctgaaattgtattatatggtttcatggatgtatctgtttttattacacaagttatatttttgtataagcctcattgaattttaatttttcttgctcagtagtgtgtatt

SEQ ID NO: 20148 - DNA, 372 bp, Homo sapiens
  chr13.fa.O7frz.84832263
  Located on chromosome 13
  Distance between a terminus base of telomere on chromosomal short arm and 5'-terminus of this base sequence : 82516891
  Distance between 3'-terminus of neighbour sequence of sequence listing upward to telomere on chrosomal short arm and 5'-terminus of this base sequence : 172757
agaaagtgaaatcagtacatcaagaagataagtgtactcacatgttcattgtagcactatttacaatagccatgatatggaaagaatcgaagtgcccatcaatagatgaatggaataaaaatgtgttttgtatatataaatatacacacacacacacacacacacacatatatagtgttccattgtgtatatatagttagcctttaaaaagtaggaaattctgtcatttgagataacacagatgaatctagaggatactatgctaagtgaaataagccaggcacagaaagacaaataccacctgatctcacatgtgggatgtaaagaaatggaactcatagaggtagagactagaatgttggttaccagatg

SEQ ID NO: 20149 - DNA, 292 bp, Homo sapiens
  chr13.fa.O7frz.85195424
  Located on chromosome 13
  Distance between a terminus base of telomere on chromosomal short arm and 5'-terminus of this base sequence : 82673992
  Distance between 3'-terminus of neighbour sequence of sequence listing upward to telomere on chrosomal short arm and 5'-terminus of this base sequence : 156729
ttaccaaggatttaccagtttcctctaggttatccaatttgtgtgtgtgtgtgtgtgtgtgtattataatacttctttaggatccttgtcatttctgaaatgtccattataacatttccactgtcatttaaccttatatatttaagtcttttttttgtttagtctagtcaaagtcttgtcaaatttatttatttttaaaaaaccaacttgttccttttctataatttttctcttctctacttatgtctgctctgatttttatttccttctgtgaacttgcagtttaatttgt

SEQ ID NO: 20150 - DNA, 185 bp, Homo sapiens
  D13S317
  Located on chromosome 13
  Distance between a terminus base of telomere on chromosomal short arm and 5'-terminus of this base sequence : 82857758
  Distance between 3'-terminus of neighbour sequence of sequence listing upward to telomere on chrosomal short arm and 5'-terminus of this base sequence : 183474
acagaagtctgggatgtggaggagagttcatttctttagtgggcatccgtgactctctggactctgacccatctaacgcctatctgtatttacaaatacattatctatctatctatctatctatctatctatctatctatctatcaatcaatcatctatctatctttctgtctgtctttttgggc

SEQ ID NO: 20151 - DNA, 323 bp, Homo sapiens
  AL355980.6_56854
  Located on chromosome 13
  Distance between a terminus base of telomere on chromosomal short arm and 5'-terminus of this base sequence : 83058213
  Distance between 3'-terminus of neighbour sequence of sequence listing upward to telomere on chrosomal short arm and 5'-terminus of this base sequence : 200270
tcgataccttaactctagcatcagctacgtacccaaagttaattgtctcaataattatttcaacgctacacatctgtatgtatgtgagtgtgtgtgtgtgtgtgtgtgtgtgtgggtgtatgaatgagactttatactcacaattttgattataattaagtaatactagactcattctagtttttctgcctagctttttgtaacttctttctaaggcaataagaaacctgattctcatcatctaaaatttatttgcttattttttcaaactgggtatacatgtaatggtttcagaattgctaagttacgccatgtaggaataa

SEQ ID NO: 20152 - DNA, 417 bp, Homo sapiens
  AL355980.6_186774
  Located on chromosome 13
  Distance between a terminus base of telomere on chromosomal short arm and 5'-terminus of this base sequence : 83188099
  Distance between 3'-terminus of neighbour sequence of sequence listing upward to telomere on chrosomal short arm and 5'-terminus of this base sequence : 129563
gttaggctaagacagttgtaccatgaagtttagagagatgtgtgaatatttttgctacgatcacattttatcatttattacatgctttaaaactgtgagctttatcacacacacagagagggagagagagagagagagagagagagagagagagattttcctttgtgtgcccttggcttactaaaaatcccgatgtttcactgcagctgtaactacaggaccagcccaaactggctctactctgttattaacaaaatgtcatgttatctcgtgggtataactgcccaaactgcaagtactataggccctgcatgcagaataggaagagctttgacctctaacaacacccagaagcaacaatgtctctccatggaactaaaaagaccaggacatgactagaacatgaccactgagttc

SEQ ID NO: 20153 - DNA, 250 bp, Homo sapiens
  D13S157
  Located on chromosome 13
  Distance between a terminus base of telomere on chromosomal short arm and 5'-terminus of this base sequence : 83412312
  Distance between 3'-terminus of neighbour sequence of sequence listing upward to telomere on chrosomal short arm and 5'-terminus of this base sequence : 223796
agctgagaaatcacaacagagatgtaactcataatcctttttcttatttaaatttaatcacagacacacacacacacacacacacacacacacacaattttccttgtttcctggtacagagttctgaaaacctatagaatctcttgaatagtaagtgtcttttctattttattaactttttttccttacattgttactttttttatttttctggtaagaacacctaaaatctactgtcagcaaatttcca

SEQ ID NO: 20154 - DNA, 248 bp, Homo sapiens
  AL139037.9_116812
  Located on chromosome 13
  Distance between a terminus base of telomere on chromosomal short arm and 5'-terminus of this base sequence : 83462762
  Distance between 3'-terminus of neighbour sequence of sequence listing upward to telomere on chrosomal short arm and 5'-terminus of this base sequence : 50200
tggtcatttaattagaaggtgtacttagtgactatatacatatatacacacatacacacacaaaaacctatagtcatttaatccttataatatcctatgagttggtattattattattattattattattattattattattattactttaccagtgaggaaactttagaacaaagagatgaagttatttgaacaaaatgtacacagatagtatgctggtatttgttagaactgagaattgtactcca

SEQ ID NO: 20155 - DNA, 103 bp, Homo sapiens
  DISO7_10003812
  Located on chromosome 13
  Distance between a terminus base of telomere on chromosomal short arm and 5'-terminus of this base sequence : 83618289
  Distance between 3'-terminus of neighbour sequence of sequence listing upward to telomere on chrosomal short arm and 5'-terminus of this base sequence : 155279
ttgctaacaagttcaatttagtagctacatatcatgcaccatttttgtttgtttgtttgtttgttttaatttgtttcagtaaatctggagcaacagattggtt

SEQ ID NO: 20156 - DNA, 147 bp, Homo sapiens
  DISO7_10003815
  Located on chromosome 13
  Distance between a terminus base of telomere on chromosomal short arm and 5'-terminus of this base sequence : 83692100
  Distance between 3'-terminus of neighbour sequence of sequence listing upward to telomere on chrosomal short arm and 5'-terminus of this base sequence : 73708
ttccttgctaccctcttccttcatgtatataaaagagatacacacacacaaacacacacacagacacacacacacacacacacacacacacacagagtgcagcgggggagagaagagaaaatatgcacggctattatggttattatc

SEQ ID NO: 20157 - DNA, 265 bp, Homo sapiens
  DISO7_10003817
  Located on chromosome 13
  Distance between a terminus base of telomere on chromosomal short arm and 5'-terminus of this base sequence : 83837714
  Distance between 3'-terminus of neighbour sequence of sequence listing upward to telomere on chrosomal short arm and 5'-terminus of this base sequence : 145467
gacgagaccaacctaactggtatctgtttatgtgtctatctgttcatctagctatctatccaaacacacacacacacacacacacacacacacacatatatacacacatgcacacgcacacacacacacagagatggggtggagagagagagagagagaaagagagagagagagatctcccttacagagaaaagaaaacaatttaatatatgccgatttcagaaaacaatatgaatccaaaatacgtttgtgctggttaattacc

SEQ ID NO: 20158 - DNA, 411 bp, Homo sapiens
  chr13.fa.O7frz.86336179
  Located on chromosome 13
  Distance between a terminus base of telomere on chromosomal short arm and 5'-terminus of this base sequence : 83890693
  Distance between 3'-terminus of neighbour sequence of sequence listing upward to telomere on chrosomal short arm and 5'-terminus of this base sequence : 52714
cttgctcatgctatagtaccactgaatgttttcttgtagactctgctctaccatctatactgagaaaggggctttcaatgtagcattgcaggccactggttctaaagtaaagcaaatatagcatatcatgcactggccaaaaaatttcacatgatcacacctattttgacacagcaggggacttcaactccattatgtattgcaaagaaggagaaacaaaacagtcacacacacacacacacacacacacacaccccatcatcatcacctccttccttgattttctaaacatacatttgaaaaagtaattggatttttctttgctatataattccaattgttctcttacctcactacgtatattctgcttcagttattctatttaaactgttatgagaccactattgattt

SEQ ID NO: 20159 - DNA, 312 bp, Homo sapiens
  AL365216.5_108942
  Located on chromosome 13
  Distance between a terminus base of telomere on chromosomal short arm and 5'-terminus of this base sequence : 84019266
  Distance between 3'-terminus of neighbour sequence of sequence listing upward to telomere on chrosomal short arm and 5'-terminus of this base sequence : 128162
ggtaggttacttcactcctcagtgtttcattttttttcatctgtacaatgatgattatagtagtatctacatatgcagttgtttcggaggttaaaaccacttacaccaatttcttatccatgttgagccaatcaaccaatactatcaaattataatatcttgatacattcttctctacagaagaaatattaccatcccagaggctatttattattattattattattattattattattattattattattattattttgagacagagttttgctctcattgcccaggctcgagtgcagtagcgctatcttg

SEQ ID NO: 20160 - DNA, 173 bp, Homo sapiens
  DISD22_0009114
  Located on chromosome 13
  Distance between a terminus base of telomere on chromosomal short arm and 5'-terminus of this base sequence : 84117109
  Distance between 3'-terminus of neighbour sequence of sequence listing upward to telomere on chrosomal short arm and 5'-terminus of this base sequence : 97531
caagcatacaagcaggaatgatttttaatttatcgtatgaattataataaatttattgttgaaaagtattatatatatttgtataaaatgtacacatctcatgtagtttgtgtgtgtgtgtgtgtgtgcataaatttagtaatagaaagaaaccagttatattcgaaactggc

SEQ ID NO: 20161 - DNA, 130 bp, Homo sapiens
  DISD22_0009121
  Located on chromosome 13
  Distance between a terminus base of telomere on chromosomal short arm and 5'-terminus of this base sequence : 84262621
  Distance between 3'-terminus of neighbour sequence of sequence listing upward to telomere on chrosomal short arm and 5'-terminus of this base sequence : 145339
tttcaataatgacaccagtgttcttcacacacacacacacacacacacacacacacacacactccattaaaaacttactgtagagatacactatgtgtttaccaaactcaggaatccaaacactacttac

SEQ ID NO: 20162 - DNA, 430 bp, Homo sapiens
  chr13.fa.O7frz.86829847
  Located on chromosome 13
  Distance between a terminus base of telomere on chromosomal short arm and 5'-terminus of this base sequence : 84435670
  Distance between 3'-terminus of neighbour sequence of sequence listing upward to telomere on chrosomal short arm and 5'-terminus of this base sequence : 172919
atttattcgatgtcaatgacacttggtctatgtctcactagttaactaattttcagccaaatgaatcagtctttataccacaatgagagagagagagagagagagagaggattaacattttaatgctagtactagatagatacagactgtatatcctttccaatttaacttagagcagctagtcgagatttgcttctttattgaagaaaacctccaaaattaggacagcaatgtccttcatgcttacagcaaagataaataataagacaaactaacacaaatcaagggtaggaaaggcatatcacatttttttgctgttgctcttatttatatgcagttattttgtgtttttgtataaattttgtatctggtggctgaattcttcaagcctacagttataaagttcaactattgtctgttcaagtgaagc

SEQ ID NO: 20163 - DNA, 308 bp, Homo sapiens
  chr13.fa.O7frz.86903757
  Located on chromosome 13
  Distance between a terminus base of telomere on chromosomal short arm and 5'-terminus of this base sequence : 84509561
  Distance between 3'-terminus of neighbour sequence of sequence listing upward to telomere on chrosomal short arm and 5'-terminus of this base sequence : 73461
gtagcaaattaaagttctttccttcttttgaaaatttctggcgaacttacatgcataaaatgccactatgaaaataatattagacaaaaaagaaaataatattacacacacacacacacacacacacacacacacacatgccatctcaaaagtttcctggtttatgtaattgataaagttaagaagctgtacttttcaaaatcttttaagtgggatcactgatcacagataatttgttgtttgtcattacatctgttcaatcaatttagtttggagggactcctctaatacttacagatggtctgctc

SEQ ID NO: 20164 - DNA, 477 bp, Homo sapiens
  chr13.fa.O7frz.87008799
  Located on chromosome 13
  Distance between a terminus base of telomere on chromosomal short arm and 5'-terminus of this base sequence : 84608537
  Distance between 3'-terminus of neighbour sequence of sequence listing upward to telomere on chrosomal short arm and 5'-terminus of this base sequence : 98668
catgtagaacgaggtcaaatacacatgtccatgtcttcaaaaataatactctagaagaaatatttatattatatgcaaaacagtgcttagattgggcccttatttcttttaaaatatatatattttatttatttatttatttatttatttatttggagacagagtctcactctgtcacccagactggagtgcagtggcgcgatcttggctcaccgcaacctccgcctcccgggttcaagctattctcctgcctcagcctcctgagtagctgggattacaggcgtgggtcaccactccaggctaatttttgtattttttagttgagatgggatttcaccatgttggccaggcttccttatttgtttattattaactgggggaaggaggtttgagatgtttgtcaaaggacacaaaatttcagttagcaaagataagtacaaaagatatattgcacatcatggtgactatagttcatga

SEQ ID NO: 20165 - DNA, 316 bp, Homo sapiens
  chr13.fa.O7frz.61769800
  Located on chromosome 13
  Distance between a terminus base of telomere on chromosomal short arm and 5'-terminus of this base sequence : 84939998
  Distance between 3'-terminus of neighbour sequence of sequence listing upward to telomere on chrosomal short arm and 5'-terminus of this base sequence : 330984
ttgtactttgacaagccaataggtattttactctatcataaaacaaatagcttgaataaaacaaaaccatgagattaataattattttaactggctatgaagctttaaacacacacacacacacacacacacacacacacacaaattgcagagggaaaatatattaagatgtataagacaatcaaaataaattcagtcatgctcctgaaaacttaatctcctgtgtgtagtaatttgcacttcttaaacagcaataggagggctgtatgtcacacaaaagacattatcttaactggtactgttcaaattgatacat

SEQ ID NO: 20166 - DNA, 286 bp, Homo sapiens
  DISO7_10000015
  Located on chromosome 13
  Distance between a terminus base of telomere on chromosomal short arm and 5'-terminus of this base sequence : 84968619
  Distance between 3'-terminus of neighbour sequence of sequence listing upward to telomere on chrosomal short arm and 5'-terminus of this base sequence : 28305
atgctgctttacacttatgaatacatatatgctttataattgtaaatatatatttttatatatgtgtttgtgtatatatatccatatagatatttacactgatacatgtatacatatagatacatatatacgtgtgtgtgtgtgtgtgtgtgtgtgtgtgtgtgtgtgtgtaggcatacctcagagatatttgagttcagtttcagactgaagtgtgcctatatatatatttctaactttgtaagtaaagaaaggtacatacagaacactcttaacaattcagatt

SEQ ID NO: 20167 - DNA, 223 bp, Homo sapiens
  DISO7_10000167
  Located on chromosome 13
  Distance between a terminus base of telomere on chromosomal short arm and 5'-terminus of this base sequence : 84969433
  Distance between 3'-terminus of neighbour sequence of sequence listing upward to telomere on chrosomal short arm and 5'-terminus of this base sequence : 528
aatgtaaccatcaagggagatagcatatatatatatatatgtacatatatatttcccttgatatatatatacacacacatatatatacgtatatatatgtatatatgggatatatatacgtatatatacatatatatgggatatatatatatatatatatatatatatatatatatatatataaagaattctccgttttcctttgggtagggccaataagcaa

SEQ ID NO: 20168 - DNA, 157 bp, Homo sapiens
  D13S1290
  Located on chromosome 13
  Distance between a terminus base of telomere on chromosomal short arm and 5'-terminus of this base sequence : 85043368
  Distance between 3'-terminus of neighbour sequence of sequence listing upward to telomere on chrosomal short arm and 5'-terminus of this base sequence : 73712
ggcagaccattttgattttctgatattgattgatccttgaatttgtaaaaataattttatacacacacacacacacacacatatatatatatatatacacacacacataaaacattgcttgttccagttatctattactccacagtgacatagccca

SEQ ID NO: 20169 - DNA, 296 bp, Homo sapiens
  DISO7_10003818
  Located on chromosome 13
  Distance between a terminus base of telomere on chromosomal short arm and 5'-terminus of this base sequence : 85106365
  Distance between 3'-terminus of neighbour sequence of sequence listing upward to telomere on chrosomal short arm and 5'-terminus of this base sequence : 62840
ggtcattaagcatctttatggtcaaactgtgaagcaaagtcatttatttgttcccctcttccatatatatatatgtatatatatatgtatatgtatatatgtatatatatatgtatacatatatatgtatatatgtatatatgtgtatatatgtatatatatgtgtatatatgtatatatatgtgtgtatatatgtgtatatgtatataaactttatatactaattaataaaacaaataggaatgcaaaaagtgagtgaattttctattattttagaattggctattgtccagatt

SEQ ID NO: 20170 - DNA, 222 bp, Homo sapiens
  DISO7_10003819
  Located on chromosome 13
  Distance between a terminus base of telomere on chromosomal short arm and 5'-terminus of this base sequence : 85189076
  Distance between 3'-terminus of neighbour sequence of sequence listing upward to telomere on chrosomal short arm and 5'-terminus of this base sequence : 82415
catgctggtatgtgtacgtagagtttatcttagtaccaagacatgtctgtctgtctgtctgtctgtctgtctgtctctctctctctctctctctctctctctccccctccctcccactctctctcttcttatagcaacatgatgtatttatagtctttcaagtctaaaacatctttcaactttggtttcattagaaattttcattgagatgaaaggcaataa

SEQ ID NO: 20171 - DNA, 126 bp, Homo sapiens
  DISO7_10003822
  Located on chromosome 13
  Distance between a terminus base of telomere on chromosomal short arm and 5'-terminus of this base sequence : 85269175
  Distance between 3'-terminus of neighbour sequence of sequence listing upward to telomere on chrosomal short arm and 5'-terminus of this base sequence : 79877
ttaattctctgccttagtctttctctttttcaaacacacacacacacacacacacacacacacacaggcacacacatacacacagagagatacttttagattttctaatccattgatgcattgttt

SEQ ID NO: 20172 - DNA, 206 bp, Homo sapiens
  chr13.fa.O7frz.87748724
  Located on chromosome 13
  Distance between a terminus base of telomere on chromosomal short arm and 5'-terminus of this base sequence : 85287787
  Distance between 3'-terminus of neighbour sequence of sequence listing upward to telomere on chrosomal short arm and 5'-terminus of this base sequence : 18486
gaagatctgctacagtgtctgtactgtgctttgaaaatacgtttatactgacaaagggatgtttgtgtgtgtgtgtatatgtgtgtgtgtgtgtgtgtgtgtatttgtttacttaacaactatagggcctaaatccgtaattctcattcctggagtggttgatcaacatctgaaagattgatctggagtctacactatggaaataa

SEQ ID NO: 20173 - DNA, 136 bp, Homo sapiens
  DISO7_10003820
  Located on chromosome 13
  Distance between a terminus base of telomere on chromosomal short arm and 5'-terminus of this base sequence : 85344740
  Distance between 3'-terminus of neighbour sequence of sequence listing upward to telomere on chrosomal short arm and 5'-terminus of this base sequence : 56747
cacatgtgctatttgtactgagagtacatcttaatgagagtagacataattttttaaataatcgtgtacacacacacacacacacataatgagcatggggagcactatgatatggggaagacaatagtgatttcgc

SEQ ID NO: 20174 - DNA, 395 bp, Homo sapiens
  chr2.fa.O7frz.190891369
  Located on chromosome 13
  Distance between a terminus base of telomere on chromosomal short arm and 5'-terminus of this base sequence : 85517309
  Distance between 3'-terminus of neighbour sequence of sequence listing upward to telomere on chrosomal short arm and 5'-terminus of this base sequence : 172433
ttgtcaatatgataaatccgacttacaagggactactgcagcattagatgctcaatcagaagtatgtccttgaaagacaagtgtgaatgaaaattatcccagtgggccacacatcaagcaatccattttggatttcttagtctgttttgagaaataaatagatgatgatagacagatagatagatagatagatagatagatagatagatagatagatctgtattaatttgaggcagtggctaatgatttggccgtataatcagaaacttggaaaataactgtattacagaattgaaaaaatggaaaaaatgagttcagaggaatatctgtttcagagaaaactttcaataatcatctggacaacatgacctgccctttgaacatcagttagcctc

SEQ ID NO: 20175 - DNA, 237 bp, Homo sapiens
  D13S1235
  Located on chromosome 13
  Distance between a terminus base of telomere on chromosomal short arm and 5'-terminus of this base sequence : 85547922
  Distance between 3'-terminus of neighbour sequence of sequence listing upward to telomere on chrosomal short arm and 5'-terminus of this base sequence : 30218
ctccccacactgttcctattccagtttgagataatgacaatgtcctttgtaagaaatctgtttagtaaaatttaataaagacagtttgcatttttttttggatgacattactggttaccaggttgaaccgagttcccccatctaccttccaagcgcgcgtgcgcactcacacacacacacacacacacacacacacacacacacacacacatatacaaatgctagattaaatgtgag

SEQ ID NO: 20176 - DNA, 221 bp, Homo sapiens
  D13S1264
  Located on chromosome 13
  Distance between a terminus base of telomere on chromosomal short arm and 5'-terminus of this base sequence : 85566268
  Distance between 3'-terminus of neighbour sequence of sequence listing upward to telomere on chrosomal short arm and 5'-terminus of this base sequence : 18109
cacagtgagtagagtcatcaaaagcctctctgttactctggaagctgcagagaaagggaacctggaaacccggtatactggcaaagagggtgggaaattcttaccaaccaagtttctggtctctccctctctctttctctctctctgtgtgtgtgtgtgtgtgtgtgtgtgtgtgtaaatggtaaaccccactgtttgtctcctcagccagggtttgatta

SEQ ID NO: 20177 - DNA, 476 bp, Homo sapiens
  AL356313.10_197554
  Located on chromosome 13
  Distance between a terminus base of telomere on chromosomal short arm and 5'-terminus of this base sequence : 85765610
  Distance between 3'-terminus of neighbour sequence of sequence listing upward to telomere on chrosomal short arm and 5'-terminus of this base sequence : 199121
tgtaattccagctagtcattactcgggaggctaaggcaggacaatcacttgaacctgggaggcggaggttgtggtgagctgagattttgccatttcactccagcctgggcaagaagagcgaatctctgactcaaaaaataaataaataaataaataaatatgttgtttactagcattataacaatcaaattatatgcatttatttaatcattacaacatattttctggtactagattactgttttaaagattatgaaaatgagactcattttagtgccataatttagtgtcaattatgttgccaatgtaattataaatgtacaagtaaatggagtaatacacacacatactcaattttcctatcatatatcatgaataaatataagcaactttttcaaaaatttatagatctatttattaattaaagacaactttttattatatcataatatattatgacatttcttaaagtagcg

SEQ ID NO: 20178 - DNA, 429 bp, Homo sapiens
  AL356313.10_1090
  Located on chromosome 13
  Distance between a terminus base of telomere on chromosomal short arm and 5'-terminus of this base sequence : 85889623
  Distance between 3'-terminus of neighbour sequence of sequence listing upward to telomere on chrosomal short arm and 5'-terminus of this base sequence : 123537
ttgcactagtcaaactctcaaggaaatatttctcaaacatgattcatatcacactatctgacatttttcttcttaaattgaaatagttgtaaaggaatcaatagtaggagaatataaaatatatttaaggaaagtgttttccattttattcctacctatatcttaactcacaacacctcaacatggatgaatacgccacttttctaaatgccaggcttcactttactagagatagatcagatagatgatagatagaaaggtagatagattggtagatagatagattagatagatagatagatagatagatagatagatagatagacagacagagaaagagagagagagagaaatgtagatggaacatgaagaatgagaaactttagactgaaatattgaattatcgttagatagccttgctatttgtta

SEQ ID NO: 20179 - DNA, 246 bp, Homo sapiens
  AL356313.10_63134
  Located on chromosome 13
  Distance between a terminus base of telomere on chromosomal short arm and 5'-terminus of this base sequence : 85951804
  Distance between 3'-terminus of neighbour sequence of sequence listing upward to telomere on chrosomal short arm and 5'-terminus of this base sequence : 61752
ttatccaggtatggtgtcatacatctatggtcccagctactcaggagtctgaggtgggaagatctctttggtccaggaggtcaaggctgcagtgagccgtgatcatgccactgcactcctgggtgacaggagtaagaccctgtctcaaaaataaataaataaataaataaataaataaataaataaataaatatttaaaagaaagttcaaaggagagctgcatcagaatacagttcttatccagac

SEQ ID NO: 20180 - DNA, 204 bp, Homo sapiens
  HUMUT1329
  Located on chromosome 13
  Distance between a terminus base of telomere on chromosomal short arm and 5'-terminus of this base sequence : 86012425
  Distance between 3'-terminus of neighbour sequence of sequence listing upward to telomere on chrosomal short arm and 5'-terminus of this base sequence : 60375
cacatagcttattgttgttgcagcaggaacaatgtttgttggttttaaatatcatatgagatgttccagctaatgccattagtcaggaaaataaaataatagatagatagatagatagatagatagatagatagatagatagatgatagatagatagacagacagagatataaagaactgaaactgtatttgctcacagataac

SEQ ID NO: 20181 - DNA, 339 bp, Homo sapiens
  AL353623.5_83876
  Located on chromosome 13
  Distance between a terminus base of telomere on chromosomal short arm and 5'-terminus of this base sequence : 86128224
  Distance between 3'-terminus of neighbour sequence of sequence listing upward to telomere on chrosomal short arm and 5'-terminus of this base sequence : 115595
aaggtcaggagttcgagaccagcctggccaatatggtgaaactctgtttctactaaaaatacaaaaattagccgggtgtggtagcgggtgcctgtagtctcagctacttgggagactgaggcaggagaattgcttgaacccaggaggcggaggttgcagtgagccgagattgtgccactgcactgcagcctgggggacaaagcaaggctctgtcaaaaaaaaaagaagaagaagaagaagaagaagaagaagaagaagaagaagaagaagaagaagaggaagaggaagaagaagaagaagaagaagaagaagaagaagaaaggtttctccaactgttaa

SEQ ID NO: 20182 - DNA, 121 bp, Homo sapiens
  D13S1286
  Located on chromosome 13
  Distance between a terminus base of telomere on chromosomal short arm and 5'-terminus of this base sequence : 86163729
  Distance between 3'-terminus of neighbour sequence of sequence listing upward to telomere on chrosomal short arm and 5'-terminus of this base sequence : 35166
ttaagcatcttgaattttgccttgtttaaattatttacagtctttgaacagcacattgtgtgtgtgtgtgtgtgtgtgtgtgtgtgtgtatgtatatattcataatatgctttggtggatc

SEQ ID NO: 20183 - DNA, 243 bp, Homo sapiens
  Z24086.1_214
  Located on chromosome 13
  Distance between a terminus base of telomere on chromosomal short arm and 5'-terminus of this base sequence : 86422970
  Distance between 3'-terminus of neighbour sequence of sequence listing upward to telomere on chrosomal short arm and 5'-terminus of this base sequence : 259120
tttcaactatctttggactgaaagtggggtttttaccagggaccctcccctatctgcctaggcatttggctgcctcctgttgctatcatttgccatttcattatctgtgtgtgcatgagtgtgtgtgcgtgtgtgtgtgtgtgtgtgtgtgttcagggtaatttggggtgagtgatgctagagattcaggtagacagtattaagactgaattcaaatgcagagacttcacaggctatcaaaga

SEQ ID NO: 20184 - DNA, 235 bp, Homo sapiens
  D13S282
  Located on chromosome 13
  Distance between a terminus base of telomere on chromosomal short arm and 5'-terminus of this base sequence : 86422972
  Distance between 3'-terminus of neighbour sequence of sequence listing upward to telomere on chrosomal short arm and 5'-terminus of this base sequence : -241
tcaactatctttggactgaaagtggggtttttaccagggaccctcccctatctgcctaggcatttggctgcctcctgttgctatcatttgccatttcattatctgtgtgtgcatgagtgtgtgtgcgtgtgtgtgtgtgtgtgtgtgtgttcagggtaatttggggtgagtgatgctagagattcaggtagacagtattaagactgaattcaaatgcagagacttcacaggctat

SEQ ID NO: 20185 - DNA, 292 bp, Homo sapiens
  AL356413.6_3132
  Located on chromosome 13
  Distance between a terminus base of telomere on chromosomal short arm and 5'-terminus of this base sequence : 86598332
  Distance between 3'-terminus of neighbour sequence of sequence listing upward to telomere on chrosomal short arm and 5'-terminus of this base sequence : 175125
aaataaggcataagtatggatcttataaatcttataaactaatacaaaattctgacaatgcctgggcaaacaaagcttccataatatgatatatgtccaggtgaagacagcttgtaatagaaaatatctgggtatagcagactaagttaagcaaaagtttttaaatggcgctcttgcttcattccatttttacttaggagaactattctgttttgttttgttttgttttgttttgtttgagacagagtcttgctctgtggctcaggctggagtacagtaggcatgatctcag

SEQ ID NO: 20186 - DNA, 187 bp, Homo sapiens
  DISO7_10003825
  Located on chromosome 13
  Distance between a terminus base of telomere on chromosomal short arm and 5'-terminus of this base sequence : 86837761
  Distance between 3'-terminus of neighbour sequence of sequence listing upward to telomere on chrosomal short arm and 5'-terminus of this base sequence : 239137
ttgccaatgctcagtagcctctctctcactatatatattttttcacattatatatatatgtagtcacatattatatatatgtgtgtgtgtatatatatatatacatacccaatatattcacatatttcatatatatatatatatatatatatatacccaatatattcacgtattccttgattctgaa

SEQ ID NO: 20187 - DNA, 128 bp, Homo sapiens
  DISO7_10003824
  Located on chromosome 13
  Distance between a terminus base of telomere on chromosomal short arm and 5'-terminus of this base sequence : 86845261
  Distance between 3'-terminus of neighbour sequence of sequence listing upward to telomere on chrosomal short arm and 5'-terminus of this base sequence : 7313
acgaatcaacaaatgagccaaaattaaacaacaacaaccacaacaacaacaaaacagaaggtaagtgtgaagttctcatttgtttgctacttttttttcaggtatttttgactttcaacctgcctgtc

SEQ ID NO: 20188 - DNA, 216 bp, Homo sapiens
  DISD22_0009135
  Located on chromosome 13
  Distance between a terminus base of telomere on chromosomal short arm and 5'-terminus of this base sequence : 87152102
  Distance between 3'-terminus of neighbour sequence of sequence listing upward to telomere on chrosomal short arm and 5'-terminus of this base sequence : 306713
cctggaagatctcatttgcaaaactgtcattatttggtttaatttggaagtaacccagtacaaaaagctgtttcttccaggggcatttgtaaaaaaaaagtttatatgtatgtgtgtgtgtgtgcacacacacatatatatgtatatatatatatatatatagagagagagagagagagaggcaattatttaactttgcagcttgctgacgatatc

SEQ ID NO: 20189 - DNA, 466 bp, Homo sapiens
  chr13.fa.O7frz.89756482
  Located on chromosome 13
  Distance between a terminus base of telomere on chromosomal short arm and 5'-terminus of this base sequence : 87239362
  Distance between 3'-terminus of neighbour sequence of sequence listing upward to telomere on chrosomal short arm and 5'-terminus of this base sequence : 87044
actgctatttaaagtttcgaaatataaagaatacatttttacaacacaacatttatcttaaaattattgcaaatggagagactagacagaatgaggaaaataagtatattatgcagaatttatgcatataactctcaatatcaagttccagaaatgattatacgtgcacacacacacacacacacacacacacacacacacacacctctaggcatatcataaagggatttcaaatataaaagacaacaacaacaaaacaaaagcaaagcaaagcaaaaattacaaaagttagattgttagctgatatcttaatagcaagactaaaatcaaatacaatataactgtttatttgaagtgctgggaaaaataaagcatgctatttacttgtggttttatacgaaggtaaatagagttcaaaaatgagggctattctttgttggatgaatgacattctacttccagtatg

SEQ ID NO: 20190 - DNA, 286 bp, Homo sapiens
  HUMUT1378
  Located on chromosome 13
  Distance between a terminus base of telomere on chromosomal short arm and 5'-terminus of this base sequence : 87322089
  Distance between 3'-terminus of neighbour sequence of sequence listing upward to telomere on chrosomal short arm and 5'-terminus of this base sequence : 82261
ctcaagggatgttaacacacaaagacatgcacatagatagatgatagatagattagatagatagatagatagatagatagatagatagatagatagatagacaaaagacgaggcaagcaattaaacttggtgacaatggtaaagtctattaacatccctagggttatactaatttagcaggggctatacaacattcatatcactgggaatgtcctttggtttttagtctcagtggaatctaagacatcatggttcccaaacatgggcttctccactttttcctcct

SEQ ID NO: 20191 - DNA, 382 bp, Homo sapiens
  AL390731.3_49703
  Located on chromosome 13
  Distance between a terminus base of telomere on chromosomal short arm and 5'-terminus of this base sequence : 87380517
  Distance between 3'-terminus of neighbour sequence of sequence listing upward to telomere on chrosomal short arm and 5'-terminus of this base sequence : 58142
ctaaacattctggtactaaagcaccatattgtgtttatgcgtatatatgcacacaatgacacgcacacaatgacacacacacacacacacacacacatataaaatacactacatacacatataaatatttacactatatgtgtaaaatagtctgtgtatatgtctacatgtatatatctgagcataacactaggttgggttaatttcctccccctttttaacctatgactgttagttaaatattaatctctcctatagagatagattgtaatacccattacaatttaaaacactccaaaatatttagcatatatatgttctcttgtagttttatgatttatttgaatatcatgtgtattagtatgcacaataaggtttcaac

SEQ ID NO: 20192 - DNA, 347 bp, Homo sapiens
  chr13.fa.O7frz.89931443
  Located on chromosome 13
  Distance between a terminus base of telomere on chromosomal short arm and 5'-terminus of this base sequence : 87400568
  Distance between 3'-terminus of neighbour sequence of sequence listing upward to telomere on chrosomal short arm and 5'-terminus of this base sequence : 19669
tactctgctatcagttgcctaggaaaaacttattatatatgtttactggcacagtagcaaattatatatatatatatatatatatatataatttttttttaaatgcctggaattggggacttatacggctcctcaaacaccactctccaacactgctgcctgggagcatctcttacgtgctctccattaccatggtcagcaccaacattctggatccactatttttctatttttatttttcctttcgattctggctcccatccctgtggttatatttactgtggagcatacatctttactgctggcagctgctgcattacgttgttatgttaatgcctacagaactg

SEQ ID NO: 20193 - DNA, 240 bp, Homo sapiens
  chr13.fa.O7frz.90258964
  Located on chromosome 13
  Distance between a terminus base of telomere on chromosomal short arm and 5'-terminus of this base sequence : 87622579
  Distance between 3'-terminus of neighbour sequence of sequence listing upward to telomere on chrosomal short arm and 5'-terminus of this base sequence : 221664
tagctgaaattgaagtcacttaagaaacttagaagggaattaatatgatacatatgcttatctcttgccattctcagtaaaattattgttattattattattattattattattggatcaatttttatttgggcttctcacagtggttagagccactctgttttcagaacaatcacagcacaggaaatgtgtcactgagactgcccagagcagtctgaccagctgtatcttatcacttaa

SEQ ID NO: 20194 - DNA, 126 bp, Homo sapiens
  D13S1279
  Located on chromosome 13
  Distance between a terminus base of telomere on chromosomal short arm and 5'-terminus of this base sequence : 87628953
  Distance between 3'-terminus of neighbour sequence of sequence listing upward to telomere on chrosomal short arm and 5'-terminus of this base sequence : 6134
actgtgcttcagcctgggcgacagagcgagattctgtcacacacacacacacacacacacacaaatattcttagtagtgctatttataattgcccaaatctgaaaactacccaaatgaccatcaag

SEQ ID NO: 20195 - DNA, 277 bp, Homo sapiens
  chr13.fa.O7frz.90124002
  Located on chromosome 13
  Distance between a terminus base of telomere on chromosomal short arm and 5'-terminus of this base sequence : 87653566
  Distance between 3'-terminus of neighbour sequence of sequence listing upward to telomere on chrosomal short arm and 5'-terminus of this base sequence : 24487
aagtgttacaaatgtttatttcctagtactaatctcagtttaatttttgtgtttcatttccccttctttattttgctttatcaatgatacttatttttagttatccgtgtgtgtgtatatatatacacacacacacacacacacatatgtatatcttttgatttgttttgttttgcatgggaggatatttgagtcaaaacacatgtaactcccaatctcttttctaagaaactcactttacttacaatatagcatgaggaagttcaagcttaaggta

SEQ ID NO: 20196 - DNA, 388 bp, Homo sapiens
  chr13.fa.O7frz.90378668
  Located on chromosome 13
  Distance between a terminus base of telomere on chromosomal short arm and 5'-terminus of this base sequence : 87882767
  Distance between 3'-terminus of neighbour sequence of sequence listing upward to telomere on chrosomal short arm and 5'-terminus of this base sequence : 228924
tatggagatcctattaatttcctcttttatgtttcagagtccatcatggtttttttctatttttagactttttttttttttttttgctatttgatgttttggttatattgtagtgttttattaaatctcaggttttctggcctgtatgttgctgatagttaaaaatgttcttaattttgtgtatatacatatatatatatacatatatatatatgtgtgtatatatatatatatacatatatatgtgtatatatatatatacacacatatatatgtgtgtgtatatatgtcttccatattcatatatttcaccgttttgtattttcattttatactaacagtttatagacttaaacacaatgacttgttaatgcattatatcttgcca

SEQ ID NO: 20197 - DNA, 364 bp, Homo sapiens
  chr13.fa.O7frz.90677936
  Located on chromosome 13
  Distance between a terminus base of telomere on chromosomal short arm and 5'-terminus of this base sequence : 88216585
  Distance between 3'-terminus of neighbour sequence of sequence listing upward to telomere on chrosomal short arm and 5'-terminus of this base sequence : 333430
gctacattcacacttagtatgttctcagtattctagaattttagcctaaggctataaataaatgagacttttaatgatgcataaggaaggtgtgtatgtatattttacacgcaagaggaaagaaagaggatgtttgtgaacaagagtttggactgcaataacacaaattactctccaataaatagtccctcctcttcaagaagcagctgtatttctgaaagtatgattttccacttaacgtaattatatgtgtgtgtgtgtgtgtgtgtgtgtgtgtgtgtgtgtgtgtgtgtgtgtttgtaatgagatatgtgtagaagtggcatgagcagaagttttaagtgaagtttgtagtttggttaac

SEQ ID NO: 20198 - DNA, 480 bp, Homo sapiens
  chr13.fa.O7frz.90990345
  Located on chromosome 13
  Distance between a terminus base of telomere on chromosomal short arm and 5'-terminus of this base sequence : 88496839
  Distance between 3'-terminus of neighbour sequence of sequence listing upward to telomere on chrosomal short arm and 5'-terminus of this base sequence : 279890
catgattcaaatcaccttctacatatgagcatatatttgagaaaatattttataactatcataaaaatgttagacattattattttggttattttatctggcatctagacgtgaattagatttagtatgatttgtacttaggaaataactttattattatttatatcaaaggatcacaaagaaatacacacacatatatatatatatatatatatatatacactttaatccttcgattgtcgtacagagttctaccgattttcacaaaaaactaatcagatgacttagggatactccagattccactacttaactagttcattcagtgtatcgtttattctctgagctttgctctgctcctcagagacttgtataatttcaaaattaattaaaaacttataatcacataaaccatcttcttctaaaaatcatcttaatttttaaaatgaagtaaccatgacatagaaggctaaattggac

SEQ ID NO: 20199 - DNA, 187 bp, Homo sapiens
  DISO7_10003830
  Located on chromosome 13
  Distance between a terminus base of telomere on chromosomal short arm and 5'-terminus of this base sequence : 88599382
  Distance between 3'-terminus of neighbour sequence of sequence listing upward to telomere on chrosomal short arm and 5'-terminus of this base sequence : 102063
tgtagaataaccatgctctaaagggatgttttgaacatttccaaatagatatggttttttactgcatagatagacagatagatagatagatagatagatagatagatagatagatatgaatgataacattatgtttattttctcatgatgatgtccttaaagaaaaagggcaccatgcagcagttaa

SEQ ID NO: 20200 - DNA, 241 bp, Homo sapiens
  DISO7_10003829
  Located on chromosome 13
  Distance between a terminus base of telomere on chromosomal short arm and 5'-terminus of this base sequence : 88644606
  Distance between 3'-terminus of neighbour sequence of sequence listing upward to telomere on chrosomal short arm and 5'-terminus of this base sequence : 45037
tggagaacgatagtgcactacttttgtgtaagtcttcttatgtattgtttaacttcattcaattgtcattttagagaagagtgtatatgtgtgtgtgtgtgtgtgtgtgtgtgtttatatatttttttccctcttgggtattttaattgccattattttcttaaaaagtcacaggtgatataaaaatatgaatgggatattattatttaactaaaatgtttgaatgcctaaacgttcttga

SEQ ID NO: 20201 - DNA, 142 bp, Homo sapiens
  G09996
  Located on chromosome 13
  Distance between a terminus base of telomere on chromosomal short arm and 5'-terminus of this base sequence : 88675213
  Distance between 3'-terminus of neighbour sequence of sequence listing upward to telomere on chrosomal short arm and 5'-terminus of this base sequence : 30366
aagtcagcttaattaaaagctggtatctaagatatctatctatctattatctatctatctgtgtatctattatctatctatctatctatctatctatctatctatctatgtctttgtgctcctatgagaatctaatgctgcc

SEQ ID NO: 20202 - DNA, 382 bp, Homo sapiens
  chr13.fa.O7frz.91619637
  Located on chromosome 13
  Distance between a terminus base of telomere on chromosomal short arm and 5'-terminus of this base sequence : 88780722
  Distance between 3'-terminus of neighbour sequence of sequence listing upward to telomere on chrosomal short arm and 5'-terminus of this base sequence : 105367
tcatttagtcttgctactcgagatatgtttacacaaagttcttaaaatggcctattttttataaagagtactttacacaccacagttacaatgctataataatctctctgtgtgtgtgtgtgtgtgtgtgtgtgtgtgtgtgtgtgtgtgtgtgtgttggtgtacttactattaccagtgagttttataccttcagatgatttcttattgctcattaacatacttttttttccaattgaataacactatagcatttttggtgagacaggtctggtgtttatgaaatctctcagactttttttgtttgtttgttttttgtctagaaaactctttatttctccttcatgtctgaaggatatttacgtacttatgccaggtagac

SEQ ID NO: 20203 - DNA, 177 bp, Homo sapiens
  DISO7_10003831
  Located on chromosome 13
  Distance between a terminus base of telomere on chromosomal short arm and 5'-terminus of this base sequence : 88894810
  Distance between 3'-terminus of neighbour sequence of sequence listing upward to telomere on chrosomal short arm and 5'-terminus of this base sequence : 113706
tctcaccagaatcttagttgttgaaaacagtgcaagtttatgggaggtggaaaaagatatatttgtatccttaaaggaatatatatatatatatatatatatatatatatatatatatacacacacacacacacacaaattacaacagtaaagaagtgacaattattctgagaagtg

SEQ ID NO: 20204 - DNA, 206 bp, Homo sapiens
  DISO7_10003834
  Located on chromosome 13
  Distance between a terminus base of telomere on chromosomal short arm and 5'-terminus of this base sequence : 89006853
  Distance between 3'-terminus of neighbour sequence of sequence listing upward to telomere on chrosomal short arm and 5'-terminus of this base sequence : 111866
cattatgtttgttcttatgcatatgtttgaatagtctgaaaaaatacttggcatataaagttgggaacaggataaattctgtgtgtgtgtgtgtgtgtgtgtgtgtgtgtgtgtgtatatatatgtctttatatatatatatatatatatatatatatatatatatatatatatgagaatgaaagcttctttgttgttattggcaa

SEQ ID NO: 20205 - DNA, 172 bp, Homo sapiens
  DISO7_10003835
  Located on chromosome 13
  Distance between a terminus base of telomere on chromosomal short arm and 5'-terminus of this base sequence : 89009441
  Distance between 3'-terminus of neighbour sequence of sequence listing upward to telomere on chrosomal short arm and 5'-terminus of this base sequence : 2382
ccaacacagaagtgagaagcagagagagacagagagagagagagagagaaagagagagagagagagagatgggagatggcagggggattgatttaaaagtttccataccacttctaaaatatttgagagatcatcagtctgtatatatgatctaaggatgagtggttagtga

SEQ ID NO: 20206 - DNA, 104 bp, Homo sapiens
  DISO7_10003836
  Located on chromosome 13
  Distance between a terminus base of telomere on chromosomal short arm and 5'-terminus of this base sequence : 89027416
  Distance between 3'-terminus of neighbour sequence of sequence listing upward to telomere on chrosomal short arm and 5'-terminus of this base sequence : 17803
gatgtaagattcctaccacggatattgcaaaacatgaccacacacacacacacacacacacacacacacacacaaaaatcaatatgagtgttgttgaaattagg

SEQ ID NO: 20207 - DNA, 125 bp, Homo sapiens
  DISO7_10003837
  Located on chromosome 13
  Distance between a terminus base of telomere on chromosomal short arm and 5'-terminus of this base sequence : 89051171
  Distance between 3'-terminus of neighbour sequence of sequence listing upward to telomere on chrosomal short arm and 5'-terminus of this base sequence : 23651
cttggaagattaaattgcctctgtgtgtgtgtgtatatgcgtgtctgggtgtgtgcatgtgtgtgtgagtgtgtgtgtgtgtgtgtgtgtgtgtgtgtgtgtgagacagactcctgcagaacagg

SEQ ID NO: 20208 - DNA, 101 bp, Homo sapiens
  DISO7_10003839
  Located on chromosome 13
  Distance between a terminus base of telomere on chromosomal short arm and 5'-terminus of this base sequence : 89096333
  Distance between 3'-terminus of neighbour sequence of sequence listing upward to telomere on chrosomal short arm and 5'-terminus of this base sequence : 45037
aaggtagctagttagcagtggctcagtataaattcaaaatggatatatatatatatatatatataacctgtaaaatgcattaatttcaattattgccactt

SEQ ID NO: 20209 - DNA, 468 bp, Homo sapiens
  chr13.fa.O7frz.91956891
  Located on chromosome 13
  Distance between a terminus base of telomere on chromosomal short arm and 5'-terminus of this base sequence : 89157448
  Distance between 3'-terminus of neighbour sequence of sequence listing upward to telomere on chrosomal short arm and 5'-terminus of this base sequence : 61014
ccagtcctcaacttagaatttctgggatttatgacgagaatagccctattcttcacacacacacacacacacacacaaaggctgattgggcctttttctcttttttttagtataataacagataaatttttcaagatttaaaattttcctgttaagaaaattaaatataggcctagaaagtgcagtggaatagtgttttgtagaaaagaagatttatctaacaaagtctgactaaatcatcaaatttggagcagcccattataggggtatgagaagactgtgtgtcagtttcaagcctattgaaagaattagaggctgctcctgggaatgaacctagtatagtgtttatgtcaaattttgcttggtttgcattgtgagtaaataaaatatacatttattaactctgttgctaatgtggcaacgggaacagagagaaaaagaggagatatcacctgctaattaacgttc

SEQ ID NO: 20210 - DNA, 407 bp, Homo sapiens
  chr13.fa.O7frz.92244682
  Located on chromosome 13
  Distance between a terminus base of telomere on chromosomal short arm and 5'-terminus of this base sequence : 89448508
  Distance between 3'-terminus of neighbour sequence of sequence listing upward to telomere on chrosomal short arm and 5'-terminus of this base sequence : 290592
caactacaatagagctaaatccacaatatgcatggattaaatgccttttttggggggctcacacccgtaatcccagcactttgggaggctcaggtgggaagctcacctgaggtcaggaattcaagaccagcctgaccaacatggcgaaaccctgtctctactaaaaatacaaaaattagccgggcatggtggtgggcacctataatcccaactatttgggagactgaggcaggagaatttctagaacccagaggcagaggttgcagtgagccgagatcgtgccattgcactctagcctgggcgaccaagtgagactcattacacgcacacacacacacacacacacacacacacacacacacagccattaaaggctgttgtgacattcattttgtctgaagctaaat

SEQ ID NO: 20211 - DNA, 459 bp, Homo sapiens
  chr13.fa.O7frz.92442704
  Located on chromosome 13
  Distance between a terminus base of telomere on chromosomal short arm and 5'-terminus of this base sequence : 89505483
  Distance between 3'-terminus of neighbour sequence of sequence listing upward to telomere on chrosomal short arm and 5'-terminus of this base sequence : 56568
attaagaataactaggccgagtgtggtggctcacgtctgtaatcccagcactttgggaggccgaggcaggtggataacctgaggtcaggagttcgatagcagactgaccaacatggtgaaaccccatctctattaaaaatataaaatcagtttggcgtggtggcacatgcctgtaatcccagctacatgggaggctgaggcaggagaattgcttgaacccaggaggcagaggttgcagtgagccaagattgagccactgcactccagagcttgggcgacaaagtgagactcaataataataataataataataataataattttaaaaaagaataactatagctacaaattaggcaaggaaaataagtaaaaaatttccaaaattaagatgaaataaaattaaattaaaggcatcaaaaaggagaagaaactttttctccgtttctagataacatgatc

SEQ ID NO: 20212 - DNA, 129 bp, Homo sapiens
  D13S266
  Located on chromosome 13
  Distance between a terminus base of telomere on chromosomal short arm and 5'-terminus of this base sequence : 89562228
  Distance between 3'-terminus of neighbour sequence of sequence listing upward to telomere on chrosomal short arm and 5'-terminus of this base sequence : 56286
ccctctggagaaacacacacatgcgcatgagcgcgcgcgcgcgcacacacacacacacacacacacacacacacacacacacacaggcgagggcaaatgcaaattaaaaataagcagcataattctgcc

SEQ ID NO: 20213 - DNA, 383 bp, Homo sapiens
  chr13.fa.O7frz.92618037
  Located on chromosome 13
  Distance between a terminus base of telomere on chromosomal short arm and 5'-terminus of this base sequence : 89742076
  Distance between 3'-terminus of neighbour sequence of sequence listing upward to telomere on chrosomal short arm and 5'-terminus of this base sequence : 179719
aaattgagtaggaccaaagaagttaaagtatagcattttccactggaaacaattattaaaaataaatctaaaggatgtttttaaggcagaaagaaaataattctggatgtaaattttgatatgtatgaaataatgaagagaaaaataaaaaagataaatagacatactattgagaggagttaaattgatatatatatatatatatatataaacatataagctttatccttcaagaagtatgagttaaaaagcgactgagttctatataaagttttcacaaaactttatagtgttaaagttttacactatcagctctcagaaagcagcactgacaggaaaaggaaatctatgtctgcaatgtatgtattgattccagtcaagat

SEQ ID NO: 20214 - DNA, 198 bp, Homo sapiens
  chr13.fa.O7frz.92718965
  Located on chromosome 13
  Distance between a terminus base of telomere on chromosomal short arm and 5'-terminus of this base sequence : 89818320
  Distance between 3'-terminus of neighbour sequence of sequence listing upward to telomere on chrosomal short arm and 5'-terminus of this base sequence : 75861
tagaacagcataagtgaaccacctccataatcaaatcacctttcatggagtccctcccacaatatgtggggattatgggaattacaattcaaaatcagatttgggtggggatacagccaaaccatatcacatgtatagcctcaccagtgtgtgtgtgtgtgtgtgtgcacttaacttacatagcatgttacctctttg

SEQ ID NO: 20215 - DNA, 361 bp, Homo sapiens
  chr13.fa.O7frz.92806511
  Located on chromosome 13
  Distance between a terminus base of telomere on chromosomal short arm and 5'-terminus of this base sequence : 89905698
  Distance between 3'-terminus of neighbour sequence of sequence listing upward to telomere on chrosomal short arm and 5'-terminus of this base sequence : 87180
aattgcctaaggtcaggagtttgagaccagcctggccaatatggcgaaatcccgtctctactaaaaatacaaaaattagctgggcgtggtggcgggtacctgtaatcccagctgtccaggaggctgaggtttggtggcgggtacctttaatcccagctgtccaggaggctgaggcagaagaaccactggaacccgggaggcagaggctggcagtgagcagagattgtgccactgcactccagcctgagtgacagggcaagactccgtctcaaaaaaaagaaacaaaagaaagtgtgtgctagtgtatgtgtgtgtgtgtgtgtgtgtgttacagtggaggtttctattcattggtacgtca

SEQ ID NO: 20216 - DNA, 144 bp, Homo sapiens
  D13S1239
  Located on chromosome 13
  Distance between a terminus base of telomere on chromosomal short arm and 5'-terminus of this base sequence : 89914182
  Distance between 3'-terminus of neighbour sequence of sequence listing upward to telomere on chrosomal short arm and 5'-terminus of this base sequence : 8123
tttcgatgacatgattgtctatgtagataatcccaagggagatacacacacacacacacacacacacacacacacacacacacacacacacaatctcctagaacaaatacatgagttaagtaaagtcacaggatataagagcaa

SEQ ID NO: 20217 - DNA, 262 bp, Homo sapiens
  D13S1230
  Located on chromosome 13
  Distance between a terminus base of telomere on chromosomal short arm and 5'-terminus of this base sequence : 90074211
  Distance between 3'-terminus of neighbour sequence of sequence listing upward to telomere on chrosomal short arm and 5'-terminus of this base sequence : 159885
ggaggataaacatccaaactatcacaagtattttatccatttttatttgatttttgtctatggcataagataaaggtcccggctgggcaaggtggctcacgcctgtaatcccagcactttgggaggccaaggtggacagatccagtgaggttaggagttcaagaccagcctggccaacatggtgaaaccctgtctccactacacacacacacacacacacacacacacacacacacagacaaattaggtgagcatggttgcg

SEQ ID NO: 20218 - DNA, 165 bp, Homo sapiens
  D13S794
  Located on chromosome 13
  Distance between a terminus base of telomere on chromosomal short arm and 5'-terminus of this base sequence : 90156434
  Distance between 3'-terminus of neighbour sequence of sequence listing upward to telomere on chrosomal short arm and 5'-terminus of this base sequence : 81961
agtgtttcttatgtaggttgatgcaaaagtaatattggtttttgctctatctatctatctatctatctatctatctatctatctatctatctatccatctatcccgatatatgttaccaaaacaccaggggtttggtctaggtcctactgctcatggcacagaaa

SEQ ID NO: 20219 - DNA, 136 bp, Homo sapiens
  G09399
  Located on chromosome 13
  Distance between a terminus base of telomere on chromosomal short arm and 5'-terminus of this base sequence : 90220285
  Distance between 3'-terminus of neighbour sequence of sequence listing upward to telomere on chrosomal short arm and 5'-terminus of this base sequence : 63686
cactttaagaaagtggcatccatttatctatctatctatctatctatctatctatctatctaccaatcatctgtctatctgtctgtcttactctcatatattattttgtttgtctcttttcttatcttggtccccc

SEQ ID NO: 20220 - DNA, 124 bp, Homo sapiens
  D13S265
  Located on chromosome 13
  Distance between a terminus base of telomere on chromosomal short arm and 5'-terminus of this base sequence : 90410514
  Distance between 3'-terminus of neighbour sequence of sequence listing upward to telomere on chrosomal short arm and 5'-terminus of this base sequence : 190093
tctgccaattacattgcatattgcatgcatttacacacacacacacacacacacacacacacacacatatgtaatctcttttaataaaagcaaaactctttattgctttgttggtgggtcctcc

SEQ ID NO: 20221 - DNA, 257 bp, Homo sapiens
  chr13.fa.O7frz.93429864
  Located on chromosome 13
  Distance between a terminus base of telomere on chromosomal short arm and 5'-terminus of this base sequence : 90534436
  Distance between 3'-terminus of neighbour sequence of sequence listing upward to telomere on chrosomal short arm and 5'-terminus of this base sequence : 123798
agcatggtgcatattctttattttgaagaaagattcataatgtttatgtacattttttatttgaaattaatgtgtaaaagttaacatgtgtggtgtgtatgtgcctctgtgtgtgtgtgtgtgtgtgtgtgtgtctggcctttggaaaatcataaacttctaatttgagaataaacaatattcagaaaatactgaaatatgtaatatccagaaaataacagcacataattaattaatgtaacatcagtacttcgttg

SEQ ID NO: 20222 - DNA, 373 bp, Homo sapiens
  chr13.fa.O7frz.93555515
  Located on chromosome 13
  Distance between a terminus base of telomere on chromosomal short arm and 5'-terminus of this base sequence : 90568243
  Distance between 3'-terminus of neighbour sequence of sequence listing upward to telomere on chrosomal short arm and 5'-terminus of this base sequence : 33550
tataatttgccttaatctgtgaatgtgtatataaaatacaatgtttaaaaaaaatacatatattacacgtaaatatatttggccttaatgtgtaaaatggattggagaggaccagagtagattcagagatcagcatacacacacacacacacacacataaatgtatgtattatatgtttatatatatatggtgtacgtgatgtttagatatacatagtaaggtgattactacagttaagcaaattaacatacttattatctcatatagttttttcttttccttttttttaaattatgcatatatttgaaactatataaccatttccaagtttaaataactggtaagagtacctaaattctactcacttggcaa

SEQ ID NO: 20223 - DNA, 420 bp, Homo sapiens
  chr13.fa.O7frz.93644369
  Located on chromosome 13
  Distance between a terminus base of telomere on chromosomal short arm and 5'-terminus of this base sequence : 90699883
  Distance between 3'-terminus of neighbour sequence of sequence listing upward to telomere on chrosomal short arm and 5'-terminus of this base sequence : 131267
tgacaaagtaggatgagctaagttatctgttttgaaaaatatggacgatataatgccaaagagcttgcagtgtcattttacacacacacacacacacacacacacacacacacacacacacacagtgtttctgaaataatggctatatttcctttggaaaagttttaatataaaagacattcaagcctcaaaaatatcaaaaatgcattttcatgtaattattcatatattaaattttaccttctaaaatattgagataaaattctaagagaagaaatacctccacattattcattgtctatacgtctacactaaaattgttttgcttatggttcagctcagtgtattgaatagagtataagcctgggaaaaatatatcctgttctataatttcatagctgtcctgcactaacaatagtc

SEQ ID NO: 20224 - DNA, 451 bp, Homo sapiens
  chr13.fa.O7frz.93742041
  Located on chromosome 13
  Distance between a terminus base of telomere on chromosomal short arm and 5'-terminus of this base sequence : 90774393
  Distance between 3'-terminus of neighbour sequence of sequence listing upward to telomere on chrosomal short arm and 5'-terminus of this base sequence : 74090
gtggttgtgttacatgacctatgcagttgttaaaactcataaaactgtaccccccaaaagtcaatttacaaagatgggtagatatatagatatagatatagatatagatatagatatagatatagatataggtatagatataggtatagatatagatatagatagatatagatgatatcgatatagatagtatagataaacctctatctacctacatctatatctatatctatctatagataaacctctatatatgtatctatctatcatctatctatctatatctctatctctctatctatctatctgaatgaatgaataaatttaatgcatgtgtctctgggcactctaaagctgagaaacaagagaagaaaccatcaaggcaatctgagaaaaagcaaccagtgggagaggagcaaaatcaagagtgtaatgtcttggaagtcaagtg

SEQ ID NO: 20225 - DNA, 476 bp, Homo sapiens
  chr13.fa.O7frz.93821082
  Located on chromosome 13
  Distance between a terminus base of telomere on chromosomal short arm and 5'-terminus of this base sequence : 90853299
  Distance between 3'-terminus of neighbour sequence of sequence listing upward to telomere on chrosomal short arm and 5'-terminus of this base sequence : 78455
gattatgcattagattggaaatacttaatagaaaggcaatctttatgcagatattaatgataaataaataaggttttaaaatctgggatatcatacagagcaggtgattgggaaacttagttgagaattacacacacacacacacatatatacacacaaacacacacaaacacaagtacacatggtggtaaatgtaatctggctgttaagaatgttcactgataatcagctaatagccagaagaactttgcattgtgcagtgtcctgctaaaggcaaataacacacatttagatatatttttatcactacaaacaccacataatgtccatgatggcagaaatgtttgtctttgtgtgtgtgtgtgtgtgtgtgtgtgtgtgtgtgtgtgtgagagagagagagagagagagagagagagacaggatctaactctgttacccagactggagtacagtggcatgattatagcttattg

SEQ ID NO: 20226 - DNA, 458 bp, Homo sapiens
  chr13.fa.O7frz.93903902
  Located on chromosome 13
  Distance between a terminus base of telomere on chromosomal short arm and 5'-terminus of this base sequence : 90936178
  Distance between 3'-terminus of neighbour sequence of sequence listing upward to telomere on chrosomal short arm and 5'-terminus of this base sequence : 82403
gctgatttatctgcaggtattaaaactgcagcatttacactccagaagttagtaaatataaaccataaggggaacatatccaccatatagattttattaaaataaaacaataaaaatcatgccaaagttcattgcatttttttttcattaaaatcatactagttcaaattttgaatgcctgctgctggaagtctataaaagaaatcataggttatatcaataaataatgacactttgccacaaatgatgaatagttttaactctgttgttctttaatttatatgtcttttagacctattctctctctctctctctctctctctctctctctcacacacacacacacacacacacacatacacaaacatacatacatatgatttacaatattcataagtgccctgcttgtaaggttttcgtccatgccatgagacttatatcctagacgaaaccaatct

SEQ ID NO: 20227 - DNA, 415 bp, Homo sapiens
  chr13.fa.O7frz.94153811
  Located on chromosome 13
  Distance between a terminus base of telomere on chromosomal short arm and 5'-terminus of this base sequence : 91188244
  Distance between 3'-terminus of neighbour sequence of sequence listing upward to telomere on chrosomal short arm and 5'-terminus of this base sequence : 251608
cttagtaatgttgatcctgaagatcaagtatattttcaaaaatgcttaagcatggagtaagagaacaatgtaaattgttctctctctccctgtctttctctcttttctctctctctctccctctctctcacacacacacactctcactctatctccacacacacacacacacacacacacatcaacattctgaatgccacataaaaaatttctgagacctttcatttctatgacttgatttatggacaataaacttcagtcatgtaataaaatgtaacttagtttatgcatggaaaatataacttagaaaatcaccatctgtatactaaaaataaattgatggacacagataacaggggatacagtacaatacagttacagaaacacagtaatcttgtaagtggtaagcaaattg

SEQ ID NO: 20228 - DNA, 299 bp, Homo sapiens
  chr13.fa.O7frz.94313030
  Located on chromosome 13
  Distance between a terminus base of telomere on chromosomal short arm and 5'-terminus of this base sequence : 91335859
  Distance between 3'-terminus of neighbour sequence of sequence listing upward to telomere on chrosomal short arm and 5'-terminus of this base sequence : 147200
ttaggatgatagcactgaacaggatacaaaaaaattctccctctctcataaatatatatatatgtatatatgtatatatacatgtgatactgatatgtatatatgtatacacacatatgatacatatatgtatacatgcacatatatgatatatgtgtctatgtatatacgcacatatacatatatgatacatatatgtatcatcctaatatatataggattttatatatatatatatatatatatatatatatgataaggagagtttattaagtgttaacttacatgatcacaaggtc

SEQ ID NO: 20229 - DNA, 374 bp, Homo sapiens
  chr13.fa.O7frz.94551420
  Located on chromosome 13
  Distance between a terminus base of telomere on chromosomal short arm and 5'-terminus of this base sequence : 91573943
  Distance between 3'-terminus of neighbour sequence of sequence listing upward to telomere on chrosomal short arm and 5'-terminus of this base sequence : 237785
ttcatttacttaggagttcagaagaggtaaggtatgctgaggaactctctcacattcaagcacacacacacacacacacacacgcgcacacacacacacctgtggaataagcatctctcactcccctttatgctgaatgaacttgccaagggcttccgttggtagtggccattacagatgtcctcttatgctggatttggaacaggacatgagaggagagtcaggcttggactggcacaggaaatgaggattctgccaaagtaagaggggatccgggtgccctctgaagagctgagactcagtgccttgtcagaagggcttctcgtgggctcaagggagaaagggagaagggctaagatttccatgagatggat

SEQ ID NO: 20230 - DNA, 455 bp, Homo sapiens
  chr13.fa.O7frz.94672681
  Located on chromosome 13
  Distance between a terminus base of telomere on chromosomal short arm and 5'-terminus of this base sequence : 91718517
  Distance between 3'-terminus of neighbour sequence of sequence listing upward to telomere on chrosomal short arm and 5'-terminus of this base sequence : 144200
gctctttggagtaggtatagcttcagactcacctgaagtttctttgaattttctaacagattcttcaaagataaagtaagaaagtgttcttgtttattttatagcatatctttccatcacatttttatttccttatctatatgccagagtgtctgagggactcttttaaaagtctgccagaagtcaagttaaaagaagacttttagtgtgatactagattctagtctcagacttctctgtaagctcaagttatagttgttctgagcctctcagcactgtggagagagaagcaggtagaacccagggtagatagcgggccccagtcagtgcgacttgagaaaaacaaaaattcacacacacacacacacacacacacacatacgcacacacactcaaaatctccccaacagccataaacaccttcttttagagtatgctgtcagttaaagctttat

SEQ ID NO: 20231 - DNA, 368 bp, Homo sapiens
  chr13.fa.O7frz.94768324
  Located on chromosome 13
  Distance between a terminus base of telomere on chromosomal short arm and 5'-terminus of this base sequence : 91814433
  Distance between 3'-terminus of neighbour sequence of sequence listing upward to telomere on chrosomal short arm and 5'-terminus of this base sequence : 95461
acaacttggattacatttaatgagggtttgtataagaactctatgtgtgtgtgtgtgtgtgtgtgtgtgtatctatctatagatagatagatagatagatagatagatagatagatagatattttttaaaatattttatccttttaatcctctgaagagaataagtgaccggcccaatgtctcatagctaaagtgtaaccacacctagtttaaattccacattattcagagtacaaatgtaaagaaatgaatgtaattattcatttttaaacaaatttaaccttctgtatgtagatgatttaaatgcaattttggaaataatgctgttctatagcgaatgaaaagaagtggttatttgagctctatgg

SEQ ID NO: 20232 - DNA, 394 bp, Homo sapiens
  AL162375.12_7890
  Located on chromosome 13
  Distance between a terminus base of telomere on chromosomal short arm and 5'-terminus of this base sequence : 92029898
  Distance between 3'-terminus of neighbour sequence of sequence listing upward to telomere on chrosomal short arm and 5'-terminus of this base sequence : 215097
gtggagatgctagtctagcttccaccctttgccactggctgtccttagagatatatctctcttcaggcaatcatgatgcttcctgtggtttgaggcatggacaggtctcccgccaaagaaaagatggtggggaagctgcttgtccacctcaatttcactttttctagtgtagaaaacatgagtcaaggacaagtttttgcacactggtgccagtcagcttgggataaggagtgttgcatatgtgaaaatctgattctctcacagtctggttggagagttgttgttgttgttgttgttgttgttggttgtttgcttgtttttacttttttttgtgaccccaggaactgactcatcttcatatttgagttctgggatattcctggtgacagtttca

SEQ ID NO: 20233 - DNA, 339 bp, Homo sapiens
  HUMUT2186
  Located on chromosome 13
  Distance between a terminus base of telomere on chromosomal short arm and 5'-terminus of this base sequence : 92121974
  Distance between 3'-terminus of neighbour sequence of sequence listing upward to telomere on chrosomal short arm and 5'-terminus of this base sequence : 91682
ctcatccctcatgtagctagatatgctgcttccactgctgctgctgctgctgctgtgtgtgtgtgtgtgtgtgtgtgtgtgtgtgtgtgtgtgtgtgtgtatgtttaggccttttgtcttctaagctggttaacctgtagcagaatgttacttgttgactccaaattcatgacttcaagtttgagaagatattctgtttagcatagttggcttgaattaatgaacacagaaaacatcctttcatattagatatgcttgtgattggttataaaagttaaaacttaagtatgtggttttgtatgaacattaatcaaccattgctggaaaaactgtactcaa

SEQ ID NO: 20234 - DNA, 452 bp, Homo sapiens
  AL138714.8_153394
  Located on chromosome 13
  Distance between a terminus base of telomere on chromosomal short arm and 5'-terminus of this base sequence : 92193259
  Distance between 3'-terminus of neighbour sequence of sequence listing upward to telomere on chrosomal short arm and 5'-terminus of this base sequence : 70946
gaaattgtgagcaatttaattcagatggttaggaggctaatatttacaattaataattaggctgggccgggtgcagtcgctcatgcctataatcctagcatttcgggaggctgaggctggcggatcacgaggtcaggagatggtgaccctcctggccaacatggtgaaaccctgtctctattaataatataaaaattagctgggcatggtggtgtgtgcctgtaatccctgcttcttcgtaggctgaggcaggagaattgcttgaaccagggagttggaggttgcagtgagccaagatcataccattgcactccagcctggggacagagtgagactctgtctcaaaataataataataataataataataataataataataatcaggctgttgtggcacattagggaaacaggcttcccaagtaccatactattctggccaagaatatgat

SEQ ID NO: 20235 - DNA, 159 bp, Homo sapiens
  DISO7_10003843
  Located on chromosome 13
  Distance between a terminus base of telomere on chromosomal short arm and 5'-terminus of this base sequence : 92271560
  Distance between 3'-terminus of neighbour sequence of sequence listing upward to telomere on chrosomal short arm and 5'-terminus of this base sequence : 77849
cgacttctcaatcattaagataatctgaagaaaattttaaaatttctctctgtctcacacacacacccacacacacaaacacacaatcaccaacaaacatgagggactatatatataaattagaccaacttcttactaagaacagttaggaaatctcca

SEQ ID NO: 20236 - DNA, 109 bp, Homo sapiens
  DISO7_10003844
  Located on chromosome 13
  Distance between a terminus base of telomere on chromosomal short arm and 5'-terminus of this base sequence : 92336854
  Distance between 3'-terminus of neighbour sequence of sequence listing upward to telomere on chrosomal short arm and 5'-terminus of this base sequence : 65135
ttataagagaaacaacttgctaaggataatatatatatgcgtgtgtgtgtgtgtgtgtgtgtgtgtgtgtgtgtgtgtgtgtgaaatacatacctatggcattcattca

SEQ ID NO: 20237 - DNA, 209 bp, Homo sapiens
  D13S1300
  Located on chromosome 13
  Distance between a terminus base of telomere on chromosomal short arm and 5'-terminus of this base sequence : 92648780
  Distance between 3'-terminus of neighbour sequence of sequence listing upward to telomere on chrosomal short arm and 5'-terminus of this base sequence : 311817
tgcaccttgagtaactggaaaatcaagaacaaacaaaaccccaaattgctagaaggaaaggaataacaaagatccgagcagaaccaaacagaatggagacaacacacacacacacacacacacacacacacacacacacacacacatcaatgatgaaacagaaagttgtttttttgaaaaaataaactaaattgataacccactaggaa

SEQ ID NO: 20238 - DNA, 383 bp, Homo sapiens
  chr13.fa.O7frz.95747671
  Located on chromosome 13
  Distance between a terminus base of telomere on chromosomal short arm and 5'-terminus of this base sequence : 92743892
  Distance between 3'-terminus of neighbour sequence of sequence listing upward to telomere on chrosomal short arm and 5'-terminus of this base sequence : 94903
aataagatttcacttatagaggcaggaatggagaagacaatataatagacatcttaaatataataaattactttggaggggtgtgtgtgtgtgtgtgtgtgtgtgtgtgtgtgtgtaggctcaaatgctgaatgaattctgactttgtttattaagcacacacacacacaaaataaacagagatacaggacaaagacatacttttgattcttctaaaaaaaagttatattcttgtttttcatagcctgacaaaagacaaggcagcttttgtctctgaaactctcacttcttcatgacttgaaatagtgtgcattctttctgattacccttaatatcagcaagcatttattgatcatttactgtgaatcagaaattgttctgag

SEQ ID NO: 20239 - DNA, 175 bp, Homo sapiens
  DISO7_10003850
  Located on chromosome 13
  Distance between a terminus base of telomere on chromosomal short arm and 5'-terminus of this base sequence : 92856699
  Distance between 3'-terminus of neighbour sequence of sequence listing upward to telomere on chrosomal short arm and 5'-terminus of this base sequence : 112424
aatattgcagtctgatctgtatccaaaataaggcataagtctcagtctctctctctctctctctctctctctctctctctcacacacacacacacacacacacacacacacacacacacatatacacacgccctatcctgaacagttaaatttccttctcaaatgagtaatggaa

SEQ ID NO: 20240 - DNA, 103 bp, Homo sapiens
  DISO7_10003851
  Located on chromosome 13
  Distance between a terminus base of telomere on chromosomal short arm and 5'-terminus of this base sequence : 92890758
  Distance between 3'-terminus of neighbour sequence of sequence listing upward to telomere on chrosomal short arm and 5'-terminus of this base sequence : 33884
agtgtagggagagcaacagacagacacacaggcactcagacacacacacacacacacacacacacacacacacacgcacacacacgggaggttacgccttctc

SEQ ID NO: 20241 - DNA, 155 bp, Homo sapiens
  DISO7_10003853
  Located on chromosome 13
  Distance between a terminus base of telomere on chromosomal short arm and 5'-terminus of this base sequence : 93014883
  Distance between 3'-terminus of neighbour sequence of sequence listing upward to telomere on chrosomal short arm and 5'-terminus of this base sequence : 124022
ggaagtcaatctgaaggagagaacatacctttaataacttctgacacacacacacacacacacacacacacgtaggtatatatacacatatatataaaacttaagcatgtttatacatattctcagattagtaagagtctccgtatacacatcaa

SEQ ID NO: 20242 - DNA, 141 bp, Homo sapiens
  DISO7_10003854
  Located on chromosome 13
  Distance between a terminus base of telomere on chromosomal short arm and 5'-terminus of this base sequence : 93098417
  Distance between 3'-terminus of neighbour sequence of sequence listing upward to telomere on chrosomal short arm and 5'-terminus of this base sequence : 83379
ttagctcctgcgatctaccttatatatatatatagacacacacacacacacacacacacatataatacatatatgtatatgtatttatatatacatgcacacatttttctatatgttcagtgtgataccaatcaacagcca

SEQ ID NO: 20243 - DNA, 212 bp, Homo sapiens
  chr13.fa.O7frz.96161424
  Located on chromosome 13
  Distance between a terminus base of telomere on chromosomal short arm and 5'-terminus of this base sequence : 93166755
  Distance between 3'-terminus of neighbour sequence of sequence listing upward to telomere on chrosomal short arm and 5'-terminus of this base sequence : 68197
tacctaatgctagatgacgagatagtgggtgcagcgcaccagcatggcacgtgtatacatatgtaactaacctgcacaatgtgcacatgtaccctaaaacttaaagtataataataaaaaataaataaataaataaataaataaataaaaagaaaataaacagttgaagatagtgaatctgacacatttagtaatgagcaaatcctattgtg

SEQ ID NO: 20244 - DNA, 338 bp, Homo sapiens
  DISO7_00003137
  Located on chromosome 13
  Distance between a terminus base of telomere on chromosomal short arm and 5'-terminus of this base sequence : 93249108
  Distance between 3'-terminus of neighbour sequence of sequence listing upward to telomere on chrosomal short arm and 5'-terminus of this base sequence : 82141
gacagctaccctgacttccttcagatgctctttgtagtgtgtatatgtgtgtgtgtgtgtgtgtgtgtgtgtgtgtgtgtgtgttggggtgtgggggcgcgggtgtactattttctgcatactatgatgttttcacgtcttaaaaatcctttctaaggagagactgcccctcctgccgctactcaattcttagaggtagaagagcctagccaggagcacacctttcatttgcaaatgaaccaatctagagccagccctcccctatctggctcttacactccaacaggcaatattcttttgcttgaatcatcccagggccagataccaggtgactaagg

SEQ ID NO: 20245 - DNA, 426 bp, Homo sapiens
  AL159151.13_152585
  Located on chromosome 13
  Distance between a terminus base of telomere on chromosomal short arm and 5'-terminus of this base sequence : 93434124
  Distance between 3'-terminus of neighbour sequence of sequence listing upward to telomere on chrosomal short arm and 5'-terminus of this base sequence : 184678
ctttcatcttggtgttaaatctacctctctagtgccttccttactcatctgtaagttgaatgggtttgttgggagatgcatttctcaaactactcttctgtgaggcacagttccacctgaagcctagagactcatttccatcctggagtcataatgactatcccattcatagaagtgtctaaagaatagagaacaggtggcacatgtatacatatgtaactaacctgcacattgtgcccatgtcatgtaccctaaaacttaaagtataataataataataataataataataataaagaatagagaacaggtgaagactggtaaaccatctgtgagccaatgagcattttgaaggacagtggtaaagggttataaagcatttgactcacagcccaagaatgaaaagcctaatttgtctaagacttt

SEQ ID NO: 20246 - DNA, 426 bp, Homo sapiens; identical to SEQ ID NO: 20245
  AL160393.8_2306
  Located on chromosome 13
  Distance between a terminus base of telomere on chromosomal short arm and 5'-terminus of this base sequence : 93434124
  Distance between 3'-terminus of neighbour sequence of sequence listing upward to telomere on chrosomal short arm and 5'-terminus of this base sequence : -426

SEQ ID NO: 20247 - DNA, 140 bp, Homo sapiens
  D13S322
  Located on chromosome 13
  Distance between a terminus base of telomere on chromosomal short arm and 5'-terminus of this base sequence : 93696210
  Distance between 3'-terminus of neighbour sequence of sequence listing upward to telomere on chrosomal short arm and 5'-terminus of this base sequence : 261660
attttttcaagtcatgtgtttgtaatcttggatatagatgatagatagatagatagatagatagatagatagatagatatagtaattctaccttatttctaaatatacagtatttcacagtatcaatgaatcatagttca

SEQ ID NO: 20248 - DNA, 272 bp, Homo sapiens
  chr13.fa.O7frz.101854444
  Located on chromosome 13
  Distance between a terminus base of telomere on chromosomal short arm and 5'-terminus of this base sequence : 93791894
  Distance between 3'-terminus of neighbour sequence of sequence listing upward to telomere on chrosomal short arm and 5'-terminus of this base sequence : 95544
ttgaactacaccttgcaattacaagttttgtatttcttttagtacttatttaccttgtccattcatccatccatccaaccatccatctgtccatccatccgtctgtccatccattcatccgtccgtccatccatccatccatccatccatccatccatccatccatccattcacttatcattcattcaattaagtgtttatttaatactgactatatgccaggcaatgttctaggcattggaatcttttaaagactaaatacaggtcctcat

SEQ ID NO: 20249 - DNA, 363 bp, Homo sapiens
  chr13.fa.O7frz.101635661
  Located on chromosome 13
  Distance between a terminus base of telomere on chromosomal short arm and 5'-terminus of this base sequence : 93978988
  Distance between 3'-terminus of neighbour sequence of sequence listing upward to telomere on chrosomal short arm and 5'-terminus of this base sequence : 186822
acggtcagtacatattcagactagacctctttgtgtgtgtgtgtgtgtgtgttttttttttttttttttttttttgagacggagtctatacctcttcgtgtttttgtgggtttttttgttgtttgttttgttttgttttgtttttgagacggagccttgctctgtcacccaagctggagtgcagtggcacgatctcggctcactgcaagctccgcctcctgagttcacgccattctcctgcctctgcctccggagtagctgggactacaggcgcctgccaacacgcccggctaattttttgtattttttagtagagacagggtttcacggtgttagccaggatggtctcgatctcctgacctc

SEQ ID NO: 20250 - DNA, 284 bp, Homo sapiens
  D13S1241
  Located on chromosome 13
  Distance between a terminus base of telomere on chromosomal short arm and 5'-terminus of this base sequence : 94097602
  Distance between 3'-terminus of neighbour sequence of sequence listing upward to telomere on chrosomal short arm and 5'-terminus of this base sequence : 118251
ataattgtaatggccttccctatgaataaaatagtattattactttgtacctttgctaaggactagggtctagggaaagtcaggcaggcagaaaaagatagttgtctttgacttcagtggtggaaaatatattcccaaaataatcacactggactatggagtgccactggaagaactctttaaaaaacaaaacccccccaacacacacacacacacacacacacacacacacacacacacacacacacacagagtaaatccctgaggtccaaactcaactggag

SEQ ID NO: 20251 - DNA, 280 bp, Homo sapiens
  chr13.fa.O7frz.101431542
  Located on chromosome 13
  Distance between a terminus base of telomere on chromosomal short arm and 5'-terminus of this base sequence : 94182990
  Distance between 3'-terminus of neighbour sequence of sequence listing upward to telomere on chrosomal short arm and 5'-terminus of this base sequence : 85104
ataggaagctgataatcctacaacagacttccccaggctcaaataaccaagagtcactgaaaacatggagcttttcagcaaatcctaagctgggtatcaaagatatgttcccagttaccaaagataggcccaacaccaaagcctaaggggtgtgtgtgtgtgtgtgtgttgatttttaaatacaaaaataattcctcatatctaaaacaggaaaagatgccataatgggttgacaactttataatgggaacagtttcacttaggaggtggagtaacaaag

SEQ ID NO: 20252 - DNA, 464 bp, Homo sapiens
  chr13.fa.O7frz.101325177
  Located on chromosome 13
  Distance between a terminus base of telomere on chromosomal short arm and 5'-terminus of this base sequence : 94289118
  Distance between 3'-terminus of neighbour sequence of sequence listing upward to telomere on chrosomal short arm and 5'-terminus of this base sequence : 105848
gaactagactcagtcacgtgagcctcctaagcaggttaataacttgtcactcctctactgtagctgtctttaaatattgttttttaaaaaaatgtctacgtggaagaggcagaatgttgcagaagggaaagcaggggacgatggattgttgggggcaatggtcagttttacttttcttgtcctgagaaactccgctctctcaaactcataggtaccctctcaacaaaacaaaagccctgcaattaaaacgacccacggtcttcagaagatatttacttgaccattggttgttgtaaaagcccacctcctgagagcctcaatatcacacctagtaactcatcacttattcatcttaaaccaaacgctactttccctgattatatatatatatatatatatatatataaaatatattctattatattttatatatataatttttcttgctgttacatttccagtaa

SEQ ID NO: 20253 - DNA, 329 bp, Homo sapiens
  chr13.fa.O7frz.101198957
  Located on chromosome 13
  Distance between a terminus base of telomere on chromosomal short arm and 5'-terminus of this base sequence : 94415559
  Distance between 3'-terminus of neighbour sequence of sequence listing upward to telomere on chrosomal short arm and 5'-terminus of this base sequence : 125977
aagtagcaaacatacgtgacttagctgcttccattacagagttgtttagtgaaggtgaaaatgataatgttatacagaaatcttttaggaaaggctcatgttaatatgctatgtgaaactgaaagctgagtatggattacactcttcataaatatatatatatatatatatatatatatatatatgtctggatggggtcctggaagatgcttattcattaatgaataagaaaaaaaatattcctcagtcaaattgactcttagaaggcagtttagagggattttggagaaaaatatttatataaggataccagttgctgattagtttaa

SEQ ID NO: 20254 - DNA, 448 bp, Homo sapiens
  chr13.fa.O7frz.100887981
  Located on chromosome 13
  Distance between a terminus base of telomere on chromosomal short arm and 5'-terminus of this base sequence : 94595386
  Distance between 3'-terminus of neighbour sequence of sequence listing upward to telomere on chrosomal short arm and 5'-terminus of this base sequence : 179498
acagtgataagttcctgttatcacctctctaattatatccattaccacttccttatccacactaaccaattaattcattaatcagttaacaaacctcaaattaatacctatcaggacactttactagatattatggggtacaaaaattggtatgtgacactcttccctactctgaaggaattcccagcctattcaggagtcaagaatttgtatgtgtgtgtgtgtgtgtgtgtgtgtgtgtgtatctgtgtgtctgtgtgtgtctatatgtgtgtctgtgtatgtctgtgtgtatgtgtgtgtatctgtgtgtgtctgcatgtgagtctgtgtctgtgtgtatatgtgtgtctgcatatatgtgtctgtgtgtgtgtgtgtgtgtgtgtgtgtgtgatttcagcactactgaattgaagggagcatttccagtatactgagataagca

SEQ ID NO: 20255 - DNA, 408 bp, Homo sapiens
  chr13.fa.O7frz.100747835
  Located on chromosome 13
  Distance between a terminus base of telomere on chromosomal short arm and 5'-terminus of this base sequence : 94735389
  Distance between 3'-terminus of neighbour sequence of sequence listing upward to telomere on chrosomal short arm and 5'-terminus of this base sequence : 139555
gaggtcaggaaatcgagactatcctggctaacatggtgaaaccccgtctctagtaaaaatattttaaaaattagctgggtgttgtggtgggcacctgtagtcccagctacttgggaggctgaggcaggagaatggcttgaacccaggaggcagagcttgcagtgagccgaaattgtgccactgcactccagcctgggcaacagagcgagactccgtctcaaaaaaagaaaaaagaaaagaaaagaaaaaagtagggagggagggagggaggaaagaagaaaggaaggaaggaaggaaggaaggaaggaaggaaggaagggaaaaaataaatgcacccagcaaaaagaaaatatttcaaaggccattcaagctaggatccttgcaaagtagtgatcaaatgattcaagc

SEQ ID NO: 20256 - DNA, 437 bp, Homo sapiens
  chr13.fa.O7frz.100375541
  Located on chromosome 13
  Distance between a terminus base of telomere on chromosomal short arm and 5'-terminus of this base sequence : 94829656
  Distance between 3'-terminus of neighbour sequence of sequence listing upward to telomere on chrosomal short arm and 5'-terminus of this base sequence : 93859
gatcaattagcaaatgattcacccacaccaacctccatcccaaccccattccagctcttaaaaactctctgtggcatgtgcctgtagccccagatattcaggaggctgaggcaggaggactgcttgagcctaaaagttcaaggccacagtgagctataattctataattgcaccactgcactccagcctgggcaacacagcaagactgtctcaaaaataaataaataaataaataaataaataaataaataaataaataaccccttccacccttccatcctttgtttcagcaaagttgagttcagactgtgttctggtctccctcccctagggcaacagccttaaataaagccttccttgcttgtttaactttatctcatgcaatttttgttgtaccctgccaaaacaccgtaccctgccataacttagttctttca

SEQ ID NO: 20257 - DNA, 277 bp, Homo sapiens
  chr13.fa.O7frz.100465900
  Located on chromosome 13
  Distance between a terminus base of telomere on chromosomal short arm and 5'-terminus of this base sequence : 95063504
  Distance between 3'-terminus of neighbour sequence of sequence listing upward to telomere on chrosomal short arm and 5'-terminus of this base sequence : 233411
gcaatcagtagcatttctatagaccaataacattcaagctgagagccaaatcaagaatgcagtcccatttacaatagccatacacacacacacacacacacacacacacacacacacacacaaataaaatacctaggaatacagctaactaaggagatgaaagatctctacaaggataattactaaacactgctgaaagtgatcatatattatgcaaacaaatgggtaaacattccatgctcacggattggaagactaaatattgttaacatggcca

SEQ ID NO: 20258 - DNA, 413 bp, Homo sapiens
  chr13.fa.O7frz.99897833
  Located on chromosome 13
  Distance between a terminus base of telomere on chromosomal short arm and 5'-terminus of this base sequence : 95161487
  Distance between 3'-terminus of neighbour sequence of sequence listing upward to telomere on chrosomal short arm and 5'-terminus of this base sequence : 97706
ggagtggagaattctttgttacaggggttttcctgtgcattgttgggtattcagcagcatttctggcctctgtccactagatggcagtagcaccccaccactccccggccatcacacattttctccagactttgccaaagctccccgaggggcatgattacccagttaagaaacactaataaagcttatagagtgtatgcatgagcacacacatacacacacacacacacacaaacccaatgtagtacaaatagctaaacaaaacataatatttttatttttttaatagtatgacagaattaaaaaaagaattagtcccattatcttcactatatagaagacattgcctataaagttaatttctgcaaggaaaattgtgttgtccacttacctcaggaatatgtcactatgga

SEQ ID NO: 20259 - DNA, 282 bp, Homo sapiens
  chr13.fa.O7frz.99713265
  Located on chromosome 13
  Distance between a terminus base of telomere on chromosomal short arm and 5'-terminus of this base sequence : 95350478
  Distance between 3'-terminus of neighbour sequence of sequence listing upward to telomere on chrosomal short arm and 5'-terminus of this base sequence : 188578
ggtacaaagttgattctgtcagggagaagcacaaggaaaggcacttttacaacggcatgttggtccagtaaaagttctgcagctactcctctctaatttaaaaacatatatatatatattatatatatatatatatatagctgcattagacacttaggttttgcaaaagatgccttcatttctcatgatggtatatacatacgttctggattacttgttacttaaaaatactgacttttgtcccacgtgttccaattttaggttacataaatgagcacacta

SEQ ID NO: 20260 - DNA, 259 bp, Homo sapiens
  D13S154
  Located on chromosome 13
  Distance between a terminus base of telomere on chromosomal short arm and 5'-terminus of this base sequence : 95385649
  Distance between 3'-terminus of neighbour sequence of sequence listing upward to telomere on chrosomal short arm and 5'-terminus of this base sequence : 34889
gtgctataaaggcttgctgcgttattctcaactgtggctgtttgggggttacaggtttgttctaagtttaatgggaatatgcacaacctactgactgcggcagtgatagcctgcctgtctccatatcattcaagaactctctgtctgtctctgtctctctctctctgtctctctctcacacacacacacacacacacacacacacacacacacacacacacacacacacacactaaaccagtcaagaccagggcaagag

SEQ ID NO: 20261 - DNA, 398 bp, Homo sapiens
  HUMUT5821
  Located on chromosome 13
  Distance between a terminus base of telomere on chromosomal short arm and 5'-terminus of this base sequence : 95478636
  Distance between 3'-terminus of neighbour sequence of sequence listing upward to telomere on chrosomal short arm and 5'-terminus of this base sequence : 92728
gccccgacttatttgtctgtatcgccagctcctaagcaagggctcagtaaatggccatggaagtcaggaagaaagaagaaaggagagagggaaggaagttaggaaagagaaaaatttaagaatgaaaaaacagaaagagatggaaagaaggaaagaagggaggaagggagagaaagaaagagaaaggaagagagggagggcgggagggaggaggacagggaaggaaagagaaagaatgaaaaagggagagagaaagaaaaaagggagagagggagggaggaaggaaggaaggaaggaaggaaggaaggaaggaaggaaggaaggaaggaaggagagaatctattaacttagagaatggcttcatcacaatggtctgtatgggtaaatattgcccatgg

SEQ ID NO: 20262 - DNA, 167 bp, Homo sapiens
  D13S1278
  Located on chromosome 13
  Distance between a terminus base of telomere on chromosomal short arm and 5'-terminus of this base sequence : 95548092
  Distance between 3'-terminus of neighbour sequence of sequence listing upward to telomere on chrosomal short arm and 5'-terminus of this base sequence : 69058
cccagacttgaagctggaatagagggagccactaggataacatgcatatttttccagatgaaaaaatggatacacacacacacacacacacacacacacacacgcatgtgcactcccccttctcgttttcccccaaattctcacagctaggagccatgctttgacag

SEQ ID NO: 20263 - DNA, 442 bp, Homo sapiens
  chr13.fa.O7frz.99270648
  Located on chromosome 13
  Distance between a terminus base of telomere on chromosomal short arm and 5'-terminus of this base sequence : 95571782
  Distance between 3'-terminus of neighbour sequence of sequence listing upward to telomere on chrosomal short arm and 5'-terminus of this base sequence : 23523
caacctagtaagacctcgtctctactaaaaaagaaaaaaaaaattagccagtcatggtggtgtgcacctgtagtcccagctactcaggaggccaaggcaggaggattacttgatctggagaggttgtgactgcagtgatcatgccattgcacttcagcctgggtgatacagcaagaccctgcctttaaagaaaagaatggaaggaacaaggaaggaaggaaggaaggaaggaaggaaggaaggaaggaaggaaggaaggaattcttaggaattcttatgcttttaccccttgatatggtttggctgtctccccacccaaatctcatcttgaattgtagctcccataattcccacgtgttgtgggagggaactcagtggggaataattgaatcatggaggcagtttccccccttctgttctcatggtagtgaataaatctcac

SEQ ID NO: 20264 - DNA, 197 bp, Homo sapiens
  HUMUT7403
  Located on chromosome 13
  Distance between a terminus base of telomere on chromosomal short arm and 5'-terminus of this base sequence : 95705659
  Distance between 3'-terminus of neighbour sequence of sequence listing upward to telomere on chrosomal short arm and 5'-terminus of this base sequence : 133435
tagccctcaccatgattggatcacctggacagccataaaaatatggatgtctgttccccttataggccaattggaaaaataatttctgggggtgggatccacgcatctatctatctatcatctatctatctatctatctatctatctatctatctatctatctattttttttgagacagagttttgctcttgttgcc

SEQ ID NO: 20265 - DNA, 284 bp, Homo sapiens
  chr13.fa.O7frz.99116063
  Located on chromosome 13
  Distance between a terminus base of telomere on chromosomal short arm and 5'-terminus of this base sequence : 95747850
  Distance between 3'-terminus of neighbour sequence of sequence listing upward to telomere on chrosomal short arm and 5'-terminus of this base sequence : 41994
aatcagctatttcttcaggaagctctggttccttttagataataatggttttggaaaccaagatctgggcaccagcatgctctcagctactggtgtgtcattgcttctggggcctgtctgtggatagagctagggactgtgtgtgtgtgtgtgtgtgtgcacatgttaacttttctctctctagctctatatattcatatctgtctgtctatatatagctgtatgtattttaaaggtaagtttaagcaaaacccatggaggtaggagtctacttaaacacggat

SEQ ID NO: 20266 - DNA, 433 bp, Homo sapiens
  chr13.fa.O7frz.98900024
  Located on chromosome 13
  Distance between a terminus base of telomere on chromosomal short arm and 5'-terminus of this base sequence : 95886335
  Distance between 3'-terminus of neighbour sequence of sequence listing upward to telomere on chrosomal short arm and 5'-terminus of this base sequence : 138201
gtgcagccatatgttagaataaatatctaaatagatttgttttgctttgcttgcctttgatttgtggctacaaaggacatacaaagagcaaaattcaaattttctggtccttaaatctaatctctctttaacttttggaaagaaactatgtgcatgccagactgttggcacctgtgtgtgtgtgtgtgtgtgtgtgtgtgtttgcacacctgtggctcaccctcaaatgtacccttctaattcttcatcctttaaggaccagcgaaagtctctctttcgcattagtgatgcttttctttaccactccattctgtaataaaacaatctctaggtcctgtaaaaagaagggatcatataacaccaggctgagcactgctctgagcatatttcacttgccccatctcatttaaacttcactcatagtcgttgagtc

SEQ ID NO: 20267 - DNA, 470 bp, Homo sapiens
  chr13.fa.O7frz.98624728
  Located on chromosome 13
  Distance between a terminus base of telomere on chromosomal short arm and 5'-terminus of this base sequence : 96128871
  Distance between 3'-terminus of neighbour sequence of sequence listing upward to telomere on chrosomal short arm and 5'-terminus of this base sequence : 242103
tctagatggtcttaatttgcttacattgaggtcagcttgcttagcatcagccatgggccttacatttttgtagccttcctcaaaatatggtagcaccatggtttctatcagagtccagaattcttgcattttttcccacatttgaccaaacattattattattattattattattattattattattattattattattattgagacagagtcttgctctgttgcccaggctggagtgcagtggcatgaacatggctcattgcagcctcaacctcctgggctcaggagatactcccacctgagcctcccgagtagctgggacaacaggtgctcaccaccacacccagctaatttttaaatgtttcatagacatgggggtctcactttgttgccgaggctggtcttgaatcccggggctcaagcgatcctcccaccttggcctcccaaagtgttaggattacaagcatcag

SEQ ID NO: 20268 - DNA, 312 bp, Homo sapiens
  chr13.fa.O7frz.98553946
  Located on chromosome 13
  Distance between a terminus base of telomere on chromosomal short arm and 5'-terminus of this base sequence : 96199663
  Distance between 3'-terminus of neighbour sequence of sequence listing upward to telomere on chrosomal short arm and 5'-terminus of this base sequence : 70322
gaacatccttctaattgcactaaagagagtgagagtacatgtgtagagcatgtgcacacacacacacacacacacacacacacacacacacacacatgcatatatacagcgcttattcttgagacttacccttgggctatattccctcatattgaataaataaaaagctcaagaaacctgtcaaagaggtgcccaatatatgtttttatgcttttagatatcaaccattccgtgttctgacttttacaatcatcagcaggccaaatgtgacatcagtttttacaaaatgtgatacttcataaggtcttggta

SEQ ID NO: 20269 - DNA, 399 bp, Homo sapiens
  chr13.fa.O7frz.98439144
  Located on chromosome 13
  Distance between a terminus base of telomere on chromosomal short arm and 5'-terminus of this base sequence : 96314282
  Distance between 3'-terminus of neighbour sequence of sequence listing upward to telomere on chrosomal short arm and 5'-terminus of this base sequence : 114307
caatcatgcaattaatgtatacaggcagccaggctttgtggttcacgcctgtaaacccagcactttgggaggccgaggtgggcagatcacttaaagccaggagttcaagaccagcctcgccaacatgttaaaaccctgtctctactaaaaatacaaaaattagccaggtgtggtggcacacgcctgtaatcccagctactagggaggctgaggcaggagaatcgcttgagcttgggaggtggaggctgcagtgagccaagatcacaccactgtacaccaggctgggcaacagagcaagactccatcatacacacacacacacacacacacacaccaaaaacaaaccaaaaaacctatagaggcaccactcaggaattaactcttcaacggtatcttcat

SEQ ID NO: 20270 - DNA, 441 bp, Homo sapiens
  chr13.fa.O7frz.98277640
  Located on chromosome 13
  Distance between a terminus base of telomere on chromosomal short arm and 5'-terminus of this base sequence : 96477701
  Distance between 3'-terminus of neighbour sequence of sequence listing upward to telomere on chrosomal short arm and 5'-terminus of this base sequence : 163020
ttagttgccagttgctgacacaaagatggccaatggttggactttctttctttcttccttccttccttcattccttccttccttccttccttccttccttccttccttccttccttcccttcgtttcccttctccttccttccttccttcttttcttttcttttctttattgcccagactggtcttgaactcctggactcaagtgatcgtcccacctcagctgctcaaagtgctgggattagaggtgtgagccactgtgcctggccctgaaatcatcttcaatggggtgaaatcagtggggaccatgctttcctttgaggctgtagtggggagaattcattccttgcctcttccaacttctggtggctaccagcattctttaaaaaatttttaaatttaattaattagtcaacgtattttgctactagcatgctttggctt

SEQ ID NO: 20271 - DNA, 217 bp, Homo sapiens
  chr13.fa.O7frz.98189267
  Located on chromosome 13
  Distance between a terminus base of telomere on chromosomal short arm and 5'-terminus of this base sequence : 96566052
  Distance between 3'-terminus of neighbour sequence of sequence listing upward to telomere on chrosomal short arm and 5'-terminus of this base sequence : 87910
cgagactccatctcgaatatatatatatatatatatacatatatatatacatatatatatatacatatatatatatgtatatatatatatgtatatatatatgtatatatatatgtatatatatatgtatatatatatatgtcaattctgattagtgtaaggtgatatcttaggatggttttaatttgcatttctctcatgattagtgatgttgagc

SEQ ID NO: 20272 - DNA, 397 bp, Homo sapiens
  chr13.fa.O7frz.98085581
  Located on chromosome 13
  Distance between a terminus base of telomere on chromosomal short arm and 5'-terminus of this base sequence : 96669440
  Distance between 3'-terminus of neighbour sequence of sequence listing upward to telomere on chrosomal short arm and 5'-terminus of this base sequence : 103171
gatccaaggagtctgattctactttttttctttgtgattataattttgtgaaataattttatttctgttccagaaataaaaaacctaggtcttgttctggctccttatctctgcacttctgatatgctgtccttgtgccataaatcttaactttgtgcctctgtttctcctattattttaaaaggagaggagtcaagatgagggaagataaataaggtaagataattctctattttggaatatatgtgcctgtgtgtgtgtgtgtgtgtgtgtgtgtgtgtgcacaagcataccaaaaatacctgatcttagtggaagaaaatataaataaatacagtcaaagtgattttagttatttcatctttctggattctagtgttctcactggtaaagtgag

SEQ ID NO: 20273 - DNA, 469 bp, Homo sapiens
  chr13.fa.O7frz.98000548
  Located on chromosome 13
  Distance between a terminus base of telomere on chromosomal short arm and 5'-terminus of this base sequence : 96754874
  Distance between 3'-terminus of neighbour sequence of sequence listing upward to telomere on chrosomal short arm and 5'-terminus of this base sequence : 85037
caaaagctccaccttctaataccatcccatgggggattagtatgaattttggggacacacaaacatgcagctcaagtaccatcattgttcatcctgccatttcccaagtatggtggactcagctcaagagcaagaatatgacgtcaacctagtcaagtccttcccttgtgcaatataccctcaggagcttcccagctggcccaaaggaaaaccattcctgcaggtgcctaaaagacctgcttcctctgtaattccaccttctgctctctccttcatgcttatacggcacctgcagcactggcctcactgctgtgcccccacactcttaggctgttcactgctctgttcccctctggtgcattcatcactctctgaaatactacctgtatgacttttatttattttattttattttattttattttatttactttctgtctcccaacactggaatatctactccaagagg

SEQ ID NO: 20274 - DNA, 283 bp, Homo sapiens
  AL161426.7_120638
  Located on chromosome 13
  Distance between a terminus base of telomere on chromosomal short arm and 5'-terminus of this base sequence : 96851170
  Distance between 3'-terminus of neighbour sequence of sequence listing upward to telomere on chrosomal short arm and 5'-terminus of this base sequence : 95827
ctatcctcaaagatcactctgaattacaccaaattaaatagatttaggaataaaagaacaaattatctatttttgtttgcatgtcaggaacaggtattttagacaagtctttgtaaaataaaagtatatcctttagttaaactagtgtttgcacacagatatccctctctctctctgtcttatacacacacacacacacacacacacacatacacacacactcccaaagaatgatcttttcctacaaaggaactaagaactgaacagataagcttggaattat

SEQ ID NO: 20275 - DNA, 344 bp, Homo sapiens
  AL161426.7_95087
  Located on chromosome 13
  Distance between a terminus base of telomere on chromosomal short arm and 5'-terminus of this base sequence : 96876728
  Distance between 3'-terminus of neighbour sequence of sequence listing upward to telomere on chrosomal short arm and 5'-terminus of this base sequence : 25275
gataccaacgacctggaatagtggcttgcatatagtaggtgctcagtaatattattgaataaatgagtgaatatatgaggatattaacaagaattctgattttatacatatatgcacacacatatattgtaattttaaatgtatatatatatacacatacatatatgcaagtgtacacacacacacacacacacacacacacatacataatgtatatacaggccaggaatttgaatatctagatttgagttatggctgtgatgctgatggacacttcttactggaggtttagtcgaggagcctgcttatgcccagagacactctctgaagcagaagtaaagcac

SEQ ID NO: 20276 - DNA, 344 bp, Homo sapiens
  AL161426.7_87564
  Located on chromosome 13
  Distance between a terminus base of telomere on chromosomal short arm and 5'-terminus of this base sequence : 96884181
  Distance between 3'-terminus of neighbour sequence of sequence listing upward to telomere on chrosomal short arm and 5'-terminus of this base sequence : 7109
catcaaggagtttacaatctagactgtcatgtaaataaaccaatacgatcaattgtcagaagtgctataatgattctatattatggagtacaaagtacataaggaagaagaaaggaaagacagatctttcacataagaaatcagagaataattcacaggagcactgacatatcaggtgaatcttgtaggataaaatgtccatgagtaaatagagtttttttaaattaagaagtttattattattattattattattattattattattattatatttactttaagttctggaatacatgtgctgaacgtgcaggtttgttacatagtaatacatgtgccatggt

SEQ ID NO: 20277 - DNA, 174 bp, Homo sapiens
  D13S775
  Located on chromosome 13
  Distance between a terminus base of telomere on chromosomal short arm and 5'-terminus of this base sequence : 96884315
  Distance between 3'-terminus of neighbour sequence of sequence listing upward to telomere on chrosomal short arm and 5'-terminus of this base sequence : -210
aagaaatcagagaataattcacaggagcactgacatatcaggtgaatcttgtaggataaaatgtccatgagtaaatagagtttttttaaattaagaagtttattattattattattattattattattattattattatatttactttaagttctggaatacatgtgctgaacg

SEQ ID NO: 20278 - DNA, 274 bp, Homo sapiens
  AL161426.7_43569
  Located on chromosome 13
  Distance between a terminus base of telomere on chromosomal short arm and 5'-terminus of this base sequence : 96928218
  Distance between 3'-terminus of neighbour sequence of sequence listing upward to telomere on chrosomal short arm and 5'-terminus of this base sequence : 43729
catattctaatgattgccagaatatatggatacaaacacaaatatctcttttctccctctttcctgtctatctgtctgtctgtctgtctatctatctatctatctatctatctatctatctatctatctataatctatctatctatctctcatggactccagtgaatattaagcacaccccatattgcatctctatacatagacacagagagagagagagagagagagagacagacagacagagagaggcctatgtttcatgaccatccttaat

SEQ ID NO: 20279 - DNA, 253 bp, Homo sapiens
  AL161426.7_193
  Located on chromosome 13
  Distance between a terminus base of telomere on chromosomal short arm and 5'-terminus of this base sequence : 96971661
  Distance between 3'-terminus of neighbour sequence of sequence listing upward to telomere on chrosomal short arm and 5'-terminus of this base sequence : 43169
ttcaacttgcctcaatagtgacatcttatatagctgttgtgtaatataaaaatgaggaaagtgacattagtacattgctattaactagtctgtagacctcagattttagagtttatgaacctgtattcacttgtgtgtgtgtgtgtgtgtgtgtgtgtgtgtgtctatacacagttctatgctattttatttcatgtattcatttgtggaaccaccaccaccacaatcaacatacagaactgttctatcacca

SEQ ID NO: 20280 - DNA, 174 bp, Homo sapiens
  D13S281
  Located on chromosome 13
  Distance between a terminus base of telomere on chromosomal short arm and 5'-terminus of this base sequence : 97084398
  Distance between 3'-terminus of neighbour sequence of sequence listing upward to telomere on chrosomal short arm and 5'-terminus of this base sequence : 112484
tgtccctgtttatatctcaatatcatgcctcacatccttgtaattatgactacatatccttgtgattgaccaaggaaaaagatttaaggaaatacacacacacacacacacacacacacacacagtcaattatctttattcatggtagttacgttctataaagtttctgtggac

SEQ ID NO: 20281 - DNA, 362 bp, Homo sapiens
  chr13.fa.O7frz.97590539
  Located on chromosome 13
  Distance between a terminus base of telomere on chromosomal short arm and 5'-terminus of this base sequence : 97162630
  Distance between 3'-terminus of neighbour sequence of sequence listing upward to telomere on chrosomal short arm and 5'-terminus of this base sequence : 78058
gctagtttagtcggctctagaccatcttgtaatcattaggtgaggaagttcattggtaaaatacttaaattcctgagacaaattattcacaaaagcattgctcagcttctttcaaaccaaggctatatatatatataccatctctctctctctctctctctctctctctctctctctctctctctctctctatcatctacctatctacccatccatccatccatccatccatccatctatctctctacccatctccaaaaggcagtgcccaaatgtcaggatggggcttataattttaactgattagggatgatgatgaaactcaggtcaaacaagccaatatctgcaaggaacagttaact

SEQ ID NO: 20282 - DNA, 178 bp, Homo sapiens
  DISO7_10003858
  Located on chromosome 13
  Distance between a terminus base of telomere on chromosomal short arm and 5'-terminus of this base sequence : 97215186
  Distance between 3'-terminus of neighbour sequence of sequence listing upward to telomere on chrosomal short arm and 5'-terminus of this base sequence : 52194
tgcagattattgttgaatcattctatgacttgttttaaacattaacattgtcaaacctttaataggagtaaccttagataagcatagaagttacatcttaaaattttattttgtgtgtgtgtgtgtgtgtgtgtgtgtgtgtgtgtgtatttttgtgatcgtgaaccataaagtcatt

SEQ ID NO: 20283 - DNA, 477 bp, Homo sapiens
  chr13.fa.O7frz.97400559
  Located on chromosome 13
  Distance between a terminus base of telomere on chromosomal short arm and 5'-terminus of this base sequence : 97350908
  Distance between 3'-terminus of neighbour sequence of sequence listing upward to telomere on chrosomal short arm and 5'-terminus of this base sequence : 135544
cctactgtaaccttcctggtacactctttgcttttgttcaattgctttgaaatgttctcaagtgaaatgccaggacattctgaaagaattctggctgtgtgtttaatcagtgggttcattgaatatggctgcatttggcgaagttttgcaccagactccttaatttcagggaaaaaatacaggaataaaatgtcagtttatgggccaccatttatttatttatttatttatttatttatttatttatttatttactcttgatggcaacagtaatctatgttgacaatatgggaagtaaaaagaacctaagtcacccataatctcaccacatcaattattaactatcatcattatttttataaaattcatcccctttaattcctctgcctacaaaaagtcatttaaaaatcctgtaatcctgctgcttacacaaactataatctgtacatttattttaatgaagcagtgaatatctcc

SEQ ID NO: 20284 - DNA, 178 bp, Homo sapiens
  DISO7_10003856
  Located on chromosome 13
  Distance between a terminus base of telomere on chromosomal short arm and 5'-terminus of this base sequence : 97496759
  Distance between 3'-terminus of neighbour sequence of sequence listing upward to telomere on chrosomal short arm and 5'-terminus of this base sequence : 145374
actgtaaactgtggctgcctttgccctcaaaacatgtgtgtatgtgtttctgtgtgtgtgtgtgtgtgtgtgtgtgtgacaattaaggattgtggatatactatgttaatttttgtttccttactcaaatacatttccagaatcaataaataaatgctgaatgaatacacaaatgaat

SEQ ID NO: 20285 - DNA, 280 bp, Homo sapiens
  AL138700.10_55172
  Located on chromosome 13
  Distance between a terminus base of telomere on chromosomal short arm and 5'-terminus of this base sequence : 97571116
  Distance between 3'-terminus of neighbour sequence of sequence listing upward to telomere on chrosomal short arm and 5'-terminus of this base sequence : 74179
ggcttcttaactttaagttccaacagcaaaactaaactggaataaaataattcaatgaaaacgtttgacaaataagaccaaaaacctctctctcacacattttttttctattatctgtagacaaaacaacaaaaacaacctcagtattacatgtatttttaaacttaaaaatgatgatgatgaagatgatgatgatgatgatgataccatgtatttgctattttctgctactaacatcagagtcttaaaagatttttagagttcagtggaaatttaaggc

SEQ ID NO: 20286 - DNA, 264 bp, Homo sapiens
  chr13.fa.O7frz.97023348
  Located on chromosome 13
  Distance between a terminus base of telomere on chromosomal short arm and 5'-terminus of this base sequence : 97668122
  Distance between 3'-terminus of neighbour sequence of sequence listing upward to telomere on chrosomal short arm and 5'-terminus of this base sequence : 96726
tgccattagctaagacacttattccgtttaatacatatatatatattatatataattttaatttgaagcacttcactaagaatgctgtctacatgagaatgttttcacacggcacacttattactgtatcataaatgcattttgcctgtgcttgtattccaagccaaggagactgagactgtgagatgtttcctaaactagccaggatctgagccaggattttaatccaggtcttctgatgttaagcacctttcattacataac

SEQ ID NO: 20287 - DNA, 393 bp, Homo sapiens
  chr13.fa.O7frz.96642728
  Located on chromosome 13
  Distance between a terminus base of telomere on chromosomal short arm and 5'-terminus of this base sequence : 97835289
  Distance between 3'-terminus of neighbour sequence of sequence listing upward to telomere on chrosomal short arm and 5'-terminus of this base sequence : 166903
gcatttaattacctagcctcagaaggcacatggcaatacttccatggtatattattggtcgagacagttacaaatatctgcccagatttaaggggagggaacatagcccttaactctcagtgggaaaaaatgccaatcttattataagaatggcatgtgaaatgggattttatatatatataaatatatatatacatatataaatatatatatacatatataaatatatatatacacatatacacacgtaaacacacataaatatgtgtgtaacatattagttctataatttatatataatgtatagcaatattacatatattgtatatatgtatgtatatttgtgtggctatctgtggaaaatacaatctatcatagtcacatggagctatt

SEQ ID NO: 20288 - DNA, 149 bp, Homo sapiens
  chr13.fa.O7frz.96520282
  Located on chromosome 13
  Distance between a terminus base of telomere on chromosomal short arm and 5'-terminus of this base sequence : 97957895
  Distance between 3'-terminus of neighbour sequence of sequence listing upward to telomere on chrosomal short arm and 5'-terminus of this base sequence : 122213
ctgacagactgttttcatgaactatcactgttcattttatttatttatttatttatttatttatttatttatttgagacaggatctcgctctgttgtccaggctggagtgcagtggcagagttatatcttacttgaactacaaccttga

SEQ ID NO: 20289 - DNA, 370 bp, Homo sapiens
  chr13.fa.O7frz.96811719
  Located on chromosome 13
  Distance between a terminus base of telomere on chromosomal short arm and 5'-terminus of this base sequence : 98049181
  Distance between 3'-terminus of neighbour sequence of sequence listing upward to telomere on chrosomal short arm and 5'-terminus of this base sequence : 91137
acaatcctttacacaaccattatgccactattggccgggcgcggtggctcacacctgtaatcccagcactttgggaagctgaggtgggtggatcacgaggtcaggagatcgagaccatcctggctaacatggtgaaactccgtctctactaaaaaaaatacaaaaaattagccgggcgtggtggcaggcgcctgtgggcccagctacctgggaggctgaggcaggacaatggtgtgaacccgggaggcggagcttgcactgagcggagatcgtgccactgcactccagcctgggcgacagggcgagactccgtctcaaaacaaacaaacaaacaaaacaaaaaaacattatgccactattacacctaaga

SEQ ID NO: 20290 - DNA, 345 bp, Homo sapiens
  chr13.fa.O7frz.96914572
  Located on chromosome 13
  Distance between a terminus base of telomere on chromosomal short arm and 5'-terminus of this base sequence : 98151293
  Distance between 3'-terminus of neighbour sequence of sequence listing upward to telomere on chrosomal short arm and 5'-terminus of this base sequence : 101742
cctatgtccaaagtcatagtacagggtgaagagaacataagcatttgtgtaaatacacaaaagcagggacacacgtatacacacacacacacacacacatttttcctgtaaaagtaccacaaaatgcaaaaagatgtattaaggaaatctattttatttttaagtttctactccggttaagtcttctgccagatttcctttatatctatctctccctaagtactctcacattctgtacttgcagaccctggtttattcccatgcttgttttatgaggtgagtgaaatttaattcaaacattaaataacatgttgtagatgagggtcagcattctagcagtagaaa

SEQ ID NO: 20291 - DNA, 261 bp, Homo sapiens
  chr13.fa.O7frz.96400182
  Located on chromosome 13
  Distance between a terminus base of telomere on chromosomal short arm and 5'-terminus of this base sequence : 98254931
  Distance between 3'-terminus of neighbour sequence of sequence listing upward to telomere on chrosomal short arm and 5'-terminus of this base sequence : 103293
atctttgaagatcatatgctacagcaggatatatatatacacatacatatatatacacacatacatgcatacatatgcacatatatatatatatatatatataaataaataaatatacatacatacataaatataatttgttatttgggctacttttcccccaatatattctacctgcttcttttctttcctaatcatcctaccccttgctttagaaaaaatacatcagccattatttcctcaatactttcctaccttggt

SEQ ID NO: 20292 - DNA, 165 bp, Homo sapiens
  DISO7_10003860
  Located on chromosome 13
  Distance between a terminus base of telomere on chromosomal short arm and 5'-terminus of this base sequence : 98506086
  Distance between 3'-terminus of neighbour sequence of sequence listing upward to telomere on chrosomal short arm and 5'-terminus of this base sequence : 250894
caggagaatgctgctttgtttgaacacggtggtggtgatggtggtggtgatgttggtagtagcagtggtggtggtgatggtggtggtggtggtggtggaggcagtgtttgggttgggaacatggtgcttcgtaccaatgaaaaataccatcttgtactcaggaca

SEQ ID NO: 20293 - DNA, 192 bp, Homo sapiens
  D13S1298
  Located on chromosome 13
  Distance between a terminus base of telomere on chromosomal short arm and 5'-terminus of this base sequence : 98536512
  Distance between 3'-terminus of neighbour sequence of sequence listing upward to telomere on chrosomal short arm and 5'-terminus of this base sequence : 30261
cctaccagtgggactttctctgacctccctaattttattcttgttctcttgctctacccttctgtctctccccgcaaccccctttctgtgtgtgtgtgtgtgtgtgtgtgtgtgtgtgtgtgtgtgtgtgtgtgtctgtctgtctgtctctggaaagtcaaagggaagaaaagcagagaatataaaacaatc

SEQ ID NO: 20294 - DNA, 436 bp, Homo sapiens
  chr13.fa.O7frz.103037947
  Located on chromosome 13
  Distance between a terminus base of telomere on chromosomal short arm and 5'-terminus of this base sequence : 98641057
  Distance between 3'-terminus of neighbour sequence of sequence listing upward to telomere on chrosomal short arm and 5'-terminus of this base sequence : 104353
caaagccagtaaattaccaatatttattaaatactatagctgcacaataaagccatccacagagtcccttaactcagctaccagaagggagaggctgggcatgatggctcatgcctgtaatcccagaactttgggaggccaaggcaggagtatcccttgagcccaggagttcaagaccagcctggggaatatggcgaaacctcgtttctacaaataaaaataaaaataaaaaaataaaaataaataaaaattagccgagcgtggtggcacatacctgtagtctcagctacttgggaagctgtatacacacacacacacacacacacacacacacacacacacacaaagaagggaaaggccagatgcagtagctcacacctgtaatcccagcactttggcaagccaaggcaagaggatcacttgaggtcagaagttc

SEQ ID NO: 20295 - DNA, 240 bp, Homo sapiens
  Z66790
  Located on chromosome 13
  Distance between a terminus base of telomere on chromosomal short arm and 5'-terminus of this base sequence : 98703820
  Distance between 3'-terminus of neighbour sequence of sequence listing upward to telomere on chrosomal short arm and 5'-terminus of this base sequence : 62327
tgagaaaccatacaggcaagccatatttgtaggaagcagtctgtcgctgaggcaagatgaaaaagacagactgcattagacataccaccaaggttgactaccaaagtttcagcaaataagggaatagcaaaggttgaaaggatcacacacacacacacacacacacacacacacacacacacaacctcaagtcatgaaaattcctattagtatggaacacggctctgtctgctggcccac

SEQ ID NO: 20296 - DNA, 342 bp, Homo sapiens
  AL137120.10_34724
  Located on chromosome 13
  Distance between a terminus base of telomere on chromosomal short arm and 5'-terminus of this base sequence : 98814238
  Distance between 3'-terminus of neighbour sequence of sequence listing upward to telomere on chrosomal short arm and 5'-terminus of this base sequence : 110178
acatctcctttaggcaggtacagttgtctgtttttcagacccatttgttcaacaaaatatttactttacgcaggggccaaatttctaacaacacagatatcacatgtcttctcttctagctcgtggttgtagatgcctgggctgtgcaaatgattaaataatgtaaggttgttattaattatggagaacatttcttaataatgtgcacacaccaagttcatagcagcattattcacaaatagccaagcagtagaagcagaccagcatctgtggatgaatgaatgaatgaatgaactaaatgtggtgtatatatacaaataatatgattcagccttaggaaag

SEQ ID NO: 20297 - DNA, 476 bp, Homo sapiens
  AL137120.10_128069
  Located on chromosome 13
  Distance between a terminus base of telomere on chromosomal short arm and 5'-terminus of this base sequence : 98904598
  Distance between 3'-terminus of neighbour sequence of sequence listing upward to telomere on chrosomal short arm and 5'-terminus of this base sequence : 90018
ccagctagtaacaaatgcttactaactatttgctgctgggcccgtcctgtcaccagcaatattttaaaataattcttctgtaatcccaggactctgggaggctgaggcaggcggatcacctgagtcaggagttcaaaaccagcctggccaacatggtgaaaccctgtctctactaaataaataaataaataaataaataaataaataaataaataaaaattagccaggtgtggtggcacacccctgtaatcccattactccggaagcagaggaaggagaattgcttgaactggggaggcagaggttgcagtgagccgagattgcgccactacatcccagctgggttgacaagagcaagactctgtctggggaaaaaaaaaaaaagaagccaggcacggtgactcacacctgtaatcccagcactttgggaggcccaggtgggcggatgacttgaggtcaggtgttcaagaacagac

SEQ ID NO: 20298 - DNA, 289 bp, Homo sapiens
  AL356580.4_100071
  Located on chromosome 13
  Distance between a terminus base of telomere on chromosomal short arm and 5'-terminus of this base sequence : 98997223
  Distance between 3'-terminus of neighbour sequence of sequence listing upward to telomere on chrosomal short arm and 5'-terminus of this base sequence : 92149
tacagaactggagctactcaatctcaacataaataaataaataaataaaataaaataaaataaaataaaataaaattaaattaaaaggcccagcatggtggctcaggcctgtaatcccagcactttgggaggctaaggcgggtggatcatttgaggtcaggtgttcgagaccagcctggccaacatggtgaaaccccatctctagtaaaaatacaaaaattagccagctgtggtggtgtgcgcctgtaatcccagctactcaggaggctgaggtatgagaatcacttga

SEQ ID NO: 20299 - DNA, 234 bp, Homo sapiens
  D13S1252
  Located on chromosome 13
  Distance between a terminus base of telomere on chromosomal short arm and 5'-terminus of this base sequence : 99024797
  Distance between 3'-terminus of neighbour sequence of sequence listing upward to telomere on chrosomal short arm and 5'-terminus of this base sequence : 27285
actgtgctgtgaaatgcgtctgtgtgtgtgtgtgtgtgtgtgtgtgcgtgcagatgtgcatgcaggtgtgtgtgcaggtgtgtgtgggtcgggtgtgtgtgcaggtgtgtgtgggtcggaggggtgtggacagaggtggtggacaggcctgatgggaggggctggaaaagcaaaagccaaatacctcagtccttaatggatggtcagatcgctcagacttttgaggacacgccg

SEQ ID NO: 20300 - DNA, 307 bp, Homo sapiens
  chr13.fa.O7frz.102404365
  Located on chromosome 13
  Distance between a terminus base of telomere on chromosomal short arm and 5'-terminus of this base sequence : 99172582
  Distance between 3'-terminus of neighbour sequence of sequence listing upward to telomere on chrosomal short arm and 5'-terminus of this base sequence : 147551
tagttgatctcacttccatgacagtgtggggaggtgaaggagaagagctatgcagcacaggttgctataatgaccagggcatcttcttctacaaggaataggaggggagcaggacataatagcaatacttgttgtttgtgcattgctcttgacatttacaaagcacattgcatgaaaaatggaaattggaaggtgtgtgtgtgtgtgtgtgtgtgtgtgtgtgtgtagggggcatgaggagaggcagaagcagcactggtccttcgaattaattacctttcaactcttacatctttaatgagcttgt

SEQ ID NO: 20301 - DNA, 467 bp, Homo sapiens
  chr13.fa.O7frz.102325201
  Located on chromosome 13
  Distance between a terminus base of telomere on chromosomal short arm and 5'-terminus of this base sequence : 99243655
  Distance between 3'-terminus of neighbour sequence of sequence listing upward to telomere on chrosomal short arm and 5'-terminus of this base sequence : 70766
gcatttgaaacagtagactgagagagaagatggcccttcctctgtgggtgggcctcatctgatctgttgaggattggaacagaacaaaaaggtagaggaaagctggaggaactctgcctgactgcctcagctgggacattgatcttctcctgccctcactgcttctgggtctcaggccttcagacttggactggaatctacaccatcaactctttgacttccaggccttcaaatgacaccaccatctttcctgggtcttcagcttgcaggtggcagatcatgggacctctcagcctccataatcatgtgagccactgcattataatgagtccgtctatctatctatctatctatctatctatctatctatctatctatctatctaatctatctatctatcatctatctctatcatctttttatccatctagagtttctatctaggtagacagatagctcggagtatc

SEQ ID NO: 20302 - DNA, 152 bp, Homo sapiens
  DISO7_10003861
  Located on chromosome 13
  Distance between a terminus base of telomere on chromosomal short arm and 5'-terminus of this base sequence : 99431457
  Distance between 3'-terminus of neighbour sequence of sequence listing upward to telomere on chrosomal short arm and 5'-terminus of this base sequence : 187335
gaaggaagccgatgttagacaaaaggccaattgcaggaaaaatgacggcaaagaaagaaggcaaaaggcactggccctgtatgtgggtgcaaacacacacagatatacacacacacacgcacacacacacacagagctgtcaagaggaccag

SEQ ID NO: 20303 - DNA, 128 bp, Homo sapiens
  chr13.fa.O7frz.103736359
  Located on chromosome 13
  Distance between a terminus base of telomere on chromosomal short arm and 5'-terminus of this base sequence : 99577734
  Distance between 3'-terminus of neighbour sequence of sequence listing upward to telomere on chrosomal short arm and 5'-terminus of this base sequence : 146125
ctcatctgtttcatctttctgtacactcattagggaagatgggcacacacacacaagcacccacgcacgcacgcacgcacgcacactctctcgctcctgctgtaggtccttagcaactaacgactagt

SEQ ID NO: 20304 - DNA, 418 bp, Homo sapiens
  chr13.fa.O7frz.103919723
  Located on chromosome 13
  Distance between a terminus base of telomere on chromosomal short arm and 5'-terminus of this base sequence : 99760836
  Distance between 3'-terminus of neighbour sequence of sequence listing upward to telomere on chrosomal short arm and 5'-terminus of this base sequence : 182974
aaatatcaaccaggttaaggactggtattattattgcaggataaatttgggcattggtgtggggtttctcatgttaaattctacccagtttcatcccctacatgaaatggcgtattaccaccaccaccaccggcaaaggtaaagacataatctcagagtgggcaagtcctgtgagttaattggataaaggctgccatttattttatcccatgaattagtcccattattaggtagtctagccactagccatagtaggatgctttctttattcaaaatgtgataaagacagggagaaataaagactgaagaaggctgtgagcacctgtgacaattcttggaggatatgtgtgtttgtgtgtgtgtgtgtgtgtgtgtgtatatatatatatatatatgtaaactgctatctctgaggaaa

SEQ ID NO: 20305 - DNA, 233 bp, Homo sapiens
  D13S813
  Located on chromosome 13
  Distance between a terminus base of telomere on chromosomal short arm and 5'-terminus of this base sequence : 99880540
  Distance between 3'-terminus of neighbour sequence of sequence listing upward to telomere on chrosomal short arm and 5'-terminus of this base sequence : 119286
tatttcctggacatcagggaagatttagtaacagtagacaacaagcagcagcagcagcagcagccgtagcagtagcagtaacagcagtagcagcagcaatagtagtagtagtagtagtagtagtagtagtagtagtagtagtagtagtagcagcagcggcggcagcagcagcagcagtattcagtcagtcaacaacgagagtagttatcatgtagcaacaataggtgccagag

SEQ ID NO: 20306 - DNA, 468 bp, Homo sapiens
  chr13.fa.O7frz.104150224
  Located on chromosome 13
  Distance between a terminus base of telomere on chromosomal short arm and 5'-terminus of this base sequence : 99991071
  Distance between 3'-terminus of neighbour sequence of sequence listing upward to telomere on chrosomal short arm and 5'-terminus of this base sequence : 110298
catgtaaccaacttaaggtgaggtcctactggaataggtgggccctaattcagtatgaatggttgtttgtttgtttgtttgtttgtttgttttgacagagcctcactctgttgcccaggctggagtgctgtggtgcagtctcagctcactgcagcctctgcctcccaggaggctgggattacaggcacctgtcaccacacctggctaattttttgtatttttagtagagaaggggttttgccatgttggccaggctgaggtcaggtcgaactcctgacctcaggtgatccgcccatctcagcctcccaaggtgctgggattacaggcgtgagccaccacgcccagcctgaatggtgtctttataagaagagacacaaatacatacacaaaggaaaaatactatgtgacaacaaaggtaggaaggagaatactgcacacctgcaagccacagaacagcaaggatcactg

SEQ ID NO: 20307 - DNA, 144 bp, Homo sapiens
  D13S1271
  Located on chromosome 13
  Distance between a terminus base of telomere on chromosomal short arm and 5'-terminus of this base sequence : 100117487
  Distance between 3'-terminus of neighbour sequence of sequence listing upward to telomere on chrosomal short arm and 5'-terminus of this base sequence : 125948
gcggtttttgccattaaaggtaaaatggcaattacttttgtaccaacctatatttgtgtgtgtgtgtgtgtgtgtgtgtgtgtgtatttttgagacacagtctcactctgacgcctcagctggagtgcagtggtgcaatctcgg

SEQ ID NO: 20308 - DNA, 237 bp, Homo sapiens
  D13S1284
  Located on chromosome 13
  Distance between a terminus base of telomere on chromosomal short arm and 5'-terminus of this base sequence : 100138573
  Distance between 3'-terminus of neighbour sequence of sequence listing upward to telomere on chrosomal short arm and 5'-terminus of this base sequence : 20942
gaagtgtccatcaatgcagatgtgagccatcaggcccggccttctttgttgtatacttccatctttattgactagttccctcttttgagtttccaatgaatgggaaaaaaatggatgatagataaagaaaattttatgcgtatatatatatatatatacacacacacacacacacacacacacagtggaatattattcagctataaaaagaatgaaatcctgtcatttgcagccaca

SEQ ID NO: 20309 - DNA, 175 bp, Homo sapiens
  DISO7_10003863
  Located on chromosome 13
  Distance between a terminus base of telomere on chromosomal short arm and 5'-terminus of this base sequence : 100200862
  Distance between 3'-terminus of neighbour sequence of sequence listing upward to telomere on chrosomal short arm and 5'-terminus of this base sequence : 62052
gcagattatacaacatgccacttttttgggaggtagggaagcaaatacacacacacacgcacacacacacacagaaagatgtctgtatgccaaaacataattttgtatgagtaattttggggctttactcatatattctagatttttaatgctgaacgtttctattcagaatgtt

SEQ ID NO: 20310 - DNA, 162 bp, Homo sapiens
  DISO7_00039154
  Located on chromosome 13
  Distance between a terminus base of telomere on chromosomal short arm and 5'-terminus of this base sequence : 100288726
  Distance between 3'-terminus of neighbour sequence of sequence listing upward to telomere on chrosomal short arm and 5'-terminus of this base sequence : 87689
ccttacagctgccaagtcctcgcctttgcagtggtggcccgtggttctccatccttgtcatgcaactaccaggccactctccctccatcaccaccctctggacacacacacacacacacacacacacacacaacacgcctgccttttcacgcttgaccatgt

SEQ ID NO: 20311 - DNA, 377 bp, Homo sapiens
  HUMUT7458
  Located on chromosome 13
  Distance between a terminus base of telomere on chromosomal short arm and 5'-terminus of this base sequence : 100314378
  Distance between 3'-terminus of neighbour sequence of sequence listing upward to telomere on chrosomal short arm and 5'-terminus of this base sequence : 25490
agattagataggcaggtggacagatatgacagattacttagatatagagatgatagggatgctagagatgccaggtggctgatagatagatggatatagagataatagatgaatagagggacagaggatggatggatagatagagagatagattggatagatagatgataagtagatagatgatagagagatatagagatgatagattacataatggatagatgaatagagggatagaggatgaatgaatccatagattagatagatagatagatagataatgtcagatggatatagaggtgatagattagataatggatagacgaatagagagatagatgggtgggtggatagataaagataggtgaagatagaga

SEQ ID NO: 20312 - DNA, 137 bp, Homo sapiens
  DISD22_0009139
  Located on chromosome 13
  Distance between a terminus base of telomere on chromosomal short arm and 5'-terminus of this base sequence : 100409791
  Distance between 3'-terminus of neighbour sequence of sequence listing upward to telomere on chrosomal short arm and 5'-terminus of this base sequence : 95036
gggaggagatggacttaactcttttggatggtgaataaagatgtttagagtgggaaaaaaaaggcaaacaaaacacacacacacacacacacacacacacacacacacacaccccagagattcagtagctactccaa

SEQ ID NO: 20313 - DNA, 124 bp, Homo sapiens
  DISD22_0009142
  Located on chromosome 13
  Distance between a terminus base of telomere on chromosomal short arm and 5'-terminus of this base sequence : 100587918
  Distance between 3'-terminus of neighbour sequence of sequence listing upward to telomere on chrosomal short arm and 5'-terminus of this base sequence : 177990
agacactctcgaggccaggagctggcctcagacataaaagtatttgtttcaacagagagagagagagagagagagagactcagtgactgctttttgagtgaattgttgttggctcagtttcagt

SEQ ID NO: 20314 - DNA, 186 bp, Homo sapiens
  D13S1232
  Located on chromosome 13
  Distance between a terminus base of telomere on chromosomal short arm and 5'-terminus of this base sequence : 100719875
  Distance between 3'-terminus of neighbour sequence of sequence listing upward to telomere on chrosomal short arm and 5'-terminus of this base sequence : 131833
aggacccctgaagatcacatggagcagaaaacacacacacacacacacacacacacacacacacacacggacacacactgccacactgccactgatcagattcgacatgaacaggaaaggcactactattatgctaatcctctttaattgtggggtttctctgttacaacaactcatactgctgga

SEQ ID NO: 20315 - DNA, 216 bp, Homo sapiens
  chr13.fa.O7frz.105000560
  Located on chromosome 13
  Distance between a terminus base of telomere on chromosomal short arm and 5'-terminus of this base sequence : 100822759
  Distance between 3'-terminus of neighbour sequence of sequence listing upward to telomere on chrosomal short arm and 5'-terminus of this base sequence : 102698
ttattcctaaccttaagcatgtaccaactttcaagggagagaggaaaacgtttggggaaaaaaaaaaaaaaatatatatatatatatatatacacacacacacacatatatatacacacatatatatatacacatatatatatatacagtagagatttgcaggatgaaaataaacacttctataaccacacctcgaaaccaatgtcttattcgagt

SEQ ID NO: 20316 - DNA, 449 bp, Homo sapiens
  chr13.fa.O7frz.104925167
  Located on chromosome 13
  Distance between a terminus base of telomere on chromosomal short arm and 5'-terminus of this base sequence : 100934235
  Distance between 3'-terminus of neighbour sequence of sequence listing upward to telomere on chrosomal short arm and 5'-terminus of this base sequence : 111260
aactcgagaggcagctaaggcttgttggtgaatatctttttatgttatgctatttatttatttatttatttatttatttatttattttgagatggagtctcactctgtcccccaggctggagtgcagtggtgtgatctcggctcactgcaacctccacgtcccgggttcaagggattctcgtgcctcagcctcccaagtagctgggattacgggcgtgcaccaccacacctggccaatttttttgtatttttagtagagacagggtttcaccacgttggccaggctggtctcgaactcccaacctcaagtgatctgcccacctcgccctcccaaagtgctgggataatgggcgtgagccaccataccctgcctatattatttaattttttaatcatgaaaatatattacacagtaaaaataagacctcatagataaatgcaaattcttg

SEQ ID NO: 20317 - DNA, 386 bp, Homo sapiens
  chr13.fa.O7frz.105305085
  Located on chromosome 13
  Distance between a terminus base of telomere on chromosomal short arm and 5'-terminus of this base sequence : 101063487
  Distance between 3'-terminus of neighbour sequence of sequence listing upward to telomere on chrosomal short arm and 5'-terminus of this base sequence : 128803
tttaagtctttagaggtcaccactgttaccttctggagcatgtgtgtctgtatgtgtgtgtgtgtgtgtgtgtgtgtgtgtgtctgtctgtctgcgtgtgctagaattttgctatcatttgttttgtaagatactcttagttgcttaagtaggacttactttttttatatgaaaagaagtggcatagaacttttcttatataagaaaacagtggtccctaggcttttaaaaataagtatggaatacctacctgcaggtaagttatttaatctttatgacaacttatgatgtattcttatttttattcttggttttatggaagagagaacaatctctgaaagtttaaataaatgccttgtccagtgtcacatagctggtaaatgaga

SEQ ID NO: 20318 - DNA, 212 bp, Homo sapiens
  D13S1267
  Located on chromosome 13
  Distance between a terminus base of telomere on chromosomal short arm and 5'-terminus of this base sequence : 101146359
  Distance between 3'-terminus of neighbour sequence of sequence listing upward to telomere on chrosomal short arm and 5'-terminus of this base sequence : 82486
tatatgtgtatgacagactgaggaaaggctgtgtgtgtgtgtgtgtgtgtgtgtgtgtgtgtgtgcgcagtagtagagatgtggataaatcatagactccaacatatatatgtttactagttactggataattacagaccccaaatagtattgatgcaaatgtgcatcacctcagtctgaggtctgccaactcgaatgatactccaaaacta

SEQ ID NO: 20319 - DNA, 471 bp, Homo sapiens
  AL356966.4_114777
  Located on chromosome 13
  Distance between a terminus base of telomere on chromosomal short arm and 5'-terminus of this base sequence : 101411231
  Distance between 3'-terminus of neighbour sequence of sequence listing upward to telomere on chrosomal short arm and 5'-terminus of this base sequence : 264660
ctataacagactaagccagcatagtggtggtgtgggttttttgttttgtgttttttttgttttgttttgttttgttttgttttgtttttgtctaaaagaacaacttcaagccttgggaaagaatttgtttttgccctgtggatgggtcagaaacatctgcttcaggtatagtttacaagcgttatttattaacccatgagccgaaaacccagatgaggagctctgactattgaaaactacacattccatgtttttataaatgtatattaagatgaattccacatacctattatttggatttctggcagccggaacttctacaaggaatttgtgtttttaaaaaggaatgtaaaattaatttttcttgtatcagagttttgctgtatatgaagaaatcctgctcatgggcagaaagcaaaggtttcaaaggaacctcatctccatatggttttactcgataatcctttatcc

SEQ ID NO: 20320 - DNA, 161 bp, Homo sapiens
  D13S1240
  Located on chromosome 13
  Distance between a terminus base of telomere on chromosomal short arm and 5'-terminus of this base sequence : 101418141
  Distance between 3'-terminus of neighbour sequence of sequence listing upward to telomere on chrosomal short arm and 5'-terminus of this base sequence : 6439
gactgtctaatgcccacgtgttaaggatttgggagaggccataagaaaaattacgtgtgtgtgtgtgtgtgtgtgtgtaatgtgtgtaaaattcaggggaggacatcttccttctccagagttagggtcgtaagaggatagtctcgtggccttgacattaa

SEQ ID NO: 20321 - DNA, 390 bp, Homo sapiens
  AL359085.11_101117
  Located on chromosome 13
  Distance between a terminus base of telomere on chromosomal short arm and 5'-terminus of this base sequence : 101589451
  Distance between 3'-terminus of neighbour sequence of sequence listing upward to telomere on chrosomal short arm and 5'-terminus of this base sequence : 171149
agactcatctcctacctttcactgatgagatattaccttatcaagatctttctgatgaattaagatggccccaacccagatgaagtctgctgatggtaaaggccattcagaacccaaatgggagaaaggttgatttggaatctcttcattcatccttccatccatccatccatccatccatccatccatccatctttccatccatctgatgcaggacaggtgagcccccaaactggggcttagctcaggaaagttcttggctttgcccagaaaataattcaagggtgagctggtggtgttagctaatcttttattgaagggtactgctccttgcagagcagggctagctcacaggcagtttgcccagagtcagcaacatatggattctta

SEQ ID NO: 20322 - DNA, 308 bp, Homo sapiens
  AC067734.11_223328
  Located on chromosome 13
  Distance between a terminus base of telomere on chromosomal short arm and 5'-terminus of this base sequence : 101763683
  Distance between 3'-terminus of neighbour sequence of sequence listing upward to telomere on chrosomal short arm and 5'-terminus of this base sequence : 173842
cactctgtattctgttctaccagactgtgtgtcagtgctatactattttgataactatagctttgctatattattttattttatttttgagacagggtctcacactgtcacccaggctggagtgcagtggcataatcttggcttattacagccttgacctcctggtctcaagtgatcctcccacctcagtctcctgagtagttgggactacagacatgcaccaccatgcccaactagtttttattttatttttaatttattttattttattttattttattttttgagatggagtcttgttctgtcac

SEQ ID NO: 20323 - DNA, 366 bp, Homo sapiens
  chr13.fa.O7frz.106114602
  Located on chromosome 13
  Distance between a terminus base of telomere on chromosomal short arm and 5'-terminus of this base sequence : 101879323
  Distance between 3'-terminus of neighbour sequence of sequence listing upward to telomere on chrosomal short arm and 5'-terminus of this base sequence : 115332
gtaggacatgcattatttcagtagaaaaaaagaaagcagcagattgcagtttatttctctttgtatctttactccccatcttcgtgtgtgtgtgtgtgtgtgtgtgtgtgttcggaggctagactgccttacccagttgtggcttttttggtggttgttattttgtttcctttctttctgggtgcaggtgaatttctagcctatttgccttttgaagagtctcgcataagccatcaacacaccttcaccttccacccatcacagttacctcctcacaggggaacccacacagtgacaacagctgagtcaaaaccatctgctagatctttcatgtctacccacacgttcaatagcatagtattacct

SEQ ID NO: 20324 - DNA, 331 bp, Homo sapiens
  chr13.fa.O7frz.106216999
  Located on chromosome 13
  Distance between a terminus base of telomere on chromosomal short arm and 5'-terminus of this base sequence : 101976029
  Distance between 3'-terminus of neighbour sequence of sequence listing upward to telomere on chrosomal short arm and 5'-terminus of this base sequence : 96340
tttgcttgataaatgaatagaaagataagtatataccaacctgttaatattctccccatatttcacagtaccaaataaaacaactccagcaaaagcgtaacacagcagcaagagaaacatgcctactatgataaagaagctcttgtacatgctgacgaccactgtcaagaggagcatctttagcgttacctggggaccaggggtgggaagcggggagacagagagagagagagagagagacagagacagagagagagagagagagagagaatattcaatctattaagctatggaagacctgggtagcaactaatctttaagcagattggct

SEQ ID NO: 20325 - DNA, 466 bp, Homo sapiens
  chr13.fa.O7frz.106330964
  Located on chromosome 13
  Distance between a terminus base of telomere on chromosomal short arm and 5'-terminus of this base sequence : 102090013
  Distance between 3'-terminus of neighbour sequence of sequence listing upward to telomere on chrosomal short arm and 5'-terminus of this base sequence : 113653
agtgctttgcaaactaagaaaacttaatattaatcttcagaattttgggcataaaatgtatttagatggtaaccttaagtttaaaatactatatgtatacatatatatacacacacatatatatacatatatacacacacatatatatacatatatacacacatatatacatatatacacatatatacacacacacacgtgtgtgtgtgtgtctgtgtgtgtgtatatatatatatatttttttgagatggagtttcactgttgttgcccaggctggggtacaacagcatgatctcggctcactgcaacccccacctcccagattcaagtgattctcccctgcctcagtatcctgagtagctgggcttacaggtgctcaccaccatgcctggctaatattttgtatttttagtagagatagggtttcaccatgttggccaggctgatctttaactcctgacctcag

SEQ ID NO: 20326 - DNA, 134 bp, Homo sapiens
  chr13.fa.O7frz.106431832
  Located on chromosome 13
  Distance between a terminus base of telomere on chromosomal short arm and 5'-terminus of this base sequence : 102191028
  Distance between 3'-terminus of neighbour sequence of sequence listing upward to telomere on chrosomal short arm and 5'-terminus of this base sequence : 100549
ctagtgagctgcctaatataacagaaagccccttctttgttctgaaaatgtgcatatatatatatatatatatatatacacatattttctatacacatggctgttatgggaagtctgcagacttagacatcaac

SEQ ID NO: 20327 - DNA, 142 bp, Homo sapiens
  DISD22_0009159
  Located on chromosome 13
  Distance between a terminus base of telomere on chromosomal short arm and 5'-terminus of this base sequence : 102302075
  Distance between 3'-terminus of neighbour sequence of sequence listing upward to telomere on chrosomal short arm and 5'-terminus of this base sequence : 110913
actggagtacaagaacatgtttgcagtgtgtgtgtgtgtgtgtgtgtgtgtgtgtgtgtgtgcacgtgtgtgcgcgcgcacacagatgcagtttttactggaaaagagaataaaacacagaaactcagaacaaagcagctcc

SEQ ID NO: 20328 - DNA, 117 bp, Homo sapiens
  DISD22_0009163
  Located on chromosome 13
  Distance between a terminus base of telomere on chromosomal short arm and 5'-terminus of this base sequence : 102373036
  Distance between 3'-terminus of neighbour sequence of sequence listing upward to telomere on chrosomal short arm and 5'-terminus of this base sequence : 70819
tggcttacagaaaggcaacacaaatatatatgtgtgtgtgtgtgtgtatgtatgtgtgtgtgtgtgtgtgtgtgtgtgtgtgtgtgtgtatatatatttctcactcttgggtgtgca

SEQ ID NO: 20329 - DNA, 164 bp, Homo sapiens
  DISD22_0009167
  Located on chromosome 13
  Distance between a terminus base of telomere on chromosomal short arm and 5'-terminus of this base sequence : 102470552
  Distance between 3'-terminus of neighbour sequence of sequence listing upward to telomere on chrosomal short arm and 5'-terminus of this base sequence : 97399
cgtccaattcataacacccacccctccaaacacacacacacacacacacacacacacacacacacacacacacacttctctacttccaattcataacacccacccctccatacacacacacacacgcgcacgcgcgcgcatgccccatagcgtctttcatcttg

SEQ ID NO: 20330 - DNA, 415 bp, Homo sapiens
  AL160153.11_25780
  Located on chromosome 13
  Distance between a terminus base of telomere on chromosomal short arm and 5'-terminus of this base sequence : 102594888
  Distance between 3'-terminus of neighbour sequence of sequence listing upward to telomere on chrosomal short arm and 5'-terminus of this base sequence : 124172
tgtgaattacagatctttccacgtttccagtataaatgaagtgatgtggacatggaattacattacaagaaaataattatatccctttattgggggaaagaaacagaatgtgtgtcttttctaacttttattttaagttcagggatgcataggtaggcttgttacatatgtcttattggagggtggagggtgggttgagggagaggatcaggaaaaataactaatgggtagtagagtgtgtgtcttaatggaaggctgaggcaccatccatccatcctatctgtctgtctgtctatctatctatctatctatctatctatctatctatctatcatctattatctgtgtatctattatctatctatatcaatcatccatatgcctgttctctctctaaccaacgataagacatttg

SEQ ID NO: 20331 - DNA, 415 bp, Homo sapiens; identical to SEQ ID NO: 20330
  AL139800.4_110201
  Located on chromosome 13
  Distance between a terminus base of telomere on chromosomal short arm and 5'-terminus of this base sequence : 102594888
  Distance between 3'-terminus of neighbour sequence of sequence listing upward to telomere on chrosomal short arm and 5'-terminus of this base sequence : -415

SEQ ID NO: 20332 - DNA, 270 bp, Homo sapiens
  D13S1323
  Located on chromosome 13
  Distance between a terminus base of telomere on chromosomal short arm and 5'-terminus of this base sequence : 102769415
  Distance between 3'-terminus of neighbour sequence of sequence listing upward to telomere on chrosomal short arm and 5'-terminus of this base sequence : 174112
aggccccctggagaatgtttctgtttaagacacacacacacacacacacacacacacacacacacacacacacacgcgcacacacacaatatgtgtatatttatctatagttttgttggtggtgatatttaacaatgacagagtttcaacgaatttacatgaggatgacatgtaagagcatattttaatgcatttaagactttatcaatttttgctcaagggataatagaaaaaagcacctttaagtctttactgcttaaacctgtggca

SEQ ID NO: 20333 - DNA, 444 bp, Homo sapiens
  chr13.fa.O7frz.107031631
  Located on chromosome 13
  Distance between a terminus base of telomere on chromosomal short arm and 5'-terminus of this base sequence : 102888216
  Distance between 3'-terminus of neighbour sequence of sequence listing upward to telomere on chrosomal short arm and 5'-terminus of this base sequence : 118531
agcaagtagcatctttgagatacttcagaaaacacattacctatccatgtgcacatcacaaaatctccactgaatgtctcatagacgtgtcaaacccttgtctaaaactgaactcttgatatcccccaaccaaaatctattcatgtttaaacctcccccttttcactagattccaataatggcttttcagtttctcaggtcaacaattttagagacactcttgtctgtctctttgtctctgtctttctctatgtatacacacacatgtatgtgcatgcacacacacacacacacacacacacaccagtctgtcatgaatttctatcagctccatcttcataatataacttaatttcttcctaccacttcaactgccaccaccttagtccatgccatgattggactctggcttagattattgtgtaagtctgctaactggttgcc

SEQ ID NO: 20334 - DNA, 573 bp, Homo sapiens
  chr13.fa.O7frz.107252986
  Located on chromosome 13
  Distance between a terminus base of telomere on chromosomal short arm and 5'-terminus of this base sequence : 103062747
  Distance between 3'-terminus of neighbour sequence of sequence listing upward to telomere on chrosomal short arm and 5'-terminus of this base sequence : 174087
aagagatgaatgcataagtacaacaaaaaataaattaaggagaaagaaagagaggaaaaaaggaagagcggttgtcagaatttcaggtccatgttctgtggaagattttcctccctctaaacaatgaattattatcattctcaagggaaaaataatcctgccgttccagttgccactggagtaactgtggctgtcttgtcaccactgtatccctagtgtctgctggctaaagagatgagaaaacagaaaatatttctttccagagagcaaatgacagcaatcgtcagtcagtgtaagcttgcctttgcaaatgaaggaaaactcttatcttagttgtaaaatatcaatattctctatgcaaccaactttctgtgaagaaagaaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaatagaaatgtgtttaagaattcctcaataagactaagctc

SEQ ID NO: 20335 - DNA, 177 bp, Homo sapiens
  D13S174
  Located on chromosome 13
  Distance between a terminus base of telomere on chromosomal short arm and 5'-terminus of this base sequence : 103203280
  Distance between 3'-terminus of neighbour sequence of sequence listing upward to telomere on chrosomal short arm and 5'-terminus of this base sequence : 139960
gacgactaacctcaagtgcgcctttagtgctggaaggcaatcttacagtattccctggagatcattctatacctcctttcttctcaaatcttcctgtacttcacacacacacacacacacacacacacacacacacacacactttactctcagataatggttttacttctgccttca

SEQ ID NO: 20336 - DNA, 175 bp, Homo sapiens
  G10095
  Located on chromosome 13
  Distance between a terminus base of telomere on chromosomal short arm and 5'-terminus of this base sequence : 103280072
  Distance between 3'-terminus of neighbour sequence of sequence listing upward to telomere on chrosomal short arm and 5'-terminus of this base sequence : 76615
ctgacaaggaaatggacaggcaagaataaataaatatctacattctaggttttacattaagtatgttatatatatctatatctatctatctatctatctatctatctatctatctatatatatatatatcttctcttttaatcactacatatttaaaggcggtattctccctcta

SEQ ID NO: 20337 - DNA, 163 bp, Homo sapiens
  D13S1266
  Located on chromosome 13
  Distance between a terminus base of telomere on chromosomal short arm and 5'-terminus of this base sequence : 103359123
  Distance between 3'-terminus of neighbour sequence of sequence listing upward to telomere on chrosomal short arm and 5'-terminus of this base sequence : 78876
ctgtgcgaggtgattgacacgtcatctaggatagcctgagattcttgacctgtcatgtggagtgtgtgtgtgtgtgtgtgtgtgtgtgtgtgtggtgtgcgcgcatgtatgtgtgcttcaggtgtgaaaattgatagaagtaaaattccaggggtaagaaaac

SEQ ID NO: 20338 - DNA, 453 bp, Homo sapiens
  chr13.fa.O7frz.107546073
  Located on chromosome 13
  Distance between a terminus base of telomere on chromosomal short arm and 5'-terminus of this base sequence : 103376721
  Distance between 3'-terminus of neighbour sequence of sequence listing upward to telomere on chrosomal short arm and 5'-terminus of this base sequence : 17435
caacctaaaaccagaatctgtaagtaattacagataaagtatggaaattacactgaaaactatacagattttagaatacaatacaggccaggcatggtggctcatgcccgtcatcctagtacattgggagaccaacatgggtggattgcctgagctcaggagttcgagaccagcctgggcaacagggtgaggctccgtctctactaaaaatacaaaaaattagccaggcatggtggtggatgcttgtagtcccacctactcaggaggctgaggtacgagaatcacttgaacccaggagatggaggttgtagtgagccaagattgtgccattttactccagcctggacaacagagcaagactctgtctactactactactactactactactactaataataataataataataataataatccacccagctctgattgactaaactgaatcca

SEQ ID NO: 20339 - DNA, 280 bp, Homo sapiens
  chr13.fa.O7frz.107731215
  Located on chromosome 13
  Distance between a terminus base of telomere on chromosomal short arm and 5'-terminus of this base sequence : 103549768
  Distance between 3'-terminus of neighbour sequence of sequence listing upward to telomere on chrosomal short arm and 5'-terminus of this base sequence : 172594
tggttgtaatttgaagatcagctgggcatggtggcacatgcctgtgatcccgtctactcaggaagctgaggtgggaggatcgcttgagccctggagctctaggctatggtgcactatgattgcaccagttaacagccactgcacttcagcctgggcaacatagtgagtccccctctctaaaaggaaataaggattaccagtagtcataagttacacgtgtgtgtgtgtgtgtgtgtgtgtgtgtgtgtgtgtgtatttgtcctagatattctatggtgcc

SEQ ID NO: 20340 - DNA, 251 bp, Homo sapiens
  HUMUT406
  Located on chromosome 13
  Distance between a terminus base of telomere on chromosomal short arm and 5'-terminus of this base sequence : 103622481
  Distance between 3'-terminus of neighbour sequence of sequence listing upward to telomere on chrosomal short arm and 5'-terminus of this base sequence : 72433
actggcccaccaataaggtaaggatgaacacacacacacacacacacacacaaacacagacacacacagagacacacacagagacaatacttacatacaagtagcccataaaccaatacttctgaccctctctccactctaaccgttaagtcaaattgggagagttggttggatgatgagaccaaagtacctctcacttcgaaaatgatgtgattctttggcaagtcagtgacttgcctgtcttcgtgtca

SEQ ID NO: 20341 - DNA, 244 bp, Homo sapiens
  D13S280
  Located on chromosome 13
  Distance between a terminus base of telomere on chromosomal short arm and 5'-terminus of this base sequence : 103797224
  Distance between 3'-terminus of neighbour sequence of sequence listing upward to telomere on chrosomal short arm and 5'-terminus of this base sequence : 174492
cggaggagcgtatgacatcctcgatgaggatgtggaaatgctaaggcaatttttagcaaataatcactttaaagaaaaccctgaataactttatgtgccactgagtttcccaaggggaaatacacacacagatgcgcgcgcacacacacacacacacacacacacacacacacacacacacaaaaccccctactacaagaatagaagatagtttcccaaatttgcctcaccccaggcagtaatt

SEQ ID NO: 20342 - DNA, 193 bp, Homo sapiens
  Z24055.1_154
  Located on chromosome 13
  Distance between a terminus base of telomere on chromosomal short arm and 5'-terminus of this base sequence : 103797303
  Distance between 3'-terminus of neighbour sequence of sequence listing upward to telomere on chrosomal short arm and 5'-terminus of this base sequence : -165
cctgaataactttatgtgccactgagtttcccaaggggaaatacacacacagatgcgcgcgcacacacacacacacacacacacacacacacacacacacacaaaaccccctactacaagaatagaagatagtttcccaaatttgcctcaccccaggcagtaatttttccagatactgcatgtgagtctagga

SEQ ID NO: 20343 - DNA, 440 bp, Homo sapiens
  AC009687.3_122336
  Located on chromosome 13
  Distance between a terminus base of telomere on chromosomal short arm and 5'-terminus of this base sequence : 103877700
  Distance between 3'-terminus of neighbour sequence of sequence listing upward to telomere on chrosomal short arm and 5'-terminus of this base sequence : 80204
gtcttggtattggataaagtacactggcaagcaagagcagattcttgtttgggggatggttgggcaaatatgtaaaggcagtaccagaaagaaattgtggtatatgtggagatagagatagagatgatagagatagatagatagatagatagagagagagagagagagagagagagagagagagagagaagctctctgtcaggtggagtagaagggtcaagttgaatattgctgataacagtacacttactggatactcttaccaagactgaggaatatcagaatgaaggaagtagatggaaggttttctttaaggttatacatgtatttattatgtcattgttatttccctctaaataataatacactaaaaattacggtgaccataaaattggttgtccaaactggaatatttctgatagtggaaggtgacactgtta

SEQ ID NO: 20344 - DNA, 446 bp, Homo sapiens
  AC009687.3_128080
  Located on chromosome 13
  Distance between a terminus base of telomere on chromosomal short arm and 5'-terminus of this base sequence : 103927285
  Distance between 3'-terminus of neighbour sequence of sequence listing upward to telomere on chrosomal short arm and 5'-terminus of this base sequence : 49145
taattacgtatcctgcaactttactgaattattggttctaatagtttttgggtggagtctttaaagttttctatatatgagatcatgatgtctgcaaacagaaacaaattaacttcttccttttcaatttgggtgatcttttcttttctccttccttccttccttccttgcttcctttttctttcttttcttttctcttttctttctttctttctctttctttctttcttccttttttctttctttcatcctctctctttctctctttctttttctcttcctgtctttctttgtgattaggtgattttctctagttaaatactttgattccttattttttatcttgtgtatgtacgataggtttttgctttgtgtttaccatggggcttacataaaacatcttataataggccattttaagctgatagcaacttaaatttggtcac

SEQ ID NO: 20345 - DNA, 350 bp, Homo sapiens
  chr13.fa.O7frz.108232787
  Located on chromosome 13
  Distance between a terminus base of telomere on chromosomal short arm and 5'-terminus of this base sequence : 104052002
  Distance between 3'-terminus of neighbour sequence of sequence listing upward to telomere on chrosomal short arm and 5'-terminus of this base sequence : 124271
tcatgaaggtaccactaatcatttcttctcttcctacttcacttctgaaagtcacttagctggtgtgggagctgggctcagtgcccagcaacccatctgaggaatagacaggactatagatagaacttgatgttttggggtctatgaagctttctggatgccttccccatgaatatcaaggatctatgttgtgtgacctgttcatccacttttatccttgttactgtaattcataactgagttgtatattttgtgaggagcacgaaccatgttgggtattgtgtgtgtgtgtgtgtgtgtgtgtgtgtgtgtgtgtgcgtgtgtgctcctacagtgtcttcagcacagat

SEQ ID NO: 20346 - DNA, 111 bp, Homo sapiens
  D13S158
  Located on chromosome 13
  Distance between a terminus base of telomere on chromosomal short arm and 5'-terminus of this base sequence : 104225602
  Distance between 3'-terminus of neighbour sequence of sequence listing upward to telomere on chrosomal short arm and 5'-terminus of this base sequence : 173250
gctttgacaatttagcagcatgtatttaaagtgtgtgtgtgtgtgtgtgtgtgtgtgtgtgtgtgtgtgtgtgtgtgttttaaaatcaatcttctttcactccgtgggtac

SEQ ID NO: 20347 - DNA, 139 bp, Homo sapiens
  D13S259
  Located on chromosome 13
  Distance between a terminus base of telomere on chromosomal short arm and 5'-terminus of this base sequence : 104443950
  Distance between 3'-terminus of neighbour sequence of sequence listing upward to telomere on chrosomal short arm and 5'-terminus of this base sequence : 218237
gaagaaactaaaagcaaatatggtagaaatatacagatttatacaaataattaactgaataaatgtgtgtgtctgtgtgtgtgtgtgtgtgtgtgtgtgtctcagaaaccaaagaaataatactcctgtgagtgtgtac

SEQ ID NO: 20348 - DNA, 360 bp, Homo sapiens
  chr13.fa.O7frz.108780079
  Located on chromosome 13
  Distance between a terminus base of telomere on chromosomal short arm and 5'-terminus of this base sequence : 104613484
  Distance between 3'-terminus of neighbour sequence of sequence listing upward to telomere on chrosomal short arm and 5'-terminus of this base sequence : 169395
cactttgtgataccaaggtagtggtttgtggaggagagtcagaggtaaacattaatttgtgtgtgtgtgtgtgtgagagagagagagagatagagagagagagagggagggtgagagagagagagatagagagagggagggagagagagagagagagagagagggagggagggagagagagagagagagagagagatttactgcaagattcatcctgaaaaggaacaggagaacagacaaaatgtataaaataaacatagatgacacaaggtgtttaaagatagtcatcttgtctcatcagacactgtattagtccattctcacactgttataaagacgtatctgagtttaattggctca

SEQ ID NO: 20349 - DNA, 210 bp, Homo sapiens
  D13S274
  Located on chromosome 13
  Distance between a terminus base of telomere on chromosomal short arm and 5'-terminus of this base sequence : 104810355
  Distance between 3'-terminus of neighbour sequence of sequence listing upward to telomere on chrosomal short arm and 5'-terminus of this base sequence : 196511
aaggcattgggttcatttacctttataaataattatggtttaatgtttagaaatagaggtataacttcttgacttatggtattctatgaaataacaagaaagaagaaaccaaatacaatttgtatatgtgtgtgtgtgtgtatgtgtgtgtgtgtgtgtgtgtgtatttagagagagagagagagaaagaagaacaaagtaaattgctca

SEQ ID NO: 20350 - DNA, 479 bp, Homo sapiens
  chr13.fa.O7frz.109232908
  Located on chromosome 13
  Distance between a terminus base of telomere on chromosomal short arm and 5'-terminus of this base sequence : 105039420
  Distance between 3'-terminus of neighbour sequence of sequence listing upward to telomere on chrosomal short arm and 5'-terminus of this base sequence : 228855
ccaaattagaagttgatccttctagtaaataaatgtccctagggaactcagattagggaaaccatgtaaatgtcagtgcttatctgatgaaaggtgcctccttctaaggtgaactgttatttcttggtagccagactccttgctccttgtccgtctgtgttcgtgcgtgtgtgtgtgtgtgtgtgtgtgtgtgtggtggtatggggggggtgtgggaaggggtaagagaggaatctaacatctataagctacagcaaaaagaaaatgcagttcccatttagggtttgataatagaaaatgagatgtaaggcatacagttgttgagataatcttacacacttaggcagtagcttccttaaagcacaaagcacaggagaaacgtctcgtttttctaattgttctaataagttagacaaaaaaagataaaacctgatacatgtgtttgaactaagcgtgtatcgtaatcatgataaagcatt

SEQ ID NO: 20351 - DNA, 404 bp, Homo sapiens
  chr13.fa.O7frz.109524277
  Located on chromosome 13
  Distance between a terminus base of telomere on chromosomal short arm and 5'-terminus of this base sequence : 105317359
  Distance between 3'-terminus of neighbour sequence of sequence listing upward to telomere on chrosomal short arm and 5'-terminus of this base sequence : 277460
ttatgttgataaatagacatgcaggaagtatcagaaagttcccaggctttcagctacattgtcccaaaattattacaattattattatttttactttctgatctgcaaaccattcctaggaaaaataatttaaaataacatgtttattatcaaatgtaatagcttgtggaaatgcagctaagcaacccatgtttttgagatagatagataatagatggatggatgaatgaatggatggatggatggatggatagatagatggatagatagatagatagatagatagatagatagatagatagatagaagatagttagatacatgatagataggtggacagagagatgagagagagaacagggaagtaccaacttttgaaaagtaaatctaggcacaaatgatct

SEQ ID NO: 20352 - DNA, 455 bp, Homo sapiens
  chr13.fa.O7frz.109651900
  Located on chromosome 13
  Distance between a terminus base of telomere on chromosomal short arm and 5'-terminus of this base sequence : 105432486
  Distance between 3'-terminus of neighbour sequence of sequence listing upward to telomere on chrosomal short arm and 5'-terminus of this base sequence : 114723
gcatgtttgacttaattcagagggatttatgaataccacagtagcctgtttggtttggctgtgaataatgtgaggcatatagcttttatttctttcaagcagaaatatctgatgtcttcttggtaaccctctttagtgaaacagacaactttttaaaatactagagtccaaacatcaaacattcttatttgttcattgtctcacacactttctgaaatatgtgagaaaatatgacttttacaaaagcaagagcctaaatgtataaaataaatgtagctaagtcagaaatatggtgccaactcagacttaatattttattttacagaataactaaaaggaaacagatgtagaaataactctgttagagtaacacacacacacacacacacacacacgtacaactggcattgcgatatttgattacaattaaaacgtagtctgtatgtggctttgaa

SEQ ID NO: 20353 - DNA, 407 bp, Homo sapiens
  chr13.fa.O7frz.110041300
  Located on chromosome 13
  Distance between a terminus base of telomere on chromosomal short arm and 5'-terminus of this base sequence : 105570518
  Distance between 3'-terminus of neighbour sequence of sequence listing upward to telomere on chrosomal short arm and 5'-terminus of this base sequence : 137577
atttcattatgagtgaagctaaaccactcttcctacaaagaatgatagtgattactgactcacatgaatttgggaagcctacgtgaaagagtgaaggaagagggaagcaaaggaattttgatcaagaataacaagaggaggagtgccctagctcttataggaatgtagtataaagtatagtaatcatctatatatatatatatatatatatatatatatatatatatatatatatctctatctcattggtgaagcatattataagagaaagacaagatccaaataaaattaatgtaaatatggaattttattaaataataaatgtaatatcacataacacaaaggaactgatgggtgaattagtaaatagcattgagaatactatctatccttatggaaacggtagt

SEQ ID NO: 20354 - DNA, 355 bp, Homo sapiens
  chr13.fa.O7frz.109728389
  Located on chromosome 13
  Distance between a terminus base of telomere on chromosomal short arm and 5'-terminus of this base sequence : 105798754
  Distance between 3'-terminus of neighbour sequence of sequence listing upward to telomere on chrosomal short arm and 5'-terminus of this base sequence : 227829
atgttcatatggctgatgttagagagctatttttctgtacttgtgttttggaattcatggaataaaaggagcagtagttttatcctttctgttcaaggcacatcatgccagaatccatggagcaaaaagactgaaaaaaacaaaagcatgctctggattagaatataattcactatgcatgaatcatgaatgcccatttaaatgaacatatttacttgaatccaaaatatgtatttttgtgtatatatatatatatatatatatctctacctatatatataccatatatatatggcctcattttgttcattggtttgtttatattaaatttgtgacatttaggttgaactttcta

SEQ ID NO: 20355 - DNA, 191 bp, Homo sapiens
  Z67235
  Located on chromosome 13
  Distance between a terminus base of telomere on chromosomal short arm and 5'-terminus of this base sequence : 105921370
  Distance between 3'-terminus of neighbour sequence of sequence listing upward to telomere on chrosomal short arm and 5'-terminus of this base sequence : 122261
gtcaaatggtctaacacttcctgaccaactacttaagaatcagaagtgtgggaattctttattatagatccctttattgtggaaatattgaagttaaaactcttgcacttctacatcctctcaagcactgcagtgtgtgtgtgtgtgtgcgcgcgcgcacgtgcgcgcacgcgcgtaaaatccctagtggc

SEQ ID NO: 20356 - DNA, 323 bp, Homo sapiens
  AL138954.16_62294
  Located on chromosome 13
  Distance between a terminus base of telomere on chromosomal short arm and 5'-terminus of this base sequence : 106269555
  Distance between 3'-terminus of neighbour sequence of sequence listing upward to telomere on chrosomal short arm and 5'-terminus of this base sequence : 347994
cagatcacgaattctaccatatcacactacctctctctactattatttctactacaaataataattacatttttattttattttattttattttattttattatactttaagttttagggtacatgtgcacaatgtgcaggtttgttacatacgtatacatgtgccatgttggtgtgctgcacccattaactcttcatttaacattaggtatatctcctaatgctagccctcccccctccccccaccccacaacagggcccggtgtgtgatgttccccttcctgtgtccatgtgttctcattgttcagttctcaatgaccaac

SEQ ID NO: 20357 - DNA, 157 bp, Homo sapiens
  AL138954.16_133578
  Located on chromosome 13
  Distance between a terminus base of telomere on chromosomal short arm and 5'-terminus of this base sequence : 106340852
  Distance between 3'-terminus of neighbour sequence of sequence listing upward to telomere on chrosomal short arm and 5'-terminus of this base sequence : 70974
ggcagaggatcaactaggatactcgtaggaaaatgtgaggataattttctgcctgatacacacacacacacacacacacacacacacgctttccgtagtttttcccgaacccctatatacctttgttgcctcacttgtaagtgtacggtttggatag

SEQ ID NO: 20358 - DNA, 196 bp, Homo sapiens
  D13S797
  Located on chromosome 13
  Distance between a terminus base of telomere on chromosomal short arm and 5'-terminus of this base sequence : 106381982
  Distance between 3'-terminus of neighbour sequence of sequence listing upward to telomere on chrosomal short arm and 5'-terminus of this base sequence : 40973
ggtttgctggcatctgtattagggttctccagacagatagaaccaataggatagatatagataatagatacatagatggatggatggatggatagatacatagatagatagatagatagatagatagatagatagatagatagcatttgttaggagaattggctcgtgattatagagactgaaaagcctccagaca

SEQ ID NO: 20359 - DNA, 147 bp, Homo sapiens
  D13S1311
  Located on chromosome 13
  Distance between a terminus base of telomere on chromosomal short arm and 5'-terminus of this base sequence : 106441324
  Distance between 3'-terminus of neighbour sequence of sequence listing upward to telomere on chrosomal short arm and 5'-terminus of this base sequence : 59146
tgatgaccttctgtgagtctctccttcttgtcataaacttgtcttcacacacacacacacacacacacacacacacagagagacgcacgcacacacaagcacacatacacagagtatcaaggatattctgttggaaattcggagttc

SEQ ID NO: 20360 - DNA, 480 bp, Homo sapiens
  chr13.fa.O7frz.110542022
  Located on chromosome 13
  Distance between a terminus base of telomere on chromosomal short arm and 5'-terminus of this base sequence : 106541933
  Distance between 3'-terminus of neighbour sequence of sequence listing upward to telomere on chrosomal short arm and 5'-terminus of this base sequence : 100462
tctactcagcaactttcaagagtataataaatattattaactgtagtcaccctattgtaaaatacatctcttgaatttattcctcctgtcaaacccaaagagaatatggattttgacgtgctacaatttcattactttgtgcctctgtgcggatttattttcatttatttttctcagtacgagacacgcacatcctatctgaaggctcatgtttttcttcaattgtggaaaattccttacttttttcagtattgtttctcctttattctttttattgtaaacctcatggttatatgtcggagtctctaaatctacccctcctatctgtgaattgttcttttctatgtggtgtgtgtgtgtgtgtgtgtgtgtgtgtgtgtgtgcgcgcgcgcgcatgtacatgcatgcaattccttcgcatattccttggcattttctctaagctgcatcctgggtgaattctttcctggatgtctagtc

SEQ ID NO: 20361 - DNA, 418 bp, Homo sapiens
  chr13.fa.O7frz.110943686
  Located on chromosome 13
  Distance between a terminus base of telomere on chromosomal short arm and 5'-terminus of this base sequence : 106626277
  Distance between 3'-terminus of neighbour sequence of sequence listing upward to telomere on chrosomal short arm and 5'-terminus of this base sequence : 83864
tcgtaagaattacaacgtcaacaaaaccttccctgattataaaccctctcctacaatttcacaacacatttcaaaagagttgtctatacctgctgtatccacttcagtctgctccttcatggtggtaacacctgcatttgcctctattgaaacatatcagccccagaacaacacgcagctcattctatcactactctatccagctctctgctcaaatgctatttttttttaagaggaaagtctttagttggctttttaattagagggttaccctccctcagggaacgctctatctatctatcttgttttatttttcttctgatgacttactacttcctaaaatcacacacacacacacacacacacacacacaaacacacacacacaaaatcacattacatgctggctattacctatc

SEQ ID NO: 20362 - DNA, 434 bp, Homo sapiens
  chr13.fa.O7frz.111042196
  Located on chromosome 13
  Distance between a terminus base of telomere on chromosomal short arm and 5'-terminus of this base sequence : 106783543
  Distance between 3'-terminus of neighbour sequence of sequence listing upward to telomere on chrosomal short arm and 5'-terminus of this base sequence : 156848
gtaggtttctatcaactatcctcacaattgcaaaacctgaaaactaaagccaagatggatgaatcttaaaaattttagttggaatgaaaacgaaagccagacacgaaagagctcatactgtgtgagtctgtttatttcaagtacataaacaggcaaactaaaatacggtagtataaatcagaatgatggttgcctgtgagggagggttgcatatgtcccagaaacggacacaacggaatttcagggtgcatgatgcatcttgatccaggtggtggttactcaagtgtgtattttatcaaaatccattgaattgtgtaccttaaacctatagatgttattgtataaatgtttacctcaacacacacacacacacacacacacacacgttctcaagacacatgaaacattctccaggatagaacctatgctaggtc

SEQ ID NO: 20363 - DNA, 461 bp, Homo sapiens
  chr13.fa.O7frz.111226648
  Located on chromosome 13
  Distance between a terminus base of telomere on chromosomal short arm and 5'-terminus of this base sequence : 106962023
  Distance between 3'-terminus of neighbour sequence of sequence listing upward to telomere on chrosomal short arm and 5'-terminus of this base sequence : 178046
tacctgcagtcaatagtatcaataatgaagaggtgcaatggtgactgtattaaagagctgggtgatttgaattattaacaatccacaagtcttgccaattcaaggtgcaattgctcatgagaaatgcacttatattcctcccacattaagagcctcacttatgtatatatttataaagctgctgtatgtgaggtacagaaatgtcaaggaatcctattggatctgtgaaatattttagccataatttacaaatgcagcgaatcctgtgtctaaacttctccagctatcccgtcccagcatgccccatcccattttactacacataatctgtcattctgcccctcttctttcttcttttttctgtgcccttcattccaccccaacacacacacacacacacacacacacacacacacgatttgtaacctagaagtcgataatatttgtcacgttcagaactg

SEQ ID NO: 20364 - DNA, 199 bp, Homo sapiens
  D13S278
  Located on chromosome 13
  Distance between a terminus base of telomere on chromosomal short arm and 5'-terminus of this base sequence : 107082654
  Distance between 3'-terminus of neighbour sequence of sequence listing upward to telomere on chrosomal short arm and 5'-terminus of this base sequence : 120170
ggggtagtttgttaccctacaatagatcattgataaatacacacacacacacacacacacacaaacatttccatatatattttcacatatgtatgtaagtgtgtatatatctgaatatgaaacagaaagaattaatattcatattatgtagatgactgctgcaagtcaattaaaaaaacaaaagaactcaggctgggca

SEQ ID NO: 20365 - DNA, 278 bp, Homo sapiens
  AL139379.13_17021
  Located on chromosome 13
  Distance between a terminus base of telomere on chromosomal short arm and 5'-terminus of this base sequence : 107111590
  Distance between 3'-terminus of neighbour sequence of sequence listing upward to telomere on chrosomal short arm and 5'-terminus of this base sequence : 28737
cgtgaaccactctttaacagactttgatctgtcagaaattacaatcttgtttatagtgtctcagctaaggtgtttaggattacaggactgggcctacagaaatataattggacatatatatatatatatatatatatatagagagagagagagagagagagagagagagagagagagaatagccacctttatcattttcattataatttacccaagagataagtgtttgaatggtcccaaatgaagaagacagactgatcataagttctgaccggatt

SEQ ID NO: 20366 - DNA, 307 bp, Homo sapiens
  AL139379.13_46684
  Located on chromosome 13
  Distance between a terminus base of telomere on chromosomal short arm and 5'-terminus of this base sequence : 107141208
  Distance between 3'-terminus of neighbour sequence of sequence listing upward to telomere on chrosomal short arm and 5'-terminus of this base sequence : 29340
tggagttctaaggagtaatgctagaatttcgaataagtctaaattaagaatccacttgttgggtctcaggttcatctatcaaacagaaaaaggaggactccaagtcagaggtcgaggttgcagggagccaagatggtgccactgaactccagcctgggcgatagagcaagactctgtctaaaaaatatatatatatatatatatatatatatatatatatatatatatatatacatatatatataaactttatataaactccaagctgatcagaaaccaagcattcaactgagtacattaggttgtc

SEQ ID NO: 20367 - DNA, 125 bp, Homo sapiens
  D13S766
  Located on chromosome 13
  Distance between a terminus base of telomere on chromosomal short arm and 5'-terminus of this base sequence : 107152539
  Distance between 3'-terminus of neighbour sequence of sequence listing upward to telomere on chrosomal short arm and 5'-terminus of this base sequence : 11024
ccttcataataatgctctatgttttcaattttaattttgagatgatagaaagatagatgatagatagatagatagatagatagatagatagatagatagatagacttgccaagaggttttgacat

SEQ ID NO: 20368 - DNA, 175 bp, Homo sapiens
  D13S286
  Located on chromosome 13
  Distance between a terminus base of telomere on chromosomal short arm and 5'-terminus of this base sequence : 107186996
  Distance between 3'-terminus of neighbour sequence of sequence listing upward to telomere on chrosomal short arm and 5'-terminus of this base sequence : 34332
aagctatcaataagccagagcatattgcaagaacgatattcccaccgccagatcacctgtttatgagttatcgatacttgagaagtcttcttaggcttttgattgtatgcatgcctgtgtacacacacacacacacacacacacacacagacacacgtttggacactgcactcta

SEQ ID NO: 20369 - DNA, 401 bp, Homo sapiens
  chr13.fa.O7frz.111580010
  Located on chromosome 13
  Distance between a terminus base of telomere on chromosomal short arm and 5'-terminus of this base sequence : 107315542
  Distance between 3'-terminus of neighbour sequence of sequence listing upward to telomere on chrosomal short arm and 5'-terminus of this base sequence : 128371
aggatcacaggacagatcacaggaaggacgtggccctggttgatgctcctgctgggatgatcttcccgagaagtcagcctagctggctcctttgcctccttgaaattatcgctcaaatggcacttctccgtcacttctctgacttctctgttctaaattgaaacatcccaattcccaatcctctttacccgctcccttcttttcgttttcccatgggactcatgacgctctaataaggtattttgttttgttgttgttgttgttgttgttgacacagagtcttgctcttttgcccaggctagagtacagtggcaaaatctcagctcactgcaacctccacctcctgggctcaagcaattctcatgcctcagcctcccaagtagctggaagtaattacagcc

SEQ ID NO: 20370 - DNA, 337 bp, Homo sapiens
  chr13.fa.O7frz.111706506
  Located on chromosome 13
  Distance between a terminus base of telomere on chromosomal short arm and 5'-terminus of this base sequence : 107442040
  Distance between 3'-terminus of neighbour sequence of sequence listing upward to telomere on chrosomal short arm and 5'-terminus of this base sequence : 126097
catcaagtatgacttccaattaagttttaatttctaaacccaatgacgacttaggtataaaagcacttaacttgtggaacacttacatagatgtaaaagcaaccactctgatttgtattactttgtaataccagaaggaagttccaaagaaatacttaatggagtaagaagctagttatttctctcacacacgcaaatcccttaattaggtcttctgtatcccccacttccactgtttgccagcactaaatcagttactctagaaccaatactggatggatggatggatggatggatggatggatggatggattaggtaatacaatccactcatctt

SEQ ID NO: 20371 - DNA, 476 bp, Homo sapiens
  chr13.fa.O7frz.111880381
  Located on chromosome 13
  Distance between a terminus base of telomere on chromosomal short arm and 5'-terminus of this base sequence : 107616004
  Distance between 3'-terminus of neighbour sequence of sequence listing upward to telomere on chrosomal short arm and 5'-terminus of this base sequence : 173627
gtgacatcactgcctaatttacactcatgccaggcctaaatgacctcatcacagaaaggcgattgtcttggctcctactacatggcacaattcttttcctgaacattcctgatcatactctgtgcactccctcatccctgcctttgttatttccccctacccctggaacacagtttgacaaacatcaattccattttcttgtgaaggcaagttaattttcagactctcagtgtcttcatctctaaaacgaagggttatctgtgctactgctgctgctgctgctgctgctgctgctgctgctgctgctgctgctgctgttttcctcatgggtgtctggaggggagctgaaatgaaagggtggaggtatctggatcccagggctgcttccttttatctgccctacatattgctaaaatcgcttttgaaaaataggccccactgcttttaaattactgaactagatagtatcgcaggct

SEQ ID NO: 20372 - DNA, 395 bp, Homo sapiens
  chr13.fa.O7frz.111961408
  Located on chromosome 13
  Distance between a terminus base of telomere on chromosomal short arm and 5'-terminus of this base sequence : 107674135
  Distance between 3'-terminus of neighbour sequence of sequence listing upward to telomere on chrosomal short arm and 5'-terminus of this base sequence : 57655
gattagacacattccatttgttatagcttcagaacccctctctgttctcccctgcacatcagcgtctcttggtgtctccatgcatttcctcctccctggagagaaagaggctccctctttcctaccgggcaaatcatcctacctggggttccaggagccctccactcccaccctcttcattctcgttgaggtggcacctcactcacagcctctcctctatgccttgttccttcagcccctctccctccacacacacacacacacacacacacacacacacacacacgcaaaaagcaattgcatctctttactggcccagaaaacaaaagtgcacatatgttagacatggtttgtattgattattctggaatgagctatgcattcatagaacattg

SEQ ID NO: 20373 - DNA, 193 bp, Homo sapiens
  chr13.fa.O7frz.112129853
  Located on chromosome 13
  Distance between a terminus base of telomere on chromosomal short arm and 5'-terminus of this base sequence : 107852765
  Distance between 3'-terminus of neighbour sequence of sequence listing upward to telomere on chrosomal short arm and 5'-terminus of this base sequence : 178235
agctgttcaacactgataacatagattttctcttaaatgttttaaaattattttgtattaacatttttaactcaaataaaaatatatgtgtgtctgtgtgtgtgtgtgtgtgtgtgtgtgtgtgtgtcagcacacatggttcagataaaaacctaattttatcattagtatttgtatggtctatgatctcaac

SEQ ID NO: 20374 - DNA, 172 bp, Homo sapiens
  D13S173
  Located on chromosome 13
  Distance between a terminus base of telomere on chromosomal short arm and 5'-terminus of this base sequence : 108056118
  Distance between 3'-terminus of neighbour sequence of sequence listing upward to telomere on chrosomal short arm and 5'-terminus of this base sequence : 203160
gtctctggctgctctcaagactattttcttcatttggtgttattttggtttttctgtgtgtgtgtgtgtgtgtgtgtgtgtgtgtgtgtgtgtgtgtgtgtggtatccccaggcatgaggctaccacttcattcatgcaattaaagtgaaggtcatcattactggaacaggg

SEQ ID NO: 20375 - DNA, 185 bp, Homo sapiens
  Z67466
  Located on chromosome 13
  Distance between a terminus base of telomere on chromosomal short arm and 5'-terminus of this base sequence : 108083628
  Distance between 3'-terminus of neighbour sequence of sequence listing upward to telomere on chrosomal short arm and 5'-terminus of this base sequence : 27338
cttgtccctactttcgtcatcgcctaatcacatttttaaatatctgaaaatgtttctttaccattccttttgttttctgtcatttgcaatatgagcatatttatttatttatttatgctgtgtgtgtgtgtgtgtgtgtgtgtccgtgtgtgtgtgtgtgtgtgttggtttgtttgttttgagac

SEQ ID NO: 20376 - DNA, 152 bp, Homo sapiens
  HUMUT7138
  Located on chromosome 13
  Distance between a terminus base of telomere on chromosomal short arm and 5'-terminus of this base sequence : 108102644
  Distance between 3'-terminus of neighbour sequence of sequence listing upward to telomere on chrosomal short arm and 5'-terminus of this base sequence : 18831
gatatgtgcatgtacgttgatatctatctatctatctatctatcatctatctatctatctatctatctatctacccatccataagttgataagttgatagatatctctcaatgtataggcacatatcataggccttggaagagatcagaagg

SEQ ID NO: 20377 - DNA, 431 bp, Homo sapiens
  AL138914.9_56360
  Located on chromosome 13
  Distance between a terminus base of telomere on chromosomal short arm and 5'-terminus of this base sequence : 108164515
  Distance between 3'-terminus of neighbour sequence of sequence listing upward to telomere on chrosomal short arm and 5'-terminus of this base sequence : 61719
taatagtaggagcaaggacctttaatgggtagcaaaggtgaggaagagttgaggggttttggtgaccatctgtcctggcttgccagggacttgccagagactttggaaaagtactgcatcccttgaaacccttcagtctgttcctgaccaagatcattggtcaccctaggggaactcctttttaacccagcagcagggctcaattctttgtgtataaatgtgtaggctcccaacaccccacaaaatgctaacagacacacacacacacacacacacacacacacacacacacacacatctcagtggactcacagttgatgtgtctatgaaatgaatctttgcttgattattacagaaagcattttgattcactgaagtttctgagcatgcaggtgaccacatatttttatggccactataaccaatttatt

SEQ ID NO: 20378 - DNA, 306 bp, Homo sapiens
  AL138914.9_151279
  Located on chromosome 13
  Distance between a terminus base of telomere on chromosomal short arm and 5'-terminus of this base sequence : 108259449
  Distance between 3'-terminus of neighbour sequence of sequence listing upward to telomere on chrosomal short arm and 5'-terminus of this base sequence : 94503
ctgcatgaacagtatcaagtttaggttgataatgatttcagtatcccatttgggccatgcataaaaatatatatttgcaataaataaatgactacatgtaatgaatatatgcacacgtgtgcatatgcatatttatatacgcatatatatatgtgtgtatatagacatgtgtctgtggatatatatatgtatacacatttacacatgcatgtttatacctattttatatacgtaacatatgtgtgtgtgtgtgtgtgtgtgtgtttaaaataaagcaaactgctgttacaagtgcaaactctggaa

SEQ ID NO: 20379 - DNA, 161 bp, Homo sapiens
  chr13.fa.O7frz.112672293
  Located on chromosome 13
  Distance between a terminus base of telomere on chromosomal short arm and 5'-terminus of this base sequence : 108347856
  Distance between 3'-terminus of neighbour sequence of sequence listing upward to telomere on chrosomal short arm and 5'-terminus of this base sequence : 88101
aacaaggaagagaagtagcaagaaaaacacatctgaaatctctactagtaacaatgccataattaaattcacacacacacacacacacacacacacacatatttttactaaattggaattacaccctgtatgatactgtgctcgttactttctagaattta

SEQ ID NO: 20380 - DNA, 101 bp, Homo sapiens
  DISO7_10026992
  Located on chromosome 13
  Distance between a terminus base of telomere on chromosomal short arm and 5'-terminus of this base sequence : 108637668
  Distance between 3'-terminus of neighbour sequence of sequence listing upward to telomere on chrosomal short arm and 5'-terminus of this base sequence : 289651
tgacaattgcaccaagatgcatacgcatgcatacacacacacacatacacacacacacacacacacacacacacacgcgcgcgtgtacctaataagctgta

SEQ ID NO: 20381 - DNA, 354 bp, Homo sapiens
  AL136964.4_36192
  Located on chromosome 13
  Distance between a terminus base of telomere on chromosomal short arm and 5'-terminus of this base sequence : 108725244
  Distance between 3'-terminus of neighbour sequence of sequence listing upward to telomere on chrosomal short arm and 5'-terminus of this base sequence : 87475
tatgttcgtgtgacaagtacatacagattttggagcctgacagcctgagtttgagtattggttatgctgcttactagctgtgtgatactgggcaagtgatttaacctgcttgctttcagtgctctcatctgcacaatgcggataatagtaatgcttactgcataaggctgttgggagaaatcaatgatttaatacatgtaaagtgtttcttgtagtgctggcatctagaaaattttcaatattaccattgctgttattattattattattattattattattggtccccatcattccttaaaggcaaaggctgttcctgttttccttatcctgtgtaccagctcatggtatatg

SEQ ID NO: 20382 - DNA, 158 bp, Homo sapiens
  D13S778
  Located on chromosome 13
  Distance between a terminus base of telomere on chromosomal short arm and 5'-terminus of this base sequence : 108725444
  Distance between 3'-terminus of neighbour sequence of sequence listing upward to telomere on chrosomal short arm and 5'-terminus of this base sequence : -154
aagtgtttcttgtagtgctggcatctagaaaattttcaatattaccattgctgttattattattattattattattattattggtccccatcattccttaaaggcaaaggctgttcctgttttccttatcctgtgtaccagctcatggtatatggatg

SEQ ID NO: 20383 - DNA, 185 bp, Homo sapiens
  Z66756
  Located on chromosome 13
  Distance between a terminus base of telomere on chromosomal short arm and 5'-terminus of this base sequence : 108858764
  Distance between 3'-terminus of neighbour sequence of sequence listing upward to telomere on chrosomal short arm and 5'-terminus of this base sequence : 133162
ggttttttagcgggaagaatgtgcccatgagatgaataatttctggaaatctaatgtacagtatggtgactacatctaacagtattgtattatatacttgaaatttggtaacagaatagatttcagatgtgctcaccacacacacacacacacacacacacaaatggaaactgtgtgaaatgatg

SEQ ID NO: 20384 - DNA, 262 bp, Homo sapiens
  D13S783
  Located on chromosome 13
  Distance between a terminus base of telomere on chromosomal short arm and 5'-terminus of this base sequence : 108915459
  Distance between 3'-terminus of neighbour sequence of sequence listing upward to telomere on chrosomal short arm and 5'-terminus of this base sequence : 56510
tttttcttttttctctatagaatccactatatgtatgtatgtggatagatagataaatatctagatagattagatatacatatctacataggtaaataaatacatatagatagatagatagatagatagatagatagatagatagatagatgtggagacagagagagaatgaatttctctgttgtccagactggagcatagctcattgcagccctgaacttctgggtttaagcaagcctcccacctcagtttccttagtagc

SEQ ID NO: 20385 - DNA, 436 bp, Homo sapiens
  chr13.fa.O7frz.113353672
  Located on chromosome 13
  Distance between a terminus base of telomere on chromosomal short arm and 5'-terminus of this base sequence : 109006234
  Distance between 3'-terminus of neighbour sequence of sequence listing upward to telomere on chrosomal short arm and 5'-terminus of this base sequence : 90513
ggtaaatcatgctctatgttaaagtgagaaatactggaatggaaaaaaggcagctctcctcatactcatcacaatccttttcagtggttgaaaagtattcaggtgaaaaattcatgtaagtacactcaaacaaatataatttccttcaaatttctgagacctttacagaacaaacatgtaattttttttctgtttctcacttcccgtttcttccttcaatcacacacacacacacacacacacacacacacacaaagtgtgagcacaaaacacttctgctcaatgccatcaagtcctgatgggtatttgctttgtctgtttgcttgtcttttataaaaattttcttccctgaactgtaactccttgagggcatgaattatatctgtttctttcatcttccctacgtttagaaaagttccttggatattgaaggtta

SEQ ID NO: 20386 - DNA, 458 bp, Homo sapiens
  chr13.fa.O7frz.113581324
  Located on chromosome 13
  Distance between a terminus base of telomere on chromosomal short arm and 5'-terminus of this base sequence : 109187987
  Distance between 3'-terminus of neighbour sequence of sequence listing upward to telomere on chrosomal short arm and 5'-terminus of this base sequence : 181317
aactgtttcatgtatttggtagacttgcaaaacaaatgattaaacttgctttctcttcagccatttctcagagcaaattaggttaaactgtaagggtgatattatattttaacagcacatagagcttttctgaaatgtcatgaatttcatatatatatatcatatatataaatcaatgggcaaatataaagtaactttaagaataatgtcatgcaatcaatgtaaaaagtataattgatttagtgtttctggaagagtgggtttctagctttgtgttctcagtttctttattatttctactcaagtaactaaaatgataaatttttgctttttagtcactcaagactgcttgcaactgattgcagacagtgaaacaccaactatacaaaaaggtaataaaatatagcaaagacttggaaccaagccaaatgtccatcaatgatagactggattaagaa

SEQ ID NO: 20387 - DNA, 447 bp, Homo sapiens
  chr13.fa.O7frz.113689283
  Located on chromosome 13
  Distance between a terminus base of telomere on chromosomal short arm and 5'-terminus of this base sequence : 109295917
  Distance between 3'-terminus of neighbour sequence of sequence listing upward to telomere on chrosomal short arm and 5'-terminus of this base sequence : 107472
ctctttaatgcatctgagtcagtttcctcatctttaaaatgggataatcaaacttcaacaccagagacaggcctcactttcagggactctccccacttggcagagaaaatctctccatcccatgttctgtatcttttggatttctattattacacttaatattattaatattatgcccactcaacacacacacatacacacacacacacacacaccaaacccctccccccccacacacacataggcacacactgaatttaagtgttttcaaggaaagtgtatttattgcattaaacaaggagactaaacatatttttgatatcatccagtctctttctgaataataagtattggttccttaggaaaattacgtatattaagtgaaatccttgacgcaaatgtatcaaatgatgcttgacacaatttagtgctccgtaaatttagtgt

SEQ ID NO: 20388 - DNA, 139 bp, Homo sapiens
  D13S1265
  Located on chromosome 13
  Distance between a terminus base of telomere on chromosomal short arm and 5'-terminus of this base sequence : 109577859
  Distance between 3'-terminus of neighbour sequence of sequence listing upward to telomere on chrosomal short arm and 5'-terminus of this base sequence : 281495
ttgttttctgctaatgtgtgattatatgtacgcgtgtgtgtgtgtgtgtgtgtgtgtgtgtgtgtgtgccagccatctctctaaacactttatacatattgtctcatttaatctgaaaagaatcctatgaggtactgta

SEQ ID NO: 20389 - DNA, 444 bp, Homo sapiens
  chr13.fa.O7frz.113994971
  Located on chromosome 13
  Distance between a terminus base of telomere on chromosomal short arm and 5'-terminus of this base sequence : 109601520
  Distance between 3'-terminus of neighbour sequence of sequence listing upward to telomere on chrosomal short arm and 5'-terminus of this base sequence : 23522
ggactttggagattaatcaaaggcttccaacaatctaagaagcatttataggctgggcatggtggttcatgcctataatcccagcactttgggaggctgaggtgggtggatcacttgaggccaggagtttgagaccagcctggccaacagggtgaaaccctttctctactaaaaatacaaaaattagccgggtgtggtggcagactcctgtaatcccagctactcagaggctgaggcaggagaatctcttgaacctgggaggcagaggttgcagtgagctgagattgagccattgcactgcagcttgggcaacaacagcgaaactctgtctcaaaaaaaaaaaaaaaaaagaagaagaagaagaagaagaaggatttattcaggaacaaatggttgaacttcggcaagagcagtgttttgtggtcctttgacgattgtagccac

SEQ ID NO: 20390 - DNA, 313 bp, Homo sapiens
  AL136132.15_139928
  Located on chromosome 13
  Distance between a terminus base of telomere on chromosomal short arm and 5'-terminus of this base sequence : 109652469
  Distance between 3'-terminus of neighbour sequence of sequence listing upward to telomere on chrosomal short arm and 5'-terminus of this base sequence : 50505
ggtgatggattagagttgacaatatcagtatgaactcatgtttagcttaatagggttacagatgcttatgcatagaaatatgtatgtgtataaatatatatatatgtgtgttcacacacacacacacacacacacacatacatttccctcccctgtcagttgagagaacccaaatccatgacactttcatagccatgagcacactgacctccaaaatcttggttccccatataattctccaattaaaaaacaaacaaacaaaaacagggatttttggagaaacgactgaatctaggtcttgcatgaaatttac

SEQ ID NO: 20391 - DNA, 232 bp, Homo sapiens
  AL136132.15_127191
  Located on chromosome 13
  Distance between a terminus base of telomere on chromosomal short arm and 5'-terminus of this base sequence : 109665146
  Distance between 3'-terminus of neighbour sequence of sequence listing upward to telomere on chrosomal short arm and 5'-terminus of this base sequence : 12364
agtttaccatgaaagcaaacaccagttaacgaaatctttttgtgtgagagggccacgagttccttttaggatgtgttagggtcagggtccctagaagacatccactttgagaagtctaagagacagctggtcctggaactcaggggagagagaaaaggagttgtgtgtgtgtgtgtgtgtgtgtgtgtgtgtgtgtgtcgtgtatgtatagtgacagaagtcctggagtaaa

SEQ ID NO: 20392 - DNA, 301 bp, Homo sapiens
  AL136132.15_41463
  Located on chromosome 13
  Distance between a terminus base of telomere on chromosomal short arm and 5'-terminus of this base sequence : 109750922
  Distance between 3'-terminus of neighbour sequence of sequence listing upward to telomere on chrosomal short arm and 5'-terminus of this base sequence : 85544
ctggtctagaactcctgacctcaggtgatctgcctgcctctgcctcccaaagtgctgggattacaggcatgagccactgtgcccatctaacacacagtcttttttttttttaatttcctcctttgtgtgtgtgtgtgtgtgtgtgtgtgtaacttatccatactgggttatttgcccctagactgccttcctccaaatcctgttgaatttcctcttttgtgtgtgtgtgtgtgtgtgtgtgtgtgtgtgtgtgtgtgtgtgtgtaacttatccatactgggttatttgtgcctagactgcc

SEQ ID NO: 20393 - DNA, 303 bp, Homo sapiens
  AL136132.15_19652
  Located on chromosome 13
  Distance between a terminus base of telomere on chromosomal short arm and 5'-terminus of this base sequence : 109772757
  Distance between 3'-terminus of neighbour sequence of sequence listing upward to telomere on chrosomal short arm and 5'-terminus of this base sequence : 21534
catgccacttattttcttgaacatgtcatttttaatcctgtgtcttatgactctaatattgaggtctgtttctactatgtgactttgtgtgtgtgtgtgtgtgtgtgtgtgtgtgtgtgtgtgtgtctgtgtgttggttttacatatatggatatatttactgacatccacggagatttttgatggagtattgaactttccatataaaaaaaccatagggcccaggaagacattatcttccttccaagaagatttgacttttcctcctagcaggcacataagttgtagacaaaccgccttgac

SEQ ID NO: 20394 - DNA, 279 bp, Homo sapiens
  AL136132.15_16278
  Located on chromosome 13
  Distance between a terminus base of telomere on chromosomal short arm and 5'-terminus of this base sequence : 109776058
  Distance between 3'-terminus of neighbour sequence of sequence listing upward to telomere on chrosomal short arm and 5'-terminus of this base sequence : 2998
aagctgagacttgaggttaaacagattttctaaagtcttcccatgagtggcagagctagcattaaagtccaggtcatgcagctccagagcgaatgcttggcaggcttctctcagcagcacaagtgctgcgcccagaggcagacagtttcatcatcatcattattattattattattattattattattattattattatatgtgatcttttgtaaacacaaacacatactttctcaaaacatgtcacctatacataggtatacagttcacaaataggac

SEQ ID NO: 20395 - DNA, 174 bp, Homo sapiens
  G09023
  Located on chromosome 13
  Distance between a terminus base of telomere on chromosomal short arm and 5'-terminus of this base sequence : 109837558
  Distance between 3'-terminus of neighbour sequence of sequence listing upward to telomere on chrosomal short arm and 5'-terminus of this base sequence : 61221
tcgttgagatttttgtgtctatgttcatcagggatattggctatagtttccttccttccttccttccttccttccttccttccttccttccttccttccttccttccttctttccttcctttctctctctttctctttctttctttctaaaattctgtctttgccagcttttgt

SEQ ID NO: 20396 - DNA, 296 bp, Homo sapiens
  chr13.fa.O7frz.114581493
  Located on chromosome 13
  Distance between a terminus base of telomere on chromosomal short arm and 5'-terminus of this base sequence : 109973878
  Distance between 3'-terminus of neighbour sequence of sequence listing upward to telomere on chrosomal short arm and 5'-terminus of this base sequence : 136146
tcttatctagatgcaagctgagtgatatttacaagcatcccattttacattgtgtcccctcacctttccctgggcctggtacaaggttacttcctcattaattatcattttgctcttgaaataattaatacagatttcaacttataattggaaattttccagggaatcctctttttcttttgctactcctaatggttataaaatctgtggcattaaacacacacacacacacacacacacacactcacacactctcacacaacccaagcattcttcagaccaaattatttaaatca

SEQ ID NO: 20397 - DNA, 459 bp, Homo sapiens
  AL137243.6_88578
  Located on chromosome 13
  Distance between a terminus base of telomere on chromosomal short arm and 5'-terminus of this base sequence : 110083240
  Distance between 3'-terminus of neighbour sequence of sequence listing upward to telomere on chrosomal short arm and 5'-terminus of this base sequence : 109066
atcatatgttccgtttctgagaatgaacttatcataacccattaaaagaaatgcaggagtcattcaactgtttcataaaatttatttatttatttattttattttatttttttttttgagacagagtttaactcttgttgcccaggctggagtgcaatgggatgatctcagctcactgcaacctccacctcccggttcaagtgattctcctatctcagcctcccaagtagctgggattacaggtgtgcaccaccacacccagctaattttgtatttttagtagagatggagtttcatcatgttggtcaggctggtctcaaactcctgacctcagtgatccgtccgcctcggcctcccaaagtgctgggattacaggcgggagccactgcacctggcctgtttcataaaacataaagaatttttggttcaaaaataaaagtcttcagtagccataatgga

SEQ ID NO: 20398 - DNA, 136 bp, Homo sapiens
  DISO7_10003866
  Located on chromosome 13
  Distance between a terminus base of telomere on chromosomal short arm and 5'-terminus of this base sequence : 110278310
  Distance between 3'-terminus of neighbour sequence of sequence listing upward to telomere on chrosomal short arm and 5'-terminus of this base sequence : 194611
aatagaatcagatccaaatagccataatataatataatataatataatataatataatataatataatataatataatatataatcttttagctgaaggaagtttccaaatataaaatcccaatcacctgctaagc

SEQ ID NO: 20399 - DNA, 214 bp, Homo sapiens
  DISO7_10003867
  Located on chromosome 13
  Distance between a terminus base of telomere on chromosomal short arm and 5'-terminus of this base sequence : 110327888
  Distance between 3'-terminus of neighbour sequence of sequence listing upward to telomere on chrosomal short arm and 5'-terminus of this base sequence : 49442
aatgtccaccacctcactcagcccctgccccttccttccttccttccttccttccctccctccctccctcctccttccttccttccttccttccttccttccttccttccttccttccttgcttccttccttccttccttccttccttccttccttccttccccccacatcatggctttcccacaaggccctggagagcgcagagaaacacatt

SEQ ID NO: 20400 - DNA, 278 bp, Homo sapiens
  AL163541.13_9332
  Located on chromosome 13
  Distance between a terminus base of telomere on chromosomal short arm and 5'-terminus of this base sequence : 110378778
  Distance between 3'-terminus of neighbour sequence of sequence listing upward to telomere on chrosomal short arm and 5'-terminus of this base sequence : 50676
gattatgacatgcctcaacatctttgtcttagcgtgtgtgtgtgtgtgtgtgtgtggtggtgtgtgcatgtgcatgcacatgcttggagtggttgagctgctgggatcagcaagtgtatatttttcattaatttgagacatttggggacatcagttttcaaatatatctcttctgcttctcctttcttctctcctttagaaactctaattatacatacatgaggccacttgcacttgtgccacaaatcaccacactgttcatttcttgtcttttgttc

SEQ ID NO: 20401 - DNA, 408 bp, Homo sapiens
  AL163541.13_29274
  Located on chromosome 13
  Distance between a terminus base of telomere on chromosomal short arm and 5'-terminus of this base sequence : 110398535
  Distance between 3'-terminus of neighbour sequence of sequence listing upward to telomere on chrosomal short arm and 5'-terminus of this base sequence : 19479
cctatcaacctgagtctggatgtgaggtggcacagtaagcagtatgccctcttggcttattcggtacccaaaatctgacagaaaataaatgtggataatttgtatacatttttaaaataaatgaggataaaaatgaaagcagagaaggtgagagggaaaggagaaaacatctcgttttctgcctctgtctctgtgtctctctctctctctctctctctcacacacacacacacacacacacacacacacacacaaccttattaacaggcttcaagccattaagcaagctgaaaatggttgaaataataactatatgaaatgtttctagtttttcaagttggagctggtggcatggtggtgttaatattcccaagagaaaaactgttctaattctttagctcttggaga

SEQ ID NO: 20402 - DNA, 377 bp, Homo sapiens
  AL163541.13_57876
  Located on chromosome 13
  Distance between a terminus base of telomere on chromosomal short arm and 5'-terminus of this base sequence : 110427194
  Distance between 3'-terminus of neighbour sequence of sequence listing upward to telomere on chrosomal short arm and 5'-terminus of this base sequence : 28251
gtcatttggtctggaaatcaccacaacaaaatttttatttgctttatgtagtataaattgtttacatatatgtaaattatatgtatgtatttatgtgtatatgtaatatcaagtatgtgtactatcaagtatctatgcacaacataattagatacaaaaatcacacacacacacacacacacacacacacacacgaattgtcttttctgggagaagcacacggctgctgaaatggtagataaaacaggtgcacaaggatgacccatagtgtaacaaatgtgcatattcactttaagaacctagttaggatgttagcttgtgtccatgtgaaatgataaaagatggcatgcaatggtatgattcattgtggcactaac

SEQ ID NO: 20403 - DNA, 216 bp, Homo sapiens
  AL163541.13_63067
  Located on chromosome 13
  Distance between a terminus base of telomere on chromosomal short arm and 5'-terminus of this base sequence : 110432506
  Distance between 3'-terminus of neighbour sequence of sequence listing upward to telomere on chrosomal short arm and 5'-terminus of this base sequence : 4935
tgctagtgtctcactggagtactacatcttagcaaattctttattattattattattattattattattattattattattattattttttgagacggacactcgcggcaacacccaggctgaagtgccgtggtaaaatctcggctcactgcaacctccacttcttgagttcaagtcattctcctgcctcagcctctcgagtagctaggactacag

SEQ ID NO: 20404 - DNA, 214 bp, Homo sapiens
  AL163541.13_84942
  Located on chromosome 13
  Distance between a terminus base of telomere on chromosomal short arm and 5'-terminus of this base sequence : 110454257
  Distance between 3'-terminus of neighbour sequence of sequence listing upward to telomere on chrosomal short arm and 5'-terminus of this base sequence : 21535
ggaataagtatcatttggcagtatcattactgccaaagaagaattttcctctacagacctgatcatcaggtgtgttttaatacagagatatacaaacctgagcagtcccaagctcacccctggcctcctatcactctctctctccctctctctctctctctctctatatatatatatatatatatacacactgtatgattaggacaattgtcaa

SEQ ID NO: 20405 - DNA, 281 bp, Homo sapiens
  AL163541.13_103327
  Located on chromosome 13
  Distance between a terminus base of telomere on chromosomal short arm and 5'-terminus of this base sequence : 110472576
  Distance between 3'-terminus of neighbour sequence of sequence listing upward to telomere on chrosomal short arm and 5'-terminus of this base sequence : 18105
gcaattgcttaattaccttcagtttgttttttatcttcctcattttcatcttctttacttcttcatctgtccccatgtttaattctgtccttctcttttctctatataagtgaattcaggaaatataaataaaagaataccttactattttatgataactaccaatggaaagaagaataaaaccagattaatctaaattagaaactaaaacaaatttcatatacatatacatatatatatatatatatatatttccacttactatggagtgaaggatgaga

SEQ ID NO: 20406 - DNA, 244 bp, Homo sapiens
  AL163541.13_163890
  Located on chromosome 13
  Distance between a terminus base of telomere on chromosomal short arm and 5'-terminus of this base sequence : 110533292
  Distance between 3'-terminus of neighbour sequence of sequence listing upward to telomere on chrosomal short arm and 5'-terminus of this base sequence : 60435
gcataatgtcttcaaattccattcatgttgtgatatgtattagaatttcctccctttttgagcttgaataatattcctgtgtgtgtgtgtgtgtgtgtgtgtgtgtgtgtgtgtgtgtaattttgtttgtccactcagtgagtcactttatatgttatattaatccattctcatgctgctataaagaactgcccaagactgggcaatttataaagggaagaggtttaattgactcagtttcgca

SEQ ID NO: 20407 - DNA, 176 bp, Homo sapiens
  D13S1315
  Located on chromosome 13
  Distance between a terminus base of telomere on chromosomal short arm and 5'-terminus of this base sequence : 110594415
  Distance between 3'-terminus of neighbour sequence of sequence listing upward to telomere on chrosomal short arm and 5'-terminus of this base sequence : 60879
tacacgataagtaagccaagcaaaactggcctgcttttatcccaacaagagagtcattccaaacacagttagtgatgaaacagtcctacacacacacacacacacacacacacacacacacacacaatcatttgttgatgaaagttctaaataattgctcttgtgactgttgagtt

SEQ ID NO: 20408 - DNA, 482 bp, Homo sapiens
  chr13.fa.O7frz.115495398
  Located on chromosome 13
  Distance between a terminus base of telomere on chromosomal short arm and 5'-terminus of this base sequence : 110792431
  Distance between 3'-terminus of neighbour sequence of sequence listing upward to telomere on chrosomal short arm and 5'-terminus of this base sequence : 197840
atctattgaagacctacgctaagccaagtgctactctccaagttccagggactggaagttggatgatgaagaagacagatggggtcacgttgcctaatgctgcaccctcactcgggttgcccattgtattagtcaggcagggttctctagagggacagaactaataggatatatatatatcatatatatatatatatatatatataactaatatacatgtatatgtatattatgtatacatatacatgtatatatacatgtatgtatgtatgtatgtatatgtatattagttctcccatatatagttctcatatatatacatatatatgtatacatgcatatacatatatatacagttatgtatatatatgggaactatacataggagagctaatatatacacctaggctaaagggcagagccatggctcctaggctacagacctgttcagcgtgtggctgtactgaatactgtaggcaact

SEQ ID NO: 20409 - DNA, 175 bp, Homo sapiens
  Z66602
  Located on chromosome 13
  Distance between a terminus base of telomere on chromosomal short arm and 5'-terminus of this base sequence : 111099566
  Distance between 3'-terminus of neighbour sequence of sequence listing upward to telomere on chrosomal short arm and 5'-terminus of this base sequence : 306653
cccatgtaatcctgtcttccttgtttctggggtgtgtgtgtgtgtgtgtgtgtgtgtgtgtgtgtgtgtgtcctagtattcatttgtatctctagatgaagaagaatgcattctgttttcaataaaaattacataactcaacagttttgctttttaactttagatgccaggagtc

SEQ ID NO: 20410 - DNA, 396 bp, Homo sapiens
  chr13.fa.O7frz.116135558
  Located on chromosome 13
  Distance between a terminus base of telomere on chromosomal short arm and 5'-terminus of this base sequence : 111429188
  Distance between 3'-terminus of neighbour sequence of sequence listing upward to telomere on chrosomal short arm and 5'-terminus of this base sequence : 329447
agtcaatccgtttccagtcaagctggactggaccccagcaggcagaaatcagacagtgtccccggaatccacagtcattctcccactacagaagatgatgatcaaaagcctttaaaacccaatacagcaggcattagcttcaaaaagaacaggctagggcaggaggattgcttgaggccaggagttggagcccagcttgggcagcatagcaaggctcctatctctacaaatacacacacacacacacacacacacacacacacacacacacacatacactttaattagccaggcatggtgacgcatgcctgtagtcccagctactcgggaggctgaggagggaagactgcttgagccaaggagttcgaggctgcaataagctatgatcatgccact

SEQ ID NO: 20411 - DNA, 308 bp, Homo sapiens
  chr13.fa.O7frz.116248810
  Located on chromosome 13
  Distance between a terminus base of telomere on chromosomal short arm and 5'-terminus of this base sequence : 111554630
  Distance between 3'-terminus of neighbour sequence of sequence listing upward to telomere on chrosomal short arm and 5'-terminus of this base sequence : 125046
ttacgtatttaaagcaaattgtaaggctgggtccacagacttcaccaggctgccacaggggcctggggtggggaggggggctggggtatgtgtgtgtgtgtgtttgtgtgtgtgtgtgtgaagagcccctgtccaatccaacagtagttcatcagtaatcacactggaattccatttccgtctgtccatctcccgggtgctccttcccaaattgtgaaaaaaggaatattactcctgggtcctctaattcgcaactcgcaggcttacttgacaccctccctcacccgaggtgctgtggttccaattaa

SEQ ID NO: 20412 - DNA, 173 bp, Homo sapiens
  chr13.fa.O7frz.116476122
  Located on chromosome 13
  Distance between a terminus base of telomere on chromosomal short arm and 5'-terminus of this base sequence : 111748462
  Distance between 3'-terminus of neighbour sequence of sequence listing upward to telomere on chrosomal short arm and 5'-terminus of this base sequence : 193524
cagaatttgactaatcaggaaagaaatgcacaaacactcagggtttaaataggatggtatgtgtgtgtgtgtgtgtgtgtgtgtgcacatgcacgcatgtggggaggggtactttcttttcttataatagacattttccaaaatttcaagttcttaatatcaaagacgttttt

SEQ ID NO: 20413 - DNA, 354 bp, Homo sapiens
  chr13.fa.O7frz.116601787
  Located on chromosome 13
  Distance between a terminus base of telomere on chromosomal short arm and 5'-terminus of this base sequence : 111905150
  Distance between 3'-terminus of neighbour sequence of sequence listing upward to telomere on chrosomal short arm and 5'-terminus of this base sequence : 156515
aatatcttaagtttaaggcggtctgtctggcttacagaaataaataagcacttatataaagtgaaaatttctaaaacttcaaaaaaataaggaaattgaacttcattaatgaaagcatgctttaaatgtagtgtgtgtgtgtgtgtgtgtgtgtgtacaaaatccaattcagaagtgttctaagaattcaagtttaaagaataagcaaaactttggtaaatgagactaattcaatccagtctaaaatctagttttaaaagagctctccctgatttatcagtgttaagtagaatacctaactacttgggtttattcttcctaaactaaaacaagtttactgatcaaatcagctaa

SEQ ID NO: 20414 - DNA, 472 bp, Homo sapiens
  chr13.fa.O7frz.116782964
  Located on chromosome 13
  Distance between a terminus base of telomere on chromosomal short arm and 5'-terminus of this base sequence : 112087160
  Distance between 3'-terminus of neighbour sequence of sequence listing upward to telomere on chrosomal short arm and 5'-terminus of this base sequence : 181656
gctgtaaatgttactgcttcacttactgttagcccaagccagtgtgttgcatctgcccagatccttctttgtggtatgtgctcactttctggcgacagccaggctgttctttgcaggcatgtgctcctagcagtcgaagacagaagtttgggggcctgtgtaggctgtatgggctgctgtgtgtgtgtacgtggtgagttgtgtctgagaccacccctcctcccctgggtgctgcctgatctgcctgcatgaccgctgtgggacaccactgtctctggtgtcctttcctggctggcagtgtggtggtgtgggcaaagccaggctggtgggctccgatcttggttctgcctttgtaagctttgtcacactgtcttttgggagctcgtgtgtgtgtgtgtgtgtgtgtgtgtgtgtgtgtgtgtgtgtgttttcgttttctgcctgtaagataaactggcatgcagtctacact

SEQ ID NO: 20415 - DNA, 380 bp, Homo sapiens
  chr13.fa.O7frz.117045282
  Located on chromosome 13
  Distance between a terminus base of telomere on chromosomal short arm and 5'-terminus of this base sequence : 112344776
  Distance between 3'-terminus of neighbour sequence of sequence listing upward to telomere on chrosomal short arm and 5'-terminus of this base sequence : 257144
cacagacaactcaaagtaggacgttgctgaccacatgaacttgtaaggctgtgcctgagtgtgtgtgtgtgtgtgtgtgtgtgtgtgtgtgcaccatgctcatgttttcctcccacatcccagcttggttatgatggtttcacatagtctgagaggtcagttctgttggaggtggcaggaggcgggcctggacacacaatggcttgcctcattcaccttcacaccctccatcttcatgtcttttgcctctagtgccttttcttgcatccctgtagcccaactcacttcagagtgacctcacaaggcctcactcaggttaagctctgcctctcccggtctcttcacttgcctgcatgactctaatacctagtgatgctgtc

SEQ ID NO: 20416 - DNA, 325 bp, Homo sapiens
  chr13.fa.O7frz.117280918
  Located on chromosome 13
  Distance between a terminus base of telomere on chromosomal short arm and 5'-terminus of this base sequence : 112578892
  Distance between 3'-terminus of neighbour sequence of sequence listing upward to telomere on chrosomal short arm and 5'-terminus of this base sequence : 233736
ctgcttcaccatcactaattatgtgactttatttcacagcatcttatattttgtgtgtgtgtgtgtgtgtgtgtgtgtgtgtgtgtgtgtgtttttcaaacaacacttatttgtgccttcaatgggactgacttaggttcctgtcgagctcaggctgtggctcggtgggaagctaagtctgcaccggctcaccgcagaacttgtgcttcctcaaaagccccggcacacatacacaacagaaagaggctgtggccacagcagttttgggagtgcaagggccggttacccctcattttggccgcagtggtttgctaccatcagcttg

SEQ ID NO: 20417 - DNA, 424 bp, Homo sapiens
  chr13.fa.O7frz.119206914
  Located on chromosome 13
  Distance between a terminus base of telomere on chromosomal short arm and 5'-terminus of this base sequence : 112974398
  Distance between 3'-terminus of neighbour sequence of sequence listing upward to telomere on chrosomal short arm and 5'-terminus of this base sequence : 395181
atgagaacatacgatgtttgattttccaatcctgagttacttcactgagaataatagtctctaatttcatccaggttgctgcaaatgccattaattcatttctttttatagttgagtagtatagcactatatatatatatatatatacatacacacatacatatacatatacatatatattacagtattccatcatatgtatatatatttgttccttgtagattctggatattagtcctttgtcagatgtatggattggaagattttctcccactctgtgggttgtctgtttactctgctgattattcattttgctgtgcaaaagccctttagtttaattaggtcccagctatttatctttgtttttattgaatttgcttttgggttcttggtcatgaattccttgcctcagttaatgtctaga

SEQ ID NO: 20418 - DNA, 320 bp, Homo sapiens
  chr13.fa.O7frz.119116644
  Located on chromosome 13
  Distance between a terminus base of telomere on chromosomal short arm and 5'-terminus of this base sequence : 113059684
  Distance between 3'-terminus of neighbour sequence of sequence listing upward to telomere on chrosomal short arm and 5'-terminus of this base sequence : 84862
ggtttctggtcttacgtttaagtctttcatgcattataagttgatttttgttaactatgtaagataaggatgcaatttcttttttttctttgtgtgtgtgtgtgtgtgtgtgtgtatgtgtggtaaaaaaaaaaacccccactggaaagccagtgtttccagcatcattgattgacaagactttcctttcccctttgcatcctcttggtgctcttgtcgaaaattcactaaccatattatatttggatttattttggggcccttcattctgttccattggtctatgtttctgtttttattccagtatgattcctatagct

SEQ ID NO: 20419 - DNA, 96 bp, Homo sapiens
  D13S285
  Located on chromosome 13
  Distance between a terminus base of telomere on chromosomal short arm and 5'-terminus of this base sequence : 113184027
  Distance between 3'-terminus of neighbour sequence of sequence listing upward to telomere on chrosomal short arm and 5'-terminus of this base sequence : 124023
atatatgcacatccatccatgcacacacacacacacacacacacacacacacacacacacacaggtatatagttaccttgctatctatctttggcc

SEQ ID NO: 20420 - DNA, 112 bp, Homo sapiens
  D13S1295
  Located on chromosome 13
  Distance between a terminus base of telomere on chromosomal short arm and 5'-terminus of this base sequence : 113483066
  Distance between 3'-terminus of neighbour sequence of sequence listing upward to telomere on chrosomal short arm and 5'-terminus of this base sequence : 298943
tgcagaaagacactactcgatacatccacagtgagtgtgtgtgtgtgtgtgtgtgtgtgagagagagagagagagagacagagagagagagaaagatttgctgactaagggc

SEQ ID NO: 20421 - DNA, 110 bp, Homo sapiens
  DISO7_10003869
  Located on chromosome 13
  Distance between a terminus base of telomere on chromosomal short arm and 5'-terminus of this base sequence : 113753813
  Distance between 3'-terminus of neighbour sequence of sequence listing upward to telomere on chrosomal short arm and 5'-terminus of this base sequence : 270635
actagtcacagtgcgggaggcttcagagcggagggcagggcccctgccaaccacccggagccacccacccacccacccaccgctgtttgaagcagggactcggttctcaa

SEQ ID NO: 20422 - DNA, 477 bp, Homo sapiens
  chr13.fa.O7frz.118098865
  Located on chromosome 13
  Distance between a terminus base of telomere on chromosomal short arm and 5'-terminus of this base sequence : 113977332
  Distance between 3'-terminus of neighbour sequence of sequence listing upward to telomere on chrosomal short arm and 5'-terminus of this base sequence : 223409
acagtgccttaaactgcactgtgcctcaggaccctcaaggcttgtgcaactcagacccctgggccccacatccagagtctctgattcaagaggtctgatgtgggctccaagagtgtgcagatttccaggggatgctgctgctgctgctgctgctgctggtctggagaccccactttgagaaccactggttgggacctcaagtctgtctctggctgtgctgcccgttctcagccgcccagttgcaggcagatgctgtcactgtgacttggggtaagaggtcacgtgtgctggggctgtgtgccggggcggcccttccacaggcaggtggaaggttggaggccactgagcactgcctggcactgctggcctcctggagatgttcagacaccccacattacaaataggccagcctttcccctgggcgcccccgccactccctgcaatgcttgggccagagacactaatggagtcattcga

SEQ ID NO: 20423 - DNA, 169 bp, Homo sapiens
  DISO7_10003868
  Located on chromosome 13
  Distance between a terminus base of telomere on chromosomal short arm and 5'-terminus of this base sequence : 114019030
  Distance between 3'-terminus of neighbour sequence of sequence listing upward to telomere on chrosomal short arm and 5'-terminus of this base sequence : 41221
gctctcagcgaatgttccgggtttttttttttgtttgcttgtttgtgtgtgtgtatgtgtgtgtgtgtgcgtgtgtgtgtgtgtgtgtttgctttactcctttattaataatgttaaagaaatgagacaaatccccaaagcatgaaaaccaatttctcagcattagtca

SEQ ID NO: 20424 - DNA, 303 bp, Homo sapiens
  AL136221.20_28763
  Located on chromosome 13
  Distance between a terminus base of telomere on chromosomal short arm and 5'-terminus of this base sequence : 114324202
  Distance between 3'-terminus of neighbour sequence of sequence listing upward to telomere on chrosomal short arm and 5'-terminus of this base sequence : 305003
aaagagaaagacagcaagaaagaaagaaaagagagagagaaagaaagagaaagaaagaaaagagaaagaaaagaaagaaaaagaaagaaagaaagaaagaaagaaagaaagaaagaaagaaagaaagaaagaaagaaagaaagaaagaggtttattctgagccaatacaagtgaccatggcccagggaacagtttcaggaggtcctgagaatgcacgtgaggtggctgggttccagtttggttttacacattttagggaggcagaagttgtgggcaaaggcgtaaacggatgcaggttagtat

SEQ ID NO: 20425 - DNA, 245 bp, Homo sapiens
  HUMUT5953
  Located on chromosome 13
  Distance between a terminus base of telomere on chromosomal short arm and 5'-terminus of this base sequence : 114621013
  Distance between 3'-terminus of neighbour sequence of sequence listing upward to telomere on chrosomal short arm and 5'-terminus of this base sequence : 296508
gtaagcaggtcaatccattgaagaattttttaagcaagaagcagcatgacctaatttatttatttctctctctctctccctcctttctttcctcccttccttccttccctccttccttccttctttccttccttccttccctccctccttccttctttccttccttcctctctttctctttctttcctctctccctccctttcttccttccaagtcccactgtgtcactcaggctagagtgcagt

SEQ ID NO: 20426 - DNA, 94 bp, Homo sapiens
  D13S293
  Located on chromosome 13
  Distance between a terminus base of telomere on chromosomal short arm and 5'-terminus of this base sequence : 114673027
  Distance between 3'-terminus of neighbour sequence of sequence listing upward to telomere on chrosomal short arm and 5'-terminus of this base sequence : 51769
gctgtttggatctcccacgtggcccagtgccccagcagcacacacacacacacacacacacacacgcgtattgaacaaaacaagtttcacagga

SEQ ID NO: 20427 - DNA, 323 bp, Homo sapiens
  chr13.fa.O7frz.119549848
  Located on chromosome 13
  Distance between a terminus base of telomere on chromosomal short arm and 5'-terminus of this base sequence : 114973176
  Distance between 3'-terminus of neighbour sequence of sequence listing upward to telomere on chrosomal short arm and 5'-terminus of this base sequence : 300055
gaagcacatttcattgatacacacacacacacacacacacacacacacacacactttaatggctctgagatggagatgcatcttgcagcacatggtgtgctatggttttccaaaacaacagatgcaatctgtcaccaatgaaatgaaatatgcacaggacagtgcctggcacagaggaagtgcccaacaagtctccagagggtgatggtgaacttccaggaggaggccaccaaccatccaccattattccctgcttccacaaatctccctagttcaccaaactctcagccctaaccctggtgggttctttacttcgtgctcct

SEQ ID NO: 20428 - DNA, 244 bp, Homo sapiens
  HUMUT5116
  Located on chromosome 14
  Distance between a terminus base of telomere on chromosomal short arm and 5'-terminus of this base sequence : 17388344
  Distance between 3'-terminus of neighbour sequence of sequence listing upward to telomere on chrosomal short arm and 5'-terminus of this base sequence : 0
tgccactgtactccagcttgggcaacagactgagaccccgtctcgaaagaagaaagaaagaaagaaaagaaagaaaaagaaagaaagaaagagaaagaaaaagagaaagaaagaaagaaagaaagaaagaaagaaagaaagaaagaaagaaagaaaggcaggcgagagagcgaggaaggaaggaagcaaagaaggaaagaaggaagggaggaagaaaaataatggttttggtgccaataatctt

SEQ ID NO: 20429 - DNA, 102 bp, Homo sapiens
  DISD22_0009199
  Located on chromosome 14
  Distance between a terminus base of telomere on chromosomal short arm and 5'-terminus of this base sequence : 17581129
  Distance between 3'-terminus of neighbour sequence of sequence listing upward to telomere on chrosomal short arm and 5'-terminus of this base sequence : 192541
aagatgctggtcagaaagctgtgtcgtgtgtgtgtatgtgtgtgtgtttgtgtgtgtgtgttgggctatgccaaggttgctgattctattctgtgatccaga

SEQ ID NO: 20430 - DNA, 104 bp, Homo sapiens
  DISD22_0009204
  Located on chromosome 14
  Distance between a terminus base of telomere on chromosomal short arm and 5'-terminus of this base sequence : 17670986
  Distance between 3'-terminus of neighbour sequence of sequence listing upward to telomere on chrosomal short arm and 5'-terminus of this base sequence : 89755
agttattgctgtattgtttaagccatatatatatatatatatatatatatatatatatatatatattgtttgtttgtttttcctgtaatgttgtcttactccag

SEQ ID NO: 20431 - DNA, 270 bp, Homo sapiens
  DISD22_0009206
  Located on chromosome 14
  Distance between a terminus base of telomere on chromosomal short arm and 5'-terminus of this base sequence : 17750321
  Distance between 3'-terminus of neighbour sequence of sequence listing upward to telomere on chrosomal short arm and 5'-terminus of this base sequence : 79231
ttcagacttcaccaaacttccaaagggatatacgatgcatttgtatatgcacacacacacatacacacacacacacacacacacacacacacacacacacacagctaggaacccctgcagtggggatcgagagcaccataattgaaactggattgcctgatttgaatctaaattttcaccatttaccaggtttgtggcttggggaatgtgaattagcttctctattctaattttctcatcatcttctaagcagagtttgtaagttagcag

SEQ ID NO: 20432 - DNA, 171 bp, Homo sapiens
  D14S609
  Located on chromosome 14
  Distance between a terminus base of telomere on chromosomal short arm and 5'-terminus of this base sequence : 17976038
  Distance between 3'-terminus of neighbour sequence of sequence listing upward to telomere on chrosomal short arm and 5'-terminus of this base sequence : 225447
tatgtgccctaaaggaagcaatagatagatagatgatagatagatagatagatagatagatagatagatagatagatagatagacagatgacatctgtatgtgctgagtgtgtgtgtatatatgtttcttatatataactctaaagattccacgacaaaactgttagagct

SEQ ID NO: 20433 - DNA, 191 bp, Homo sapiens
  D14S261
  Located on chromosome 14
  Distance between a terminus base of telomere on chromosomal short arm and 5'-terminus of this base sequence : 18266342
  Distance between 3'-terminus of neighbour sequence of sequence listing upward to telomere on chrosomal short arm and 5'-terminus of this base sequence : 290133
attttgaagccccaggaatatgtgtgtgtgtgtgtgtatgtgtgtgtgtgtgtgtgtgtgtgtgtgtgtgtatcttcattatagcactagtcagtctgaatagtgctgctggtttaaatatatgcacattcctctactgtgagcttccttaattaaaggatgaatttcatctgtaactggttcatactgcc

SEQ ID NO: 20434 - DNA, 184 bp, Homo sapiens
  DISO7_12215122
  Located on chromosome 14
  Distance between a terminus base of telomere on chromosomal short arm and 5'-terminus of this base sequence : 18532929
  Distance between 3'-terminus of neighbour sequence of sequence listing upward to telomere on chrosomal short arm and 5'-terminus of this base sequence : 266396
gattcttcacagacctttgctgaatgaatgaatgaataaataaataaataaataaataaataaataaataaatatttgtttccaagatttccaaagggatttccatgaataggaatcccttttcaaatgtccaataaactagacaaaatttactacaaagtttggttcttggtagatacaacaa

SEQ ID NO: 20435 - DNA, 267 bp, Homo sapiens
  D14S72
  Located on chromosome 14
  Distance between a terminus base of telomere on chromosomal short arm and 5'-terminus of this base sequence : 18798199
  Distance between 3'-terminus of neighbour sequence of sequence listing upward to telomere on chrosomal short arm and 5'-terminus of this base sequence : 265086
tcctaacattctgctacccatctccaaaaatgggcttcaataaaatggctatctcagacactttgcaatctatgagtctgcaatgaagaatgaatgtgtgtgtgtgtgtgtgtgtgtgtgtgtgtgtgtgtgtgtgttttaaagaggcatatatgtggtttacttggtttatgtatatgagttacttgattacttataagggagtattctgaataatggattaattgaataaatgaaatataattacaccatgtacaaaactttaca

SEQ ID NO: 20436 - DNA, 122 bp, Homo sapiens
  D14S1043
  Located on chromosome 14
  Distance between a terminus base of telomere on chromosomal short arm and 5'-terminus of this base sequence : 18802717
  Distance between 3'-terminus of neighbour sequence of sequence listing upward to telomere on chrosomal short arm and 5'-terminus of this base sequence : 4251
tactctggagcataggtatgggtgtatgcctgtgtgtgtgtttgtgtgtgtgagtgtgtgtgtgtgtgtgtgtgtgtgtgtgtaggaaaagatgtaaaggaaatttggttgacatctgtgca

SEQ ID NO: 20437 - DNA, 215 bp, Homo sapiens
  HUMUT1392
  Located on chromosome 14
  Distance between a terminus base of telomere on chromosomal short arm and 5'-terminus of this base sequence : 18804863
  Distance between 3'-terminus of neighbour sequence of sequence listing upward to telomere on chrosomal short arm and 5'-terminus of this base sequence : 2024
ccagcctgggtgagactccatctcaaagaaaaaaagaaggaaagaaataagaaagaaagaaagaaagaaagaaagaaagaaagaaagaaagaaagaaagaaagaagggagggatggagggagggagggtagggtaggggaggggaggggtgtggagaggagaggagaagagaagagaagagaaatattctaaaaacatgcagtggtacatgaacg

SEQ ID NO: 20438 - DNA, 99 bp, Homo sapiens
  D14S1023
  Located on chromosome 14
  Distance between a terminus base of telomere on chromosomal short arm and 5'-terminus of this base sequence : 18869263
  Distance between 3'-terminus of neighbour sequence of sequence listing upward to telomere on chrosomal short arm and 5'-terminus of this base sequence : 64185
gactcttgtagttctttgaagccctcataaggagtgtgtgtgtgtgtgtgtgtgtgtgtgtgtgtgtgtgtgtgtagaggaatgtctacggaaaatgca

SEQ ID NO: 20439 - DNA, 266 bp, Homo sapiens
  D14S1070
  Located on chromosome 14
  Distance between a terminus base of telomere on chromosomal short arm and 5'-terminus of this base sequence : 18975497
  Distance between 3'-terminus of neighbour sequence of sequence listing upward to telomere on chrosomal short arm and 5'-terminus of this base sequence : 106135
tggtcaaacatctcagaaccagcatgagagttcatatagcctcatattaggaaattaaagccggacacacacacacacacacacacacacacacacacacacacacaccccttctgtactgtttctccaggcttggtccctgggaccgtttctcaccagttgccaaggcttggtgaaggccgtcagtcatccctatgaccctcatcctgcttttggttcaccccagtttgatgtacttcaccctcggacatagccctggaactttg

SEQ ID NO: 20440 - DNA, 215 bp, Homo sapiens
  DISD22_0009222
  Located on chromosome 14
  Distance between a terminus base of telomere on chromosomal short arm and 5'-terminus of this base sequence : 19193149
  Distance between 3'-terminus of neighbour sequence of sequence listing upward to telomere on chrosomal short arm and 5'-terminus of this base sequence : 217386
cacaattctatgtttcggtatctcaataaattattctttctttctttctttctttctttctttctttctttctttcttttttttgagatagggtctcactctggcacacaggctggagtgcagtggtgcagtctcagctcactttagcctcaacttcctggaatcaagtatcaataaatcttatctacagggagggtaaactagtgcaaggctga

SEQ ID NO: 20441 - DNA, 165 bp, Homo sapiens
  D14S1003
  Located on chromosome 14
  Distance between a terminus base of telomere on chromosomal short arm and 5'-terminus of this base sequence : 19543561
  Distance between 3'-terminus of neighbour sequence of sequence listing upward to telomere on chrosomal short arm and 5'-terminus of this base sequence : 350197
agctactgagaggtagaaaatggttattatcatgattataatgattattagaaacacacacacacacacacacacacacacacacacaaactcaccaaggagttacaaaatctatggagaccagaggccaactatcatcacctcatgtctgctctcaccaacagc

SEQ ID NO: 20442 - DNA, 402 bp, Homo sapiens
  G10057
  Located on chromosome 14
  Distance between a terminus base of telomere on chromosomal short arm and 5'-terminus of this base sequence : 19628191
  Distance between 3'-terminus of neighbour sequence of sequence listing upward to telomere on chrosomal short arm and 5'-terminus of this base sequence : 84465
ggcgtggttttctttcataaccttaggaactttctaaaatttgctttaacaatggtctaaattttttattacaatatacataaaaaacaacattaatgtatgtgatatgctcctatgtgttcacccaaatacttttgaacaccaaaaaatgttttgcaaaggagtatatatatatcagttaaggttctccagagaagcagaactaataggatgtctatctatctatctatcatctatctatctatctatctatctatctatctatctatctatctatctatacataaatatttattggaatatgtatatttattggaatatacgtgtaattattggttatatataaatcttggtccaagtctaaaggctcaagaatcagaagcactgatgttagagggcagg

SEQ ID NO: 20443 - DNA, 372 bp, Homo sapiens
  DISO7_00039426
  Located on chromosome 14
  Distance between a terminus base of telomere on chromosomal short arm and 5'-terminus of this base sequence : 19836712
  Distance between 3'-terminus of neighbour sequence of sequence listing upward to telomere on chrosomal short arm and 5'-terminus of this base sequence : 208119
attatgctcaaggctaaacagatctctctctctctctctctctctttttttttttccctaggaagaacccgtggaaattcagtgacccagatggaagggccagtgactctctcagaagaggccttcctgactataaactgcacgtacacagccacaggatacccttcccttttctggtatgtccaatatcctggagaaggtctacagctcctcctgaaagccacgaaggctgatgacaagggaagcaacaaaggttttgaagccacataccgtaaagaaaccacttctttccacttggagaaaggctcagttcaagtgtcagactcagcggtgtacttctgtgctctgagtgacacagtgacagggactgca

SEQ ID NO: 20444 - DNA, 201 bp, Homo sapiens
  Z24322.1_188
  Located on chromosome 14
  Distance between a terminus base of telomere on chromosomal short arm and 5'-terminus of this base sequence : 20114724
  Distance between 3'-terminus of neighbour sequence of sequence listing upward to telomere on chrosomal short arm and 5'-terminus of this base sequence : 277640
tcttaggttagtgtagtttgcaaacaaaaggcatatatgttttcctagtaaccgcaatgtgtgtgtgtgtgtgtgtgtgtgtgtgtgtgttttaatttccctacaaatcactgctaacagccaaggaaagcgaggctatattctggaaggcctgggagatatagtcccctgtatgtgtatgaaatctgtttggaatctcat

SEQ ID NO: 20445 - DNA, 131 bp, Homo sapiens
  D14S283
  Located on chromosome 14
  Distance between a terminus base of telomere on chromosomal short arm and 5'-terminus of this base sequence : 20114761
  Distance between 3'-terminus of neighbour sequence of sequence listing upward to telomere on chrosomal short arm and 5'-terminus of this base sequence : -164
tgttttcctagtaaccgcaatgtgtgtgtgtgtgtgtgtgtgtgtgtgtgtgttttaatttccctacaaatcactgctaacagccaaggaaagcgaggctatattctggaaggcctgggagatatagtccc

SEQ ID NO: 20446 - DNA, 304 bp, Homo sapiens
  DISO7_00039435
  Located on chromosome 14
  Distance between a terminus base of telomere on chromosomal short arm and 5'-terminus of this base sequence : 20385526
  Distance between 3'-terminus of neighbour sequence of sequence listing upward to telomere on chrosomal short arm and 5'-terminus of this base sequence : 270634
cagtaatacccttgctcctgtgcctgcacagggaaaggagatgcctgcctgcctgcctgcctgcctgcctaccggtctgccttttggtccgccgcttggtggggccccaggtgtaacctctggctgtctcttctgcctggtttttgttgagcttcctatcacagtggaacaccggtaaccagttctattttgggacagggacaagtttgacggtcattccaagtaagtcaaagaaaattttccatcaccattgtgttgagcaaaccctttaaactgcagaaagagctgtcaaagtctgctactc

SEQ ID NO: 20447 - DNA, 454 bp, Homo sapiens
  AC023226.3_18655
  Located on chromosome 14
  Distance between a terminus base of telomere on chromosomal short arm and 5'-terminus of this base sequence : 20540024
  Distance between 3'-terminus of neighbour sequence of sequence listing upward to telomere on chrosomal short arm and 5'-terminus of this base sequence : 154194
ttcatctatgttatagcatggatcattgccaaggatcttaaagaaccaatgtagcaggaggaaaggccacagccccaagaagaagccctgacccctggcatggcagaaacacacacacacacacacacacacacacacacacacacacacacacacagagagagagagagagagagagagagagagagagagagagagagacagcagttactaaatgtagatatatgcacagtctgtaaaatctagaagaatagtatggaggatgaatttggacttggtcaccaaatctggaaatggtaggatgagggatcaagacttaattcatttaactctcaaaatacatctttgcataaggtgcaactgcacccactggaaaatcatttcctcacatcagaaatattaagaagcttaatgaaggcaaagatacacacctgagattataacaggaacagct

SEQ ID NO: 20448 - DNA, 389 bp, Homo sapiens
  HUMUT1079
  Located on chromosome 14
  Distance between a terminus base of telomere on chromosomal short arm and 5'-terminus of this base sequence : 20638190
  Distance between 3'-terminus of neighbour sequence of sequence listing upward to telomere on chrosomal short arm and 5'-terminus of this base sequence : 97712
caccactgcattccagcctgggctacagagtgagactctgtcaaaaaaagaaagaaagaaaggagaaagagataaagagagagaaagaaagaaagagacaaagaaagaaagagagagagagagaaaggaaggaaggaaggaaggaaggaaggaaggaaggaaggaaggaaggaaggaaggaaggaaggaagggaaagaaacaaagaaaggaaagaaagaaagaaagaaagaaagaaagaaagaaagaaagagagagagagagagaaagaaagaaggagaaaggaaggaaggaaggaagaaagaaagaaagaaaaaaagaaaagaaaaagaaaaaaagagaataaaggtcctaaaaagtctagcctgaccacaggtcatctggaaaggcc

SEQ ID NO: 20449 - DNA, 276 bp, Homo sapiens
  Z67550
  Located on chromosome 14
  Distance between a terminus base of telomere on chromosomal short arm and 5'-terminus of this base sequence : 20893197
  Distance between 3'-terminus of neighbour sequence of sequence listing upward to telomere on chrosomal short arm and 5'-terminus of this base sequence : 254618
cagagtcagtccatgccctcaccttgatcctgccccggccacattcgactgtcatagcccctgacatctacctgactgcctgtgccctcactcaaggacatacagagccgggaaaggaagaagggagcaagggagagagggaggaagaaaggaggggggatttctgcagtcaagaaaacaaaatactgaaagtggggacacacacgcacacgcacacacacacacacacacacacacacagaaagatgcgggggaggaggctgagatttatagacc

SEQ ID NO: 20450 - DNA, 147 bp, Homo sapiens
  D14S990
  Located on chromosome 14
  Distance between a terminus base of telomere on chromosomal short arm and 5'-terminus of this base sequence : 21013603
  Distance between 3'-terminus of neighbour sequence of sequence listing upward to telomere on chrosomal short arm and 5'-terminus of this base sequence : 120130
gtccacttggtcatggaaacaagaggtgcagacctagccacatgcatcctctgtccccagggtcctccatgacacacacacacacacacacacacacacacacacacacacagccaacagtcccaacacccagtcacagtgcaactt

SEQ ID NO: 20451 - DNA, 240 bp, Homo sapiens
  DISO7_00039469
  Located on chromosome 14
  Distance between a terminus base of telomere on chromosomal short arm and 5'-terminus of this base sequence : 21171954
  Distance between 3'-terminus of neighbour sequence of sequence listing upward to telomere on chrosomal short arm and 5'-terminus of this base sequence : 158204
catctttcagtaacagacctcccctcccccagctccccactcagtcttgtatgatcacatcatcatcatcatcatcatcatcttcctcctcctcctcctcctcttcctcatcatcttctggcagttcttcctcctcctcttcctcttcttcatctagacaaactaccacctcagctggctgaggtaatcgagagtcaaaccaatccagcacctgctgggtgctaagccttgatgcctgac

SEQ ID NO: 20452 - DNA, 364 bp, Homo sapiens
  DISO7_00039482
  Located on chromosome 14
  Distance between a terminus base of telomere on chromosomal short arm and 5'-terminus of this base sequence : 21319742
  Distance between 3'-terminus of neighbour sequence of sequence listing upward to telomere on chrosomal short arm and 5'-terminus of this base sequence : 147548
acataattcagaattgatcaccacctctgacttttcattccccagctcctttctagaaagatatcagaaaagttaacatcctctaaccctacccccctctaaacataaacacaaacacacacacacacacacacacacacacacacacacacacacacacacacagagctctgggcacagatagacatggcatatctaggccccacaactctcaatctactcacatcatccacttgctgctccagcttgactttggccttagtcagggtgttgaccttgtcctcctcggcctgaaggtcatccagagcctgttggtgggcctcttgcagagctttcttctccttggtcagcttggcaatgatct

SEQ ID NO: 20453 - DNA, 433 bp, Homo sapiens
  AC012505.4_38540
  Located on chromosome 14
  Distance between a terminus base of telomere on chromosomal short arm and 5'-terminus of this base sequence : 21470146
  Distance between 3'-terminus of neighbour sequence of sequence listing upward to telomere on chrosomal short arm and 5'-terminus of this base sequence : 150040
tgatcctctagttactgagatcagtttttcctgcacatgtctccaccctatctagcctaaaatgttccctggtgctctgccttcccccttccctggcttaagtccctgggctctaacatccagactcccagacacatctatagatgcacattctctgactcaaacgtctactctgcatttggcatgtttatattctttctctctctctgtaacacacacacacacacacacacacacacacacgcactctcactgtgtcacccattatacaaactcatttaagcatatttggacatatcctgatctctgatctctcaaaaagtctcaaatttaaatgaaatcctccacccctttaaaagaaaattcaatatgtaaaaattcaaatatgtgagttgtataaataaggggtctatgaatctcattacaagtggat

SEQ ID NO: 20454 - DNA, 165 bp, Homo sapiens
  DISO7_10003871
  Located on chromosome 14
  Distance between a terminus base of telomere on chromosomal short arm and 5'-terminus of this base sequence : 21819370
  Distance between 3'-terminus of neighbour sequence of sequence listing upward to telomere on chrosomal short arm and 5'-terminus of this base sequence : 348791
gcgttcctgaatataaagaagagaattataatattctctatttcagagtagaagaaagaaagtataaggcatataaaaatgtgtgtgtgtgtgtgtgtgtgtgtatgaacacacactctttatttatattttggctctgttttgtttctatgcgacttgtgattc

SEQ ID NO: 20455 - DNA, 134 bp, Homo sapiens
  D14S64
  Located on chromosome 14
  Distance between a terminus base of telomere on chromosomal short arm and 5'-terminus of this base sequence : 21987479
  Distance between 3'-terminus of neighbour sequence of sequence listing upward to telomere on chrosomal short arm and 5'-terminus of this base sequence : 167944
tgggatagaagcaacacagatgaaatagatgttcattctaagggacgaacagaaaaggcctgtgtgtgtgtgtgtgtgtgtgtgtgtgtgtgtgtgtgtgtgtgtgttagagacagagtctcactgtgttgccc

SEQ ID NO: 20456 - DNA, 284 bp, Homo sapiens
  chr14.fa.O7frz.20397289
  Located on chromosome 14
  Distance between a terminus base of telomere on chromosomal short arm and 5'-terminus of this base sequence : 22290533
  Distance between 3'-terminus of neighbour sequence of sequence listing upward to telomere on chrosomal short arm and 5'-terminus of this base sequence : 302920
atgtattacaaagtgctttgctacagctccctcgattgctggggagtgctgcagaggaggaggaggaggaggaggaggatggaaaggatggtcccacggagaccctggaggagctggtcctgggactagccgctgaggtgtgtgatgattttcttgtctactgtggagacacacatggcagcttcgtggtcagaactctgcttcaggtgttaggagggactattctggagtctgagagagccaggccccgtggttcccaatcatctggtaagtattacaagagg

SEQ ID NO: 20457 - DNA, 334 bp, Homo sapiens
  chr14.fa.O7frz.20501711
  Located on chromosome 14
  Distance between a terminus base of telomere on chromosomal short arm and 5'-terminus of this base sequence : 22394857
  Distance between 3'-terminus of neighbour sequence of sequence listing upward to telomere on chrosomal short arm and 5'-terminus of this base sequence : 104040
atcaacctcgactcctaagaccttgttttgtactccctggagaacagccctccagtgagcgggaagctacttgccaagcctgtgtgtgtgtgtgtgtgtgtgtgtgtgtgtgtgagagaatgtgtgtgtgtgaatgtgtgtgaatgtgtgtgaatgtgtgtgtgtgtgtgtatgtgtgttgggagtggttgggctcccagatctaactgctcctcaaagaacctggtttttcatgttccccttcacttccaattccagagtttcttgttgttgttttctgagccttttgagtatcctgcagtgtaaattggggtggttctggaaagtagacaat

SEQ ID NO: 20458 - DNA, 325 bp, Homo sapiens
  chr14.fa.O7frz.20601851
  Located on chromosome 14
  Distance between a terminus base of telomere on chromosomal short arm and 5'-terminus of this base sequence : 22495030
  Distance between 3'-terminus of neighbour sequence of sequence listing upward to telomere on chrosomal short arm and 5'-terminus of this base sequence : 99839
tcttaagctggaaatatggatcctgcctttccagggaaaatctcttctttttcctcatttttttttcttcattaattcctctctatttctctctctctctctctctctccctccccccccatacacacacacacacacacacacacacacacacacacacacacaaaccccttccaaatccttgggtgcttgggctgggaatcaggtcactatgtgcagggagaagagagcagcagagaggggacacacactcacgactagaagctgtgtcttcactgaggtttattgagagttctgtgacctgtaggatacttctggaggctta

SEQ ID NO: 20459 - DNA, 386 bp, Homo sapiens
  AC021728.5_19942
  Located on chromosome 14
  Distance between a terminus base of telomere on chromosomal short arm and 5'-terminus of this base sequence : 22744227
  Distance between 3'-terminus of neighbour sequence of sequence listing upward to telomere on chrosomal short arm and 5'-terminus of this base sequence : 248872
tgtattaggaaggctatgaataagctgtaaatacttgctgggaagccatagccgtggacttccctgagtgtggtgactcgtgtaataggcttatttcttgctgaaccttagaagctgtgcacatggcattgtgggaggagatactagtccttttttgggacatggagtttctagggcatggggtctctcacacctgtcatgtgatcaagtacaagaggcattctctattattattattattattattattattattatactttaagttctagggtatatgtgcacaacgtgcaggtttgttacatacgttgctttgctggttgtttgttggtttgctgcacccattaactcgtcatttacattagttatttctcctaatgctatcc

SEQ ID NO: 20460 - DNA, 452 bp, Homo sapiens
  AC021728.5_64945
  Located on chromosome 14
  Distance between a terminus base of telomere on chromosomal short arm and 5'-terminus of this base sequence : 22777318
  Distance between 3'-terminus of neighbour sequence of sequence listing upward to telomere on chrosomal short arm and 5'-terminus of this base sequence : 32705
tgttattttaagctcaaactcaagatatattaaaaaatgtaccatcatattctttcctaagctggttctccttccattatttgctctcgttttttttaacctccatccatccatccatccatccatccatccatccatccatccaaactagaattgtggtaggcaactttggttcttccctctcactgtccatctagtggtcatttccctgctttccaagtatataatcagtacatacatggtacttggtacttggtagaaccccaacattggttccttgaaactaattccccctccagaccacgtagaaaataaaaaatattctttttcacgggagagattagtaccactcttgaagaactgcaggatgcagggttaatggaccccatttaattcaccagtgtgactctgacacacacataaaaaaagacagctattagatgcatgagtac

SEQ ID NO: 20461 - DNA, 216 bp, Homo sapiens
  D14S264
  Located on chromosome 14
  Distance between a terminus base of telomere on chromosomal short arm and 5'-terminus of this base sequence : 22801403
  Distance between 3'-terminus of neighbour sequence of sequence listing upward to telomere on chrosomal short arm and 5'-terminus of this base sequence : 23633
gagttggcaaccacttctgttcttgaatttggcggactgtcagggggttttagatttatcctttcaattatttataccaactctctatctctgaaaccagaatccaatttggaaagataaatacatctctgtgtgtgtgtgtgtgtgtgtgtgtgtgtgtgtgtgcattctgaactgagatctgcaaacaaaatctatttggagtgatatttgggg

SEQ ID NO: 20462 - DNA, 435 bp, Homo sapiens
  AC021728.5_6387
  Located on chromosome 14
  Distance between a terminus base of telomere on chromosomal short arm and 5'-terminus of this base sequence : 22875102
  Distance between 3'-terminus of neighbour sequence of sequence listing upward to telomere on chrosomal short arm and 5'-terminus of this base sequence : 73483
acaataaaggaatcctattttgactcattttccagcggacagtaattctaatatagcttactttccaaaagcaataaacaaacaaacaaacaaacaaaaaacccaaagcactgcctacgtgaaccaaccgtcagtgcaagatgggcggcatgcgctgacatggtgcttcagagactgtgcctctgtgtcttctcccaaagcatacacatagaatgactttgcaccaaagtagttctcctggcaaatcgatcttcaatgctaactttccaaaaatatgcacatattcagtaaagcatatggatctataatgtttatgaataccctattaataatttattatttatgaatcctgtttttatatattttgccccatgacaggtacactcagtatgaaatgctgaattataaagctcctcactatgtcttgacatggtt

SEQ ID NO: 20463 - DNA, 111 bp, Homo sapiens
  D14S1041
  Located on chromosome 14
  Distance between a terminus base of telomere on chromosomal short arm and 5'-terminus of this base sequence : 23004099
  Distance between 3'-terminus of neighbour sequence of sequence listing upward to telomere on chrosomal short arm and 5'-terminus of this base sequence : 128562
gcaaaatcaccattggctatcaacatctctctttcacacacacacacacacacacacacacacacacacacccctaaaggtaagtgtcttctcatgggaatacataacact

SEQ ID NO: 20464 - DNA, 401 bp, Homo sapiens
  chr14.fa.O7frz.21191317
  Located on chromosome 14
  Distance between a terminus base of telomere on chromosomal short arm and 5'-terminus of this base sequence : 23086465
  Distance between 3'-terminus of neighbour sequence of sequence listing upward to telomere on chrosomal short arm and 5'-terminus of this base sequence : 82255
ctgagtgtcgctagtttcatagcaaatgactctgactctctgacgccttcactgtggctttgggtgaagactccttgctttggctcagttccagagaaccataattctcagggggttgtgggagtgagggcaagtgtggataggagagagaggaagaggagagtgtgtgtgggagagagagagactgtgtgtatgtgaaaagagagaaagagaggcagtatgcatgtgtgtgtgtgtgtgtgtgtgtgtgtatgcgtgtgtgaaacagagatagactgcaccgttccctccagcttgccagtcctctctcttctggtgcagaaccccactgctgtgtgattttagtgactgactgctctgctggaagactgaatgcctttatggagcttcctgtaatattg

SEQ ID NO: 20465 - DNA, 453 bp, Homo sapiens
  AC021715.4_84923
  Located on chromosome 14
  Distance between a terminus base of telomere on chromosomal short arm and 5'-terminus of this base sequence : 23233577
  Distance between 3'-terminus of neighbour sequence of sequence listing upward to telomere on chrosomal short arm and 5'-terminus of this base sequence : 146711
attctgagtcagtactgtttactgaaaagtacttcctttccccctgccctatggtggaaactgccaccactttcgttgtatattagccaactgtatatttgtgagtctgtttctgcactctattttgtgtcatttttctatttgtctatccttgcatccattccattttaactgttatttgttgacccttgcaatctgaaaatcctctaactttatttttcttttaagtttgttttgggtattcttaagagtttttatgtccatacaagttttagttcaacatcagcttgttaatatcaacaattgaaaacaatagcaacaacaataacaacaacaacaaccaaagccaaaaaccaaccaaccagacaaataaacctcttgggattttatttgaaattgcatttaatctatggagcaatttgaggagatctgaagctttacagtattgagttt

SEQ ID NO: 20466 - DNA, 443 bp, Homo sapiens
  AC021715.4_161023
  Located on chromosome 14
  Distance between a terminus base of telomere on chromosomal short arm and 5'-terminus of this base sequence : 23270250
  Distance between 3'-terminus of neighbour sequence of sequence listing upward to telomere on chrosomal short arm and 5'-terminus of this base sequence : 36220
agttaagtgagcaagtgatacaagagcttgcaaaaggaattttcttgttaggggaaaatatagatattgactgacttaacatatctgtttttaccttcatgaatctctcctccactttttctatcattaacatcattattattattattattattattattattattattattattattattattattatttgagacggagtctcactctgtcacccaggctggagtgtagtggcgcgatcttggctcactgtgtcattaacttatttactttttcctttcacctgcatccttctttatttcttcttttctttatctttaccttctaactaccattcccattcaaaatttctacaatcagaggtgtttattataaaatacagaatggaatatcaaaggtatagttggtgtctttggaaagagtacagaaaggtgaatgtttga

SEQ ID NO: 20467 - DNA, 443 bp, Homo sapiens; identical to SEQ ID NO: 20466
  AC019192.5_163594
  Located on chromosome 14
  Distance between a terminus base of telomere on chromosomal short arm and 5'-terminus of this base sequence : 23270250
  Distance between 3'-terminus of neighbour sequence of sequence listing upward to telomere on chrosomal short arm and 5'-terminus of this base sequence : -443

SEQ ID NO: 20468 - DNA, 448 bp, Homo sapiens
  HUMUT1919
  Located on chromosome 14
  Distance between a terminus base of telomere on chromosomal short arm and 5'-terminus of this base sequence : 23280963
  Distance between 3'-terminus of neighbour sequence of sequence listing upward to telomere on chrosomal short arm and 5'-terminus of this base sequence : 10270
caagcaaaggtagtaagcagcagggagtaatggggtcaggcaggaaaggcaaataaggagcatggatacaagctccgtagtccaactgaaggaatcttcttccctcccctcccctcccctcccctcccctcccctcccctcccctccctccctccctccctccctccctccctccctccctccctcccttccttccttccttccttccttccttccttccttccttccttccttccttccttccttccttcatctctttctctctttctctttctttctaaaggaaatgtaagatattgaaggattttaaacagagttcacatttttagatattcattttgaaaatattgtggggagagagtggggggagcagcagagatacaactgggccatttcagggccattgtgtcatgccaaacaagaagttatggtagtttagacaaggctg

SEQ ID NO: 20469 - DNA, 102 bp, Homo sapiens
  DISO7_10003875
  Located on chromosome 14
  Distance between a terminus base of telomere on chromosomal short arm and 5'-terminus of this base sequence : 23461503
  Distance between 3'-terminus of neighbour sequence of sequence listing upward to telomere on chrosomal short arm and 5'-terminus of this base sequence : 180092
ggaggatcagtgctaataaggactgcatgcatgcctctgtgtgtgtgtgtgtgtgtgtgtgtgtgtgtgtatactctcttgttacttatcaaagttaggctg

SEQ ID NO: 20470 - DNA, 131 bp, Homo sapiens
  DISO7_10003876
  Located on chromosome 14
  Distance between a terminus base of telomere on chromosomal short arm and 5'-terminus of this base sequence : 23470243
  Distance between 3'-terminus of neighbour sequence of sequence listing upward to telomere on chrosomal short arm and 5'-terminus of this base sequence : 8638
ttgattacatttaattcagcttctctcagtcttggttaaaacacacacacacacacacacacacacacacacacacacatacacacacacccctacttaaaaatatggtgcctgcgagcattgtttctaag

SEQ ID NO: 20471 - DNA, 203 bp, Homo sapiens
  chr14.fa.O7frz.21711403
  Located on chromosome 14
  Distance between a terminus base of telomere on chromosomal short arm and 5'-terminus of this base sequence : 23606701
  Distance between 3'-terminus of neighbour sequence of sequence listing upward to telomere on chrosomal short arm and 5'-terminus of this base sequence : 136327
tagcgatttcagtgtgattaagaaccattgctgggagtagaatagttgtttggaggtaagaagactctggctttttgagttgccaaattctcgcactgttttattatgtatgtatgtatgtatgtatgtatgtatgtatgtatgtatgtatttatttattttttcatatgtgtgggctgatgttcctttaatctttgaaggtg

SEQ ID NO: 20472 - DNA, 270 bp, Homo sapiens
  D14S1032
  Located on chromosome 14
  Distance between a terminus base of telomere on chromosomal short arm and 5'-terminus of this base sequence : 23732690
  Distance between 3'-terminus of neighbour sequence of sequence listing upward to telomere on chrosomal short arm and 5'-terminus of this base sequence : 125786
tgggtactaggcttaatacctgggtgaagaaataatctgtacaacaaactccctctgaacttaaaataaaaatgtggtgtacacacacacacacacacacacacacacacacacacacacaatgaaatactctttggccataaaaaagaatgaaatcctgttatttgtggcaacatgggtggaaatggaggtcgttacgttacagaaataagccaaccccacagaaaggcaaatattgcctgttctcactcgtatgcaacctctctagca

SEQ ID NO: 20473 - DNA, 472 bp, Homo sapiens
  chr14.fa.O7frz.22045022
  Located on chromosome 14
  Distance between a terminus base of telomere on chromosomal short arm and 5'-terminus of this base sequence : 23940712
  Distance between 3'-terminus of neighbour sequence of sequence listing upward to telomere on chrosomal short arm and 5'-terminus of this base sequence : 207752
aatagctaccattttgaaccacttgcaaggtacaaggatcaagcaatactacatacacacacacacacacacacacacacacacacaccagctttacccacacaaccctaggcagtgggttatttacatacaacaaatctgacagacaaaatggcttgccccaggtcacacaactaattataaaactgggatttgaaaacaagtctgtctgtccctacaattcactcccctaacgatacaccaaactgcctctttaaacctcctaagaatgggaagtatccagttgattctgtggcttcctcatgaggtttgtttctgacggctgaaagtgagtgtttctcagatataatttagaatgatcactctttggaagactggactctacacagatatggcaccgaaggaggcatggctgagaaggggcactacccagccaccatctcacgtaatctccatcagtaccttcctagac

SEQ ID NO: 20474 - DNA, 361 bp, Homo sapiens
  AC021729.3_73581
  Located on chromosome 14
  Distance between a terminus base of telomere on chromosomal short arm and 5'-terminus of this base sequence : 24002645
  Distance between 3'-terminus of neighbour sequence of sequence listing upward to telomere on chrosomal short arm and 5'-terminus of this base sequence : 61461
caatgttaagttgtcatcagtttaaaatagtacgttatgttatttgcaagcctcatggtaatctcaaataaaaaaccatgcaatatacaaaatatcaaaagcaagacattagaacatattaccagagaaaaataagaagatggatggatagatggatggaaggaaggaaggaaggaaggaaccacaagacaaccagaaaacaaatggcaaaagggcagtagtatgtctttacttattaataataacattgaatataaatggactaaactcttcaatcaaatgtcatagagtggctgaatgaacaacaacaataacaactcctcctccccaaatatctgttgcctataagaaatgtatttca

SEQ ID NO: 20475 - DNA, 195 bp, Homo sapiens
  D14S275
  Located on chromosome 14
  Distance between a terminus base of telomere on chromosomal short arm and 5'-terminus of this base sequence : 24218255
  Distance between 3'-terminus of neighbour sequence of sequence listing upward to telomere on chrosomal short arm and 5'-terminus of this base sequence : 215249
taggaaagcattccctattctggacaccaaaagtttctgagcatgcacacacacacacacacacacacacacatacacacatacacacatgtgcatgcagaacagaagatctactaggaatctacagcctattaggagagagggtcagggtcagcagacaaaacaaataagagattgagtacccaagaacctgat

SEQ ID NO: 20476 - DNA, 364 bp, Homo sapiens
  chr14.fa.O7frz.22462606
  Located on chromosome 14
  Distance between a terminus base of telomere on chromosomal short arm and 5'-terminus of this base sequence : 24358202
  Distance between 3'-terminus of neighbour sequence of sequence listing upward to telomere on chrosomal short arm and 5'-terminus of this base sequence : 139752
atgaatcatgctggaactaagggctaatcatgggaaaaaaagataaagttacaacctcatctcgtgtcatacaagaaaattaattctagatggattgatggcctatataaggaagtaaaaactgagaattactttttaagcaaaaccaacacacacacacacacacacacacacacacacacacacacacaaacccaaaacaaggttttggtaagattgactattttcaaatgtaaaatttctgtataacaaaggacaccataaacaaattaaatgtacaaggagcagaagaggacacatttccattatgtattctttatgaaaaattgatatccaaaatatttaactcctacaaatcacaaga

SEQ ID NO: 20477 - DNA, 422 bp, Homo sapiens
  chr14.fa.O7frz.22548102
  Located on chromosome 14
  Distance between a terminus base of telomere on chromosomal short arm and 5'-terminus of this base sequence : 24509581
  Distance between 3'-terminus of neighbour sequence of sequence listing upward to telomere on chrosomal short arm and 5'-terminus of this base sequence : 151015
cataaatttggtcactattgtttcggtgttggacagttcctgtttcaaatctaaacccattttagcagtgatgaactgcttcaattatgtatgtatgtatgtatgtatgtatgtatgtatgtatgtatgtatttatttatttttagagaggggggtctccctttgccacccaggctggagtacagtgacacaatcatagctcactgcagcctcgaactcctgggctgaagcgatccacctggttcagcctcctgagtagctgggattataggtgtgagccactgtacccagcttaatactactacttttaaattaaaagaatctttacttaaaccttccttattctagactcacaagttatttatccaaaaaaagataagattaacaatataattatactaattatgctagcatcaactgtt

SEQ ID NO: 20478 - DNA, 190 bp, Homo sapiens
  chr14.fa.O7frz.22680940
  Located on chromosome 14
  Distance between a terminus base of telomere on chromosomal short arm and 5'-terminus of this base sequence : 24642447
  Distance between 3'-terminus of neighbour sequence of sequence listing upward to telomere on chrosomal short arm and 5'-terminus of this base sequence : 132444
cactgtattggtattccatgagcacttcacagaagaaatctcaaatggttcattcagtcattcattcatacattcatttaaatttccagtgccacctatgattaaacaattgcgctgtatgttaaacacacagcaggcaagaaggatgccataaattcccccacatcagtggaccttaatccaattactc

SEQ ID NO: 20479 - DNA, 402 bp, Homo sapiens
  chr14.fa.O7frz.22800492
  Located on chromosome 14
  Distance between a terminus base of telomere on chromosomal short arm and 5'-terminus of this base sequence : 24761917
  Distance between 3'-terminus of neighbour sequence of sequence listing upward to telomere on chrosomal short arm and 5'-terminus of this base sequence : 119280
attaatcactaggtgacagtcacttttctaagggctttctgtgtattaactcagtaaatgtttaattcatgttagcctttttatccttacacttgttattgggaagtaacaaatttatcgtaggggctcccaagcttccatctatctatctatctatctatctatctatctatctatctatctatctatctacacatatgcttgcataaaatgtatatgtgtagatctatatctgcatgtatctttgtagaaaattaaaaacgaggatgacataaaataaaataatgcaatgggttttggttctctattgtgttcattttcatatttgaatatctttttataatatttaacatttatataatgaaatagacctgaaacaagaatctttccatgttcctgtat

SEQ ID NO: 20480 - DNA, 105 bp, Homo sapiens
  DISO7_10003878
  Located on chromosome 14
  Distance between a terminus base of telomere on chromosomal short arm and 5'-terminus of this base sequence : 24872899
  Distance between 3'-terminus of neighbour sequence of sequence listing upward to telomere on chrosomal short arm and 5'-terminus of this base sequence : 110580
tcatagcacttatcactaccttaggtctatctatctatctatctatctatctatctatctatctatctatcagttgaggagctcctcctcctccttggcttcatc

SEQ ID NO: 20481 - DNA, 364 bp, Homo sapiens
  chr14.fa.O7frz.23129964
  Located on chromosome 14
  Distance between a terminus base of telomere on chromosomal short arm and 5'-terminus of this base sequence : 25091233
  Distance between 3'-terminus of neighbour sequence of sequence listing upward to telomere on chrosomal short arm and 5'-terminus of this base sequence : 218229
aacaattctctagcttccagagtgaatgacacctgggactgaaaactcagaaattcagagtttgcatgtaagggaaacgctgaaatgatatcaaattatatttttaaaaatctgtgtattgagtgttgttacacatatatttgaaaatttaagtaaaaaacaaatttatgtatggtaagaaaagcaaacctacatatatgagtatgtatatatataaagtgttttaatgttttcatatcaactcacctctgagttaattaatagtatattctcaacaattcagtctacttatgacatatatatatatatatatatatatatactcagattctacaatcaaatataccatatgccacaatgttac

SEQ ID NO: 20482 - DNA, 324 bp, Homo sapiens
  chr14.fa.O7frz.23452819
  Located on chromosome 14
  Distance between a terminus base of telomere on chromosomal short arm and 5'-terminus of this base sequence : 25411657
  Distance between 3'-terminus of neighbour sequence of sequence listing upward to telomere on chrosomal short arm and 5'-terminus of this base sequence : 320060
atctttctaggtttgtatccaaaggaaataaaatcagtacctccaagagatatctgagccaccatatttattgcagcatttttcatgaaagccaaggtatgaaaacaacctaagtgtccactgatggatgaatggatacagaaaatgtggtgtgtttgtatgtgtatgtgtgtgcatgtgtgtgtttgtgtgtgtgtgtgtgtaagaatattgtccagccacaaaaagatgagaatcctgccatttgccacaacatggattaacctggaggatactgtgttaaacaaaataagccagtcacagaaaggcaaatactgcatgatc

SEQ ID NO: 20483 - DNA, 436 bp, Homo sapiens
  AC020737.4_70077
  Located on chromosome 14
  Distance between a terminus base of telomere on chromosomal short arm and 5'-terminus of this base sequence : 25455460
  Distance between 3'-terminus of neighbour sequence of sequence listing upward to telomere on chrosomal short arm and 5'-terminus of this base sequence : 43479
ccagtaggtcatatgtcttgttagaggccctaccagtaataagcagcagcagagttacagatgctggtcagcctcaaactaaacttttttgcttagataaattttgtctgctattttgtttgtttgtttgtttgtttgtttgttttatggacactcggtagcactttttatcatttaaagtcttccaaatttaaagctccatgaacacattttgtgcatttcagcattactcaagttctgagacttttagtcatgtcatgctgtccatgaaatatctgatagatctgttctttccttgggcatcgtattgcttctacaaacatagctcaaagtgtaaggaatttgtaattttcatcataactgacaggactggcagacacatttttctcagttgacttggtgcatgcttttgacgtgcataacttatgaaagcagt

SEQ ID NO: 20484 - DNA, 443 bp, Homo sapiens
  AC020737.4_165893
  Located on chromosome 14
  Distance between a terminus base of telomere on chromosomal short arm and 5'-terminus of this base sequence : 25464649
  Distance between 3'-terminus of neighbour sequence of sequence listing upward to telomere on chrosomal short arm and 5'-terminus of this base sequence : 8753
tagctatgacctttagcaagttaggtaaactttactaactctgttcacttctttgtcaaatgacgatgatgttttctcccttgcattgctcttatagattaaatgtattaattgagttaatgtacaaaaatcttctgacacagttcctgacatatttagtaaacatgtatttaataaattggggaagcattgtgagtgtagacacacaggtataccagaattaggatctggctcacattaagctctacaatcaatagttcgagatctatgaatagagccatgtgatgcttagacgctgatattccactgtgtgtgtgtgtgtgtgtgtgtgtgtgtgtgtgtgtgtgtgtgtgtgttggggaatggtgacaggacttacatatgtatgttttctgaactaaattgattgtacataaggaaagaactccagtgccatcatgtac

SEQ ID NO: 20485 - DNA, 196 bp, Homo sapiens
  chr14.fa.O7frz.23564122
  Located on chromosome 14
  Distance between a terminus base of telomere on chromosomal short arm and 5'-terminus of this base sequence : 25523084
  Distance between 3'-terminus of neighbour sequence of sequence listing upward to telomere on chrosomal short arm and 5'-terminus of this base sequence : 57992
agtgtacagattcaatgtagtccttatcaaaatcccaatggcatttgttatcattgttatcataatggaaaaaacaattttagaatttatgtagaaacacacacacacacacacacacaaagttggaggcatcacacattgtaatttcaaaatgtattacacaactatagtaattacaatagtatgtttctggcat

SEQ ID NO: 20486 - DNA, 461 bp, Homo sapiens
  chr14.fa.O7frz.23683654
  Located on chromosome 14
  Distance between a terminus base of telomere on chromosomal short arm and 5'-terminus of this base sequence : 25642314
  Distance between 3'-terminus of neighbour sequence of sequence listing upward to telomere on chrosomal short arm and 5'-terminus of this base sequence : 119034
atgcagctgtattctattagaaagtgtattaacatttccttgttaattttctgaagatttaacaaattatatatggtgtttaagtattaatttgactgcctttgaaatcagtattaacttaagcaaaatggcccagaatggcagctgacgcctataattccagcactttgggaggccaaggcaggtcaggagtctgagaccatcctggccaaaaagtgaaaccctatctctactgaaaatacgaaaattagccgagtgtggtggggcatgcttgtaatcccagcgactcgggaggctgaggtaggagaatcactttaacactggaggcggaggttgcagtgagctaatatcggccactgcactcgagcctggacaacagagctagactccatctcaaaaaacaaacaaacaaacaaacaaacaaacaaaaacaacaaaacttgcattctagaattccatta

SEQ ID NO: 20487 - DNA, 188 bp, Homo sapiens
  chr14.fa.O7frz.23798304
  Located on chromosome 14
  Distance between a terminus base of telomere on chromosomal short arm and 5'-terminus of this base sequence : 25757287
  Distance between 3'-terminus of neighbour sequence of sequence listing upward to telomere on chrosomal short arm and 5'-terminus of this base sequence : 114512
ggataatggtttccagttctatccatactgcacagaaaacatgatttcattcttttttacgtctgagtagtattccgtgtgtgtgtgtgtgtgtgtgtgtgtgtgtgtgtgtgtgtattctgcattttatccaatgatccatttatggacacaggttgattcgatgacttagctattgtgactagcca

SEQ ID NO: 20488 - DNA, 316 bp, Homo sapiens
  chr14.fa.O7frz.24021763
  Located on chromosome 14
  Distance between a terminus base of telomere on chromosomal short arm and 5'-terminus of this base sequence : 25980772
  Distance between 3'-terminus of neighbour sequence of sequence listing upward to telomere on chrosomal short arm and 5'-terminus of this base sequence : 223297
tgtcagaaacctgtgaagttagtttcttaatgttgattcttcggatctcttgggttttattttatttatttatttatttacttatttatttattttgagacagagtctcactctgtcccctggctaatttttgttttttagtagaaacgaggtttcaccgtgttggccaggctggtctcaaactcctgaccttaggtgatctgcctgcctcagccttgcaaagcgctaggattacaggtgtgagccactgtgcctggccatctcttgggttttaaatgcctttctgtcttctacctgaaatttctaggttgatcct

SEQ ID NO: 20489 - DNA, 165 bp, Homo sapiens
  D14S615
  Located on chromosome 14
  Distance between a terminus base of telomere on chromosomal short arm and 5'-terminus of this base sequence : 26093136
  Distance between 3'-terminus of neighbour sequence of sequence listing upward to telomere on chrosomal short arm and 5'-terminus of this base sequence : 112048
taagcctaaaacacctttcccagactaatagataggtagatagatagatagatagatagatagatagatagatagatagatggatgtacagatacatccatccataatggaaatcctcagtttcttcagctgtgctctacattgcacaagtattctgaccgccac

SEQ ID NO: 20490 - DNA, 206 bp, Homo sapiens
  D14S608
  Located on chromosome 14
  Distance between a terminus base of telomere on chromosomal short arm and 5'-terminus of this base sequence : 26427269
  Distance between 3'-terminus of neighbour sequence of sequence listing upward to telomere on chrosomal short arm and 5'-terminus of this base sequence : 333968
acgtggtacaggtagataaatggatgatagatagataatagagatagatgatagacagatagatagatagatagatagatagatagatagatagagtatatatataatggactatataatatgtgacatagcatatataatggaatattattcatccataaaaagaaggagatcctcttgtatgctacagcatggataaaccttta

SEQ ID NO: 20491 - DNA, 382 bp, Homo sapiens
  chr14.fa.O7frz.24705398
  Located on chromosome 14
  Distance between a terminus base of telomere on chromosomal short arm and 5'-terminus of this base sequence : 26635501
  Distance between 3'-terminus of neighbour sequence of sequence listing upward to telomere on chrosomal short arm and 5'-terminus of this base sequence : 208026
caaattctgtcaaatctggtactgcatatagactatgttgaaagatgtttctctagtttttctgattataagaaatggcaagcaaggaagacaaaattttatttatttatttatttatttatctatttattttatttgtttgtttgtttatttattttgagacagagtttcactcttgtcacccaggccggagtgcagtggcgtgatctcagctcactgcaacctctgcctcccaggttcaagcaattctcctgcctcagcttaccaagtagctgggattacaggcacctgccactgcacccagctaatgtttgtatttttagtagagaaggggtttcgccatgttggccaggctggtctgacacttctgacttcaaattat

SEQ ID NO: 20492 - DNA, 277 bp, Homo sapiens
  Z66624
  Located on chromosome 14
  Distance between a terminus base of telomere on chromosomal short arm and 5'-terminus of this base sequence : 26765786
  Distance between 3'-terminus of neighbour sequence of sequence listing upward to telomere on chrosomal short arm and 5'-terminus of this base sequence : 129903
cttgcctttgcctattgttctagtcaggctatcaacagattgaatgtacatgtgtgtgtggattggatgtgtgtgtgtgtgtgtgtgtgtgtgtgtgtatctgtatgggacataggtaaagatatagatatatcctattggttctgtttccctagggaaccccaactgacacaaagactaactaataaatgtagaagaaatgacagaactagaaaatcagaaataaatagccaacatagcattattaactcagcccagaaacatctttatcagatag

SEQ ID NO: 20493 - DNA, 266 bp, Homo sapiens
  D14S1042
  Located on chromosome 14
  Distance between a terminus base of telomere on chromosomal short arm and 5'-terminus of this base sequence : 26838423
  Distance between 3'-terminus of neighbour sequence of sequence listing upward to telomere on chrosomal short arm and 5'-terminus of this base sequence : 72360
aattacaggcacctgccatcatgcctggctactgtgtgtgtgtgtgtgtgtgtgtgtgtgtgtgtgtgtgtgtgtttgtgtatttttgtagagatggtgtttcaccatgttggccaggctggtctcgaactcctgacctcaggtgatccacctgtctcagcctctcaaagtactgtgagccactgcatctggctccttttatttatttaatcatatttttgtgtgtgtgtgggataacattgcacctgctcggttatgcacaagta

SEQ ID NO: 20494 - DNA, 431 bp, Homo sapiens
  chr14.fa.O7frz.25006976
  Located on chromosome 14
  Distance between a terminus base of telomere on chromosomal short arm and 5'-terminus of this base sequence : 26935889
  Distance between 3'-terminus of neighbour sequence of sequence listing upward to telomere on chrosomal short arm and 5'-terminus of this base sequence : 97200
tcaattgaagtcattaatgatttcaaactagtgttctgaatgtaatcaaataaattacacacacatacacacacacacacacacacacacacacacacacacacactgcattatgtatcattcccagctctccattctttggagaagggagaatgttaagaaaggacgctgatgattgacctcatgccagtcccttaattctgtctgtccttcgtagcttcttcccctatgggtgaaagagatttctatttccccacctggaaggaactgatactgttcattcccttctccctcctcaagcagcataacctcaacctttactgggaataaaatagcagaagtgtggaagggcaaaaaattcagatgattactaactcaagatgcagaggcacttaaaaatattattcctggaacacttatagacagcttaa

SEQ ID NO: 20495 - DNA, 200 bp, Homo sapiens
  D14S262
  Located on chromosome 14
  Distance between a terminus base of telomere on chromosomal short arm and 5'-terminus of this base sequence : 27138557
  Distance between 3'-terminus of neighbour sequence of sequence listing upward to telomere on chrosomal short arm and 5'-terminus of this base sequence : 202237
ccatgaaactggtcccgggtgtcaaaaagtttggggactactgggttagagcgttctagatggtcccaagagaaagttgtgtgtgtgtgtgtgtgtgtgtgtgtgtgtgtgtgtttaaacaaacaaaatgtttcttattaataagatacttcttcctaattgcttttgtaattttaagcctgggagcatcagtccactac

SEQ ID NO: 20496 - DNA, 398 bp, Homo sapiens
  chr14.fa.O7frz.25333517
  Located on chromosome 14
  Distance between a terminus base of telomere on chromosomal short arm and 5'-terminus of this base sequence : 27260897
  Distance between 3'-terminus of neighbour sequence of sequence listing upward to telomere on chrosomal short arm and 5'-terminus of this base sequence : 122140
taaagatgctgatctggttaagtgaaaacacagactaaataaaccaacaaacttcaaacacttgattgtgtaaatccaagagtgaaaggaagttagtttgagagttaaaggaatgcccagaaatacaaagaaaggaaggaggaaaaagaaagaagaaaggagagagagacagagcgagaacacgagcaagagagaaagagagagagagagaaaggaaggaaggaaggaaggaaggaaggaggctggctcatttgggttataacaaataaatacttattaaattaatgctgatttgctttgcttcattttaaagatcgtggattactgaccgatcaactcagctgcagtatcaataatgattatgtcaaatgccagtgtggattgtcatgctagtctaa

SEQ ID NO: 20497 - DNA, 230 bp, Homo sapiens
  G09065
  Located on chromosome 14
  Distance between a terminus base of telomere on chromosomal short arm and 5'-terminus of this base sequence : 27345781
  Distance between 3'-terminus of neighbour sequence of sequence listing upward to telomere on chrosomal short arm and 5'-terminus of this base sequence : 84486
atgcagttttctgagacctaccgtaagttgccacaggcctactatatctatatctatatctagctatcatctatctatctatctatctatctatctatctatctatctatctatagagagagagactcctcttttttgccattatgtgtagacttcctaatggaattctgtatatgtttccctcagaaatatgctagtgatatcttctaacagaaaagtgcagagtgaca

SEQ ID NO: 20498 - DNA, 439 bp, Homo sapiens
  chr14.fa.O7frz.25524762
  Located on chromosome 14
  Distance between a terminus base of telomere on chromosomal short arm and 5'-terminus of this base sequence : 27452054
  Distance between 3'-terminus of neighbour sequence of sequence listing upward to telomere on chrosomal short arm and 5'-terminus of this base sequence : 106043
gaagactacaattcctttattgttaattgatatcaaaaactggggccaggctggtggttcacacctgtaatcccaatactttgggaggccaaggccagtggatcacctgaggtcaggagttcaagaccagcgtggccaacatggtgaaaccccattcctactaaaaatactaaaattagctgggtgtggtggtgcgtgcctgtagtcccagctattcgggaggctgaggcagaagaatcgcttgaacccaggaggtggaggttgcagggagccgagcctgggcaacagaccaagactctatctaaaaaacaaacaaacaaacaaacaaacaaaaaattgtttacattggctgaggtgtgggaaaagcatttctatgcattctttccaattggtggagttctgctaaatacctgtagtaatgtcttaatgaactcagcag

SEQ ID NO: 20499 - DNA, 246 bp, Homo sapiens
  D14S252
  Located on chromosome 14
  Distance between a terminus base of telomere on chromosomal short arm and 5'-terminus of this base sequence : 27665422
  Distance between 3'-terminus of neighbour sequence of sequence listing upward to telomere on chrosomal short arm and 5'-terminus of this base sequence : 212929
gtgcattctattaagtaaaattggccccaagtgttggggagaggtgaggatcaattcaatgtttgcatagcaaaagaaatcacttgaggactaatctatttgtgtgtgtgtgcgtgcacacacacacacacacacacacacacacacatatatatattttaattttttgagacagagtcttgctctgtcagccaggctggaatctagtgttgtgatctccactcactgcaacctccacctcccagg

SEQ ID NO: 20500 - DNA, 187 bp, Homo sapiens
  DISO7_10003886
  Located on chromosome 14
  Distance between a terminus base of telomere on chromosomal short arm and 5'-terminus of this base sequence : 27779677
  Distance between 3'-terminus of neighbour sequence of sequence listing upward to telomere on chrosomal short arm and 5'-terminus of this base sequence : 114009
gagatctaaacataattgagtgtgcgtgtgtgtgtgtgtgtgtgtgtgtaattgatatactaactgaacaatttaaagggtcaatgactttgggaaaatggcactatgtcgttcaaaactagaattaaactgttagagaatagctccttttaaattccagcaaaatagctggtaagagtaagggagc

SEQ ID NO: 20501 - DNA, 477 bp, Homo sapiens
  chr14.fa.O7frz.26044374
  Located on chromosome 14
  Distance between a terminus base of telomere on chromosomal short arm and 5'-terminus of this base sequence : 27952018
  Distance between 3'-terminus of neighbour sequence of sequence listing upward to telomere on chrosomal short arm and 5'-terminus of this base sequence : 172154
tccactagaatgtagcttcaagagagcagggattttgtctgttttgtttacagatacatctatgtgcctagaataccatctactttacaataggagcgcaatatatatttgtagaacaaatgagtgaataaataaattaaggactaagtattatccaagtgaatcatgccccaaaccctgtaaggtaatatttaaacaattatcaacattatttagatgagaaaagagaactaatgaaaatttaggaggttttcctatgtaattaatatatgacaccagagcttaaatccagatttactgactcttaacttcagaaaatctgttttccattaacgtttcccaattataaggtttttaaggtttctacaggcatgtgtgtgtacacacacacacacacacacacccatcaagactattagcttaaatgaaggtttatttttcctttgaacaggtaatatttgcttaggtgataggaga

SEQ ID NO: 20502 - DNA, 260 bp, Homo sapiens
  DISO7_10003893
  Located on chromosome 14
  Distance between a terminus base of telomere on chromosomal short arm and 5'-terminus of this base sequence : 28043185
  Distance between 3'-terminus of neighbour sequence of sequence listing upward to telomere on chrosomal short arm and 5'-terminus of this base sequence : 90690
ggaattcaatcattaatagtcacctttaattttatgtttgccaaagctagaacaaaaccaaacataactgatatgtattagagaaatatttaatggtaagaaatgaccttgtatttttagagaaagatataaagaggggtgtgtgtgtgtgtgtgtgtgtgtgtgtgtgtgtgtgtgtgtgtgttgggggataagtatgtacaaaaaatttaatctttaaaaatgaatgtgtttcaaggaaagggtggagaagctgacaa

SEQ ID NO: 20503 - DNA, 455 bp, Homo sapiens
  chr14.fa.O7frz.26283495
  Located on chromosome 14
  Distance between a terminus base of telomere on chromosomal short arm and 5'-terminus of this base sequence : 28191185
  Distance between 3'-terminus of neighbour sequence of sequence listing upward to telomere on chrosomal short arm and 5'-terminus of this base sequence : 147740
ttaagcttataaagcataaaccaggtcaccacaagctttgaagatactgatcatcaattatttcgctaattgtttgttctgtttgcatgtctcagggtaaaaggaaaaagtcactgaagcgaaaaagagacaccaataattgctacctcagtgacagttggtttttaatatctcattatttatgatttgttttgttgtgcatatgtgactttaagtctactgtattaatgtatacccaagaagcctactgtgtaacacttctgaaagaattacacaaattaatcagcaaacctaggcatagaatctgccccgcaaagtcctgaaagactgttattacgtgtgtgtgtgtgtgtgtgtgtgtgtgtgtgtgtgtgtgtgtgcatgggcgtgtgtatgaattcaagagtcttcacttatggtgttgaacttcttgctgtcaaggaagtgctatgtag

SEQ ID NO: 20504 - DNA, 170 bp, Homo sapiens
  D14S975
  Located on chromosome 14
  Distance between a terminus base of telomere on chromosomal short arm and 5'-terminus of this base sequence : 28266382
  Distance between 3'-terminus of neighbour sequence of sequence listing upward to telomere on chrosomal short arm and 5'-terminus of this base sequence : 74742
catacacagacacacggagacacacacacacacacacaccccaccaccaccaccaccaccgctatgataccatatacacaaaaacacacagaatcctttgattctcattcttctccctaaaacagttcaacttcaagcacattgctaaatgcaaaactgattatttggca

SEQ ID NO: 20505 - DNA, 212 bp, Homo sapiens
  Z67577
  Located on chromosome 14
  Distance between a terminus base of telomere on chromosomal short arm and 5'-terminus of this base sequence : 28399647
  Distance between 3'-terminus of neighbour sequence of sequence listing upward to telomere on chrosomal short arm and 5'-terminus of this base sequence : 133095
cacctccttggttagatgtattcctaggttgtgtgtgtgtgtgtgtgtgtgtatgtgtgtgtgtgtgtctactgtaaatgggattatgttcttgttttggcattcagcttgaacattatcagtatataaaaatgctactgattttttgaacactggttttgtatcctgaaactttactaaagtcgcgtaccagttccgggagacttttggca

SEQ ID NO: 20506 - DNA, 322 bp, Homo sapiens
  chr14.fa.O7frz.26605734
  Located on chromosome 14
  Distance between a terminus base of telomere on chromosomal short arm and 5'-terminus of this base sequence : 28513557
  Distance between 3'-terminus of neighbour sequence of sequence listing upward to telomere on chrosomal short arm and 5'-terminus of this base sequence : 113698
gattatggaaactacaattcaagatgagatttgggtggagacaaaatcaaatcatatcaatatactagaagaaaacctaggagaatccctttatgtccttggaatagcaaaggctttgataagtatgactcaaaatccagaagctcctccccaaaatacttggcaaatttaagtacatgaaatgtttttaaagtatatgcgtactctgtgtgtgtgtgtgtgtgtgtgtgtgtgtgtgtgtgtgtgtgtattcctcccacatgtcaaataccacgcacaggtagaaagacaagcaagaaacttggaagtttcacctcattat

SEQ ID NO: 20507 - DNA, 315 bp, Homo sapiens
  chr14.fa.O7frz.26711698
  Located on chromosome 14
  Distance between a terminus base of telomere on chromosomal short arm and 5'-terminus of this base sequence : 28619580
  Distance between 3'-terminus of neighbour sequence of sequence listing upward to telomere on chrosomal short arm and 5'-terminus of this base sequence : 105701
ctatgacagtggaatcatgaagaaacatgaaaatggacatatggagccaatgggtggtagggtggggtggggtaggggaggatgacatctgtttcctggggactagttatatattgataacttaatgtaaacttgtaactttgttacttttgtgtgtgtgtgtgtgtgtgtgtgtgtgtgtgtgtgtgtgtgtgatatagagtctcactctgttgcccaggctgaatgcaatggtgggatcttgactcactgcaacctccgccttcccggttccagtgattctcctgcctcaacctcctgagtagctggattaca

SEQ ID NO: 20508 - DNA, 320 bp, Homo sapiens
  AC000004.1_113991
  Located on chromosome 14
  Distance between a terminus base of telomere on chromosomal short arm and 5'-terminus of this base sequence : 28810090
  Distance between 3'-terminus of neighbour sequence of sequence listing upward to telomere on chrosomal short arm and 5'-terminus of this base sequence : 190195
agtatgatcagtaaccagcgaaagtggaaattactcaaggaactgaatatgtgtatataatgtgtgtgtgtgtgtgtgtgtgtgtgtgtatacacacatttaaaatgtatatgcacaaatgatgtatatatgtgtgtatatatatctgaatatttatactaggtaggtaggtagattagataaattagacagatgattacagagatagaaccagagaacaataatttcaaagcagcgctgggcagagatggaaataatggttgcagcaatcatttgttgagcatctcccacacaacaggaactggccaagcactttacac

SEQ ID NO: 20509 - DNA, 276 bp, Homo sapiens
  D14S1021
  Located on chromosome 14
  Distance between a terminus base of telomere on chromosomal short arm and 5'-terminus of this base sequence : 28858970
  Distance between 3'-terminus of neighbour sequence of sequence listing upward to telomere on chrosomal short arm and 5'-terminus of this base sequence : 48560
gcgctggtgtgaatctttatgaaaggatgtgtatcagacaccgcaggatagctcacctaggcacattgccagataccctcccaccttcctcttccatagagggggatgtattgattaaagaatctccaactctccattgcagcgtgtgtgtgtgtgtgtgtgtgtgtgtgtgtgtgtgtgtgtgtgtgtgagactctggtatatctctgtgtatggttgctttgggtattgttagaggtcagtttttcctattgtgcatgcccaggatacacgact

SEQ ID NO: 20510 - DNA, 425 bp, Homo sapiens
  chr14.fa.O7frz.27067041
  Located on chromosome 14
  Distance between a terminus base of telomere on chromosomal short arm and 5'-terminus of this base sequence : 28975103
  Distance between 3'-terminus of neighbour sequence of sequence listing upward to telomere on chrosomal short arm and 5'-terminus of this base sequence : 115857
gatcagctatcatgtcgtagagttttgtcctgttggcccctgtaaattaatgtcagcagtagaggttcatttaatggctaccgcttgactttccggcagcctttaaaaccaatttattaacaaaacagactattaagaagtcccagttattaaaatatcagaaaattaaagatgtcttccattttccataccatcccccaaaacacattgagtttaaatatttactatttctgtggagagagagatatatataaagatacatatctatattacatatatgtctctctctaaagagatatatatatatatatatatctccacagaatactttagagagttctttaaagttctgtaagctcacagacacagaaggtatcattaaaacaaaggaaaattttggtgtttaaggttaacatttaccagtg

SEQ ID NO: 20511 - DNA, 210 bp, Homo sapiens
  HUMUT7488
  Located on chromosome 14
  Distance between a terminus base of telomere on chromosomal short arm and 5'-terminus of this base sequence : 29069861
  Distance between 3'-terminus of neighbour sequence of sequence listing upward to telomere on chrosomal short arm and 5'-terminus of this base sequence : 94333
ctcaaccaatcttcctgccttggcttctcaaagcaattttattattattattattattattattattattattattattattattattattatttgagacagagtgtcagtctattgaccagactagagtgcagtggtgagatcatggctcacagcagccttgaccccttgggctcaagcgatcctcccgtcccggtttcccgagtagct

SEQ ID NO: 20512 - DNA, 462 bp, Homo sapiens
  chr14.fa.O7frz.27282196
  Located on chromosome 14
  Distance between a terminus base of telomere on chromosomal short arm and 5'-terminus of this base sequence : 29190417
  Distance between 3'-terminus of neighbour sequence of sequence listing upward to telomere on chrosomal short arm and 5'-terminus of this base sequence : 120346
gtcagccttaattctataacgagcaatagccactgctaatatgttgaacattcctaagtattatgtgattatatggagagtttatggaaagtttatttcacttgtttccattagtgggctgtgtgtgtatgcataaatgtgtgtgtgtgtgtgtgtgtgtgtgtgtgtgtgtgtgtgtgtgtgtgtgcgcgcgtatgtatatacagctatataccaatttttaaaataaatattcacagcatctcagccttttggctaagatacagtgtaaaatagctcggctttctattatttaaactaaaccttttgacaaagttttagtaaagtcagtgtttcaaagttttaatgcctaaagtatcaagtgatttgtttttagaaagaaaattttgcttcaatatttcacaaggaagagagctctagagtataaaattataaaaataaacaaagctctttagtgagttt

SEQ ID NO: 20513 - DNA, 396 bp, Homo sapiens
  chr14.fa.O7frz.27376966
  Located on chromosome 14
  Distance between a terminus base of telomere on chromosomal short arm and 5'-terminus of this base sequence : 29285156
  Distance between 3'-terminus of neighbour sequence of sequence listing upward to telomere on chrosomal short arm and 5'-terminus of this base sequence : 94277
ctaacctcagtaaatgtactgcactatatgggctgaatattctcacagacttaaagctctgagtaagatagtattcattcctagaacaaatgataattgaaatctttattctcttctcttttagggttccccacttcctctttccccctaacctgggcatagctacagggtttgtgtgtgtgtgtgtgtgtgtgtgtgtgtgtaaagaaatgacttgtagtctcaaaaaactaagcacagaaccttctttgcatagtgatttcttctatcatatacattctatattgtcacattcatgaaattacaacagaatttgtaataatacagcaatggctgttctccatttgaactattttagtcactgaaaaaagtgtggtgcctctgtcaaagatttac

SEQ ID NO: 20514 - DNA, 194 bp, Homo sapiens
  D14S257
  Located on chromosome 14
  Distance between a terminus base of telomere on chromosomal short arm and 5'-terminus of this base sequence : 29316624
  Distance between 3'-terminus of neighbour sequence of sequence listing upward to telomere on chrosomal short arm and 5'-terminus of this base sequence : 31072
ttggtaaagtggtaaaaagcatacaaagggaaacaattattgcgggcttttgccattttgtgtgtatgtgtgtgtgtgtgtgtgcgtgtgtgtgtgtgtgtgtgtgtgtatgtgtcaactgggtttttgttttgaaattgggtctatttctgtcaccccaggctggagtgcagcggcacagtcatggctcactg

SEQ ID NO: 20515 - DNA, 290 bp, Homo sapiens
  D14S1071
  Located on chromosome 14
  Distance between a terminus base of telomere on chromosomal short arm and 5'-terminus of this base sequence : 29415255
  Distance between 3'-terminus of neighbour sequence of sequence listing upward to telomere on chrosomal short arm and 5'-terminus of this base sequence : 98437
ggctcaactacgtgttgctagtaacaaggttaagaatggatactaaaagaacatctcaaagtgtaagagtgtgtgtgtgtgtgtgtgtgtgtgtgtgtgtgtgtgtacataccttaaggtataacatgacataaaatataaaaatagatgtaaaaaaagatttacaaaagcagatatgttttttaaaaaagcacagtctgaaaaaatgtataagaattagcctgaggccgggtgtggtggctcacacctgtaatcccagcactttgggaggcgaaggtgggtggatcact

SEQ ID NO: 20516 - DNA, 283 bp, Homo sapiens
  chr14.fa.O7frz.27615178
  Located on chromosome 14
  Distance between a terminus base of telomere on chromosomal short arm and 5'-terminus of this base sequence : 29523406
  Distance between 3'-terminus of neighbour sequence of sequence listing upward to telomere on chrosomal short arm and 5'-terminus of this base sequence : 107861
taggctgtgacagtttcttagactttccttgtttttaatgactttgacaattttgaggagcactggtcaggtgtattgtaaaataaccctctattggaattggatttttttcaatatacatacatactgtatatatatatatatatatatatatatatatatatataacctctataattatacgcagagattatagatctttggaggcagatcacagaggtgaagtgccatttttaacacattatatgaagagtacatgctgtcaactgtcttattgctgatg

SEQ ID NO: 20517 - DNA, 462 bp, Homo sapiens
  chr14.fa.O7frz.27809956
  Located on chromosome 14
  Distance between a terminus base of telomere on chromosomal short arm and 5'-terminus of this base sequence : 29718133
  Distance between 3'-terminus of neighbour sequence of sequence listing upward to telomere on chrosomal short arm and 5'-terminus of this base sequence : 194444
ttctgtatcattccaatttcagtttaggtgctgccaaagtgagtacctgttaaattttaaagaaacacatttaacatggtgatgaatctgctcacatttctgagctttcaatttataatttatcatatattaactataggaattaaaatatgcattaaaattattaatttttaatatttatatttattttattttattttactttattttattttattatactttaagttctgagatacacgtgcagaatgtgcagatttgttacatacatatacaagtgccatggcggtttgctgcatctgtcaacgtgtcatctaggcttttaagccccacatgctttaggttatctatcctaatgttatcccttccctctgccccccacccaccgacaggccctggtatgtgatgtttccctccctgtgtccatctgttctcattgttcaactaccacttatgattgag

SEQ ID NO: 20518 - DNA, 229 bp, Homo sapiens
  D14S1040
  Located on chromosome 14
  Distance between a terminus base of telomere on chromosomal short arm and 5'-terminus of this base sequence : 29798242
  Distance between 3'-terminus of neighbour sequence of sequence listing upward to telomere on chrosomal short arm and 5'-terminus of this base sequence : 79647
ggcactatgaaaccaattttaactattgtgtacacacacacacacacacacacacacacacacacacacacacatcttcctttcccaggttcatgccattaggacatccacttcttatctttgtcttttatattatctgttaagttgtatgccagtgactttcaaacttgactctatgcctgaattacctgggattcttgttaagatgcagattctgattcagcaggcc

SEQ ID NO: 20519 - DNA, 370 bp, Homo sapiens
  chr14.fa.O7frz.27979150
  Located on chromosome 14
  Distance between a terminus base of telomere on chromosomal short arm and 5'-terminus of this base sequence : 29887459
  Distance between 3'-terminus of neighbour sequence of sequence listing upward to telomere on chrosomal short arm and 5'-terminus of this base sequence : 88988
gtcagtactttcacattagcatactatgctatactatactgtactataccataccataccataccataccataccataccataccataccatactatactcatactataagctctatgaccacctgtctctctcgctgtgcctggaagatgtagtttctcgctaaatatatactgagtgaatgagtggagtaggattttcataggcatatctagggactagggagggacagaattcagtcttgaaagaatcaggaatacacaagttgtgttcaggattgttcagtttgtctatagttgagatagttacgcattggtgtattgccaggtttggtagagccctaaacagtaggctaaggaatttgtactttc

SEQ ID NO: 20520 - DNA, 178 bp, Homo sapiens
  D14S1034
  Located on chromosome 14
  Distance between a terminus base of telomere on chromosomal short arm and 5'-terminus of this base sequence : 30055635
  Distance between 3'-terminus of neighbour sequence of sequence listing upward to telomere on chrosomal short arm and 5'-terminus of this base sequence : 167806
tagacaaatcgctggtcactcttgtctgctgttctgctactgggggctgtgtgtgtgtgtgtgtgtgtgtgtgtgtgcacgcatatcaaggcatgtgagtgtatttgtgtggtgcatgtgcctgtgtgtgtgtgtgtgagagagagactgtgtatatgtaggatttggagcatctacg

SEQ ID NO: 20521 - DNA, 100 bp, Homo sapiens
  D14S297
  Located on chromosome 14
  Distance between a terminus base of telomere on chromosomal short arm and 5'-terminus of this base sequence : 30122747
  Distance between 3'-terminus of neighbour sequence of sequence listing upward to telomere on chrosomal short arm and 5'-terminus of this base sequence : 66934
ctgttcaaatttgtcactctccaagactctattatctatctatctatctatctatctatctatctatctatctatcacctctttttattatgcttgtcat

SEQ ID NO: 20522 - DNA, 321 bp, Homo sapiens
  chr14.fa.O7frz.28339103
  Located on chromosome 14
  Distance between a terminus base of telomere on chromosomal short arm and 5'-terminus of this base sequence : 30247294
  Distance between 3'-terminus of neighbour sequence of sequence listing upward to telomere on chrosomal short arm and 5'-terminus of this base sequence : 124447
tcaggaactagcagaatgtaacctcagatacttcttttagcatctttgtatcaaatagaggaagtcctatttgattcacagtgtgtcacctgtttgaaagccttctgagaagcataaaacactctaaaaatccaagaaggtattcttttttttaaaaaaacacacacacacatacacacacacacacacacacacccctcattttaaatctttttcattgtgaaatacggcccacatacagcaaagtacataaaacattgacattatcataaagtgaaaccatgtagccacaacccagatctagaatactgccagctccta

SEQ ID NO: 20523 - DNA, 350 bp, Homo sapiens
  DISO7_00003164
  Located on chromosome 14
  Distance between a terminus base of telomere on chromosomal short arm and 5'-terminus of this base sequence : 30366168
  Distance between 3'-terminus of neighbour sequence of sequence listing upward to telomere on chrosomal short arm and 5'-terminus of this base sequence : 118553
atcttccacttatttctgagctttcccctctggtcttgtcacttgtgcgcatccatccatccatccatccatccatccatccatccatccatccatctgtccatcaaacaagtacgtattgagtgtccccttagatgcagcagtgaacaagagattgttgttgccttcatggggcttttagtttagtgttccagtctcctcatcaagctgccatctggctcttgccatcatgccccataacccagaaatctctgatctcctacatgctgtgggtgcccccaccaccacgctggccttgccccgttctttactgtgccacaaaaggagcagcatcttcccttaattctgca

SEQ ID NO: 20524 - DNA, 226 bp, Homo sapiens
  DISO7_10003899
  Located on chromosome 14
  Distance between a terminus base of telomere on chromosomal short arm and 5'-terminus of this base sequence : 30478198
  Distance between 3'-terminus of neighbour sequence of sequence listing upward to telomere on chrosomal short arm and 5'-terminus of this base sequence : 111680
cagagcatagcctctggtatcttttaagaaaagtgtgcaggagattgatttgtgtgtgtgtgtgtgtgtgtgtgtgtttgtgtgtctgaaaatacctttattctaccctctcattgattattagtctatattattcttggtatgaaattctaggttagaattatttttctttcttatgtaaaacaaattgtcttctggcttttaatgttgctgttgagaaatccaa

SEQ ID NO: 20525 - DNA, 386 bp, Homo sapiens
  chr14.fa.O7frz.28758856
  Located on chromosome 14
  Distance between a terminus base of telomere on chromosomal short arm and 5'-terminus of this base sequence : 30667159
  Distance between 3'-terminus of neighbour sequence of sequence listing upward to telomere on chrosomal short arm and 5'-terminus of this base sequence : 188735
aagtctgtttcatggaccttagtgtattcatgaggtctctctctctctctctctctctgacacacacacacacacacacacacacacacacacacacacacgttcattcctttctcagtctctggaaatcaaaagcagaaaaactttctttacttttgacatcttagatattattgtgtaaccattgtgtgtgggtgtgtttatataacatattctattaatgcggttagcactcacaacgggcttactatagtttaggttcatgtaaagccttttacctgggtgtgcttgttcattcttcccaacaatgccaggagtcctaactcctattattactttccctttactgacaaaaaaacttaggttccaaacggagtagataatca

SEQ ID NO: 20526 - DNA, 280 bp, Homo sapiens
  chr14.fa.O7frz.28877310
  Located on chromosome 14
  Distance between a terminus base of telomere on chromosomal short arm and 5'-terminus of this base sequence : 30785621
  Distance between 3'-terminus of neighbour sequence of sequence listing upward to telomere on chrosomal short arm and 5'-terminus of this base sequence : 118076
tagcatttgctttcttactgatagactaagtaagatatattttattttctcagtgtattctatctatctatctatctatctatctatctatctatctatctatcaatcgtatctatcagtcaatcatgcatatatgggaaaggggatcttgctggataaacaggtgtttgtggcattatatttgtaccaggaaagacattcaatcctgtcattctaataactagatcattttccttgttttaacttttcctaatataaagtcaactgaagctcagttaaa

SEQ ID NO: 20527 - DNA, 158 bp, Homo sapiens
  DISO7_10003903
  Located on chromosome 14
  Distance between a terminus base of telomere on chromosomal short arm and 5'-terminus of this base sequence : 30885816
  Distance between 3'-terminus of neighbour sequence of sequence listing upward to telomere on chrosomal short arm and 5'-terminus of this base sequence : 99915
ctgggcatcacctatcatctatctctctctctctctctctctctcacacacacacacacacacacacacacacacacacacacacactctcacaccccagatctgtgcctcagccaattggcctgcccatttccaagtgggccaagttgaaagaattg

SEQ ID NO: 20528 - DNA, 199 bp, Homo sapiens
  D14S1060
  Located on chromosome 14
  Distance between a terminus base of telomere on chromosomal short arm and 5'-terminus of this base sequence : 31003605
  Distance between 3'-terminus of neighbour sequence of sequence listing upward to telomere on chrosomal short arm and 5'-terminus of this base sequence : 117631
gttaaaatgggccacaataaatacataaatggtaagttatttactcccccatccccccaacacacacacacgcgcacacacacacacacacacacacacacacacacacacagagtcatcttcaagaagggaaagttagcctttggtaactttttttcctctatgccaggaaccctagggttggtctgatacataacag

SEQ ID NO: 20529 - DNA, 335 bp, Homo sapiens
  chr14.fa.O7frz.29173092
  Located on chromosome 14
  Distance between a terminus base of telomere on chromosomal short arm and 5'-terminus of this base sequence : 31081237
  Distance between 3'-terminus of neighbour sequence of sequence listing upward to telomere on chrosomal short arm and 5'-terminus of this base sequence : 77433
acatttactgtatgtcgaccactaatgtaggggtgcaaagatgaaaaaagatactgatgtggcccttagatgttcatagtatggataaattgaaggaaaaccagacactttagtttgtttttggcagaagagtaacttggtaggtcttttggacagaacaagagcaatacacattcaagtaatatatgtatatgtgtgtgtatatatatgtgtatatatatgtgtgtgtgtgtatatgtgtgtgtgtgtgtgtgtgtgtgtgtgtatgtatattccccccaccaagatggagtcttgctctgtcacccaggctggagtacagtggcatgatctcg

SEQ ID NO: 20530 - DNA, 478 bp, Homo sapiens
  chr14.fa.O7frz.29356199
  Located on chromosome 14
  Distance between a terminus base of telomere on chromosomal short arm and 5'-terminus of this base sequence : 31264295
  Distance between 3'-terminus of neighbour sequence of sequence listing upward to telomere on chrosomal short arm and 5'-terminus of this base sequence : 182723
tgttgctgttaatggaagttacacatgtgtgctcaccaggatgagaaagcctttatcccatgtcgggcaaagacccgtgatcctgaatctctttctaaacttgcgacctgaagagagcagtgcagggaattgctgctttctcactgtattagcttcttcaatttccttttaattggagcctgcaacccagattcttgtaacttcagggggatgaacaatacagattaagatctggatgctttccaggaagttctcagctcaaagaacattacacacacacacacacacacacacacacacacgcacacacacacacacacacacacagttgtggctattcacaaatcgcatgcagttgcctaatgagtccatatttgcttctgagttttcacatttgcaaactgcactgctgagaaagtaagtgaagtgttcacccatctctgagtgtgaactgattgatttaatgtacaggacagat

SEQ ID NO: 20531 - DNA, 369 bp, Homo sapiens
  chr14.fa.O7frz.29483995
  Located on chromosome 14
  Distance between a terminus base of telomere on chromosomal short arm and 5'-terminus of this base sequence : 31392259
  Distance between 3'-terminus of neighbour sequence of sequence listing upward to telomere on chrosomal short arm and 5'-terminus of this base sequence : 127486
ccatttctgagttacttcacttagaataacagtctcaaattccatccaggttgcaatgaatgccattattttgtttcttgctatggcttagtggtattccattgtgtgtgtgtgcgtgtgtgtgtgtgtgtgtgtgtgtgtgtatcacattttctttatcctattgttgattgatgggcacttgggctggttccatgtttttgcaattgcaaattgtgctgctgtaaacttatgcatgttcaactatcttttttgtataaagacttcttttcctctgggtagatacctagaagtgggagagtccttaaagaactaaaagtagatttaccatttgatccaggcagtttattcttatagtgatggactgca

SEQ ID NO: 20532 - DNA, 428 bp, Homo sapiens
  chr14.fa.O7frz.29598597
  Located on chromosome 14
  Distance between a terminus base of telomere on chromosomal short arm and 5'-terminus of this base sequence : 31506742
  Distance between 3'-terminus of neighbour sequence of sequence listing upward to telomere on chrosomal short arm and 5'-terminus of this base sequence : 114114
ctaccacagctgaactgagtagttgcaacggaggatgtatgccctgcaaagcctaaaatatttacattctagccctttacagaaagcgtttttttgaccccttagtatgaagacactttagcttgaaaaacagctgtgcctaaattcatcttatatgattgaaccactttatagcataaatacacagacacccacacacacatatacatgcacacacatgcacacacacacacacacacagagaagaaactgagaatttaaatggctaaaaaatgcaatctgcattctgactctgaattatattttttaaatgttgcatagactttgtttggattaccctcttttattcccccccaggctctgtcttaatcttcctaagtgaaatctgtcctttgcttcatgttgtcttgtaaccatatttcaatagc

SEQ ID NO: 20533 - DNA, 337 bp, Homo sapiens
  chr14.fa.O7frz.29690059
  Located on chromosome 14
  Distance between a terminus base of telomere on chromosomal short arm and 5'-terminus of this base sequence : 31598182
  Distance between 3'-terminus of neighbour sequence of sequence listing upward to telomere on chrosomal short arm and 5'-terminus of this base sequence : 91012
accactttcaagctaaagaaaccaggcgtggaagttgcattttttgaagagggattatctcctgacacctctttttgttgctggcttggactagcatctttttattaatctcttgtttaatgcgttttcccccccaagtcaggatttcttctttactttatggtattaggcatccatgatcaaccagttctatacccagttatgtttcaaggaatgaaagaactattgttggggtatgtttagaggtgtgtgtgtgtgtgtgtgtgtgtgtgtgtgcatgcacacacacacattagtaataggaacacacaacctgtaatcagcagttctaagtgca

SEQ ID NO: 20534 - DNA, 115 bp, Homo sapiens
  DISO7_10003905
  Located on chromosome 14
  Distance between a terminus base of telomere on chromosomal short arm and 5'-terminus of this base sequence : 31620823
  Distance between 3'-terminus of neighbour sequence of sequence listing upward to telomere on chrosomal short arm and 5'-terminus of this base sequence : 22304
ttgactttgccagatacacatacatacacacacacacacacacacagagagagagagagagagagagagagaggagagatgtatatatttaacctaacaacatccaagaactggt

SEQ ID NO: 20535 - DNA, 106 bp, Homo sapiens
  DISO7_10003907
  Located on chromosome 14
  Distance between a terminus base of telomere on chromosomal short arm and 5'-terminus of this base sequence : 31704552
  Distance between 3'-terminus of neighbour sequence of sequence listing upward to telomere on chrosomal short arm and 5'-terminus of this base sequence : 83614
gcacagtaagcaatttcatacacttactcagtttattacatcttcttactctctctctctctctctctctatatatatatatatatagccacatgatgaagaaaca

SEQ ID NO: 20536 - DNA, 257 bp, Homo sapiens
  chr14.fa.O7frz.30113090
  Located on chromosome 14
  Distance between a terminus base of telomere on chromosomal short arm and 5'-terminus of this base sequence : 31962993
  Distance between 3'-terminus of neighbour sequence of sequence listing upward to telomere on chrosomal short arm and 5'-terminus of this base sequence : 258335
tacacctagacctaatcatgaaaggggaaagcatgagacaaatccaaatagaaggatatctataaaactgagatggattttaaaacacacacacacacacacacacacacacacacagagacagagagagagagagaaacagaaaaagagtgaatgccatgaaaaactttaaaaaaagaataacaaatgaaaaggggctggggacctgtcccacattacaggagactaaaagtaaatgaaatgtagttcatgacctt

SEQ ID NO: 20537 - DNA, 220 bp, Homo sapiens
  chr14.fa.O7frz.30280666
  Located on chromosome 14
  Distance between a terminus base of telomere on chromosomal short arm and 5'-terminus of this base sequence : 32131008
  Distance between 3'-terminus of neighbour sequence of sequence listing upward to telomere on chrosomal short arm and 5'-terminus of this base sequence : 167758
aatcttgtactgctagattgaaactggatatagtataaatttattatatatatatacacacacacacccacacacacacacatatatatgggggtgtatgggggtgtgggtgagtgtgtgtgtttcttaattctgtgtgttgaaagggcctagaagttttgatatatcagtagcagcaaggacacccagcaccctaatcttggtttctaaataccattcc

SEQ ID NO: 20538 - DNA, 84 bp, Homo sapiens
  D14S599
  Located on chromosome 14
  Distance between a terminus base of telomere on chromosomal short arm and 5'-terminus of this base sequence : 32241924
  Distance between 3'-terminus of neighbour sequence of sequence listing upward to telomere on chrosomal short arm and 5'-terminus of this base sequence : 110696
aacttactggcgcagatgacagagccagtaataataataataataataataataataataataacagcaaatattgcactgagt

SEQ ID NO: 20539 - DNA, 98 bp, Homo sapiens
  D14S596
  Located on chromosome 14
  Distance between a terminus base of telomere on chromosomal short arm and 5'-terminus of this base sequence : 32241924
  Distance between 3'-terminus of neighbour sequence of sequence listing upward to telomere on chrosomal short arm and 5'-terminus of this base sequence : -84
aacttactggcgcagatgacagagccagtaataataataataataataataataataataataacagcaaatattgcactgagtcaggccttattcca

SEQ ID NO: 20540 - DNA, 263 bp, Homo sapiens
  D14S1049
  Located on chromosome 14
  Distance between a terminus base of telomere on chromosomal short arm and 5'-terminus of this base sequence : 32365719
  Distance between 3'-terminus of neighbour sequence of sequence listing upward to telomere on chrosomal short arm and 5'-terminus of this base sequence : 123697
tttgaggagcaggcaataggacaggagggtgtgtgtgggggtgtgtgtgtgtgtgtgtgtgtgtgtgtgtgccaaatactgtccaggaatttccctgtgtcttttcaacacccaacctcctatgtttctaaagtacccaaaagtcatcaccatgggaaggggctggacacttcctttgggaagaggctgttccgtcactactcagggtgtctctccagcactttgcaagtctctcactaattgagaaggtgccagtgttttcc

SEQ ID NO: 20541 - DNA, 200 bp, Homo sapiens
  chr14.fa.O7frz.30674565
  Located on chromosome 14
  Distance between a terminus base of telomere on chromosomal short arm and 5'-terminus of this base sequence : 32524468
  Distance between 3'-terminus of neighbour sequence of sequence listing upward to telomere on chrosomal short arm and 5'-terminus of this base sequence : 158486
tcaaagctactggcataattaggtctgagttgggtatgcaaaaaataaaataaaaaaatagaatgccaactgcaacaacttaaacacacacacacacacacacacacacacacacacacacacacagagccacatagttgtattcataaataaggtcagtgcctagctgaaatctaataaatagaccttaattcgaccag

SEQ ID NO: 20542 - DNA, 311 bp, Homo sapiens
  chr14.fa.O7frz.31978038
  Located on chromosome 14
  Distance between a terminus base of telomere on chromosomal short arm and 5'-terminus of this base sequence : 32671358
  Distance between 3'-terminus of neighbour sequence of sequence listing upward to telomere on chrosomal short arm and 5'-terminus of this base sequence : 146690
atcataacagaaattaaagtgcacaagaccatcaaaaatatgtgatttggttgtaccctaaatatggggcacatgtcctcaggacctcctgaggctatgtcatgggaaaaaaaatgttatatatatatatatatatatatatatatatatatatatatatacacacacacatatacagccagttgtgctgccatattaaaggttcaattctttctactgttcctgaatctttggaagtttttcttctttttaaataattattaatgaggcatacatggttctgcaactggtgttccaagtaatgcatacat

SEQ ID NO: 20543 - DNA, 283 bp, Homo sapiens
  chr14.fa.O7frz.31732796
  Located on chromosome 14
  Distance between a terminus base of telomere on chromosomal short arm and 5'-terminus of this base sequence : 32916564
  Distance between 3'-terminus of neighbour sequence of sequence listing upward to telomere on chrosomal short arm and 5'-terminus of this base sequence : 244895
gacaaatccttagttgttctgacaggccctggtgttcccaactaattaactgtcagagaatataaatactcaagacaagatcactctgttactgtggtagaataatacagaaacacaatcactctgtaattatgtctaaaattaagtagagacaagaatgttttaaacacacacacacacacacacacacacacaccccctaaacatcctaacatgaatgactaatgcttctttaccaaaaacaactctcctcctacctcttagatgaaacgcattaagataa

SEQ ID NO: 20544 - DNA, 471 bp, Homo sapiens
  chr14.fa.O7frz.31598579
  Located on chromosome 14
  Distance between a terminus base of telomere on chromosomal short arm and 5'-terminus of this base sequence : 33050807
  Distance between 3'-terminus of neighbour sequence of sequence listing upward to telomere on chrosomal short arm and 5'-terminus of this base sequence : 133960
gtggatcttgcagactcatggaggtattgccttggtgttcttgataagagccagaaaaattctctggattaccaagcagagactcttgttctcttcccttactttctcccaaacaaatagtgtgtgtgtgtgtgtgtgtgtgtgtgtgtgtgtgtgtgtgtgtgtgtgtgctgagcttcctggagctggggtagcagtgacacaagcactcctgtggccactaccactgaaactctgctgggtcagacctgaagacagcatagcactgggtcacacccaaggtcttcagttaccactacttggctaccacctatgttcactcaaggccctagagctctccagtcagcagggagcaaagcctgccaggtttcagtctttcccttcagggcaatgagttcccctggtcccaagtggttccagagatatatctgaaagccagggcctagagttgacaaccttaggaatctactt

SEQ ID NO: 20545 - DNA, 443 bp, Homo sapiens
  chr14.fa.O7frz.31483051
  Located on chromosome 14
  Distance between a terminus base of telomere on chromosomal short arm and 5'-terminus of this base sequence : 33166410
  Distance between 3'-terminus of neighbour sequence of sequence listing upward to telomere on chrosomal short arm and 5'-terminus of this base sequence : 115132
gtcaggagttccaggctacagtgagctatgatcatgccactacactccagcctggacaacagagtgaaagcctgtctctaaataaataaataaataaataaacctttataatcacaatatctgacttaattgaaacatttagtcatgatagtacatctcagacatctcatgctattttccaagcagaggatgttttgttccatatagtttacactactcctgtgttattcctgagagattttattgtttacactttaatgcaatgagaggctagaggcctctgcttacaggtcagtttccctcactgccatagggaatagtcttttcttagctcaatgtggctcagagtgttttataatcaaatctatcaatcttttcaaatctatcaatcttttcttatataattagaaagtcctcttgtctctagtgactgcattgcttat

SEQ ID NO: 20546 - DNA, 242 bp, Homo sapiens
  D14S1014
  Located on chromosome 14
  Distance between a terminus base of telomere on chromosomal short arm and 5'-terminus of this base sequence : 33394305
  Distance between 3'-terminus of neighbour sequence of sequence listing upward to telomere on chrosomal short arm and 5'-terminus of this base sequence : 227452
aatccctacccttgtggtgctttcactctatacagagaaaagatatatagtaaaagctctgtgtgtgtgtgtgtgtgtgtgtgtgtgtgtgtgtgtgtatgtgtgtgtgtagcatgtcagataagtgctatggagaaaaataaagcagagatggaaaatagggagtgctggcagattagaatggggatatgaaggaaagaggggaatcaaggatgattctgacctttttgacctgaatagct

SEQ ID NO: 20547 - DNA, 113 bp, Homo sapiens
  D14S988
  Located on chromosome 14
  Distance between a terminus base of telomere on chromosomal short arm and 5'-terminus of this base sequence : 33503087
  Distance between 3'-terminus of neighbour sequence of sequence listing upward to telomere on chrosomal short arm and 5'-terminus of this base sequence : 108540
atgttatgtaaggttttgttttgttaattaaaatttggtcattttgtgtgtgtgtgtgtctgtgtgtgtgtgtgtgtgtgtggtgagaatataccagtgatatccaatcacca

SEQ ID NO: 20548 - DNA, 420 bp, Homo sapiens
  chr14.fa.O7frz.30899692
  Located on chromosome 14
  Distance between a terminus base of telomere on chromosomal short arm and 5'-terminus of this base sequence : 33749520
  Distance between 3'-terminus of neighbour sequence of sequence listing upward to telomere on chrosomal short arm and 5'-terminus of this base sequence : 246320
tctaggctgttatcagattcaaatgaatcttgaaaatgacaaatttattacaaacataaggggaagtttcattttaggcagtctaataatttattttgctaggatcttattgataggaagtagagggaaagctatagatcaagtcagattaaattaatatttattcaagagctgcccaggcgggagtgcagtggtgtgatctcagttcaccccaaccctctcctcccgggttcaaggcttcttctgcctcagcctcctgagtagctggaacaacaggtgcatgccaccacgctcagcatgcatatatgtgtgtgtgtgtgtgtgtgtgtgtgtatgtatatgtatatgtgtttgtatttttagtagagatggagtttcgccattttggccaggctggtctcaaacttctgacgtcaagta

SEQ ID NO: 20549 - DNA, 218 bp, Homo sapiens
  HUMUT7222
  Located on chromosome 14
  Distance between a terminus base of telomere on chromosomal short arm and 5'-terminus of this base sequence : 33853218
  Distance between 3'-terminus of neighbour sequence of sequence listing upward to telomere on chrosomal short arm and 5'-terminus of this base sequence : 103278
acgaaaattggggcaacagagtgagactctgtctcaagtaaatacatacatacatacatacatacatacatacatacatacatacgtacatacatacagtgtaggcaacacgatcaggagtcaaagaaaagtggacaatttcagtcattgggaaaacatttgttgaatacttagtatgtaccaaacacagcactgacttccaagtgtgtggtttccct

SEQ ID NO: 20550 - DNA, 420 bp, Homo sapiens
  chr14.fa.O7frz.32098315
  Located on chromosome 14
  Distance between a terminus base of telomere on chromosomal short arm and 5'-terminus of this base sequence : 34122502
  Distance between 3'-terminus of neighbour sequence of sequence listing upward to telomere on chrosomal short arm and 5'-terminus of this base sequence : 269066
taagtgacactgaagtaaaggaatgaccatatttatccttccttccttccttccttccttccttcctttctttctttctttctttctttctctctttctttttttcttttctgacggtgtcttgctcaggctggagtgcagtggcatgatctcggctcactgcaatctctgcctcccaggttcaaccaattcttgtgcctcaggctcccaggtagctgggcatgcgcctccatgcctgagtaatttttgtatttttagtagagatgggttttcgccatgttggccaggctgatcttcaactcctgacctctggtgattcacctgcctcagcctcccagagtggtgggattacgggtgtgagccaccgcacctggctttaacttcagtctctaaattgacttaacagcttaatgcaatgag

SEQ ID NO: 20551 - DNA, 254 bp, Homo sapiens
  chr14.fa.O7frz.32272561
  Located on chromosome 14
  Distance between a terminus base of telomere on chromosomal short arm and 5'-terminus of this base sequence : 34296695
  Distance between 3'-terminus of neighbour sequence of sequence listing upward to telomere on chrosomal short arm and 5'-terminus of this base sequence : 173773
actaccactttctagttccatttccatgatctttacctaaacaacaccctctcgttaataaaacattatgcctttgcattccattaaaacccattattgggagtttaaactattgattctgaatatatatatatatatatatatatatatatatatatattctactttttgtgtggctgcagaaatactttgctattactctaattatatgctggagttagaatccttccagctagttaaggttggaaggattc

SEQ ID NO: 20552 - DNA, 456 bp, Homo sapiens
  chr14.fa.O7frz.32524411
  Located on chromosome 14
  Distance between a terminus base of telomere on chromosomal short arm and 5'-terminus of this base sequence : 34362670
  Distance between 3'-terminus of neighbour sequence of sequence listing upward to telomere on chrosomal short arm and 5'-terminus of this base sequence : 65721
aatagccaggtggctctatccttctgagagcagcaagaaggatcagagttcctgtgctttcttcgacgagtgtgtgtgtgtgtgtgtgtgtgtgtgtgtgtgtatgtgtgtgtgtgttgcctcttgttcttaagagacaaggtctcgttatgttatccagactggactagaactcctgagcttatgcgatgctcctgcctcagccttctgaatagctgggactacagaggtgtgcctccgtggccggccaacttggttattttgtcctgtatgaggggggcaaacacaaagctcattggaggatgtcttaggagttagagtcaagcagtcctcagcgctcaagggctaaaagtcagctaccagaagataactttataaggagagaactagggaatctgtctgaaatgttctctcagcattcatcattttcctttctccactacctagttgaccttc

SEQ ID NO: 20553 - DNA, 323 bp, Homo sapiens
  chr14.fa.O7frz.32636180
  Located on chromosome 14
  Distance between a terminus base of telomere on chromosomal short arm and 5'-terminus of this base sequence : 34398194
  Distance between 3'-terminus of neighbour sequence of sequence listing upward to telomere on chrosomal short arm and 5'-terminus of this base sequence : 35068
cctaatttagaatgtgcatcacaaagagcgttagatgatgaccccacaaagagatacacacacacacacacacacacacacacacacacacacacactccatgctgcatgcacatacacacatgaaaactgtctctttctggcctagatcttctctgaagctcccaggaaggatcctgcaagattgtttttctccagattcctaaaccagaggttgagaactaggggcctcaatagccatctgaccagtgaattcctctgatcttctacatgaataattccttttaatttggtttggataactgtctagaatttatcgtgctg

SEQ ID NO: 20554 - DNA, 231 bp, Homo sapiens
  Z67331
  Located on chromosome 14
  Distance between a terminus base of telomere on chromosomal short arm and 5'-terminus of this base sequence : 34577571
  Distance between 3'-terminus of neighbour sequence of sequence listing upward to telomere on chrosomal short arm and 5'-terminus of this base sequence : 179054
cccataaagattgacattggatgaaaaagaatcaagagagcaagcatttctgagagtccctaatacacacacacacacacacacacacacacacacacacgtacctccttcatattctccttttttccttttttttttcctctcatttcgttttgagacagggtcttgctctgtcatgcaggctgaagggcaatggcgccatcacagcacactgcagccttaaccccctgg

SEQ ID NO: 20555 - DNA, 428 bp, Homo sapiens
  chr14.fa.O7frz.32942544
  Located on chromosome 14
  Distance between a terminus base of telomere on chromosomal short arm and 5'-terminus of this base sequence : 34704539
  Distance between 3'-terminus of neighbour sequence of sequence listing upward to telomere on chrosomal short arm and 5'-terminus of this base sequence : 126737
ctctactttaatttgcaaacagactccattcccttcctagtgaattctgccaaatagcctttccagtccctgggaaaagagagagagagagagagagagagagagagagagagaatgcagttggtattgggagtagagaaaagggacagtccaattcagagcttttagctagggtaaagcatttgaaaacctgttgactcataaaggaccacccagtcagaatacaggaggaaataaagcatgaccaaagccccctcagaggtttcttccatagcaccctactgatagaagctctgtgaaactatagcaccttttgaaattacatgacttcagtaaagacctagaaagtttttattagtccatagggcaggttattgaagagaaatgatctctacctctaatatgtgataatgttactttcctggata

SEQ ID NO: 20556 - DNA, 145 bp, Homo sapiens
  Z66766
  Located on chromosome 14
  Distance between a terminus base of telomere on chromosomal short arm and 5'-terminus of this base sequence : 35032206
  Distance between 3'-terminus of neighbour sequence of sequence listing upward to telomere on chrosomal short arm and 5'-terminus of this base sequence : 327239
tgccattctctaaggagcgaagtatcgtatagtaaaacacacacacacacacacacacacgaactctgaaaatctgggtttgagttttgtatcaagtttcacaaatcacatattccaggggttcttaacctgtggtcggattttg

SEQ ID NO: 20557 - DNA, 194 bp, Homo sapiens
  D14S75
  Located on chromosome 14
  Distance between a terminus base of telomere on chromosomal short arm and 5'-terminus of this base sequence : 35088359
  Distance between 3'-terminus of neighbour sequence of sequence listing upward to telomere on chrosomal short arm and 5'-terminus of this base sequence : 56008
tgtccccaggtgttgaggccttacccagatatgggagactggcaatctcctcccacagaacactggctcacatacatgtgtgtagagatgtacacataagcacacgtgcacacacacacacacacacacacacacacacacacacacatgcaacagagccagaagggagggggacacagagcaaggccacttgg

SEQ ID NO: 20558 - DNA, 238 bp, Homo sapiens
  Z66751
  Located on chromosome 14
  Distance between a terminus base of telomere on chromosomal short arm and 5'-terminus of this base sequence : 35238458
  Distance between 3'-terminus of neighbour sequence of sequence listing upward to telomere on chrosomal short arm and 5'-terminus of this base sequence : 149905
catactgggaattaaaagatgtgagttttgttaagtgtgtgtgtgtgtgtgtgtgtgtgtgtgtgtgtgcgtgtgtgtgttgtgtgcctcaatccctttgtgttttggcttttcagtctggaaattcacaaaaataggacaagtcataatatctaaaatggataaatatattatattctttttatcttcttgtacctttcctcagttttcaattttctgttccctgatttccatccac

SEQ ID NO: 20559 - DNA, 398 bp, Homo sapiens
  chr14.fa.O7frz.33826566
  Located on chromosome 14
  Distance between a terminus base of telomere on chromosomal short arm and 5'-terminus of this base sequence : 35588314
  Distance between 3'-terminus of neighbour sequence of sequence listing upward to telomere on chrosomal short arm and 5'-terminus of this base sequence : 349618
taaatacactgaagccagtcacagtggctcatgcctgtaatgccaggaggctaaagtgagaggatcacttgaagtcaggagtttgagaccagcctggcaaacatggggaaaccccgtctctactaaaaaaaaaatacacacacacacatacacacagacacacacacacttagctgggcatagtggcacatgcctgtagtcccagctacttaggacgctgaggcaggagaatcacttgaaccctgggagacagaggttgcagtgagccgagattgtgccgctgcactccagcctgggcaacagagagagactgtcaataaataaataaataaataaataaataaataaataaatagaaaataaacagtttgtttctgaatgatccttggataaatgac

SEQ ID NO: 20560 - DNA, 452 bp, Homo sapiens
  chr14.fa.O7frz.33944874
  Located on chromosome 14
  Distance between a terminus base of telomere on chromosomal short arm and 5'-terminus of this base sequence : 35706829
  Distance between 3'-terminus of neighbour sequence of sequence listing upward to telomere on chrosomal short arm and 5'-terminus of this base sequence : 118117
attctaaaccatccttcacaaggcatgatttagctctcatctatattcacaatctcctaaaggtcttgctttttctgtgtttctctatttttcttttttcttttcctttgtgtgtgtgtgtgtgtgtgtgtgtgtttcttttgagtcagggtctctcttgtcacccaggctgaagtgcagtggtatgatcatagcttactgcagcctccaactcctggctcggtgatcctcctgcctcaacctctgagtagctgggactaggcacatgccaccatgcccagctaattgtataaaaaattttatagaggcagggtctcactttgttttccaggctggtcttgaactcctggcctccagcaatcctcccacttcagcctcccaaagtgctgggattaagggtgtaagccaccaccatgcctggcctatagttctcaaagaataagtcctaacat

SEQ ID NO: 20561 - DNA, 474 bp, Homo sapiens
  chr14.fa.O7frz.34061697
  Located on chromosome 14
  Distance between a terminus base of telomere on chromosomal short arm and 5'-terminus of this base sequence : 35823535
  Distance between 3'-terminus of neighbour sequence of sequence listing upward to telomere on chrosomal short arm and 5'-terminus of this base sequence : 116254
ccaatggaacagaatacagtacacacctacagtaaactcattttcaacaaaggtgtcaagaacatatgctggggaaaagggagcctcttcaataagtgatgctgggaaaatgatatccatatgcagaagaatgaatctagacccctatgtctcaccatagacaaaatcaaatcaaaattgattaaataattaaatctaagacctcaaactataaaactaccacaaaaacaaacaaacaaacaaacaaacaaacaaacaaacactggggaaactctccagtacattggtttcagcaaatatttcttgagccataccccataagcacaggcaaccaaagcaaaaatgaacaaatgggttcatgtcaagttaaaaagcttttgcacaccaaaggatacaatcagtaaagtgaagagacaacccacagaatgggaaaaatattagcaaactacccatcttgcaaggaattaataacca

SEQ ID NO: 20562 - DNA, 212 bp, Homo sapiens
  chr14.fa.O7frz.34173134
  Located on chromosome 14
  Distance between a terminus base of telomere on chromosomal short arm and 5'-terminus of this base sequence : 35935143
  Distance between 3'-terminus of neighbour sequence of sequence listing upward to telomere on chrosomal short arm and 5'-terminus of this base sequence : 111134
ataattgatactatccaatggctaatgttggatattctacaactctatctcaagacacacacacacacacacacacacacacacacacacaaacacacacacatcattctaattcttacgttcgtggggtggacattgttttaaactggtattggtataaatgaaaaaagaggtgcacttgattagttgttctattaagaaatgccagtaaa

SEQ ID NO: 20563 - DNA, 204 bp, Homo sapiens
  D14S306
  Located on chromosome 14
  Distance between a terminus base of telomere on chromosomal short arm and 5'-terminus of this base sequence : 35988825
  Distance between 3'-terminus of neighbour sequence of sequence listing upward to telomere on chrosomal short arm and 5'-terminus of this base sequence : 53470
tgacaaagaaactaaaatgtcccaaatattttaaatctgtctctatctatctatctatctatctatctatctatctatctatctatctatctatctatcttatgtatgtacgtatctatctatctagtctgtccatctatctagtctgtctgtctgtctacctacctacctatttgtctacctacctaatttggatgtagctga

SEQ ID NO: 20564 - DNA, 429 bp, Homo sapiens
  chr14.fa.O7frz.34351785
  Located on chromosome 14
  Distance between a terminus base of telomere on chromosomal short arm and 5'-terminus of this base sequence : 36113739
  Distance between 3'-terminus of neighbour sequence of sequence listing upward to telomere on chrosomal short arm and 5'-terminus of this base sequence : 124710
aatgaaatcagtatgtcaaagaactttctatctatctgcactttcatgttcactgaagcattatttatagtaaccaagatatggatgatgagtggataaagaaaatgcaacacacacacacacacacacacacacacacacacacacacacgactatacacatcataaaccctggaatgatgttcagcctaaaaaaataaagaaattctgctatttgtgacaacatggataaacctgaaggatgttatactaagtggaagaagccaggcacagaaagacaaatactgcataatctcactgatatttggaatctaaaaaaagccaactcatggaaacagagtagaatggtggttactcagggttgaggggtggggaaatagggagatatgggtcaaatggtataaacttctagttgcaagatcaataaat

SEQ ID NO: 20565 - DNA, 340 bp, Homo sapiens
  chr14.fa.O7frz.34500154
  Located on chromosome 14
  Distance between a terminus base of telomere on chromosomal short arm and 5'-terminus of this base sequence : 36261779
  Distance between 3'-terminus of neighbour sequence of sequence listing upward to telomere on chrosomal short arm and 5'-terminus of this base sequence : 147611
cggtgagaatgtaaattagtacagccattatggaaaacagtatggagtttcctaaaaaaaaaaattataattagaactgtcatatgattcagctgttctacttttgggtttgcatctgaaggaaatgagatcagtatcgtagagatatctgtattcctatgttcactgaagcactattcacaatagccaagataagaaaacaagaatttgttgataaataaatagttaagttgtataatatatacatatagatacatatatatgtatctatatgtgtgtatacacacacacacacacacacacacacacatacatagatacaatggaatgttatttagcc

SEQ ID NO: 20566 - DNA, 159 bp, Homo sapiens
  D14S286
  Located on chromosome 14
  Distance between a terminus base of telomere on chromosomal short arm and 5'-terminus of this base sequence : 36519163
  Distance between 3'-terminus of neighbour sequence of sequence listing upward to telomere on chrosomal short arm and 5'-terminus of this base sequence : 257044
cattaagcgaaattggagaaatgaaacattgcaagtctttgtactgtctctgcaacttttctgtaagtctaaaattatttcaaaatttagaattagaaaacatatgaaacacacacacacacacacacacacacatacacataaacaaaggccaaacaa

SEQ ID NO: 20567 - DNA, 193 bp, Homo sapiens
  HUMUT5219
  Located on chromosome 14
  Distance between a terminus base of telomere on chromosomal short arm and 5'-terminus of this base sequence : 36732570
  Distance between 3'-terminus of neighbour sequence of sequence listing upward to telomere on chrosomal short arm and 5'-terminus of this base sequence : 213248
gagagactgagaacaaaagctagacacacacacacacacacacacacacacacacacatacagagagagagacagagagagaaagagagagagagagagagagagagattgagagaagagaagccaagaaaatagaatggaagacataaagagatgaagagatttctgctttaggtatgaggggataaagtaa

SEQ ID NO: 20568 - DNA, 176 bp, Homo sapiens
  D14S1048
  Located on chromosome 14
  Distance between a terminus base of telomere on chromosomal short arm and 5'-terminus of this base sequence : 37082875
  Distance between 3'-terminus of neighbour sequence of sequence listing upward to telomere on chrosomal short arm and 5'-terminus of this base sequence : 350112
ttgttcatcaaaatcacctgggagcatgcgtgtgtgtgtgtgtgtgagtgtgtgtgtgtgtgtgtgtgtgtgtgtgtgtgtgtttgcttgtttgttttaaggtcgaattctctactccagacctagcccaaaagagaatcttgaaggtagggcccaagaatctgcattttaagtca

SEQ ID NO: 20569 - DNA, 474 bp, Homo sapiens
  chr14.fa.O7frz.35426722
  Located on chromosome 14
  Distance between a terminus base of telomere on chromosomal short arm and 5'-terminus of this base sequence : 37179998
  Distance between 3'-terminus of neighbour sequence of sequence listing upward to telomere on chrosomal short arm and 5'-terminus of this base sequence : 96947
gagtcaagtctgattagatgaagtgtttacccaggatggctagcaatgcagctgaagggagaacacaattagtggttgatgggtaaaccaaaggtcagagatgaatcagccatcaattttaagttgtgaaacagaaaaggccaggagtcaaaaaggaagccgggagcagtggcacaggcctgtagttcctgctccttgggaggctgaggtgggaggatcacttgagcccaggagttcaagtccagcctgggtaagtaatatggcaagatcccatctcaaaagaaggaaagaaaggaagaaagaaagaaagaaagaaagagatgaacagatccctgaagttggatgcacaatggatccgaacaagggactgagaatagaggcagtaaatcatgtgtggataccagtatcttatgtgataaatgacttaggtgataacgcactttagtttcagtagctattctaggatagcctcat

SEQ ID NO: 20570 - DNA, 434 bp, Homo sapiens
  M14_37368858
  Located on chromosome 14
  Distance between a terminus base of telomere on chromosomal short arm and 5'-terminus of this base sequence : 37368717
  Distance between 3'-terminus of neighbour sequence of sequence listing upward to telomere on chrosomal short arm and 5'-terminus of this base sequence : 188245
ctgcttctggtgcctttaaaatgccagtctaaggccaggtgtggtggctcatgcctataatcccagtgctttgggaagctgaggcaggaggaacacttgagaccaagagttcgagactagcctgggcagcatagcaagaatacacacacacacacacacacaaattagtggggtgttgtggtacatgtttgtagtcctagctacttcagaggctgagggaggcagaggcaggaggacagcttgagcctggaagttagaggttacagtgagctatgattgcactgctgcactccagcctgggcaacagagcaagactctgtctctattaaaaaacaaaaacaaaaacaaaaacaaaatctatatcttgaattcattggaggcatccaatgcagccatacaaaaactgacatcttaggtgtcataaaaggcaaaga

SEQ ID NO: 20571 - DNA, 155 bp, Homo sapiens
  DISO7_10003918
  Located on chromosome 14
  Distance between a terminus base of telomere on chromosomal short arm and 5'-terminus of this base sequence : 37738594
  Distance between 3'-terminus of neighbour sequence of sequence listing upward to telomere on chrosomal short arm and 5'-terminus of this base sequence : 369443
tacaagtgcttggtgataaatgagttaaacaacaaagtaagttatgttttcacataataaactgtatccaaaccctagctatttgagtacaaatcacacacacacacacacacacacacacacacacacacaaacacacgcacgagtaagaataa

SEQ ID NO: 20572 - DNA, 152 bp, Homo sapiens
  D14S278
  Located on chromosome 14
  Distance between a terminus base of telomere on chromosomal short arm and 5'-terminus of this base sequence : 37826298
  Distance between 3'-terminus of neighbour sequence of sequence listing upward to telomere on chrosomal short arm and 5'-terminus of this base sequence : 87549
ggacaaaataatggaatgtataaagaaaatgtgattttatataaatatatatatatatatacatacacacacacacacacacacatacacaccatggaatactactcagccataaaaaagaacaaaataatggtattcacggcaacctggat

SEQ ID NO: 20573 - DNA, 277 bp, Homo sapiens
  G09062
  Located on chromosome 14
  Distance between a terminus base of telomere on chromosomal short arm and 5'-terminus of this base sequence : 38012240
  Distance between 3'-terminus of neighbour sequence of sequence listing upward to telomere on chrosomal short arm and 5'-terminus of this base sequence : 185790
tgtcaaatagggtgcctcatttaatcctgagagggagattggctggtctgaaatgaataaaaaatgcgtgtaaaatatcccacataatgcctaccatataagatgctcaatagatagaaattattttctctaacatctatctatctatctatctatctatctatctatctatctatctatctatttatatatatatctcacttctgttgacatcaatctcatccactagtttggaaatctccaaatgcttttattcctttccaagtcctggtgtcat

SEQ ID NO: 20574 - DNA, 152 bp, Homo sapiens
  D14S1039
  Located on chromosome 14
  Distance between a terminus base of telomere on chromosomal short arm and 5'-terminus of this base sequence : 38132173
  Distance between 3'-terminus of neighbour sequence of sequence listing upward to telomere on chrosomal short arm and 5'-terminus of this base sequence : 119656
tagaccggatggacttggatcaatctcatatttcattaactttgcaagaatggaatcctatattttacctgtgtgtgtgtgtgtgtgtgtgtgtgtgtgtgtgtgtgtgtgtgttttgactctactcatagccttatggcaaggttttgctg

SEQ ID NO: 20575 - DNA, 423 bp, Homo sapiens
  chr14.fa.O7frz.36281249
  Located on chromosome 14
  Distance between a terminus base of telomere on chromosomal short arm and 5'-terminus of this base sequence : 38222396
  Distance between 3'-terminus of neighbour sequence of sequence listing upward to telomere on chrosomal short arm and 5'-terminus of this base sequence : 90071
tgaagatctgttagctgcatagttttaattctagactgttagggttccttgacaacaaatgtgtgtgtgtgtgtgtgtgtgtgtgtacataaatgtgttggggataatgtttgagctatttttacacttcaaaaacaggctctatacttaaaatggtttattcaccagaaataaagtttcatgggctattaaatataatattttgataagactaaatacatcaaaactttggtttcataagaatattttgttataaatattttcctgagtgtcaaaagcttttaaaatgtgaattagttgacatcaagaatcttcaaaggcaaacacagggcaaattctattttctttctatcgtgaaaattagtagcacacatagtctctgtgtggcataaaggaagctactaggtgatccttactttcaag

SEQ ID NO: 20576 - DNA, 222 bp, Homo sapiens
  chr14.fa.O7frz.36395509
  Located on chromosome 14
  Distance between a terminus base of telomere on chromosomal short arm and 5'-terminus of this base sequence : 38336567
  Distance between 3'-terminus of neighbour sequence of sequence listing upward to telomere on chrosomal short arm and 5'-terminus of this base sequence : 113748
tcatactatggtaatttgccagggagttatagaaactctaggataaaataaatgtatctctggataatctattttactgaaaaatttgggaatatagttactggtaaaacatagagatacacagcagtccatgatggattgatgcatatcacacacacacacacacacacacacacacacacacacacacacaccattctttggtttatttgagtagaacag

SEQ ID NO: 20577 - DNA, 472 bp, Homo sapiens
  chr14.fa.O7frz.36490673
  Located on chromosome 14
  Distance between a terminus base of telomere on chromosomal short arm and 5'-terminus of this base sequence : 38431712
  Distance between 3'-terminus of neighbour sequence of sequence listing upward to telomere on chrosomal short arm and 5'-terminus of this base sequence : 94923
ctggcattctaaatcacaaacattattatcaatttaaaaagcatataacattcatctgtttttctcccactttgatttttagtccaggggtaactctgtgaaagccaggtcaaatgttttctgtatacaaatttcaaagtttatcaaaggtgagacacagagaaaattatacacacacacacacacacacacacacacacacacacacgatagacatatatatttcacatacaccacattttctttatccactcatttaggttggttccatatctttgcaattgtgaattgtgctgcagtaaacatatacatgctggagtctttttgatacaatgatttttcctttgggtagatatccaggagcaggattgctgatagataggttagtgcagcagtaattaattaaagtaattttactattaaagtaatggcaaaacccacaattactgttgtacaaactgaatacttttgc

SEQ ID NO: 20578 - DNA, 304 bp, Homo sapiens
  D14S579
  Located on chromosome 14
  Distance between a terminus base of telomere on chromosomal short arm and 5'-terminus of this base sequence : 38772659
  Distance between 3'-terminus of neighbour sequence of sequence listing upward to telomere on chrosomal short arm and 5'-terminus of this base sequence : 340475
aataatgttgggaccagcctggacaacatggtgaaaccctgtctcgactaaaaatacaaaaattagccaggcatgcagaagtgcctgtaatcccagctacttgtgggaccgaggcagaagaattgcttgaacgcgggatgtggaggttgcagtgagcctagatggattgcgccatcgcactccagcctgggggacaagagagagattcgtgtcaaagtaataataataataataataataataataataataataataataatgttggtattttgatagagattgcattgaatccgtagattgc

SEQ ID NO: 20579 - DNA, 159 bp, Homo sapiens
  D14S600
  Located on chromosome 14
  Distance between a terminus base of telomere on chromosomal short arm and 5'-terminus of this base sequence : 38772817
  Distance between 3'-terminus of neighbour sequence of sequence listing upward to telomere on chrosomal short arm and 5'-terminus of this base sequence : -146
tagatggattgcgccatcgcactccagcctgggggacaagagagagattcgtgtcaaagtaataataataataataataataataataataataataataataatgttggtattttgatagagattgcattgaatccgtagattgctttcggcagtatg

SEQ ID NO: 20580 - DNA, 296 bp, Homo sapiens
  chr14.fa.O7frz.37151800
  Located on chromosome 14
  Distance between a terminus base of telomere on chromosomal short arm and 5'-terminus of this base sequence : 39092238
  Distance between 3'-terminus of neighbour sequence of sequence listing upward to telomere on chrosomal short arm and 5'-terminus of this base sequence : 319262
cactaaagttaatggattgacaacgtaaatatatatatattatattaatatataacattatatagcctatattattatataatatataatgcattatataattatatataataaaatgttatataattatatattataaatatataaatatttatatatatatcacttgtatatatagggtacgagtgcaattttgttacatgcatagattgcatatatatacatatatatatatatatatgtatatatatgcacaccacaatttctttttccactcattgatttatgagcatttg

SEQ ID NO: 20581 - DNA, 404 bp, Homo sapiens
  chr14.fa.O7frz.37245114
  Located on chromosome 14
  Distance between a terminus base of telomere on chromosomal short arm and 5'-terminus of this base sequence : 39183117
  Distance between 3'-terminus of neighbour sequence of sequence listing upward to telomere on chrosomal short arm and 5'-terminus of this base sequence : 90583
cttagaatcaatgtcagctcagagcccgtgtctagtggtttccaaaaggtcttatcattcccctaacctcagtacacatttaccctgccaaaaggccaaagcattagtccattctcatgctgctatgaattaatatctgtgtgtgtaatttatatatatgtgcatatataatatatattctctctatatataatatatatgttttatatatatatatatatatataaataagtttaattgactcagagttcttcatggatggggaagcctcacgaaacttagacaatcatggcagaaggagaagcaaacacatccttcttcacatgaaggtgggaaggagaattgccaagcaaagcagggaaaagccccttttcatcagatctcgtgagaactcagtcactatc

SEQ ID NO: 20582 - DNA, 271 bp, Homo sapiens
  D14S1053
  Located on chromosome 14
  Distance between a terminus base of telomere on chromosomal short arm and 5'-terminus of this base sequence : 39263617
  Distance between 3'-terminus of neighbour sequence of sequence listing upward to telomere on chrosomal short arm and 5'-terminus of this base sequence : 80096
caaatgttgccaggcactgaatggacactggatgcattaaagacaaataaataaataaataaagtctttttgttgctgttattgttggcgcttccaactgtttttgtttatatatatatgtgtgtgtgtgtgtgtgtgtgtatatatgtgtgtgtgtgtgtgtgtgtgtgtatatatatatatgttctagggttcatgtgcacaacgttcaggtttgttacatatgtatacatgtgacatgttggtgtgctgcacccattgactcgtcatt

SEQ ID NO: 20583 - DNA, 363 bp, Homo sapiens
  chr14.fa.O7frz.37515412
  Located on chromosome 14
  Distance between a terminus base of telomere on chromosomal short arm and 5'-terminus of this base sequence : 39445415
  Distance between 3'-terminus of neighbour sequence of sequence listing upward to telomere on chrosomal short arm and 5'-terminus of this base sequence : 181527
acctttccaatttaattcaaatgccaaacaaccatagaatggttgatgttgagttctttgttgtaagaggatcatcttcgataattactttcttgtctttgtttttttttattttatttatttatttatttatttatttttgacatggagtcttgctctgtcatccaggctgtcagtggggcgatcttggctcactgcaacctctgactccagggttcaggtgattcttcagcctgagacacctgagtagctgggattacaggtgcgcaccacaatgcccagctaatgtttgtatttttagtagagatggggtttcgtcatgttgctcaggctgttctcgaacttctaagctcaaagttatcc

SEQ ID NO: 20584 - DNA, 148 bp, Homo sapiens
  Z17095.1_57
  Located on chromosome 14
  Distance between a terminus base of telomere on chromosomal short arm and 5'-terminus of this base sequence : 39638376
  Distance between 3'-terminus of neighbour sequence of sequence listing upward to telomere on chrosomal short arm and 5'-terminus of this base sequence : 192598
ataatcaactgagcattctcaaagagacttgccacagcattaaagttatttcataaactggtgagtatttttattgttatgtggctttcatatgacgtgtgtgtgtgtgtgtgtgtgtgtgtgtgtgtctccatggtctatcaacctt

SEQ ID NO: 20585 - DNA, 79 bp, Homo sapiens
  D14S79
  Located on chromosome 14
  Distance between a terminus base of telomere on chromosomal short arm and 5'-terminus of this base sequence : 39638444
  Distance between 3'-terminus of neighbour sequence of sequence listing upward to telomere on chrosomal short arm and 5'-terminus of this base sequence : -80
ttttattgttatgtggctttcatatgacgtgtgtgtgtgtgtgtgtgtgtgtgtgtgtgtctccatggtctatcaacct

SEQ ID NO: 20586 - DNA, 348 bp, Homo sapiens
  chr14.fa.O7frz.37912248
  Located on chromosome 14
  Distance between a terminus base of telomere on chromosomal short arm and 5'-terminus of this base sequence : 39842092
  Distance between 3'-terminus of neighbour sequence of sequence listing upward to telomere on chrosomal short arm and 5'-terminus of this base sequence : 203569
gtaggttttcaacctggtttagaatttctctaggttataatttatgtggtgttaatatttttgtctctctcaacattcatcctgtaggattaaaaaaaaatctgcttctgtttttccaacttggatttactcaagtttaagtgtgacatactttattcttcttcttgcttatctttaagaggaatcaagagacttgttggatctatcagtgttttcagggaagacataactaaataacaacagaacatatatttttatacacatacacacacacacacacacacacacacacacatatttttacactgttcagataaacaacttctcttctgtaaagcctaggaagtc

SEQ ID NO: 20587 - DNA, 424 bp, Homo sapiens
  AC016914.5_7615
  Located on chromosome 14
  Distance between a terminus base of telomere on chromosomal short arm and 5'-terminus of this base sequence : 39899796
  Distance between 3'-terminus of neighbour sequence of sequence listing upward to telomere on chrosomal short arm and 5'-terminus of this base sequence : 57356
aagattctggctctatcttcagtagctcccatgatgcactaaaaaaggcaaattcgataacatcatttcacattcatctataaactatttttcctgggcacaatctctccccactggcatgcacgtgagagtgcacacatagacataaacacaccacacacacacacacacacactgactgtttaaagctatttaccgttactcccatatattcttttaaccctctgctttaaacactctgattttctcatctttctctacacatgaaaccatctttccctctcttcctatggtcatgtttttccttacaataaaccacttctgttcataatctctgtaagtctcaaagtgaattctttactaaatatgcccaaactaatctttctctactcagagagaaagctctgtaaccaatgcagtttag

SEQ ID NO: 20588 - DNA, 435 bp, Homo sapiens
  chr14.fa.O7frz.38068443
  Located on chromosome 14
  Distance between a terminus base of telomere on chromosomal short arm and 5'-terminus of this base sequence : 39998244
  Distance between 3'-terminus of neighbour sequence of sequence listing upward to telomere on chrosomal short arm and 5'-terminus of this base sequence : 98024
gataagtgttggtgagataacaagtgttggcaagaaatggaccctttgtacactgttggggccaatgtaaattaatacaatcattttgcaaaatagtatggagattttccaagaactaaaagtagattccatatgaccccaaaaatgttacttttggatatatagccaatgaatctgaaatcagcatgtgaacgagatacctgtactttcatgtttatttcagaattagtcacagtagccaagatatagaagcaatagaagcaacctggttttattaaaagattaatgaagaaaatgtggtgtgtatacacacacacacacacacacacacacacacacactagaataatatacagccataaaaataaggaaatttttttcattcacaacatggctggaactggaggaatttatactaagtgaattcagccagtc

SEQ ID NO: 20589 - DNA, 340 bp, Homo sapiens
  chr14.fa.O7frz.38227532
  Located on chromosome 14
  Distance between a terminus base of telomere on chromosomal short arm and 5'-terminus of this base sequence : 40157464
  Distance between 3'-terminus of neighbour sequence of sequence listing upward to telomere on chrosomal short arm and 5'-terminus of this base sequence : 158785
ctacgtggaaattgacacttacctataaattttccttgtgtttggccaagatttttatctttacaaggaacacagtaaaacaatagttatgctgttcggcagttaagtaagaaatagttgagtagtttccatttatactgaaaatgccttaaataaaatttcttaagaactgtttgctgttttctgaccaataaaatatgtatgcattgtgtgtgtgtgtgtgtgtgtgtgtgtgtgtgtgtagctttgcacaagagctatagcttattctgtgattgcttgcacaggcctttaagataattgcttcttgattttaataaatttaacttgcgattagtcc

SEQ ID NO: 20590 - DNA, 476 bp, Homo sapiens
  chr14.fa.O7frz.38974290
  Located on chromosome 14
  Distance between a terminus base of telomere on chromosomal short arm and 5'-terminus of this base sequence : 40404399
  Distance between 3'-terminus of neighbour sequence of sequence listing upward to telomere on chrosomal short arm and 5'-terminus of this base sequence : 246595
agatttaattgactcacagttcagtgtggctgaggaggcctcaggaaacttacaaacatatttgagagagtcttgctctgccttccaggctagagtgcagtggcacgatctcggctcattgcaacccctgcttctgggttcaagtgattctcctgcctcagcctctggagttgctgagaatacaggtgctcgccaccatgcccggctaatttgtgtatttttagtagagatgaggtttcaccatgtaaatgatccacctgccttggcctcccaaagtagtgggattacaggcttgaaccatcacatctggccaataaatataattttacttcttcagtttatttattgaatacaattcaataaatacaattatttatttatttatgaatacaatttatttatttatttatttatttacttactttttgcataattaccctacctagaacctccagtgcaatgttgaatataagtgg

SEQ ID NO: 20591 - DNA, 200 bp, Homo sapiens
  chr14.fa.O7frz.38332632
  Located on chromosome 14
  Distance between a terminus base of telomere on chromosomal short arm and 5'-terminus of this base sequence : 40624544
  Distance between 3'-terminus of neighbour sequence of sequence listing upward to telomere on chrosomal short arm and 5'-terminus of this base sequence : 219669
attcaattatcttcacctggtcccgtccttgacacatgagcgttatttcaattcaaggtgagatttcagtgaggacacagagccaaaccatatcaacgtgtgtgtgtgtgtgtgtgtgtgtgtgtgtatttttctatttaaatatattttaatttgtattttccttggtagtaattattgtggtctaaacttaaatcact

SEQ ID NO: 20592 - DNA, 331 bp, Homo sapiens
  chr14.fa.O7frz.38425885
  Located on chromosome 14
  Distance between a terminus base of telomere on chromosomal short arm and 5'-terminus of this base sequence : 40717822
  Distance between 3'-terminus of neighbour sequence of sequence listing upward to telomere on chrosomal short arm and 5'-terminus of this base sequence : 93078
acaaagctatagttgtcagaacagcatggtactgaggtaaaaccatatgcatatatatatatatgtgtatatatatatacacacacacacacacacacacacacacacagacagacagagagagaaatgcgatagactagaaagcacagaaataaatctatgcagttacagtcaattgattttcaactaagatgccaagaatacacaatggggaaagaatagtcttttcaataaatggtatttagaaaactggatatccacatacagaagaatgaaattaaacccttatctcacactatttacaaaagtcaactcattatgaatccaatac

SEQ ID NO: 20593 - DNA, 225 bp, Homo sapiens
  chr14.fa.O7frz.38548901
  Located on chromosome 14
  Distance between a terminus base of telomere on chromosomal short arm and 5'-terminus of this base sequence : 40840749
  Distance between 3'-terminus of neighbour sequence of sequence listing upward to telomere on chrosomal short arm and 5'-terminus of this base sequence : 122596
caattcaaagaatatcttgcttataataagctatacagatacgtttttgtaaaatacataagtaatataactaaagaaataagtattgagaagtattgagtgtcttctacaagcactttacccacaggtagacagaaaatatgtataaagaattggccctccacatattgcgtgtgtgtgtgtgtgtgtgtgtgtgtgtgtgtgtgtaatagctcctgaggtacc

SEQ ID NO: 20594 - DNA, 426 bp, Homo sapiens
  AC023221.2_8877
  Located on chromosome 14
  Distance between a terminus base of telomere on chromosomal short arm and 5'-terminus of this base sequence : 40909060
  Distance between 3'-terminus of neighbour sequence of sequence listing upward to telomere on chrosomal short arm and 5'-terminus of this base sequence : 68086
gcacatttgaacatgaaattacttcttctagtatttacagattggcttctgcagagaaagcccttcaccagtaagcccagcaagagaagtaaccaaaaagaaatgcaagaaataataatgataataataataataataataataataataataataataataataaacagtaacagaaataaagaatgctctcaaaaggctgatcagtaaactgcaaatggctaaggaaaaagtctctgggtttgagaatataccaatagaaacctctaaaaccaaaaaatcagagataacatttgaaaaaaaaaagaatatcaaagaactctggacaactacaaaaggtgtagcatatgcataatgagaatactaacaaaaaaagagagtgaatggaagagaagactgtttgaatccataaggactgataatttc

SEQ ID NO: 20595 - DNA, 230 bp, Homo sapiens
  AC023221.2_113618
  Located on chromosome 14
  Distance between a terminus base of telomere on chromosomal short arm and 5'-terminus of this base sequence : 40980591
  Distance between 3'-terminus of neighbour sequence of sequence listing upward to telomere on chrosomal short arm and 5'-terminus of this base sequence : 71105
gatggctatgacatcactagataggaattttttcggctccattataatcttagggactactaccatacatgtggtttattgttgactaaaatgttgttacaggaaacaggactagtgtgtgtgtgtgtgtgtgtgtgtgtgtgtgtgtgtgtgtgtgtgtgcgcgcgcgcgcgcgctgttgtttctgcttttctggttagccctgactgatacagcagttacagcttact

SEQ ID NO: 20596 - DNA, 281 bp, Homo sapiens
  D14S301
  Located on chromosome 14
  Distance between a terminus base of telomere on chromosomal short arm and 5'-terminus of this base sequence : 41083518
  Distance between 3'-terminus of neighbour sequence of sequence listing upward to telomere on chrosomal short arm and 5'-terminus of this base sequence : 102697
ccactatacccagctggttgttgtatttcaaatttttatctggaaacacattcccataataatgtaaccagaatggtatacataaattcccatttctgaaaacagattgattgatctatctatctatctatctatctatctatctatctatctatcgatctatctatctatctatatttctgcttttgttatttttgttaaattcattaatgaaagagatgtagaataaaagacttgataattttacaaagattctctgccctacagatgttttagtggct

SEQ ID NO: 20597 - DNA, 251 bp, Homo sapiens
  DISD22_0009240
  Located on chromosome 14
  Distance between a terminus base of telomere on chromosomal short arm and 5'-terminus of this base sequence : 41212967
  Distance between 3'-terminus of neighbour sequence of sequence listing upward to telomere on chrosomal short arm and 5'-terminus of this base sequence : 129168
gttattgacaaattcttcaagacagataaattaaatatattcaaataaccaaacgaaaccatgtccaaataaagtatgaaaatagtgtctcaccaaagaaagactatcaatctaacaaaaaacatctaccggagggacttgttttaggattctttagagaaacaggccagtagtaaatagattgtgtgtgtgtgtgtgtgtgcgtgtgtgtgggtgcgagtctgtgtgtggttgcaagtgtatgtgtaggg

SEQ ID NO: 20598 - DNA, 210 bp, Homo sapiens
  DISD22_0009252
  Located on chromosome 14
  Distance between a terminus base of telomere on chromosomal short arm and 5'-terminus of this base sequence : 41327494
  Distance between 3'-terminus of neighbour sequence of sequence listing upward to telomere on chrosomal short arm and 5'-terminus of this base sequence : 114276
aaagacattccatctccagcttttattgaactattatctggctaaaaacctatatatatatatatatatatatatatatatatatatatatatatatatatatatatatatacacacacacacacacacatatatatacacacacacacatatatatatatatatatatatatacacatacatatatattagcaatcattcctccaattg

SEQ ID NO: 20599 - DNA, 336 bp, Homo sapiens
  chr14.fa.O7frz.39544487
  Located on chromosome 14
  Distance between a terminus base of telomere on chromosomal short arm and 5'-terminus of this base sequence : 41488058
  Distance between 3'-terminus of neighbour sequence of sequence listing upward to telomere on chrosomal short arm and 5'-terminus of this base sequence : 160354
cagtatttctaacgtaaactccagaaactgtgagcgttctcattttggtagagaaacaagtttttgctttattctaagttgtgatattttcaggacaactaatatggatatgagtttttattagtcagggctttccagagaaacagaaccaacaggagatacacacacacacacacacacacacacacacacacacccctcccacacacacacacacacacccctcacacacacacacacacacacagaggagagatttttaatgagaaattagcttatgaaattatggaggctgagaagtcccatgatttgccatttataagatggagatccagg

SEQ ID NO: 20600 - DNA, 396 bp, Homo sapiens
  chr14.fa.O7frz.39629543
  Located on chromosome 14
  Distance between a terminus base of telomere on chromosomal short arm and 5'-terminus of this base sequence : 41573076
  Distance between 3'-terminus of neighbour sequence of sequence listing upward to telomere on chrosomal short arm and 5'-terminus of this base sequence : 84682
caatgatagtgactaaggatgaaccctgagagtccatttgagtctacttcgagaagccagaagagagatgatggacaacggcaatgaaaataagaataagtgacaagatagttttcaagatacagtttgtcattatatataaaatatatatgtataattttatgtatattttatatgttaatatatattttatactgtgtgtgtgtgtgtgtgtgtgtgtatgtatgtatggaggtgttccagatgcttcacattcaatgaagattcatgattattaataaagtcgccatgattccatgcagcctccaatggttctgtattttattgctgatagaaaatacacagaataatacccccttgaattacttttatatgtaagtttatgatccttgcaaa

SEQ ID NO: 20601 - DNA, 469 bp, Homo sapiens
  chr14.fa.O7frz.39771011
  Located on chromosome 14
  Distance between a terminus base of telomere on chromosomal short arm and 5'-terminus of this base sequence : 41714673
  Distance between 3'-terminus of neighbour sequence of sequence listing upward to telomere on chrosomal short arm and 5'-terminus of this base sequence : 141201
caatttcaaggagtacattcacattttacttaaggctgaatccctgaatgcattaatactagcagttatatatacatatatatatatatatatatatatatatatatatatatatatatatacacacacatacacatatatacacacacaaataatatacatctattatgtttctagtgatacactgaaaaattattaaagcataagtaaaagtaaaataaataaaatactgcaaatttgtccctaagagaaaagtttttgtctgtgttctataatttgtttgtaaatatctttgcaattacgctttaatcataacgtcagtactttgtattcttaagaacatatttttaacaataatagataaaaatctctatttaattttgtctcttgatgattccaatgttttggtaattttcagtcaatattattgactcaaacttctaaaatagttaatctcgtccttaggttt

SEQ ID NO: 20602 - DNA, 331 bp, Homo sapiens
  chr14.fa.O7frz.40003851
  Located on chromosome 14
  Distance between a terminus base of telomere on chromosomal short arm and 5'-terminus of this base sequence : 41905461
  Distance between 3'-terminus of neighbour sequence of sequence listing upward to telomere on chrosomal short arm and 5'-terminus of this base sequence : 190319
ttagctggtaactggtattgaccaatgaaatttaatcttcagcaattcactttttttttttaagaaaagcaaactcattctacattgaatcaataacatgaccaaaaatccctttaaaaaactaggaactttcaagacaattcgttaattcatacattaattcatttattcatttttacacacacacacacacacacacgatactactttagtcagtaggaaagagcaagattttgaagggctacaaaactgtaatttcaccatagttactgttttaaatagtgttttatatacatatttattttgcatgctaacttaatctagtggatca

SEQ ID NO: 20603 - DNA, 376 bp, Homo sapiens
  chr14.fa.O7frz.40105295
  Located on chromosome 14
  Distance between a terminus base of telomere on chromosomal short arm and 5'-terminus of this base sequence : 41997962
  Distance between 3'-terminus of neighbour sequence of sequence listing upward to telomere on chrosomal short arm and 5'-terminus of this base sequence : 92170
agtgatgaataacttctactgcattttaatgaactagatgaaccatttcctgtaactcatcagttttgactatattctgcttttcttgttaattatgtggatgaactgtgtggtcatgttccataatatgaaatgtaaacataaagaaacaatgtggcattaattttagtgtttagaattcaataagtacagatattttctagagtaccttgactacacacacacacacacacacacacacacacacacacagacaactttaaagttaaaacagaattagttcaccaaaagtctgaatttaaattagtgggggttcctgagtgtgattaccagctgtctggtcaattaatcagtgacagtaaattcaccattagtt

SEQ ID NO: 20604 - DNA, 363 bp, Homo sapiens
  chr14.fa.O7frz.40230223
  Located on chromosome 14
  Distance between a terminus base of telomere on chromosomal short arm and 5'-terminus of this base sequence : 42122051
  Distance between 3'-terminus of neighbour sequence of sequence listing upward to telomere on chrosomal short arm and 5'-terminus of this base sequence : 123713
ctgttggcagttgtagtttaacgtatgtttctagtttgtactgggaatttttaataaaacataaaatgatatttcatacacataaaatacatatgtatgtatgctgatacaagtacacattaatatgtatatttcaaaatatgtgttgatttgtacactgaggagggacctatttttgtctctgcatgaaaaacataatgatgtgcttaaggattgtggaagaggagactggagaggagcggaggggaggggaggggagaggagaggaggagaggagaggagaggagaggagattatttatgaagagccaagatgccttcctacagggcaagaacaaaaacctcattacctttctcctgaaat

SEQ ID NO: 20605 - DNA, 136 bp, Homo sapiens
  D14S266
  Located on chromosome 14
  Distance between a terminus base of telomere on chromosomal short arm and 5'-terminus of this base sequence : 42245261
  Distance between 3'-terminus of neighbour sequence of sequence listing upward to telomere on chrosomal short arm and 5'-terminus of this base sequence : 122847
acaagccccatatattcatgtaaatttttgtacacacacacacacacacacacacacacacgcacacacatacataccacatcataactaaagatttaataatttgataactactctgaagatttggaagtctatt

SEQ ID NO: 20606 - DNA, 203 bp, Homo sapiens
  D14S288
  Located on chromosome 14
  Distance between a terminus base of telomere on chromosomal short arm and 5'-terminus of this base sequence : 42252064
  Distance between 3'-terminus of neighbour sequence of sequence listing upward to telomere on chrosomal short arm and 5'-terminus of this base sequence : 6667
tggagacaggaacaacacacacaaacagaaagaaatgcagttgattgatagataataaggtttgcagatatggactataaaataattgtgattaatatgttgaagagaagagattacaagattttatatgtgtgtgtgtgtgtgtgtgtgtgtgtgtgtgtgtgtgtgtgtgtgtgtgtgtgtgtttatggcagagtctagct

SEQ ID NO: 20607 - DNA, 424 bp, Homo sapiens
  chr14.fa.O7frz.40503049
  Located on chromosome 14
  Distance between a terminus base of telomere on chromosomal short arm and 5'-terminus of this base sequence : 42394965
  Distance between 3'-terminus of neighbour sequence of sequence listing upward to telomere on chrosomal short arm and 5'-terminus of this base sequence : 142698
caactgaggtagcattaggagggaaatttatagcactaaatgtccatatcagaaatttagaaagatcataatttaacaacctaacaccatgactaagggaactagagaatcaagagcaaaccaacctcaaagctagcagaagacaagatataaccaaaatcaggctgaacaaaggagacacacacacacacacacacacacacacacacacactcacacacacacactcaaaagatcaacaaattcgggacctgttttttttgaaaaattaataaaacagatagaccactggttatactgataaagaagaaaagattcaaataaacacaaccagaaatatcaagggggatattaccactgaccccacagaaataacaacaaccattagagaatactttgaacacctttatgcacgtaaactaga

SEQ ID NO: 20608 - DNA, 161 bp, Homo sapiens
  DISO7_10003921
  Located on chromosome 14
  Distance between a terminus base of telomere on chromosomal short arm and 5'-terminus of this base sequence : 42617856
  Distance between 3'-terminus of neighbour sequence of sequence listing upward to telomere on chrosomal short arm and 5'-terminus of this base sequence : 222467
ctagcactttgtcagctgaagattttggtccaaaacgtgttcctaactagtgtgtgtgtgtgtgtgtgtgtgtgtgtgtgtgtgtgtgtatgtaggagagagagagagagacagagaaagagtgagagagagagagggagacatatacctcctctgaggcc

SEQ ID NO: 20609 - DNA, 445 bp, Homo sapiens
  chr14.fa.O7frz.40926161
  Located on chromosome 14
  Distance between a terminus base of telomere on chromosomal short arm and 5'-terminus of this base sequence : 42817950
  Distance between 3'-terminus of neighbour sequence of sequence listing upward to telomere on chrosomal short arm and 5'-terminus of this base sequence : 199933
gtcaacctccaaacttttctaggaaaaacttcctcgatgctatttggaaatagtgccatttgatcatgactgacttatcccaattgggagtaatgacatgtactccccactgctctcagctctgccacaaacaccatatgtgtgtgtgtgtgtgtgtgtgtgtgtgtgtgtatataaaatttattaatatatttatttatatatttttatatagtataaatatatttatatatttatttatatattacttatatatatttgttatttatatatttatatattttatttacatatttaaaaatatattttatatatatttatatatatatatataattacaatgatatatctggtgagaaaaaaagagattaagtgtccattaaatacttttaaaggaagaatcattccaagaaaaaagagtggcatcttccggtattctacctgg

SEQ ID NO: 20610 - DNA, 417 bp, Homo sapiens
  chr14.fa.O7frz.41048528
  Located on chromosome 14
  Distance between a terminus base of telomere on chromosomal short arm and 5'-terminus of this base sequence : 42940388
  Distance between 3'-terminus of neighbour sequence of sequence listing upward to telomere on chrosomal short arm and 5'-terminus of this base sequence : 121993
aagatagtaagcgactgtactgatttattgaaattttattttttgtagaatagtgtttccataaataaaactagaaactagaacagcatttttcaaaccaaataaattctactacccattacacaaaaacaaagaattactaggaaaggtctattcactatattttcaatgaaaaggattgtcctgaaaatcatatccaggagtttctggtacacaatagattagagtctgttcagactgtgtgtgtgtgtgtgtgtgtgtgtgtgtgtgtgtggtgggtgtgtgggtgtgtaccactcatgcacaaacatggtgacaaagtatcttttaccttttcctgctactgattagtcttatgttggatgattttgccctgacatggttcctctaatagtgctatagatcttgctacaaagt

SEQ ID NO: 20611 - DNA, 221 bp, Homo sapiens
  D14S1027
  Located on chromosome 14
  Distance between a terminus base of telomere on chromosomal short arm and 5'-terminus of this base sequence : 43101477
  Distance between 3'-terminus of neighbour sequence of sequence listing upward to telomere on chrosomal short arm and 5'-terminus of this base sequence : 160672
tcccttgatttttcaacgattcataccttctttcccacagctttccttaccgtctatcagattttcaaattcccaacatcctgtttttgcttttatcattctacacacacacacacacacacacacacacacacacacacacacacacacaaaccccatgacacttaaacttgattggcaatggccaccactgactttcacattgccaaacccaactgact

SEQ ID NO: 20612 - DNA, 404 bp, Homo sapiens
  chr14.fa.O7frz.41387451
  Located on chromosome 14
  Distance between a terminus base of telomere on chromosomal short arm and 5'-terminus of this base sequence : 43279345
  Distance between 3'-terminus of neighbour sequence of sequence listing upward to telomere on chrosomal short arm and 5'-terminus of this base sequence : 177647
tcttcctgcttgttaacaatacagaatggaattgggaagtctgaggacactggagaaaacaaatatgattttgacccttaaaagacctcagaatataaatgaaagacagggaaatccaatgaatatggttacccaaatgccagaggacagatcacaagaaagaggccaaatcgaaaaaaaaaaaaaagaagaagaagaaagaaagagagagagagagagagagagagaaagaaagaaagaaagaaagaaagaaagagagagagagagaaagaaaatgaaagaaaaaaataaaaaaatattggggtttatgctgtctatgctgtcgttggaagaagcgtatgctaaggagtatacatgaaatatttctagaagtttccaataaataacttaggatccaccgtatt

SEQ ID NO: 20613 - DNA, 439 bp, Homo sapiens
  chr14.fa.O7frz.41518405
  Located on chromosome 14
  Distance between a terminus base of telomere on chromosomal short arm and 5'-terminus of this base sequence : 43410439
  Distance between 3'-terminus of neighbour sequence of sequence listing upward to telomere on chrosomal short arm and 5'-terminus of this base sequence : 130690
atcactgtgaagttcagaacactgataagaaagattatagaaggatccagaaagagaaatacatatatatatatatatatatatatatatatatctcataggagagaggacagctccatgcatgttattgtccctgaagaccttccagtgggacaagacgtggaggtggaaaacaaggatattgatgattctgatcctccgtatttgtattagtccattttcatattgctataaagaagtacccgaggtttggtaatttataaagaaaaagaggtttcatggactcacaattccacatggctggggaggcctcacaatcatggcagaaggtgaaggagaagcaaaggcacgtcttacatggtggcaggcaagagagcatgtgcaggggaactgccctttataaaaccatcagatctcataagacttattcactatcacg

SEQ ID NO: 20614 - DNA, 378 bp, Homo sapiens
  chr14.fa.O7frz.41596738
  Located on chromosome 14
  Distance between a terminus base of telomere on chromosomal short arm and 5'-terminus of this base sequence : 43488553
  Distance between 3'-terminus of neighbour sequence of sequence listing upward to telomere on chrosomal short arm and 5'-terminus of this base sequence : 77675
ataacttttaagcctatccatgactcttcccttcttccacatgtctgggaaagctgataaagctcagatgctgtcacctttagtgtcatcaggggattgaaattgaaacacataagctcctgtttgtctgcaggaaccctcgccctggcccaatcccccacaatagaaatctctagccagtctcctttccttgcctttcaatccattttcagacaagcttgagaagccttccctgctttcatccaaaatcctcataataaaactttttcacactgttgaggtgtgtgtgtgtgtgtgtgtgtgtatgtgtgtgtgtgatcatcagtcttgacatctaaatcaaattttgagtggtaatctagcctgtacctatggagt

SEQ ID NO: 20615 - DNA, 357 bp, Homo sapiens
  chr14.fa.O7frz.41899051
  Located on chromosome 14
  Distance between a terminus base of telomere on chromosomal short arm and 5'-terminus of this base sequence : 43791036
  Distance between 3'-terminus of neighbour sequence of sequence listing upward to telomere on chrosomal short arm and 5'-terminus of this base sequence : 302105
tttccattcctaagttacttcacttagaataatagtctccaactccatccaggttgctgcgaatgtaataatttcattcttttttttatggctgagtagtagtccatgttgtgtgtgtgtgtgtgtgtgtgtgtgtgtgtgcatgtgtgtcacattttctttatccactcactgattgatgggcatataggctggcttcatatttttgcagttgcgaattttgctgctataaatatgggtgtgcgagtatctttttcatataatgacttcttttcctctggattagatacccagtagtgggactgctggatcaaatggtagttctgcttttagttctttaaggaatctccgtattgt

SEQ ID NO: 20616 - DNA, 382 bp, Homo sapiens
  chr14.fa.O7frz.42143174
  Located on chromosome 14
  Distance between a terminus base of telomere on chromosomal short arm and 5'-terminus of this base sequence : 43926768
  Distance between 3'-terminus of neighbour sequence of sequence listing upward to telomere on chrosomal short arm and 5'-terminus of this base sequence : 135375
aactgcattgcaaatctagtaggggaaataaaactttcccctacgtctttctgggaagtgtgtgtgtgtgtgtgtatgtgtgttacacttggaatgtgaaggagagaatacagcttaataatttaatccaaaacatacaatttttccttctttgggatttttcacatgctgagagtgttacatacttctgaaagttcttattctcatccttcacacaacagaatgagaagagcaaacccaaactgaaagagagagaacttccatcatagttccttgctgtagagagaacactcaaaacctggaaatgagtgatttaatttgggataaagcaaagtttgaatactttcttcctattttcattaacttagtggttgcatctatt

SEQ ID NO: 20617 - DNA, 270 bp, Homo sapiens
  D14S259
  Located on chromosome 14
  Distance between a terminus base of telomere on chromosomal short arm and 5'-terminus of this base sequence : 44248119
  Distance between 3'-terminus of neighbour sequence of sequence listing upward to telomere on chrosomal short arm and 5'-terminus of this base sequence : 320969
tctttgtataaaatggctaactgaataatgtagaatgtacttgaaagaaatatcttaaagtttattttaaaactcctgaaaactaaactataatccgttatctctcatgagcacagacacaaaatctactttttgtgtgtgtgcgtgtgtgtgtgtgtgtgtgtgtgtgtgtgtgtgtgtgtttttagacagcctctctctctgttgctcaggctggagtacagtggtgtgatctccacttactgcaacctctgcctccgtggatcaagc

SEQ ID NO: 20618 - DNA, 443 bp, Homo sapiens
  chr14.fa.O7frz.42593594
  Located on chromosome 14
  Distance between a terminus base of telomere on chromosomal short arm and 5'-terminus of this base sequence : 44376100
  Distance between 3'-terminus of neighbour sequence of sequence listing upward to telomere on chrosomal short arm and 5'-terminus of this base sequence : 127711
tggtctgtggtttctgaagactgtggaaaaagcataatatctgggccaaaatgcacccttccttacagcacagtccctcatggcttcccttggctaggggagggagttccccaaccgcttgtgctttctgggtgtggcaatgctccaccctgctttggctcaccctctgtgggctgcacccactctctaaccagtcccaatgagatgagctgggtacctcagttggaaatgcagaaatcacctattttctgctttgatcttgctgagagctgcagactggagctcttcctcttcaaccatcttgccagcccccaatcatattctatcttgttatgcatgcatatgtaatgaaggctttctttctttctttctttctttctttctttctttctttctttctttctttctgacacagagtttcactattgtcactcaaattggag

SEQ ID NO: 20619 - DNA, 450 bp, Homo sapiens
  chr14.fa.O7frz.42802104
  Located on chromosome 14
  Distance between a terminus base of telomere on chromosomal short arm and 5'-terminus of this base sequence : 44585122
  Distance between 3'-terminus of neighbour sequence of sequence listing upward to telomere on chrosomal short arm and 5'-terminus of this base sequence : 208579
aactggtccatcctatctagagacagaaatttctaaggatatcattattcccttatattagactgtcaaaatggcttgatatattagtcagggttctccagagaaacagagccagtagtctgtctttgtctttgtctttgtctgtctgtctgtctgtttacctacctacctacctacctatcacctatcttataaggaattggctcatacaattgtggggctgaaaagtcccataatctgctgtttggtaaatgcaggaaagccagtggcatagttcagtctgagtctgaaggcctgagaaccaggggagtcagcagtgtaaatccagatctgagagcaggagaaaatgatatgggataccccagttcaagtagtgaggcaggaacgaagtgatgaattatttcctccatcttttgttctgttcagaccttcaatggatataattaggcc

SEQ ID NO: 20620 - DNA, 334 bp, Homo sapiens
  chr14.fa.O7frz.43088633
  Located on chromosome 14
  Distance between a terminus base of telomere on chromosomal short arm and 5'-terminus of this base sequence : 44872982
  Distance between 3'-terminus of neighbour sequence of sequence listing upward to telomere on chrosomal short arm and 5'-terminus of this base sequence : 287410
tggaactgaaattgtaaattctacactgaataacataatataaaaagatacaaaattgtctgagaaatgcgatgtgctccagattagtgatttccagatttggatatatatctaacatatctggagaccttataaaaatatttagttttccatcaccctacctgtactgatcagaatcactgagaatggccttctggaatgcgtgtgtgtgtgtgtgtgtgtgtgtgtgtgtgtgtgtgtatacatataggcatatctgggcattcacaggcaattctgataattctgaagtagccatttctgaataccgctgcttagaatacatggtacttct

SEQ ID NO: 20621 - DNA, 229 bp, Homo sapiens
  G09211
  Located on chromosome 14
  Distance between a terminus base of telomere on chromosomal short arm and 5'-terminus of this base sequence : 45070415
  Distance between 3'-terminus of neighbour sequence of sequence listing upward to telomere on chrosomal short arm and 5'-terminus of this base sequence : 197099
aaaataagaggtgacaaaatatttttatcttgtttcatctttttttcccaacaatacatttttttaaaattttaatcctgcagaactttatagtaaacaaccatacactttttactcaggttgacaaattgctaagagtgtgcagttgttttgcctataaatagatagatggatgaatacatacatggatggatggatggatggatggatggatagatagagataaagt

SEQ ID NO: 20622 - DNA, 399 bp, Homo sapiens
  chr14.fa.O7frz.43371674
  Located on chromosome 14
  Distance between a terminus base of telomere on chromosomal short arm and 5'-terminus of this base sequence : 45105912
  Distance between 3'-terminus of neighbour sequence of sequence listing upward to telomere on chrosomal short arm and 5'-terminus of this base sequence : 35268
tcagatagtaagaatggtatccagtaggtatttttctaaccctctccctcttacccacctccaccctcaagtaggccttgttgtctattgttctgatctttgtgtccatgttttcttgtttggcttccacttataagtaagaacatgagatatttgattttctgtttctgcatttgtttccttgagataatggcctccagttccatccatgttacagcaaagaacatgatctcattctttttttctggtggtgtagtagtctatggtatatatatatatatatatatatatatatatatatataaacacttttttttaaatctagtctaccattgatgggtatttaggttgattccatgtctttgctgttgtgaatagtactacaacggacatatgcat

SEQ ID NO: 20623 - DNA, 333 bp, Homo sapiens
  AC021839.3_103830
  Located on chromosome 14
  Distance between a terminus base of telomere on chromosomal short arm and 5'-terminus of this base sequence : 45242520
  Distance between 3'-terminus of neighbour sequence of sequence listing upward to telomere on chrosomal short arm and 5'-terminus of this base sequence : 136209
ccattccttctgaaactatttcaaacaataggggtcctccctaactcattttatgaggccggcatcattctgataccaaaacctggcagatacacaacaacaacaacaaaaagaaaattttaggccaatatccctgatgaacatcgatacggaaattctcaataaaatactggcaaaccgaatccagcagcacatcaaaaagcttttccaccatgatcaagtgggcttcatccctgggatgcaaggctggtttaatgtacacaaatcaataaatgtaatccatcatataaacagaaccaatgacaaaaactacacgattatctcaatagatgc

SEQ ID NO: 20624 - DNA, 213 bp, Homo sapiens
  D14S1068
  Located on chromosome 14
  Distance between a terminus base of telomere on chromosomal short arm and 5'-terminus of this base sequence : 45284550
  Distance between 3'-terminus of neighbour sequence of sequence listing upward to telomere on chrosomal short arm and 5'-terminus of this base sequence : 41697
gaactgcaagagatccagaatattcattaaagtcttgaaaaagccaaacaaagttggaggactgacacttctcaatttcataacttattgaaaagttacaataatcaagacaatgtggtcctggagtaaggataaacacacatgcgtgcacacacacacacacacacacacacacacaccagttgaatataattgagggctctgaagtaagct

SEQ ID NO: 20625 - DNA, 351 bp, Homo sapiens
  AC024735.3_89373
  Located on chromosome 14
  Distance between a terminus base of telomere on chromosomal short arm and 5'-terminus of this base sequence : 45501358
  Distance between 3'-terminus of neighbour sequence of sequence listing upward to telomere on chrosomal short arm and 5'-terminus of this base sequence : 216595
tcaaagttctgcactaatttctatttttctccaaataggacatttaagtagtgaagaaatattttatgcatatagttaataaaaagaaaactatcactaacacacacacacacacacacacacacacacacaaacatttagcattttttaacattagcaatatgaaaaatgaatggccaccaacaaccaagaccaaaatccggcaactaagatgtcttttgatatgtatataaataaactggtacatttatgcaatggagattattcaatgataaaaagaaatgtgctatgaagtcccaaaaaggcatacagaaatcttatgtatttctaagtgaaataaggcagtctaaa

SEQ ID NO: 20626 - DNA, 326 bp, Homo sapiens
  chr14.fa.O7frz.43777368
  Located on chromosome 14
  Distance between a terminus base of telomere on chromosomal short arm and 5'-terminus of this base sequence : 45501383
  Distance between 3'-terminus of neighbour sequence of sequence listing upward to telomere on chrosomal short arm and 5'-terminus of this base sequence : -326
tttctccaaataggacatttaagtagtgaagaaatattttatgcatatagttaataaaaagaaaactatcactaacacacacacacacacacacacacacacacacaaacatttagcattttttaacattagcaatatgaaaaatgaatggccaccaacaaccaagaccaaaatccggcaactaagatgtcttttgatatgtatataaataaactggtacatttatgcaatggagattattcaatgataaaaagaaatgtgctatgaagtcccaaaaaggcatacagaaatcttatgtatttctaagtgaaataaggcagtctaaa

SEQ ID NO: 20627 - DNA, 465 bp, Homo sapiens
  chr14.fa.O7frz.43906623
  Located on chromosome 14
  Distance between a terminus base of telomere on chromosomal short arm and 5'-terminus of this base sequence : 45590143
  Distance between 3'-terminus of neighbour sequence of sequence listing upward to telomere on chrosomal short arm and 5'-terminus of this base sequence : 88434
ctgtaggttgcctgttcactctgatggtagggaattgaacaaggagaacacttggacacaggaaggggaacatcacacaccggggcccgttgtggggtagggggaagggggagggatagcattaggagatatacctaatgtaaatgatgagttaatgggtgcagcacaccaacatggcacatgtatacctatgttaaaaacctgcacgttgtgcacatgtaccttagaacttaaagtattccatatatatatatatatatatatatatatatatatatatatatatggaataaatttaacaaaggaagtaaaagatctctgcaagggcaactacagaactgatgaaataaattaaagaggacacaaacaattggaaagacattccattttcatgaataagaagaattgatgtcattaaaatgattctactgcccaaagcaatctatagattcaaagcagtcctta

SEQ ID NO: 20628 - DNA, 400 bp, Homo sapiens
  chr14.fa.O7frz.44225989
  Located on chromosome 14
  Distance between a terminus base of telomere on chromosomal short arm and 5'-terminus of this base sequence : 45909654
  Distance between 3'-terminus of neighbour sequence of sequence listing upward to telomere on chrosomal short arm and 5'-terminus of this base sequence : 319046
tgttcaataggaccacaagtagattgctactatatttatttcatgctacctttttaaaataataggggtggatataacaaataactcatactttctggacttacacacacacacacacacacacacacacacacacgcacacactctcatacttaaggcatatacataatacagactcatatactagatcaattaatttgattatcatttcatgattaaaaaagtctcttcaggctatgctgaagttggttaatctgaggaacaaaaacatattgtgaaatatctaccatttggtgatcttcctacttaaataatacatttctgaactatgtcaataagagtcttcaaataataaaaatacaaaatccaattcatcgatgttcatgtaactgttcagaat

SEQ ID NO: 20629 - DNA, 134 bp, Homo sapiens
  G10035
  Located on chromosome 14
  Distance between a terminus base of telomere on chromosomal short arm and 5'-terminus of this base sequence : 46004386
  Distance between 3'-terminus of neighbour sequence of sequence listing upward to telomere on chrosomal short arm and 5'-terminus of this base sequence : 94332
taaggcagcctagcataaagtctctatgtatagagttaaatagatagatgatagatagatagatagatagatagatagataatagatagattagataaagagataaatagaacataatgatattccatattggt

SEQ ID NO: 20630 - DNA, 464 bp, Homo sapiens
  chr14.fa.O7frz.44445036
  Located on chromosome 14
  Distance between a terminus base of telomere on chromosomal short arm and 5'-terminus of this base sequence : 46128654
  Distance between 3'-terminus of neighbour sequence of sequence listing upward to telomere on chrosomal short arm and 5'-terminus of this base sequence : 124134
atttccagttccttacactatttcttatatagctgtttgctctatttttactatactggtcctttattaaggagcatgcttcctgtaaaaatatctgagtaatgtagagttaattagtggcagccacatatttcctaatttgctgattgactctctctctctctctctctctctctctctgtatatatatatatttgctaccagtagtttttctgaatttttaaaaatatgaatgagaaacagaagggaaaaaagaataacacttactcccattgttgttataaaaacaaagtctccacgtataagtaagaaaggttatttgttgctgttgcattgattgtttttggtggttatttccatatggatatgaaatctagtgggtagcttagatatcctgactagaacaatataggaggcaataagataaacacagacatgaaaataagtcttgtgcataaaggaac

SEQ ID NO: 20631 - DNA, 237 bp, Homo sapiens
  G09069
  Located on chromosome 14
  Distance between a terminus base of telomere on chromosomal short arm and 5'-terminus of this base sequence : 46232526
  Distance between 3'-terminus of neighbour sequence of sequence listing upward to telomere on chrosomal short arm and 5'-terminus of this base sequence : 103408
atctggcaatacttcgcaagtttccaaatgaatgctgaatccaagaaatatgatttccctattctgtacccaaattctactttatcactgcattcaccaaattatatttcaaatgtgatagatagatagatagacagatagatagatagatagatagatagatagatagatagatagatagatcttctgtgttttattcattgctgtcatctggcataaagtgtgacaccccacagt

SEQ ID NO: 20632 - DNA, 199 bp, Homo sapiens
  D14S1055
  Located on chromosome 14
  Distance between a terminus base of telomere on chromosomal short arm and 5'-terminus of this base sequence : 46382257
  Distance between 3'-terminus of neighbour sequence of sequence listing upward to telomere on chrosomal short arm and 5'-terminus of this base sequence : 149494
ggaatgagatggtaatgatgattttttcaaaatcaatagcatgaacctaatatttgagaagcacactggatctgctgcaaaataagatgaaattacacacacacgcacagacacacacacacacatacacacacacacacacacacacacacacacagtgctaaaaccaaaaccaaacacccaagacataaagatcttc

SEQ ID NO: 20633 - DNA, 189 bp, Homo sapiens
  G10000
  Located on chromosome 14
  Distance between a terminus base of telomere on chromosomal short arm and 5'-terminus of this base sequence : 46519243
  Distance between 3'-terminus of neighbour sequence of sequence listing upward to telomere on chrosomal short arm and 5'-terminus of this base sequence : 136787
atcctgggaaatttttctgctgttatcttgggaaattctctgtgtccttctcctgaattggattataggggtctcataattttttccagtggcttaatcatgtctgtctcatgattcacattttctctaattaaacagcgacagcagcagcagcagcagcaaaataaagagctcactagcacaactggc

SEQ ID NO: 20634 - DNA, 325 bp, Homo sapiens
  chr14.fa.O7frz.44958265
  Located on chromosome 14
  Distance between a terminus base of telomere on chromosomal short arm and 5'-terminus of this base sequence : 46641469
  Distance between 3'-terminus of neighbour sequence of sequence listing upward to telomere on chrosomal short arm and 5'-terminus of this base sequence : 122037
tagcctactcctaggctacaacatgcttctgtacagcttgttactatactgaatactgtaggcaattgtaacacgatggtatgtattagtatatctaaacatacctaaaattggaaaaggtacagtaaaaatattgtattataatttcatggaaccatatgtggtccgtcatttactaaatgatggatatttagtggcactttgttatgtagcatatgactctctctctctctctctctctctctccctctctctctctctcggtgtgtgttagtgtgtgtgtgtgtgtgtgtgtgtgtgtgtgtagtgctagcctgtttcatta

SEQ ID NO: 20635 - DNA, 421 bp, Homo sapiens
  chr14.fa.O7frz.45314936
  Located on chromosome 14
  Distance between a terminus base of telomere on chromosomal short arm and 5'-terminus of this base sequence : 46965502
  Distance between 3'-terminus of neighbour sequence of sequence listing upward to telomere on chrosomal short arm and 5'-terminus of this base sequence : 323708
taattgtatgaacgttgaggatattaagctaagtgaaagaagccagctacagaagtacaaatactacatgatttttatatgaggtatataaaatagtcaaactcatagaaacaaagtgtacaattgtggttgcctagggttgggcagagtggaaatgaggggtttctattcaactagtataatgtttcagttatgcaaaatgattaagttttggagatttgctatacaacattgtagttgacaataatgtgttctacacataacacatttgtgaagaaggtaaaaaaaagttacctgtagaaacttcaatcctgtttgtgtgtgtgtgtgtgtgtgtgcgtatacacttaacagaattatataaatatgtttacatcaacactatgttaatttccaaaaactgtatgcagctgacatgtcc

SEQ ID NO: 20636 - DNA, 363 bp, Homo sapiens
  G10070
  Located on chromosome 14
  Distance between a terminus base of telomere on chromosomal short arm and 5'-terminus of this base sequence : 47243244
  Distance between 3'-terminus of neighbour sequence of sequence listing upward to telomere on chrosomal short arm and 5'-terminus of this base sequence : 277321
actatcacaaaataccaacccgagtatgttagctacattcagtcctttccaggatatttttgttttgttttgttttcctgtattactcattatgagccacacagggaggattctttctctttctgttgtcttgggttgggttagccagggttctccagagaaacagaaccattaggatggagatatagctatctatctttatctatctatctatatatctatctatcatctatctatcaattatctatctatctatctatctatctatctatctatctatctatctagaattggctcacatgattgtggaggctgagaagtgctggggtctgctgtttgtaaggcagagaatcaggaaaacca

SEQ ID NO: 20637 - DNA, 456 bp, Homo sapiens
  chr14.fa.O7frz.45638452
  Located on chromosome 14
  Distance between a terminus base of telomere on chromosomal short arm and 5'-terminus of this base sequence : 47313257
  Distance between 3'-terminus of neighbour sequence of sequence listing upward to telomere on chrosomal short arm and 5'-terminus of this base sequence : 69650
gagtgaattatgattgctaatcacatgaccttaaaataaaaagattatcctggattataaagaaaaggtaaatggattatctctatattagttttctatcagtgctgcaacaaattaccacagacttggtggattaaaacaacagacatttattattgtgttaagagacatggaaccaattgtgtgtgtgtgtgtgtgtgtgtgtgtgtgtgtgtgtgcgtgtgtgaatatatatatggagacagagagatgttatggaattattttacaggagtgtgaagtttttttttttattaattccttcatttaattggatgaaacccaaccacactatgtgggataaactcctcgactcatattcttctgatttacatattaatctcatctaaaaaaattactttcacagggacaactagactggtatggtttcaaacatccaagtactaagacctagcc

SEQ ID NO: 20638 - DNA, 261 bp, Homo sapiens
  chr14.fa.O7frz.45731148
  Located on chromosome 14
  Distance between a terminus base of telomere on chromosomal short arm and 5'-terminus of this base sequence : 47406031
  Distance between 3'-terminus of neighbour sequence of sequence listing upward to telomere on chrosomal short arm and 5'-terminus of this base sequence : 92318
aggaaagttacaggcaataaataaaaactgataaaatctatgaattaaagagaccaaataacattaggtaccagtcacctctgtatctgtatttgtgtgtgtgtgtgtgtgtgtgtgtgtgtgtgtataattcaaacaagttagctatatattcatctttggaaaatatgtataatacagattatatgtgttatctcacatattttctcgttggaaaatttgtagaacacattttaggtgttctatggaaaggatacataa

SEQ ID NO: 20639 - DNA, 231 bp, Homo sapiens
  DISO7_10027128
  Located on chromosome 14
  Distance between a terminus base of telomere on chromosomal short arm and 5'-terminus of this base sequence : 47565256
  Distance between 3'-terminus of neighbour sequence of sequence listing upward to telomere on chrosomal short arm and 5'-terminus of this base sequence : 158964
tgaagcgtgttaatgtttcccactgcagactcctataaaatacatttcaagatctttacgaggaaaaaaatgtatttatgaaaatcaaagggcctccaaaagggaaataggagaataaatgagtgtgtgtgtgtgtgtgtgtgtgtgtgtgtgtgtgtgtgtgtgtatggtgtgtggagtgtgtatggtgtgtggagtgtgtatatgaattgctgtattatcaaatgagat

SEQ ID NO: 20640 - DNA, 160 bp, Homo sapiens
  Z23678.1_22
  Located on chromosome 14
  Distance between a terminus base of telomere on chromosomal short arm and 5'-terminus of this base sequence : 47673162
  Distance between 3'-terminus of neighbour sequence of sequence listing upward to telomere on chrosomal short arm and 5'-terminus of this base sequence : 107675
ttccaatacctcaccaatacacacacacacacacacacacacacacacacacgtttgtagatcccatgcctttgaaagaactctacgaaaaggtgagaatgaccactaagagcatctgtacagcatcttaagcgtatggtttctggaatcagaatgctta

SEQ ID NO: 20641 - DNA, 196 bp, Homo sapiens
  chr14.fa.O7frz.46321072
  Located on chromosome 14
  Distance between a terminus base of telomere on chromosomal short arm and 5'-terminus of this base sequence : 47880807
  Distance between 3'-terminus of neighbour sequence of sequence listing upward to telomere on chrosomal short arm and 5'-terminus of this base sequence : 207485
gattcaaatctggttagctagaccagctcatgaaattcagggaaatcatccaaccaactagtaagataagtaaaatatgcagagctatagccaaccagaacagcttgagcttgactacttcctccattcattctctctctctctctctctctctctctctctctctctccaccttatgactttctatgatgtccac

SEQ ID NO: 20642 - DNA, 227 bp, Homo sapiens
  D14S269
  Located on chromosome 14
  Distance between a terminus base of telomere on chromosomal short arm and 5'-terminus of this base sequence : 47930828
  Distance between 3'-terminus of neighbour sequence of sequence listing upward to telomere on chrosomal short arm and 5'-terminus of this base sequence : 49825
cacatggcattaccaaccttttcttcctatcctcccataaatcctggtatataaccttctctcagttgcatatgctcagttgggtatgtggctatttccacggacatgcatgtgtgcacacaggcatgcacacacatacatacacacacacacacacacacacacacacacacacacacactctctctctctctctccagcaacaatgtacctgtcaagcatgttgc

SEQ ID NO: 20643 - DNA, 364 bp, Homo sapiens
  chr14.fa.O7frz.46449014
  Located on chromosome 14
  Distance between a terminus base of telomere on chromosomal short arm and 5'-terminus of this base sequence : 48016670
  Distance between 3'-terminus of neighbour sequence of sequence listing upward to telomere on chrosomal short arm and 5'-terminus of this base sequence : 85615
acaccaaaccttaaggaactagaaaaacaagagaaagccaaccccaaaggtggcagaagacaagtaacaaccaatatcagagctgaacttaaggaaattgaaacagacacacacacacacacacacacacacacacacacaaaaccacaaaaaatcaacaaaccagacatcagatctttaaaagaataaataagatagacagctagctagattaataaaaaatgaatacccaaataaacacaattagaaataacaaaggagacattaccaccaaccacatggaaatacaataaaccatcagagactattatgaacacttctatacatctacaagaaatgggtagttcctggaaatatacaacct

SEQ ID NO: 20644 - DNA, 274 bp, Homo sapiens
  Z67256
  Located on chromosome 14
  Distance between a terminus base of telomere on chromosomal short arm and 5'-terminus of this base sequence : 48275585
  Distance between 3'-terminus of neighbour sequence of sequence listing upward to telomere on chrosomal short arm and 5'-terminus of this base sequence : 258551
gctggtcttgaacttcaggactaattcttacttatcatgactataaacacacacacacacacacacacacacacacacaggtttttttcttaatgtaaaaatttaagtctttaaaatgaaatctaatttaaattatctcattgctaactctgtttttttttaaatagaatactcaaaaagataaatagaatactcaaaaagttttaaaacatgaacccttaaaagagttcaagaaagaagaaaaaaaataagacctaccagcaaacattatgcg

SEQ ID NO: 20645 - DNA, 242 bp, Homo sapiens
  D14S1031
  Located on chromosome 14
  Distance between a terminus base of telomere on chromosomal short arm and 5'-terminus of this base sequence : 48464739
  Distance between 3'-terminus of neighbour sequence of sequence listing upward to telomere on chrosomal short arm and 5'-terminus of this base sequence : 188880
gcctgggacattactgcatactactgtagacttgataaatactgcacacttgggctacactaaatttgttttttattttttaatttttaaaaaaattatgcttacctcagaccagattaaatttatgtatttatttatttatatacatacacacgcacgcgcacgcgcgcgcacacacacacacacacacacacacacatatattttttttttcctttttgagactgaatctcactctgtca

SEQ ID NO: 20646 - DNA, 473 bp, Homo sapiens
  AC020711.4_63411
  Located on chromosome 14
  Distance between a terminus base of telomere on chromosomal short arm and 5'-terminus of this base sequence : 48563463
  Distance between 3'-terminus of neighbour sequence of sequence listing upward to telomere on chrosomal short arm and 5'-terminus of this base sequence : 98482
aactgtaagtccaataaacctctttcttttgtaaattgcccagtctctggtatgtctttatcagcagtgtgaaaatagactaatacagctgggcgcagtggctagtgcctgtaatcccatctacttgggaggctgaggtgggaggatcacttgagcccaggcattcaagggtacagtgagctatggttggccccctgcattccagcttagcctgggtgacagagtgaagacactgtctcttaaaaacaacaacaacaacaacaacaacaacaacaaaaaacccaaaaaaacaggacgtttgcatttgagcatcaagcgctatgtaacacattatgaagtcctatatattagacatgatttactagtcagatgtattagttaccacctagggaagagccaaaatgaaggtagatatttgtaaagacagtttgatgacggaatattaataaaaagaatacctactcgatctccat

SEQ ID NO: 20647 - DNA, 431 bp, Homo sapiens
  chr14.fa.O7frz.47075307
  Located on chromosome 14
  Distance between a terminus base of telomere on chromosomal short arm and 5'-terminus of this base sequence : 48672431
  Distance between 3'-terminus of neighbour sequence of sequence listing upward to telomere on chrosomal short arm and 5'-terminus of this base sequence : 108495
tctggacctctagttattggtctattaaaggggataatacttgcccagtcggccttacaccttccataagatgtttcttttcttttcttttcttttcttttcttttttcttttcagatggagtttcattcttgctatccaggctggagtgcagtggcacgatcttggctcactgcaacctccacctcccaggttcaagccattctcttgcctcagcctcctgattagctgggattacaggtgcaggctgccaggtccagcaattttttttttgtatttttagtagagatggggtttcaccatgttggccaggctggtcttgaactcctgaccttaggtgatctgcccgccacggcgtcccaaagtgctgggattacaggtgtgagctactgcgcctggccccataagatgtttctacaaagtgaagacagt

SEQ ID NO: 20648 - DNA, 476 bp, Homo sapiens
  chr14.fa.O7frz.47301702
  Located on chromosome 14
  Distance between a terminus base of telomere on chromosomal short arm and 5'-terminus of this base sequence : 48897577
  Distance between 3'-terminus of neighbour sequence of sequence listing upward to telomere on chrosomal short arm and 5'-terminus of this base sequence : 224715
taggaactatgcttgacagaatccccttctcttcatggttccaacttaaacttggtcaaaacaggagatgcatataatctggtggcagagggccaggcgtggtagctcacacctgtaatcccagcactttgggaggccgaggcgggtggatcatgaggtcaggagatcgagaccatcctggttaacatggtgaaaccccgtctctactaaaaatacaaaaaaattagccaggtgtggtggcgggcgcctgtcccagctactcgggaggctgaggcaggagaatggtgtgcacccgagaggcggagcttgcagtgagccaagactgcaccaatggactccagcctgggcgacacagtgagactccgtctcaaaataataataataataataataataataataataataataataataataataatctggtggcagaagtaaatcagcaggtattattctctgaaggtcatcctagt

SEQ ID NO: 20649 - DNA, 437 bp, Homo sapiens
  chr14.fa.O7frz.47416381
  Located on chromosome 14
  Distance between a terminus base of telomere on chromosomal short arm and 5'-terminus of this base sequence : 49012248
  Distance between 3'-terminus of neighbour sequence of sequence listing upward to telomere on chrosomal short arm and 5'-terminus of this base sequence : 114195
caatggctaatcctaaatctactaatggagacacagagcatcccctcacttttgaacaatcttcttcactaagcttttaagaacactatggccaggagcgggggctcacgcccataatcctagcactttgggaggccaaggtgggcgggtcatttgaggtcaggagtttgagaccagcctgaccaacatggtgaaaccctctctctactaaaaatacaaaaagtggccaggtgtagtggcaggcacctctcatcccagctacttgggaggctgaggcaggagaatctcttgaacctgggaggcggaggttgcagtgagctgagattgtgccactgcactccagcctgggtagcagagtgagactgtctccaaaaaagaaataataataataataataataataataataataataatgaaagaacattgttctatgg

SEQ ID NO: 20650 - DNA, 396 bp, Homo sapiens
  chr14.fa.O7frz.47644759
  Located on chromosome 14
  Distance between a terminus base of telomere on chromosomal short arm and 5'-terminus of this base sequence : 49236364
  Distance between 3'-terminus of neighbour sequence of sequence listing upward to telomere on chrosomal short arm and 5'-terminus of this base sequence : 223679
agatgaggtcttgctatgtttccagggctggtctcaaacttctgggttcaatcaatcctcctatcttgacctcccaaagtgctgggattacaggtgtgagccactgcacccaggcaattattatttttttagagatggggtcttgctctgtctatcaggctggagtgcagcggtgtgaacatagctcactgcagccttgaactattgagctcacacaatcctcctgcttcagcctcccaaataggactacaggagtgtgccaccatgcccggttatttatttatttatttatttatttatttatttatttatttatttattttgcagagatgggggtttcactatgctgcccaggctggtcttgaactcctggcctcaagtgataaattacaggca

SEQ ID NO: 20651 - DNA, 343 bp, Homo sapiens
  chr14.fa.O7frz.47834419
  Located on chromosome 14
  Distance between a terminus base of telomere on chromosomal short arm and 5'-terminus of this base sequence : 49411921
  Distance between 3'-terminus of neighbour sequence of sequence listing upward to telomere on chrosomal short arm and 5'-terminus of this base sequence : 175161
agcttcctgtagatttcagtaagctgaacatggatgttagaccacaatgaacacacaggtgcacgcgcacacacacacacacacacacacacacacacagagtccactggcaatctacagaccactttcagaaagttgaggcgctttgtttcttttccaatttatattagtatctgaaatatctgtagccccagtctgagctgggatttgcaagaaatatttacagcttgctcagcatggcattttcaatcatgttctataaatgggatgctggtaaatgagccataaagaaagaataaagaaaatgttactgaacctcctttattggtagattatggcaata

SEQ ID NO: 20652 - DNA, 380 bp, Homo sapiens
  chr14.fa.O7frz.47913519
  Located on chromosome 14
  Distance between a terminus base of telomere on chromosomal short arm and 5'-terminus of this base sequence : 49491018
  Distance between 3'-terminus of neighbour sequence of sequence listing upward to telomere on chrosomal short arm and 5'-terminus of this base sequence : 78754
gtgagttcaagtacagtgagctatgattgcaccactgcactccagcctcagtgacagggtaagaccatgacaagaaagaaagaaagaaagaaagaaagaaagaaagaaagaaagaaagaaagaaagaaagaaagaaagaaagaaagagaaagaaagaaagaaagaaagaaagaaagaaagaaagaaagaaaggaaggaaggaaagagaaagaaacaaagaaaacaaacattcccagagcaagtataagagtattaacaggcagtgaacaaaatccccctttgccctgacagttccatgaaatgagctagtactcaaagaaaacttccctttcttgaaaagtgtgggtattttcccccagaccatcttactatcctcaagc

SEQ ID NO: 20653 - DNA, 336 bp, Homo sapiens
  chr14.fa.O7frz.47985433
  Located on chromosome 14
  Distance between a terminus base of telomere on chromosomal short arm and 5'-terminus of this base sequence : 49562862
  Distance between 3'-terminus of neighbour sequence of sequence listing upward to telomere on chrosomal short arm and 5'-terminus of this base sequence : 71464
gtagtggtaggagcctgtagtcccagctactcgagagtctgaggcaggagaatcgcttcaaccctggaggcgaaggatgcagtgagccaagatggcgccgctgcacttcattcagcctgggcgagagtgagactctgtctcaaacaaaacaaaacaaaacaaaacaaaacaaaacaacaaaacagtaaatatatgtatacataaagtgttttctaaggtgcatttaaatttttaaggatacattttagcagttgctaccttggtggaggcctaggtctttggggtgaagaagagttactttccatttgaaaactgttacagttgcaatttcttact

SEQ ID NO: 20654 - DNA, 118 bp, Homo sapiens
  DISD22_0009263
  Located on chromosome 14
  Distance between a terminus base of telomere on chromosomal short arm and 5'-terminus of this base sequence : 49700585
  Distance between 3'-terminus of neighbour sequence of sequence listing upward to telomere on chrosomal short arm and 5'-terminus of this base sequence : 137387
ggagaataggtgtttcaattgagttttattgaacacacacacacacacacacacacacacacacacacacacacacggagaaacaactaaaaaatgagtctttggatgttcagaattc

SEQ ID NO: 20655 - DNA, 101 bp, Homo sapiens
  DISD22_0009266
  Located on chromosome 14
  Distance between a terminus base of telomere on chromosomal short arm and 5'-terminus of this base sequence : 49817698
  Distance between 3'-terminus of neighbour sequence of sequence listing upward to telomere on chrosomal short arm and 5'-terminus of this base sequence : 116995
tatgccctagagcatgccttccaacatagacacacacacacacacacacacacacacacacacacacacacactccagtggatcaggccaaggctagactt

SEQ ID NO: 20656 - DNA, 335 bp, Homo sapiens
  chr14.fa.O7frz.48218445
  Located on chromosome 14
  Distance between a terminus base of telomere on chromosomal short arm and 5'-terminus of this base sequence : 49986447
  Distance between 3'-terminus of neighbour sequence of sequence listing upward to telomere on chrosomal short arm and 5'-terminus of this base sequence : 168648
ggaacttaatttagaatgtgcttattttgttagattttgtaattaaaaaatggatcccactctgactgaatcagagatgttgaagtcattgatctgggagggtatgttcctgggagtgggtggctgaggtgagatttcaaacaaggttgttgaggaagaggagttcaagtgactgagaggacatattgttggataaattgtgcgtgcgtgtgtgtgtgtgtgtgtgtgtgtgttgaaatcaccaagaatagggaaagaagtgtataagagagtgtggcagtgagcccagagctaaaagaaatcatgagcagggagtaattcacgagcagaaagta

SEQ ID NO: 20657 - DNA, 230 bp, Homo sapiens
  D14S978
  Located on chromosome 14
  Distance between a terminus base of telomere on chromosomal short arm and 5'-terminus of this base sequence : 50067361
  Distance between 3'-terminus of neighbour sequence of sequence listing upward to telomere on chrosomal short arm and 5'-terminus of this base sequence : 80579
aatacattggccccagaggagggtagtccttctctcttgtgtagacacacacacacacacacacacacacggaagttgaggttgcctgtattgggttctggatttcatagttttctaagtcagtcacacgtccagagaaagatgagttggatgatttggaaaccagacaatatggttgtcattttagttattctttcagaagtaatttagtgaatgtccatcatgtagcc

SEQ ID NO: 20658 - DNA, 396 bp, Homo sapiens
  chr14.fa.O7frz.48410012
  Located on chromosome 14
  Distance between a terminus base of telomere on chromosomal short arm and 5'-terminus of this base sequence : 50178163
  Distance between 3'-terminus of neighbour sequence of sequence listing upward to telomere on chrosomal short arm and 5'-terminus of this base sequence : 110572
gtaatcaacctaggtgtccatcaatggatgagaaaatgtgacatatatatatatatatatatatacacacatacatacatacatacataggaatattattcagcctttaaagagaagaaggaaatcctgtcactttcaatgacatggatgaacctggaagacattatgctaagtggtataagccaggcacagaaagccaaatacagcatgatctcacctctttgtagaatctaaaacagtcaaactcaactagtgggatagtggttatcaggggctagggcaaggctagggcagggtgatggtagggggagccagggagaggggttggaaaatgttcttcaaatgatacacaatttcagttagacaggaaacataaattcaggacatctgtacaac

SEQ ID NO: 20659 - DNA, 368 bp, Homo sapiens
  chr14.fa.O7frz.48497094
  Located on chromosome 14
  Distance between a terminus base of telomere on chromosomal short arm and 5'-terminus of this base sequence : 50265139
  Distance between 3'-terminus of neighbour sequence of sequence listing upward to telomere on chrosomal short arm and 5'-terminus of this base sequence : 86580
aacattacgtgaactgagtgatataaggtgtcccattcaaatcaaccaaggcttcttaagggatagatcatttttcatcaatacctgagatatccggcccagaagcttctcaaaaaatgttaatccttttctgttctcatctcagtgcatctcagatttctctgcctcacccttcacacacacacacacacacacacacacacacacactcactcactctctctctctctctctccctccctgatctctacgtgtaatttatgggattcattcattcaacaaatatgtgtcagatactgttctagatgaatggggccatagcagttagagagattttagatctgtgctcacgtgaagcttaaattcta

SEQ ID NO: 20660 - DNA, 480 bp, Homo sapiens
  chr14.fa.O7frz.48585971
  Located on chromosome 14
  Distance between a terminus base of telomere on chromosomal short arm and 5'-terminus of this base sequence : 50356114
  Distance between 3'-terminus of neighbour sequence of sequence listing upward to telomere on chrosomal short arm and 5'-terminus of this base sequence : 90607
aggtttcttatgctatatttgaaatggtataatattacttaaagatggactatgatagtttaaagatgtatactataaactctagaacaaccactagaaataaagcaaagaggcagccaggcacggtggctcacacctgtaatcccagcactttgggaggctcaggcgggaggatcacgaggtcaggagatcaagaccatcctggctaacatgatgaaaccccgtctctactaaaaatacaaaaaaaaaaaaaaaaaattagccgggcgtggtggcggacacctgtagtcccagctactcaggaggctgaggcaggagaatggcgtgatccccggaagcggagcttgcagtgagccaagattgtgccactgcactccagcctgggcgacagagcgagactccatctcaaaaataaataaataaataaataaataaataaataaataaatgaaacaaagaggcataagtgataaagtagaa

SEQ ID NO: 20661 - DNA, 350 bp, Homo sapiens
  chr14.fa.O7frz.48670342
  Located on chromosome 14
  Distance between a terminus base of telomere on chromosomal short arm and 5'-terminus of this base sequence : 50440602
  Distance between 3'-terminus of neighbour sequence of sequence listing upward to telomere on chrosomal short arm and 5'-terminus of this base sequence : 84008
ctcacatagatttaacagatgctctgagccccgcagtgcacttcagttctattctctgcactcgccatggcacttggcaccattaactgcagctctctctgccttgacatctgcaccccactctcccctgtgtgttttttctttgggggtttcttatcaggcgcctcttctttaaatgcttgttttcctttgagccctgtccaaagctctaggttccattttccactttctacgttctatctggtccttcattcaaatttacagctcacatctctgcttttgcctctagcccagatctctctctctctctctctctctctctctctctctgtctttcaaaccttacacaa

SEQ ID NO: 20662 - DNA, 265 bp, Homo sapiens
  chr14.fa.O7frz.48796272
  Located on chromosome 14
  Distance between a terminus base of telomere on chromosomal short arm and 5'-terminus of this base sequence : 50566773
  Distance between 3'-terminus of neighbour sequence of sequence listing upward to telomere on chrosomal short arm and 5'-terminus of this base sequence : 125821
acctcaagcttagaagacaaactcttatttgcacaggtaaacatcggaatgggttttctcctcttcctctcacgttgcgttgtttgtttgtttgtttgtttaagattctttgttttgtttgcaatagttggctttataaggtttgaacaaattcagataaaccaggaatagaggtacatcacttggcgtttcaggaaacagctagaaagcatggatgcacatgtgttgtcttttttaacatatacaaagccaatacttgttctag

SEQ ID NO: 20663 - DNA, 205 bp, Homo sapiens
  D14S1018
  Located on chromosome 14
  Distance between a terminus base of telomere on chromosomal short arm and 5'-terminus of this base sequence : 50648457
  Distance between 3'-terminus of neighbour sequence of sequence listing upward to telomere on chrosomal short arm and 5'-terminus of this base sequence : 81419
gattcctagatggtttgtatgctattaaagttcaagtactggtatgaatttgctgttaaaatactaagcacaaaaacccatcacctaagcagtcctcaattaaagtttataacactccagagcaattgctacacacacacacacacacacacacacacacacacgcagtttctcctgtcacttttaccctcatcccactgaatta

SEQ ID NO: 20664 - DNA, 388 bp, Homo sapiens
  chr14.fa.O7frz.48968537
  Located on chromosome 14
  Distance between a terminus base of telomere on chromosomal short arm and 5'-terminus of this base sequence : 50739066
  Distance between 3'-terminus of neighbour sequence of sequence listing upward to telomere on chrosomal short arm and 5'-terminus of this base sequence : 90404
agtaccaaaccatgtaatgataacttggactttaataaaagggaaatgagttcgaactgaaaaaacaaacaaacaaacaaacaaaaaagaaaagtttcaaatgccagcctgaggatataggttcctgcagaggaggtttagttaggtattcacaggttttaagtgtatcaaggcaagttaagcagtgttcaagtgagaatcatctaggctgaacatgggcccaggagacccaagaagaaaaatgtatagagggcagaagcatgaaggggcccattattataattcacatgacaagggcccagaccaccgtggtactggcaaaaatggagggaggaatgggctaggatgtggtttaaaggttgaagggatagaattcattgcctagctc

SEQ ID NO: 20665 - DNA, 465 bp, Homo sapiens
  chr14.fa.O7frz.49073925
  Located on chromosome 14
  Distance between a terminus base of telomere on chromosomal short arm and 5'-terminus of this base sequence : 50844385
  Distance between 3'-terminus of neighbour sequence of sequence listing upward to telomere on chrosomal short arm and 5'-terminus of this base sequence : 104931
tgctcagttcagacttattcacctgggaggccggcttgaaactgaggcaagggatttgagactgtactcagcctcttaactggtgatttgtttgaaggtgcatgaatgtgtgtcctttgtatgtgggccctgaatgatccctttctctctctctctctctctctttccccttgttcaaacatcatcctcctgattatctcagaagccacctacagccttattcctctcggccaaaagcacctttagctccctctggttggaaacacttcaccttgactggtgacttgcagaggtgggagggatttgttccccaccgtttggttcactgtggcccagggcaacacttgtgcattaattaaggctgtgtaatatagatagatgtagatatagatatagatatagatatagatatagatatagatatagatatagatatagataccaccgtgtaggtctgaggtgctg

SEQ ID NO: 20666 - DNA, 307 bp, Homo sapiens
  AF134201.1_220
  Located on chromosome 14
  Distance between a terminus base of telomere on chromosomal short arm and 5'-terminus of this base sequence : 50932724
  Distance between 3'-terminus of neighbour sequence of sequence listing upward to telomere on chrosomal short arm and 5'-terminus of this base sequence : 87874
gcaagattagacttgcacttaaaggaacaaacgtgatggtccagttgctacgtagcgacagcaaacttatcaactctcctactcagcaatctagcaacagggaacacagcaaactgctaaaccaaacacacacacacacacacacacacacacacacacacatatgtatgtattctgtccaaatgctggaagcaattaaaaggagtaatttgaacaagcaatgctgagcagcacagtaattaataggatactggcctcccaagatttatagggcccactctagtcttcctcttgtcacataccttac

SEQ ID NO: 20667 - DNA, 454 bp, Homo sapiens
  chr14.fa.O7frz.49204531
  Located on chromosome 14
  Distance between a terminus base of telomere on chromosomal short arm and 5'-terminus of this base sequence : 50974788
  Distance between 3'-terminus of neighbour sequence of sequence listing upward to telomere on chrosomal short arm and 5'-terminus of this base sequence : 41757
acaataacctatgaagtgccttgataatatatgaagtgaggccacacgcagtggctcatgcctgtaatgccagcactttgggaagccaaggcagaaggattgcttcagcccaggagttcgagaccagactaggcaacatggtgaaactctgtctctataaaaaatataaaaattagctaggcatagtgccgtgtgcctacagtcctagctacttgggaggctgaggtgggaggatcaattaagctgggaggtcgaggctgcagtgagccatgattgtgccactgcactccagcttgggtgacagggagagaccccatctttctctctctttctctctctctctcactgtgtgtgtgtgtgtgtgtgtgtgtgtagtgaaatttaagtatctaacttttctagttttactaagcagtttataaatgtaattttaggattacatgtgctaagtaaa

SEQ ID NO: 20668 - DNA, 238 bp, Homo sapiens
  chr14.fa.O7frz.49301201
  Located on chromosome 14
  Distance between a terminus base of telomere on chromosomal short arm and 5'-terminus of this base sequence : 51071671
  Distance between 3'-terminus of neighbour sequence of sequence listing upward to telomere on chrosomal short arm and 5'-terminus of this base sequence : 96429
aagtgtatctaccatttgatcaagcaatctcactactggtgcacacacgtttatagtagcacaatttgcaattgcaaaaatacagaaccagcccaaacgcccatgaatcaacaagtggataagaaaatgtgttttatatatatatatatatatatatatatacacacacacacacatacatatatatatgtatacatacacacacattgtggaatactactcagccataaaaggaaag

SEQ ID NO: 20669 - DNA, 239 bp, Homo sapiens
  chr14.fa.O7frz.49435588
  Located on chromosome 14
  Distance between a terminus base of telomere on chromosomal short arm and 5'-terminus of this base sequence : 51198350
  Distance between 3'-terminus of neighbour sequence of sequence listing upward to telomere on chrosomal short arm and 5'-terminus of this base sequence : 126441
cactaatgttacacctcaaggaactggaaaaacaagaacaaacaaaacccaaagctagcagaaaagagatcagaactgaatgaaattgagaccaaacatgcacgcgtgcgcgcgcgcgcacacacacacacacacacacacacgatcaatgaaatgaaaagttgattcttggcaaagacaaacaaaattggtaggcaaacaaaagaagagagaggattcaaataagaacaatcagaaac

SEQ ID NO: 20670 - DNA, 466 bp, Homo sapiens
  chr14.fa.O7frz.49542187
  Located on chromosome 14
  Distance between a terminus base of telomere on chromosomal short arm and 5'-terminus of this base sequence : 51304809
  Distance between 3'-terminus of neighbour sequence of sequence listing upward to telomere on chrosomal short arm and 5'-terminus of this base sequence : 106220
ctatcaatggtttcaacatcacaggtacaatcatccaagtaaccactaacctgttacaaagaaaatgaaatattaaattgaaatgtcctaaatgcaacagggttctttttcctcacatggttgttaggaaacagccccctactcaaccagtccttatcctccctcctcccacatagtttcttgagatggggtatgacaataatctagtaatactgctgctcttgctatataccgaggaatggaaggtgtgcagagctcatgacacacacacacacacacacacacacacacacagagagagttggccccctggcaacctttattttgtaactctgccctccaggccatagttgacctgaccaagggtaggcatccaactcaaaccaggtcatggtcccctctccaggatcctagaattgagaataacagggaaagatgtctccctgtggctagaccagtaaaacaa

SEQ ID NO: 20671 - DNA, 442 bp, Homo sapiens
  chr14.fa.O7frz.49784472
  Located on chromosome 14
  Distance between a terminus base of telomere on chromosomal short arm and 5'-terminus of this base sequence : 51547266
  Distance between 3'-terminus of neighbour sequence of sequence listing upward to telomere on chrosomal short arm and 5'-terminus of this base sequence : 241991
catgttctaatctagactctggactatgttctaaataaacatttctgatttccagaatggcaggcttggtatttcaaacattagatgaccaagtgcaacacacacacacacacacacacacacacacacacacacacacactcagcctggcacttggccagaagttagcaaacatcaccggagtagattcattcatctgcattataaaaccattcaaggcatagactacgctcaaaaacttgctctgagagtccatttctccaaggtcatgattttcagttatcctccaggtacaggccaacttttattcagtatatcttatattttaaattttgatgttaaactttcagaagtaacccatcacaaatacaagctttctcaaaaaggctcgggggtggggcgtggggggtaaaaagctgtactattatgaagccatcacttg

SEQ ID NO: 20672 - DNA, 384 bp, Homo sapiens
  chr14.fa.O7frz.49865952
  Located on chromosome 14
  Distance between a terminus base of telomere on chromosomal short arm and 5'-terminus of this base sequence : 51628608
  Distance between 3'-terminus of neighbour sequence of sequence listing upward to telomere on chrosomal short arm and 5'-terminus of this base sequence : 80900
gttacctaggacgtagtaagcataaagtgatgataatggtgattggctgggcatggtgactcacacttgtaatctcagctctttgcgaggcagaggtgggaggatcacttgagcccaggagttggagaccagcctgggaaacataatcagatcccatctctccaaaagaaaaaaaaaaaagaagaagaagaaggaaaaggatgatactggttaaaagagtaatacaaaaggaactctgtgtgtgtgtgtgtgtgtgtgtgtgtgtgtgtgtgtgtgtaaaaagagaggagcaagaaaaaacgaatggacaaaatagagtaataccgcaactgggctatggacattttgaacaaacctaaatctgtgtgataccatggaccagtg

SEQ ID NO: 20673 - DNA, 418 bp, Homo sapiens
  chr14.fa.O7frz.50218830
  Located on chromosome 14
  Distance between a terminus base of telomere on chromosomal short arm and 5'-terminus of this base sequence : 51981445
  Distance between 3'-terminus of neighbour sequence of sequence listing upward to telomere on chrosomal short arm and 5'-terminus of this base sequence : 352453
gcagtgacatgacaggatctatactttaggaaaatcacttaggctacagcatagagcatcagtagtgagggcagtgatggctgcgtggagaccagttatgtcaccattgaggtaatccaggcagaagatgcatgaccaggaatgtggtaatggcagtgcaggtggaaagaaatagatggaatcaaaagatagttagaagataggagggctggaacgtggttatcaatcaggtgtgtggaagagacagcagttaaagatgaagcccagggtctttctagtctatatctctatgttcttgaaaatggtgtgtgtgtgtgtgtgtgtgtgtgtgtgtttaaatctcaaattattttgacttcagggcagttgctgtcatgtcatctagtcagacattctatcatgacatagaaatcctcat

SEQ ID NO: 20674 - DNA, 193 bp, Homo sapiens
  HUMUT7952
  Located on chromosome 14
  Distance between a terminus base of telomere on chromosomal short arm and 5'-terminus of this base sequence : 52104693
  Distance between 3'-terminus of neighbour sequence of sequence listing upward to telomere on chrosomal short arm and 5'-terminus of this base sequence : 122830
taaagcgcagctgatggtgccaacgaaattttgttgccttgctctgggcatgagcctcattttatacaatgtacaaatacataaatttcttttctttctttctttctttctttctttctttctttctttctttctttcttttctttcattttcttcttttgagacagtctcactctgtcatccatgctggact

SEQ ID NO: 20675 - DNA, 246 bp, Homo sapiens
  HUMUT1569
  Located on chromosome 14
  Distance between a terminus base of telomere on chromosomal short arm and 5'-terminus of this base sequence : 52123696
  Distance between 3'-terminus of neighbour sequence of sequence listing upward to telomere on chrosomal short arm and 5'-terminus of this base sequence : 18810
aggtcttcgttccaataacctccagaattatcttatctctacatattttgtgtatctgtgtcttccttccttctttccttccttccttccctccttccttccttctttccttccttccttccttccttccttccttccttccctcctcccttcctccctcccttctttctttcctcccttcctcccttccttccatctttcgcttttctatacattctctatataaagagacttgaacagttccca

SEQ ID NO: 20676 - DNA, 472 bp, Homo sapiens
  chr14.fa.O7frz.50566280
  Located on chromosome 14
  Distance between a terminus base of telomere on chromosomal short arm and 5'-terminus of this base sequence : 52297571
  Distance between 3'-terminus of neighbour sequence of sequence listing upward to telomere on chrosomal short arm and 5'-terminus of this base sequence : 173629
gattagatggtagacattgtgaattttaccttgatgggggctgaaacttttggtattcctctaaatattttctttattatattatattatattatattatattatattaattatattatattattttttttgagacagagtcttgctctgttgcccaggttggagtgcagtggtgcgatcttggctcgctgcaacctccacctcctgggttcacgcgattctcctgcctcagcctcctgagtagctgggattacaggcatgtgccaccacacccagctaatttttctatttttagtggagatggggtttcaccatgttggccaggatggtctcaatctcttgacctcgtgattttcccgcctcggcctcccaaagtgctgggattacaggcatgagccactgtgcctggcctcctctaaatattttcaagctttggtctggaacacagttatctggaaatagtttgatcttt

SEQ ID NO: 20677 - DNA, 403 bp, Homo sapiens
  chr14.fa.O7frz.50660050
  Located on chromosome 14
  Distance between a terminus base of telomere on chromosomal short arm and 5'-terminus of this base sequence : 52391329
  Distance between 3'-terminus of neighbour sequence of sequence listing upward to telomere on chrosomal short arm and 5'-terminus of this base sequence : 93286
gaagctgaaaggagcctagctgagctgatggagacaccacatgcaggcggttttaggagtcaaagtcacacagagacaaaggcgcatgcacatacacacacacacacacacacacacacgtcacacacacacacatacacacacactcactcaatcagggaaataagtaaaggcaggctgacccagaaaggggcagagaaacattgaggggaaaaagtaacattcagatagggaaaatgtatcccccaaaaaagtatctcaagggacatgactatttctaaatgcccttgttttgcattttcatatagatgtacttgctatgtcaaaaaagtctaagtgacacctttcagtaggttaacagtacccagttaattaaacttactaatttgtcaaatgtctggac

SEQ ID NO: 20678 - DNA, 324 bp, Homo sapiens
  chr14.fa.O7frz.50789844
  Located on chromosome 14
  Distance between a terminus base of telomere on chromosomal short arm and 5'-terminus of this base sequence : 52521025
  Distance between 3'-terminus of neighbour sequence of sequence listing upward to telomere on chrosomal short arm and 5'-terminus of this base sequence : 129293
tcaccatgttagtcaggctgatcttgaactcctgaccacccacctcggcctcccaaagtgctgggattacaggcatgagccaccaagcctggccaaagaagtttatttttaaaagcaaggaagaagagagaaagagagagaaaaagaagaaggaatgaaggaaagaagggagggagggaaggaggaaggaaagaaggaaggaaggaaggaaggaaggaaggaaggaaggaaggaaggaaggaaggaaggaaagaaaaaaaaaagaacaaggaaagaaaaaggcaagaaagaaagctttccaggttctacctctggatgctaatc

SEQ ID NO: 20679 - DNA, 206 bp, Homo sapiens
  Z67708
  Located on chromosome 14
  Distance between a terminus base of telomere on chromosomal short arm and 5'-terminus of this base sequence : 52677847
  Distance between 3'-terminus of neighbour sequence of sequence listing upward to telomere on chrosomal short arm and 5'-terminus of this base sequence : 156498
cacagccagtgatggtgaagtcacaactgagcctcccagcaaaaagggtctgaaagatggcttgagccacagctgtggtgccctggagactgtagctgcacctcagttgcagctctgtgtgcgtgcgtgcgtgtgtgtgtgtgtgtgtgtgctgattccactgctcttcctctgcttctaggttggtctaggtgggagccccaaat

SEQ ID NO: 20680 - DNA, 289 bp, Homo sapiens
  D14S584
  Located on chromosome 14
  Distance between a terminus base of telomere on chromosomal short arm and 5'-terminus of this base sequence : 52721898
  Distance between 3'-terminus of neighbour sequence of sequence listing upward to telomere on chrosomal short arm and 5'-terminus of this base sequence : 43845
taatttacccctggctctcctgttctctaacttgcagacagcatactgtgggacttctccgcctctgtaatcacatgaggcaattcccataataaatctctctctcgatagatagatagatagatagatagatagatagatagatagatagatcttatatatctatatatatatacccttttcctaaagacaacacagaaggccatagaccaggacaaccacagagactctgatatgtctgtgaaataggtttttattacattaagctcaggacttatttgttacactg

SEQ ID NO: 20681 - DNA, 201 bp, Homo sapiens
  G09068
  Located on chromosome 14
  Distance between a terminus base of telomere on chromosomal short arm and 5'-terminus of this base sequence : 52721939
  Distance between 3'-terminus of neighbour sequence of sequence listing upward to telomere on chrosomal short arm and 5'-terminus of this base sequence : -248
catactgtgggacttctccgcctctgtaatcacatgaggcaattcccataataaatctctctctcgatagatagatagatagatagatagatagatagatagatagatagatcttatatatctatatatatatacccttttcctaaagacaacacagaaggccatagaccaggacaaccacagagactctgatatgtctgt

SEQ ID NO: 20682 - DNA, 393 bp, Homo sapiens
  chr14.fa.O7frz.51095347
  Located on chromosome 14
  Distance between a terminus base of telomere on chromosomal short arm and 5'-terminus of this base sequence : 52826564
  Distance between 3'-terminus of neighbour sequence of sequence listing upward to telomere on chrosomal short arm and 5'-terminus of this base sequence : 104424
tcaatcatagaggatttgaagtagtagaaatttaggacaattgacctgggactataaaagtggcagaatgaagcctccccagattcacgtggaatccgtgctgaaacaatatcctgagtgactgtgttcccaaatctgctgtcattgttggttctaacccaggtaaagtagggtgcgtgtgtgtgtgtgtgtgtgtgtgtgtgtgtgtggtcaaagacccaaggtcatggtaaggagcacaccagctctcttacttggccttcatggaccaaaagagaaactgggagatccaaacccatatgcctaaacctgtaacacagagggctatttttacccaggcaagaatctaatgatcagagcaaagaggaagcaatgtgaagccatcaagatgag

SEQ ID NO: 20683 - DNA, 213 bp, Homo sapiens
  Z67699
  Located on chromosome 14
  Distance between a terminus base of telomere on chromosomal short arm and 5'-terminus of this base sequence : 52925493
  Distance between 3'-terminus of neighbour sequence of sequence listing upward to telomere on chrosomal short arm and 5'-terminus of this base sequence : 98536
ttgctttaccctaatatcactatgcacactacacacacacacacacacacacacacacacacacacacacatgcagattttccagaaataataatagtggttgttatcaacttgcttctaaacagcctttccctcctaggaaactttctaataatgaattgattttcctatcaacttcagggaagtttttattcctgcagacacacatttggg

SEQ ID NO: 20684 - DNA, 347 bp, Homo sapiens
  chr14.fa.O7frz.51293289
  Located on chromosome 14
  Distance between a terminus base of telomere on chromosomal short arm and 5'-terminus of this base sequence : 53024493
  Distance between 3'-terminus of neighbour sequence of sequence listing upward to telomere on chrosomal short arm and 5'-terminus of this base sequence : 98787
gtaggagaattgctttgacaggaggcaggggttgcagtgagccgagatcgcaccactgcactccagcctggcaacagagcgagactctgtctcaaaaaaaaaaaaaaaagaataatagtctccagttccacccgggttgctgtgaatgccattttgttccttttcatggctgagtagtattccatggcatgtgtgtgcgtgtgtgtgtgtgtgtgtgtgtgtgtatgtatatctcacattttctttttttattatactttacaaccccactttttgatggggatgtttgtttttttcttgtaaatttgtttaagttccttgtagattctggatattagacctttgtc

SEQ ID NO: 20685 - DNA, 321 bp, Homo sapiens
  chr14.fa.O7frz.51459675
  Located on chromosome 14
  Distance between a terminus base of telomere on chromosomal short arm and 5'-terminus of this base sequence : 53191007
  Distance between 3'-terminus of neighbour sequence of sequence listing upward to telomere on chrosomal short arm and 5'-terminus of this base sequence : 166167
ttagagcttcgtcttcagaataatatgcaggtgacgctagagactagtaaaatgacatttgcagcatatatatatatatatatatatatatatatatatatatatatatatatataatgcggttaagcttactgctcgtgacattatccatattgatacggatcttgtagaaaaaaagggtcttggagaaaggacaggcatgaagtgggttacttaatgcttttcgttaggaaactttactgaatagaacagaatcgtttcatattaccctgctagtatttacagacacctcaactagtatggaaagtgaatatagtcgaa

SEQ ID NO: 20686 - DNA, 173 bp, Homo sapiens
  D14S281
  Located on chromosome 14
  Distance between a terminus base of telomere on chromosomal short arm and 5'-terminus of this base sequence : 53262095
  Distance between 3'-terminus of neighbour sequence of sequence listing upward to telomere on chrosomal short arm and 5'-terminus of this base sequence : 70767
gatgctagggatgcctgctacttgcctacctcgagcagatgttctgaatgtcaagtcagcattgcttgaaacacacacacacacacacacacacacgtacacaccactgttactagttctgctatgtctggctcatagacaaggatgtaaagaagcagtctaacattctgcca

SEQ ID NO: 20687 - DNA, 159 bp, Homo sapiens
  D14S991
  Located on chromosome 14
  Distance between a terminus base of telomere on chromosomal short arm and 5'-terminus of this base sequence : 53379664
  Distance between 3'-terminus of neighbour sequence of sequence listing upward to telomere on chrosomal short arm and 5'-terminus of this base sequence : 117396
attctacatgattcctgggaagttatattttatagaaagtgtccaacattattcgttatgtatttggtttctttatttgtgtgtgtgtgtgtgtgtgtgtgtgtgtgtgtgtgtgtgtgtgttttgttttgttttgtttggtgtggttgcctccaatag

SEQ ID NO: 20688 - DNA, 270 bp, Homo sapiens
  chr14.fa.O7frz.51727698
  Located on chromosome 14
  Distance between a terminus base of telomere on chromosomal short arm and 5'-terminus of this base sequence : 53458914
  Distance between 3'-terminus of neighbour sequence of sequence listing upward to telomere on chrosomal short arm and 5'-terminus of this base sequence : 79091
ttaggctagtcattcttaactgagggagcccaccagaataaccaagggcaattttctttttcaaactataattacaaatactgaatagttcctcacagggtacagaaacattgtctaaaagttccctaggtgatttggataggcacacatggccaatagtccctcatttaaataaacgtgtgtgcgtgtgtgtgtgtgtgtgtgtgtgtgtgtgtgtgtaaatatgccttaaatatttggggaagtatatgtaagaaagtggtaaagtgg

SEQ ID NO: 20689 - DNA, 258 bp, Homo sapiens
  DISO7_10004943
  Located on chromosome 14
  Distance between a terminus base of telomere on chromosomal short arm and 5'-terminus of this base sequence : 53537810
  Distance between 3'-terminus of neighbour sequence of sequence listing upward to telomere on chrosomal short arm and 5'-terminus of this base sequence : 78626
tgagattacaggcatgcgccacccactaagcccggccccaacagaaagaaaagaaaagaaaagaaaagaaaagagaagagaagagaagagaagagaagagaagagaagagaagagaagagaagagaagagaaaagaaaagagaaaagaaaagaagaaaagaaaagaaaagaaaaggaaaaggaagatgattcgtggggagagtgacaagaaaaattagaaggagactagtgggaaattgcatttataatcatggcgtc

SEQ ID NO: 20690 - DNA, 451 bp, Homo sapiens
  chr14.fa.O7frz.52351832
  Located on chromosome 14
  Distance between a terminus base of telomere on chromosomal short arm and 5'-terminus of this base sequence : 53880087
  Distance between 3'-terminus of neighbour sequence of sequence listing upward to telomere on chrosomal short arm and 5'-terminus of this base sequence : 342019
tttcattgaagtctttaggcttttattgcaatggtagctgtccataagcaataccaagtattgttgtgtgtgtgtgtgtgtgtgtgtgtgatttgtatgtttttaagatttgaataaatggtagcatatagtgtatgttgttttgcaatttgcttttatcacatgaacaaaacgttttctggccctttctctatttttttccctaatgaatagggaaaataatacgtagggaaaaaatagtttgcattttcttaagtatttgaaaacagcttttaaaaaataattaggtacttgtgagtctggctctggatttagattttaccgacagttccataagactgacagggaatcaaataaaagggtactcagactggactaaaatgttgtcaggttttttactttgatctctattgctaaaaaaaaaattgtcagattcaattgtcacttagat

SEQ ID NO: 20691 - DNA, 179 bp, Homo sapiens
  chr14.fa.O7frz.52430883
  Located on chromosome 14
  Distance between a terminus base of telomere on chromosomal short arm and 5'-terminus of this base sequence : 53959232
  Distance between 3'-terminus of neighbour sequence of sequence listing upward to telomere on chrosomal short arm and 5'-terminus of this base sequence : 78694
caggatgtatctgtaagagatgaggactcaaaaatgcatacacacattttgagaacttcccagaaatgtaaaaaaaaaaaatgctatacacatatagaatatatacatgcacgcacacacacacacacacacacacacatatatactattttatggtctgtctgactcagaatcctatg

SEQ ID NO: 20692 - DNA, 462 bp, Homo sapiens
  chr14.fa.O7frz.52644761
  Located on chromosome 14
  Distance between a terminus base of telomere on chromosomal short arm and 5'-terminus of this base sequence : 54172862
  Distance between 3'-terminus of neighbour sequence of sequence listing upward to telomere on chrosomal short arm and 5'-terminus of this base sequence : 213451
aaattgagtctaacaatgttcaagtgggatttatctcaggtatgcaaggttggttcaacacttgaaaatcaattaatgtaactcatcacaacagataaaaggggaaaaatcataagatcatatcaatagatgcaaaaaaaagtgataaaatctatcatcaattcatgataaaagctcttagcaaatgaggaataagggggaacatctacaacttgataaagaacagctataagccaggtgtggtggtgtgtgcttgtagtcccacccactcgggatcaattgagcctgggaggtggaggttgctgtgagcagagatcataccactgctctctaatgtgggtgacagagtgagacccttgtctcaaacacacacacacacacacacacacaccacagctacaaaaaacttatagctaacaacatacttatggtgagaaacttattgtcaaaggatagacaaag

SEQ ID NO: 20693 - DNA, 437 bp, Homo sapiens
  chr14.fa.O7frz.52740435
  Located on chromosome 14
  Distance between a terminus base of telomere on chromosomal short arm and 5'-terminus of this base sequence : 54268788
  Distance between 3'-terminus of neighbour sequence of sequence listing upward to telomere on chrosomal short arm and 5'-terminus of this base sequence : 95464
caggatttatgcacttgtctacgtaaatgttacaccttagtatagaaaaaaaatcaattaaaagagcccatgtttgtctgtctttctttctttcttcctttttttcctttctttccttcctttcctttccttttccttttccttttccttttcctttcctttcctttcctttcctttcctttcctttcctttcctttcctttcctttcctttcctttcctttcctttcctttccttctctctttctctctctttctctttctctttccttctcttttcttcttttctttctttttttttggacttgcgaggtcttagagtctggattctttgtatttgaagaattgaattaatgtaaaggaagtgaggcagattgtcttaaggttatcttttctagtgattaagatttttttcataagatactaattcattttgcca

SEQ ID NO: 20694 - DNA, 476 bp, Homo sapiens
  chr14.fa.O7frz.52852652
  Located on chromosome 14
  Distance between a terminus base of telomere on chromosomal short arm and 5'-terminus of this base sequence : 54381069
  Distance between 3'-terminus of neighbour sequence of sequence listing upward to telomere on chrosomal short arm and 5'-terminus of this base sequence : 111844
tgtaatataattctgcaagcagtaactgatgaatttcagaaaatggagactctgtgtgtgtgtgtgtgtgtgtgtgtgtgtgtgtgtgtgtgtttgttttgcagggagtaaaaattttggggggcttctcagtttcttttattctgtgccaaacgtttcctaggattagatcacttttggaacttcaggtcctcacagagcagttgatagataagatcatatgggatattactttccacatttggttacttatgcagtctatcttgaactaaaagctattgtcccaaatagggggcttttgtgtggtgctggtgaacacaggggtgctatcctgtcaccatgacagcaagcatttgcattaagagcaggctcctcaggccacattacagtcatgtggtctagagggacccctttgaagctcctgtaatcttttccgagctgattgttaacatctgaacataatcattaaccatgtt

SEQ ID NO: 20695 - DNA, 356 bp, Homo sapiens
  chr14.fa.O7frz.52932665
  Located on chromosome 14
  Distance between a terminus base of telomere on chromosomal short arm and 5'-terminus of this base sequence : 54460961
  Distance between 3'-terminus of neighbour sequence of sequence listing upward to telomere on chrosomal short arm and 5'-terminus of this base sequence : 79416
cagacttctacaagcttcacaggacctttcaactcaaactattttcatgacaccacctagccactttgattgacttctgtttgccaccagaattgtcagattgttttaggctcaggtctttttggccttcttgagtttttattggtcctctgttaaggaagtgaggtcatgatcaggtgtgtgtgtgtgtgtgtgtgtgtgtgtgtgtgtatgaagatgactctgactttgtatatgaacgttcatggcagcatgcttatagccaaaagtggaaataaacatccatcaacagatgaaaagataaacaaatagtggtatacccatccaatggaatgttactcattcaaacgaatgag

SEQ ID NO: 20696 - DNA, 394 bp, Homo sapiens
  chr14.fa.O7frz.53004097
  Located on chromosome 14
  Distance between a terminus base of telomere on chromosomal short arm and 5'-terminus of this base sequence : 54532481
  Distance between 3'-terminus of neighbour sequence of sequence listing upward to telomere on chrosomal short arm and 5'-terminus of this base sequence : 71164
gctaatacaaggctaattgctctgtcataggtgagtgagttgttagacacttaaatccctgtaagggaattctctccatttgtcaggggacacacacacacacacacacaaacacacacacaatctcagatgttcagaggagattatgaaagtgagaatcactttgtccttatttctacatctattggctcttccaggtacagggtattctaggatgaaaatgtggtcctctcctgtcaagggcatgcagtctagcagaagcttcagtgatcttaacaaggacgcacagcaacatgggattatttaaccgtaatggtgacaataacagcaaccacttattgggagcttaccctgtgtcaggcactgagctgtgattgacattctacctcattta

SEQ ID NO: 20697 - DNA, 150 bp, Homo sapiens
  D14S1064
  Located on chromosome 14
  Distance between a terminus base of telomere on chromosomal short arm and 5'-terminus of this base sequence : 54659309
  Distance between 3'-terminus of neighbour sequence of sequence listing upward to telomere on chrosomal short arm and 5'-terminus of this base sequence : 126434
agctggctaggaaatgcttttttggttttcatgagatgcatgtgggtgtggtggcacacacacacacacacacacacacacacacacacacacacacacatacacacacacagcctttgccaagaggtgcccactggggctcttattacc

SEQ ID NO: 20698 - DNA, 116 bp, Homo sapiens
  G09070
  Located on chromosome 14
  Distance between a terminus base of telomere on chromosomal short arm and 5'-terminus of this base sequence : 54707440
  Distance between 3'-terminus of neighbour sequence of sequence listing upward to telomere on chrosomal short arm and 5'-terminus of this base sequence : 47981
tctgtaggcaaatactgttggatcatatatatatatatatctatatctatctatctatctatctatctatctatctatctatctgtcattcctaggggaagagacaccagggtctt

SEQ ID NO: 20699 - DNA, 194 bp, Homo sapiens
  D14S1056
  Located on chromosome 14
  Distance between a terminus base of telomere on chromosomal short arm and 5'-terminus of this base sequence : 54804220
  Distance between 3'-terminus of neighbour sequence of sequence listing upward to telomere on chrosomal short arm and 5'-terminus of this base sequence : 96664
gcgtgctactgttgtgtaatctctatttgtgtagtgtttattcatgtatgtatttgctcttagaataatactcagaggtatttctctgattatgtaatgtgtgtgtgtgtgtgtgtgtgtgtgtgtgtgtttttaaattaaaagtcctgttttacttctggccattctgttgcataggcatagggcttttagca

SEQ ID NO: 20700 - DNA, 226 bp, Homo sapiens
  AC022462.4_96870
  Located on chromosome 14
  Distance between a terminus base of telomere on chromosomal short arm and 5'-terminus of this base sequence : 54897377
  Distance between 3'-terminus of neighbour sequence of sequence listing upward to telomere on chrosomal short arm and 5'-terminus of this base sequence : 92963
tactggtacctttgctagtgagaagtagggaaggtgaggggaagacctgaagaaagaaactctaaatctcatcttgtatctgtagcagttcattcgttcattcattcattcattcattcgtttgacattcattgaatgcctgccacactgttgatgctggggtggaaaaataaataagactgaacgtgtgttcgaggcacatgcagtgttatgagaacagaggtgg

SEQ ID NO: 20701 - DNA, 463 bp, Homo sapiens
  chr14.fa.O7frz.53576021
  Located on chromosome 14
  Distance between a terminus base of telomere on chromosomal short arm and 5'-terminus of this base sequence : 54968088
  Distance between 3'-terminus of neighbour sequence of sequence listing upward to telomere on chrosomal short arm and 5'-terminus of this base sequence : 70485
caaattagtacaggttgagcatccctaatctgaaaatccaaaatccaaaatgcttcaaaaatccaaaactttttgaaaatgcttatcagtagcatataaattcagagtcagagatgatggtgatgctaaataccagattttccacatgggtggctgagatagtgacacctttgctttctgatggttcaacgtacacaaacgttgtttcatacacaaaattatttaaaatattatataaaattaaatgtaagctatgtgtataaggggtgtgtgtgtgtgtgtgtgtgtgtgtgtgtgtgtgtgtgtgtgtatgtgtgtttagacttgggtcccatccccaagatatcttcattatgtatataatatatgcaaatattccaaattccaaaaaaaaaataaaaaatctgaaactcaagtgttcccaggctttttggataagggacactcgaccagtatcacctga

SEQ ID NO: 20702 - DNA, 168 bp, Homo sapiens
  D14S282
  Located on chromosome 14
  Distance between a terminus base of telomere on chromosomal short arm and 5'-terminus of this base sequence : 55102087
  Distance between 3'-terminus of neighbour sequence of sequence listing upward to telomere on chrosomal short arm and 5'-terminus of this base sequence : 133536
taaatcctgcaaattcatgattttgcatgattttgaccagtctgctctttaattttaaacccaaagagtgtgtgtgtgcatgtgtgtgtgtgtgtgtgtgtgtgtgtgtgtgtgtgttgggcaacagatggagagtagggcaaacagatgcactatatttcttaatcg

SEQ ID NO: 20703 - DNA, 183 bp, Homo sapiens
  D14S285
  Located on chromosome 14
  Distance between a terminus base of telomere on chromosomal short arm and 5'-terminus of this base sequence : 55130150
  Distance between 3'-terminus of neighbour sequence of sequence listing upward to telomere on chrosomal short arm and 5'-terminus of this base sequence : 27895
ctggcctgggcaatagagtgagaaccatgaggctccatctcaaaaataaataaatatataaataaataatactacctgtatgagtgtctgatagaatacctgagagaaagtgtgtgtgtgtgtgtgtgtgtgtgtgtgtgtgtgtgtgtgcatacctggggctgggaaacttgggggccatgt

SEQ ID NO: 20704 - DNA, 190 bp, Homo sapiens
  D14S66
  Located on chromosome 14
  Distance between a terminus base of telomere on chromosomal short arm and 5'-terminus of this base sequence : 55206413
  Distance between 3'-terminus of neighbour sequence of sequence listing upward to telomere on chrosomal short arm and 5'-terminus of this base sequence : 76080
cgttcagtaagcagagagcagccattgagaaattttagactagggatgcaatccagccttttgtgtgtgtgtgtgtgtgtgtgtgtgtgtgtgtgtgtatgtgtttaggggcatgggggaaggcaggtgttgattataagtgatttcagtatgaagatgaattgaagtaggattggtcaagtctgttgcc

SEQ ID NO: 20705 - DNA, 160 bp, Homo sapiens
  D14S980
  Located on chromosome 14
  Distance between a terminus base of telomere on chromosomal short arm and 5'-terminus of this base sequence : 55308332
  Distance between 3'-terminus of neighbour sequence of sequence listing upward to telomere on chrosomal short arm and 5'-terminus of this base sequence : 101729
ctgggcaacaagagtggaactccgtctcagaaaacacacacacacacacacacacacacacacacacacagagagagagagagagagagagagagaaagaaaagaaagttaatgccagaagaaaaaacaaaaaatctctcttagagaattgtcccgcttc

SEQ ID NO: 20706 - DNA, 307 bp, Homo sapiens
  AC023079.2_94120
  Located on chromosome 14
  Distance between a terminus base of telomere on chromosomal short arm and 5'-terminus of this base sequence : 55448554
  Distance between 3'-terminus of neighbour sequence of sequence listing upward to telomere on chrosomal short arm and 5'-terminus of this base sequence : 140062
ttcttacatgcacttccattattaactaaaaaattaactaaagaaccatgtgcttctttactggtttttgtgttttatatgaggacatttgtatgtggttcgtatatacaacacattcttctcccaagaatgccaaaaacaaagaaaaggaaaggaaggaaggaaggaaggaaggaaggaaggaaggaaggaaggaaggaaaagaaagaaagagaaacgtaacaggcatggccgaagaagcactctagcactctactcttgagacttgggctgaatacagggcctactttggtcactgttctttaaa

SEQ ID NO: 20707 - DNA, 227 bp, Homo sapiens
  chr14.fa.O7frz.54169284
  Located on chromosome 14
  Distance between a terminus base of telomere on chromosomal short arm and 5'-terminus of this base sequence : 55561523
  Distance between 3'-terminus of neighbour sequence of sequence listing upward to telomere on chrosomal short arm and 5'-terminus of this base sequence : 112662
tactgaagatccagttctatcaattatctctgtccctaagtcttcattcttcttttctagggcttccttctcccagcaaaataaatgtattcaagctattgccatcttaaaacacacacacacacacacacacacacacacacacacgcacgcacacacaccacgtttcttgaacctgtgtctccctgactactgacagatgaagtattgatacatgctacagttca

SEQ ID NO: 20708 - DNA, 257 bp, Homo sapiens
  chr14.fa.O7frz.54300490
  Located on chromosome 14
  Distance between a terminus base of telomere on chromosomal short arm and 5'-terminus of this base sequence : 55692692
  Distance between 3'-terminus of neighbour sequence of sequence listing upward to telomere on chrosomal short arm and 5'-terminus of this base sequence : 130942
aaactcctactgagcatcagtaactcagtgtgaacaaggttagtgaaccatattaaaggaatagtattgccttttcattttcatttcaatgagattcaacttataataaatatatttgcatactgatactgcaaataaaatccaaaaattacaaacacacacacacacacacacacaacaataacaacaacacatagacattttcacatacttggaatgtaaacaatttcccaatcttcaagaacattgctagactg

SEQ ID NO: 20709 - DNA, 155 bp, Homo sapiens
  D14S607
  Located on chromosome 14
  Distance between a terminus base of telomere on chromosomal short arm and 5'-terminus of this base sequence : 55774287
  Distance between 3'-terminus of neighbour sequence of sequence listing upward to telomere on chrosomal short arm and 5'-terminus of this base sequence : 81338
attgccctgaagggattatcggtaaaaaaaaaaatagatagatagatagatagatagatagatagatagatagatagatgatagatagatagatagatgctaaaggtgatattacaggcctctgatgaggcctcagaaagaaaagaggagagcta

SEQ ID NO: 20710 - DNA, 300 bp, Homo sapiens
  Z24067.1_257
  Located on chromosome 14
  Distance between a terminus base of telomere on chromosomal short arm and 5'-terminus of this base sequence : 55815134
  Distance between 3'-terminus of neighbour sequence of sequence listing upward to telomere on chrosomal short arm and 5'-terminus of this base sequence : 40692
tacctcacatgcctaggacagtgcatagtaggtgctcaataaatatttactgaattgaacaaatgacaagataaacccttgaatgctaattgggcatctatcctaggataataagaacttgtgcggtagagtcttgtggtgatggttaactggaaatgtgtgcattgacttctgaactttgggcacccttccatggagagcaaaggagacactgggggctctacacacacacacacacacacacacacacacacacacacacacttgttctgttgctcatttgctggtttgtcagataac

SEQ ID NO: 20711 - DNA, 124 bp, Homo sapiens
  D14S274
  Located on chromosome 14
  Distance between a terminus base of telomere on chromosomal short arm and 5'-terminus of this base sequence : 55815306
  Distance between 3'-terminus of neighbour sequence of sequence listing upward to telomere on chrosomal short arm and 5'-terminus of this base sequence : -128
tgaactttgggcacccttccatggagagcaaaggagacactgggggctctacacacacacacacacacacacacacacacacacacacacacttgttctgttgctcatttgctggtttgtcaga

SEQ ID NO: 20712 - DNA, 440 bp, Homo sapiens
  chr14.fa.O7frz.54517117
  Located on chromosome 14
  Distance between a terminus base of telomere on chromosomal short arm and 5'-terminus of this base sequence : 55909229
  Distance between 3'-terminus of neighbour sequence of sequence listing upward to telomere on chrosomal short arm and 5'-terminus of this base sequence : 93799
aggattgttatgaggtttagataagattatattgacttagtatgatgcttagtgtatagtatagatttagtagatactagagatgattcttatttaaaacttttaaatatctttagcaaatgttgcaatcaataagcattatttagcaccttctctattctatcaataggaagacaataaaaaagacgtttcctgattttagtatgtttaatggttggtaaagtatagatctatatgtgtgtacacacacacatacacacacacacacacacacacacgaaacatatgaaaatatgagacaagaaacaatttataaatgaatcaaaagtatttaattcagatcaaatagaaatatgtaacatcgaatagtagctaaaatgaggtagagttatctaaacttaaacaacctttttgcctcatacattaaggagaataaagct

SEQ ID NO: 20713 - DNA, 391 bp, Homo sapiens
  chr14.fa.O7frz.54611904
  Located on chromosome 14
  Distance between a terminus base of telomere on chromosomal short arm and 5'-terminus of this base sequence : 56003460
  Distance between 3'-terminus of neighbour sequence of sequence listing upward to telomere on chrosomal short arm and 5'-terminus of this base sequence : 93791
gcactctagtcagcgtgactgggtgacacagtgagaccatttcgaaataaagaaagaaagaaagagagagagagagaaagaaagaaaggaaggaaggaaggaaggaaggaaggaaggaaggaaggaaggaaggaaggaaggaaggagaaagaagaaagaaagagaaagaggaagaaggaaagaaaggaaggaaggagaaaagggaaaggaaagggaaggcaaggaagcttcagcaattagctcagatacagcatccaattgaatggctgtagataagtggggtgcccctaccccgctaaaagaatggggaaggtcctttccttcctgatactttccctcttaatactttttttttggacaaagagcaaaatagagttaggtgatggattcc

SEQ ID NO: 20714 - DNA, 154 bp, Homo sapiens
  HUMUT534
  Located on chromosome 14
  Distance between a terminus base of telomere on chromosomal short arm and 5'-terminus of this base sequence : 56097691
  Distance between 3'-terminus of neighbour sequence of sequence listing upward to telomere on chrosomal short arm and 5'-terminus of this base sequence : 93840
agattgtgccactgcactccagcctgggcgacagagtgagactccatctcaaaataaataaataaataaataaataaataaataaataaaatctataaaaaaataaaataaaacaagattctttatagaaagagtgcaggtggccagataagac

SEQ ID NO: 20715 - DNA, 443 bp, Homo sapiens
  chr14.fa.O7frz.54887197
  Located on chromosome 14
  Distance between a terminus base of telomere on chromosomal short arm and 5'-terminus of this base sequence : 56278642
  Distance between 3'-terminus of neighbour sequence of sequence listing upward to telomere on chrosomal short arm and 5'-terminus of this base sequence : 180797
ccttcctatcttgcgtattaaccacatgaggctactggtttcgtgtgtgtgtgtacatatctaccaaaagtgggagatgaagggcaaaacacacacttggaaactggctcctatgagaaaggagccagaagcccccccacaccccccacacacactcacacatatatgcttgaggacacacacacacatgtccttagagtatatatatatatatatacacacacacacacacacacacacacacacagatacacatgatatatatacacacgtatatgtgctcagaggacattaaaaccctaaattagttaccttagattatttgcatgtaaaaatcctcatggcttgttactataggaactcagagttctaccagaaatctcctcagattttaggtagcatggcagttaaggatagaagttctttagctaaaggatgtaggt

SEQ ID NO: 20716 - DNA, 381 bp, Homo sapiens
  chr14.fa.O7frz.54988819
  Located on chromosome 14
  Distance between a terminus base of telomere on chromosomal short arm and 5'-terminus of this base sequence : 56380326
  Distance between 3'-terminus of neighbour sequence of sequence listing upward to telomere on chrosomal short arm and 5'-terminus of this base sequence : 101241
gtagatttggatttccacctagcataatttttcttctgttagagtcccctgtggttcttcagttgacaaattctgtcagctttggtatgtgtgataaaggctttatttctccttcatttagaaattttttttctgggtataggattataggttcatgtgtgtgtgtgtgtgtgtgtgtgtgtgtgtgtgtgtgtgttattttaatacttttaaaaacgttgcaccactggcttttcacttgcattatttctggtgagaaatctgcagacactcttatttttttctctgtaaataatatgtttttttgtctctggctgcttttagattttctctttatcaatggttttggacaatttaattatgatacgctttagtgaagtt

SEQ ID NO: 20717 - DNA, 338 bp, Homo sapiens
  chr14.fa.O7frz.55097770
  Located on chromosome 14
  Distance between a terminus base of telomere on chromosomal short arm and 5'-terminus of this base sequence : 56489266
  Distance between 3'-terminus of neighbour sequence of sequence listing upward to telomere on chrosomal short arm and 5'-terminus of this base sequence : 108559
gtctagagcctttccattagagcagaacatccttgaagctgtgtgttcagagcgaacaccctcccctcaggtgtgggactcttctgctttagccagagacccaatgggttagggtcagtgagcagtggagacgattcctctgttcatagtctgcagacacagcttcctgcaaataataataataataataataataataataataataataataattttcaaagtttcatctcagaaatgaaaaggtggaggtggagggttagtggaggggagggtcagctcatcagcttagaggcaatttaggtccaccttccgtgcagagctggcttaagacatcc

SEQ ID NO: 20718 - DNA, 318 bp, Homo sapiens
  chr14.fa.O7frz.55168370
  Located on chromosome 14
  Distance between a terminus base of telomere on chromosomal short arm and 5'-terminus of this base sequence : 56559870
  Distance between 3'-terminus of neighbour sequence of sequence listing upward to telomere on chrosomal short arm and 5'-terminus of this base sequence : 70266
tgccttgatctagtcacagtagtctcattgtatatagattactatagaaagtaaaatacagactacagatggaaagtcaggagataaagaggtcataataataggttatcataatagaaatataggaggcaaaattacaataatgatggtcagaaggaaggaaggaaagaaaagaaaagaaaagagaaaagaaaagaaagaaaagaaaagaaaagaaaagaaaagaaaagaaaagaaaagaaaagaaaagaaaagaaaagaaaaaagaaaagaaaaagatatcacaaaggataaaagatctggctatttctcagaaag

SEQ ID NO: 20719 - DNA, 454 bp, Homo sapiens
  chr14.fa.O7frz.55285696
  Located on chromosome 14
  Distance between a terminus base of telomere on chromosomal short arm and 5'-terminus of this base sequence : 56676980
  Distance between 3'-terminus of neighbour sequence of sequence listing upward to telomere on chrosomal short arm and 5'-terminus of this base sequence : 116792
agcaattatgtggtaatgtcacttgccagtgaaaccaccaaggcctgcagtagtacatacaatttgtatgtgatggtttatgcacaaagtgctacgttgcattgaaaatttggatataaaatataatgttccaggccaggcacagtggctcatgactgtaatcccaacactttggcaggctgaggcaggcagattacctgaagtcaggagttcgagaccagcctggccaacatggtgaaaccctctctctactaaaaatacaaaaaatagctgggcttgatggcaggcacctgtaatgccagaagaatcacttgaacctgggaggcagagattgcagtgagccaagatcgtgccactccagtgtgtgcaagagaaggactctgtctcaaaaaaaaaaaaataaataataataataataataataatgttccatacctcaccatttaatttcatt

SEQ ID NO: 20720 - DNA, 477 bp, Homo sapiens
  chr14.fa.O7frz.55407838
  Located on chromosome 14
  Distance between a terminus base of telomere on chromosomal short arm and 5'-terminus of this base sequence : 56799324
  Distance between 3'-terminus of neighbour sequence of sequence listing upward to telomere on chrosomal short arm and 5'-terminus of this base sequence : 121890
cttcatcttaattactgcctacattttgctgaagctaaggttgtttttgttcaggatgacttctgtgggctgacaaaaaaaattacagcctgttgtagtttccctagaccattaccatgatcacacagaattaagctttcattaaaatcatgcacttaaaagaaaggggtggggagagagggggggggaggggagagagagagagagagagaaagtaccatttattctgcatgtgaatgaaaagagaaatataaaaatgacaccaatcaaccagtactcaatctcctggccctggccccagaatagaagaccacaaagtcacgctttccctagagttgacatgaaccctttccctagggttcacttaaaacagaagtgatgctaataaagaatcctaaacaaaggccatggattcatgccatctttccagtttgggagagggccagaagagtcaggtaaagttaggcattaaccgat

SEQ ID NO: 20721 - DNA, 196 bp, Homo sapiens
  chr14.fa.O7frz.55629816
  Located on chromosome 14
  Distance between a terminus base of telomere on chromosomal short arm and 5'-terminus of this base sequence : 56959663
  Distance between 3'-terminus of neighbour sequence of sequence listing upward to telomere on chrosomal short arm and 5'-terminus of this base sequence : 159862
caaagtgaactttctagaaccttacaacaaatctcctagaaccttctctttatatatatatatatatatatatatatatatatatatatatatatatatatataattaaaaccgaggtttagagaggtttcagaattttttacaagcttttaagaaaatgttctctcctcctctagactgtaagatctgtgaaagc

SEQ ID NO: 20722 - DNA, 256 bp, Homo sapiens
  DISO7_00003190
  Located on chromosome 14
  Distance between a terminus base of telomere on chromosomal short arm and 5'-terminus of this base sequence : 57078085
  Distance between 3'-terminus of neighbour sequence of sequence listing upward to telomere on chrosomal short arm and 5'-terminus of this base sequence : 118226
aactgccttgaactgataagtctccctctctttgccatggattacgtgtgtgtgtgtgtgtgtgtatgtgtgtgtgcgagtgcatgcacatgcatgtgctagagcatgcctccagtgcctggcagattatgagtctgttttagcctttcacttcctacttgcacagagcctcaaggtcggaagtgagtgattaggaccttcccaggtctctcttgggcatgtacatagccctgtatgtggactagaaggcatgacc

SEQ ID NO: 20723 - DNA, 233 bp, Homo sapiens
  DISO7_10003932
  Located on chromosome 14
  Distance between a terminus base of telomere on chromosomal short arm and 5'-terminus of this base sequence : 57190648
  Distance between 3'-terminus of neighbour sequence of sequence listing upward to telomere on chrosomal short arm and 5'-terminus of this base sequence : 112307
ggcctttcttccttcagagagacacttgattaagaaaactttttaacaaaaaagttctctaacacgcactttaaaaatttcaagtaacttgtgtgtacagatgcacgcgcgcgcgcacacgcgcgcgcaaacacacacacacacacacacactagttttactaatggaaaggcagctttaaagcaaaggcaatgaaatcttttcattccttccggactgtggtccaaggtgaa

SEQ ID NO: 20724 - DNA, 432 bp, Homo sapiens
  AC009959.6_11955
  Located on chromosome 14
  Distance between a terminus base of telomere on chromosomal short arm and 5'-terminus of this base sequence : 57398820
  Distance between 3'-terminus of neighbour sequence of sequence listing upward to telomere on chrosomal short arm and 5'-terminus of this base sequence : 207939
ttcaatcagtgatcggaacattgctgaaaaaatggaggtataatacaaaaatgatgttctttctatctctttcagttgtggccagcttactttgtgtttgagacaggctgcatagctcatgcaggatgacagttcatgctggggtttggtagtggtgtgttctgggaagttgggggtctcttttgcgtatttctggggtgtatattggaacgtgaggagaccataattttgtgtaagttgtggagcaaagattcaatgcgtggaagacatactagatgggtaatacttcaccacatctagacttatcctggagtgtgtgtgtgtgtgtgtgtgtgtgtgtggttttctaaagatgctggtgaactgagatacttctgagagagcagatgtgctatatggactaagggaatagaaccttgatgtcacaagtat

SEQ ID NO: 20725 - DNA, 447 bp, Homo sapiens
  chr14.fa.O7frz.56069209
  Located on chromosome 14
  Distance between a terminus base of telomere on chromosomal short arm and 5'-terminus of this base sequence : 57399074
  Distance between 3'-terminus of neighbour sequence of sequence listing upward to telomere on chrosomal short arm and 5'-terminus of this base sequence : -178
aatgcgtggaagacatactagatgggtaatacttcaccacatctagacttatcctggagtgtgtgtgtgtgtgtgtgtgtgtgtgtggttttctaaagatgctggtgaactgagatacttctgagagagcagatgtgctatatggactaagggaatagaaccttgatgtcacaagtatttctcggaagcctgccacatcattgctgttagggtttagggtttctgtttctctaagctctgacctagagataaacctctctgagcttgtgataatgaggatttaccctactggcttctaacatggatacaaaatagggaaggtgaaaagtggtacgtgtttcccagagtgaggggtaggtaatttctgtctcagcactgaagacttggagtcagaggcagaaagttcttctgcgttctgtgagtctctaggaagattacttgacctgc

SEQ ID NO: 20726 - DNA, 350 bp, Homo sapiens
  chr14.fa.O7frz.56176430
  Located on chromosome 14
  Distance between a terminus base of telomere on chromosomal short arm and 5'-terminus of this base sequence : 57506201
  Distance between 3'-terminus of neighbour sequence of sequence listing upward to telomere on chrosomal short arm and 5'-terminus of this base sequence : 106680
caggtatcattattcaccaataagcaaacagagaaccagagatttaagctgcttaaggtcatccaagtagtaaagagtagagccaagatttgaggccccatctacctaattccaaaccttgaatgctttcagcttcctctgacaacctccactgtgtgtgtgtgtgtgtgtgtgtgtgtgtgtgtgtgttgaagggtggtgggatgtgggtgcattatttgtgtctctgagaatagtgagttatgtgtgagttttctagaaataccctactagtcttataataaaaagtttactataaaaattcttggatttggaataagccttaaaggttaccttctaagaccagcaac

SEQ ID NO: 20727 - DNA, 476 bp, Homo sapiens
  chr14.fa.O7frz.56288783
  Located on chromosome 14
  Distance between a terminus base of telomere on chromosomal short arm and 5'-terminus of this base sequence : 57618903
  Distance between 3'-terminus of neighbour sequence of sequence listing upward to telomere on chrosomal short arm and 5'-terminus of this base sequence : 112352
tcctgattctagacttgattacactgttgttgccattgctgtctaattgtctcctccactagaataccaactccatgggtgcagaaactgcagctttatgtttattgtattattattattattattattattattattattattattattattgttatttgagatggagtcttgctctgtaacctaggctggagtgcaatggcgcaatctctgctcactgcaacttctgcctcccgggctcaagctattctcctgcctcagcctcccaagtagctgggattacaggcacacaccaccacatccagctaatttttgtattttcagtacagacagggtttcactatgttggccaggctggtctcaaactcctgacctcaggtgattctcccgcctcagcctcctaaagtggtggtgctgggattataggcatgaggaactgtgccccgccccatcgttgtattcttagcactgagacc

SEQ ID NO: 20728 - DNA, 419 bp, Homo sapiens
  chr14.fa.O7frz.56628610
  Located on chromosome 14
  Distance between a terminus base of telomere on chromosomal short arm and 5'-terminus of this base sequence : 57885033
  Distance between 3'-terminus of neighbour sequence of sequence listing upward to telomere on chrosomal short arm and 5'-terminus of this base sequence : 265654
acattctttaaatcatgtactcctatagcattttcaacattttcccatatctacatatacaaatgccttggttcttttaaatgagtgtataatattctattagtgtgtgtgtgtgtgtgtgtgtgtgtgtgtgtgtgtgtgtgtgtgtaatttaaccatttcctttccttgctggtgaattcattttctcttttcagtttgaaaatttctggcccatctagctcaagtcctggctttgttgtaaatttgaattagttaatacagtgaacatttatggagtgccttctctcttcctgggattgtgcagggcactaggcccacaaaatacttgatgcacagccgcttcccctcacttcagttaccacagcctaacaggaagacacactcataaagagcttagaatgtgatcatgctaaagt

SEQ ID NO: 20729 - DNA, 417 bp, Homo sapiens
  chr14.fa.O7frz.56716414
  Located on chromosome 14
  Distance between a terminus base of telomere on chromosomal short arm and 5'-terminus of this base sequence : 57972806
  Distance between 3'-terminus of neighbour sequence of sequence listing upward to telomere on chrosomal short arm and 5'-terminus of this base sequence : 87354
tcttagctcattcaagtgtcagcctttagcacataaacacacccctacatacagcatctgcacacatataccacacatacacacctacacacagtgtgcatacacccctgcatgcacaccctcatgcacacgccccttacacacacacacacacacgtcttatgcacatgcccctctcaagactccacatccccatctagctactgtcttctctctgatgcagccagagtcttgaaagccatccacgctcactttctacccactctgctgcactgtcctcctcccctccctagagctcttctcaggggcacttgcaacttccctgttgccggagccaggggacactgcggggccctcatttttcttagtttcttgggggtgttggcacccatggctgcatgctgaaatgctgtcttc

SEQ ID NO: 20730 - DNA, 313 bp, Homo sapiens
  DISO7_00042143
  Located on chromosome 14
  Distance between a terminus base of telomere on chromosomal short arm and 5'-terminus of this base sequence : 58039555
  Distance between 3'-terminus of neighbour sequence of sequence listing upward to telomere on chrosomal short arm and 5'-terminus of this base sequence : 66332
cttggaggcagaactccttgaatgatgtgctgctgccatcagcctagctttcagtctagtgctcgggatggattcctttagctgagcgtgactctagtttgtaaggatggtgcagagacaatagcgcattctctctctcttctctctctctcttctctctctctcttctctctctcttctctctctctctctctctctctctctctctcctctctctctctctctctctctctctctctctctctctctctctaggcttatggtttggtactgtgtgctgctgaacatgctggcacagaatgttccaacgcat

SEQ ID NO: 20731 - DNA, 192 bp, Homo sapiens
  Z67090
  Located on chromosome 14
  Distance between a terminus base of telomere on chromosomal short arm and 5'-terminus of this base sequence : 58135442
  Distance between 3'-terminus of neighbour sequence of sequence listing upward to telomere on chrosomal short arm and 5'-terminus of this base sequence : 95574
agattcaacacaaacccaattaagatctcagcaggggtgtgtgtgtgtgtgtgtgtgtgtgtgtgtgtgtgtgtgtgtagattaggtgattctaaaatgtatatggaaatcaaagaatttagaatagtgaaaataattttaaaagacaagcatacaggtgaagaattctattacctgatgttcagactgcat

SEQ ID NO: 20732 - DNA, 136 bp, Homo sapiens
  DISO7_10003939
  Located on chromosome 14
  Distance between a terminus base of telomere on chromosomal short arm and 5'-terminus of this base sequence : 58228684
  Distance between 3'-terminus of neighbour sequence of sequence listing upward to telomere on chrosomal short arm and 5'-terminus of this base sequence : 93050
atacttatgggttctactgagtggtatttttaataatgacatttttcattagttcaaatggttaaatttaattcttgggtgggaaaaacatgatatatatatatatatatatatatcataccagcttaagcctcct

SEQ ID NO: 20733 - DNA, 397 bp, Homo sapiens
  chr14.fa.O7frz.57443811
  Located on chromosome 14
  Distance between a terminus base of telomere on chromosomal short arm and 5'-terminus of this base sequence : 58628603
  Distance between 3'-terminus of neighbour sequence of sequence listing upward to telomere on chrosomal short arm and 5'-terminus of this base sequence : 399783
tcatttggatttatgcttatctacagctaaaaatcatgagtttagagaacatgtcctagaatatatactactaagtcaagtattttctgactcctccccagctttattttattcttaccttcattagaaagaaattgaaagaagctttccatgacttgctaccaactttctcttattctccctctccatctactcaaaagagtaactaactcctagaaattaaaaaatatgtccacaagtgtgcactatttgattgaaaagagaaatatgtatatgtgtgtatacacacacacacacacacacacacttatctgaataaagaatatttctgtatgtgcattttggtaacatggttgtgtttgtcaaggagggaaggtaagaattagaaatcacggct

SEQ ID NO: 20734 - DNA, 224 bp, Homo sapiens
  D14S994
  Located on chromosome 14
  Distance between a terminus base of telomere on chromosomal short arm and 5'-terminus of this base sequence : 58841978
  Distance between 3'-terminus of neighbour sequence of sequence listing upward to telomere on chrosomal short arm and 5'-terminus of this base sequence : 212978
ggcagacagggctagaaccccattctcctgacattctctataccatacacttacatgtgtgtatgtacatgtcatacatacaggcatgcacacacacacacaaaacacacacacacacacacacacacacacacacacacacaattctttccatctccacacaaaacttactataacttgtgtctgcatttcagaaatcctggagtctcttacatctgataacg

SEQ ID NO: 20735 - DNA, 477 bp, Homo sapiens
  chr14.fa.O7frz.57770240
  Located on chromosome 14
  Distance between a terminus base of telomere on chromosomal short arm and 5'-terminus of this base sequence : 58955010
  Distance between 3'-terminus of neighbour sequence of sequence listing upward to telomere on chrosomal short arm and 5'-terminus of this base sequence : 112808
ctccatacaaatcatgagctatttatcactttcctttaatacactaccattttactccaagagccccatttaacagaacttcaaaactgaaagtggatttatttacattttttatgaagaaacaatggtatatactcttaatcacccagtgtttctccacggggttgctaatggcattggcagaatgtttagcatcgctggttcttgggtgctaaatgccagtggcaccctcctccaagtctttgtgacaaccaacgttgctccctgacatgcacgtgcgcgcgctagcgcacacacacacacacacactctctctctctctctctctctctctacctgccctcagtggggcagtactgccctcgcttgagaacccaaactgccttatgctgaaaagaaacctgagacccagggaagagaagggcagtagggatttgcccaagacctacaccaaactggtattgtgttcggctttca

SEQ ID NO: 20736 - DNA, 280 bp, Homo sapiens
  chr14.fa.O7frz.57870482
  Located on chromosome 14
  Distance between a terminus base of telomere on chromosomal short arm and 5'-terminus of this base sequence : 59055422
  Distance between 3'-terminus of neighbour sequence of sequence listing upward to telomere on chrosomal short arm and 5'-terminus of this base sequence : 99935
gttgatattgaactcaactgaaacatcaactcttacctgaatttctagcctgccagcttgtcctacagatttcagacttgccacctctacaatcttaacaaccaattccttaaaataaatctagatgaatggatggatagattagatatagatagacagatagatagatagatagatagatagatagatagatagatagatactatagatagatactattggttctatttctctgtagaatactgactggctttgaaaattggagtgatgtagctacaag

SEQ ID NO: 20737 - DNA, 374 bp, Homo sapiens
  chr14.fa.O7frz.58089468
  Located on chromosome 14
  Distance between a terminus base of telomere on chromosomal short arm and 5'-terminus of this base sequence : 59274496
  Distance between 3'-terminus of neighbour sequence of sequence listing upward to telomere on chrosomal short arm and 5'-terminus of this base sequence : 218794
gtccggttgtaatataatccttaccctgctctgagagggacactgccctcaaagcgagaacgacagcggctccaagaagattaaataaagaggtgtgtgtgtgtgtgtgtgtgtgtgtatgtgtgtgtgtgtgtgtgttgcaatgctggcctattttgctgccagggaatgagagatgcactgcaatttaagtcccatcatctgctgttttgtttatgtgtggagaatgcttagtaaaactgcacaaacaagtgaagttgtaattatcttaagcctcatttgcacacctagttccaaagcaataattaaaaggattttgaaaacaattagcctctctaaacaaagataatctattgtcagtagctgagactagc

SEQ ID NO: 20738 - DNA, 393 bp, Homo sapiens
  chr14.fa.O7frz.58273802
  Located on chromosome 14
  Distance between a terminus base of telomere on chromosomal short arm and 5'-terminus of this base sequence : 59458659
  Distance between 3'-terminus of neighbour sequence of sequence listing upward to telomere on chrosomal short arm and 5'-terminus of this base sequence : 183789
tgtagatgtctgttaggtccactttctctagagctagttcaagtcctgtatatccttgttaattttttgtgtttttgatcagtctaaaattgacagtggggtgttaaagtctcccactattgggagggagtttgtgtgggagtctaagtctctttgtaggtctctaagaacttgctttatgaatctgggtgctcctatattgggtgcatatatatttaggatagttagctcttcttgttgcattgatccctttaccattatgtagtgcccttccttccttccttccttccttccttccttccttccttccttccttccttcctaccttgctcccgccctccctccctccctccctctctctctcattcattcgttcattcgttcaaagtcagt

SEQ ID NO: 20739 - DNA, 450 bp, Homo sapiens
  chr14.fa.O7frz.58608081
  Located on chromosome 14
  Distance between a terminus base of telomere on chromosomal short arm and 5'-terminus of this base sequence : 59792830
  Distance between 3'-terminus of neighbour sequence of sequence listing upward to telomere on chrosomal short arm and 5'-terminus of this base sequence : 333778
aagctttgtatgcaaatcaagaatacattaaaaaatattctcccgctgggcgtggtggttcacgcctgtaatgccagcactttgggaggctgagtcgggtggatcctctgaggttgggagtttgagagcagcctgaccaacatggagaaaccccgtctctactaaaaatacaaaattagccaggtgtggtggctcatgcctgtaatctcagctactcagggggctgaggcaggagaatcacttgaactcgggaggcagagtttgcggtgaactgagattgcgccattgcactttagcctggacaacaagagtgaaactccgtctcaaaacaaaacaaaacaaaacaaaacaaacaaacaaaatatatatatatatatacacacacatatatatacatatatatatatatattctcccaagagcacaactttgtgaccttctgcaaatgac

SEQ ID NO: 20740 - DNA, 373 bp, Homo sapiens
  chr14.fa.O7frz.58701161
  Located on chromosome 14
  Distance between a terminus base of telomere on chromosomal short arm and 5'-terminus of this base sequence : 59887674
  Distance between 3'-terminus of neighbour sequence of sequence listing upward to telomere on chrosomal short arm and 5'-terminus of this base sequence : 94394
atgtctccaggtagtggaatacaaaataatcagccaagttcatctaataatttatgggttgttataccccgatagagaaatacaaacacaagcccataacttcaagggtcaagtcctctaaaatttagaatatacgagcaggtaatgtctaaggaaaagcatctgaagtcagagtattgtgtgtgtgtgtgtgtgtgtgtgtgtgtgtgtgtgtgtgtgtgtgtgtatgtgtgtgtacgcacgtgcatgtgcagtttctggaaagtgtctaagaacaacatccttattttatttaatctcatatgccaaaagggcaaatacatgggcattgtttaactgagtccttgctctgcaccttataactgtataccag

SEQ ID NO: 20741 - DNA, 480 bp, Homo sapiens
  chr14.fa.O7frz.58804921
  Located on chromosome 14
  Distance between a terminus base of telomere on chromosomal short arm and 5'-terminus of this base sequence : 59990992
  Distance between 3'-terminus of neighbour sequence of sequence listing upward to telomere on chrosomal short arm and 5'-terminus of this base sequence : 102945
aatacttcgatgagtaggaaagtctgttttcctgaatatatccactttcctacatattccattgcttgtggaagcaatgacccaagggttatatgcaggactttttcttactttggcagactggagacccagagctcagagaaggcagaaagtgtgttaaagaacaataggaaaagtggtgagagacaggcagatgaaggaagcatgaactaccatcacagagaaagggtagagtcagcaggtaattctcaaagggatgtgcatctgcccctaacccaatctaaatgcctgactcaatgtcctcagaggacacgaaccctggaaaacaagtatgagatgatactactcaggtattgcgtgtgtgtgtgtgtatgtgtgtgtgtgtgtgtgtgtgtgtcagaggtcagccctgatgtaattgccaccgaggtcaccgtggatgaggtcattgtgggtgaggttacagtgcaagagctgtct

SEQ ID NO: 20742 - DNA, 177 bp, Homo sapiens
  DISO7_00000011
  Located on chromosome 14
  Distance between a terminus base of telomere on chromosomal short arm and 5'-terminus of this base sequence : 60152950
  Distance between 3'-terminus of neighbour sequence of sequence listing upward to telomere on chrosomal short arm and 5'-terminus of this base sequence : 161478
gtacaggaagctcatgtggccgcatgtggccgcacgtgtgtgtgtgtgtgtgtgtgtgtgtgtgtgtgtgtgtgtgtgcccattctgagaggtggatggtttggggtctggctgccctatctcgtgctgctctttgtatctttcagagatctgaaactggacaatgtcctgttggac

SEQ ID NO: 20743 - DNA, 313 bp, Homo sapiens
  chr14.fa.O7frz.59044689
  Located on chromosome 14
  Distance between a terminus base of telomere on chromosomal short arm and 5'-terminus of this base sequence : 60230885
  Distance between 3'-terminus of neighbour sequence of sequence listing upward to telomere on chrosomal short arm and 5'-terminus of this base sequence : 77758
gctaaacattactagcaatcagagaaatacaaattaaaacatcaatgagagatcactttagagaaagtcggataaaatcaagtataacaaagacactgctagaggggtggaaataaatgcagccatcctgcagagcaatctaggagtccctagagaaatcaaggatgcattcttggccctgagtatgtgcccaagaaaacactgatgtgcagatcataagaatacatgtaaagctgtccatcatggtgtgtgcgtgtgtgtgtgtgtgtgtgtgtgtgtgtgtgtgtatgtatgtaaacaaggactgatgttt

SEQ ID NO: 20744 - DNA, 348 bp, Homo sapiens
  chr14.fa.O7frz.59328799
  Located on chromosome 14
  Distance between a terminus base of telomere on chromosomal short arm and 5'-terminus of this base sequence : 60515169
  Distance between 3'-terminus of neighbour sequence of sequence listing upward to telomere on chrosomal short arm and 5'-terminus of this base sequence : 283971
catttgagaactgaatcctttaatttatcttttggtccaccttccaggacatgtgtgcacgtgcatacacacacgcgcacacacacacacacacacacacacacacaatttatccatctctctcttgcttttgtggcaagcacgtcttcacctgttttttttttccccttgcaaacttgagcattgattcacatttcaagccaattgtttattgctgttgctattgagaatgtgacattagggagattcagaacaatgcatttcagctcactgttgactcatgttggatgatttcagcagcagcagctcaagctggtggcctgtgggatcaagataatgagcctgaat

SEQ ID NO: 20745 - DNA, 471 bp, Homo sapiens
  chr14.fa.O7frz.61627389
  Located on chromosome 14
  Distance between a terminus base of telomere on chromosomal short arm and 5'-terminus of this base sequence : 60697922
  Distance between 3'-terminus of neighbour sequence of sequence listing upward to telomere on chrosomal short arm and 5'-terminus of this base sequence : 182405
gcattaactgacatgattatagaatttatttccattagcttgttaaaatggtgggttacattgattgatttttggatgttaaactagccttgcattcctggaataaaccttatttggtcatggtgtataattccttatatatatatatatatatatatatatatacacacacacacacacacacacatataaatatatatatgtgtatatatgtatataaatatatatgtatatatgtatatatataaatatatatgtgtatatatgtatatatatataacgtgtatatatatatatgtagctgaattatatttgctaatattttattaaggatttctgtgtaaatatccttgagagatattgtagtttcttttttggtactgtaacactggctttcataaaattaattgggagtgtttctttctcttcagttttccaggagagattgtacataattgctgttaaatctcc

SEQ ID NO: 20746 - DNA, 341 bp, Homo sapiens
  chr14.fa.O7frz.59647279
  Located on chromosome 14
  Distance between a terminus base of telomere on chromosomal short arm and 5'-terminus of this base sequence : 60792018
  Distance between 3'-terminus of neighbour sequence of sequence listing upward to telomere on chrosomal short arm and 5'-terminus of this base sequence : 93625
aatataaagttctttggccaagatttcataattatgtgttgacagaggcagatcttgaacagagatctctgaactctcacctctaatacttttgcacttcaccactatatgagaatacatctgggctcaagtgatggaagccaaattcagaggggcttaagcatacacacacacacacacacacacacacacacacacacacacacacgcacatacacactagattttactgactcacattagtgaaaagtgatatgctaggaaagcatatccagtgagtgctggatacaagaatgatttgctccagttcacggagggtgttgaaagcagtaatctagcag

SEQ ID NO: 20747 - DNA, 373 bp, Homo sapiens
  chr14.fa.O7frz.59765606
  Located on chromosome 14
  Distance between a terminus base of telomere on chromosomal short arm and 5'-terminus of this base sequence : 60910440
  Distance between 3'-terminus of neighbour sequence of sequence listing upward to telomere on chrosomal short arm and 5'-terminus of this base sequence : 118081
gaccaacttaatgactgattctacactctctcggttttgtggtaactagctctgatttgtgcgtgagaaacacacacacacacacacacacacacacacacacacaaacaacacagccgatgaggaataggtgagcactggagattattcctctcatcatcagtgcagatgtccacagaaattccctgagggtctttaaattcgagcttttggtcactgaattcaggcaggcatttataagagatttttaggcttttccattatttttcctgtgatttgtcttttaaaataagcttttatagtagacgcctatgttatttttcctccatcagatgaaaatgattatctttgtgaattgtactctccacttgat

SEQ ID NO: 20748 - DNA, 204 bp, Homo sapiens
  chr14.fa.O7frz.59930390
  Located on chromosome 14
  Distance between a terminus base of telomere on chromosomal short arm and 5'-terminus of this base sequence : 61075167
  Distance between 3'-terminus of neighbour sequence of sequence listing upward to telomere on chrosomal short arm and 5'-terminus of this base sequence : 164354
tcacagaaggtatgaataccagaaagtggagataatttaggccattttagagactgcctactattttaggttcaacattatttttccttggtactttgaagacataagctcactgtcttgtagtatccattttgtgtgtgtgtgtgtgtgtgtgtgtgtgtgtgtgtttgtgtgtgtgtgtgctcgcaaattgtaagacttcta

SEQ ID NO: 20749 - DNA, 425 bp, Homo sapiens
  chr14.fa.O7frz.60059617
  Located on chromosome 14
  Distance between a terminus base of telomere on chromosomal short arm and 5'-terminus of this base sequence : 61204396
  Distance between 3'-terminus of neighbour sequence of sequence listing upward to telomere on chrosomal short arm and 5'-terminus of this base sequence : 129025
ctagtttcgaactcttgacctcaagtgatctgcctgccttggcctcccaaagtgctgagattacaggtctaagccaccatgccctgccgaacttctaacttctttcagccatctatctcttcaagaaagtcttttatccacgcctctttgcaaatatgtacgtgtatatatatgtgtgtgtatatacatatatatgcaattatttgagcaccattatctatatatgtgtatatatatgtgtgtgtgtgtatatgtgtgtgtgtgtgtgtgtgtgtgtatgtacaaataattccttcccaaagttagttcggcctacgcccaggaatgctgtgcccaggaatgaacaaggacagcttaaaggttagaagcaagatggagtcggttaggtctgatttctttcactgtcgtaatttcctcagttataa

SEQ ID NO: 20750 - DNA, 476 bp, Homo sapiens
  chr14.fa.O7frz.60258136
  Located on chromosome 14
  Distance between a terminus base of telomere on chromosomal short arm and 5'-terminus of this base sequence : 61403013
  Distance between 3'-terminus of neighbour sequence of sequence listing upward to telomere on chrosomal short arm and 5'-terminus of this base sequence : 198192
cagcatttgaataggtagactaagtaaagcagattgccctccctgctgtgggtgagccttatccagtcagttgaaggccaatttcagatcttgggacttctacctccataatcgcttgagccaattccttataataaatccctttacacacacacacacacacacacacacacacacacacacagagttgacacttgcatacaggtttgaactgcatagatccacttatatatggatttttttctgcctctgccacccaagacagcaagaccaacccatcttcttcctccttctgcctattcaatgtgaagatgaggatgaagacctttatgattactattaaatgaaaacggataaatatgttttttcttccttatgattttcttaatcctttcttctagcttacattattgtaataacacagtatataatacatataacatataaaatatgtgttaactgacttattggtaagg

SEQ ID NO: 20751 - DNA, 459 bp, Homo sapiens
  chr14.fa.O7frz.60385185
  Located on chromosome 14
  Distance between a terminus base of telomere on chromosomal short arm and 5'-terminus of this base sequence : 61529807
  Distance between 3'-terminus of neighbour sequence of sequence listing upward to telomere on chrosomal short arm and 5'-terminus of this base sequence : 126318
catgttctcagatggtagctagtattactacccattagataatattttctcaccacttatctttttcatgagtatattgtttctctgaaaataaagtgaaactgaatgacacccttttcctactatttgccaagttactgagacaatgcatcaagagcagagaggctagaattataaaaattgacaccagttataacaggaaacaggttgtgagggaagaaagccgcttggtgttactcagcaaattggcacccatggagacaggcacagcgtttctgggtcctgttgaaaaaccaacaacagttttctgtctctagcttgtcttcttatcagaagactgagtccacaccagtgtgcactcagctgtcacaaccaatgaatgcatgtgtgtatgtgtatttgtgtgtgtgtgtgtgtgtgtaagagaaaaagtggtgacagatgttctactggtgatct

SEQ ID NO: 20752 - DNA, 272 bp, Homo sapiens
  chr14.fa.O7frz.60468962
  Located on chromosome 14
  Distance between a terminus base of telomere on chromosomal short arm and 5'-terminus of this base sequence : 61613899
  Distance between 3'-terminus of neighbour sequence of sequence listing upward to telomere on chrosomal short arm and 5'-terminus of this base sequence : 83633
acatgtctttgtcgcttctattttgtttctatttttttcctatgttaagttaggaaaaggcacatttccccccaccatctccatttacacacacacacacacacacacacacacacacacacacggtataattatgatctgatctgatgattgataatagcatgagatgtatctttcaggatatttgtaaattctttgattgcatctttaaaaaacaactttaaagcacaaaataagaaaactacaatgataagacttcagctatgtagcaa

SEQ ID NO: 20753 - DNA, 398 bp, Homo sapiens
  chr14.fa.O7frz.60678381
  Located on chromosome 14
  Distance between a terminus base of telomere on chromosomal short arm and 5'-terminus of this base sequence : 61820303
  Distance between 3'-terminus of neighbour sequence of sequence listing upward to telomere on chrosomal short arm and 5'-terminus of this base sequence : 206132
tatccatgagcataggatgtatttccatttgcttgtatcatctatgatttcttttagcagtgttttgtggttttctttgtagaggtctttcacctccttggttaagtatattcctgagtattttattttattttattttattttttattttattttattttattttatttttgaagctattgtaaaaggggttaagttcttgatttgattctcagcttggttgctgttggtatatagcagagctactgatttgtgtacattaattttgtatcctgaaactttgctgaattatttaccagttctaggaacttttttgatgagtcttttgggctttctaaatatacaatcatgtcatcagcaaacagcgacagtttgacttcctctttaccaatttgtat

SEQ ID NO: 20754 - DNA, 149 bp, Homo sapiens
  D14S1059
  Located on chromosome 14
  Distance between a terminus base of telomere on chromosomal short arm and 5'-terminus of this base sequence : 61833672
  Distance between 3'-terminus of neighbour sequence of sequence listing upward to telomere on chrosomal short arm and 5'-terminus of this base sequence : 12971
ggtgagggcaggttgtccccagtttactttcaagtgattcagaaaaaaactaatatacatagacacacatacacaaacacacacacacacacacacacacacacacatctatatatatacatagagagagagcctgataacgcaaatgg

SEQ ID NO: 20755 - DNA, 191 bp, Homo sapiens
  chr14.fa.O7frz.60792055
  Located on chromosome 14
  Distance between a terminus base of telomere on chromosomal short arm and 5'-terminus of this base sequence : 61934013
  Distance between 3'-terminus of neighbour sequence of sequence listing upward to telomere on chrosomal short arm and 5'-terminus of this base sequence : 100192
catattaactggcagaactgagattgaaccccgggtatctgtcttcacagtttatactcctaaccaccaaagtaaactggatgatggatggatggatggatggatggatggatggatggatggatgaatgggtgggtggacaatgggccactttgctgtactttagcctagctaaactgacaagcatacat

SEQ ID NO: 20756 - DNA, 343 bp, Homo sapiens
  chr14.fa.O7frz.60892599
  Located on chromosome 14
  Distance between a terminus base of telomere on chromosomal short arm and 5'-terminus of this base sequence : 62034544
  Distance between 3'-terminus of neighbour sequence of sequence listing upward to telomere on chrosomal short arm and 5'-terminus of this base sequence : 100340
atgtgacagaacattcaatcacctttctgtgattcaagctgattttattagagataggcacaaaattgaacaattatcacacacacaaacacatgcacacacacacacacacacacacacacacacacacacaattagtagagctgagtaatatgcttataaaagggaccctaatatattggtctttctttaagacacaagcccttgctttcccacattcacacccactcatgaacacatggattcgcatacacagtgaggctttaaagcaaccaaaatatgtaattaaattatcaaatctaatccagatatataaatgctatcttcaaagttctacctttga

SEQ ID NO: 20757 - DNA, 288 bp, Homo sapiens
  D14S1012
  Located on chromosome 14
  Distance between a terminus base of telomere on chromosomal short arm and 5'-terminus of this base sequence : 62108012
  Distance between 3'-terminus of neighbour sequence of sequence listing upward to telomere on chrosomal short arm and 5'-terminus of this base sequence : 73125
ggcatcagggcaatgtttcttaatccaaatatactcagaatgggcctgggtacctcttttgtgactcttgatagtactggcctagaaggggacaatctgtagacatctccttatgcttgaggagtgctaggctgacctgcagctcctcaacatgtcagaccacaaagggcaaatccttgcttgggaagtaggtgatgtcccctgttccctgcacacacacacacacacacacacacacacacacacacacacacatacacacatagaacctctcattcccaactggtg

SEQ ID NO: 20758 - DNA, 348 bp, Homo sapiens
  chr14.fa.O7frz.61094660
  Located on chromosome 14
  Distance between a terminus base of telomere on chromosomal short arm and 5'-terminus of this base sequence : 62236612
  Distance between 3'-terminus of neighbour sequence of sequence listing upward to telomere on chrosomal short arm and 5'-terminus of this base sequence : 128312
tctagcctggagatacagactaaaaagcctgagaggggaaactgaaggcatcagaatggatatgatcgatctctttctttctctttctctctctctctcacacacacacacacacacacacacacacacacacacacaaagaatcgtatcaagtgtaaagaagaacaccaaggacttctaagcatttcctttttcagaatgaacttgctcacatgaacactattattagtatttttttcatctgtcttaagcatacactgtgtcaaacacccacaaatattcaaaagcaaaaaaagcaacttcttaagaatgaggcaatgacaagaacgaggctattacagataactt

SEQ ID NO: 20759 - DNA, 171 bp, Homo sapiens
  D14S1001
  Located on chromosome 14
  Distance between a terminus base of telomere on chromosomal short arm and 5'-terminus of this base sequence : 62379454
  Distance between 3'-terminus of neighbour sequence of sequence listing upward to telomere on chrosomal short arm and 5'-terminus of this base sequence : 142494
gcttaggtgacagaataagactttgtctctaaacacacacacacacacacacacacacactctctctctctctctctctctctctctctctcctctctaaatgttaaactttttgacaagtattctggtactatataataaaactagaagtatgtgtctccttgaatccaa

SEQ ID NO: 20760 - DNA, 459 bp, Homo sapiens
  chr14.fa.O7frz.61367393
  Located on chromosome 14
  Distance between a terminus base of telomere on chromosomal short arm and 5'-terminus of this base sequence : 62509087
  Distance between 3'-terminus of neighbour sequence of sequence listing upward to telomere on chrosomal short arm and 5'-terminus of this base sequence : 129462
tagtcatgcttgttcagagaacttaacttttattggagtaagattgtatcctcatgcatatgaaaaataatgaggaggctgggtacggtggctcatgcccataatcccagcactttgggaggccgaggcgagtggatcacttgatgtcaggagtttgagaccagcctgaccaacatggtgaaaccccatctctactaaaaatacaaaaattagtcaggcatggtggcacacgcctgtagtcccagctactcgggaggctgaggcaagggaattgcttgaatccgggaggaggaggttgcagcgagctgagattgcaccactgcattccagcctgggcaacagagtgagactccaccttaaaaataataataataataataataataataataattaggctcagatattaattgaaccctaaacctattcaaagatttgtccactaaatgctgttaaatg

SEQ ID NO: 20761 - DNA, 131 bp, Homo sapiens
  Z67197
  Located on chromosome 14
  Distance between a terminus base of telomere on chromosomal short arm and 5'-terminus of this base sequence : 62587884
  Distance between 3'-terminus of neighbour sequence of sequence listing upward to telomere on chrosomal short arm and 5'-terminus of this base sequence : 78338
catgcctggccttacgtatgtacatatcttaatgtagatatttgcgtgtgtgtgtgtgtgtgtgtgtgtgtgtatttccagccctgaaagtacatgttaatctttgagatattcccattagcatcagtgtt

SEQ ID NO: 20762 - DNA, 205 bp, Homo sapiens
  D14S63
  Located on chromosome 14
  Distance between a terminus base of telomere on chromosomal short arm and 5'-terminus of this base sequence : 62936664
  Distance between 3'-terminus of neighbour sequence of sequence listing upward to telomere on chrosomal short arm and 5'-terminus of this base sequence : 348649
gccagagagccacactgtatgcataggggtgtgtgtgtgtgtgtgtgtgtgtgtgtgtgtgtatgtgtatgaacatggtgagtgttagaggggaaaagggcagggcagtgagagtaaaacaggagtctcaaccttatccagtgactgtacactttccgattgtcaatattgtaagtattcaaaccaaactgattgaaacctggcc

SEQ ID NO: 20763 - DNA, 156 bp, Homo sapiens
  chr14.fa.O7frz.62204772
  Located on chromosome 14
  Distance between a terminus base of telomere on chromosomal short arm and 5'-terminus of this base sequence : 63215525
  Distance between 3'-terminus of neighbour sequence of sequence listing upward to telomere on chrosomal short arm and 5'-terminus of this base sequence : 278656
gttgtcacttacctgaattcaggaatgacaggtttctttcatgcatgaggtactggatacattaaacacacacacacacacacacacacacacacacatatggcattgagttctagtcatatcctaaagaaaaactatggtgcgctatgttattta

SEQ ID NO: 20764 - DNA, 157 bp, Homo sapiens
  D14S982
  Located on chromosome 14
  Distance between a terminus base of telomere on chromosomal short arm and 5'-terminus of this base sequence : 63366668
  Distance between 3'-terminus of neighbour sequence of sequence listing upward to telomere on chrosomal short arm and 5'-terminus of this base sequence : 150987
ccttacagaggatttcagagtaagaatcctgctgtgtgtgtgtgtgtgtgtgtgtgtgtgtgtgtttacaaccattcttacgcatttggaccaagaccattttctaaatagcagaacaccaaatgccaacacaagatgtcctgtctctgatgaaacg

SEQ ID NO: 20765 - DNA, 203 bp, Homo sapiens
  D14S1024
  Located on chromosome 14
  Distance between a terminus base of telomere on chromosomal short arm and 5'-terminus of this base sequence : 63461998
  Distance between 3'-terminus of neighbour sequence of sequence listing upward to telomere on chrosomal short arm and 5'-terminus of this base sequence : 95173
taccttgggaacagggtcccaaaaggagagatggtttctacaggtgccggaagctcttaaaaactcacatcctttacttcctaggctgtgagactgtgtgtgtgtgtgtgtgtgtgtgtgtgtgtgtgtgtagtattagaaaggaaccagtattctcatatagcttctattccttcagttcattgctacatccccagtgcctg

SEQ ID NO: 20766 - DNA, 215 bp, Homo sapiens
  D14S1046
  Located on chromosome 14
  Distance between a terminus base of telomere on chromosomal short arm and 5'-terminus of this base sequence : 63468757
  Distance between 3'-terminus of neighbour sequence of sequence listing upward to telomere on chrosomal short arm and 5'-terminus of this base sequence : 6556
catttggagttgagtggttagagaaggtcatgtagggccctacacacacacacacacacacacacacacacaacacacacacacacaacacacacacacacaacacacacacacacacacacacacacacacacacacacacacacacacacacacaaagcagagttaatctcccacttcttcctgatgtttccttttcccagaatccacagagg

SEQ ID NO: 20767 - DNA, 426 bp, Homo sapiens
  chr14.fa.O7frz.62647057
  Located on chromosome 14
  Distance between a terminus base of telomere on chromosomal short arm and 5'-terminus of this base sequence : 63656893
  Distance between 3'-terminus of neighbour sequence of sequence listing upward to telomere on chrosomal short arm and 5'-terminus of this base sequence : 187921
attgaattcctgagctttaatatcatcatattacttcttccaggtatatttacattttgagcaccattctgaattttgaaatgaaatgctctctgatgtagacaccttgcctgtgaagggtcactaccttccttcagcccaagttgacaaaaaccagtatgtatgtatgtatgtatgtatgtatgtatgtatgtatgtatgtatttagaggcaaggtctctgttttccaggctggagtgcaatggtgcaatcaaagctcgctgcagtatcgacctccaaggctcaagtgatcctcccacctcagcctcccaagtagctgggattacaggcacacgcccccacacccaccgcccagttaatttttgtattttttgtaaagacggagtcttgccatgttgcccaggctagtcctgaacttctgagctc

SEQ ID NO: 20768 - DNA, 159 bp, Homo sapiens
  chr14.fa.O7frz.63492054
  Located on chromosome 14
  Distance between a terminus base of telomere on chromosomal short arm and 5'-terminus of this base sequence : 63910582
  Distance between 3'-terminus of neighbour sequence of sequence listing upward to telomere on chrosomal short arm and 5'-terminus of this base sequence : 253263
atgaaattatcctgatggtctcagggcttggagctcctgcctctacactgacttctgcccatggaaggagaggctgtgtgtgtgtgtgtgtgtgtgtgagatggtagggctgggagagtggaaggggtcttgtgttgctttgaagtaggttctggagtc

SEQ ID NO: 20769 - DNA, 350 bp, Homo sapiens
  chr14.fa.O7frz.63396057
  Located on chromosome 14
  Distance between a terminus base of telomere on chromosomal short arm and 5'-terminus of this base sequence : 63999793
  Distance between 3'-terminus of neighbour sequence of sequence listing upward to telomere on chrosomal short arm and 5'-terminus of this base sequence : 89052
gttcctagctatgccacttaactagctaagtgtcatattagtcagggctctgcagagaaacggtaccaataagatatatagcctatctatctatctatctatctatctatctatctatctatcatttatctatcatcttcccacctttctatatgtgtagataggtagatagatagatatgaagtttattataaggaattgacttacatgattatggaggtagagaagtcccaagatctgaggttggcaaactcgaggcccaggacagctaatggtatatttccaatctgagcctgagttcaaaaacagaagactgatgtgatttcctcacttgaagatagtcagcttaa

SEQ ID NO: 20770 - DNA, 201 bp, Homo sapiens
  D14S981
  Located on chromosome 14
  Distance between a terminus base of telomere on chromosomal short arm and 5'-terminus of this base sequence : 64100150
  Distance between 3'-terminus of neighbour sequence of sequence listing upward to telomere on chrosomal short arm and 5'-terminus of this base sequence : 100007
tattgtctgggctggtcttgaactcctggcttcaagcaatcctgcagccttggctacccaaagtgctgggattacagggatgagccaccatgcccggccgaattgctgggatttggaagaaagactttgtaggggatcctcccctacacacacacacacacacacacacacacacacacacaccccttgagacaagacgag

SEQ ID NO: 20771 - DNA, 399 bp, Homo sapiens
  chr14.fa.O7frz.63063608
  Located on chromosome 14
  Distance between a terminus base of telomere on chromosomal short arm and 5'-terminus of this base sequence : 64332272
  Distance between 3'-terminus of neighbour sequence of sequence listing upward to telomere on chrosomal short arm and 5'-terminus of this base sequence : 231921
ggatctattagttcttaaaccaaacctgtgtcagtaataccctattctgatccttgagaagaaagcaaaagtcatttcaaggtatctcaataataaatacacctttggcttccctgcactatgggaagtgcatctcttcaaaatactgatagtgctatattttatatatatatatatatatagtcatgcattgcttaagggcgggattacattctgagaaatacgtcattaggtgatttttgtggctgtatgaacatcatagagtatacttacatcatagagtgtagtaggctagtgtgtactacatacctagggtatatgatataggctattgctcctaggctacaaacttgtacagcatgttgctgtactgaatactgtaggcagttgtaacatgat

SEQ ID NO: 20772 - DNA, 171 bp, Homo sapiens
  DISO7_10003949
  Located on chromosome 14
  Distance between a terminus base of telomere on chromosomal short arm and 5'-terminus of this base sequence : 64429445
  Distance between 3'-terminus of neighbour sequence of sequence listing upward to telomere on chrosomal short arm and 5'-terminus of this base sequence : 96774
atacatcagttccattggaaagaaagacatatttgtgtgtgtgtgtgtgtgtgtgtgtgtgtgtgtgtgtgcgcgcgcgcatgcgcgcgcacgtatgtgtgtgcgcatgtgtgtttttaagtaatagactttattactcatgcatttttgttgccttagcagaaggtcaaa

SEQ ID NO: 20773 - DNA, 201 bp, Homo sapiens
  HUMUT1719
  Located on chromosome 14
  Distance between a terminus base of telomere on chromosomal short arm and 5'-terminus of this base sequence : 64743943
  Distance between 3'-terminus of neighbour sequence of sequence listing upward to telomere on chrosomal short arm and 5'-terminus of this base sequence : 314327
ggttgaatgtggcgtgttccactctttaattacagtttaaagtccatctgtctatcctatctatcctatctatctatctatctgtctatctatctatctatctatctatctatctatctatctatcatcttatctcacttatctgtctttcccactagtgtgatatgatgagaggttaagagccccaggctctggagtcag

SEQ ID NO: 20774 - DNA, 103 bp, Homo sapiens
  DISO7_10004944
  Located on chromosome 14
  Distance between a terminus base of telomere on chromosomal short arm and 5'-terminus of this base sequence : 65041979
  Distance between 3'-terminus of neighbour sequence of sequence listing upward to telomere on chrosomal short arm and 5'-terminus of this base sequence : 297835
agaaagagactgacatagccagtttaaacacacacacacacacacacacacacacacacacacacacaccacatttaatagggacttacaaacagaatccatg

SEQ ID NO: 20775 - DNA, 264 bp, Homo sapiens
  DISO7_10003960
  Located on chromosome 14
  Distance between a terminus base of telomere on chromosomal short arm and 5'-terminus of this base sequence : 65316603
  Distance between 3'-terminus of neighbour sequence of sequence listing upward to telomere on chrosomal short arm and 5'-terminus of this base sequence : 274521
gattggctatagatacagcacatcaaaatagcaagtgttggcctggcgcaggggctcatgcctgaaatcccagctacttggggggctgaggcaggagaatcacttgaaatcgggagtcggaggctgcagtgagccgagattgcaccactgcactccagcctgggcaacaagaacaaaactccatctcaaaaaaaaaaaaaaaaaaaaaaaaaatatatatatatatatatatatatatatatagcaagtgctcttcctctttga

SEQ ID NO: 20776 - DNA, 202 bp, Homo sapiens
  D14S298
  Located on chromosome 14
  Distance between a terminus base of telomere on chromosomal short arm and 5'-terminus of this base sequence : 65389827
  Distance between 3'-terminus of neighbour sequence of sequence listing upward to telomere on chrosomal short arm and 5'-terminus of this base sequence : 72960
aaagcatgaccctgtctgaaatagatagatagatagatacataggtaggtagatagatagatagatagatagatagatagatagatagatagatagaatgaatttaatgagcgctaagatataaaagagtattttcccaaattttgttgagaatataataataaaatgatggtttaatggaggggaacttataatttaagtg

SEQ ID NO: 20777 - DNA, 445 bp, Homo sapiens
  chr14.fa.O7frz.64932963
  Located on chromosome 14
  Distance between a terminus base of telomere on chromosomal short arm and 5'-terminus of this base sequence : 65678148
  Distance between 3'-terminus of neighbour sequence of sequence listing upward to telomere on chrosomal short arm and 5'-terminus of this base sequence : 288119
taaccaacttaaggacagtatgatggcacatctttgaaatggaataatgtgggcttttatagaggagagaggtaggcatttgaaaggcaaggtttaaatgaagatgactaagatgagggaaccaggtcatgtttagaggaaccagcaatgggaacaggaattcatttcaatccagagatccttcatcctgtatactcagccttctaccactcatagacatttttctaaaaagattgctaggctcgaaccccagagattctgattcagtaggtttggaattcggtttaggtaatgtgcacatacatgcctctgtgtgtgtgtgtgtgtgtgtgtgtgtgtgtgtgtgtgtgtctgtgtgcgtgcgcacacgtgaacgtgtgtctgtgtgtgtgttttaatccactgatgaaacacaatatgagttaaattgaactctgtaccgtag

SEQ ID NO: 20778 - DNA, 360 bp, Homo sapiens
  chr14.fa.O7frz.65234649
  Located on chromosome 14
  Distance between a terminus base of telomere on chromosomal short arm and 5'-terminus of this base sequence : 65979893
  Distance between 3'-terminus of neighbour sequence of sequence listing upward to telomere on chrosomal short arm and 5'-terminus of this base sequence : 301300
tagcaatgttaaagtgcctattactctccttttccctaatgctctaaatctgtctctgtttcgggcataaactattgactatagcttgtagcaaagccttcaggcaagcaccagagtaaaacagaaattctctgtggatgacaaatacttgagagctgtgcttaatttgcttccataaccaataatatcagaatagaagataagtgacattctcttttgagatacatatgtaagtatttcacagtagggttttttgttttgttttgttttgttttgaggtttttgttgtattttgttttttgagacaaagtctcactctgtcacccagggtagagtgcagtactgccgtcatagttgact

SEQ ID NO: 20779 - DNA, 176 bp, Homo sapiens
  Z67715
  Located on chromosome 14
  Distance between a terminus base of telomere on chromosomal short arm and 5'-terminus of this base sequence : 66089411
  Distance between 3'-terminus of neighbour sequence of sequence listing upward to telomere on chrosomal short arm and 5'-terminus of this base sequence : 109158
aggacgaagtgttccagaaactattgacacacacacacacacacacacacacatgaaactgataggttacctgatttgtttgaatgtatacattaaaaaaatattgattctttttaccaaagaatgtgggtattgtgaacccaaaatatctgacaggtctcattttgccaaggcta

SEQ ID NO: 20780 - DNA, 235 bp, Homo sapiens
  chr14.fa.O7frz.65416949
  Located on chromosome 14
  Distance between a terminus base of telomere on chromosomal short arm and 5'-terminus of this base sequence : 66162398
  Distance between 3'-terminus of neighbour sequence of sequence listing upward to telomere on chrosomal short arm and 5'-terminus of this base sequence : 72811
gtggtactggctactgaagaggccgagttcgtgctactgcactccagcctgggcaacacagcaagacttggtctcaaaaataaataaataaataaataaataaataaataaataaataaatagatatagaaactaagaagatgatggtgttactcactggatgcaaaatgtaaccaaccagttatgtaattgtactctgaatctgttcttctagtattgtgaaagaatggtattg

SEQ ID NO: 20781 - DNA, 212 bp, Homo sapiens
  chr14.fa.O7frz.65526644
  Located on chromosome 14
  Distance between a terminus base of telomere on chromosomal short arm and 5'-terminus of this base sequence : 66272103
  Distance between 3'-terminus of neighbour sequence of sequence listing upward to telomere on chrosomal short arm and 5'-terminus of this base sequence : 109470
aaggttgaaagattcatcctagcatattagagcttgaaaatggacctaagagttccatgaaattcaatagtttctttctttctttctttctttctttctttctttctttctttctttctttctttctttcttctttcttttttgcatcagaattactcacaaaagtttcaatagtttctaaactccagacctcagagcagtacctgtctaca

SEQ ID NO: 20782 - DNA, 361 bp, Homo sapiens
  chr14.fa.O7frz.65744679
  Located on chromosome 14
  Distance between a terminus base of telomere on chromosomal short arm and 5'-terminus of this base sequence : 66489944
  Distance between 3'-terminus of neighbour sequence of sequence listing upward to telomere on chrosomal short arm and 5'-terminus of this base sequence : 217629
agaacttcacctaaggtcaaacaaaaaaccttgagcctgccacactgggggtgatttggtctcagggaaattagtatctggggcttgagcaagcttccccacctgccctaatttctcaactgccctaattttctaaatccccaccgaagttttactccacctgtaatcctaaatacagacagcaggaagaaaaaagtagccttgtcaggccagaattaacaaccactgacagaaacggaggcagctccaagttcttagctgttcaaagcacgcgcgcgcgtgcacacacacacacacacacacacacccaaaatcaaaagggacccagctcacagaggcctagtacagagcaagtgaccac

SEQ ID NO: 20783 - DNA, 216 bp, Homo sapiens
  D14S1069
  Located on chromosome 14
  Distance between a terminus base of telomere on chromosomal short arm and 5'-terminus of this base sequence : 66754104
  Distance between 3'-terminus of neighbour sequence of sequence listing upward to telomere on chrosomal short arm and 5'-terminus of this base sequence : 263799
tgttctagttgatgtgagactttcctttggcatgtattaatgaaagcaaggacataacccacaaatttcctatgtgcatgtacatatgtgcacatcacacacacacacacacacacacacacacacacacacacacacacacacacacacattttgtggttactaaacagtctaggccaggataaaatttagggaattacagcaggtcctcaaata

SEQ ID NO: 20784 - DNA, 298 bp, Homo sapiens
  chr14.fa.O7frz.66357872
  Located on chromosome 14
  Distance between a terminus base of telomere on chromosomal short arm and 5'-terminus of this base sequence : 66988866
  Distance between 3'-terminus of neighbour sequence of sequence listing upward to telomere on chrosomal short arm and 5'-terminus of this base sequence : 234546
gtttgaggttgataatgttgacagagtccttgcagaatggaagttcatctccacagggaaaggctttgtatttcaagttttaaaattccaaaatattttgctataacattgttattcctagttttttatgcctttttgtgtggaaggttggtttctcctttatctacttaccagcttttaggggaatccctttttaagtcaagaaagcaccttagaaaatttctctctctctctctctctctctctctctctctctctctctgcctttatgaaactgacagtagcatatcttgctatt

SEQ ID NO: 20785 - DNA, 422 bp, Homo sapiens
  chr14.fa.O7frz.66461706
  Located on chromosome 14
  Distance between a terminus base of telomere on chromosomal short arm and 5'-terminus of this base sequence : 67092759
  Distance between 3'-terminus of neighbour sequence of sequence listing upward to telomere on chrosomal short arm and 5'-terminus of this base sequence : 103595
ttgcattagctgagacctaagtcatgagaagcatccccatgggtcttgggaaaagtgaggaaaacatattcaaatagaaagaaatatctggtgcaaaggctctgggataggagtaagcttagagtatcccagaacaaaaagagggccagtgtggctgagagaccgtgtgtgtgtgtgtgtgtgtggagaggggaagacagcgggggtagagatagtaggggagtaattacctcacaagtttcatggctgacacctctataacaaaggagattaacaagagaaaagcatagcacatttatttaaccaaagttttacatgatgcaggagccttcagaaattaagatccagacccaaggaaagctgtattattatggttaggtttgatgaagcatggacagtcatgtagaagtatagttggacaa

SEQ ID NO: 20786 - DNA, 195 bp, Homo sapiens
  HUMUT601
  Located on chromosome 14
  Distance between a terminus base of telomere on chromosomal short arm and 5'-terminus of this base sequence : 67258538
  Distance between 3'-terminus of neighbour sequence of sequence listing upward to telomere on chrosomal short arm and 5'-terminus of this base sequence : 165357
atagagacagtaaaggccattctttttctttctttctttctttctttctttctttctttctttcttccttccttccttccttccttccttccttcctttctttctttctttctttctctctttctttctctctttctctctctctctctttctttctttctttttttgtttttgagatggagtttcactcttgtt

SEQ ID NO: 20787 - DNA, 261 bp, Homo sapiens
  D14S1065
  Located on chromosome 14
  Distance between a terminus base of telomere on chromosomal short arm and 5'-terminus of this base sequence : 67271610
  Distance between 3'-terminus of neighbour sequence of sequence listing upward to telomere on chrosomal short arm and 5'-terminus of this base sequence : 12877
tggattgtttgctctcagatccgctccctgcccttcccctgctctacttgataccacagggaactgacctttacaatttgcatttcccagtctccctttccattgagtctggttagtttggagaggagggatgaagggcagaagtatgagagaagccatgtatttttgtacacacacacacacacacacacacacacacacactctctcacacacacattcctctgccttgcttccagtggtgtcccaggcagtgacatta

SEQ ID NO: 20788 - DNA, 219 bp, Homo sapiens
  AF044776.1_1092
  Located on chromosome 14
  Distance between a terminus base of telomere on chromosomal short arm and 5'-terminus of this base sequence : 67314675
  Distance between 3'-terminus of neighbour sequence of sequence listing upward to telomere on chrosomal short arm and 5'-terminus of this base sequence : 42804
gataatctgccaagctggtaccacccatgagattctagtgtggcattttgtatcattaattacttttactgaaagtaattacttttactgaaagtaattaatgatgcaattcagagatattttaggggtgtgtgtgtgtgtgtgtgtgtatgtgtgtgtgtatcaaagttcaactttgtctccctaatcctgctagccttctggccattctattaaggt

SEQ ID NO: 20789 - DNA, 313 bp, Homo sapiens
  AC004518.1_112768
  Located on chromosome 14
  Distance between a terminus base of telomere on chromosomal short arm and 5'-terminus of this base sequence : 67403366
  Distance between 3'-terminus of neighbour sequence of sequence listing upward to telomere on chrosomal short arm and 5'-terminus of this base sequence : 88472
caaagaagctgcaaatctagtaagagaataatatgtgcgtatatgaaactataatttaagacactgtgatcaataacctaaagggaaaggctctgaggacatccaggggtcttgggctcaaaggctggagcgccacacacacacacacacacacacatgcacacacacacacatgcacacacacacacatcaaatcacatattagctcgtgtcttcatgagctttccagtttgcaaaccgctcacacatacagcatttcctttaaacttcacatcagccagtgaaggggctttgtaagcctgacatgtaagat

SEQ ID NO: 20790 - DNA, 250 bp, Homo sapiens
  AC004518.1_115875
  Located on chromosome 14
  Distance between a terminus base of telomere on chromosomal short arm and 5'-terminus of this base sequence : 67406451
  Distance between 3'-terminus of neighbour sequence of sequence listing upward to telomere on chrosomal short arm and 5'-terminus of this base sequence : 2772
cagatgaagactttagcttcactttggtgctcagttccctctacagagcccggcaaacaagagcatgcagcacatgagtatgggctgagcttgagcttttgttctcattgactgctgtgtgtgtgggggtgtgggtgtgggtgtcagtgtgtgtatgtgtgtgtgtgtgtgtgtgtgtgtgctcactcacatgttgaaggaactccattgctctcctctccacccccacccctactccagcaagctgagg

SEQ ID NO: 20791 - DNA, 335 bp, Homo sapiens
  chr14.fa.O7frz.66864630
  Located on chromosome 14
  Distance between a terminus base of telomere on chromosomal short arm and 5'-terminus of this base sequence : 67495863
  Distance between 3'-terminus of neighbour sequence of sequence listing upward to telomere on chrosomal short arm and 5'-terminus of this base sequence : 89162
gttgcagtgagttgagatctagccactgtgctccagcctgggtgacagagtgagactccatctcaaaaacaaagagagagagagagagagagagagatgggtgggacaaggtcaagatatttatttatcctcctggttctactgtaatgggcccttgcttggctgtgtctctccactgcccctgtatctaaggccatagcccctgatgaatggctctctcctccagatactttctctttcacttcgccccctttacccttcaggctccccccgctgctagccctggagggcttcatctttccttgttagcttcctttagctttacgcataacttg

SEQ ID NO: 20792 - DNA, 298 bp, Homo sapiens
  HUMUT1339
  Located on chromosome 14
  Distance between a terminus base of telomere on chromosomal short arm and 5'-terminus of this base sequence : 67582820
  Distance between 3'-terminus of neighbour sequence of sequence listing upward to telomere on chrosomal short arm and 5'-terminus of this base sequence : 86622
caggcaccccatataagcactatttacagggcactcagagaatcagaaaaactgatgaggcccaggacatagatagatagatagatagatagatagatagatagatagatagataactagagaactgtttcaagggcaccaagtgtgattacatgttcaaacctgtctttgtttatttttccccctctcacatgaaaagaaagacagatgtgtaccttctctatgagttggtgcaacgtctgggttcaggtagaaaatcctaggcccccttgaatacactcccagagctcagtgggtt

SEQ ID NO: 20793 - DNA, 462 bp, Homo sapiens
  chr14.fa.O7frz.67027625
  Located on chromosome 14
  Distance between a terminus base of telomere on chromosomal short arm and 5'-terminus of this base sequence : 67658745
  Distance between 3'-terminus of neighbour sequence of sequence listing upward to telomere on chrosomal short arm and 5'-terminus of this base sequence : 75627
ataaagtatctccttggaccacaacaggatgaagttaaaaaatcaataacagaaatataactgaaggccggtcgtggtggctcacgcctgtaatcccagcaatttgggaggcctcggaggtgggcagatcacttgagcccagaattcgagaacagcctgggcaacatgctgaaaccccatctctacaaaataataataataataataataataataataaataaaaaatagccaggcatggtggcgcacacctgtagtcccagctactcttagaggctgaggtgggaagatcatctgagcctgggaaggttggggctgcagtgagctgtgatcacaccactgcactccagtctgggcgacagagtgagaccctgtctacaaaaaaagaaaagaaaaggaaatacaactggaaaattcacaaatttgtgaaaaaacaatgcactcttaaccaatggatcaaag

SEQ ID NO: 20794 - DNA, 211 bp, Homo sapiens
  Z66914
  Located on chromosome 14
  Distance between a terminus base of telomere on chromosomal short arm and 5'-terminus of this base sequence : 67839975
  Distance between 3'-terminus of neighbour sequence of sequence listing upward to telomere on chrosomal short arm and 5'-terminus of this base sequence : 180768
ttcctcatttacaaagtgggggatggtacccacctagcagttaatgaatagcattaaactaaagagggtgtccgacacaataggcatttaatatatattattattatagtccttaatgggttatccttctaatatgtccaaggagatattacaacacacacacacacacacacacacacacacaaatcagtgttcaaattctgtttccagg

SEQ ID NO: 20795 - DNA, 185 bp, Homo sapiens
  D14S1011
  Located on chromosome 14
  Distance between a terminus base of telomere on chromosomal short arm and 5'-terminus of this base sequence : 67931828
  Distance between 3'-terminus of neighbour sequence of sequence listing upward to telomere on chrosomal short arm and 5'-terminus of this base sequence : 91642
gctgagattgcaccacggcactccagcctggcaacagagtgggactctgtctcaacacacacacacacacacacacacacacacacacacacacacacacacaactaacaaagcaaaaacaggctccatcgagattcacatggctcttaacatttgtctacccatgaaacctgatctcgaggggc

SEQ ID NO: 20796 - DNA, 148 bp, Homo sapiens
  DISO7_10003962
  Located on chromosome 14
  Distance between a terminus base of telomere on chromosomal short arm and 5'-terminus of this base sequence : 68084635
  Distance between 3'-terminus of neighbour sequence of sequence listing upward to telomere on chrosomal short arm and 5'-terminus of this base sequence : 152622
ccagattcttgaacaaatggactattttcagttgttgggatgtgtgtgtgtgtgtgtgtgtgtgtgtgtgtatgtctgtgtgtgtgtaagatgtagagggggggatcaaatgataataaagaaaattgtatcctagttgattgcccat

SEQ ID NO: 20797 - DNA, 270 bp, Homo sapiens
  chr14.fa.O7frz.67524236
  Located on chromosome 14
  Distance between a terminus base of telomere on chromosomal short arm and 5'-terminus of this base sequence : 68155512
  Distance between 3'-terminus of neighbour sequence of sequence listing upward to telomere on chrosomal short arm and 5'-terminus of this base sequence : 70729
caagatcgcagtactgtactccagcctgggtgccagagtaagcctccgtctcaaaaaagaaaaaagaaagctgaggtggctcacggtgtgtgtgtgtgtgtgtgtgtgtgtgtgtgtgtgtgtgtgcgcacacgtgtagggaagcaaaggacgtgctggctttagtgggcaggcctcctgccatggtggggccagtttgctggtagaagctgctcttccttgcagccctgcaggctgtagtgtccgctggactccaaattgtcaggttca

SEQ ID NO: 20798 - DNA, 196 bp, Homo sapiens
  Z67598
  Located on chromosome 14
  Distance between a terminus base of telomere on chromosomal short arm and 5'-terminus of this base sequence : 68438484
  Distance between 3'-terminus of neighbour sequence of sequence listing upward to telomere on chrosomal short arm and 5'-terminus of this base sequence : 282702
gggaatacagtgtccaatgaccaggagctgtgtgtgtgtgtaggtgtgtgtgtgtgtatatgtgtgtgtgtgtgtgtgtgtgtgtgtatgtgggaggggtttgtgggctggctctgtctagaaaggcctcaggccctaggctatccccagtcccttccttcctccctgcagattgtctcctagagtcactgcccag

SEQ ID NO: 20799 - DNA, 120 bp, Homo sapiens
  D14S588
  Located on chromosome 14
  Distance between a terminus base of telomere on chromosomal short arm and 5'-terminus of this base sequence : 68586190
  Distance between 3'-terminus of neighbour sequence of sequence listing upward to telomere on chrosomal short arm and 5'-terminus of this base sequence : 147510
cgaatgcatacttgctgttgaaatttggatccatcccttccttccttccttccttccttccttccttccttcctttctctctttccttctttctttccttccttttttctttctttcggc

SEQ ID NO: 20800 - DNA, 428 bp, Homo sapiens
  chr14.fa.O7frz.68182709
  Located on chromosome 14
  Distance between a terminus base of telomere on chromosomal short arm and 5'-terminus of this base sequence : 68779466
  Distance between 3'-terminus of neighbour sequence of sequence listing upward to telomere on chrosomal short arm and 5'-terminus of this base sequence : 193156
ctgtccttgcaatagtgagtacttgtgatatctggttaagtgtttgatccaccccccatccctcttgcttctgcttttgccatgtgacatgcaagctcctgcttcaccttctgccctgagtaaaagctccctgaggcctccccagaagcagagcaaatgccagtgttatgcttcctgtacagcctacagaaccatgagcaattaaatctcttttctttataaattacccagtctcaggccggccttccttccttccttccttccttccttccttccttccttccctccctcccttccttcttccttcactccctctttcttttcttttctttgctcctttctttcctttcattcttattctgtcacccaggctggagtacagtggtaccatcatggctcactgcagccttcacctcttagctcaagtg

SEQ ID NO: 20801 - DNA, 260 bp, Homo sapiens
  D14S1029
  Located on chromosome 14
  Distance between a terminus base of telomere on chromosomal short arm and 5'-terminus of this base sequence : 68856404
  Distance between 3'-terminus of neighbour sequence of sequence listing upward to telomere on chrosomal short arm and 5'-terminus of this base sequence : 76510
agcatggtcgcaggttgtagggtgtgtgtgtgtgtgagtgtgtgtatgtgtgtgtgtgtgtgtgtgtgtgtgtaggggtaggagtaggggcagggattgctctatgcagtcactctgggatccaggctgagagtgactctgccatcttcatcatgtggcttccaaggttactctgggggtcatctccatcctcagtcaaccagatggagtagacatgaagcagtgcatgtgagggagtttcatgggccagtcctggaaat

SEQ ID NO: 20802 - DNA, 123 bp, Homo sapiens
  D14S603
  Located on chromosome 14
  Distance between a terminus base of telomere on chromosomal short arm and 5'-terminus of this base sequence : 68889856
  Distance between 3'-terminus of neighbour sequence of sequence listing upward to telomere on chrosomal short arm and 5'-terminus of this base sequence : 33192
aatggatcaatggctttcctcactacattgagatagatagatatagataggcagataggtagatagatagatagatagatagatagatagatagatagataggcaagagcttgtttattctgc

SEQ ID NO: 20803 - DNA, 176 bp, Homo sapiens
  D14S258
  Located on chromosome 14
  Distance between a terminus base of telomere on chromosomal short arm and 5'-terminus of this base sequence : 68948914
  Distance between 3'-terminus of neighbour sequence of sequence listing upward to telomere on chrosomal short arm and 5'-terminus of this base sequence : 58935
ctaactaaatggcgagcattgagaacactgtgtgtgtgtgtgtgtgtgtgtgtgtgtgtgtgtatgtgtgtgcacgtttgtgtgcagggtggaacgggaaggatctgtggagcccagcaggaagcacagtttgagaactttggctctaaggaacatggtgcttccagatgcagtga

SEQ ID NO: 20804 - DNA, 400 bp, Homo sapiens
  chr14.fa.O7frz.68449398
  Located on chromosome 14
  Distance between a terminus base of telomere on chromosomal short arm and 5'-terminus of this base sequence : 69046242
  Distance between 3'-terminus of neighbour sequence of sequence listing upward to telomere on chrosomal short arm and 5'-terminus of this base sequence : 97152
attcataagacctcatccaaagtagataggggagactcagacttggggactggtttttagagcaaattattatacttggtgtgtagctgtcagtcagacttgtttcagtgcataacacatgctgaggaacacacacacacacacacacacacacacacacacggcattcaaagcatttaaaactgcccatcatggcatacacatcctgacttttaccctaataagctggcccttctaatcaggggacttggctgattcttagtcttaaaagataaggggagctgtcttcaactaaaatactagcagagatttactgttctctgcttgacttataaccacaacttcagttccctccgtatttttggcccagctgagactcttattggtctttggaatgagt

SEQ ID NO: 20805 - DNA, 276 bp, Homo sapiens
  chr14.fa.O7frz.68590478
  Located on chromosome 14
  Distance between a terminus base of telomere on chromosomal short arm and 5'-terminus of this base sequence : 69187252
  Distance between 3'-terminus of neighbour sequence of sequence listing upward to telomere on chrosomal short arm and 5'-terminus of this base sequence : 140610
tggacctcgacatatgagtctctttttttggctgttcctaatttatatcctttataataacactgtaatcataagtatagtattctcctgagttctatgagtagttctactaaattattgaacctgagggggtggcttaaacctggggttatgcctggtgtaggaagttaggggagttttgtgcaggactatgcatagagtgtgtgtgtgcgtgtgtgtgtgtgtgtgtgtggtgtttgaattgcactgcaacacttactgcctgttaccatagaa

SEQ ID NO: 20806 - DNA, 439 bp, Homo sapiens
  chr14.fa.O7frz.68867463
  Located on chromosome 14
  Distance between a terminus base of telomere on chromosomal short arm and 5'-terminus of this base sequence : 69668149
  Distance between 3'-terminus of neighbour sequence of sequence listing upward to telomere on chrosomal short arm and 5'-terminus of this base sequence : 480621
atggttaaagaaaccaagaaagaatgttgaagtatccagagattagcaagagagggaagatattttggcaaaaaaagaaggaaggaaggaaggaaggagggagggagggagggaaggaaggaaggaaggaaggagagagaaagagaaaagaaagaaagaaagagagagaagaaggaaggaaatgaaagaaagaaagaaagaaagaaagaagggaagggaagaagggaagggaagggaagaagggaagggaagggaaagagagagagaaataaattgtattaccagaacccattaagaggtagactcaaggaggaagggcccccttgttataatagtgataaaaaaatcgaccgctgccaaaaccttggtgccaaagcagggaggaagtgggaaaaaaatgttaatctgtcttctctcatcctccagtctcatgttggtg

SEQ ID NO: 20807 - DNA, 390 bp, Homo sapiens
  chr14.fa.O7frz.68946360
  Located on chromosome 14
  Distance between a terminus base of telomere on chromosomal short arm and 5'-terminus of this base sequence : 69746967
  Distance between 3'-terminus of neighbour sequence of sequence listing upward to telomere on chrosomal short arm and 5'-terminus of this base sequence : 78379
caagccactgatttcaaagagggtgcaaatttatgtggaaggaggtaggggagggagggtgagagactgctctggagctcagtgagggacctcagggttacacaagaagggactctgcgctgggttccaggcctgattcttttattttctctttttctttctttctctttctttttctttctttcttttctttctttctttctttctttcttttctttctttctttctttctttctttctttctttctttctctctctttcttccctccctccctccgtccctccctcctttctttttctttctttctttctctctctctctctttctttgtacagagttttgctcttgtcacccaggctggagtgcagtggtacaatggcgtgatcttg

SEQ ID NO: 20808 - DNA, 403 bp, Homo sapiens
  AC004818.1_14402
  Located on chromosome 14
  Distance between a terminus base of telomere on chromosomal short arm and 5'-terminus of this base sequence : 69870736
  Distance between 3'-terminus of neighbour sequence of sequence listing upward to telomere on chrosomal short arm and 5'-terminus of this base sequence : 123379
cagactgtctttggacttgaactgaaaccctttcctacatctctggccagttagcctcccgtgtcagattttggatgtatcaggcttccacaattgggtgaggcgattcctttagaataaatctctttacacacacacacacacacacacacacacacacacacacacacgtgtacccacacacacgtgcatatgcacacacacacacgcacacatccatcctattgcttctgtttctctggagaaccctaatacaaatttgcatgtcattaaatatcactagtgatgtagctaagcattcaaaatactaagaatgtggtcatgggcttcctcaattaagaattcagaactgggagctcgtaagttcactgaaattactgtatgttaaagtaggagcttacgc

SEQ ID NO: 20809 - DNA, 168 bp, Homo sapiens
  D14S1002
  Located on chromosome 14
  Distance between a terminus base of telomere on chromosomal short arm and 5'-terminus of this base sequence : 69870801
  Distance between 3'-terminus of neighbour sequence of sequence listing upward to telomere on chrosomal short arm and 5'-terminus of this base sequence : -338
agattttggatgtatcaggcttccacaattgggtgaggcgattcctttagaataaatctctttacacacacacacacacacacacacacacacacacacacacacgtgtacccacacacacgtgcatatgcacacacacacacgcacacatccatcctattgcttctg

SEQ ID NO: 20810 - DNA, 241 bp, Homo sapiens
  AC004825.2_91690
  Located on chromosome 14
  Distance between a terminus base of telomere on chromosomal short arm and 5'-terminus of this base sequence : 69917540
  Distance between 3'-terminus of neighbour sequence of sequence listing upward to telomere on chrosomal short arm and 5'-terminus of this base sequence : 46571
atccaaaccatattagtcctcataatgggattagtacccttatgagaggagatagcagacagcttgcagtctctctctctctctctctctctctctctccctctctctctctctctctctctctctctctctctccaccatgtgaggacacagagggaaggcagccatctacaagccaaggagagagtccttacaggaacctgaccgtgctgggaccttgatactcatacttccagcctcc

SEQ ID NO: 20811 - DNA, 268 bp, Homo sapiens
  AC004825.2_72841
  Located on chromosome 14
  Distance between a terminus base of telomere on chromosomal short arm and 5'-terminus of this base sequence : 69936267
  Distance between 3'-terminus of neighbour sequence of sequence listing upward to telomere on chrosomal short arm and 5'-terminus of this base sequence : 18486
aaaggataacatgtgcataatgtaaaattcattaagagaaaagatatacaatcaaaagtaaggtctctcacccctgtggcaattcctgctgccattttctcacatgttctgctagggacattcagtacacagataatcacataaaatacattcttttctcttatgacaagtgctgttatatacttttttccacatatatatatatatatatatatatatatttttttttttttttttttttttttgagacaggatctcactttgtcac

SEQ ID NO: 20812 - DNA, 236 bp, Homo sapiens
  AC004825.2_2785
  Located on chromosome 14
  Distance between a terminus base of telomere on chromosomal short arm and 5'-terminus of this base sequence : 70006356
  Distance between 3'-terminus of neighbour sequence of sequence listing upward to telomere on chrosomal short arm and 5'-terminus of this base sequence : 69821
ctgtaatcctagctactcaggaggttgaggcacgagaatcgcttgaacctgggaggcggaggttgtagtgagccgagatcgtgtgactgcactccagcctgggtgaaagagcgagactctgtcacaaatagagaaacacacgcacacatacaggtacatatgtatgtatgtatgtatgtatgtatgtactatgtggtatggaaacttttttaaaacaattaaaggtgaatcaactg

SEQ ID NO: 20813 - DNA, 231 bp, Homo sapiens
  AC004817.2_99638
  Located on chromosome 14
  Distance between a terminus base of telomere on chromosomal short arm and 5'-terminus of this base sequence : 70175233
  Distance between 3'-terminus of neighbour sequence of sequence listing upward to telomere on chrosomal short arm and 5'-terminus of this base sequence : 168641
ttccttgaggactttgaagtatagtactagcatcagtgcctaccctgcttcttgtaccttccccttaccaataatcacagacacacacacacacacacacacgcacgcacactcactctcacacacacacatactctcacacacacacgcacactctcacactcacgcaaactcacacccactctctcacacacacacactcacacagtgaattgcactacgtgaggacta

SEQ ID NO: 20814 - DNA, 214 bp, Homo sapiens
  AC004817.2_81994
  Located on chromosome 14
  Distance between a terminus base of telomere on chromosomal short arm and 5'-terminus of this base sequence : 70192815
  Distance between 3'-terminus of neighbour sequence of sequence listing upward to telomere on chrosomal short arm and 5'-terminus of this base sequence : 17351
ctcctgacctcaagtgatgtacccgcctcgacctcccaaagtattgggattacaggcatgagccactgcacccagtttctcacctctctttctttcttacacacatacacacaggtgcgctcacacgtgtgcgggcacacacacacacacacacacacacacacggttcttttctacagtgccagtaaatttcttacgaaactgttgctgactt

SEQ ID NO: 20815 - DNA, 298 bp, Homo sapiens
  AC004817.2_64819
  Located on chromosome 14
  Distance between a terminus base of telomere on chromosomal short arm and 5'-terminus of this base sequence : 70209894
  Distance between 3'-terminus of neighbour sequence of sequence listing upward to telomere on chrosomal short arm and 5'-terminus of this base sequence : 16865
aactctgctcatttcactagaaagcatcatctgtctgcctctctcttcctatttattaatctcaaactaagcaaaatgtatccgggttgcaggaagagagaagacactgtgcccacacaattcctactgcttgtaaactataaagcattataaacatatgatatctatgtctatatatatgcatatacatatagccatgtagctttgtattattcttttacaaaagaaagtgtgtgtgtgtgtgtgtgtgtgtgtgtgtgcgcgtgtgttcctagacacacatgccatatgcagtgag

SEQ ID NO: 20816 - DNA, 298 bp, Homo sapiens
  chr14.fa.O7frz.69773203
  Located on chromosome 14
  Distance between a terminus base of telomere on chromosomal short arm and 5'-terminus of this base sequence : 70354952
  Distance between 3'-terminus of neighbour sequence of sequence listing upward to telomere on chrosomal short arm and 5'-terminus of this base sequence : 144760
ctttgaaattactgtaacatggtcaatatttttgttgtttttgtagttgggacaagataaattttaaaataaaattgtcaacatttaaagaaaattgtcaacatatagctactctttgtgaaactgacctactataagatgaaactttttttatcatttgctgtaaaaggaagatttgttatttattggaaaattttataggtctaagagctcttatattaaattatatatatatatatatatatatatatactcacacatacatatgtgtatatatatttagatgcaggatctcact

SEQ ID NO: 20817 - DNA, 467 bp, Homo sapiens
  AC005994.2_20442
  Located on chromosome 14
  Distance between a terminus base of telomere on chromosomal short arm and 5'-terminus of this base sequence : 70452982
  Distance between 3'-terminus of neighbour sequence of sequence listing upward to telomere on chrosomal short arm and 5'-terminus of this base sequence : 97732
ctggtaatgctggtacagtatctctaataggtcaggtgggagattcttctgttatacatccattcttactcaggtctcctcaggcaacacaggaggaggccatgactcaacagttctcccaacctgttggtgacatgactcttcgccttctaagtgtatacttccttcctaagtgctatttctctacttaagggatatctaaaacaatttctatactctaaaagaaagaaaaatctacacacacacacacacacacacacacacacacgcatgcacacacacacaaccttgtatatatatagttttatgtgtaccttattaaatccatcattcttttttaaattattttttgagcagcattattctagaatataaatactgaattgaataagcatacttttttcttttcctttaaacacacttttaaaatacagtttttaaaattaaatagaaacatggtctcactg

SEQ ID NO: 20818 - DNA, 462 bp, Homo sapiens
  chr14.fa.O7frz.70087635
  Located on chromosome 14
  Distance between a terminus base of telomere on chromosomal short arm and 5'-terminus of this base sequence : 70669580
  Distance between 3'-terminus of neighbour sequence of sequence listing upward to telomere on chrosomal short arm and 5'-terminus of this base sequence : 216131
tgtttcaatgagcaattacaagcatgattgttatgttatgttatgttatgttatgttatgttatgttatgttatgttctgttctgttctgttctttggagatggggcctcactctgtcgccaggctgcagtgcagtggcttgatttcggctcactgcaacctccaccctccgggttcaagcgattctcttgcctcagcctcctgagtaatgtgtgtatttttagtatttttgtatttttattagagacgcccagctaatttttgtatttttagtagagacggggtttcaccatgttggctaggatggtctcgatctcttgacctcatgatcctcctgcctaggcttcccaaagtgctgggattacaggcgtgagccacagcacccagccacaagcatgatttttaaaaatgaaaaaatagaaagtcttagcaaaaaattgaaggtattaaggaacaaatgga

SEQ ID NO: 20819 - DNA, 381 bp, Homo sapiens
  AC005993.2_56050
  Located on chromosome 14
  Distance between a terminus base of telomere on chromosomal short arm and 5'-terminus of this base sequence : 70926686
  Distance between 3'-terminus of neighbour sequence of sequence listing upward to telomere on chrosomal short arm and 5'-terminus of this base sequence : 256644
ttaatgctacgtggaaggtaaaatcagtgcaggagaggtccacctgaagaatgacagccggtaggattagtctgattttatggctcttagatagtttgctgtgtgtgtgcgtgtgcataagacagacagagagagagagagagagagagagagagagagagagagagagaaatcttgtctagaggctgagctagcatctgccggtacttcagctctcctaacccctcattctatggcacctgtcttcctgttaggccaattgtcagatgcttttgatgagcatagacctttgttccaacccactcttccaaaggttatttttccagtttattccatttctaaccatttacctgctgctaatcctcagcacagttaattcta

SEQ ID NO: 20820 - DNA, 428 bp, Homo sapiens
  AC005993.2_23553
  Located on chromosome 14
  Distance between a terminus base of telomere on chromosomal short arm and 5'-terminus of this base sequence : 70959240
  Distance between 3'-terminus of neighbour sequence of sequence listing upward to telomere on chrosomal short arm and 5'-terminus of this base sequence : 32173
gttcttgacagttttgaacagtactggccaggtattttgtagactgtaccatgctctttttgtttgtttaccacagaagtaaatgtgatgggaagacaaaaaacaaaaacaaaacaaaacaaaacaaaacaaaacaaaaaaaggaacctagatgctatagttctcaaaattccatttcagaaaacccattgaaaatcttgctagagttgagctttttggggttcctatgtgaataagttcctgatcccagaatcaggacatggcaggactaaggagaacaggagagcaaggactaaaagctcagaagcctttttccaaaagcccccagcatatttttccttcattttttattggtcataatttcatatcatggccacagaaatggaacggccatgattagcttagtctaatgaagatccactctagtg

SEQ ID NO: 20821 - DNA, 234 bp, Homo sapiens
  AC005477.1_96145
  Located on chromosome 14
  Distance between a terminus base of telomere on chromosomal short arm and 5'-terminus of this base sequence : 70992745
  Distance between 3'-terminus of neighbour sequence of sequence listing upward to telomere on chrosomal short arm and 5'-terminus of this base sequence : 33077
tgttggaatttggtaaggatagtgtgacacagaaagggggtgtattagtgttccctagagggacagaactaatagtgtgtgtgtgtgtgtgtgtgtgtgtgtatattctatttttatatatacaatagtatatatataacagtgtgtgtgtgtatatatatgtaggagtttattaagtattatcttacatgatcacaaggtcccacaagaggctgtctacaagcttgaggaaga

SEQ ID NO: 20822 - DNA, 219 bp, Homo sapiens
  chr14.fa.O7frz.70507525
  Located on chromosome 14
  Distance between a terminus base of telomere on chromosomal short arm and 5'-terminus of this base sequence : 71090590
  Distance between 3'-terminus of neighbour sequence of sequence listing upward to telomere on chrosomal short arm and 5'-terminus of this base sequence : 97611
ccaacatgaagatgactgatacacccatcatactgaaggattcctactgtgtcagagattacattatattaagtccttacagaaatataaagagtataaccttcaaaaaactgggaattgttaaattatacattggattttgggggctattgtttgggaggttttgttttgttttgttttgtttttccttctttcataacagttcgctcaattaactat

SEQ ID NO: 20823 - DNA, 236 bp, Homo sapiens
  AC005226.1_94569
  Located on chromosome 14
  Distance between a terminus base of telomere on chromosomal short arm and 5'-terminus of this base sequence : 71202444
  Distance between 3'-terminus of neighbour sequence of sequence listing upward to telomere on chrosomal short arm and 5'-terminus of this base sequence : 111635
actgaatttaccaaaacagcataggtaacagattctaagatatcttagagttaattgataatatgtatctgaatgttgtaaaatttatctttcctatgcaaatcccttcaaaccatcccttctagtcccatttttgagacacacacacacacacacacacacacacacacacacacacacacagactgactttgttattccttactggtttttactgatggtcatagacgtctttc

SEQ ID NO: 20824 - DNA, 368 bp, Homo sapiens
  AC005226.1_76295
  Located on chromosome 14
  Distance between a terminus base of telomere on chromosomal short arm and 5'-terminus of this base sequence : 71220754
  Distance between 3'-terminus of neighbour sequence of sequence listing upward to telomere on chrosomal short arm and 5'-terminus of this base sequence : 18074
acagtctgtgaggcttacaaataccttctttaagctattagtaaaacaaaagtactggcacaaagtgatttcttgttcatataacagaagtattttactttcaaacacacacacacacacacacacacacacacacacacacacacagaaagagggagagaaagagagagaagcccaacccaacaaaccacttaagggaaaccatgaaaatggtatctttgttgagagttaatgagtttatagttaatttatgctttccctggaatacatattatactcattatgtacaagtaaactatgactgtttttaaacctatcacagatattccagatcttaaaatgctctgtttgaaataaaaggcagaagg

SEQ ID NO: 20825 - DNA, 282 bp, Homo sapiens
  AC005226.1_72200
  Located on chromosome 14
  Distance between a terminus base of telomere on chromosomal short arm and 5'-terminus of this base sequence : 71224853
  Distance between 3'-terminus of neighbour sequence of sequence listing upward to telomere on chrosomal short arm and 5'-terminus of this base sequence : 3731
gtaatgagaacaggctaacctaccccttggagttgacgtgaggatctcatgagctaatgcccctaaaatgcatggtgccttacagtgtgccccataggtgctaactatagcagttatcatcatcatcatcatcatcatcatcaatgaaaatacgggagaagaaaaaattaccaataatcccactattgtacctcaacaactctcttcattttgggtattcccttcagtcattgttacgttgcattcacatctttgtataactgcattaaactgcatacaatt

SEQ ID NO: 20826 - DNA, 326 bp, Homo sapiens
  AC005157.1_107846
  Located on chromosome 14
  Distance between a terminus base of telomere on chromosomal short arm and 5'-terminus of this base sequence : 71353283
  Distance between 3'-terminus of neighbour sequence of sequence listing upward to telomere on chrosomal short arm and 5'-terminus of this base sequence : 128148
atacatggccaaatcagtaaacctgaacttctcaaagtggccatctggtagctactagcttataaactgttccctaggtatagagaattgaaagcaggtgaagtgtgtgtgtgtgtgtgtgtgtgtgtgtgtgtgtgtgtgtatttcacatatcactcaggtcaatgttcctttgaaaatggagaatgcaactctattaagataatagtgtaaatttggtaactgatcacttacagcaattacaacaaaagatgcaaaagtcaggcagaactgggttctaatgctggctgtagcactggttggttatgtgaccttgagctcattag

SEQ ID NO: 20827 - DNA, 215 bp, Homo sapiens
  Z24162.1_116
  Located on chromosome 14
  Distance between a terminus base of telomere on chromosomal short arm and 5'-terminus of this base sequence : 71597226
  Distance between 3'-terminus of neighbour sequence of sequence listing upward to telomere on chrosomal short arm and 5'-terminus of this base sequence : 243617
ggctaagtttagtgcacttgaagattcagataaggttgctgatggggtgattttgtggacgtgtgtgtgtgtgtgtgtgtgtgtgtgtgtgtgtgtgtgtgtttaagatggggagaaaaaatgaaaagttttgtctcactagtgaaaatggggagtgaaagcaatggggaggaaaaaggtcaaggagaggtagggaaaggcagactttctgacag

SEQ ID NO: 20828 - DNA, 152 bp, Homo sapiens
  D14S277
  Located on chromosome 14
  Distance between a terminus base of telomere on chromosomal short arm and 5'-terminus of this base sequence : 71597238
  Distance between 3'-terminus of neighbour sequence of sequence listing upward to telomere on chrosomal short arm and 5'-terminus of this base sequence : -203
tgcacttgaagattcagataaggttgctgatggggtgattttgtggacgtgtgtgtgtgtgtgtgtgtgtgtgtgtgtgtgtgtgtgtgtttaagatggggagaaaaaatgaaaagttttgtctcactagtgaaaatggggagtgaaagcaa

SEQ ID NO: 20829 - DNA, 153 bp, Homo sapiens
  Z67144
  Located on chromosome 14
  Distance between a terminus base of telomere on chromosomal short arm and 5'-terminus of this base sequence : 71603048
  Distance between 3'-terminus of neighbour sequence of sequence listing upward to telomere on chrosomal short arm and 5'-terminus of this base sequence : 5658
ggttcgttgggcaggatgtacctctagaaaaatcgaccacccctccccacactccacccttccccattatcacacacacacacacacacacacacacacacacacacacacacacacacacacctgtttccttctcactcccaaccaggctgc

SEQ ID NO: 20830 - DNA, 361 bp, Homo sapiens
  chr14.fa.O7frz.71125293
  Located on chromosome 14
  Distance between a terminus base of telomere on chromosomal short arm and 5'-terminus of this base sequence : 71708255
  Distance between 3'-terminus of neighbour sequence of sequence listing upward to telomere on chrosomal short arm and 5'-terminus of this base sequence : 105054
cagctgtacaaaggtattactgtcagataacccattcaaggtggttaagcctccatctatttcatttttattttacccgcttctaatcccattctttcagaaccctttcaattctccccttacgccatgtcgttcatttgcactgaaagcaaaaggaagttggaaagtctgataagtggtaggtgataaaatagtttgtttcctttaaccacaggaggaaatttctgtgatctgcatccacatacatgtgcacgtgtgcacaccacacacacacacacacacacacacacacagacacacacacacacacacacacacccagccaccagccatgcccaggtatcggttactccagaaagtt

SEQ ID NO: 20831 - DNA, 102 bp, Homo sapiens
  D14S268
  Located on chromosome 14
  Distance between a terminus base of telomere on chromosomal short arm and 5'-terminus of this base sequence : 71841511
  Distance between 3'-terminus of neighbour sequence of sequence listing upward to telomere on chrosomal short arm and 5'-terminus of this base sequence : 132895
agcttcctactgtgtaaaacgagggagtcccacagccctggacacacacacacacacaaacacacagacacacacacacttctaaatacaaggtgcagcccc

SEQ ID NO: 20832 - DNA, 241 bp, Homo sapiens
  D14S1028
  Located on chromosome 14
  Distance between a terminus base of telomere on chromosomal short arm and 5'-terminus of this base sequence : 71952194
  Distance between 3'-terminus of neighbour sequence of sequence listing upward to telomere on chrosomal short arm and 5'-terminus of this base sequence : 110581
tgaacactggttgtactgctgtcagggtcttgctgctcctgagccctctcggtagccagaggcaagaacatctgcatatgtacctgtacatatttatatctctgtgtgtgtgtgtgtgtgtgtgtgtgtgtgtgtgtgtgtgtgtgtccatgattgcactttagtacttcaatcccaatctggttttcaatctttccacatttatagctctcttttccaatagtgagaatcccatctccca

SEQ ID NO: 20833 - DNA, 350 bp, Homo sapiens
  AC004858.2_98632
  Located on chromosome 14
  Distance between a terminus base of telomere on chromosomal short arm and 5'-terminus of this base sequence : 72140337
  Distance between 3'-terminus of neighbour sequence of sequence listing upward to telomere on chrosomal short arm and 5'-terminus of this base sequence : 187902
gattataagcgtgagtcactgtgcccagcctgagaatttttttagagacaacatggtctttgtctgtctgtctgtctgtctgtctctctctctctctctctctctctctcacacacacacacacacacacacacacacacacacacactctctctctctctctctctctcactatgggtaaaagtaataattttcaactctggttaatttctgtctgaagccactttttatagaaacacagtggccactcaatgttctgggcagacatgactccctgctgtctccttgggtccgtgggcatttttaaagttgctctttttgttgaagttctgtatactgagacatcagct

SEQ ID NO: 20834 - DNA, 209 bp, Homo sapiens
  D14S77
  Located on chromosome 14
  Distance between a terminus base of telomere on chromosomal short arm and 5'-terminus of this base sequence : 72140345
  Distance between 3'-terminus of neighbour sequence of sequence listing upward to telomere on chrosomal short arm and 5'-terminus of this base sequence : -342
gcgtgagtcactgtgcccagcctgagaatttttttagagacaacatggtctttgtctgtctgtctgtctgtctgtctctctctctctctctctctctctctcacacacacacacacacacacacacacacacacacacactctctctctctctctctctctcactatgggtaaaagtaataattttcaactctggttaatttctgtctg

SEQ ID NO: 20835 - DNA, 205 bp, Homo sapiens
  AF109907.1_33118
  Located on chromosome 14
  Distance between a terminus base of telomere on chromosomal short arm and 5'-terminus of this base sequence : 72151509
  Distance between 3'-terminus of neighbour sequence of sequence listing upward to telomere on chrosomal short arm and 5'-terminus of this base sequence : 10955
acaggtactggaaccttgatgtacttgtttgaattagatatgtagaaaggataatggaggtagaggagatagaacatctgatggcattgatagcagttaggttaagcatcacaaggattactacaggaactgatacgtgtgtgtgtgtgtgtgtgtgtgtgtgtgtgtgtgttttaagtcggatacatgtgcaggtttgttacat

SEQ ID NO: 20836 - DNA, 361 bp, Homo sapiens
  AC004858.2_87351
  Located on chromosome 14
  Distance between a terminus base of telomere on chromosomal short arm and 5'-terminus of this base sequence : 72151597
  Distance between 3'-terminus of neighbour sequence of sequence listing upward to telomere on chrosomal short arm and 5'-terminus of this base sequence : -117
gatagcagttaggttaagcatcacaaggattactacaggaactgatacgtgtgtgtgtgtgtgtgtgtgtgtgtgtgtgtgtgttttaagtcggatacatgtgcaggtttgttacataggtaaacttgtgtcatgggggtttgttgaacagattatttcatcacccaggtgttaagcctagtactcattagttatttttcctgatcctctccctcctcccaccctctgccctacgataggccccattgtgtgttgttcccctctcttcgttcatgttttttcatcatttagctcccgcttataagtgaaaacatactgtatttggttttctgttcctgtgttagtttgctaaggatagtgg

SEQ ID NO: 20837 - DNA, 184 bp, Homo sapiens
  chr14.fa.O7frz.71803213
  Located on chromosome 14
  Distance between a terminus base of telomere on chromosomal short arm and 5'-terminus of this base sequence : 72386442
  Distance between 3'-terminus of neighbour sequence of sequence listing upward to telomere on chrosomal short arm and 5'-terminus of this base sequence : 234484
aggttgaggcacaagaatcacttgaacccagaagcagtgaggcgtggttgcaccactgcactccagcctgggcgagagtgaggctctgtctcacatacatacatacatatatacatacatacatacatacacacacacacacacacacacacacacactgaagtcagtgtttcctatgtcaatg

SEQ ID NO: 20838 - DNA, 268 bp, Homo sapiens
  DISO7_10003966
  Located on chromosome 14
  Distance between a terminus base of telomere on chromosomal short arm and 5'-terminus of this base sequence : 72730571
  Distance between 3'-terminus of neighbour sequence of sequence listing upward to telomere on chrosomal short arm and 5'-terminus of this base sequence : 343945
ggaggagagttgaggacattacaaaatgaaggaactttaagctgggcacggtggcatgcacctgtagatccagctacttgggaggctgaggcatgaagatcctttgagcccaggagttcaagtccagcctgggcaacatagcaagccctgtctataaataaataaataaataaataaataaataaataaataaataaataaataaagtcttcagagaagagaagagaaaagggaaagaaaaatgaaggaactttgttaaccagtaggc

SEQ ID NO: 20839 - DNA, 147 bp, Homo sapiens
  D14S1025
  Located on chromosome 14
  Distance between a terminus base of telomere on chromosomal short arm and 5'-terminus of this base sequence : 72809246
  Distance between 3'-terminus of neighbour sequence of sequence listing upward to telomere on chrosomal short arm and 5'-terminus of this base sequence : 78407
aggaaattaacattttcttacagcttcaagttctagtgtgtgtgtgtgtgtgtgtgtgtgtgtgtgtgtgtgtgtattttgttgttgttgttgttttcgagacagagtctcgctctgtcgcccaggctggagtgcagtggtgccatc

SEQ ID NO: 20840 - DNA, 470 bp, Homo sapiens
  chr14.fa.O7frz.73175275
  Located on chromosome 14
  Distance between a terminus base of telomere on chromosomal short arm and 5'-terminus of this base sequence : 73005964
  Distance between 3'-terminus of neighbour sequence of sequence listing upward to telomere on chrosomal short arm and 5'-terminus of this base sequence : 196571
ggtcaggagttctcaggagttcgagaccagcctggccaacatagtgaaaccccatctccaataaaaatacaaaaaaattagccaggagtggtggcgcatgcctgtaatcccagctacttgggaggctgaggcagaagaatcgcttgaacccaggaggcgaaggttgcagtgagctgagatcatgccattgcactccagcccaggaaacaagagcgagactccatctcaaaaaaataataataaataaataaataaataaataaaccatgtgacttggcatcttaatttgggctgctagtctttctgttctgtgacctgtgcgatagcttgcctggtaatacactcggaggctaccattgcattgagataatttcccacattcatggtgcccagcacagtaccttgtccatagcccaaacaaaaatacctcataatttcacttctagctactctgattactgaacaagctc

SEQ ID NO: 20841 - DNA, 306 bp, Homo sapiens
  D14S986
  Located on chromosome 14
  Distance between a terminus base of telomere on chromosomal short arm and 5'-terminus of this base sequence : 73079137
  Distance between 3'-terminus of neighbour sequence of sequence listing upward to telomere on chrosomal short arm and 5'-terminus of this base sequence : 72703
accatgttataaagaatgctgggcggcacacactgttctcccacctactctggagactgaggctcaaggattgcttgagcccaggaattcggggctgcagtgagccatgattgtgtcactgtattccagcctggatgacagagtaagaccctgtccttctctctctctcttcctctttctctctctcgctctgtttctctctctctctcttatacacacacacacacagacacacacacacacacacacacacacacacactactgggaaagtgaatgtttgttttcctcgccattagtggaagct

SEQ ID NO: 20842 - DNA, 197 bp, Homo sapiens
  D14S71
  Located on chromosome 14
  Distance between a terminus base of telomere on chromosomal short arm and 5'-terminus of this base sequence : 73150625
  Distance between 3'-terminus of neighbour sequence of sequence listing upward to telomere on chrosomal short arm and 5'-terminus of this base sequence : 71182
cccggccagaaatgcttttttaatataactgagattagtgtgtgtgtgtgtgtgtgtgtgtgtgtgtgtgtgtgtagttttaacttgtgctttaaaaaattttattctatcttaagcattttcctgtgtcattaaaagttctaccactgaagatttttgaataggaaagatacacacctttaggaggcattggtgca

SEQ ID NO: 20843 - DNA, 139 bp, Homo sapiens
  D14S1047
  Located on chromosome 14
  Distance between a terminus base of telomere on chromosomal short arm and 5'-terminus of this base sequence : 73468578
  Distance between 3'-terminus of neighbour sequence of sequence listing upward to telomere on chrosomal short arm and 5'-terminus of this base sequence : 317756
tgccagaacacccactcccaaggactctcctcttcttatgccttggaaggtgtgtgtgtgtgtgtgtgtgtgtgtgtgtgtgtgtgtgtgagagagagagagagagagaaagggagaagaagggataagccaatgaggc

SEQ ID NO: 20844 - DNA, 237 bp, Homo sapiens
  chr14.fa.O7frz.73749063
  Located on chromosome 14
  Distance between a terminus base of telomere on chromosomal short arm and 5'-terminus of this base sequence : 73579936
  Distance between 3'-terminus of neighbour sequence of sequence listing upward to telomere on chrosomal short arm and 5'-terminus of this base sequence : 111219
gaaacaataaatgtcagactgaacctcgcagatgcatggcacaaaccctatagagcctgcctgcctgcctgcctgccttccctccctttttcctccctccctcccttccttcctcccttccttccccacagtctcaaggctggcatgctggcccactgtccctcactagctgggtgaatttgggcaggttacacaacctctttgaggctgggtcttcttatcagtaaactggagatg

SEQ ID NO: 20845 - DNA, 246 bp, Homo sapiens
  D14S1045
  Located on chromosome 14
  Distance between a terminus base of telomere on chromosomal short arm and 5'-terminus of this base sequence : 73618729
  Distance between 3'-terminus of neighbour sequence of sequence listing upward to telomere on chrosomal short arm and 5'-terminus of this base sequence : 38556
agggctggtgacaatggtcctggtggaataactgtatcccaagccagccaaagccactactggacctgctgaccactgaggctgagtctgggctctgatttcttcccagaacaggtctacacctgttctgtgtacatgcacacacacacatacatacacacacacacacacacacacacacacacacacactccagtttcctctctctgcttgttgccacctcctcccatccacccaagtcctcac

SEQ ID NO: 20846 - DNA, 450 bp, Homo sapiens
  AC007956.5_141633
  Located on chromosome 14
  Distance between a terminus base of telomere on chromosomal short arm and 5'-terminus of this base sequence : 73794933
  Distance between 3'-terminus of neighbour sequence of sequence listing upward to telomere on chrosomal short arm and 5'-terminus of this base sequence : 175958
cagatcacgaggtcaagagatggagaccatcctgaccaacatggtgaaaccctgtctctgctaaaaatacaaaaattagccagccgtggtggcgtgttcccgtaatcccagctactcgggaggctgaggcagaattgcttgaactcaggaggtggaggttgtagtgagccgagatcatgccactgctctccagcctggtgacagagggagactctgtctcaaataaataaataaataaataaataaataaataaataaataaaaataaataaataaatagtatatttgtacactgttagaactcaggatagtagtgggagaagatagtgactagaaggggcacaaaggggacttctggcaatgcttcctttcttgatctgggtgctagttaaatagatgcattcagtttgtgaaaaattcatcaagctgtaccacttatgatttgtgcac

SEQ ID NO: 20847 - DNA, 275 bp, Homo sapiens
  AC006530.4_9181
  Located on chromosome 14
  Distance between a terminus base of telomere on chromosomal short arm and 5'-terminus of this base sequence : 73895049
  Distance between 3'-terminus of neighbour sequence of sequence listing upward to telomere on chrosomal short arm and 5'-terminus of this base sequence : 99666
ttaactagtgaattccttgttcctgtggtttctatttgatttcattttgtttttctgattggaattgtgtatttgctccatttttctgtctctggaaactctggtcaaataagctggatgacatatgtgcacagttaagtcacagaatgtaaaaatcatctcgatgtggaaaagttatgtagcatagatgatgtcaaatacaggttggtgtattttgtgtgtgtgtgtgtgtgtgtgtgtgtgtgtggtgtcttagatgtcaaatacaggttggt

SEQ ID NO: 20848 - DNA, 306 bp, Homo sapiens
  AC006530.4_18716
  Located on chromosome 14
  Distance between a terminus base of telomere on chromosomal short arm and 5'-terminus of this base sequence : 73904628
  Distance between 3'-terminus of neighbour sequence of sequence listing upward to telomere on chrosomal short arm and 5'-terminus of this base sequence : 9304
acgatgaaagtaatgtaggatcattttacttcccaaatatagaaatgtattaagaggaaaagaaagacactctaatgccactcccagagaaaatcagttaaaattttggtgttcatcatttttgccaagctcttttctccatgtacagagaagtttataatttctcgtaattatatatatatatatatatatatatatatatatatatatatatatataaacaaaaatggtattatagatatatagttttatgcctccatttttaaatctttcatgtggatgaatatcaatctacagcaacgttgt

SEQ ID NO: 20849 - DNA, 352 bp, Homo sapiens
  AC006530.4_90964
  Located on chromosome 14
  Distance between a terminus base of telomere on chromosomal short arm and 5'-terminus of this base sequence : 73976776
  Distance between 3'-terminus of neighbour sequence of sequence listing upward to telomere on chrosomal short arm and 5'-terminus of this base sequence : 71842
gccagaagcacattctgaccagcgtgtcctgcagagtccccaggcctcggtgaacagggcaccaaggacagctgcctcagcagggccaccccactccgctggacatccccagctcccctcaaagccccaggcaggcccctgtgcccctgggtccctgtgggtttctcctcagcagcctcaaatgaggaagtgaggctgaggagagaatgggggaacttctcttcccccaatacatatagcagcatataacatcaaagacacagacacacagacacacacacacacacacacacacacacacacacacacacacaccccttgcaggtcagaagcagagtggagtttgatagta

SEQ ID NO: 20850 - DNA, 210 bp, Homo sapiens
  AC006530.4_140898
  Located on chromosome 14
  Distance between a terminus base of telomere on chromosomal short arm and 5'-terminus of this base sequence : 74026939
  Distance between 3'-terminus of neighbour sequence of sequence listing upward to telomere on chrosomal short arm and 5'-terminus of this base sequence : 49811
gtacaatccacagagcttattcagatttcatacatgcattccgtgtgtgtgtgtgtgtgtgtgtatatgcacaattttatcacaggtagtcttgcataaccaccaccacaatcaagaaacccaagtgtactattaatatcacaagattcctagtgttactcctttgtagccacacatcccacccatctgtaactcctggaagccactaat

SEQ ID NO: 20851 - DNA, 339 bp, Homo sapiens
  AC006530.4_154731
  Located on chromosome 14
  Distance between a terminus base of telomere on chromosomal short arm and 5'-terminus of this base sequence : 74040693
  Distance between 3'-terminus of neighbour sequence of sequence listing upward to telomere on chrosomal short arm and 5'-terminus of this base sequence : 13544
gacatttcactttaagcacattaaccctgtggtaccagggtctgctaggtgggcagtgcatgtgaagggcagacatctttttccgtatacgcgtaatgtgtgtttgtgatatagcaatttcatatatatatatatatatatatattttttttttttttttttttttttttttttttttttgcaaaaccgttcttacagaagggacaatggagaacattgcagcccaggctctggagcacattcactccaatgaggtgatcatgaccattggcttctcccgaacagtagaggccttcctcaaagaggctgcccgaaagaggaaattccatgtcattgtag

SEQ ID NO: 20852 - DNA, 476 bp, Homo sapiens
  AF195658.1_13164
  Located on chromosome 14
  Distance between a terminus base of telomere on chromosomal short arm and 5'-terminus of this base sequence : 74075681
  Distance between 3'-terminus of neighbour sequence of sequence listing upward to telomere on chrosomal short arm and 5'-terminus of this base sequence : 34649
cacttaaggacaaggtcactaaaggactttgatttataaattattgccaaatataaagtcaatatataatcttctgcaggagaaccttgagaatccttgaaactgtcagcctgaatccataattcattccctccaaacctacttacactactaaagatatttctttctttgtaattataattaatcccttgctttttcttctgatgataaaagttctagtaagaacacacacacacacacacacacacacgtgccttgaccaaggtggtctatatcattaaataaatcaaattttagaagagttaggccatatatatatatatatatatttatgagattttgaagttaatcttttacctgcattgaatgaatcattcctttggtgaaacgatagggatacaagatgttgtgaattttaactgctaagctctcagcctggccactgcttacatcaacagcaacctagaaagactcag

SEQ ID NO: 20853 - DNA, 309 bp, Homo sapiens
  AC007055.3_112014
  Located on chromosome 14
  Distance between a terminus base of telomere on chromosomal short arm and 5'-terminus of this base sequence : 74182836
  Distance between 3'-terminus of neighbour sequence of sequence listing upward to telomere on chrosomal short arm and 5'-terminus of this base sequence : 106679
tcttatcagcatcaaatttctattatcaccattcctagtctcttgcagctttttcctccatcctgccctcttccttgaaagtttgaaattattttaactaaaaactatctttgactattgttatttcccaaacacaaaacagttgttcaagactaaacagcactgaatccatgccccagatagatagatagatagatagatagatagatagatagatatacaactgttggtcttggggaaaaagtcttaggaattaaaaacaaatcacttttcttaaccttgggcattaacaaataactgaattccagc

SEQ ID NO: 20854 - DNA, 154 bp, Homo sapiens
  AF111167.2_50227
  Located on chromosome 14
  Distance between a terminus base of telomere on chromosomal short arm and 5'-terminus of this base sequence : 74320483
  Distance between 3'-terminus of neighbour sequence of sequence listing upward to telomere on chrosomal short arm and 5'-terminus of this base sequence : 137338
tgcatagagttccaatttctctacatccttgacaaagtttgtaattttttctctctctctgtgtgtgtgtgtgtgtgtgtgtgtgtgtgtgtgtgtattttttttagagagtcttgctctgttgcccaggctggagtgcagtggtatgctcatg

SEQ ID NO: 20855 - DNA, 369 bp, Homo sapiens
  AF111167.2_56229
  Located on chromosome 14
  Distance between a terminus base of telomere on chromosomal short arm and 5'-terminus of this base sequence : 74326276
  Distance between 3'-terminus of neighbour sequence of sequence listing upward to telomere on chrosomal short arm and 5'-terminus of this base sequence : 5639
tccaagttacagaaatccatagagaaggctcggccacttccagggagcagtgccttctctcaggagctgggcaggcagcccggggggcagtgggctgggagaagccggcctgagagggacggaagtgtccactgaacaggcaaagaggcctctgggaaggctagaaggctttctgggcagaacggatttgcagctgtgttggctttctgggcaaaagatgaattgaagtaaatcacagagtgttttaaaataaaaaactcccccaaaccacacacacacacacacacacacacacacacacacacacacgccaatggaggagagagagggctttgggaacctcagcggtggaacacggaaataccttat

SEQ ID NO: 20856 - DNA, 155 bp, Homo sapiens
  D14S273
  Located on chromosome 14
  Distance between a terminus base of telomere on chromosomal short arm and 5'-terminus of this base sequence : 74326472
  Distance between 3'-terminus of neighbour sequence of sequence listing upward to telomere on chrosomal short arm and 5'-terminus of this base sequence : -173
tgttggctttctgggcaaaagatgaattgaagtaaatcacagagtgttttaaaataaaaaactcccccaaaccacacacacacacacacacacacacacacacacacacacacgccaatggaggagagagagggctttgggaacctcagcggtgg

SEQ ID NO: 20857 - DNA, 387 bp, Homo sapiens
  AF111167.2_60644
  Located on chromosome 14
  Distance between a terminus base of telomere on chromosomal short arm and 5'-terminus of this base sequence : 74330751
  Distance between 3'-terminus of neighbour sequence of sequence listing upward to telomere on chrosomal short arm and 5'-terminus of this base sequence : 4124
acttagcacagaccttgttcagagctttgctacaggaggaagtctgcttctgccctccggctttttaagccaaaggatggtgatgcaggaaagcagcctggctgtgctctttctttggtgctggtggatttcaactgaaccccacaagtgtcactggagggcccaccatggacaaactgtgtgtgtgtgtgtgtgtgtgtgtgtgtgtgagagagagagagagagagagagagagagcataaaatacagagataaaaatgacaggatcgctacccctgccatgttcataaacagcaggctgcgtggcacaatggagcatgcatgagagttggaggcagacagaccagtgccccagtcctcggctgaatcatagttctgctactgaag

SEQ ID NO: 20858 - DNA, 179 bp, Homo sapiens
  D14S76
  Located on chromosome 14
  Distance between a terminus base of telomere on chromosomal short arm and 5'-terminus of this base sequence : 74330876
  Distance between 3'-terminus of neighbour sequence of sequence listing upward to telomere on chrosomal short arm and 5'-terminus of this base sequence : -262
ggatttcaactgaaccccacaagtgtcactggagggcccaccatggacaaactgtgtgtgtgtgtgtgtgtgtgtgtgtgtgtgagagagagagagagagagagagagagagcataaaatacagagataaaaatgacaggatcgctacccctgccatgttcataaacagcaggctgcgt

SEQ ID NO: 20859 - DNA, 213 bp, Homo sapiens
  D14S1036
  Located on chromosome 14
  Distance between a terminus base of telomere on chromosomal short arm and 5'-terminus of this base sequence : 74345566
  Distance between 3'-terminus of neighbour sequence of sequence listing upward to telomere on chrosomal short arm and 5'-terminus of this base sequence : 14511
gcccatgtgatatttggtgggcagtgctgtctgtgccacagaaagagtaaggcatgctgggaaactgcaagtccttccaagtggctagagcttattgagtgtgtgtgtgtgtgtgtgtgtgtgtgtgtgtgtgtgcgttggggattagtaggcagggttggagagagaaatgatagggagtgaggtgagttgaggtcagtcacaaaggggctt

SEQ ID NO: 20860 - DNA, 155 bp, Homo sapiens
  AF111167.2_75349
  Located on chromosome 14
  Distance between a terminus base of telomere on chromosomal short arm and 5'-terminus of this base sequence : 74345643
  Distance between 3'-terminus of neighbour sequence of sequence listing upward to telomere on chrosomal short arm and 5'-terminus of this base sequence : -136
caagtggctagagcttattgagtgtgtgtgtgtgtgtgtgtgtgtgtgtgtgtgtgtgcgttggggattagtaggcagggttggagagagaaatgatagggagtgaggtgagttgaggtcagtcacaaaggggctttgtaagccatgttcaatgt

SEQ ID NO: 20861 - DNA, 307 bp, Homo sapiens
  AF111167.2_155680
  Located on chromosome 14
  Distance between a terminus base of telomere on chromosomal short arm and 5'-terminus of this base sequence : 74425830
  Distance between 3'-terminus of neighbour sequence of sequence listing upward to telomere on chrosomal short arm and 5'-terminus of this base sequence : 80032
tcagctccatcaagtacagtttaataaggctcctggggagctgtgagcttcaagtgctgtgcagagtggcagaatgggtagggacacgtgctctcttctacctacaggaccccagcttctgtggctctgagagccaggcacttggcaagataggcctgagtagtggtgtgtgtgtgtgtgtgtgtgtgtgtgtgtgtgtgtgtggcagggaggggaggttcaaactgacccctggttgtcatggcaacccgtccttgagccaatcttatgctgatctgagtgtttctgaagacaagctgtaacttcc

SEQ ID NO: 20862 - DNA, 293 bp, Homo sapiens
  AC009363.4_58615
  Located on chromosome 14
  Distance between a terminus base of telomere on chromosomal short arm and 5'-terminus of this base sequence : 74517227
  Distance between 3'-terminus of neighbour sequence of sequence listing upward to telomere on chrosomal short arm and 5'-terminus of this base sequence : 91090
gcctccattctgtaataggttcaccagttttaaacacaaacacacacacacacacacacacacacacactcttacatatttctttgtaagccattagaaaataacttgtagagaacatgacctatcagtcttaagtacttcagtgtacatctcctaaagacaaggacataaccacaatgtcattatcacacctaaggaatttaacaataatttaataatatcatctaagatactatctatatataacttgtagataacatgacacatcactcttaaatacttcagtgcgcatc

SEQ ID NO: 20863 - DNA, 297 bp, Homo sapiens
  AC007182.3_29524
  Located on chromosome 14
  Distance between a terminus base of telomere on chromosomal short arm and 5'-terminus of this base sequence : 74532147
  Distance between 3'-terminus of neighbour sequence of sequence listing upward to telomere on chrosomal short arm and 5'-terminus of this base sequence : 14627
acagtgctagaattacaggcatgagccatgccacccggccccaagagtagaacaaagatggaggactaggtcataaaagacactgcaactcctctctctctctctctctctctctctctctctgtctctctctctttctttatttctctctcttgttgttcactctccagggagccagttgccatgtcatggggaggacactcaggcagccccgtggggagactcatgtgaggaggaactgagatgtcttgccaacatccatatgagggagccatcttgtaaatgaatcttccagtc

SEQ ID NO: 20864 - DNA, 365 bp, Homo sapiens
  AC007182.3_68044
  Located on chromosome 14
  Distance between a terminus base of telomere on chromosomal short arm and 5'-terminus of this base sequence : 74570621
  Distance between 3'-terminus of neighbour sequence of sequence listing upward to telomere on chrosomal short arm and 5'-terminus of this base sequence : 38177
agacatggtcttgttctgtcacccaagctaaagtgcatggctcactgcagcctcaaactcctgggctcaagcaatcctaccacctcaacctcctgaatagctgggactaccagtgagtgccaccatgcctggctaattttgtgtgtgtgtgtgtgtgtgtgtgtgtgtgtgttttcaatagagatagggtttcaccatgttgctcagtcttgtcttgaactcctggactcaagtgatccacctgccttggcctcccaaagtgctgggattgcaggtgtgagtcactgcacccagccaaaagcatcttatcttctttctctatcttgtggcatgtgaagatactgatactaaactttgccaatcat

SEQ ID NO: 20865 - DNA, 241 bp, Homo sapiens
  AC007182.3_157250
  Located on chromosome 14
  Distance between a terminus base of telomere on chromosomal short arm and 5'-terminus of this base sequence : 74659814
  Distance between 3'-terminus of neighbour sequence of sequence listing upward to telomere on chrosomal short arm and 5'-terminus of this base sequence : 88828
gtaatgattgaccttgactatgaacatcttactggtttgggtttccatttttcttctagcacatagacagtagttgcacttctgtctccactaacttgtttcccatttgtgattgtgatttccaggtgatggctttggaggaggcgggcgtggtgtgtgtgtgtgtgtgtgtgtgtgtgtgtgtgtgtgtgtgtgtcagagagagaggggagactaagtgactgaaataggctgttagttt

SEQ ID NO: 20866 - DNA, 374 bp, Homo sapiens
  AC007182.3_168496
  Located on chromosome 14
  Distance between a terminus base of telomere on chromosomal short arm and 5'-terminus of this base sequence : 74671124
  Distance between 3'-terminus of neighbour sequence of sequence listing upward to telomere on chrosomal short arm and 5'-terminus of this base sequence : 11069
actttagagcactgctactttcagaagagtaccatgaaggcccctagatcacaagggagatggcagcctcagcttccgtgctggctgaacacacacacacacacacacacacacacacacacacacacacacataaagttctgctcagctatatgcctttaagtcacatgacctctggacctctttgcctcaactttaaactcaaagggctagaccagatgacctctaaaaatgtgtgaatctatatagggttccatgaccacctgagggcagcatttgaaggtgaaaagatggaattattctgctcactttcccaggttctttactcttattatatttgagctttcttaaaatgagccttagcctacttaatt

SEQ ID NO: 20867 - DNA, 174 bp, Homo sapiens
  AC009399.5_35899
  Located on chromosome 14
  Distance between a terminus base of telomere on chromosomal short arm and 5'-terminus of this base sequence : 74725265
  Distance between 3'-terminus of neighbour sequence of sequence listing upward to telomere on chrosomal short arm and 5'-terminus of this base sequence : 53767
gttggaagtcagaatctactgaattaagtataacccttttgcttccagcagaaacaaaaaaatttatacacacacacacacacacacacacacacacacacacacaatggatgttttttcacagaataattagaaaaacagcttttaaaaaactcagaccaagtagaaccagaa

SEQ ID NO: 20868 - DNA, 411 bp, Homo sapiens
  AC009399.5_56874
  Located on chromosome 14
  Distance between a terminus base of telomere on chromosomal short arm and 5'-terminus of this base sequence : 74746155
  Distance between 3'-terminus of neighbour sequence of sequence listing upward to telomere on chrosomal short arm and 5'-terminus of this base sequence : 20716
tgtgacctctgatcaaacagtaaggaaggtagtgtggtagtgtttacttctagagaaaaaatataagcagtttttttgagggtcacaggatgggatgtttaggagtgatgttttatatatatatagatatagctataaatatacacatacatacacacacacacacacacacacacacacacacacacacacacacacacaggactgtacattaccgtgatttttgtagaggaagtctcagtaataataagaagggtttcaaagttaacctctcatccctgaacttgttaaatgaaaccaggcattctgggaagaacacttgcttctgggtcttgctttctctttgcaacagttgggaaggtagagaaagagaatcaatacagaatccataaacttgatctctggctccta

SEQ ID NO: 20869 - DNA, 239 bp, Homo sapiens
  AF107885.2_51495
  Located on chromosome 14
  Distance between a terminus base of telomere on chromosomal short arm and 5'-terminus of this base sequence : 74883864
  Distance between 3'-terminus of neighbour sequence of sequence listing upward to telomere on chrosomal short arm and 5'-terminus of this base sequence : 137298
caataacatgctagctcctcagcgtggcacaaagagcaggcaaacagtctagccatgcaggaggtgtcttgatacatctttataatggcgtatcagagaggaaggttggactggggacatgagaggggaggagtgtgtgtgtgtgtgtgtgtgtgtgtgtgtgtgtgtgtgtgtgtgtgtgtttaagttccagagcatattgactccggaacttaatgtcataacctattgcttcgttg

SEQ ID NO: 20870 - DNA, 215 bp, Homo sapiens
  D14S61
  Located on chromosome 14
  Distance between a terminus base of telomere on chromosomal short arm and 5'-terminus of this base sequence : 74883947
  Distance between 3'-terminus of neighbour sequence of sequence listing upward to telomere on chrosomal short arm and 5'-terminus of this base sequence : -156
aatggcgtatcagagaggaaggttggactggggacatgagaggggaggagtgtgtgtgtgtgtgtgtgtgtgtgtgtgtgtgtgtgtgtgtgtgtgtgtttaagttccagagcatattgactccggaacttaatgtcataacctattgcttcgttgtttttttgtttggttggttcttttgttctattttattttcccacttgacttttagcagg

SEQ ID NO: 20871 - DNA, 384 bp, Homo sapiens
  AF107885.2_110824
  Located on chromosome 14
  Distance between a terminus base of telomere on chromosomal short arm and 5'-terminus of this base sequence : 74943199
  Distance between 3'-terminus of neighbour sequence of sequence listing upward to telomere on chrosomal short arm and 5'-terminus of this base sequence : 59037
cattgcttagcaaagatagtgagaaagctccagttctttttggctcaaacagaagagtttatgtcctgacacctgagttattaaattatggcacagctagctctgtgatgaatgaatgacaaaaacatatatatatatatatatatatatatcactgtatttctgctttactctatcatttcctgggcaaaatgttattttatttataaaattcatccatctctttcacaaacctcagcttttatggcaaaacacacagacacgcactgagccacttttcagcctatatgtactcttttcagagagcattagaattaaactaattagaattcctccctccctcccctgagattgatgtatttctcagcattctacgatgcttat

SEQ ID NO: 20872 - DNA, 373 bp, Homo sapiens
  AF107885.2_173870
  Located on chromosome 14
  Distance between a terminus base of telomere on chromosomal short arm and 5'-terminus of this base sequence : 75006100
  Distance between 3'-terminus of neighbour sequence of sequence listing upward to telomere on chrosomal short arm and 5'-terminus of this base sequence : 62517
ttgtttgaacgtaggagttcacgaccagcctgggcaaccttgtctttgcaaaatatttaaaaattagctgggtttgggtggcatgtgcctatagtcccagctacttgggaggctgaggcaggaaaattgcttgaacccgggaggcggaggttgcagtgagctgagatcttgccattgcactccagcctgggcaacaagagtgatatatacataaatatataattaacaataagagtatatattatatatatatatataaatattaacaagagtgtgtgtgtgtgtgtgtgtgtgtgtgtgtgtgtgtgtatgtatgtatatatattttaaagtctacttaattgtgaaggaggttatagccacctatggtagt

SEQ ID NO: 20873 - DNA, 285 bp, Homo sapiens
  AC008015.5_117693
  Located on chromosome 14
  Distance between a terminus base of telomere on chromosomal short arm and 5'-terminus of this base sequence : 75133872
  Distance between 3'-terminus of neighbour sequence of sequence listing upward to telomere on chrosomal short arm and 5'-terminus of this base sequence : 127399
ctctttgcatcacggtaattttttcatggtgccctaagtctaaagaaactcctggctgggggcggtggctcacacctgtaatcccagcattttgagaggccaaggtgggaggattgcttgggccagggaggtcgaggctgcagtgagctatgattatgtggctgcaactccagcctgggcgacagagcaagaccctgtctcaaaaagaaaaataaaagaaatgcccgaacattattattattattattattattattattttaagtaactaggtccaaacaactc

SEQ ID NO: 20874 - DNA, 222 bp, Homo sapiens
  D14S270
  Located on chromosome 14
  Distance between a terminus base of telomere on chromosomal short arm and 5'-terminus of this base sequence : 75198871
  Distance between 3'-terminus of neighbour sequence of sequence listing upward to telomere on chrosomal short arm and 5'-terminus of this base sequence : 64714
agaggcaggtgaatgactatactaaaaactgtttccagtggaaattgtgtctttttcttgtcccattttatttgtagtagggaaacatttctttcaaagcacctgggcagcattggaaatttcacatgcatcattagcatggtgtgtgtgtgtgtgtgtgtgtgtgtgtgtgtgtgtgtgtgtggcgacaatgttatcattagtggtataattttattttgc

SEQ ID NO: 20875 - DNA, 466 bp, Homo sapiens
  chr14.fa.O7frz.75591236
  Located on chromosome 14
  Distance between a terminus base of telomere on chromosomal short arm and 5'-terminus of this base sequence : 75421418
  Distance between 3'-terminus of neighbour sequence of sequence listing upward to telomere on chrosomal short arm and 5'-terminus of this base sequence : 222325
tactcaaatgtcacattggttaaaacagtgccccggctgggtgcagtggctcacacctgtaatcccagcactttgggagactgaggcaggtggatcacgaggtcaggagttagagaccagcctagacaacatagtgaaaccccgtctctactaaaaatacaaaaaactagccaggtatgatggcaggcacctgtaatcccagctacttgggaggctgaagcaggagaattgcttgaacccagaggcagaggttgcggtgagccaagatcatgccattgcactccagcctgggcaacaagagcaagacttcgtcaaaaaacaaacaaacaaacaaacaaaaaaccagtgccccatccttgcccatccttgtctaacacaagatgtagtgctaagaagccattaatgccatgtggacaaataaacagactaattgggtagggagagtcctctgttattgattagtctg

SEQ ID NO: 20876 - DNA, 301 bp, Homo sapiens
  DISO7_00000012
  Located on chromosome 14
  Distance between a terminus base of telomere on chromosomal short arm and 5'-terminus of this base sequence : 75504277
  Distance between 3'-terminus of neighbour sequence of sequence listing upward to telomere on chrosomal short arm and 5'-terminus of this base sequence : 82393
attaatgttgcccaaggcctctctcctactcaaagacctgataagggaaattggatgtccatttctatctatcttttattacctcccagctcccccggccaccacaggcagccacacaccctctcccatgcagggaatctggacaaccacacacacacacacacacacacacacacacacacacacacacacaccctgatcccctgtcacagcctctcccctgagaaggtgcatcaatcaaagctcccccgtgtcagtcggtgtaatcactcctgctcttttgttgatcacccatggattc

SEQ ID NO: 20877 - DNA, 445 bp, Homo sapiens
  chr14.fa.O7frz.75794249
  Located on chromosome 14
  Distance between a terminus base of telomere on chromosomal short arm and 5'-terminus of this base sequence : 75581996
  Distance between 3'-terminus of neighbour sequence of sequence listing upward to telomere on chrosomal short arm and 5'-terminus of this base sequence : 77418
tgaaatgagaaccgttgaccatttattcacaccaactgctgtgcacacgtccacacagagtctctgcagtggtcacaagcttgtctctccccttggtcaaaggaagccaagtgaggacacccaggtcccacggcccacaggagcacctatggacccaggtgcctcagcatgtgggggcggggctttgtgttcttggcagtggccagtgggtcagtcgcagtgtctgtgttcacaggggcttcatcctcgtctaggggatctgaaaatgtggtggccctcgtacacaatccccaagttgtctctgtgctaataaacttgggacaatcagcttgactctgtgtgtgtgtgtgtgtgtgtgtgtgtgtgtgtgtgtgtgtgtccctaagcgtttaccctcacatgtttggtaagttaggtgtattaaatgcattttcaacttacagta

SEQ ID NO: 20878 - DNA, 270 bp, Homo sapiens
  chr14.fa.O7frz.75891000
  Located on chromosome 14
  Distance between a terminus base of telomere on chromosomal short arm and 5'-terminus of this base sequence : 75679020
  Distance between 3'-terminus of neighbour sequence of sequence listing upward to telomere on chrosomal short arm and 5'-terminus of this base sequence : 96579
cattcaatcagtggatcttaatccttggggggtcactgatgcctttgaaaatctaataaagctacacacacacacacacacacacacacacacacacacacacacacaatgcacatagaaacaaaaacttgccaccaatttcaaggtgttcacaacctccctgaagcttccccaaggattctttagagctgccctatccaagatgatggctacaagctacttgtggctactgggcccttgaaatgcggctactcaggatggagatttacc

SEQ ID NO: 20879 - DNA, 243 bp, Homo sapiens
  AF111169.2_82364
  Located on chromosome 14
  Distance between a terminus base of telomere on chromosomal short arm and 5'-terminus of this base sequence : 75868388
  Distance between 3'-terminus of neighbour sequence of sequence listing upward to telomere on chrosomal short arm and 5'-terminus of this base sequence : 189098
cagagttctgaaggtagtcttcagctggaaagggtgtgtgtgtgtgtgtgtgtgtgtgtgtgtgtttgtgtatgtgttgggataagttgggggctgcagagtactggagagaataattgggaatatctgtacttcatatatgcatgtactttttaccatctcttgactgtaaatgcagtgaccattctctactataaagccagtgtcaccctcagtgctccctggtacactgcagatctttct

SEQ ID NO: 20880 - DNA, 185 bp, Homo sapiens
  AF111169.2_92119
  Located on chromosome 14
  Distance between a terminus base of telomere on chromosomal short arm and 5'-terminus of this base sequence : 75878106
  Distance between 3'-terminus of neighbour sequence of sequence listing upward to telomere on chrosomal short arm and 5'-terminus of this base sequence : 9475
tcattatggaaacatctctaggacttggcgaatggttggatatgtgggggtgtgtattgcatgcatgtgagtgtgtgtgtgtgtgtgtgtgtgtgtgtgttgggataggaaggcctgtgatgataaaagaaacccaaagataacccaagatttcaaggccaagggactgaaggaaagattgccag

SEQ ID NO: 20881 - DNA, 144 bp, Homo sapiens
  D14S263
  Located on chromosome 14
  Distance between a terminus base of telomere on chromosomal short arm and 5'-terminus of this base sequence : 75878121
  Distance between 3'-terminus of neighbour sequence of sequence listing upward to telomere on chrosomal short arm and 5'-terminus of this base sequence : -170
ctctaggacttggcgaatggttggatatgtgggggtgtgtattgcatgcatgtgagtgtgtgtgtgtgtgtgtgtgtgtgtgtgttgggataggaaggcctgtgatgataaaagaaacccaaagataacccaagatttcaaggc

SEQ ID NO: 20882 - DNA, 373 bp, Homo sapiens
  AF111169.2_115992
  Located on chromosome 14
  Distance between a terminus base of telomere on chromosomal short arm and 5'-terminus of this base sequence : 75901853
  Distance between 3'-terminus of neighbour sequence of sequence listing upward to telomere on chrosomal short arm and 5'-terminus of this base sequence : 23588
aagcaatgaactttagtgaacatcatgtttacatgtgttttatgcaaagcaccacgcttggtggtaccatggggaacaaagagacagctaagataaagtccttgcccttaagggtctcttaatatattttaggtcacagacacttttgagaatctttggaaagctatgaacttgccccagaaaaatgcaatgcacgcacacacacacacacacacacacacacacacactcagttctgtatccatttcagaaggtttgctggccctctgcagccaatccgcagaccttcatagacccaggattaggaaaccttccttaaagacgcgcacaattatctctagaagaacaatcgataggcaatttcaacagaaca

SEQ ID NO: 20883 - DNA, 396 bp, Homo sapiens
  AF111169.2_136855
  Located on chromosome 14
  Distance between a terminus base of telomere on chromosomal short arm and 5'-terminus of this base sequence : 75922661
  Distance between 3'-terminus of neighbour sequence of sequence listing upward to telomere on chrosomal short arm and 5'-terminus of this base sequence : 20435
ggatcacctaagttcaggagttcgagaccagcctagccaacatggtgaaaccccatctctactaaaaatacaaaaaattaaccgggtgtggtggtgggcacctgtaatcccagctactcgggaggctgaggaaggagaatcacttgaacccatgaagtggaggttgcagtgagctgaggtggccccattgtactccagcctgggcaacaagagtgaaactccatctaaaaaaaatatatacatacatatacatatatatatatatatatatattttaatcattattattataactatatcataaaggaaaaatattaaaatgaaacaacaggtatttcaatatgtaaatggtcaggaatgactgcattccgtatgtaaatgtttaggcatgactgc

SEQ ID NO: 20884 - DNA, 414 bp, Homo sapiens
  AC007686.5_22240
  Located on chromosome 14
  Distance between a terminus base of telomere on chromosomal short arm and 5'-terminus of this base sequence : 75974687
  Distance between 3'-terminus of neighbour sequence of sequence listing upward to telomere on chrosomal short arm and 5'-terminus of this base sequence : 51630
acatagagtggtcacttcatttaccaaccctggaaccgcagacctctgggcttcctggtatgtgatttcagttttacccctcactgtttaaattgcttgagttatgtattttgttattgatttatttatttatttatttatttattttgagacagcgtctctctctgtcgcccaggctggagtgcagtggtgcgatctcggctcactgcaacctccgcctcgcgggttcaagcgattctcctgcctcggcctctcgagtagctgggattacaggcatgcaccactacacctggctaattttgtacttttagtagagatggggtttcgccatgttggtcaggctggtctcaaactcctgacatcaggtgatccgcctgcctcggcctcccaaagtactggcattacagatgtgag

SEQ ID NO: 20885 - DNA, 208 bp, Homo sapiens
  D14S279
  Located on chromosome 14
  Distance between a terminus base of telomere on chromosomal short arm and 5'-terminus of this base sequence : 75987297
  Distance between 3'-terminus of neighbour sequence of sequence listing upward to telomere on chrosomal short arm and 5'-terminus of this base sequence : 12196
caggtattcccaatatgcagccataattgagaaccactagtcaatatggagtgtgtgtgtgtgtgtgtgtgtgtgtgtgtgtgtgtgtgtgtacatttctaggtatgggtgatatttgcatgcagcacgtatctgtgcacatagacacatacacacacggaaatctggacttcccaatacacagagtaatacatgctgaggtcaccag

SEQ ID NO: 20886 - DNA, 178 bp, Homo sapiens
  AC007686.5_34781
  Located on chromosome 14
  Distance between a terminus base of telomere on chromosomal short arm and 5'-terminus of this base sequence : 75987325
  Distance between 3'-terminus of neighbour sequence of sequence listing upward to telomere on chrosomal short arm and 5'-terminus of this base sequence : -180
gagaaccactagtcaatatggagtgtgtgtgtgtgtgtgtgtgtgtgtgtgtgtgtgtgtgtgtacatttctaggtatgggtgatatttgcatgcagcacgtatctgtgcacatagacacatacacacacggaaatctggacttcccaatacacagagtaatacatgctgaggtcacc

SEQ ID NO: 20887 - DNA, 292 bp, Homo sapiens
  AC007686.5_45201
  Located on chromosome 14
  Distance between a terminus base of telomere on chromosomal short arm and 5'-terminus of this base sequence : 75997663
  Distance between 3'-terminus of neighbour sequence of sequence listing upward to telomere on chrosomal short arm and 5'-terminus of this base sequence : 10160
gaaattcaggcttacggaagcctcaacctcctgggttcaagtgatcctcccacctcagcctcccaagaagctggaactacaggtgtgcaccaccacacttggcttgtgtgtgtgtgtgtgtgtgtgtgtgtgtgtagagatagggtctcactatattgtccaggctggtcttgaactcctaggctcgaacaatccttccgcctcagcctcccaaagtgctgagattacaggtgttttccactgtgcccaatatttttcttcttttgctgtaaaggatattagcaggatggtt

SEQ ID NO: 20888 - DNA, 260 bp, Homo sapiens
  D14S983
  Located on chromosome 14
  Distance between a terminus base of telomere on chromosomal short arm and 5'-terminus of this base sequence : 76069167
  Distance between 3'-terminus of neighbour sequence of sequence listing upward to telomere on chrosomal short arm and 5'-terminus of this base sequence : 71212
tggactggttagcctcagtgccaacctggtaggaaccatcgcctgcccggattcctgttctcccccagaccactgggcaaatccttcatggttggtagggctttaagggctagaagaggataggaaatatgttcttgatgactttttattaacatccaattttctactccccatggccttcattacacacacacacacacacacacacacacacacacacacacacacagcaaaggtgaggattggaagccagttgatgc

SEQ ID NO: 20889 - DNA, 399 bp, Homo sapiens
  AC007686.5_116785
  Located on chromosome 14
  Distance between a terminus base of telomere on chromosomal short arm and 5'-terminus of this base sequence : 76069180
  Distance between 3'-terminus of neighbour sequence of sequence listing upward to telomere on chrosomal short arm and 5'-terminus of this base sequence : -247
ctcagtgccaacctggtaggaaccatcgcctgcccggattcctgttctcccccagaccactgggcaaatccttcatggttggtagggctttaagggctagaagaggataggaaatatgttcttgatgactttttattaacatccaattttctactccccatggccttcattacacacacacacacacacacacacacacacacacacacacacacagcaaaggtgaggattggaagccagttgatgctggaggaatgctttaacacccctatcaacacacaacccaagtcgggtccagcttattctttcaagatgtccacagtttcaccccacgctcaggatatgtatgggtgcgtgtgcttttgtacacactcatatagcaaactttgagctatagcc

SEQ ID NO: 20890 - DNA, 295 bp, Homo sapiens
  AC007686.5_146148
  Located on chromosome 14
  Distance between a terminus base of telomere on chromosomal short arm and 5'-terminus of this base sequence : 76098538
  Distance between 3'-terminus of neighbour sequence of sequence listing upward to telomere on chrosomal short arm and 5'-terminus of this base sequence : 28959
gattcaagcaataaaggatttcccaacatcaaagggcaacagatctctgctctgggtccatcattaatttttattttatttattattatttttagagatgaggtcttgctatgttgcccagcctggtctcagactacaggcattcaccactgcatccagcttttccttccttcccgccttccttccttccttccttccttccttccttccttcccttcttcctttttttcttttttttttgacaaagtcttgctctcttgcccatgccggagtgcaatggtttgatctcacctca

SEQ ID NO: 20891 - DNA, 285 bp, Homo sapiens
  AC007686.5_170052
  Located on chromosome 14
  Distance between a terminus base of telomere on chromosomal short arm and 5'-terminus of this base sequence : 76122441
  Distance between 3'-terminus of neighbour sequence of sequence listing upward to telomere on chrosomal short arm and 5'-terminus of this base sequence : 23608
ctgcctgagttattccagttaccttggagtaggatgaaatttgcaaaatcaagacaatttttcccattttaattaccacatttgtagttcaaaaaatttcaaatctatacaaaagcaaatgaataccccatatgtctatctttttgccatatatgctttctctctctcgctctctttacacacacacacacacacacacacacacacactctctctctgaattatttgaaagtaaattgcaaacacttgacattttaccccatgtagcttcagtacagatttcct

SEQ ID NO: 20892 - DNA, 387 bp, Homo sapiens
  chr14.fa.O7frz.76429197
  Located on chromosome 14
  Distance between a terminus base of telomere on chromosomal short arm and 5'-terminus of this base sequence : 76217143
  Distance between 3'-terminus of neighbour sequence of sequence listing upward to telomere on chrosomal short arm and 5'-terminus of this base sequence : 94417
agtgtatacaactcaacatgcacacatatgaacacataaatatgcatgcaacccaaaacacaagcatctaaaacccaaactataatcacaaacacattcctaagcacaaccaaatacccctcaaaacatactcagatacacacacacacacacacacacaaacacattgacagacacacctcaaaacacacaagcaccaatgcatagacccactgtattggcttcccagggccctgcaacaaattaccacaaactgtgtggttctgaacaacagaaagttattctcttccagtcctggaggccagaagtctgaaatcaaggtgtcagcagggccgtgctccctctgcaggacctaggggagcatccttacttgcctcttcctagttc

SEQ ID NO: 20893 - DNA, 306 bp, Homo sapiens
  AF111168.2_9186
  Located on chromosome 14
  Distance between a terminus base of telomere on chromosomal short arm and 5'-terminus of this base sequence : 76421551
  Distance between 3'-terminus of neighbour sequence of sequence listing upward to telomere on chrosomal short arm and 5'-terminus of this base sequence : 204021
cctaagtagctctcctgcagtaccttgtgccttacacacacacacacacacacacacacacacacagagagagagagattgatttaataagatagcaatgggccaacaggaaagtaattttcaaaagaatgccagaaatatgttgagccgtgaccagcaggactgtagggacaggtagcttgaagaatcgtaggatcttggagagcagctatgactcccttattggccccccagacgctgacagaatcttcatcatactgatactgaggccgcaagatattggtgtggttcaacagtagtttcagc

SEQ ID NO: 20894 - DNA, 186 bp, Homo sapiens
  AF111168.2_166996
  Located on chromosome 14
  Distance between a terminus base of telomere on chromosomal short arm and 5'-terminus of this base sequence : 76579508
  Distance between 3'-terminus of neighbour sequence of sequence listing upward to telomere on chrosomal short arm and 5'-terminus of this base sequence : 157651
gccggcagtatcaatagactcctggctttcaaatctttatgcatgcatacacacacacacacacacacacacacacacacacacacacacacacacacagatgtgtgtgtatgcatgagttcgcatatatacatacattttctagctctagtcactgagaggtgagaagcagtgatactccttcag

SEQ ID NO: 20895 - DNA, 108 bp, Homo sapiens
  D14S594
  Located on chromosome 14
  Distance between a terminus base of telomere on chromosomal short arm and 5'-terminus of this base sequence : 76653420
  Distance between 3'-terminus of neighbour sequence of sequence listing upward to telomere on chrosomal short arm and 5'-terminus of this base sequence : 73726
tagatgggactacaggtgcccaccactgtgcctggctattattattattattattattattattattatttttgtagagccaggttctttctatgttgcctaggctgg

SEQ ID NO: 20896 - DNA, 233 bp, Homo sapiens
  HUMUT1235
  Located on chromosome 14
  Distance between a terminus base of telomere on chromosomal short arm and 5'-terminus of this base sequence : 76773036
  Distance between 3'-terminus of neighbour sequence of sequence listing upward to telomere on chrosomal short arm and 5'-terminus of this base sequence : 119508
ttacattggctattccttctgccatcaaatcaatctaatcatctatctatctatctatctatctatctatctatcgcaatcaatcaatcacaatttttctctattgcaatcaatcaatcacaatttttctctatctatctatctattgcaatcaatcacaatttttccggctgggcgaggtggctcacacctgtaattccaacactttgggaggccaaggcaggtggattact

SEQ ID NO: 20897 - DNA, 193 bp, Homo sapiens
  AC008372.6_107993
  Located on chromosome 14
  Distance between a terminus base of telomere on chromosomal short arm and 5'-terminus of this base sequence : 76831913
  Distance between 3'-terminus of neighbour sequence of sequence listing upward to telomere on chrosomal short arm and 5'-terminus of this base sequence : 58644
ttggtcagaagttccagagacctggacttgtgactgatgttgtggggggaagtgggggatgcagtcttggggactgggccctcaacccatgggatctgacaccatctccaggtagtagatggtaaatatatatatatatatatatatttaaaaaatgtggctatattataaggcataagtcaaagtagacttt

SEQ ID NO: 20898 - DNA, 269 bp, Homo sapiens
  AC008372.6_143995
  Located on chromosome 14
  Distance between a terminus base of telomere on chromosomal short arm and 5'-terminus of this base sequence : 76867986
  Distance between 3'-terminus of neighbour sequence of sequence listing upward to telomere on chrosomal short arm and 5'-terminus of this base sequence : 35880
attctgaatagtttctattgccaggttttcaagttcactaatcttttatgtgtgtatatatatatatatatatatatattttttttttttttttttttttttagagacagggtcttgctgtgttgcccaggctggtctcaaaatctctggctcaggcaacccatcgtcccccttggcctcccaaagtgctgggattacaggtgtgagccaccatgcctggcctgatatttttttccccctgcaatgtctaatctgccattaattgcatc

SEQ ID NO: 20899 - DNA, 398 bp, Homo sapiens
  AC008372.6_178019
  Located on chromosome 14
  Distance between a terminus base of telomere on chromosomal short arm and 5'-terminus of this base sequence : 76901865
  Distance between 3'-terminus of neighbour sequence of sequence listing upward to telomere on chrosomal short arm and 5'-terminus of this base sequence : 33610
acttgaggtcaggaatttgagaccccatctctattaaaaaatacaaagattagctgggtgtgatgtcacacacctgtaatcccagctactcaggagactgaggcaggagaattgcttgaacctggggggcggaggctgcagtgagccaagatcatgccactgcactccagcctggtcgacagcgcgggactctgtctcaacacacacacacacacacacacacacacacacacgcacaacacacacacacactctctctctctttctctctcaaatctgtcctgggggcactaggcagccctgactctggcccatcttcctggctccctctcactgaactgggtcatctttttcattgctctgttctctccactcccgacagatccatgatttgttcc

SEQ ID NO: 20900 - DNA, 152 bp, Homo sapiens
  D14S254
  Located on chromosome 14
  Distance between a terminus base of telomere on chromosomal short arm and 5'-terminus of this base sequence : 76927566
  Distance between 3'-terminus of neighbour sequence of sequence listing upward to telomere on chrosomal short arm and 5'-terminus of this base sequence : 25303
cggccttgaagactacggaggagcgtgtgtgtgtgtgtgtgtgtgtgtgtgtgtgtgtgtgtgtgtgtaatgaaagagtccacaatcctgaaagtttcagatagactcctgaggttctaaagtctccttaggactgtggtactcagcgagcc

SEQ ID NO: 20901 - DNA, 207 bp, Homo sapiens
  AC008372.6_266323
  Located on chromosome 14
  Distance between a terminus base of telomere on chromosomal short arm and 5'-terminus of this base sequence : 76990315
  Distance between 3'-terminus of neighbour sequence of sequence listing upward to telomere on chrosomal short arm and 5'-terminus of this base sequence : 62597
ttatgttggatggtattggaagagccatgggaattgagccaagcacatatatatgtgtgtgtgtgtgtgtgtgtgtgtgtgtgtatgtgtatatatctatatatatatctatatatctatatatctatatctatatatatatatatatgcttgaatatgcattaaacatctctggaaggacctgcaggaatttagtgacattggttg

SEQ ID NO: 20902 - DNA, 370 bp, Homo sapiens
  AC007955.4_5634
  Located on chromosome 14
  Distance between a terminus base of telomere on chromosomal short arm and 5'-terminus of this base sequence : 77040864
  Distance between 3'-terminus of neighbour sequence of sequence listing upward to telomere on chrosomal short arm and 5'-terminus of this base sequence : 50342
tagtgactgtgccattgatctcatcaaacaacaaattcttcagttcattctcgagtgtctactgggagctagggcacagtgagtgcgtgtgtgtgtgtgtgtgtgtgtgtgtgtgtgtgtgtgtgtgtgtgttgggggcggagggggtaggcatgcacacaggaataaatagctaatggtttaagttaatggacaatttttgttaggagttgatttagtaacacagacccctgtgatgataaatcttatgtgtcagcttgactgggccatggaatattcagatgtttggttagacattattctggatgagtccctctgtgaaggcgtttctggaggagatgaacctctgaattggtaaactgaataaagc

SEQ ID NO: 20903 - DNA, 315 bp, Homo sapiens
  AC007955.4_62822
  Located on chromosome 14
  Distance between a terminus base of telomere on chromosomal short arm and 5'-terminus of this base sequence : 77098006
  Distance between 3'-terminus of neighbour sequence of sequence listing upward to telomere on chrosomal short arm and 5'-terminus of this base sequence : 56772
ccactcataaattctggtcctcatgtggagcacctcttggttgagatgggttttgcagagcactttctgccatcagaaggaacattccagagagagagagagagagagagagagagagagagagggagagagagagagagagagagagagagagagagagagagagagagagagatcctgtgggaaaacatcctcttaggcttaattcttcctgggtgaattgcatgtggccgagttccaccccaggagtaaaagcaattcttatatttatttccatccctgtctcctttgctgaacatgtctttaaggacattt

SEQ ID NO: 20904 - DNA, 393 bp, Homo sapiens
  AF099810.1_45940
  Located on chromosome 14
  Distance between a terminus base of telomere on chromosomal short arm and 5'-terminus of this base sequence : 77218812
  Distance between 3'-terminus of neighbour sequence of sequence listing upward to telomere on chrosomal short arm and 5'-terminus of this base sequence : 120491
tatttccttcaccaatctgataaggttttccgttaccactattaatacatagtactttatgtgatacaaatgataaacactaatactgaaaactttaaaaagtcagaaaagcacagagacagaagcaaaaaaatcactattttcctaccacataccattgttgactttttggtgtagatccttccaggtgtgtgtgtgtgtgtgtgtgtgtgtgtgtgtgtggtttgtgtgtgtgtgtggtttgtgtgtgtgtgtggtttgtgtgtctgtattagattgtatacacttctttttttatttgtttacagaaacacactgtgttgtctgatttttttttcctgattttagtgttataatgtgagcttgttactgtgccagtaggtattctttaac

SEQ ID NO: 20905 - DNA, 403 bp, Homo sapiens
  AF099810.1_68111
  Located on chromosome 14
  Distance between a terminus base of telomere on chromosomal short arm and 5'-terminus of this base sequence : 77241042
  Distance between 3'-terminus of neighbour sequence of sequence listing upward to telomere on chrosomal short arm and 5'-terminus of this base sequence : 21837
ggttactgctcacatgtctatctctcctcacccactaaaccctggctgggatctttgggactccaggaacttacagggtgcctagcaagtagcaggtgtttttttggtgtgtgtgtgtgtgtgtgttggtgtgtgtgtgtgtgtgtgtgtgtgtgtgtgtgtgtgtgtgtgttttgagatggagtcttgctctgtcgcccaggctagaatgcagtggcctgatctccgctcactgcaacatctgcctcctgggttcaagcgattctcctgcctcagcctcctgattaggtgggattacaggcgcgtgccaccacgcccgactaattttttgtatttttagtagagatgtggttttaccacgttagccaggatgatctcgatcttctgacctcgtgatccactc

SEQ ID NO: 20906 - DNA, 165 bp, Homo sapiens
  AF099810.1_77131
  Located on chromosome 14
  Distance between a terminus base of telomere on chromosomal short arm and 5'-terminus of this base sequence : 77250153
  Distance between 3'-terminus of neighbour sequence of sequence listing upward to telomere on chrosomal short arm and 5'-terminus of this base sequence : 8708
aaattacatttgattatctggcagccacaaatgcttttatatatatatatatatatatatatatatgtgtatatatatatgtgtgtgtgtgtgtgtgtgtctttttgtcaatttaatttctcaattcttgtttactatatagttacaaattgtaccttccatcct

SEQ ID NO: 20907 - DNA, 222 bp, Homo sapiens
  AF099810.1_93083
  Located on chromosome 14
  Distance between a terminus base of telomere on chromosomal short arm and 5'-terminus of this base sequence : 77266125
  Distance between 3'-terminus of neighbour sequence of sequence listing upward to telomere on chrosomal short arm and 5'-terminus of this base sequence : 15807
ctttgttccttctagccagagagagagagagagagagagagagggagaataggaaagaaaatgaaaatgaatgaatatgagtatagtattcaattcccagcctcaaaactctggttttagtgaagtgactgggattggacccaaggctccggaggtagttggagcacaggtgcaccacaccggagcttcgctggacaggatgacctcttcaaacttaccttt

SEQ ID NO: 20908 - DNA, 246 bp, Homo sapiens
  AF099810.1_106010
  Located on chromosome 14
  Distance between a terminus base of telomere on chromosomal short arm and 5'-terminus of this base sequence : 77278959
  Distance between 3'-terminus of neighbour sequence of sequence listing upward to telomere on chrosomal short arm and 5'-terminus of this base sequence : 12612
catcagatttgcaggtctaaattttgtcaagaatgtttgatccttccttcaattttttagttaataacaaatttcaccatgcgcatttttagctgctgtcagttctattttgtgtgtgtgtgtgtgtgtgtgtgtgtgtgtgtgtgtgtgtgtgtgtgtgtgttttcctgacaggtctaatttttttccgggtcagtttttgcagtttgaaaaaccaaatcttcttcctacaactaacgtcagtcc

SEQ ID NO: 20909 - DNA, 467 bp, Homo sapiens
  chr14.fa.O7frz.77603116
  Located on chromosome 14
  Distance between a terminus base of telomere on chromosomal short arm and 5'-terminus of this base sequence : 77391118
  Distance between 3'-terminus of neighbour sequence of sequence listing upward to telomere on chrosomal short arm and 5'-terminus of this base sequence : 111913
aaggataaatctacatggttcagtgttagtgaaaattctttttttaaaaatttttgctggttcaacttcttcctccttgatacacacacacacacacatacacacacacacacactcattctcctaaagataatatcatctctgctagatccattctttgagatttgtgatacagcactgaaagactgagaagaaagagagaattaaagtagcaggactaaaaatgggcatgtttagccagggaggcatcattgaaagttgcaaactcaaagttctacaggaactagggctaacatatatgagtgatgcaggatgggtataaagcaatgaaggatcatggttcccactgtggcataccccatctaaagaggtcagcttctactcagctagagcaaattgttggaatgcataatgcaaacccactgttgccacatgtcccaatttttcaagaatagtaacagatctgg

SEQ ID NO: 20910 - DNA, 204 bp, Homo sapiens
  AC007056.4_142840
  Located on chromosome 14
  Distance between a terminus base of telomere on chromosomal short arm and 5'-terminus of this base sequence : 77486418
  Distance between 3'-terminus of neighbour sequence of sequence listing upward to telomere on chrosomal short arm and 5'-terminus of this base sequence : 94833
aaactggtacatgattcgtgagtgtcttcattcttctctttcttccctttcttctcttcaacacactcaacacacacacacacacacacacacacacacacacacacacacccccaagaaattcacctctggctctggaatctggagaaagttcaaagtcatgcagcaatgaccgtcagcatgattaggcctactggaatcaac

SEQ ID NO: 20911 - DNA, 258 bp, Homo sapiens
  AC007056.4_155576
  Located on chromosome 14
  Distance between a terminus base of telomere on chromosomal short arm and 5'-terminus of this base sequence : 77499070
  Distance between 3'-terminus of neighbour sequence of sequence listing upward to telomere on chrosomal short arm and 5'-terminus of this base sequence : 12448
gctcatggcttatgttagctagactgctggttcgatttttcagtggaagcctccttttgaagaagggcaagccattcatttttcagcataaaccaagggatgctcttacacacacacacacacacacacacacacacacacacacacacacacagagagagagagagagagagagcaaaaaaagaatagccatcataaagatacatttctgttctggattcaagaggcagaattattaatacaggtagactgccagga

SEQ ID NO: 20912 - DNA, 288 bp, Homo sapiens
  AC007056.4_169131
  Located on chromosome 14
  Distance between a terminus base of telomere on chromosomal short arm and 5'-terminus of this base sequence : 77512670
  Distance between 3'-terminus of neighbour sequence of sequence listing upward to telomere on chrosomal short arm and 5'-terminus of this base sequence : 13342
ctatcacttgctgttctcattaacctggaaatagacaccacattttatctgctgctctgtttcctgctgtagatctgtgtagtaaatccattaatctgtctgtccattcatccatccatccatccatccatccatccatccatccatccatctatccatctgtccacccatctgtctttccatccaaatttccatttttaaagggactattttgtgtcaagtgtcatactgggaggcaatatatttcatggttagatatataggctgtatgtagcctcagactgtctg

SEQ ID NO: 20913 - DNA, 388 bp, Homo sapiens
  AC008045.5_126953
  Located on chromosome 14
  Distance between a terminus base of telomere on chromosomal short arm and 5'-terminus of this base sequence : 77642178
  Distance between 3'-terminus of neighbour sequence of sequence listing upward to telomere on chrosomal short arm and 5'-terminus of this base sequence : 129220
gccatcaggaagagaaataaagaggtctgggagaatccaatcttctttagcttgtcctttttcactctcttagcttttttgtttgtttgtttctctttccctcccttcctccctccctcccttctctctctctctctctctctctctctctctctctctctcatttttattagactgctctgcatcaggctagagtttctttttcaatttccctcttctttcactgtttttaattgtttcagtgcctttgtttttccctagacttgagcacagtgggaaaggtcagctgtcagaagaggggctgtacacagctgataaggccttcaggagactggattggagtcatttaggcagcattctctccctgaagtcatagaggctacactgt

SEQ ID NO: 20914 - DNA, 315 bp, Homo sapiens
  AC008045.5_153559
  Located on chromosome 14
  Distance between a terminus base of telomere on chromosomal short arm and 5'-terminus of this base sequence : 77668687
  Distance between 3'-terminus of neighbour sequence of sequence listing upward to telomere on chrosomal short arm and 5'-terminus of this base sequence : 26121
aggatttaggtcttgcctttaggattaattttctcctacacacaattatattgagctacctctccattatatacttagagacaatggagcaatttcccaaccatgaatcttctatctattaatcaggaaggatgccctgaaaattttgaaacaagtctcataaaaacacaaaggtgtctctgatgactttatccatgtggaaacaaaagaaaataaaatacacacacacacacacacacacacacacacacatttttgctgcccagatagagagcagaaagcttcaaaagtctgtcagaatcattctgaatagct

SEQ ID NO: 20915 - DNA, 325 bp, Homo sapiens
  AC008045.5_160102
  Located on chromosome 14
  Distance between a terminus base of telomere on chromosomal short arm and 5'-terminus of this base sequence : 77675228
  Distance between 3'-terminus of neighbour sequence of sequence listing upward to telomere on chrosomal short arm and 5'-terminus of this base sequence : 6226
ggcttatttcagtaggaaccaggtgtgaacatttagccaagcgtggctgtaaaaaagtggtatgggcctaaggaagagtgaggagcactgaggtctcaaagatctttggtgtttcggtgctgtgacagacagagagtagttcttcagttagtgccacaataaaattactaaagaaggatttgctgcttacagttgatgggttgttgatgaagaagtagatttatatatatatatatatatatatttggcaactgggtattcattctgccttcatctgatacatgtttcttgatttttattcccctcattctcaatccaatgattc

SEQ ID NO: 20916 - DNA, 357 bp, Homo sapiens
  AC009396.5_9866
  Located on chromosome 14
  Distance between a terminus base of telomere on chromosomal short arm and 5'-terminus of this base sequence : 77708674
  Distance between 3'-terminus of neighbour sequence of sequence listing upward to telomere on chrosomal short arm and 5'-terminus of this base sequence : 33121
actatgatttggtatgagccagttttatcaatttaatcatctattttttattttcttcacgcatttctccccaaacacacatatcatccccaagccaataataattcctttcaaagtactttttgtacttttggtcttatgtatgtcatgttgcaatagcttttcaagttgattttcgtgtgtgtgtgtgtgtgtgtgtgtgtgtgtgtgtgtgtgtgtgtgtgtgtgtgtgttctcttgctttcttttagttcattccctatgtgaccaccagattaatcttttatataataccaacctgacctcgtcactcttctgaaccagagcgatttcctagtgcctttaggatcaagttaa

SEQ ID NO: 20917 - DNA, 347 bp, Homo sapiens
  AC009396.5_50416
  Located on chromosome 14
  Distance between a terminus base of telomere on chromosomal short arm and 5'-terminus of this base sequence : 77749319
  Distance between 3'-terminus of neighbour sequence of sequence listing upward to telomere on chrosomal short arm and 5'-terminus of this base sequence : 40288
actttggctacagttgaatcagggatttagtgtgaaaaacatgtaggtttaaaagagccaaacacacgtatctgcatctgaaacacacacacacacacacacacacacacacacacacacacacacacacccttttcatcttactaattcctatatttcccattacttgagagataacataatgaattttggatgcaagatgaaaagaaagtcattttatccaaagggatgttatttcaaagacatacatagatgagcactcctgcatatcatgctattcttcacaatgtcattttaaatgatatttactcaaatattagttagtgatgactaactgccagatacca

SEQ ID NO: 20918 - DNA, 339 bp, Homo sapiens
  AC009396.5_110816
  Located on chromosome 14
  Distance between a terminus base of telomere on chromosomal short arm and 5'-terminus of this base sequence : 77809661
  Distance between 3'-terminus of neighbour sequence of sequence listing upward to telomere on chrosomal short arm and 5'-terminus of this base sequence : 59995
gttatcttggaaggtagtacctcataaaaagtagttgaaattcggagttttttcttttgctaactttgtgtaatattaaagtttagtttaattaaagtagtacatatagattttcctctaaagagtttgtctattctatttgtgtgtgtgtgtgtgtgtgtgtgtgtgtatataatatatatatgcttagaaaagtacctagaaatatgcctctctactgttaatgatggcatgatttgaaaagcttaatttttttctttatgtatgtctacatctcttatattttaaaatgatgaacatgtactatttaacaaaattaaatctctggctagatgcagt

SEQ ID NO: 20919 - DNA, 443 bp, Homo sapiens
  AC009396.5_162115
  Located on chromosome 14
  Distance between a terminus base of telomere on chromosomal short arm and 5'-terminus of this base sequence : 77860859
  Distance between 3'-terminus of neighbour sequence of sequence listing upward to telomere on chrosomal short arm and 5'-terminus of this base sequence : 50859
ctttccaggtatcttccaactctaatattctgtggacttatatacttgagagtattcattctgcgtgtaagatctcacacttctatagctgatacattataatctgcctatgtctctttttatctgatctatagaaaaaatattattttcatatcttcatatgtttttgggttaccttaggctattaaaagaaaaataatgaagatgttaagatatttcaggacagtatgagtatgttggggtgtgtgtgtgtgtgtgtgtgtgtgtgtgtgtatgtgtgtgtataaaagattttactttttactcagccaacgctttagagatcttctgagtttccaagtaaatttatttgcttaagatgtgtctgtttgctttcatacagccattccacatcttccaagaaatgacttcaagaacatctgcttcagtactcataaacatcc

SEQ ID NO: 20920 - DNA, 458 bp, Homo sapiens
  AC026888.6_39890
  Located on chromosome 14
  Distance between a terminus base of telomere on chromosomal short arm and 5'-terminus of this base sequence : 77984742
  Distance between 3'-terminus of neighbour sequence of sequence listing upward to telomere on chrosomal short arm and 5'-terminus of this base sequence : 123440
catgtatcgcttctgttcttaaacagcttccatctgggttagctcatcatcgtaaagcacacatttataaaagcttcctgtcagcttatcaggctgacttggagttatggaaattgtttccctttgcctaagagttatttttgtattttgcactagtaataggaatgttcattcctataacccactccatttttcctttatccagaaatatttcttaaattgtcttggccaaatatggtgtttgtactatgtagtgtgtgtgtgtgtgtgtgtgtgtgtgtgtgtgtgtgtgtgtataaagggacaggaggttgggaatcactaagcccttaaagcagccactttgctcctagaaatgaacaatttcattcaatcagggatttttgtctccttggcttgcttttagttcttttgtgtattaaagggcaatcctggaatagacgtagcatttggaatta

SEQ ID NO: 20921 - DNA, 226 bp, Homo sapiens
  AC026888.6_76405
  Located on chromosome 14
  Distance between a terminus base of telomere on chromosomal short arm and 5'-terminus of this base sequence : 78021347
  Distance between 3'-terminus of neighbour sequence of sequence listing upward to telomere on chrosomal short arm and 5'-terminus of this base sequence : 36147
agattgtaagcctttctgagagcagacaacacgtggctgcataaacagaccctagtgcaatgtctgatatatagtgcagattcaatgaatattttggggaagaatgagcaaaatcaagaaagctattaggaggctcttgaaaataggtgtggtaaatggcaaaaaacaaacaaacaaacaaacaaacaaaaaccccaaaagcatgaactaaagtgtcagtactggt

SEQ ID NO: 20922 - DNA, 242 bp, Homo sapiens
  D14S287
  Located on chromosome 14
  Distance between a terminus base of telomere on chromosomal short arm and 5'-terminus of this base sequence : 78110018
  Distance between 3'-terminus of neighbour sequence of sequence listing upward to telomere on chrosomal short arm and 5'-terminus of this base sequence : 88445
ggtagagttgaaagcaatagagaagatttgttgacaatatcgatgattaaaaaaatgagcctttttaaacaagaaattcctgctcatacatttggcttctgagagagagaaagagagagagagagagagagagagagagagagtgtgtgtgtgtgtgtgtgtgtgtgtgtgtgaaatggggaaaaatatcaatgcatcaaaatggacaggtcattttgttgaatgtaactgaactcctaagc

SEQ ID NO: 20923 - DNA, 183 bp, Homo sapiens
  AC026888.6_165055
  Located on chromosome 14
  Distance between a terminus base of telomere on chromosomal short arm and 5'-terminus of this base sequence : 78110083
  Distance between 3'-terminus of neighbour sequence of sequence listing upward to telomere on chrosomal short arm and 5'-terminus of this base sequence : -177
taaacaagaaattcctgctcatacatttggcttctgagagagagaaagagagagagagagagagagagagagagagagtgtgtgtgtgtgtgtgtgtgtgtgtgtgtgaaatggggaaaaatatcaatgcatcaaaatggacaggtcattttgttgaatgtaactgaactcctaagcattcag

SEQ ID NO: 20924 - DNA, 373 bp, Homo sapiens
  AC022469.5_29864
  Located on chromosome 14
  Distance between a terminus base of telomere on chromosomal short arm and 5'-terminus of this base sequence : 78155620
  Distance between 3'-terminus of neighbour sequence of sequence listing upward to telomere on chrosomal short arm and 5'-terminus of this base sequence : 45354
caatgaggttagaatcactaggacttttcttaatgttggttcacccccattatacctcctgagtataagtggataatgatttttttaaatcataagagcgccatgttgcaattgttattatcaccccacctcactgtgtgtgtgtgtgtgtgtgtgtgtgtgtgtgtgtgtgaagttaaatgatctttaatagtggtttgttaccaaaaaatccatgtaagctcaagtcacctaaataaaaactactgtataagaaggaggcacaagtatggaaaacatataggaatacaagaaatgtttacttttggcccttttcctcttttaggccatttccttcctttccctctaccttggacagctagtttcaataaac

SEQ ID NO: 20925 - DNA, 444 bp, Homo sapiens
  AC022469.5_117030
  Located on chromosome 14
  Distance between a terminus base of telomere on chromosomal short arm and 5'-terminus of this base sequence : 78242638
  Distance between 3'-terminus of neighbour sequence of sequence listing upward to telomere on chrosomal short arm and 5'-terminus of this base sequence : 86645
cgtttggctatgactcaactttttaagctaactctatttggaaagagtctgattaaagaaaatgtcaccaaacggttaaatatgttatttctgtgcatgtttgttatttgtcaaggggtttcattttaacccaaatgaataactttttattggtggattgtacccatcctcgttagatcaccaaaggcagtatgtattctgatagggccactttgttgtgcctctctgctttcttttctctctctttttcttttctttctttttctctctctctcctttctctccttccttccttccttccttccttccttccttccttccttccttccctcctcccttcctcccttcctccctcccttcctcccttcctcccttcctccctcccttcctccctcccttcctctctttcttctcttgcctctttacctaatgtctcaaatggta

SEQ ID NO: 20926 - DNA, 398 bp, Homo sapiens
  AC022469.5_122957
  Located on chromosome 14
  Distance between a terminus base of telomere on chromosomal short arm and 5'-terminus of this base sequence : 78248688
  Distance between 3'-terminus of neighbour sequence of sequence listing upward to telomere on chrosomal short arm and 5'-terminus of this base sequence : 5606
taatccgtgatttggttctaagagcctataatgaactccagttaattcagatgccatttagagaaacttggtcatattctaccttagaaaactcttggaataactttagttcttttgaaaattgcagtggtccagacatttttactctagtataactgctgtgtgtgtgtgtgtgtgtgtgtgtgtgtgtctgttgatcagaaactttataacgaggattagacttaaatttggcaagcttttctagataaattctagagaaaggtcccatgatgatcctagaaaatttaattaagagtaacaattaagagatccttttgaagtgcccatgtttaagttttatttgtttggttttgtatttttttctaaatattctttcagatcaaaccaagtctaaa

SEQ ID NO: 20927 - DNA, 382 bp, Homo sapiens
  AC022469.5_149000
  Located on chromosome 14
  Distance between a terminus base of telomere on chromosomal short arm and 5'-terminus of this base sequence : 78274654
  Distance between 3'-terminus of neighbour sequence of sequence listing upward to telomere on chrosomal short arm and 5'-terminus of this base sequence : 25568
aacgtggttgtagcatcaatagaataaggttttagttatatatatatgtatctacatatatatagttatctatatatatagctgtatatatagttatctatatatagctatatatagagttatatatatatagctatatatatggttatctatatagctatatatatagttatctatatatagctatatagttatctatagatagctatatatatagtttatatatatagttttatacacacacacacacacacacacacacacacacacatatacacacacacttagcttttctgtttcaactttgagtcataatgttgaatgaaaactgagtccaagattgatattctggggtcatctacatggagcactgaactatctt

SEQ ID NO: 20928 - DNA, 287 bp, Homo sapiens
  AC022469.5_150892
  Located on chromosome 14
  Distance between a terminus base of telomere on chromosomal short arm and 5'-terminus of this base sequence : 78276622
  Distance between 3'-terminus of neighbour sequence of sequence listing upward to telomere on chrosomal short arm and 5'-terminus of this base sequence : 1586
gatttatcctgacttgaagatgaggggacgtctcatggaagaggaggcagttaagctagacctgaggatgctaagtgcctcacataagtagggaaagaaagcataagtccagtctgggaaaatggtgagtgagatgaaatcccacagataagaaaggtgctgtgtgtgtgtgtgtgtgtgtgtgtgtgtgtgtgtgtgtgtgatggggtgggggcggggggatgacaacatgcctacagaatacagggggatgtgaaagaacaatttaccttccagaataaacttcc

SEQ ID NO: 20929 - DNA, 255 bp, Homo sapiens
  AC022469.5_153813
  Located on chromosome 14
  Distance between a terminus base of telomere on chromosomal short arm and 5'-terminus of this base sequence : 78279609
  Distance between 3'-terminus of neighbour sequence of sequence listing upward to telomere on chrosomal short arm and 5'-terminus of this base sequence : 2700
agtccaagcttaaggtgtcacaaagttaggtttcttctgagatctcctctctccttggcttgcaaatggctgccttctctgtgtgtttacatgatgtgtgtgtgtgtgtgtgtgtgtgtgtgtgtgtgcgcgcgtgcatgtatgtccccaaactccgagtgtttctttgccttcttataaggacaccagtatattagattagtgcctcacccttatgacctcacttaaccttaattacctctttcaaggctgtat

SEQ ID NO: 20930 - DNA, 278 bp, Homo sapiens
  Z66925
  Located on chromosome 14
  Distance between a terminus base of telomere on chromosomal short arm and 5'-terminus of this base sequence : 78346856
  Distance between 3'-terminus of neighbour sequence of sequence listing upward to telomere on chrosomal short arm and 5'-terminus of this base sequence : 66992
aatgctgaaattcccatgtaagtgtattttgcaagaaattttcacactatgaaataattggtctttatctctcatcctgtctgattctctatcaagacatatcaaacatgcacccctctgctcaaagtgtaaaaaaaaagtttgctttttaaagttttaattaaggcttttgctgtgtgtgtgtgtgtgtgtgtgtgtgtgtgtgaaagtactacacactttagttgtttaggtgtcattgttgagacatttagactgtatttcattcaggcagatac

SEQ ID NO: 20931 - DNA, 364 bp, Homo sapiens
  AC012099.4_15424
  Located on chromosome 14
  Distance between a terminus base of telomere on chromosomal short arm and 5'-terminus of this base sequence : 78441038
  Distance between 3'-terminus of neighbour sequence of sequence listing upward to telomere on chrosomal short arm and 5'-terminus of this base sequence : 93904
ggcctctatttctggtctagagctctttcatcatttccaggctacttgtttgtttgcagcaatttgtatgttctgtagaggaagattgaaaagagaaatggatagaaagagagagcagagatgaggggatgagagtctggagagaaggggagagagagagagagagagagaaatagattcatatatgaaggttagatcaagggccagcatccaagggtggtctaggtagagtactgggaaccaatctcaacctggcaggagaggcataattaaccagtgtctacatctgtgatattatttgtccttgctccaaaatgacaatagtgattacagtagatgcagctgacagtagcagatgacacaa

SEQ ID NO: 20932 - DNA, 118 bp, Homo sapiens
  D14S1008
  Located on chromosome 14
  Distance between a terminus base of telomere on chromosomal short arm and 5'-terminus of this base sequence : 78450757
  Distance between 3'-terminus of neighbour sequence of sequence listing upward to telomere on chrosomal short arm and 5'-terminus of this base sequence : 9355
tggcaaggatgtagaacactaagatacacacacacacacacacacacacacacacacacacatacattctttgtttgtttgttttgagacaggatctcgctctgtcacccaggctaag

SEQ ID NO: 20933 - DNA, 452 bp, Homo sapiens
  AC012099.4_76339
  Located on chromosome 14
  Distance between a terminus base of telomere on chromosomal short arm and 5'-terminus of this base sequence : 78501838
  Distance between 3'-terminus of neighbour sequence of sequence listing upward to telomere on chrosomal short arm and 5'-terminus of this base sequence : 50963
ctacctatggttacagagttggatgatgagaaagctgggtgtaaaatgccagccttctaatttatcagatttcaacacatgcagaaaatacatagtgttctgttttagctggaatctcaggaaaatggggactgaggtcctgaatgaatgatgaagaaggagagggtgaatcaatttccaatcggtggtcttaaaggtgaaatattgttagcctaagtaatctctactcttttgtgtcccttctattaaactctctttacaggttctctctctctctctctctctctctctctctctctctctctctctctcccacacacacacaccccaagataaaatccaaagcttctgattcaatagccaacctcttcagcaagaagagcaaaggttctgcagccagattgcctgggttcaaatcctgatcctatcactgaatagcagactttaggcaa

SEQ ID NO: 20934 - DNA, 280 bp, Homo sapiens
  AC012099.4_89382
  Located on chromosome 14
  Distance between a terminus base of telomere on chromosomal short arm and 5'-terminus of this base sequence : 78514996
  Distance between 3'-terminus of neighbour sequence of sequence listing upward to telomere on chrosomal short arm and 5'-terminus of this base sequence : 12706
acaaggtaatgtcatgatatggactgactcatttatttgttcatttgttcattcattccttcatcattcttcactcatcagacatgtagtgaggactttctttatattaggccccctgtgtttggttttctgtcagttatcttagggtcgtgtgtgtgtgtgtgtgtgtgtgtgtgtgtgtgtgttaaaggacgaataaagtaaataaactaatgcaatgtaagaagtgttgtggttttttagtaaaggttataaatctagacttatgtgcgtattgttt

SEQ ID NO: 20935 - DNA, 390 bp, Homo sapiens
  AC008056.6_5841
  Located on chromosome 14
  Distance between a terminus base of telomere on chromosomal short arm and 5'-terminus of this base sequence : 78584663
  Distance between 3'-terminus of neighbour sequence of sequence listing upward to telomere on chrosomal short arm and 5'-terminus of this base sequence : 69387
ttgcattaaacaattactatgcaggctctgggcttaagttttgacttaagtttagaaattgagtagttcccacaatgccctccatttctaaatgtatgagaagaggatcaacaaagaaaaaaattaatgggcttttgaatgagcaacgtgtgtgtgtgtgtgtgtgtgtgtgtgtgagagagagagagagagagacagagagacagagagaggcatgatcttggctccctgcaacctccgtctcccgggttcaagtgattctcatgcctcagcctcctgagtagctgggattacaggtgcccgccaccacacctggctaatttttgtattttttgtagagaccgggttttgccatgttggccaggatggtcttgaactcttgagctcaag

SEQ ID NO: 20936 - DNA, 422 bp, Homo sapiens
  AC008056.6_155490
  Located on chromosome 14
  Distance between a terminus base of telomere on chromosomal short arm and 5'-terminus of this base sequence : 78734262
  Distance between 3'-terminus of neighbour sequence of sequence listing upward to telomere on chrosomal short arm and 5'-terminus of this base sequence : 149209
accagtcatgagtttctttgaattcctccatgcttatccacatcagtccttactttaggggaatcccttcgtccctttgtttgaaatcttatgctaattatctcttcactcgggtctcttcccaaggtttggacatcatttagtgttctcattttccactggtgccattaatatcatcccgtcatcatagacatatatgtgtgtgtgtgtgtgtgtgtgtgtacatatatatgtatgtatgtgtatatgtatgtgtatgtatacacgcgtgtgtatatatatgtatatatacacatatatgtgtattgtgtgtatgtgtatatatatgtgtgtgtatatatatgtgtgtatatatatatatatatacctttcccatttcaaaaacaaaatcaaaacaaaaaaggcaattatctatgaacctg

SEQ ID NO: 20937 - DNA, 264 bp, Homo sapiens
  AF123462.1_2373
  Located on chromosome 14
  Distance between a terminus base of telomere on chromosomal short arm and 5'-terminus of this base sequence : 78822072
  Distance between 3'-terminus of neighbour sequence of sequence listing upward to telomere on chrosomal short arm and 5'-terminus of this base sequence : 87388
gtcacaatcctcaatacgtacattaaattagcttgttttgtggcaaaccctttaagaaatctaggctttaattttatatatatatatatatatatatatttttttttttttttttttttttttttttttttgagatagggtctcactctgtcacctaggctggagtgcagtggcgtgtttatagctcgctgcagccttaaactcccgggctcaagtggtcctcctgcctgagcttcccaagtagctagaactacatgcaccact

SEQ ID NO: 20938 - DNA, 405 bp, Homo sapiens
  AF123462.1_35403
  Located on chromosome 14
  Distance between a terminus base of telomere on chromosomal short arm and 5'-terminus of this base sequence : 78854985
  Distance between 3'-terminus of neighbour sequence of sequence listing upward to telomere on chrosomal short arm and 5'-terminus of this base sequence : 32649
tgtaatttaacagctcaggaagggaatcaaatcattcagaccaactgaagctttcaaaatgttactgcttgaatgggcagaatatccaaaaacatttattgtgtgatcctaacatctacatattagaaactgatagaaaacttctgatgtatcagtaagatgataattacccttgtaacatttctggaagcatgtatgtatgtatgtatgtatgtatttaaacgaatgcttgtatatctagcatctctttcaattgactcaatacccaaggaattttatctccattttacaaataagagagattatgacttatttcaggtcacagaagttggatcacagctggaactttagtccagttgggtctagaaattcaattttctttttactttcatgactaaggaccac

SEQ ID NO: 20939 - DNA, 223 bp, Homo sapiens
  AF123462.1_47669
  Located on chromosome 14
  Distance between a terminus base of telomere on chromosomal short arm and 5'-terminus of this base sequence : 78867410
  Distance between 3'-terminus of neighbour sequence of sequence listing upward to telomere on chrosomal short arm and 5'-terminus of this base sequence : 12020
tcctgtcaatacaggttctagttcaactcccaacacacacacacacacacacacacacacacacacacacacacacacctctcacatgctttccttctaattggcaagaagccttcagatgtccttcacccctactggaaaggcatgaaacaaaacccagtaccttcctcctacccctaaactggttttgtcttgctgcccctaatcctagcttgctgttctg

SEQ ID NO: 20940 - DNA, 320 bp, Homo sapiens
  AF123462.1_148014
  Located on chromosome 14
  Distance between a terminus base of telomere on chromosomal short arm and 5'-terminus of this base sequence : 78967739
  Distance between 3'-terminus of neighbour sequence of sequence listing upward to telomere on chrosomal short arm and 5'-terminus of this base sequence : 100106
gagctcagtgaaccagaagtagcatacatatacataaacacaatacagacacacacacacacacacacacacatacacacacacacacaaccaactatgagaccaaggtacatcataaacacatttctgagaaccacaataaagaagatttaaatctaccagaggtgagggtggagacatgatatatagagagaaaagaaaaaaaaattactgaggacatgtcaaaagaaataagataaatgaaggaaagaaaaagaaagacccagtttaaaagtagtgaaagaaaaaaataaacaatcaaattgcattctaaatctagc

SEQ ID NO: 20941 - DNA, 350 bp, Homo sapiens
  AC007514.5_14114
  Located on chromosome 14
  Distance between a terminus base of telomere on chromosomal short arm and 5'-terminus of this base sequence : 79005786
  Distance between 3'-terminus of neighbour sequence of sequence listing upward to telomere on chrosomal short arm and 5'-terminus of this base sequence : 37727
cttcaagtccatcttcactgtatttgtcaaggtcagccaaaggagcgaaatcaataagggtgtgtgtgtatgtgtgtgtgtgtgtgtgtgtgtgtgtgtaaagagaaagagaataggtcagagatacaagtaagaagagttcaagtctgaaggcactgtgctagcagaattccttcttcctttgagaaggcagtcttttttcttttttatttgttttttatttatttattgcatttatttatttttatgtatataatagttgtacatatttgggaggtacctgatatactttggtacctgcatataatgtgtagtaataaaatcagggtaattggaccatctatcacctc

SEQ ID NO: 20942 - DNA, 387 bp, Homo sapiens
  AC007514.5_76764
  Located on chromosome 14
  Distance between a terminus base of telomere on chromosomal short arm and 5'-terminus of this base sequence : 79068355
  Distance between 3'-terminus of neighbour sequence of sequence listing upward to telomere on chrosomal short arm and 5'-terminus of this base sequence : 62219
ggcaccatagtgatagaatcagcaaaattcaaactattagaagcagctgggtttcttccacaccacaacaaaaattaagtagttcattcattcattcactgaattacaaaaaagagcagcaactatatattatatatatatatatatatatacacacacacacacacacacacaaagtgattattaattaattgaaatgtataggccaggctttttaaggattctaattttaacaatgaattgaaccaaaagattctaagatatttggggaaatgtacacactgcttggatatttgatgatattgagaaatgactgcttattttgtgaagtagcaattatgaataaaaacagaatactaatcacttactagaccaacctcctgaaat

SEQ ID NO: 20943 - DNA, 154 bp, Homo sapiens
  AC007514.5_94516
  Located on chromosome 14
  Distance between a terminus base of telomere on chromosomal short arm and 5'-terminus of this base sequence : 79086153
  Distance between 3'-terminus of neighbour sequence of sequence listing upward to telomere on chrosomal short arm and 5'-terminus of this base sequence : 17411
gactgaccactaagctatgcagagagaggtgactcttatgtaagcaggcttaaaataataataataataaaacaagaattaaatgtgtgtatgtgcatgtgtgtatgtgtgtgtgtgtgtgtgtgtgtgtgtgtatgtttgtataccaagcaga

SEQ ID NO: 20944 - DNA, 352 bp, Homo sapiens
  AC007372.4_13674
  Located on chromosome 14
  Distance between a terminus base of telomere on chromosomal short arm and 5'-terminus of this base sequence : 79181975
  Distance between 3'-terminus of neighbour sequence of sequence listing upward to telomere on chrosomal short arm and 5'-terminus of this base sequence : 95668
tctttcattaaggtgctaccaatcaataaattgagtgacactggatggtggcagagacaattaaaacaaagttacttggtgagatatttatctgtcatatgggctgatttataagccttctacaagaagtaatttaacagccctttaatagaaggaggcttgataaaataccagcagatggtattatgggtagtgacccaggcaataatgattttagtaatggcacgtcttatttatttacctgtactcaaagagtaaacttgcgtagatgcacacacacacacacacacacacacacacacacacaaagagagagagagacattgtcttctgatggactagactgcctaaa

SEQ ID NO: 20945 - DNA, 325 bp, Homo sapiens
  AC007372.4_43770
  Located on chromosome 14
  Distance between a terminus base of telomere on chromosomal short arm and 5'-terminus of this base sequence : 79212092
  Distance between 3'-terminus of neighbour sequence of sequence listing upward to telomere on chrosomal short arm and 5'-terminus of this base sequence : 29765
atcatgagcaagttcagagtctcaagagatgctcctactttaagttgcctgttttccaaaaaatgcacatatttaaccatgttatgaacatattccttttcattaacagtccattgcctccacagaacatatcctttatacctcctcatagtgaaaagtgcttgatataaatgtgttcaaatgtatcacatattaatacactgccaatcataaataatatagaagtgtgtgtatatagtacatgtgtgtatgtgtgtgtgtgtgtgtgtgtgtgtcattttaaccaatttcttggaaagtatattaattgcacttagaaagcctg

SEQ ID NO: 20946 - DNA, 330 bp, Homo sapiens
  AC007372.4_103396
  Located on chromosome 14
  Distance between a terminus base of telomere on chromosomal short arm and 5'-terminus of this base sequence : 79271859
  Distance between 3'-terminus of neighbour sequence of sequence listing upward to telomere on chrosomal short arm and 5'-terminus of this base sequence : 59442
ggtctagaactgaatccacaatatttctgaggtatgctgtgtatattatattttcttgttacagtcttttttggtcttgacatgtggccaagcaagatgtactcactcactctctctctctctctctctctctctctctcacacacacacacacacacacacaccagtttttttctttaggagtgtgggatttagttcctagtgcatttgttctggcatatccattttagaaccaatttatcaagttccataaaagcaaaacaatgcaatgcaagaaatatcttatggagattttgtagaggattccttgtaatgtatagatcagcgtga

SEQ ID NO: 20947 - DNA, 403 bp, Homo sapiens
  AC010849.3_102348
  Located on chromosome 14
  Distance between a terminus base of telomere on chromosomal short arm and 5'-terminus of this base sequence : 79425534
  Distance between 3'-terminus of neighbour sequence of sequence listing upward to telomere on chrosomal short arm and 5'-terminus of this base sequence : 153345
tgttatgagtgaaatgtcggtatcccccaaaataaatatgttgaagcattaatccccaatgcaatggtatttggaggtggcctctgaaaggttattaggtttagatgaggtctcaaggttagagacctcataatgggattagtgtcatcagaagagagagaccagagctcgctctctctctctctctctctctctctctctctctctctctccctctctgcttgtcatatgaggacacagaaagaagggagctgtctacaagccaggaaggggcccctcaccaggaactgaatcttctggcaccttgatcttggacttcccagcctccagaattgtgaaaaataatgtatgttgtttaagccacctagtgtatggcattttgttacagcagtctgagcagact

SEQ ID NO: 20948 - DNA, 195 bp, Homo sapiens
  AC018513.5_22965
  Located on chromosome 14
  Distance between a terminus base of telomere on chromosomal short arm and 5'-terminus of this base sequence : 79482678
  Distance between 3'-terminus of neighbour sequence of sequence listing upward to telomere on chrosomal short arm and 5'-terminus of this base sequence : 56741
tgattactcaagattggcctacaatcattattgacttaaaggactgttttatatttatatatatatatatatatatatatatatattcgttatactttaagttctagggtacatgtgcacaacatggtttgacacataggtatacatgtgccacgttggtttactgcacccatcaactcgtcatttacattaggt

SEQ ID NO: 20949 - DNA, 443 bp, Homo sapiens
  chr14.fa.O7frz.79803746
  Located on chromosome 14
  Distance between a terminus base of telomere on chromosomal short arm and 5'-terminus of this base sequence : 79591454
  Distance between 3'-terminus of neighbour sequence of sequence listing upward to telomere on chrosomal short arm and 5'-terminus of this base sequence : 108581
taaagtttcagctgatcttgagaggaatgaaaaagggatttgcttgtttcaatgtatctcaaactcatatgcaaataaaactctgatactgcactacacatttatagtcaaagacaatactttaagaggagtagcacacaatgcaactgcaaatgaatgtcacacacacacaaaaataaggcagacaatgttaagctccaatgaagaattttggtaattacaagctgtattgttaaaaatcactgtcaaatatgtttgtctccattgtttgtgattcctcttaagattgaaaacactctcctccctgaggctccaccccccctgccgttttatccttctccactgctactaccactcatgtgaaattactccggcgtgtgtgtgtgtgtgtgtgtgtgtgtgtgtctgtgtctgtgtctgtgtctatacaggaatggcagaat

SEQ ID NO: 20950 - DNA, 381 bp, Homo sapiens
  chr14.fa.O7frz.79874249
  Located on chromosome 14
  Distance between a terminus base of telomere on chromosomal short arm and 5'-terminus of this base sequence : 79662030
  Distance between 3'-terminus of neighbour sequence of sequence listing upward to telomere on chrosomal short arm and 5'-terminus of this base sequence : 70133
tgcaccataaattatttagcactcttattctctactatggccaattatgttaattttacttgattattatcataaaactgaaatgaacattcagatatataaatctttcacactttaaaaaatgtgtttttcaaagagcaattttttagaagtagaatgctaggccaaaaggtgcttttatttataagaaatatatatatatatatatgtgtgtgtatatatatgtgtgcatgtatatatatatatatatatatatatatatatatatatatatatatatatacacccttataaatacacatacacacacacacacacacatacacacacacacacacacacactgcattctagaaacactgtatggaatgcttaagaatg

SEQ ID NO: 20951 - DNA, 384 bp, Homo sapiens
  chr14.fa.O7frz.79960482
  Located on chromosome 14
  Distance between a terminus base of telomere on chromosomal short arm and 5'-terminus of this base sequence : 79748376
  Distance between 3'-terminus of neighbour sequence of sequence listing upward to telomere on chrosomal short arm and 5'-terminus of this base sequence : 85965
aacgtcttcaaactaggacatcaattctctcttgccttaagcttgaactcagactggaacttataccatcacctgtcttggttcttatagcactggactaagactggaactataccataggtgctcttgggtctctggcttgctgaccatagatcttgggacttctcagtcttcataaccacatgggtcgtgtgtgtgtgtgtgtgtgtgtgtgtgtgtgtgtgtgtgtgtgtatttgtgtgtctgtgaacatacatagaaacacaccctattgctactgtttctggagaacccagactaatacaggtggtctaaacagaaagagaggaatgaatatatgacaaacagctaagaaaaactttgtaaagtcaccagttgtagtgg

SEQ ID NO: 20952 - DNA, 390 bp, Homo sapiens
  chr14.fa.O7frz.80048726
  Located on chromosome 14
  Distance between a terminus base of telomere on chromosomal short arm and 5'-terminus of this base sequence : 79836677
  Distance between 3'-terminus of neighbour sequence of sequence listing upward to telomere on chrosomal short arm and 5'-terminus of this base sequence : 87917
catagcaagtcctcaaataagtattcccaaagctgtattttatcttccaaattgctttaaattttcaatagatccatagataataaaaagttatcaatacttcatattttctgaggaactgaagttatatgtcacacacatacacacatacacacacacacacacacacacacacacacacacacacacacatgcacacaaagctaagaatcacaaggccccatttaattttttttttttaagagatgaagtcttgctcttccacccagactggagtgaagtggtgtgaacatggctcactgcagcctcggcctcccagactccagtgattctcccgtctcagccccctgtaatactccattctcccactgcagataaagacatacctga

SEQ ID NO: 20953 - DNA, 259 bp, Homo sapiens
  AC010582.6_90518
  Located on chromosome 14
  Distance between a terminus base of telomere on chromosomal short arm and 5'-terminus of this base sequence : 80226924
  Distance between 3'-terminus of neighbour sequence of sequence listing upward to telomere on chrosomal short arm and 5'-terminus of this base sequence : 389857
agaaattctgaaggattctcctactttcacaaaacatctagctcctggataaaatatattacacttctaggttcccaagaaataatgctgtagaaacagagctttccctaagaataaatgaaatgaaatagtagattattattcaacttatggtccaaatatttacacataattagagtgtatcaagtactttatatatatatatatatatatatatatatatataactagagtatatttagaatagtggttctcagcc

SEQ ID NO: 20954 - DNA, 312 bp, Homo sapiens
  AC010582.6_105454
  Located on chromosome 14
  Distance between a terminus base of telomere on chromosomal short arm and 5'-terminus of this base sequence : 80241842
  Distance between 3'-terminus of neighbour sequence of sequence listing upward to telomere on chrosomal short arm and 5'-terminus of this base sequence : 14659
gatgtatgcctcagactatttgttgtaggactgcattaacacccatcctaccatataaactatatttactttatataaaaagtaaatattttatataagaagattatataatacgtccatgtcccacatgtccatataaggaggttggttgaataaactatagtacatgcacacaggtgaggactatgcagctggaagaagaaataaggaatatatatatatatatatatatatatatgcccactatggattgatctttggaatataatgctgaatgaaaaaagcaagatgtggaaaagtattctttgcctc

SEQ ID NO: 20955 - DNA, 315 bp, Homo sapiens
  AC010582.6_170501
  Located on chromosome 14
  Distance between a terminus base of telomere on chromosomal short arm and 5'-terminus of this base sequence : 80307022
  Distance between 3'-terminus of neighbour sequence of sequence listing upward to telomere on chrosomal short arm and 5'-terminus of this base sequence : 64868
acctttgtagaaacttgatcaaacatgtggagaaaatgcttagtatactaggcatgtttcaaatacttagcatgggtacacacacacacacacacacacacacacacacacacacacacacggatatcacctcttccctatcctttgtaagagtaggctattatagccagaaaaatggccctggttgtcagtccaaagggaaaggtattttggcaaatatgaaggatctgttattcctttaaacctttctattatttgggcaataattcaatcttaagtgctctagctccctggtgacaatggtaacagcctatc

SEQ ID NO: 20956 - DNA, 227 bp, Homo sapiens
  AC010582.6_181702
  Located on chromosome 14
  Distance between a terminus base of telomere on chromosomal short arm and 5'-terminus of this base sequence : 80318171
  Distance between 3'-terminus of neighbour sequence of sequence listing upward to telomere on chrosomal short arm and 5'-terminus of this base sequence : 10834
cactgccatctatagtttggaggggcaggaacaagtagaaaaatatttgctgagttgattgcttttgttaaatggctgttagactgattatatggaatggagttcagtgagggtgtacatgtgtggggggtgtgtgtgtgtgtgtgtgtgtgtgtaaaagagataatgaatacaaatgagaatgagaataagaaaatgtgtattgggtgagcagaggataagcagag

SEQ ID NO: 20957 - DNA, 367 bp, Homo sapiens
  AB024748.1_857
  Located on chromosome 14
  Distance between a terminus base of telomere on chromosomal short arm and 5'-terminus of this base sequence : 80542596
  Distance between 3'-terminus of neighbour sequence of sequence listing upward to telomere on chrosomal short arm and 5'-terminus of this base sequence : 224198
accaataagtgcattagctcactggatttatttttgagaactggaaagtggaaacaaatgacacaggttaaatcttcaaacttacacacacacacacacacacacacacacacacacagagcacattcaagttgaaatgaaatatttactattccctcttgtaggtcagtaattttttcttcctccagaaaaactagaactaatactaataccatctgtctttttctgtcctttttaattcaactgttactcaaaagttgcagacctcatatcctttctaagatacataattcatccttttaaatcaggcagcaaatactggccaatacacattttagtacataccttggaatctaaggattcatcc

SEQ ID NO: 20958 - DNA, 132 bp, Homo sapiens
  D14S1000
  Located on chromosome 14
  Distance between a terminus base of telomere on chromosomal short arm and 5'-terminus of this base sequence : 80654823
  Distance between 3'-terminus of neighbour sequence of sequence listing upward to telomere on chrosomal short arm and 5'-terminus of this base sequence : 111860
tgtgtacccaagcataagtaggaagtgtgtgtgtgtgtgtgtgtgtgtgtgtgtgtgtgcgcgcgcacgcatgcgcacacatgtgtttaacattcttgagggcaaccaccaaccagttggcaatacaatcca

SEQ ID NO: 20959 - DNA, 337 bp, Homo sapiens
  chr14.fa.O7frz.81162818
  Located on chromosome 14
  Distance between a terminus base of telomere on chromosomal short arm and 5'-terminus of this base sequence : 80729868
  Distance between 3'-terminus of neighbour sequence of sequence listing upward to telomere on chrosomal short arm and 5'-terminus of this base sequence : 74913
cagctcactatgctcaagataggtcctctcaacagtaacctcctaggagttagctacactcttctaaggactttcacgctgtcactcagttacttactcttccagttgccgtttattaagctcttactacataccaaccaaacactaaactgtaatcacaatgaagccattgatggtgcccccaaggagctcactttctagagaggctgacacccttgattaatgacacattagagagagagagagagagagagaaaacacactgtgggatggtaaaatatagctattatttattgagaggttcaggcaaccttggaaatgcatttcttagaccttc

SEQ ID NO: 20960 - DNA, 190 bp, Homo sapiens
  G10093
  Located on chromosome 14
  Distance between a terminus base of telomere on chromosomal short arm and 5'-terminus of this base sequence : 80815508
  Distance between 3'-terminus of neighbour sequence of sequence listing upward to telomere on chrosomal short arm and 5'-terminus of this base sequence : 85303
tttggagaggtgagtgtattagggttttccagaagaacagaaccaataggagatctatctgtctgtccgtctgtctgtctgtctgtctatctgtctgtctgtctatctatctatctatctatctatctatctatctatctatctatctatctatctatctatctatctggagggagaaagggggagatag

SEQ ID NO: 20961 - DNA, 149 bp, Homo sapiens
  chr14.fa.O7frz.81358278
  Located on chromosome 14
  Distance between a terminus base of telomere on chromosomal short arm and 5'-terminus of this base sequence : 80925495
  Distance between 3'-terminus of neighbour sequence of sequence listing upward to telomere on chrosomal short arm and 5'-terminus of this base sequence : 109797
agctaaacttggagctaaagaagctagcaatctaaacatgccaaaaagtacaggagacaataatagcaacaacaacaacaacaacaacaacaacaacaacaacaacaacaacaaaatcctgctgtctttacctacaggaccagaataat

SEQ ID NO: 20962 - DNA, 373 bp, Homo sapiens
  chr14.fa.O7frz.81504681
  Located on chromosome 14
  Distance between a terminus base of telomere on chromosomal short arm and 5'-terminus of this base sequence : 81071818
  Distance between 3'-terminus of neighbour sequence of sequence listing upward to telomere on chrosomal short arm and 5'-terminus of this base sequence : 146174
attacactgttatagtgcagatcagttcaatatatagtatataaatataaatatatagctaacatatattctacatatgtaaatatatagtatattaatgtaaaaatatattgctgtattagtttttcagagagagaacaccaatagaagatagatagatagatagatagatagacagatagatgatagatatgtagctatattagaggggatttattaggggaattggctcacacaattatggaggctgagaagtcccacaataggccatttgcaagctggagaaccagagaagatggcagcatggcttagtccaagttggaaagcccaagaaccgagtaagccaatggtgtaacttagtctaaggctgaaa

SEQ ID NO: 20963 - DNA, 242 bp, Homo sapiens
  chr14.fa.O7frz.81591694
  Located on chromosome 14
  Distance between a terminus base of telomere on chromosomal short arm and 5'-terminus of this base sequence : 81158915
  Distance between 3'-terminus of neighbour sequence of sequence listing upward to telomere on chrosomal short arm and 5'-terminus of this base sequence : 86724
taaccagaagctattcactgagaaggaagtaaatagtatatatactttttatgtgtgtgtgtgtgtgtatatatatatatatatatatatatctttaatgtattatatattcatatataatacataaaatatattcataaaatatatattatgtatatatattcatatatacacatatatatgtatatgtgtattatgatactgtttaatatcaatgggtctgaccttgtaaacagaaatac

SEQ ID NO: 20964 - DNA, 460 bp, Homo sapiens
  AC021122.4_63872
  Located on chromosome 14
  Distance between a terminus base of telomere on chromosomal short arm and 5'-terminus of this base sequence : 81309865
  Distance between 3'-terminus of neighbour sequence of sequence listing upward to telomere on chrosomal short arm and 5'-terminus of this base sequence : 150708
catctgaagttaccatgtttctactgccaaaacgtgtcacctcttcatttgggccttatgttgattattctggaaatattttcatttgcaaggtagatttcccaccttgttatatgcttttttggggctatttatatgacaaagtttctagtaatctgacaggaagagccagggtttgaagcatatatcagagtatgggcctagatgagaatttaacatgcatctaaaagtctttctcccctatctctcatggtctcaaagcttagaaatatttgtgtgtgtgtgtgtgtgtgtgtgtgtgtgtgtgtgtgtgtgtgtgtgatttgttggttttaaataaagtgaataggttttcttcaatctagtaattatttagggattttactcttaggtttttagaaccctagtgaaatagattagctcatacaattttgccttaggaattacatgtcagaaattc

SEQ ID NO: 20965 - DNA, 346 bp, Homo sapiens
  AC027615.5_153916
  Located on chromosome 14
  Distance between a terminus base of telomere on chromosomal short arm and 5'-terminus of this base sequence : 81462270
  Distance between 3'-terminus of neighbour sequence of sequence listing upward to telomere on chrosomal short arm and 5'-terminus of this base sequence : 151945
aagcctgattctacaggtatttactgagcttggcatgtgccaggcaatatgctcagggctggaaacactcgggaaaataaaatactgaaaatgtcacagctgtacattcttgtggggaagacagacctcaaacaagtcaacatatacacagcaactgaaagaaagagttagccagggatgataataataataataataataataataataatagaataaagacctttgctaggttaaaggtcagaaaggcccaggcctgtcacaaagatacctgaggcaagagggaaagagaaaagatttcagatcggaaggttcccttttgcctttaattggaccagattcattg

SEQ ID NO: 20966 - DNA, 256 bp, Homo sapiens
  D14S591
  Located on chromosome 14
  Distance between a terminus base of telomere on chromosomal short arm and 5'-terminus of this base sequence : 81462329
  Distance between 3'-terminus of neighbour sequence of sequence listing upward to telomere on chrosomal short arm and 5'-terminus of this base sequence : -287
tggaaacactcgggaaaataaaatactgaaaatgtcacagctgtacattcttgtggggaagacagacctcaaacaagtcaacatatacacagcaactgaaagaaagagttagccagggatgataataataataataataataataataataatagaataaagacctttgctaggttaaaggtcagaaaggcccaggcctgtcacaaagatacctgaggcaagagggaaagagaaaagatttcagatcggaaggttc

SEQ ID NO: 20967 - DNA, 382 bp, Homo sapiens
  AC027615.5_165714
  Located on chromosome 14
  Distance between a terminus base of telomere on chromosomal short arm and 5'-terminus of this base sequence : 81473986
  Distance between 3'-terminus of neighbour sequence of sequence listing upward to telomere on chrosomal short arm and 5'-terminus of this base sequence : 11401
cctgttaacatctagcagtcactgccacaatccttatctttttgtataactctgtggtgccatgatttcttccaaggaaatcagttagagaaaactaagttgtctacagcatttgattgaccacagaccaaagtaaaactattaaaaagaagtcattaaaataatcccactggaaaatcttgttaatgagttttatctcttatttatttccttagaatgtaagttattgaattaagctaactgaattattgtatcattttatgtacacacacacacacacacacatacactcaaccttgacagcataaataaaatgtatttttagatattaccatttttttttcctgaaatcatgtaaatgtagtcacatttgactggtagc

SEQ ID NO: 20968 - DNA, 397 bp, Homo sapiens
  chr14.fa.O7frz.82195483
  Located on chromosome 14
  Distance between a terminus base of telomere on chromosomal short arm and 5'-terminus of this base sequence : 81823380
  Distance between 3'-terminus of neighbour sequence of sequence listing upward to telomere on chrosomal short arm and 5'-terminus of this base sequence : 349012
atttcaattgatagtttgactgattaaaagtgattgtagaaatgcctgcattatcgggcgggtgcggtggctcacgcctgtaatcccagcactttgggaggccgaggcaggagatcacgaggtcaggagatcgagaccatcctggctaacatggtgaaaccccttctctactaaaaatacaaaaaattagctgggcgtggtagccggcgcctgtagtcccagctgcttgggaggctgtggcaggagaaaggcgtgaatccaggaggcggagcttgcagtgagatcgtgccactgtactccagcctgggcaacagagcgagactctgtctcaataaataaataaataaataaataaataaaaagaaatgcctgcattatctacaagtgagcagagaag

SEQ ID NO: 20969 - DNA, 464 bp, Homo sapiens
  chr14.fa.O7frz.82300247
  Located on chromosome 14
  Distance between a terminus base of telomere on chromosomal short arm and 5'-terminus of this base sequence : 81928172
  Distance between 3'-terminus of neighbour sequence of sequence listing upward to telomere on chrosomal short arm and 5'-terminus of this base sequence : 104395
gaggctctagtttctatgactttctttggggaaggaagaaccctggtttgtgtgacttgtgtcagggatgaaagaggggtgggagacagaagaacaggaaggcagagagagactttgcttctgaggctgcttctgaggctttccagtctcctttatttcagagtactcaggatgccaaagtgctgcattttggatatgattttctgagatccaacaatagacagataggtgtatggaaagatagatagatagacagatagatagatagatagatagatagatagatagatagatacatacatacatacatacatacatacatacatacatagatacatagaaacatagatacgtagatagatgagagggagagatgatagacagacagacagacagatagatagatagattagaaaaatagcgtagtaaatgagtggtttgtgatgaagctagcattcaataca

SEQ ID NO: 20970 - DNA, 372 bp, Homo sapiens
  chr14.fa.O7frz.82392981
  Located on chromosome 14
  Distance between a terminus base of telomere on chromosomal short arm and 5'-terminus of this base sequence : 82021077
  Distance between 3'-terminus of neighbour sequence of sequence listing upward to telomere on chrosomal short arm and 5'-terminus of this base sequence : 92441
gcctggagtcctagctactcgggaggctgaggcaggagaatggcgtgaacccaggaggcggagcttgcagtgagcagggatggcgccactgcactccagcctgggcaacaaacagagcgagactctgtctcaaaaaataataataataataataataatgataataataataataaagaaatagtaaattgtcttacacaatgaatatatttatggcaagattatgcctagttttctctcttctgtctatctctctattcttcacatttttattttaaatgtaagatgattgtcaaatagaattgtattaactcatttatttgaattgaaaaataaaaccatagatcttatttcctacagtaagtctgaggt

SEQ ID NO: 20971 - DNA, 461 bp, Homo sapiens
  chr14.fa.O7frz.82528320
  Located on chromosome 14
  Distance between a terminus base of telomere on chromosomal short arm and 5'-terminus of this base sequence : 82156402
  Distance between 3'-terminus of neighbour sequence of sequence listing upward to telomere on chrosomal short arm and 5'-terminus of this base sequence : 134953
gtatagtcagcacctgttgaagtcctattgattttaattcaaacctgcccaaggtgatggcacagtgccccctcatgcctcctctgtccctctgtcaataatttgaaatgtcaaccatttggaaggataagagtttgcaacttccattatgatccctcaagaaaagctttacctaatacagtgtgtgtgtgtgtgtgtgtgtgtgtgtgtgtgtgtatgtgtgtgcttacacagctgcataaaacctatataagtatttgtatgtacaaaacacaaactttcagctcgtattctcatttgcagttcactgtatcaagaaagggttacagaggatggagctatgactacaagtgactagaattcactgtggaccactctcaaaggaaagccattaaaatgggctttttaaagttatgttgcctttattatttagaagacttagtcctcagtaacaaccatta

SEQ ID NO: 20972 - DNA, 359 bp, Homo sapiens
  HUMUT2031
  Located on chromosome 14
  Distance between a terminus base of telomere on chromosomal short arm and 5'-terminus of this base sequence : 82370705
  Distance between 3'-terminus of neighbour sequence of sequence listing upward to telomere on chrosomal short arm and 5'-terminus of this base sequence : 213842
aaactgggccttctctccttccttccttccttccttccttccctctttcatcccttcctcctctcccctccccttcctcccttcctctcgctttcctcccctcctctccctgcctctcctctcctatccttctttgtttctttctctctcttttttctttcttttccttccttccttccttccttccttccttccttccttccttccttccttccttccttccttctttcctccctctctctcttcctccctccctcctttccttcttttcctcattctttttttccttttctttctttattttcttcccttgaatgtggcagaggtattattattgaagggcttttgaacttgttggt

SEQ ID NO: 20973 - DNA, 413 bp, Homo sapiens
  chr14.fa.O7frz.82862662
  Located on chromosome 14
  Distance between a terminus base of telomere on chromosomal short arm and 5'-terminus of this base sequence : 82490670
  Distance between 3'-terminus of neighbour sequence of sequence listing upward to telomere on chrosomal short arm and 5'-terminus of this base sequence : 119606
ctgtatgcatctacttcaggagatgttatgttattgttggctgttttggcagagcatggccattcaaggtaaatgccttcgtttaaatctcaactcagtgatttcctaggtaagcgagatcaggcatataacacaaacctccataagcccaacgttccgctctgtagagataaaatgataattcctgttccacagaaaagtgttgaatgaagtagatgaaaaggcaaaagtccttatacagtgagaaagagagagagagagagagagcaatcaatcaatgcatgaaaagaattataacactgtctttgacactgtcctaggtgcttgtgacaagtacagaagaaacaggtatgatctggcctttaaagagcttccattccagttgagccctgagtaccaagaaattctaaaga

SEQ ID NO: 20974 - DNA, 444 bp, Homo sapiens
  chr14.fa.O7frz.83112703
  Located on chromosome 14
  Distance between a terminus base of telomere on chromosomal short arm and 5'-terminus of this base sequence : 82740866
  Distance between 3'-terminus of neighbour sequence of sequence listing upward to telomere on chrosomal short arm and 5'-terminus of this base sequence : 249783
taatcttgtttcatagaattaccagcaacgccgtaaaaatgtgaacacagtaagacattataaacaacagtacaatgacaccacagaaattcatacacacacacacacacacacacacacacaggtttttaaaaaaatactgcaggtcttcatgtgaaataaaataataaagaataaaacccatgtatattactctttgttgtcaacacaggaggcaaagtgattacatcagaatattttcactgaatatttttcatgtgtcttgttttgatggtgaggtgagggctcttgttctgatatcactatcagaacagagagtgatctgttatcactatctgttatctgatatcactaacagatagtgaaatcagaacaagagccctcacctcaccatcaaaacaagacatgtgaaaaaaggatctaactttagtacatccttccatg

SEQ ID NO: 20975 - DNA, 343 bp, Homo sapiens
  chr14.fa.O7frz.83240916
  Located on chromosome 14
  Distance between a terminus base of telomere on chromosomal short arm and 5'-terminus of this base sequence : 82869103
  Distance between 3'-terminus of neighbour sequence of sequence listing upward to telomere on chrosomal short arm and 5'-terminus of this base sequence : 127793
acgtgcaggtttgttacatataattttgaaacaaatcctgaagacttgcctcaagcaatagacctttctttcttccttccttccttccttcctttctttctttcttttctttctttctttctttctttctttctttctttctttctttctgtctgtctttctttctttctgtctttctttctttctttctttctttcagattggtactccctgttttgagtagatggacattttaaacgtttcttttttttctaaaaacttggccaggttaggcaggcaagcaagtgatcaaattacaaaatctgcatatttctgacatcttcatatgctcttgtcatacttt

SEQ ID NO: 20976 - DNA, 443 bp, Homo sapiens
  AC026841.2_45211
  Located on chromosome 14
  Distance between a terminus base of telomere on chromosomal short arm and 5'-terminus of this base sequence : 83017490
  Distance between 3'-terminus of neighbour sequence of sequence listing upward to telomere on chrosomal short arm and 5'-terminus of this base sequence : 148044
ttgttcttaacaaaggtgatagacaaaaagacatttgttaatttctcacaatctcaatggaccatttctcattgataaaattaatattatacttgcattacacctgataatttttaccttttatttttttcttgcatgctcactaacctataatgtaaattacctttaaaattgattatcgtgtatcaaaaacatttcaggttttgacgatcagtatggtctggggtctggatgattttagaggaagattactgttgaagataaagccagatgcacttgagagaaaaaaattaaacatttgaatttaaaaattcagaacactgtgtgtctgtgtgtgtgtgtgtgtgtgtgtgtgtgtgtgtgtgtgtgtattctgtatggttctatttgtataaagctctggcaaagaaaaatctaccctttggtgacaaagaatattagtg

SEQ ID NO: 20977 - DNA, 424 bp, Homo sapiens
  chr14.fa.O7frz.83472060
  Located on chromosome 14
  Distance between a terminus base of telomere on chromosomal short arm and 5'-terminus of this base sequence : 83100506
  Distance between 3'-terminus of neighbour sequence of sequence listing upward to telomere on chrosomal short arm and 5'-terminus of this base sequence : 82573
gaaggaacttcaatgagtcatatgttatgtatacttgagattgtggaggttgcttagagtatacatcatttagagtaacattatcaagtcatcctctagtcagccccaaacacctaatcaataatttctaactaatctaaaacacttgtgttgtcattttcaacaattcaaattaatggaaattttgaagatggatagatcttgacggaaacaagcagagagataaagcagatggagaaaagagggaggcaacgaaggaagggagggagggagggagggaggaaggaaggaaggaaggaaggaaggaaggaaggaaggaaggaaggaaggaaggaaggaaaaaatagactttgcaacttatgtaaaagagagatgtgcaagataaagaaagttaaattcaacgtggcattgaatagaaaggtat

SEQ ID NO: 20978 - DNA, 274 bp, Homo sapiens
  chr14.fa.O7frz.83615597
  Located on chromosome 14
  Distance between a terminus base of telomere on chromosomal short arm and 5'-terminus of this base sequence : 83188268
  Distance between 3'-terminus of neighbour sequence of sequence listing upward to telomere on chrosomal short arm and 5'-terminus of this base sequence : 87338
acaaatatgtctcctaagctgatctttctttgatttaataaatatacctttccaacttggctagtatatatcaaagcatgcaaacacacacacacacaaacacacacacacacacacacacacacactggaagagcaatgaaaacagaaggactaaaagaatcattctcttggtaatggttctcccaagcaaagtgaaatggcatgagtaatgtctgttatcaaagaaagagattagattgtcagaaatactagaattcttgtccaatacagtc

SEQ ID NO: 20979 - DNA, 341 bp, Homo sapiens
  chr14.fa.O7frz.83741403
  Located on chromosome 14
  Distance between a terminus base of telomere on chromosomal short arm and 5'-terminus of this base sequence : 83318229
  Distance between 3'-terminus of neighbour sequence of sequence listing upward to telomere on chrosomal short arm and 5'-terminus of this base sequence : 129687
gtttgactcaattgtaggtgataggagtcagtgattttaggttacttccctggtctacccatacatacacacacacacacacacacacacacacacacacacatacatatacacaccccttaccctttgtaccagacactgaactatttaaaataaaacctatcatacactgggaatactaactttaagagaagaagcctgctgtcgccactctataccttctgagatacaatgttgtgtatatttcttctcactcctctctatctacactttaaccaggatttatgtcctgtgagccagagggcagaactggcaggctgatctacttaatttcaatggcc

SEQ ID NO: 20980 - DNA, 477 bp, Homo sapiens
  AC017102.5_180722
  Located on chromosome 14
  Distance between a terminus base of telomere on chromosomal short arm and 5'-terminus of this base sequence : 83587166
  Distance between 3'-terminus of neighbour sequence of sequence listing upward to telomere on chrosomal short arm and 5'-terminus of this base sequence : 268596
aagcaaataaggtcctattcacaagtaccagatatataaacatctcttcttggaaaacacaaatcaacaccaaacagagaaaaaagcacaacagaaaagtatcaaagtcaaagtttggttttaaaaagaaaataaataagtaaaatagaaatatacaactctaaaaatgctcagaaacctctggcagggctgataaagaaacatgcacacacatacacacacacacacacacacacacacacacacacacacttaaggttggaaataccctttatttcctaagcagatattaatttcccttcatactctattttaatttgtatatattgaatttttgttgattagtgttaattcatatacattatatataataaatatgaaaaacaaaaatgagatgactgtgatgtaattgaacaaacacttgttaaaaaatacaagataaatgattcaagcctcagatctatgatttgtgaactc

SEQ ID NO: 20981 - DNA, 269 bp, Homo sapiens
  AC017102.5_4764
  Located on chromosome 14
  Distance between a terminus base of telomere on chromosomal short arm and 5'-terminus of this base sequence : 83706881
  Distance between 3'-terminus of neighbour sequence of sequence listing upward to telomere on chrosomal short arm and 5'-terminus of this base sequence : 119238
ctattggtgaaatgcagataatacaggttttttttttaaacaggaatatatatatatatatatgaatatcttatgtatatgtaaagatatatatatctttttacatgatctatatatatagtgtgtatgtatatattgatggggtgtgtgtgtgtgtgtgtgtgtgtgtgtgtgtatgcattttatctttataaatgactgggacaaagtcaaaactgattaaaacatttggttattctggagtttcctaatacaaagatctggcaaga

SEQ ID NO: 20982 - DNA, 216 bp, Homo sapiens
  D14S616
  Located on chromosome 14
  Distance between a terminus base of telomere on chromosomal short arm and 5'-terminus of this base sequence : 83804301
  Distance between 3'-terminus of neighbour sequence of sequence listing upward to telomere on chrosomal short arm and 5'-terminus of this base sequence : 97151
agaacagagttgaggcctctgcttcaaaatgcagttctcttccactgaataataatgagtttttaaggaaatccttatatatgtacacatagataaccacacacacacacacacacgtttgtgcagatagatagatagatagatagatagatagatagatagaactattgtctctctctctctctctctgtctctgtctcttctatacatgaaggc

SEQ ID NO: 20983 - DNA, 213 bp, Homo sapiens
  D14S1037
  Located on chromosome 14
  Distance between a terminus base of telomere on chromosomal short arm and 5'-terminus of this base sequence : 83807613
  Distance between 3'-terminus of neighbour sequence of sequence listing upward to telomere on chrosomal short arm and 5'-terminus of this base sequence : 3096
tcaatcatggaagttggctacctagacagctgttttgtacgtgttctgcatcatttccatgtttacactttcttttaattcacccacttgcaaagaccacaagctgtacatacaattaccagggcattaaaggaaacacacacacacacacacacacacacacacacacacacacacacacacacacaatactgatgctttggtccaccttca

SEQ ID NO: 20984 - DNA, 433 bp, Homo sapiens
  chr14.fa.O7frz.84214099
  Located on chromosome 14
  Distance between a terminus base of telomere on chromosomal short arm and 5'-terminus of this base sequence : 83903311
  Distance between 3'-terminus of neighbour sequence of sequence listing upward to telomere on chrosomal short arm and 5'-terminus of this base sequence : 95485
gcaggttaattatgactcatgagcaggaacacttttctcctctgccactctgattgcctgtgaaggaatctctgtttgaataatatcccaggcctcaatctactccctcagcactcactcagtgactgcccaaattggtgagttacgcacacgggaagggagaaggtgtggctcagcccgtcttggatatttcaggtgctgacccgaaaatttgccgagcccaggccaaaatgaatagccagagctcttgtttaaagaaaagaaaaaccatatgtgccagtaaagctaccaaagtgtgtgtatatatatatatatatatatttttttttttttctttctgttgtggtatttctcccaatctattattgtgtcttctatgtgccatttaatagcacatatttaagaccttcagattatgaggtattcatggacc

SEQ ID NO: 20985 - DNA, 374 bp, Homo sapiens
  chr14.fa.O7frz.84317879
  Located on chromosome 14
  Distance between a terminus base of telomere on chromosomal short arm and 5'-terminus of this base sequence : 84007078
  Distance between 3'-terminus of neighbour sequence of sequence listing upward to telomere on chrosomal short arm and 5'-terminus of this base sequence : 103334
cgtattactggaattagagtcaaggcatcaacaatgacatctgtatacgaagtgagccataattccatgacctgtagagctgaaattttctaatgtgttatccagatagtcatcagaacaaagtaaggcaagctttatatttgctgctgcaatgattgctgtgcaagaccaactctttgtaacttgaatctgtccatgtgtttacctttgggcaatacggaccgcacttcactctttcatcacagcaacaacctttaaattatacctcgtggacttatttattcacaatataccctaagtattatgtcctcagtgtgtgtgtgtgtgtgtgtgtgtgtgtgtgtgtgtgtgtgtgtcctacgtgagaatactca

SEQ ID NO: 20986 - DNA, 240 bp, Homo sapiens
  D14S1022
  Located on chromosome 14
  Distance between a terminus base of telomere on chromosomal short arm and 5'-terminus of this base sequence : 84385947
  Distance between 3'-terminus of neighbour sequence of sequence listing upward to telomere on chrosomal short arm and 5'-terminus of this base sequence : 378495
cggatgtgaatgtgtagaattcggtacacacgtgtcagcttttcctctctgagaggaaagagagcccatggggagagatagagagagaaagtaagtgtgtatgtgtgtgtgtgtgtgtgtgtgtgtgtgtttgtgtgtgtgtgtgtgtgtagtgtgactgtgtgtgtatgtttgtaggaactgatgaaacaaaatcctagtcaatttttctgacttttttcaattgcatccgaactgtct

SEQ ID NO: 20987 - DNA, 299 bp, Homo sapiens
  chr14.fa.O7frz.84815781
  Located on chromosome 14
  Distance between a terminus base of telomere on chromosomal short arm and 5'-terminus of this base sequence : 84505140
  Distance between 3'-terminus of neighbour sequence of sequence listing upward to telomere on chrosomal short arm and 5'-terminus of this base sequence : 118953
actgaattactggctccttaatggcaattgcatttgctctctgagtccccattcttttcttctttttctccatagattctattagtaaccaacatatgatatattatgacatagtatatcatatattgtatgtgtttgttttaccattttcatacatgcatacacacacacacacacacacacacacacacacacacacacacacacacgcaaagattatagaatccatagagaaggaattttttagtttgttttgttcactggtgtttcccttgctccttaaagaggtgatagaaatt

SEQ ID NO: 20988 - DNA, 360 bp, Homo sapiens
  chr14.fa.O7frz.84942928
  Located on chromosome 14
  Distance between a terminus base of telomere on chromosomal short arm and 5'-terminus of this base sequence : 84632364
  Distance between 3'-terminus of neighbour sequence of sequence listing upward to telomere on chrosomal short arm and 5'-terminus of this base sequence : 126925
taaccgtatcaagcagtttaactatttctctcttatctgaaatctattttattttattttattttattttattttattttattttatttttttagagatgaggtctcaccctgtggcccaggctgatctcaaactcctggcctcaagtgatcctcttgcctcagcctcccaagtagttgggattacaggtgtgaggccctgtgcctggcctctctctgagatcttaaaatgaatctggtgaggaaagaagaaaattggaagaaagccaactattaaaaactagaaaacacttttaaggacttgaggaagaaataagcattaagacgtatacatgtttctaatttctagcaatgagatgtt

SEQ ID NO: 20989 - DNA, 235 bp, Homo sapiens
  chr14.fa.O7frz.85066414
  Located on chromosome 14
  Distance between a terminus base of telomere on chromosomal short arm and 5'-terminus of this base sequence : 84755731
  Distance between 3'-terminus of neighbour sequence of sequence listing upward to telomere on chrosomal short arm and 5'-terminus of this base sequence : 123007
tgaatactataaattcaccaggacagatacgatcgataaatttttattgatgtggaaatattctcatcatttacaaaaaatacaggttaaaaaataaaaatcgtttctatatatttttgcttatctgtaacatatttttccactacttatatatatataagtggtgtgtgtgtgtgtgtgtgtgtgtaaatgaacactagttaaagtactgccctaagcatttgttaaacatcca

SEQ ID NO: 20990 - DNA, 404 bp, Homo sapiens
  chr14.fa.O7frz.85174408
  Located on chromosome 14
  Distance between a terminus base of telomere on chromosomal short arm and 5'-terminus of this base sequence : 84863682
  Distance between 3'-terminus of neighbour sequence of sequence listing upward to telomere on chrosomal short arm and 5'-terminus of this base sequence : 107716
tttggaacacctagtgcattttcataaatgacattccttttaactgagcccatttttacccccaattctattgcagctccatgatttctcttgctccctgttttcccttcactttagtttctaaatgaaataaaagactattttctggtaatcactaccctaaatttgttatatgataatctaattcttattgtatgtgtgatttttcgtgcatctatctatcatctatctatccatctatgtatctatccatctgtctacctattttgtttctatctacctaataaagtattttggaatatagcagaaaataagccataaatttaaaaataagcaaataaatatactactgataacattacaattacttcttcaggctttagtagaattggctttcactacaa

SEQ ID NO: 20991 - DNA, 247 bp, Homo sapiens
  D14S1061
  Located on chromosome 14
  Distance between a terminus base of telomere on chromosomal short arm and 5'-terminus of this base sequence : 84944547
  Distance between 3'-terminus of neighbour sequence of sequence listing upward to telomere on chrosomal short arm and 5'-terminus of this base sequence : 80461
aggcgaacctatgggaaacaataaatgtattttcataaaaataaaagttatacgcatttatctttttatatttataaaatatttatatacaccacacacacacacacacacacacacacacacaccctttgatcatgtttaaccaactcaatcatagtactggtatttaaatatgaaaagtattctaaaaatagtgagtgtttttcgtcagaccatacctaaactctgtcaagttggcattactgat

SEQ ID NO: 20992 - DNA, 333 bp, Homo sapiens
  HUMUT5122
  Located on chromosome 14
  Distance between a terminus base of telomere on chromosomal short arm and 5'-terminus of this base sequence : 84990993
  Distance between 3'-terminus of neighbour sequence of sequence listing upward to telomere on chrosomal short arm and 5'-terminus of this base sequence : 46199
gccccaaaactctcagaagatactttttaggcttatagtttttttctttctctttctttctttctttctttctttctttctttctttctttctttctttctttctttctttcttttctttctttcttttctttctttcttttctttctttctttatttctttctctttccctttctttctttctttctttctttctctctctttctttttattttctttcttttgtttttaaagactgtatttccttagagcacttctagattgagagcaaaattaagaatatagtacagagatttcccataaaagccctgcactcacacatgcataacctca

SEQ ID NO: 20993 - DNA, 114 bp, Homo sapiens
  D14S1052
  Located on chromosome 14
  Distance between a terminus base of telomere on chromosomal short arm and 5'-terminus of this base sequence : 85024318
  Distance between 3'-terminus of neighbour sequence of sequence listing upward to telomere on chrosomal short arm and 5'-terminus of this base sequence : 32992
tattcaggttgctgatgggttttccagtgctattatgacagaaacgagaagaatgcatttgtgtgtgtgtgtgtgtgtgtgtatgtgtgtgtcaagaagcaaatgacttttagc

SEQ ID NO: 20994 - DNA, 92 bp, Homo sapiens
  D14S974
  Located on chromosome 14
  Distance between a terminus base of telomere on chromosomal short arm and 5'-terminus of this base sequence : 85240467
  Distance between 3'-terminus of neighbour sequence of sequence listing upward to telomere on chrosomal short arm and 5'-terminus of this base sequence : 216035
ggctaagtgctacgccacataaggttgtgtgtgtgtgtgtgtgtgtgtgtgtgtgtatacactcacctataagatgcatgtgcatgtgtgtg

SEQ ID NO: 20995 - DNA, 465 bp, Homo sapiens
  chr14.fa.O7frz.85554764
  Located on chromosome 14
  Distance between a terminus base of telomere on chromosomal short arm and 5'-terminus of this base sequence : 85269851
  Distance between 3'-terminus of neighbour sequence of sequence listing upward to telomere on chrosomal short arm and 5'-terminus of this base sequence : 29292
tagctgtcacgaaatagatttaagaagaaagcaaatgttttcaaatatagtaattcacaatagaaactaataaataaatacaagtggctcttttgtaatacagaaacaaaagaaaagcaaagtccctgataaccaagaatggtaaaaactaattttgcattttaatatttcttttgctaaggctaaaatgattttagagattgataaaattcccttaaaaatatattaggaatgcagcaaagaaaaattttaaaaagtttcacagacacacacacacacacacacacacacacacacacacactctgaaagaggaaggttaaacccattccaggtttctttgtgaaagaaattgtgttttcttgtggtttttcattgggaatctaaaataatatgcacacattttaaaaaatgcttatgacaacatccttgaaaagagatgcataagatcaatgtatttgccttc

SEQ ID NO: 20996 - DNA, 407 bp, Homo sapiens
  chr14.fa.O7frz.85682505
  Located on chromosome 14
  Distance between a terminus base of telomere on chromosomal short arm and 5'-terminus of this base sequence : 85397726
  Distance between 3'-terminus of neighbour sequence of sequence listing upward to telomere on chrosomal short arm and 5'-terminus of this base sequence : 127410
taaaggatttccaaggagatagttttatgagactcaatttccaggtccttaatttccaactccttcatttccacacagtctctttcctcagctgcgtgagattgctcatgttcctattagtctttctcattttacacacacacacacacacacacacaaaaacactgtccttaactgcagaaaaaaatattaaagttttgcagtaactcctttaatgattcatggatatgtcttaaacgcattagtctcctgttttcctttgcatttaacatataaatatctggagtgttagaatgttctgaattcaaaagggctaatgcattagaagttactgaacctgatacttttaaacttagctgactattttcctagcatgaccgaagttctcatgttacaggaagtgaaac

SEQ ID NO: 20997 - DNA, 121 bp, Homo sapiens
  D14S73
  Located on chromosome 14
  Distance between a terminus base of telomere on chromosomal short arm and 5'-terminus of this base sequence : 86012783
  Distance between 3'-terminus of neighbour sequence of sequence listing upward to telomere on chrosomal short arm and 5'-terminus of this base sequence : 614650
ttagccaccacagtcatcaaccattgatcattttgcagacacacacacacacacacacacacacacacacacacacacacacacacacaatgtcagttacaggtgaaagcataagacgaag

SEQ ID NO: 20998 - DNA, 242 bp, Homo sapiens
  D14S618
  Located on chromosome 14
  Distance between a terminus base of telomere on chromosomal short arm and 5'-terminus of this base sequence : 86062557
  Distance between 3'-terminus of neighbour sequence of sequence listing upward to telomere on chrosomal short arm and 5'-terminus of this base sequence : 49653
ctacgaatgccaggaaagaagaaaggaagggaagaagggagggagggagggagggagggagggaaggtaggaaggaaggaaggaaggaaggaaggaaggaaggaaggaaggaaggaaggaaaaaaaaaacaaaagagctgaactaaacaaagttcactaacattttggcactagctcactgtcttatcatgaactgatagtaagaagtttgcagaccagccatcaatgcactaaccccattt

SEQ ID NO: 20999 - DNA, 250 bp, Homo sapiens
  AC006256.1_91735
  Located on chromosome 14
  Distance between a terminus base of telomere on chromosomal short arm and 5'-terminus of this base sequence : 86108173
  Distance between 3'-terminus of neighbour sequence of sequence listing upward to telomere on chrosomal short arm and 5'-terminus of this base sequence : 45374
ccattatgtcgtgttcttatcacaaacacacacacacacacacacacacacacacacacacacacacacacaaaaacaacaataaactccaaaaataagtttctaggaggaagcttttggaggtgatgaataaatttatggcattgatagggatgatgatctgatagtttcacaggtgtataaatatatccaaacacagcaagtggtacacataaaatatctacaggttcttaatgccaatcatacctta

SEQ ID NO: 21000 - DNA, 235 bp, Homo sapiens
  D14S1063
  Located on chromosome 14
  Distance between a terminus base of telomere on chromosomal short arm and 5'-terminus of this base sequence : 86311760
  Distance between 3'-terminus of neighbour sequence of sequence listing upward to telomere on chrosomal short arm and 5'-terminus of this base sequence : 203337
cgcatggtaacagtcaagaatgaaaattatttaagattgtgtgtgtgtgtgtgtgtgtgtgtgtgtgtgtgttatgcatacaggcacataaagtgatattggcattccttatacttaggaagctttttattctaaaactctgaatgtagaggttgggaagaaaatagaaagacggttttcattccagcagaactcaacagactggacattaagaacttctcatgtgcaattgagg

SEQ ID NO: 21001 - DNA, 254 bp, Homo sapiens
  AC005968.1_130229
  Located on chromosome 14
  Distance between a terminus base of telomere on chromosomal short arm and 5'-terminus of this base sequence : 86440065
  Distance between 3'-terminus of neighbour sequence of sequence listing upward to telomere on chrosomal short arm and 5'-terminus of this base sequence : 128070
ttcctcacactatccaataaagatgtgagctgtgagcacccaatggaaacatccagcagaggcaagaggggtctttatgtacaatgctgtggttatggattcaattgtgtgtgtgtgtgtgtgtgtgtgtgtgtgtgtgtgtgtgtgtgagagagagagagagagagagagagagagagagagagagagaggaggtaagagccaggcctaattccagcttgatttgttctgtttcaatgatttggtgataatct

SEQ ID NO: 21002 - DNA, 302 bp, Homo sapiens
  AC005968.1_110346
  Located on chromosome 14
  Distance between a terminus base of telomere on chromosomal short arm and 5'-terminus of this base sequence : 86459961
  Distance between 3'-terminus of neighbour sequence of sequence listing upward to telomere on chrosomal short arm and 5'-terminus of this base sequence : 19642
tatcactgtttcagaaacatgagtgaataagaaaagaaaaataactcaaggaacaaaacaagacaaagaaagaggactcaaaaaagtctgtgtgtgtgtgtgtgtgtgtgtgtgtgtgtgtgtaattatcataatccaaacttatattacttttgctctttaaaggaaggttcagtctttatttagtaaagtagaccaaatgtgtccatgttagcatctcttttactttggaaatggaagtgggtcagaagctccctctgaggcggaagttgaaaatctgtagcttatgaccattagatgag

SEQ ID NO: 21003 - DNA, 328 bp, Homo sapiens
  AC005968.1_34780
  Located on chromosome 14
  Distance between a terminus base of telomere on chromosomal short arm and 5'-terminus of this base sequence : 86535602
  Distance between 3'-terminus of neighbour sequence of sequence listing upward to telomere on chrosomal short arm and 5'-terminus of this base sequence : 75339
tttaagatgcaggatagaatttacctggttttgtttgtttgtttgtttgtttgtttgttttactgttctaccaatttttattgtatcccggacgttgtggatgttatatattgacactcttgatatgttgttcctttggaatgtgtctatttttattctaaccagcaagcaaattactagttgattaatttgaattttttatgctttgttatttcagatatgttttagttttactattagttagaaggcaaattccacaattctggagtttcacttgggactttattctgggccttcatctatgctgttaacttgtgattcttgtgga

SEQ ID NO: 21004 - DNA, 299 bp, Homo sapiens
  AC005968.1_34102
  Located on chromosome 14
  Distance between a terminus base of telomere on chromosomal short arm and 5'-terminus of this base sequence : 86536245
  Distance between 3'-terminus of neighbour sequence of sequence listing upward to telomere on chrosomal short arm and 5'-terminus of this base sequence : 315
ttgagttctagccaacctgtactacatacattgagaagttccctcaaggtaaaagctgtacacacacacacacacacacacacacacacacacactttcattttttcagagtcatgttccattttctcattttctggctgttttactttgctcccctgtgccttcaatttatttgtttttcaatattttgtccagatttatgattgttatcagagaaagagtcttgccattactggaaccagaatactttcataatgatttcttaaaaaccatgaaacctatgtaccttaccagctaca

SEQ ID NO: 21005 - DNA, 291 bp, Homo sapiens
  AC005968.1_29931
  Located on chromosome 14
  Distance between a terminus base of telomere on chromosomal short arm and 5'-terminus of this base sequence : 86540426
  Distance between 3'-terminus of neighbour sequence of sequence listing upward to telomere on chrosomal short arm and 5'-terminus of this base sequence : 3882
actggtaaacataaactggtgaacctaattgggtatattttcttccctcatgcacacacacacacacacacacacacacacacacccatgaatatgcactgtatacaggggaaacaatgataatgatatgtaataatgatatgtagagctgcaatggctggattttaagttcagtacaggaacacaacttggaatatacaaaaatgtatttatcccattctcatattgatgaacatttaattttttccagtttccccttttgtaaataacgttctgataatcttcctgtaa

SEQ ID NO: 21006 - DNA, 237 bp, Homo sapiens
  chr14.fa.O7frz.86724081
  Located on chromosome 14
  Distance between a terminus base of telomere on chromosomal short arm and 5'-terminus of this base sequence : 86724417
  Distance between 3'-terminus of neighbour sequence of sequence listing upward to telomere on chrosomal short arm and 5'-terminus of this base sequence : 183700
tttagcttacatcaaaggattaagggatcaaagaattactgtagatatattactagatatatagatgatagaagatgatggaagatagatagatagatagatagatagatagatagatagataaaaatgtgctacaatgttggccattatatcccactatccttctgagaaggacagatatgagaaatttcagcaggcccatgcagtaacacaaaatgtatggacaaacatgagtct

SEQ ID NO: 21007 - DNA, 303 bp, Homo sapiens
  HUMUT1685
  Located on chromosome 14
  Distance between a terminus base of telomere on chromosomal short arm and 5'-terminus of this base sequence : 86907801
  Distance between 3'-terminus of neighbour sequence of sequence listing upward to telomere on chrosomal short arm and 5'-terminus of this base sequence : 183147
gaacagaaaaagggaaacctgcttccatgatgcaatcacctcccaccaggtctcttccacaacacatggggattacaattggaggtgagatttgggtggggacacagagcgaaaccatatcgatagatagatagatagatagatagatagatagatagatagatagatagataaacatttgttaagggaattgattcacatgattatggaggctgagaagtcccttgataactgcctgcaagctggagacctgggaatgtcagtagtgtggctcagttgaagtccaaaagcctcagaaccaaa

SEQ ID NO: 21008 - DNA, 266 bp, Homo sapiens
  HUMUT1731
  Located on chromosome 14
  Distance between a terminus base of telomere on chromosomal short arm and 5'-terminus of this base sequence : 86937839
  Distance between 3'-terminus of neighbour sequence of sequence listing upward to telomere on chrosomal short arm and 5'-terminus of this base sequence : 29735
tccttggactatttccctgtaacctttttttggtggttggttgttacacagcaaagatatagatagatggatagatggatggatggatgggtagatagatagatagatagatagatagataatacatacatacatagagatatatagctatatgaggaggttttccatgaatccaatatttactttctctttgcactgttcttgtcagatatttgagtggaaattgtgatttataagattaggcagggctttggtaggtaggagtg

SEQ ID NO: 21009 - DNA, 225 bp, Homo sapiens
  chr14.fa.O7frz.87064896
  Located on chromosome 14
  Distance between a terminus base of telomere on chromosomal short arm and 5'-terminus of this base sequence : 87065234
  Distance between 3'-terminus of neighbour sequence of sequence listing upward to telomere on chrosomal short arm and 5'-terminus of this base sequence : 127129
agcagcctacgatagaaagtaggttgaactaattccatatagtaaatgcagcaaacgtaaatagatcacgcgcgcgcgcacacacacacacacacacacacacacacacacacacacacagttacaaaggaaatcgcaaaacccagtaaatttgagtgaattcctgcacaggcagccacagtactcacaaaatgccagttgtggatgtgacattgaggtgaccac

SEQ ID NO: 21010 - DNA, 362 bp, Homo sapiens
  D14S610
  Located on chromosome 14
  Distance between a terminus base of telomere on chromosomal short arm and 5'-terminus of this base sequence : 87136081
  Distance between 3'-terminus of neighbour sequence of sequence listing upward to telomere on chrosomal short arm and 5'-terminus of this base sequence : 70622
tccagccacatggaactcggagtccaattaagcctctttcttttgtaaattttcaagtctcgggtatgtctttatcagcagtgtaaaagcagatgaatacagtagggcttctcagcctccataattgcatgagccaattcccctagtaagcctcttatctatctattatccatctatctatctatctatctatctatctatctatctatctatctacctatctatatcgatccatatcccattgacactgtctctctggagagccctgactaatagagagagtaaaaataggaaaggcttggtggagggccagccccatgggatttgtatctgttgagaagtcaggaaggagctcgagttga

SEQ ID NO: 21011 - DNA, 169 bp, Homo sapiens
  D14S1033
  Located on chromosome 14
  Distance between a terminus base of telomere on chromosomal short arm and 5'-terminus of this base sequence : 87220483
  Distance between 3'-terminus of neighbour sequence of sequence listing upward to telomere on chrosomal short arm and 5'-terminus of this base sequence : 84040
catttagaaatactgatacacagcgctaaccacacacacacacacacacacacacacacacacacaccccacacacacacacagagagaactcctactcatccttcaaggcccaacttaaatgctacacctctgagaatgttttctgcttagccagtaccttgtgggag

SEQ ID NO: 21012 - DNA, 197 bp, Homo sapiens
  Z16650.1_105
  Located on chromosome 14
  Distance between a terminus base of telomere on chromosomal short arm and 5'-terminus of this base sequence : 87318171
  Distance between 3'-terminus of neighbour sequence of sequence listing upward to telomere on chrosomal short arm and 5'-terminus of this base sequence : 97519
tacctttcatttaagaatttcgagatgaatctgtagtagtcagagttctaggatgaaggcatctgtagtagtcagggtttgccagagaaaacagaaccaacagggtgtgtgtgtgtgtgtgtgtgtgtgtgtgtgtgtgtgtgtgtgtgtagagagagagagatttactttaagaaattggctcatagaattgtaga

SEQ ID NO: 21013 - DNA, 352 bp, Homo sapiens
  chr14.fa.O7frz.87638056
  Located on chromosome 14
  Distance between a terminus base of telomere on chromosomal short arm and 5'-terminus of this base sequence : 87434907
  Distance between 3'-terminus of neighbour sequence of sequence listing upward to telomere on chrosomal short arm and 5'-terminus of this base sequence : 116539
aatcaagtgctacaagaaacagataaactcaagcaagaattggttagtttgccagccaaagtggaactggaaaaaaaaatacaaagcttcttggggctgaaaaaactcttgggttctatacctcaaatacgaaaagataagatttgcagatcaaaaaaaaagagagagagagagagagagagagatccagccaagtggcaaagataatatcaataaagttgctttgccacccaggctattttagacttcaatgtggattccatgatggcggaatagatggtatgctccaggaagacaaaccttagatcaggtctagaaaagaatttgggggttatttacgagcacatgaaac

SEQ ID NO: 21014 - DNA, 158 bp, Homo sapiens
  D14S68
  Located on chromosome 14
  Distance between a terminus base of telomere on chromosomal short arm and 5'-terminus of this base sequence : 87557858
  Distance between 3'-terminus of neighbour sequence of sequence listing upward to telomere on chrosomal short arm and 5'-terminus of this base sequence : 122599
gagaggtggttttcagtggtcattccctgaggaaaaatgccttcagcccaacctcagtatatacacatgcgcgcgcgcgcgcgcgcacacacacacacacacacacacacacacacacacacacaccactccaccatatacccaccaactatccctga

SEQ ID NO: 21015 - DNA, 261 bp, Homo sapiens
  D14S1058
  Located on chromosome 14
  Distance between a terminus base of telomere on chromosomal short arm and 5'-terminus of this base sequence : 87578275
  Distance between 3'-terminus of neighbour sequence of sequence listing upward to telomere on chrosomal short arm and 5'-terminus of this base sequence : 20259
gcacaactacaatggcccttgacaagtatctgtgctcaactccctcccttgatgtgcagacaaggtaacaagagatctaggcagagaactgatgcacccacaatcacaggctatgactgctggaacacaaatagtcctagttaccttagtaacaggccagagatggcccaacaccaccccaacccgcacacacacacacacacacacacacacacacacacacacacacacacactctatacagccctgccccaaagtgat

SEQ ID NO: 21016 - DNA, 466 bp, Homo sapiens
  chr14.fa.O7frz.88345976
  Located on chromosome 14
  Distance between a terminus base of telomere on chromosomal short arm and 5'-terminus of this base sequence : 87738009
  Distance between 3'-terminus of neighbour sequence of sequence listing upward to telomere on chrosomal short arm and 5'-terminus of this base sequence : 159473
aaggtcaactgtacactgacacacacacacacacacacacacacacacacacacacacacatatatatatatttaattgagacggagtctcactttgtttcccaggctagagtgcagtggcgcatcttagctcactgcaacctctgcctccctggttcaagcaattctcctgcctcagcctcctaagtatctgggattacaggtgcgtgccaccacacccagttaatttttgtatttttagtagagatgaggtctcaccatgttggccaggctggtctcaaactcctgacctcaagtgatctgcccacttcagcttcccaaagtgctgggattacgggtgtgagccacagtgcccagcccactgacatatattttgagtcagcaatgacacaggaaagagagctgggatcacttcttcctcattattttccccatgcatccaggtagaaacgaggaatatacatgc

SEQ ID NO: 21017 - DNA, 248 bp, Homo sapiens
  chr14.fa.O7frz.88257695
  Located on chromosome 14
  Distance between a terminus base of telomere on chromosomal short arm and 5'-terminus of this base sequence : 87826275
  Distance between 3'-terminus of neighbour sequence of sequence listing upward to telomere on chrosomal short arm and 5'-terminus of this base sequence : 87800
atatcctagtgcttgaccaatctgtgctatatgaagacactatttatttatttatttatttatttatttatttatgagacagtctctctctgttgtccaggctggagtgcagtggtgcggtctcagctcactgcaatggaggcactctttaaaaactactcatcatgttgagtaattaaggaatattatacattaattagcaggtagtagaaaacctaaaagatgcctcgatagtttcagttgtcaaa

SEQ ID NO: 21018 - DNA, 253 bp, Homo sapiens
  Z67182
  Located on chromosome 14
  Distance between a terminus base of telomere on chromosomal short arm and 5'-terminus of this base sequence : 87919973
  Distance between 3'-terminus of neighbour sequence of sequence listing upward to telomere on chrosomal short arm and 5'-terminus of this base sequence : 93450
tgcccatgttcaccactgccatttgacattgtactgaaggttctaaccagagcaattaggcaagaaaaataaaagacatttaaagtggaaagaagtagtaaaactatctatgtacagatgacataatcctagacaaagaaaatcctccaaatccaccccccaaccgtgacacacacacacacacacacacacacacacacacacacacccctgccctactcgaggtaatacattcagtgaagtttgcagggta

SEQ ID NO: 21019 - DNA, 134 bp, Homo sapiens
  D14S256
  Located on chromosome 14
  Distance between a terminus base of telomere on chromosomal short arm and 5'-terminus of this base sequence : 88141539
  Distance between 3'-terminus of neighbour sequence of sequence listing upward to telomere on chrosomal short arm and 5'-terminus of this base sequence : 221313
gctgtctaataaaatatatccaacattttaataatggtctaaattgtgtgtttgtgtgtgtgtgtgtgtgtgtgtgtgtgtgtaataggcctctctgtgcacctactaaaaaccaaatgtattctccaaaatgc

SEQ ID NO: 21020 - DNA, 212 bp, Homo sapiens
  D14S1005
  Located on chromosome 14
  Distance between a terminus base of telomere on chromosomal short arm and 5'-terminus of this base sequence : 88308087
  Distance between 3'-terminus of neighbour sequence of sequence listing upward to telomere on chrosomal short arm and 5'-terminus of this base sequence : 166414
aaagttctggccctcgtggagcttattgtcaggtagaagattgacagtgaaggcagatcataaggaaactagtaatttataacctatcatggggtaataaatgccatatcagaatagggaagatagagagtaacgtgtgtgtgtgtgtgtgtgtgtgtgtgtgtgtgtttggtattttagtgggggttagggaagacctccctgataaaggg

SEQ ID NO: 21021 - DNA, 270 bp, Homo sapiens
  HUMUT2084
  Located on chromosome 14
  Distance between a terminus base of telomere on chromosomal short arm and 5'-terminus of this base sequence : 88387005
  Distance between 3'-terminus of neighbour sequence of sequence listing upward to telomere on chrosomal short arm and 5'-terminus of this base sequence : 78706
cctgcagatttttgatttaccagcatttataattgcataagccaaccccttataacaaatctattatctatctatctatctatctatctatctatctatctatctatgtatcatctgtctatccatctttctatctatctatctatctatctatctatctatctatctattatctatctatctatccatctatattatatatcctcttagttctgtgtctctggtacagattttggtaccaggatttggggggctgccctaacaagatgc

SEQ ID NO: 21022 - DNA, 154 bp, Homo sapiens
  chr14.fa.O7frz.88943657
  Located on chromosome 14
  Distance between a terminus base of telomere on chromosomal short arm and 5'-terminus of this base sequence : 88517576
  Distance between 3'-terminus of neighbour sequence of sequence listing upward to telomere on chrosomal short arm and 5'-terminus of this base sequence : 130301
caaaccatagcataacctacacaaagaaaatattcttacccctgtcttagagaggtaagagccagggcttagaaaaaataaataaataaataaataaataaataaataaataaataaataaaaactcacccaaggtctattaacttggaagagc

SEQ ID NO: 21023 - DNA, 200 bp, Homo sapiens
  chr14.fa.O7frz.89027228
  Located on chromosome 14
  Distance between a terminus base of telomere on chromosomal short arm and 5'-terminus of this base sequence : 88601126
  Distance between 3'-terminus of neighbour sequence of sequence listing upward to telomere on chrosomal short arm and 5'-terminus of this base sequence : 83396
gtacaatgagaaggctatgataatataactgccattgcttttgctttccctgaatagtgcatattcaatttgatacaaagagacataggctccatccatccatccatccatccatccatccatccatgcattcatgcatccatccatccatccatccatcattgagaacaaaagatatcgttatgctgttaatgagtatt

SEQ ID NO: 21024 - DNA, 390 bp, Homo sapiens
  AC007263.4_125636
  Located on chromosome 14
  Distance between a terminus base of telomere on chromosomal short arm and 5'-terminus of this base sequence : 88720683
  Distance between 3'-terminus of neighbour sequence of sequence listing upward to telomere on chrosomal short arm and 5'-terminus of this base sequence : 119357
taaattagcaccattacggaatagaaattattaatacattcagggaggtggggggacattttcacttaaagagaaaatgctacttaggcttttgaaatattgatcactagccagagtgctgggaagcattaagagaaccacagcctaaacatactgatttggtttgaaacagctaagtgtgtgcgtgtgtgtgtgtgtgtgtgtgtgtgtgtgtgtgtgtgtgtgtatgtacccacatctttactagcagggaaaacaaagcggcagtaggatacatgagaaaataacagcagagctaccctttggggagagaatataggaatacagagattaaggaggtttatgaggaggaatacacaaaacagcgtttcatcctaagatgacagctac

SEQ ID NO: 21025 - DNA, 214 bp, Homo sapiens
  AC007263.4_116112
  Located on chromosome 14
  Distance between a terminus base of telomere on chromosomal short arm and 5'-terminus of this base sequence : 88730352
  Distance between 3'-terminus of neighbour sequence of sequence listing upward to telomere on chrosomal short arm and 5'-terminus of this base sequence : 9279
tccactgacagataaattaatgaagaaaatgtggtgtgtatatatatatatatatatatatatatatatatatatatatatgtatataaatgtggtatacacacacacacacacacacacaaaggaatattacttgaccttagaaaagaaggaaatcctgccatttttgacagcatggatggacctagaggacatcatgctacatgaaacaagc

SEQ ID NO: 21026 - DNA, 220 bp, Homo sapiens
  AC007263.4_116072
  Located on chromosome 14
  Distance between a terminus base of telomere on chromosomal short arm and 5'-terminus of this base sequence : 88730352
  Distance between 3'-terminus of neighbour sequence of sequence listing upward to telomere on chrosomal short arm and 5'-terminus of this base sequence : -214
tccactgacagataaattaatgaagaaaatgtggtgtgtatatatatatatatatatatatatatatatatatatatatatgtatataaatgtggtatacacacacacacacacacacacaaaggaatattacttgaccttagaaaagaaggaaatcctgccatttttgacagcatggatggacctagaggacatcatgctacatgaaacaagccagaca

SEQ ID NO: 21027 - DNA, 175 bp, Homo sapiens
  Z67617
  Located on chromosome 14
  Distance between a terminus base of telomere on chromosomal short arm and 5'-terminus of this base sequence : 88731454
  Distance between 3'-terminus of neighbour sequence of sequence listing upward to telomere on chrosomal short arm and 5'-terminus of this base sequence : 882
ctgggattacagacctgaaaaagagtagaacttaactattttcatatcacacacacacacacacacacacacacacacacacacacacacacaaatggtaactatatgaggtaatagatatgttaaactgtggtaatcattttacaatgtgtgtatcacaacatcacactgtacg

SEQ ID NO: 21028 - DNA, 294 bp, Homo sapiens
  D14S1066
  Located on chromosome 14
  Distance between a terminus base of telomere on chromosomal short arm and 5'-terminus of this base sequence : 88732348
  Distance between 3'-terminus of neighbour sequence of sequence listing upward to telomere on chrosomal short arm and 5'-terminus of this base sequence : 719
cccaaaatgactgagagtttaagaggaacaaaacaagaggaaaccctcatttgctctaagaagaattcatgggcaagaaagctttataatatggtgaggtttgactctctttttttcttattaaacaaacgtataaataatccctaaaatattgtgtgattctccccaccctacattcgcttttcgattttgtctaaaacagaagtgatccttacacacacacacacacacacacacacacacacacattcataatccttagtcaccccttccccattctcctaacggtgcctc

SEQ ID NO: 21029 - DNA, 192 bp, Homo sapiens
  AC007263.4_35062
  Located on chromosome 14
  Distance between a terminus base of telomere on chromosomal short arm and 5'-terminus of this base sequence : 88812219
  Distance between 3'-terminus of neighbour sequence of sequence listing upward to telomere on chrosomal short arm and 5'-terminus of this base sequence : 79577
caccagatacgcaaatagttattcactggtgacctccttacaacttttctctacacacacacacacacacacacacacacacacacaccctcttttgttttttttatgacttgctgtgttttgttaccctctttattttttaacggagaaaatgcggcaagaaagcttagtttctcgcctagtaaacagaag

SEQ ID NO: 21030 - DNA, 478 bp, Homo sapiens
  chr14.fa.O7frz.89343985
  Located on chromosome 14
  Distance between a terminus base of telomere on chromosomal short arm and 5'-terminus of this base sequence : 88917379
  Distance between 3'-terminus of neighbour sequence of sequence listing upward to telomere on chrosomal short arm and 5'-terminus of this base sequence : 104968
tgactaggaaatctagaactgaattacagaagtctgaaatttaaaaatttcctgaatgggtttaagagaatggtgaggctgggcacggtggctcacacctgtaatcccagcactttgggaggccaaggcaggtggatcatgaggtcaggagacagaccatcctggccaacgtggtgaaaccccgtctctactaaaaatacaaaaattagctggatgtggtggtgcgtgcctgtaatcccagctactagggaggctgaggcaggagaatcgcctgaaccagggagtcagacgttgcagtgagccaagattgcaccactgcactccagcctggcaacagagcaggctccatctaaaaaaaaacaaaagagagagagagaatgatgaatcttcatagatgatagatagagagagagagagagagagagagagacagatagaataaaaagaatagaagagaatcaatgaatttgaaggttct

SEQ ID NO: 21031 - DNA, 261 bp, Homo sapiens
  D14S1044
  Located on chromosome 14
  Distance between a terminus base of telomere on chromosomal short arm and 5'-terminus of this base sequence : 89000490
  Distance between 3'-terminus of neighbour sequence of sequence listing upward to telomere on chrosomal short arm and 5'-terminus of this base sequence : 82633
aagtccttgctttgcaggttgataatgatcctaggaacctgacaaaaacaaatgcaaattctggagaaactcactttcaactccaacccactgataaagaattcccactaatagagtttccaaaaacaaagcaaaacaaaacacacacacacacacacacacacacacacacacgtgcgcgcacacacacgcgcgcgcacacacacagagagagagagagagagaaacaaagcaccatgaacaacaaccagtgaaaacaat

SEQ ID NO: 21032 - DNA, 361 bp, Homo sapiens
  chr14.fa.O7frz.89523069
  Located on chromosome 14
  Distance between a terminus base of telomere on chromosomal short arm and 5'-terminus of this base sequence : 89096772
  Distance between 3'-terminus of neighbour sequence of sequence listing upward to telomere on chrosomal short arm and 5'-terminus of this base sequence : 96021
ggtttagctttctgaatttatcttctaccctccaccatgcaaattaaaggttctgttttgatactgggaaaaaatgatctaagattaagaggacattgtgtatatgtgtgtgtgtgtgtgtgtgtgtgtataaattaattttatatgatcacttgtccaaacacaatcacgttttcaaactaaaaagtgtgtcaaagtggttttagaagaaattaaatagtctggcaagatgaagaataaaaaagttccaagtgaatgatcctttggagtggaaaaaggttagctgtgaatatgcttttgaaatatactacaggggattctcatcccaagattatggtcgttcatgcctctaggtttaagt

SEQ ID NO: 21033 - DNA, 434 bp, Homo sapiens
  chr14.fa.O7frz.89622945
  Located on chromosome 14
  Distance between a terminus base of telomere on chromosomal short arm and 5'-terminus of this base sequence : 89196427
  Distance between 3'-terminus of neighbour sequence of sequence listing upward to telomere on chrosomal short arm and 5'-terminus of this base sequence : 99294
agaaactatcacctcattgttttaccgagtctaaaaacgcttgtggctgggcgtggtggctcatgcttgtaatcccagcactttgggaggcccaggcgggtggatcacctgaggtcaggagttcgagactagcctggccaatgtggtgaaacccaatctctactaaaaatacaataattagccaggcatggtggcaggtgcctgtaatcccagctacttgggaggctgaggcagaagaattgcttgaacccgggaggcagaggttgcagtgagccaagatcgggccactgcactccagcctgggcgaaaagagcaaaactcaatctcgtaaacaaacaaacaaacaaacaaacaaacaaacaaacgcacgcctgagaaacaccttagacccatcattcagggacccgtaagtaagtcgattacagtttccatgc

SEQ ID NO: 21034 - DNA, 468 bp, Homo sapiens
  chr14.fa.O7frz.89741942
  Located on chromosome 14
  Distance between a terminus base of telomere on chromosomal short arm and 5'-terminus of this base sequence : 89315355
  Distance between 3'-terminus of neighbour sequence of sequence listing upward to telomere on chrosomal short arm and 5'-terminus of this base sequence : 118494
gaactctgagttctgcagaagagggcagccacaggtacaggaggggtcagtggcaggcatgtcaactacgtgccatccctataacagggaactgaagccagctgagttacatttctcctggatagcaataggggtattgtctgacctgagtgacaggcataccagatctctgcatgaaatggaaggcattctggaatgacacaggaccagggtgggggaactgagtacagaagacagattctggtagcccaaacactttggtcacatagagatcagtttctgcctgtactgtgacatggtcccattctgggatcaaggccggcaccaggggatctaagcaagaggatccaggaaggtggatagcagagtttagagatttctcagacatcacacttgatgagagagagagagagagacagagagagagagagagagagagaaacactaattcactgtggaatgtatgat

SEQ ID NO: 21035 - DNA, 470 bp, Homo sapiens
  chr14.fa.O7frz.89821180
  Located on chromosome 14
  Distance between a terminus base of telomere on chromosomal short arm and 5'-terminus of this base sequence : 89394889
  Distance between 3'-terminus of neighbour sequence of sequence listing upward to telomere on chrosomal short arm and 5'-terminus of this base sequence : 79066
agctaacatgtagttcttaaccagcagttccaggcacagttccaagcacattatatatatatatatatatatatatatatatatatatatatatatatatatgtatgtatgtatgtatgtatatgtatatgtatatatatgtatatattaattcatgtaattcttatagccgttctacagtgtatccattaatccccttttcagatggaagaactgaagcacagaggttaaacaatgtgcccaagaatccagagtccccaccctcaaacactgtcctgtagggtgtgagtgctcgggttggggagggaggctgctccttaaggaagaaggtcagggaaggccttctgacgtggtgacattcatgcagagacctgaaagaagtaggggaagagccatgtggatgggttgctgagggacgcggggtggggagtgggaatatgcttactgtgtttgattaacagcaaagtgag

SEQ ID NO: 21036 - DNA, 465 bp, Homo sapiens
  chr14.fa.O7frz.90011634
  Located on chromosome 14
  Distance between a terminus base of telomere on chromosomal short arm and 5'-terminus of this base sequence : 89585312
  Distance between 3'-terminus of neighbour sequence of sequence listing upward to telomere on chrosomal short arm and 5'-terminus of this base sequence : 189953
gacttgtatggtttcatatgagaggtcggctgtaactcctttcttgttcctgtgaatgtaatattccttttttctctggctgccttcaagattttgtcttttgttttctgcagtttgaatatagtatgtctagatgggtgtgtgtgtgtgtgtgtgtgtgcatattgtaaaaccaaagtaataattgccacaagcaagatccactgatggatgctaaaattaagggtgtagaagtttaagccaaaagggatatttgcagtctcaaaggatctcgaccaaaatagttggtaattacaaagagaaaaatagtaactttacagtggagaattctggcagatatcaaattaatcaagtgaccagagttaacctcgccattagcacctacccatcatgcaccacctgatttgatgcattgagaaggcccagcatctctgtggagtccttcacaagaacttcaatctaatc

SEQ ID NO: 21037 - DNA, 370 bp, Homo sapiens
  chr14.fa.O7frz.90097537
  Located on chromosome 14
  Distance between a terminus base of telomere on chromosomal short arm and 5'-terminus of this base sequence : 89671223
  Distance between 3'-terminus of neighbour sequence of sequence listing upward to telomere on chrosomal short arm and 5'-terminus of this base sequence : 85446
gataaggacatgtcctaaggacaccgaagcctatgtgaaggggcttccactggccaaactcgggacaatctgagcatcctaacaaacagttactattaatggaatacagtatagccctttaaatagggaactacacacacacacacacacacacacacacacacacacacacacacacacacaccccaatacatatgaattgatctgaaagtttgctgaggaaggggtatttacagattttgagagtctgccacaaaacactgttcagttagaaagggaaagtcacactggagatgcccagcagacaccgtcttcaccaagtggtcaaatgcacatcatcagtaatgggcactttgaaagtacgtgccac

SEQ ID NO: 21038 - DNA, 183 bp, Homo sapiens
  AC006536.2_57153
  Located on chromosome 14
  Distance between a terminus base of telomere on chromosomal short arm and 5'-terminus of this base sequence : 89826969
  Distance between 3'-terminus of neighbour sequence of sequence listing upward to telomere on chrosomal short arm and 5'-terminus of this base sequence : 155376
ggcaataaacgctatggagcaggattttagcactagcatatggggtgtgtgtgtgtgtgtgtgtgtgtgtgtgtgtgtgtgtgtgtgttgtgcgggtggtggtggtgttctgtgggttaaatttagctttccaaagcgaaagattacaaccataacaatagctaccgttcattgagcaactat

SEQ ID NO: 21039 - DNA, 212 bp, Homo sapiens
  chr14.fa.O7frz.90403072
  Located on chromosome 14
  Distance between a terminus base of telomere on chromosomal short arm and 5'-terminus of this base sequence : 89934311
  Distance between 3'-terminus of neighbour sequence of sequence listing upward to telomere on chrosomal short arm and 5'-terminus of this base sequence : 107159
aatcttagttctgccaggtaattccacaatgaccccaggcaggtgtcctgccgtcttagtgtctagcgtctgcgtcctcatctattaatggatggacggatggatggatggatggatggatggatggatggatggatggacggacggacggacgggtggacggatgaatggatggatggatggatggacggatggatgaatgtccttagttg

SEQ ID NO: 21040 - DNA, 238 bp, Homo sapiens
  chr14.fa.O7frz.90506731
  Located on chromosome 14
  Distance between a terminus base of telomere on chromosomal short arm and 5'-terminus of this base sequence : 90037983
  Distance between 3'-terminus of neighbour sequence of sequence listing upward to telomere on chrosomal short arm and 5'-terminus of this base sequence : 103460
taccatgtggtatggctattagtttaataagcctcctcttggatgacaccctaggctatggaagaaggaaccataccctggagtccaatgcctaatgaaagagcttgtgtgtgtgtgcgtgtgtgtgtgtgtgtgtgtgtgtgtgttggagggtgagacacggaatgaagctttataaatattgatgagagacactgaattcaattgcatcaggttgtactttaccgatggttaaagg

SEQ ID NO: 21041 - DNA, 359 bp, Homo sapiens
  chr14.fa.O7frz.90787801
  Located on chromosome 14
  Distance between a terminus base of telomere on chromosomal short arm and 5'-terminus of this base sequence : 90319692
  Distance between 3'-terminus of neighbour sequence of sequence listing upward to telomere on chrosomal short arm and 5'-terminus of this base sequence : 281471
agctagtatgacaagtgacaaaagaagaaagtaatacatgttagtggttgagatacactatagtggcaaagtagtggtagaatctacttgacagacccactcttcactggaacagaccactgtctacataatatgagtcctgggtatatgtcatcccatcccatcagaaagacttctcatgcatgaaatggtaccatcatccatccatccatccatccatccatccatccatccatcctttccatgaatccattcatttattcttgttcactttttgcatgcatgtatatttcagttgctgatttaaccctttttttgaagaatgcaaatagtcctagtaaggcaacatgaactgtcta

SEQ ID NO: 21042 - DNA, 439 bp, Homo sapiens
  chr14.fa.O7frz.91108577
  Located on chromosome 14
  Distance between a terminus base of telomere on chromosomal short arm and 5'-terminus of this base sequence : 90640392
  Distance between 3'-terminus of neighbour sequence of sequence listing upward to telomere on chrosomal short arm and 5'-terminus of this base sequence : 320341
ccatagcatctcacttctagaacccttgtcactgtttcaaaggtcagtcccatctgggcccacgaagtccctgtgagtcaggtgggctggcattgctaagccatttctcagaacctgaagcccagagaggctaatgcagggaggctcaaactcacacagtcagttggggtggatctgaatccagaacccacgtgtctaggcaccaacttgctgcctttgagctttttggatcacaagcaatagcaagaaatacacctgacatcgcgacccagaacacagacacacacacacacacacacacacacacacacacacacatctgtacaaagcaacaaacttccccaaagcaatacttaccctacttcttgccacgcactctgatcatttctattctatttcaattttttaaatgcaggtcatgagctatgaagttgattta

SEQ ID NO: 21043 - DNA, 471 bp, Homo sapiens
  chr14.fa.O7frz.91286331
  Located on chromosome 14
  Distance between a terminus base of telomere on chromosomal short arm and 5'-terminus of this base sequence : 90818036
  Distance between 3'-terminus of neighbour sequence of sequence listing upward to telomere on chrosomal short arm and 5'-terminus of this base sequence : 177205
gagcaggagcttaaattgttactacaacttggggtggggagagggaatggctattttttttttttttcgagactgagtcttgctctgtcacccaggctggagtgcagtggcgcaatcttggctcactgcaacctctgtctcccaggggtcaagctatctcagctcactaccatgccgagctaatttttgtatttttagtagagacaaggtttcgccatgttggccaggcggttctcaaactcctgacctcaggtgatctgcccgcctcggcctcacaaagtgctgagattacaggtgtgagccactatggctggccacaaaatactatattctatgatagttttatattctgtcacagatctgacattttggaacgttcttttatttactttatttatttatttatttatttatttttgagacagagtctcgctctgttgcccaggctagaagtgtaatggctgagcaatc

SEQ ID NO: 21044 - DNA, 191 bp, Homo sapiens
  Z66580
  Located on chromosome 14
  Distance between a terminus base of telomere on chromosomal short arm and 5'-terminus of this base sequence : 90933786
  Distance between 3'-terminus of neighbour sequence of sequence listing upward to telomere on chrosomal short arm and 5'-terminus of this base sequence : 115279
agttccattgcagggctctctctgtctgtctctctctctctctctctctcacacacacacacacacacacacacacactcacttacactaggacaatgtatttatttgttgtagagatagggtcttgctctgttgctcaggctggagttcagtggtgcaatcatggctcaccgaatcctcaaactcctggg

SEQ ID NO: 21045 - DNA, 227 bp, Homo sapiens
  chr14.fa.O7frz.91476393
  Located on chromosome 14
  Distance between a terminus base of telomere on chromosomal short arm and 5'-terminus of this base sequence : 91008376
  Distance between 3'-terminus of neighbour sequence of sequence listing upward to telomere on chrosomal short arm and 5'-terminus of this base sequence : 74399
ataaataccactgttacatccaactcatatcgttgaggcttccccattcactgatgagcacctgaatatttggtttgatgatataaataaaataactttgattgtttactgttttctttctttctttctttctttctttctttctttctttctttctttctttcttcctttttttaagagatgagatcgcgctctgtcacccaggctggagtacagtggcactatta

SEQ ID NO: 21046 - DNA, 233 bp, Homo sapiens
  D14S280
  Located on chromosome 14
  Distance between a terminus base of telomere on chromosomal short arm and 5'-terminus of this base sequence : 91113025
  Distance between 3'-terminus of neighbour sequence of sequence listing upward to telomere on chrosomal short arm and 5'-terminus of this base sequence : 104422
gggcaacagagcagatttcgtctcaaaaaaatccaaacaaataaacaaacaaacaaacaaaaaaccacacaattaaatgccactacacttttttttagaatggctaaaaatttaaaaaatatgtctatacatacttatatgcatacatatttacaagcatacacacacacacacacacacacacacacacacacacagacacacacacatacactaagttctggcctggatgc

SEQ ID NO: 21047 - DNA, 141 bp, Homo sapiens
  D14S617
  Located on chromosome 14
  Distance between a terminus base of telomere on chromosomal short arm and 5'-terminus of this base sequence : 91132918
  Distance between 3'-terminus of neighbour sequence of sequence listing upward to telomere on chrosomal short arm and 5'-terminus of this base sequence : 19660
ccagtttaggcaacagaacaagatctgtctcaaaaagaaagaaagaaagaaaaagaaaggaaggaaggaaggaaggaaggaaggcaggcaggcaggcttatgtaggcaggcttatgtaagatagatggtggccacctaaaa

SEQ ID NO: 21048 - DNA, 156 bp, Homo sapiens
  AC007057.3_92867
  Located on chromosome 14
  Distance between a terminus base of telomere on chromosomal short arm and 5'-terminus of this base sequence : 91342950
  Distance between 3'-terminus of neighbour sequence of sequence listing upward to telomere on chrosomal short arm and 5'-terminus of this base sequence : 209891
ggatgacattgttacagcttagttttcagcacacacacacacacacacaccccacagacacatacatacgcacacaaggttaatttgttcaaagcagtatgttttcaagagctcgctgaataaagactgtgggtgtcatttaggtaaagttctcca

SEQ ID NO: 21049 - DNA, 287 bp, Homo sapiens
  AJ000501.1_436
  Located on chromosome 14
  Distance between a terminus base of telomere on chromosomal short arm and 5'-terminus of this base sequence : 91467341
  Distance between 3'-terminus of neighbour sequence of sequence listing upward to telomere on chrosomal short arm and 5'-terminus of this base sequence : 124235
tatgtcagataaagtgtgaaggtagcgaacatgatgaatggtgagcaggccttacctagatcactcccaagtgctcctgaactggtggctggcctttcacatggatgtgaactctgtcctgataggtccccctgctgctgctgctgctgctgctgttgctgcttttgctgctgtctgaaacattcaaaagtgaagtatatttaaaaaacaaaacttaaaagaataaatacaccatgagaaaaactattcataaggaaaatacattgtttcacgaatcaaagtagtca

SEQ ID NO: 21050 - DNA, 264 bp, Homo sapiens
  D14S1015
  Located on chromosome 14
  Distance between a terminus base of telomere on chromosomal short arm and 5'-terminus of this base sequence : 91667028
  Distance between 3'-terminus of neighbour sequence of sequence listing upward to telomere on chrosomal short arm and 5'-terminus of this base sequence : 199400
gaatgccattattttgtccttttttatggctgactagtattccattacacacacacacacacacacacacacacacacacacacacacacacacacgtatctcccatggaatatatggaatgtatatcctacccagtaatgggatttctgaatcaaatagtagttctactttcaattttttctgtagtttaaatatgatgtacctaggtgttttttgttttgtgtttgtttgtttgtgtacttattctgctcggtgttttctaa

SEQ ID NO: 21051 - DNA, 208 bp, Homo sapiens
  D14S1016
  Located on chromosome 14
  Distance between a terminus base of telomere on chromosomal short arm and 5'-terminus of this base sequence : 91845453
  Distance between 3'-terminus of neighbour sequence of sequence listing upward to telomere on chrosomal short arm and 5'-terminus of this base sequence : 178161
caaatggtttgggaaccgtgctgatggttgtagaacaatgtgaatgtaattaatgccactgttttgtgcccttaaaaagggaaagtagttagaatggttaatgttatgacatatatttttttcccactacatacacacacacacacacacacacacacacacacacaaatccctactcatgagctgagccatgttcaggttcatcttc

SEQ ID NO: 21052 - DNA, 137 bp, Homo sapiens
  D14S1050
  Located on chromosome 14
  Distance between a terminus base of telomere on chromosomal short arm and 5'-terminus of this base sequence : 91846445
  Distance between 3'-terminus of neighbour sequence of sequence listing upward to telomere on chrosomal short arm and 5'-terminus of this base sequence : 784
gctggggcaaggtaaggctgagcagacaggagtgggcagaaatgtgtcctggaagccactctctcctcttttgtgtacacacacacacacacacacacacacacacacacacacacaccctctcacaatgtcccccc

SEQ ID NO: 21053 - DNA, 150 bp, Homo sapiens
  D14S973
  Located on chromosome 14
  Distance between a terminus base of telomere on chromosomal short arm and 5'-terminus of this base sequence : 91915988
  Distance between 3'-terminus of neighbour sequence of sequence listing upward to telomere on chrosomal short arm and 5'-terminus of this base sequence : 69406
ggtctctggaccactgagaaactgggaaaataagggtggcctgtgtgtgtgtgtgtgtgtgtgtgtgtgtgtgtgtgtcagcatcagtgtcagccatggctgccaacgtgtcttttcttaggcagaactgtcctttgctggtttggaaga

SEQ ID NO: 21054 - DNA, 312 bp, Homo sapiens
  M14_91918482
  Located on chromosome 14
  Distance between a terminus base of telomere on chromosomal short arm and 5'-terminus of this base sequence : 91918263
  Distance between 3'-terminus of neighbour sequence of sequence listing upward to telomere on chrosomal short arm and 5'-terminus of this base sequence : 2125
cttctcgcaatggatatcttctcatttatcttcacccatcctcctaatcatcatccagacatccacctgtccattctattcaccatccatccatctagccatctacttatccacccatccatccatacatccacccatcaacccacccttcatccatccatccacctatccacccatcgacctatccaccctcccacgcttctatccatccatttatctatccatccatgcatccatccatccatccactcacctacccttccatccttccatctatcaatccatctatttactgagcacctgaacacctag

SEQ ID NO: 21055 - DNA, 469 bp, Homo sapiens
  chr14.fa.O7frz.92561123
  Located on chromosome 14
  Distance between a terminus base of telomere on chromosomal short arm and 5'-terminus of this base sequence : 92299623
  Distance between 3'-terminus of neighbour sequence of sequence listing upward to telomere on chrosomal short arm and 5'-terminus of this base sequence : 381048
caaccactagtctctgttactcacaccaggctagaacagactgcgcaggcaaggaacacaagacctcctggtcggctgaatgtgaccctgaaatcacaagccctggcagggaggggagacacttgccttaggggcaaaatgtagggggatgcccaagaaactcaaccacaaagataaattatatatatatgtgtgtgcatgtgtgtgtgtgtgtgtgtgtgtgtgtgtatacacataatttttaaaatgattcagtggttttcagtatatttgcaaggtcatacaactaaaactactccaattccaaatcatttttatcaccccaaaaagaaactcggtacccattagcaatcactccccattctcttttctgcccagctccaggcaaccactcatctgctttctgtttgtgggtttgcttattctggacgttgcatatagatggaatcctatgtcctatcatacgtac

SEQ ID NO: 21056 - DNA, 120 bp, Homo sapiens
  D14S977
  Located on chromosome 14
  Distance between a terminus base of telomere on chromosomal short arm and 5'-terminus of this base sequence : 92330172
  Distance between 3'-terminus of neighbour sequence of sequence listing upward to telomere on chrosomal short arm and 5'-terminus of this base sequence : 30080
ggtggtggtccatgagtccctctttctctccatgcactccctgacctgtgtgtgtgtgtgtgtgtgtgtgtgtgtgtgtgtgtgtgtgtggcctccagatgtgctgcgtacaccccagat

SEQ ID NO: 21057 - DNA, 155 bp, Homo sapiens
  DISO7_10003969
  Located on chromosome 14
  Distance between a terminus base of telomere on chromosomal short arm and 5'-terminus of this base sequence : 92392857
  Distance between 3'-terminus of neighbour sequence of sequence listing upward to telomere on chrosomal short arm and 5'-terminus of this base sequence : 62565
aggaagaaattcctgactgctcttaatatagttattttccaaaagggagacactgaatttataggtgatatgtataatgatcatgtgtgtgtgtgtgtgtgtgtgtgtgtgtgtgtgtgtgtgtgtgtgtgttgataaatagacggcttattgca

SEQ ID NO: 21058 - DNA, 251 bp, Homo sapiens
  HUMUT7780
  Located on chromosome 14
  Distance between a terminus base of telomere on chromosomal short arm and 5'-terminus of this base sequence : 92523182
  Distance between 3'-terminus of neighbour sequence of sequence listing upward to telomere on chrosomal short arm and 5'-terminus of this base sequence : 130170
ggataagggggcactgctgtaattagttacacaataatagatgactaatactaacaggatatatccagagaaactggcatagcttgagcactgtaagggtctggatgattctggaaatagaatagatacatagatagatgatagatagatagatagatagatagatagatagatagatagatagatagatagtctctttctgtcattcaggctgaagtgcagtggtgcaatcataggtcactgcagcctcg

SEQ ID NO: 21059 - DNA, 185 bp, Homo sapiens
  G09042
  Located on chromosome 14
  Distance between a terminus base of telomere on chromosomal short arm and 5'-terminus of this base sequence : 92523245
  Distance between 3'-terminus of neighbour sequence of sequence listing upward to telomere on chrosomal short arm and 5'-terminus of this base sequence : -188
tccagagaaactggcatagcttgagcactgtaagggtctggatgattctggaaatagaatagatacatagatagatgatagatagatagatagatagatagatagatagatagatagatagatagatagtctctttctgtcattcaggctgaagtgcagtggtgcaatcataggtcactgcagcc

SEQ ID NO: 21060 - DNA, 102 bp, Homo sapiens
  DISD22_0009322
  Located on chromosome 14
  Distance between a terminus base of telomere on chromosomal short arm and 5'-terminus of this base sequence : 92873020
  Distance between 3'-terminus of neighbour sequence of sequence listing upward to telomere on chrosomal short arm and 5'-terminus of this base sequence : 349590
gacagactactgcaacggcacctcattttacaagaaccctagattaaaacacacacacacacacacacacacaccccaaaagttcacagcacacgtgtctca

SEQ ID NO: 21061 - DNA, 318 bp, Homo sapiens
  chr14.fa.O7frz.93293170
  Located on chromosome 14
  Distance between a terminus base of telomere on chromosomal short arm and 5'-terminus of this base sequence : 93140162
  Distance between 3'-terminus of neighbour sequence of sequence listing upward to telomere on chrosomal short arm and 5'-terminus of this base sequence : 267040
ttagcttagtggtcagctaattattggatgaagactttcttgattgcctagaaccaataaatctcccagtctttgcaaagggcatgtgtgtgtatgtgtgtgtgtgtgtgtgtgtgtgtgtgtgttgtggcatgctttcaactctcagccaagcaactgacagctctgtcttggccctcactttctgcttatgcaattcctcaagccagatgtgagagcttagggccttctcagattttcttatcatgttgtcagtcaccactgagtatgggcacaggcatatatatgtgtgtggtcatctaggttcctaggaatatt

SEQ ID NO: 21062 - DNA, 219 bp, Homo sapiens
  Z67707
  Located on chromosome 14
  Distance between a terminus base of telomere on chromosomal short arm and 5'-terminus of this base sequence : 93342754
  Distance between 3'-terminus of neighbour sequence of sequence listing upward to telomere on chrosomal short arm and 5'-terminus of this base sequence : 202274
ccaccttttcagagtcacatagctagttatctgcagaggaaattcagcactgatttataatacagtccacatacttaagtgtgtgtgtgtgtgtgtgtgtgtgtgtgtgtatgtgtgcatacactgtctcccaatccagtgtaaacttcttcctgcattttaagaccaagaagcaagggcaagcttgcacgacctgaaagactgaagggttatgctgcc

SEQ ID NO: 21063 - DNA, 171 bp, Homo sapiens
  Z66584
  Located on chromosome 14
  Distance between a terminus base of telomere on chromosomal short arm and 5'-terminus of this base sequence : 93406284
  Distance between 3'-terminus of neighbour sequence of sequence listing upward to telomere on chrosomal short arm and 5'-terminus of this base sequence : 63311
ttgcttccatatagttaaaaatgagtaattctactgaggtctaataaataccatggtaaggaaacactttaaacacacacacacacacacacacacacaaacacacatacaatgtctaaaatatgcacatatgcagattcagagaactgagggtcatgtggttagaacaga

SEQ ID NO: 21064 - DNA, 287 bp, Homo sapiens
  HUMUT5824
  Located on chromosome 14
  Distance between a terminus base of telomere on chromosomal short arm and 5'-terminus of this base sequence : 93613489
  Distance between 3'-terminus of neighbour sequence of sequence listing upward to telomere on chrosomal short arm and 5'-terminus of this base sequence : 207034
agctatgtttgtgccatggcactccagcctgtgtgacagagtaagacccctcttaaaaagaaagaaagatgaaagacagaaaggagggagagagaaagaaagaaagaaagaaagaaagaaagaaagaaagaaagaaagaaagaaagaagaaagaaagaggggaaggaaggaaggaaagaaggaaggaaagaaggaaggaaggaagggaagattcctttctaaattgataactttgtgatttttcagttgacactagaaaagccttttcactcccttgtggctttgta

SEQ ID NO: 21065 - DNA, 143 bp, Homo sapiens
  D14S1062
  Located on chromosome 14
  Distance between a terminus base of telomere on chromosomal short arm and 5'-terminus of this base sequence : 93614748
  Distance between 3'-terminus of neighbour sequence of sequence listing upward to telomere on chrosomal short arm and 5'-terminus of this base sequence : 972
ggaagcatcacctgatctctgccttcactgtcacatggctgtgtgtgtgtgtgtgtgtgtgtgtgtgtgtgtccaaaagtcctctttttaaaaggacatcagttatactgaattaaaggcccactctattccaataagacctc

SEQ ID NO: 21066 - DNA, 369 bp, Homo sapiens
  G09066
  Located on chromosome 14
  Distance between a terminus base of telomere on chromosomal short arm and 5'-terminus of this base sequence : 93656809
  Distance between 3'-terminus of neighbour sequence of sequence listing upward to telomere on chrosomal short arm and 5'-terminus of this base sequence : 41918
gcaatgtgaaaataccctgggaacagatagatctcttctgtgtcctcccaaggcctctggagttcctaggatagtcatcttataaagtggttggtgggaaataagccatgaaaacaatagaaacgtgataggtaggtaagtagatagacaaggggattggatggatggatggatgaatagatgatagatagatagatagatagatagatagatagatagatagatagatagaacacagataggaagggagggggccagactgggagttggcaaggataatgccccacagtcctgcctagctggacaggaccagggccagctaggagcagggaatggaccgagatgaggcagagctgccactgtcagaac

SEQ ID NO: 21067 - DNA, 173 bp, Homo sapiens
  G09072
  Located on chromosome 14
  Distance between a terminus base of telomere on chromosomal short arm and 5'-terminus of this base sequence : 93656890
  Distance between 3'-terminus of neighbour sequence of sequence listing upward to telomere on chrosomal short arm and 5'-terminus of this base sequence : -288
ataaagtggttggtgggaaataagccatgaaaacaatagaaacgtgataggtaggtaagtagatagacaaggggattggatggatggatggatgaatagatgatagatagatagatagatagatagatagatagatagatagatagatagaacacagataggaagggaggggg

SEQ ID NO: 21068 - DNA, 361 bp, Homo sapiens
  HUMUT2133
  Located on chromosome 14
  Distance between a terminus base of telomere on chromosomal short arm and 5'-terminus of this base sequence : 93656897
  Distance between 3'-terminus of neighbour sequence of sequence listing upward to telomere on chrosomal short arm and 5'-terminus of this base sequence : -166
ggttggtgggaaataagccatgaaaacaatagaaacgtgataggtaggtaagtagatagacaaggggattggatggatggatggatgaatagatgatagatagatagatagatagatagatagatagatagatagatagatagaacacagataggaagggagggggccagactgggagttggcaaggataatgccccacagtcctgcctagctggacaggaccagggccagctaggagcagggaatggaccgagatgaggcagagctgccactgtcagaaccaaaggcccagaggctgctctgtgcaggggcttcatcatcccccaaatacagggtttgaatgtacagctaacttccccag

SEQ ID NO: 21069 - DNA, 159 bp, Homo sapiens
  DISO7_00000637
  Located on chromosome 14
  Distance between a terminus base of telomere on chromosomal short arm and 5'-terminus of this base sequence : 93728666
  Distance between 3'-terminus of neighbour sequence of sequence listing upward to telomere on chrosomal short arm and 5'-terminus of this base sequence : 71408
gaaagaacagccatagtgaccatgtgcaggttggggtcctcctttaagcaggaaaggggagccctaggcaggtctcagccctgcttgtagctggtgcattcagacacacacacacacacacacacacacacacacacagatggtgcttagctgacagca

SEQ ID NO: 21070 - DNA, 220 bp, Homo sapiens
  chr14.fa.O7frz.94025282
  Located on chromosome 14
  Distance between a terminus base of telomere on chromosomal short arm and 5'-terminus of this base sequence : 93872311
  Distance between 3'-terminus of neighbour sequence of sequence listing upward to telomere on chrosomal short arm and 5'-terminus of this base sequence : 143486
tgaagcaaagatgtcatagaaggaccagccatggccctggtttgtctctaacttgctgtgtgatgctgaggaagtcaatacccttcattggtctcaaatttgtgtgtgtgtgtgtgtgtgtgtgtgtgtgtccacgcataaatgtgaaataagccacgtggagtttagctgcaaatcctctttcaaacgatcttcctcctatgcttattcgacataagga

SEQ ID NO: 21071 - DNA, 114 bp, Homo sapiens
  chr14.fa.O7frz.94153980
  Located on chromosome 14
  Distance between a terminus base of telomere on chromosomal short arm and 5'-terminus of this base sequence : 94001052
  Distance between 3'-terminus of neighbour sequence of sequence listing upward to telomere on chrosomal short arm and 5'-terminus of this base sequence : 128521
tctttcattaactggtataaccagaaatacgtagagttgcacatgcatttaaatctacacacacacacacacacacacacacacacacacttgtttctaccagacagttccttc

SEQ ID NO: 21072 - DNA, 282 bp, Homo sapiens
  chr14.fa.O7frz.94374211
  Located on chromosome 14
  Distance between a terminus base of telomere on chromosomal short arm and 5'-terminus of this base sequence : 94221291
  Distance between 3'-terminus of neighbour sequence of sequence listing upward to telomere on chrosomal short arm and 5'-terminus of this base sequence : 220125
agtccaaagctaagtactaagctctgcatgcataaagtgaaattccacatggctggtccacacacacacacacacacacacacacacacacacacacacacacacacgaaaaaataaacctactgtgaaggtataagcaaaataatttccagagttcacaaagcataggatatattaaggttatgcacccaaagtggagagacctggaacattcagtagagacccagaagtgtcacatcttggcattagggctaaactaactttgaattaaagctgcactag

SEQ ID NO: 21073 - DNA, 309 bp, Homo sapiens
  X73288.1_81
  Located on chromosome 14
  Distance between a terminus base of telomere on chromosomal short arm and 5'-terminus of this base sequence : 94320989
  Distance between 3'-terminus of neighbour sequence of sequence listing upward to telomere on chrosomal short arm and 5'-terminus of this base sequence : 99416
ttagatctcaataaacattgatactggagggatgaaatgaaggaaggatggatagaaggctataaggatgggtggatggataaatggatggatggatggatggatggatggatggatggatagatggatggatggaaaaatggatagatggatgggtggatggatgaatggatggatggatggatggatggatggatgaatggatgaatatatgggtggatggatggaaggaaggaaggaaggaaggaaggaaggaaggaaggaaggaaggatggtagaagaaaggtagtaccagtatgctttagctca

SEQ ID NO: 21074 - DNA, 257 bp, Homo sapiens
  Z67731
  Located on chromosome 14
  Distance between a terminus base of telomere on chromosomal short arm and 5'-terminus of this base sequence : 94381950
  Distance between 3'-terminus of neighbour sequence of sequence listing upward to telomere on chrosomal short arm and 5'-terminus of this base sequence : 60652
gttatatcatcatgctacacacacacctacacacacacacacacacacacacacacactcacatgcccactgtgcaccaggagctgtgcatataggcaacaatctggagtggtgctgactcaccctgcctccatggcctcaagcatgctcttgcctctgctgaaacccccaaacccctttcctgcctctcccctgctccatcttccagtttcagttcaggtgccacctcctccaggaaaccttccaggaacttctac

SEQ ID NO: 21075 - DNA, 168 bp, Homo sapiens
  D14S1054
  Located on chromosome 14
  Distance between a terminus base of telomere on chromosomal short arm and 5'-terminus of this base sequence : 94573761
  Distance between 3'-terminus of neighbour sequence of sequence listing upward to telomere on chrosomal short arm and 5'-terminus of this base sequence : 191554
acagtcacgtgggccagtttcttgaaataaatctcatcacacacacacacacacacacacacacacacacacacacacacacacacacacaccctgttggctctgtttctctggagagccctgactgatacaagccttctattttattcagaataaatgcccaggtcc

SEQ ID NO: 21076 - DNA, 435 bp, Homo sapiens
  chr14.fa.O7frz.94809418
  Located on chromosome 14
  Distance between a terminus base of telomere on chromosomal short arm and 5'-terminus of this base sequence : 94655067
  Distance between 3'-terminus of neighbour sequence of sequence listing upward to telomere on chrosomal short arm and 5'-terminus of this base sequence : 81138
tctaaggaacctactgaaggatgtgctccaccgaaacaaaggagtaagtaataaaagaggaaggcatgtgtcttaatctgctcaggctaccatgttaaaatactataaactggatggtttaaacaataactgtatttctcacagttttggaggctggaaaatccaagatcaaggcatctgctaatttggtgtctagtgagggctttcttcctgactggcagacagtcaacttctcactgtgtgctcatatgatgtttctttgatatgtgcacatggaaaagaggagagagaggaagagggagagagagagagagagagagaaagagaaagagtgagagagaaagagaaagagagagagagagagagagatcgagagagagatctcactctttttataaggccaccaatcctgtaggattagaacctcatccttat

SEQ ID NO: 21077 - DNA, 435 bp, Homo sapiens
  chr14.fa.O7frz.95489126
  Located on chromosome 14
  Distance between a terminus base of telomere on chromosomal short arm and 5'-terminus of this base sequence : 94711000
  Distance between 3'-terminus of neighbour sequence of sequence listing upward to telomere on chrosomal short arm and 5'-terminus of this base sequence : 55498
tgttcagtctaagctttcagagatttatccatccattcattcatccatccatccatccatccatccatccatccatccatccatccacccatgcatgcgtttttcaatccatctatccaccactcaccaaaaccctggatctctgcctggctcctgggtcaccaaggccagatttatcattagaggttggctcacacaattatggaaactgagaagtcccatgatctgacatctgcaagctggagacgcaggaacgctgatggtgtggttccagtccaagcccaaaaacctgagaaccaggagagccaatggtgtaagccccagtctgagtccaaacacctgaaaaccaggaactcaatgagaaaggaaatttctccttcctctacctttctgttctactcaggccctcagtggattggatgaggactatgaaat

SEQ ID NO: 21078 - DNA, 311 bp, Homo sapiens
  chr14.fa.O7frz.95418486
  Located on chromosome 14
  Distance between a terminus base of telomere on chromosomal short arm and 5'-terminus of this base sequence : 94781525
  Distance between 3'-terminus of neighbour sequence of sequence listing upward to telomere on chrosomal short arm and 5'-terminus of this base sequence : 70090
catctgtagttggcaaggtggagacccaggaaagtggtgatgtccatggagtccaaggccaaaggcctgagaactgagggtggggagcactgaggtaagtcccgaagtccgaaggccaaagagccaggagttgtctgagggcgggagaagatagatatcacagctgaagatgagagagagagagagagagagagagagagagagaaaggattggctcttcctccatctttttgttctatctggccctcaatggatcagggatgcccaccacattggcgagggcagatcttccttattctaaggattcaaat

SEQ ID NO: 21079 - DNA, 411 bp, Homo sapiens
  chr14.fa.O7frz.95240867
  Located on chromosome 14
  Distance between a terminus base of telomere on chromosomal short arm and 5'-terminus of this base sequence : 94959326
  Distance between 3'-terminus of neighbour sequence of sequence listing upward to telomere on chrosomal short arm and 5'-terminus of this base sequence : 177490
aagaaatgatcttacctggaagaagaggattatgttccatatcagcccaagaaccaaagaagggttgccatctgctatttctgctgcatcaatgctaaccagttttacctggagggaagcaatttatgaacttaaagcgaggtgtccagggaggataacatatgttattttctggttctctctctctctctgtgtgtgtgtgtgtgtgtgtgtgtgtgtgtgtgtgtgtttgcatgagcctgtttttcttacttaccctgccattctcagggacactcagcatgcaaaagtgtatttaattaacacatacacagcacttaccatatgcagcctctattctaaacttcttacaaatattaactcagtttattctcacaataaacctatgatgtaggtgtattagtccgttct

SEQ ID NO: 21080 - DNA, 159 bp, Homo sapiens
  chr14.fa.O7frz.95111477
  Located on chromosome 14
  Distance between a terminus base of telomere on chromosomal short arm and 5'-terminus of this base sequence : 95090793
  Distance between 3'-terminus of neighbour sequence of sequence listing upward to telomere on chrosomal short arm and 5'-terminus of this base sequence : 131056
ttcaattatccttgcagaataggggcacactagggctatggaaatgcataagccatggtttgaagtcgtgtgtgtgtgtgtgtgtgtgtgtgtgtggggcggggggtgagggggtatgacagcagcaggttgaagaccttgcagtgagtaggattagtg

SEQ ID NO: 21081 - DNA, 218 bp, Homo sapiens
  Z67463
  Located on chromosome 14
  Distance between a terminus base of telomere on chromosomal short arm and 5'-terminus of this base sequence : 95152647
  Distance between 3'-terminus of neighbour sequence of sequence listing upward to telomere on chrosomal short arm and 5'-terminus of this base sequence : 61695
atgacaagagtagatatggtccctctgcgtattgtttacataatagaatatttaaaacaatggaatgtgtttgtctttgacatcaaaaatcatttatgcagcatctacatgcacatatacacacacaagtgtgaacgcatacacaaacacacacacacagacacacacacacacacacacacaccccatgccattgcttggtccacactgcatgaaac

SEQ ID NO: 21082 - DNA, 242 bp, Homo sapiens
  D14S996
  Located on chromosome 14
  Distance between a terminus base of telomere on chromosomal short arm and 5'-terminus of this base sequence : 95262815
  Distance between 3'-terminus of neighbour sequence of sequence listing upward to telomere on chrosomal short arm and 5'-terminus of this base sequence : 109950
caaatccagggcttccgggatgctgttttccttttttgtttcttagcagggatggcagatgtttgtagaacagatccgtgtaaaagtcagtatcctaagagattaaattgtaaagcaggacaagatagttaacggtgtgtgtgtgtgtgtgtgtgtgtgtgtgtgtgtgtgtatgtcttttccaaattgagagggaggtagaagaattagccaaaacccaggattcactctgaggtagaccc

SEQ ID NO: 21083 - DNA, 118 bp, Homo sapiens
  D14S62
  Located on chromosome 14
  Distance between a terminus base of telomere on chromosomal short arm and 5'-terminus of this base sequence : 95268285
  Distance between 3'-terminus of neighbour sequence of sequence listing upward to telomere on chrosomal short arm and 5'-terminus of this base sequence : 5228
caaaccagcaccactgttagtaacgtaacaggtgagaagtctgtgtgtgatgtatctgctggggtgtgtgtgtgtgtgtgtgtgtaaacagcaaggctgaagcctccagttgtgtgat

SEQ ID NO: 21084 - DNA, 451 bp, Homo sapiens
  chr14.fa.O7frz.96039343
  Located on chromosome 14
  Distance between a terminus base of telomere on chromosomal short arm and 5'-terminus of this base sequence : 95377994
  Distance between 3'-terminus of neighbour sequence of sequence listing upward to telomere on chrosomal short arm and 5'-terminus of this base sequence : 109591
agcttgcagatgaaacaaggaggtggcttcatccactgggtcagggtgtggcaggatagggtctggataggctttgaaagctttctggggcacaattcaatgcagaggaagccatgggaggcagggaggctgcagtccaggtgagggtgatgaggctgctggtgctggctcagttactgcagggctgagccaggggaccttggcagagtccccagggcaaagcttgtctccagaaatctcctcacagtgtgtgtgtgtgtgtgtgtgtgtgtgtgtgtgtgtgtgtgtgtgtgtgttgggggatggggattagagtaggatctctgcattgcatgtgctggaaggcactgctagagggaatggccaggaccagggaggatcattgctgggatgagtcttctttccttttaatccttgggatgacactgatgaataactcaccttgacgttg

SEQ ID NO: 21085 - DNA, 255 bp, Homo sapiens
  chr14.fa.O7frz.96147996
  Located on chromosome 14
  Distance between a terminus base of telomere on chromosomal short arm and 5'-terminus of this base sequence : 95486756
  Distance between 3'-terminus of neighbour sequence of sequence listing upward to telomere on chrosomal short arm and 5'-terminus of this base sequence : 108311
tcactcaggactctaacattagagtcctctgatgcttgtcttagtccagagaccgaaccgttcatctttgtattctctgaagtgctgagatcagtgccagacccagaagagatggttcagaaacagtaatcatgatagtgtgtgtgtgtgtgtgtgtgcgtgtgtgtgtgtgtgttggagagggtggtatgcacaaggagctaggctgcatgtaatcctctcagcagccctatgagttgcggacaattaatatct

SEQ ID NO: 21086 - DNA, 419 bp, Homo sapiens
  chr14.fa.O7frz.96251634
  Located on chromosome 14
  Distance between a terminus base of telomere on chromosomal short arm and 5'-terminus of this base sequence : 95590398
  Distance between 3'-terminus of neighbour sequence of sequence listing upward to telomere on chrosomal short arm and 5'-terminus of this base sequence : 103387
taggtttagaagcaggtagcttctttccagttcacaaccaacccacgggggaaccaacaggcattcctgagatgctctcaggcatgtggcccaactctctctctctctctctctctctctctctttctctctcacacacacacacacacacacacacacacttctatgatgtactcaagtccttccaaatatgttctcctgtctccatacaatttcccttttcatcttctatcaaatgctacccaagtcccactccagtgccttttccaaggaggagcacttgctctgtccccatcactgtttacatcacctgtgtgaggaggaccccctatgcagggaaagcagggtggatgcctgcacaccttggtcttaagcagattttcctgtatctttggttgacattaacttaaagtcctggc

SEQ ID NO: 21087 - DNA, 278 bp, Homo sapiens
  HUMUT474
  Located on chromosome 14
  Distance between a terminus base of telomere on chromosomal short arm and 5'-terminus of this base sequence : 95674734
  Distance between 3'-terminus of neighbour sequence of sequence listing upward to telomere on chrosomal short arm and 5'-terminus of this base sequence : 83917
tgcgcatgccagaatgaacagtgtagcttctgttggagtggatatgtggttagcttgcctagcccctcagtcagtttccaaagagattcataattctcagaaactgggcagccgccacagtgcggtgtcctgccaacggttaccataactctctccccttcttgccacccgagcctctgtcgtcctgaccaaggttggccatgttctttctttttttccgttttctttctttctttctttctttttttttttcagacagagtctcacactgccatcca

SEQ ID NO: 21088 - DNA, 274 bp, Homo sapiens
  D14S605
  Located on chromosome 14
  Distance between a terminus base of telomere on chromosomal short arm and 5'-terminus of this base sequence : 95712981
  Distance between 3'-terminus of neighbour sequence of sequence listing upward to telomere on chrosomal short arm and 5'-terminus of this base sequence : 37969
ctcccattccattagcattgacttttcctttgctggctctcttctttgactctacattttgctacaaatatctggaagtaagatgttaactattctctctctctctaaagatatatatttactatatctatagatagatagatagatagatagatagatagatagatagatagataccttcttttaaatttttttttaagagatcaggtcttactctgtcacccaggctagaatgcagttgcacaatcatagctcactgcagctttgaattcct

SEQ ID NO: 21089 - DNA, 403 bp, Homo sapiens
  chr14.fa.O7frz.96444700
  Located on chromosome 14
  Distance between a terminus base of telomere on chromosomal short arm and 5'-terminus of this base sequence : 95783526
  Distance between 3'-terminus of neighbour sequence of sequence listing upward to telomere on chrosomal short arm and 5'-terminus of this base sequence : 70271
ctccttagagtacagctggttccctcccagtgagcccccggagggcaaagcctccacgtgtcaccaagtctgtggtgtccaccacacacacacacacacacacacacacatacagagcaatgggcccctgtgggcgtctcttctgttccccttacttgaactgtggcacctgcatgattttcgatactggtttgagctgagagccatggagtacccgctgtgcaacctgagcaccgtgcggtcctcgaagacaccactcacagcctcgtctctattggatgattagccatgttagggctctcatttattgaggacaccgcgtgctatattccctatctcatttaattattcggttctgtattctcttttcacagatgaggaaatctaggctcaaagacactat

SEQ ID NO: 21090 - DNA, 213 bp, Homo sapiens
  chr14.fa.O7frz.96651998
  Located on chromosome 14
  Distance between a terminus base of telomere on chromosomal short arm and 5'-terminus of this base sequence : 95990843
  Distance between 3'-terminus of neighbour sequence of sequence listing upward to telomere on chrosomal short arm and 5'-terminus of this base sequence : 206914
ggattaatgtatgaaagcatctagcacagtgcctggtacatagttggcactgaacatgtactagctttgatgatgatgatgatgatgatgatgatgatgatggtggtggtgttggcagtgagtgtgatgggggcatcctccaagggaaacccttccatagtgtcccacccctcttgcgataaggttctacagctgtaacatggcttgcaagac

SEQ ID NO: 21091 - DNA, 456 bp, Homo sapiens
  chr14.fa.O7frz.96840536
  Located on chromosome 14
  Distance between a terminus base of telomere on chromosomal short arm and 5'-terminus of this base sequence : 96179338
  Distance between 3'-terminus of neighbour sequence of sequence listing upward to telomere on chrosomal short arm and 5'-terminus of this base sequence : 188282
ggtatcgccttgatagtcttagactaaatctggaagaattctctggattaccaggcagactcttgttctcttcccttacatctctccaaatatacagtctctctgtctgtctgtctctctctctctctctctctctctctctctctctgttctaagccacctaaagctgggggtggagtgacacaagcaaccctgtagccaccaccactgtgactgtgctgggtcagacctgaagccagcacagcactgggtcttgcccaaggcctgctgtaaccactccctggttactgcctgtgttcactcagggctctggggctccacaatcagcaggtggcataaccagccaggtctgtttccttcccttcagggtggcaaggtcccccaggctccaggtgggtccagaagtgccatctgggagtcagggactagagtgataaaccttagaagtctacctgg

SEQ ID NO: 21092 - DNA, 218 bp, Homo sapiens
  AB025574.1_375
  Located on chromosome 14
  Distance between a terminus base of telomere on chromosomal short arm and 5'-terminus of this base sequence : 96315235
  Distance between 3'-terminus of neighbour sequence of sequence listing upward to telomere on chrosomal short arm and 5'-terminus of this base sequence : 135441
agacttctggaagtgcaaaataacaaagttatttctggggagtaaggtgatctctgtctcactaccgtgcccctctcaatccccatacatacacacatatgtgagttttggggttcttttcagttttaggcatcagaaattgtgtgtgtgtgtgtgtgtgtgtgtgtgtgtgtgtaaaaacgtaaaatgtcccaactttgtgctcttccttgtggatg

SEQ ID NO: 21093 - DNA, 441 bp, Homo sapiens
  AC023317.2_131514
  Located on chromosome 14
  Distance between a terminus base of telomere on chromosomal short arm and 5'-terminus of this base sequence : 96377073
  Distance between 3'-terminus of neighbour sequence of sequence listing upward to telomere on chrosomal short arm and 5'-terminus of this base sequence : 61620
gtaacatggagtagcacatcaggccagggaggtccagggattctcatcagatggacccagcagacctcactatgcaccaggcactggggcaggggcggggacacagagatgagtcagaccttgttccccgccccatattcaaggagctcacagggcagtgggagagacagacagacagacagacagacagacagacagaccgaccaggcaggcagagagacagttactgtagtgttttgaagagaaggagaggcctcatcctgggctaagagcaatgaggaggacttgctgcaaagcgaaagagggaaggagactactcagcggctttggcagacggaaatatctagggagcttttagctagaaacacagacaattataatgatacaaaatgatgataataataattattatctaatgatgacatcaagacaacatagaaa

SEQ ID NO: 21094 - DNA, 220 bp, Homo sapiens
  Z66769
  Located on chromosome 14
  Distance between a terminus base of telomere on chromosomal short arm and 5'-terminus of this base sequence : 96463671
  Distance between 3'-terminus of neighbour sequence of sequence listing upward to telomere on chrosomal short arm and 5'-terminus of this base sequence : 86157
gaatgttattgttgcctcgctaaatattcatggatgaatatgtggaataaattctcttgtaagctgacagagagcaagtaaggcctgtccttgagtctctcatctgcatccttatttctgaaaaactgtctatttgggcacgagtgtgtgtgtgtgtgtgtgtgtgtgcatgcaaaagtgcgggcactacgtgcttggttaatttaagcagaagaatccc

SEQ ID NO: 21095 - DNA, 364 bp, Homo sapiens
  AB025785.1_250
  Located on chromosome 14
  Distance between a terminus base of telomere on chromosomal short arm and 5'-terminus of this base sequence : 96612253
  Distance between 3'-terminus of neighbour sequence of sequence listing upward to telomere on chrosomal short arm and 5'-terminus of this base sequence : 148362
cttctggatggtaaacttgtaaatcttgggaagtccaaaaatgtctgttttttccccagttgaaaactaatgtggctatatagtttttaattgaagacattgctttgttgccttctaacatctaattttcctaatttttgttttttactagatttctattttttccactcttgctttgaagcttcttgcctttctctttgtcctggcattctgcagatatctgtgcacaagtgtgtgtgtgtgtgtgtgtgtgtgtgtgtgtgtgtgctagtttgtttttacactttaattagttatctttcttggtacttggcagacctttttcatctaaaggcttaatgcctgtcttagacgcttgaacaat

SEQ ID NO: 21096 - DNA, 413 bp, Homo sapiens
  chr14.fa.O7frz.97463790
  Located on chromosome 14
  Distance between a terminus base of telomere on chromosomal short arm and 5'-terminus of this base sequence : 96717284
  Distance between 3'-terminus of neighbour sequence of sequence listing upward to telomere on chrosomal short arm and 5'-terminus of this base sequence : 104667
gtagagctgtctaatgtaccagacgcggatgatagttaataacattgtattgtattcaggatttttgctaacagtagattttaggtattcttgcttcacacacacacacacacacacacacacacacacagacacacacacagcggctatgtgaaatgatagatatgtgataatttgtttaactataataaccatttcactaggtatatgtatatcaaaacatcatgttatacaccttaaaaatatacaataaaatatttttaaagtacgtctcaaatatttcatgaaacatacttctactattgtttttcattgtttacctaaaactcaaatttaattggacattctgtatttttaaacctggcaaccctaagctgagacatagagaagtttggttacttagtcaagatcct

SEQ ID NO: 21097 - DNA, 155 bp, Homo sapiens
  D14S1067
  Located on chromosome 14
  Distance between a terminus base of telomere on chromosomal short arm and 5'-terminus of this base sequence : 96717290
  Distance between 3'-terminus of neighbour sequence of sequence listing upward to telomere on chrosomal short arm and 5'-terminus of this base sequence : -407
ctgtctaatgtaccagacgcggatgatagttaataacattgtattgtattcaggatttttgctaacagtagattttaggtattcttgcttcacacacacacacacacacacacacacacacacagacacacacacagcggctatgtgaaatgata

SEQ ID NO: 21098 - DNA, 170 bp, Homo sapiens
  D14S611
  Located on chromosome 14
  Distance between a terminus base of telomere on chromosomal short arm and 5'-terminus of this base sequence : 96814306
  Distance between 3'-terminus of neighbour sequence of sequence listing upward to telomere on chrosomal short arm and 5'-terminus of this base sequence : 96861
acaaatagatacacggatacaaggttaatagatacatagacagataaatagacagacagatagatagatgaatggaataaatagatagatagatagatagatagatagatagatagatagatagatagatagatagatagattagatagatttgctagaggccagacttg

SEQ ID NO: 21099 - DNA, 147 bp, Homo sapiens
  D14S65
  Located on chromosome 14
  Distance between a terminus base of telomere on chromosomal short arm and 5'-terminus of this base sequence : 96903654
  Distance between 3'-terminus of neighbour sequence of sequence listing upward to telomere on chrosomal short arm and 5'-terminus of this base sequence : 89178
tacaccctgtggaaaggctggccaggtaagttactgttcaaatcaggaccatttgtgggagtgaagtgtgtgtgtgtgtgtgtgtgtgtgtgtgtgtgtgtgtgtgtgtgtgttggggggatggcagggatctttagggggtggagc

SEQ ID NO: 21100 - DNA, 316 bp, Homo sapiens
  HUMUT7014B
  Located on chromosome 14
  Distance between a terminus base of telomere on chromosomal short arm and 5'-terminus of this base sequence : 96984178
  Distance between 3'-terminus of neighbour sequence of sequence listing upward to telomere on chrosomal short arm and 5'-terminus of this base sequence : 80377
gtcctccctgcttttccttttcttttttttctttctctttcttccttccttccttccttccttccttccttccttccttcctttccttccttcctttccttccttccttccttccttccttccttccttccttccttccttccttcctttctctctctctctctctctctctctttctttcttttgatgaagtctcactctatcgcccaggctggagtacaatggcacgattgcggctcactgcaacctccagctcccaggttcaagtgaaccttttgcctcagcctccccagtagctgggattacaggcacacac

SEQ ID NO: 21101 - DNA, 423 bp, Homo sapiens
  chr14.fa.O7frz.97851007
  Located on chromosome 14
  Distance between a terminus base of telomere on chromosomal short arm and 5'-terminus of this base sequence : 97106424
  Distance between 3'-terminus of neighbour sequence of sequence listing upward to telomere on chrosomal short arm and 5'-terminus of this base sequence : 121930
cactagcatctattacatgcctggtatatagtagaggatcacaaatgcttactattcagatggatgggtgggtgggggagtgaaaagatagatggatggatggataagttgataaatgaatgggtgagagaatagatgggagaatgggtgaatggatggatagatagatagatagatagatagatagatagatagatagatagatagacagatagataattgggtatctaaataaatcggcaggcagaaggatgggtgaagaaatgaatggatgggagaatggatgaatgaaaggatgggcggatatatggatgatgaatcaattactagtcttgacagttttcagtggaggatattgctatttgaaaaatgattttctggttgttatattatacaagtctcaattactccaggtattgagta

SEQ ID NO: 21102 - DNA, 461 bp, Homo sapiens
  chr14.fa.O7frz.98021211
  Located on chromosome 14
  Distance between a terminus base of telomere on chromosomal short arm and 5'-terminus of this base sequence : 97276485
  Distance between 3'-terminus of neighbour sequence of sequence listing upward to telomere on chrosomal short arm and 5'-terminus of this base sequence : 169638
tctgagaaggctttggataagggattggccaatcgagggattagaagcagcatcaggggtgttcatgagcgtgtgtctgtgtgcgcacatgcatgtgcatgctgagtatgtttgaatgtgtgagcatatgtgtgcatgtgtgagtgtatgagagtgcagccacgtgtcagagtgtgggagtgtgtatgcaagtatgtgtgtgtgcatgttgagtgtgtttgaatgtgtgcatgcatgtgagtgtgtgattgtgtgcacatgtgtgagagagcatatccatgtgtgagagtcagtgtgtgtgcacatctttgtgcacgttgagtgtgtgtttgaaaatatgaacatgtgtgtctgtgtgtgtatgtgtgtgtgtatgttgagtgtatgcacatacttgagcatggatatgtgtgtgagggtgcatatggatatgtaagtgtgagtcaatgagtgtacatgag

SEQ ID NO: 21103 - DNA, 189 bp, Homo sapiens
  DISD22_0009333
  Located on chromosome 14
  Distance between a terminus base of telomere on chromosomal short arm and 5'-terminus of this base sequence : 97389115
  Distance between 3'-terminus of neighbour sequence of sequence listing upward to telomere on chrosomal short arm and 5'-terminus of this base sequence : 112169
ttgtggacagtggacattatcatgtgtgtgtgtgtgtgtgtgtgtgtgtgagagagagagagagagagagagagagagagagagagagagacatacagagaggtgggaggatggagggttagggagagaagacaacgccagcctgtttccaaatctgagcagatttctaattaggataacattcagcga

SEQ ID NO: 21104 - DNA, 140 bp, Homo sapiens
  Z66596
  Located on chromosome 14
  Distance between a terminus base of telomere on chromosomal short arm and 5'-terminus of this base sequence : 97411722
  Distance between 3'-terminus of neighbour sequence of sequence listing upward to telomere on chrosomal short arm and 5'-terminus of this base sequence : 22418
atggattagcaacctcaaaacatacacacacgcacacacacacacacgcacacatatttgtttttctgctaggcaaaactcctggggatctcagaaagtccccagaaatgtcacagccaaggtcctaactttctgggcta

SEQ ID NO: 21105 - DNA, 391 bp, Homo sapiens
  D14S614
  Located on chromosome 14
  Distance between a terminus base of telomere on chromosomal short arm and 5'-terminus of this base sequence : 97600657
  Distance between 3'-terminus of neighbour sequence of sequence listing upward to telomere on chrosomal short arm and 5'-terminus of this base sequence : 188795
ggagcagctgtaaaatggaatactaagcagctattaaaaataatgttttagaaggccacttaatgatgtggaacatgttcacagtgttttggaggagaaaaagcaggatcacaataaaataggcatatatggcaatagaaaataagaccagaataaaatacacaaaaaatgtgcatagagctgatctcaaggtgagagaattatggataattttatttctggcattttgttttctggtatcttctaaatgatagatagataggtagataaatagatagatagatagatagatagatagatagatagatagatagatagattatacccaaaaaatgccatgtcaacttttaaatgtgtcaaaaggtctcttactcccttgaggacaggaaat

SEQ ID NO: 21106 - DNA, 468 bp, Homo sapiens
  AC020546.2_93540
  Located on chromosome 14
  Distance between a terminus base of telomere on chromosomal short arm and 5'-terminus of this base sequence : 97703033
  Distance between 3'-terminus of neighbour sequence of sequence listing upward to telomere on chrosomal short arm and 5'-terminus of this base sequence : 101985
gagctttcagtgagtcaagatcacgccactgcactccagcctgggcaacagagcaagactgcctctcaaaaaataaataaataaataaataaactacctgtgtatgaaaccattgttttaggtactttgaaaaacaaagcagatgaattaggtgagtacaatttttaaggcatgtatagctcattctttgtaccgtgcaatgtattgaatgatgtaagttgggtgtgtgtgtgtgtgtgtgtgcgcgcacacacattcttcacattcagagaactgatcagagcctttgcggaaggggtactattagacaggcccgcagtgatgaacattttgttttgttcgtgccaggcaaatatcccatcctcattactctccttcactctcaatctatgtggttttcattggaaagaacccaaccccaggtttagggttaggacaatgacacaatcctgcacatttgtatttaag

SEQ ID NO: 21107 - DNA, 356 bp, Homo sapiens
  AC020546.2_94950
  Located on chromosome 14
  Distance between a terminus base of telomere on chromosomal short arm and 5'-terminus of this base sequence : 97704475
  Distance between 3'-terminus of neighbour sequence of sequence listing upward to telomere on chrosomal short arm and 5'-terminus of this base sequence : 974
tgacagagcaagactccatcatatatatatatatatatatatatatatgtgtgtgtgtgtgtgtgtatgtgtgtgtgtgtatacgtgtgtatacatatatatgcatgtatatacatatgcatgtatatatacacatatatacatatataagatgaagtcttgtatatacatatatacgtgtgtgtgtgtgtgtgtgtgtgtgtgtgtatatatatatatatatatatatgcattttcctttatcatcaaaatgtatcacagctcctgagctgtgtgtgttttggctgttgggtatagatgtgtatggttttataaaagtcatgctgagcttagtagtgcaaacctatatgtagcac

SEQ ID NO: 21108 - DNA, 326 bp, Homo sapiens
  HUMUT2025
  Located on chromosome 14
  Distance between a terminus base of telomere on chromosomal short arm and 5'-terminus of this base sequence : 97816512
  Distance between 3'-terminus of neighbour sequence of sequence listing upward to telomere on chrosomal short arm and 5'-terminus of this base sequence : 111681
cccccataggctttgtaggaagatgggaaagtagttgtgcacatagctggtcccagcctgacttgattcagttcagccacccaccaccaccccctcaataaaagaagaaagagaaagagatagaaagagagagagagaaagaagaaagaagaaagaaagaaagaaagaaagaaagaaagaaagaaagaaagaaagaaagaaagaaagaaagaaagaaagagagagagagaaggaaggaaggaaggcggggaagggaggggagggagcgagggagggaggaaggaaggaaaggaaggaaaaggaaaggaaagggaaaaagaggagag

SEQ ID NO: 21109 - DNA, 197 bp, Homo sapiens
  Z67666
  Located on chromosome 14
  Distance between a terminus base of telomere on chromosomal short arm and 5'-terminus of this base sequence : 97891788
  Distance between 3'-terminus of neighbour sequence of sequence listing upward to telomere on chrosomal short arm and 5'-terminus of this base sequence : 74950
acttagggatttggggggtcacctgtgcgtgtgtgtgtgtgtgtgtgtgtgtgtgtgtgtgtgtgtgtgtgtgtgttcgggatgaacagttgctttggagaaaaaaatcagcgtaccaagaagcagggaaagtgtgactgcatggtttcaggaaggtgggatgacttgtttaagaacccaccctccgtacacctgac

SEQ ID NO: 21110 - DNA, 370 bp, Homo sapiens
  AC021720.4_136673
  Located on chromosome 14
  Distance between a terminus base of telomere on chromosomal short arm and 5'-terminus of this base sequence : 97997543
  Distance between 3'-terminus of neighbour sequence of sequence listing upward to telomere on chrosomal short arm and 5'-terminus of this base sequence : 105558
tactgagacagaatggacagagcaaggaggacagatgagctgcccagaccacgtggttagtatgtggtgaccctgggattcaaacccggggactggcttccaaggtaatgttttcattacctcgatcacaagggggtttgataaactaagcaatcagaacttgctggttttccaaggaagaattgacaggatgattgagagagagagagagagagagaaagagtgtgtgtgtgtgtgtgtgtgtgtgtgtcaggaaggttgcaaagtagtatagtcagagttagagtggcctaagatttagggaggaaagcaatatacactcagactctgtccccaaatgtctgaactctacagtgatcaagacactgct

SEQ ID NO: 21111 - DNA, 348 bp, Homo sapiens
  chr14.fa.O7frz.98762813
  Located on chromosome 14
  Distance between a terminus base of telomere on chromosomal short arm and 5'-terminus of this base sequence : 98015803
  Distance between 3'-terminus of neighbour sequence of sequence listing upward to telomere on chrosomal short arm and 5'-terminus of this base sequence : 17890
caatgctactttccaatgttactttctcccaatgctattggaggattttagaccaaggtggtctttaaagtgctgttctgaaagactggtgatcaaattcttccttgtggggagaaaggagctcttgatgctcacatgcaatgctgaagggagatcaagagcctgtcaatatctaaacaaaggttagaattatgaaaaagtaaatcaaatgtaatgtaggaaggaaaggcatcacatacatacacacacacacacacacacacacagaatcactcccatacaaacacacactccactcacatatatgatctaaactagcaaagagcctcctgtattaacatgctacca

SEQ ID NO: 21112 - DNA, 287 bp, Homo sapiens
  chr14.fa.O7frz.98860918
  Located on chromosome 14
  Distance between a terminus base of telomere on chromosomal short arm and 5'-terminus of this base sequence : 98113989
  Distance between 3'-terminus of neighbour sequence of sequence listing upward to telomere on chrosomal short arm and 5'-terminus of this base sequence : 97838
tgtctattgatgtcttggaaagaatttgatgaggtcaaatttgttgattttattgtctttcatttagtgctttttgtttcctaagaaatagggtcacaaagttgttcttttgttttcttctagaatctttggagttttaccttacatttagttctgcagtttatctcaaaacattttttgtgtgatataaggtaaagttaaattatgtgtgtgtgtttgtgtgtgtgtgtgtgtgtgtgtgtgtgtataatagttgttccagggtcaatcgttgaaaagactattta

SEQ ID NO: 21113 - DNA, 289 bp, Homo sapiens
  chr14.fa.O7frz.98963419
  Located on chromosome 14
  Distance between a terminus base of telomere on chromosomal short arm and 5'-terminus of this base sequence : 98217631
  Distance between 3'-terminus of neighbour sequence of sequence listing upward to telomere on chrosomal short arm and 5'-terminus of this base sequence : 103355
agtagaacttgagctgtaagcacatggataatccatctaagatgctcccaacagtgaggtctttaactccctgccagagcattctgcttggaacggaatgggtattttcaccaagtctggcatggatccaaaggtttcctctgtgtgtgtgcatgtgtgtgtgagagagtgtgtgtgtgtgtgtgtgtgtgtgtgtgtacatatttaagaaagctatatttgtgatatctgaatatctttgagccttgtagaaagactgctgtttctaattactagacatccaagctgt

SEQ ID NO: 21114 - DNA, 249 bp, Homo sapiens
  AC021307.4_40685
  Located on chromosome 14
  Distance between a terminus base of telomere on chromosomal short arm and 5'-terminus of this base sequence : 98259429
  Distance between 3'-terminus of neighbour sequence of sequence listing upward to telomere on chrosomal short arm and 5'-terminus of this base sequence : 41509
gaaatctaatggatgctcaagaccatgacagggaggcacatacaaaagcaccatctgccaaagtcacctgtcttagggcagcgtgtgtgtgtctgtgtgtgtgtgtgtgtgtgtgtgtgtgtggtctttttaaccattttcatccaagaccttggtgggtcatctgccaagtgacattgatggcaccagtcatggcctctcatctcctaccccacttcactcccacatatccaatgagtctaggcttaa

SEQ ID NO: 21115 - DNA, 268 bp, Homo sapiens
  chr14.fa.O7frz.99125632
  Located on chromosome 14
  Distance between a terminus base of telomere on chromosomal short arm and 5'-terminus of this base sequence : 98379961
  Distance between 3'-terminus of neighbour sequence of sequence listing upward to telomere on chrosomal short arm and 5'-terminus of this base sequence : 120283
cataagagtaaaccatttcatgagagtaaataatttcaaatatttaacgtattagaaattaaaagataataataataataataataataataataataataataataaatacaatagtgaaatgctttttgggaaaaattcaacaggagtctcccaatgtactacagttaggagggaaaccacaacaacaaaaacacatggtgtttcagcaccatggacagtatcacgtcagccccagaacccaaacgttctagccatactatgacta

SEQ ID NO: 21116 - DNA, 213 bp, Homo sapiens
  D14S267
  Located on chromosome 14
  Distance between a terminus base of telomere on chromosomal short arm and 5'-terminus of this base sequence : 98557569
  Distance between 3'-terminus of neighbour sequence of sequence listing upward to telomere on chrosomal short arm and 5'-terminus of this base sequence : 177340
ttaatgcccactgaatgctaagcattgcagcctcacagtcatgctctgattgaaaaaggattgttctttaagagccaaacatacacacacacacacacacacacacacacacacacacacacacacatacgaaaccttgaaaaataatccatcctgtgtcacacacaagtagtaaaaggaagcaaaactgagattagaaaccagggctgcctt

SEQ ID NO: 21117 - DNA, 479 bp, Homo sapiens
  chr14.fa.O7frz.99376709
  Located on chromosome 14
  Distance between a terminus base of telomere on chromosomal short arm and 5'-terminus of this base sequence : 98630739
  Distance between 3'-terminus of neighbour sequence of sequence listing upward to telomere on chrosomal short arm and 5'-terminus of this base sequence : 72957
tgcctgacaaataatgaattagagagagatcagaacatccaagaccaaaacagtcattaactgccactccccccagaccccctcccagaacatgccggctgccagaagccggcccagacagtccagttaggaaacaaaaagatggaacagaaaggcctctttgagcagcctggttattaagagctctagacagggagagagagtgtgtgcagcttaactcaaacatttgtgctgaaatgtaaaaaacaattatgacattcaattattccattaagtgaaattaaccattcttcttgttctttgaaaagaccaaaaggaagcacagatctgaataattaggtcagtgaagaattgtgaagaaaggatgtctggacttttattttcatttgaaagtaggaggaggattttgcgttcgggctgtgtgtgtgtgtgtgtgtgtgtgtgtgtgtgtgtggtgtccgtttgctctaagaacgcct

SEQ ID NO: 21118 - DNA, 250 bp, Homo sapiens
  AC024932.4_96170
  Located on chromosome 14
  Distance between a terminus base of telomere on chromosomal short arm and 5'-terminus of this base sequence : 98718067
  Distance between 3'-terminus of neighbour sequence of sequence listing upward to telomere on chrosomal short arm and 5'-terminus of this base sequence : 86849
aagttaagcagagcaagtactattttcttccactctcagagtggggaaattgaggcatagagcacctggcagtagtgatagagccattcaagggaagagtgccatttcctgtaataaagccacctaggttggctggaaatcacacacacacacacacaaaaaaaactcagggtaaactgtaccaaacagcttcttaaacaggtagaacagctggcaagatagcaagaagtcctgaagtccaaatctaact

SEQ ID NO: 21119 - DNA, 329 bp, Homo sapiens
  chr14.fa.O7frz.99464093
  Located on chromosome 14
  Distance between a terminus base of telomere on chromosomal short arm and 5'-terminus of this base sequence : 98718294
  Distance between 3'-terminus of neighbour sequence of sequence listing upward to telomere on chrosomal short arm and 5'-terminus of this base sequence : -23
agtcctgaagtccaaatctaactggggttagagaaggaagcggagttgcaaagccctgaggacatctgataaccatatagggaccttgaccttgcattttcagagcctccaagggtaccgagacatacgacaaagcctagagcccattcaggtggagtgaggataggaagggaggtgaagggagagtgtccaagagaagatcctccttataaaaagccagattctcaaagggcacaagggcaagctcaatggacacacacacacacacacacacacacacacacacacggaatatagcccgagtgcaaagcagaaatgtccttagaatg

SEQ ID NO: 21120 - DNA, 105 bp, Homo sapiens
  DISO7_10003970
  Located on chromosome 14
  Distance between a terminus base of telomere on chromosomal short arm and 5'-terminus of this base sequence : 98832274
  Distance between 3'-terminus of neighbour sequence of sequence listing upward to telomere on chrosomal short arm and 5'-terminus of this base sequence : 113651
gagataggagaggaaagctggggaaacaggtaggaagaaagatgttgttgttgttgttgttgttgttgttgttgttgttgttgtcatcgtcatcttgatcacact

SEQ ID NO: 21121 - DNA, 253 bp, Homo sapiens
  chr14.fa.O7frz.99675832
  Located on chromosome 14
  Distance between a terminus base of telomere on chromosomal short arm and 5'-terminus of this base sequence : 98930136
  Distance between 3'-terminus of neighbour sequence of sequence listing upward to telomere on chrosomal short arm and 5'-terminus of this base sequence : 97757
tggtgacaggtgcctatagtgaaagaagaaagaaagaaagaaagaaagaaagaaagaaagaaagaaagaaagaaagaaagaaagaaagaaagaaagagaaagaaagagcgagagagagagagggagggagggagggaggaaggaaggaaggaaggaaggaaggaaggaaggaaggaaggaaggacgaaagaagtgcctgaagcccattccacataacaataagcaaaagaaacctctagaaataactccttgg

SEQ ID NO: 21122 - DNA, 462 bp, Homo sapiens
  AC073473.4_146975
  Located on chromosome 14
  Distance between a terminus base of telomere on chromosomal short arm and 5'-terminus of this base sequence : 98961649
  Distance between 3'-terminus of neighbour sequence of sequence listing upward to telomere on chrosomal short arm and 5'-terminus of this base sequence : 31260
atgttcaatgtacatcaccaacacaatggaggccaggcatggtggctcacacctgtaatcctggcactttgggaggtcaaggtgggcagatcacttgaggtcaggagtttgagaccagcctggccaacatggtgaaaccccatctctaccaaaaatacaaaaattagctgggcatggtggcatgcacctttacaggtgctcccagctactcgaggggctgaggcaagagaattgcttgaaccagaaaggtggaggttgcagtgtgctgagatcccaccgctgctctccagcctgggtgacagggtgaaaccctgccacacacacacacacacacacacacacacacaaaacacaatggaaagcatctttaacaacttttctgtttattttcatcagccacagtagagagaattgttaggtaataataattcttcttgtagctagtttctgagacaaccatca

SEQ ID NO: 21123 - DNA, 298 bp, Homo sapiens
  AC021726.3_107809
  Located on chromosome 14
  Distance between a terminus base of telomere on chromosomal short arm and 5'-terminus of this base sequence : 99094683
  Distance between 3'-terminus of neighbour sequence of sequence listing upward to telomere on chrosomal short arm and 5'-terminus of this base sequence : 132572
aaataaggaatagtttaggctacagttttgtaccaatgttaatttcctgattttgatcattgcactgtggttatgcaagataaatccttgcttttaggaaatacacacgctgaaatagaggcatcttactcttagatagttcaggagaggggggggggagagagagagagagagagagagagagagagagagagagagagagagagaaagcgtatgcagtaaagtattcgcatttggggagtgatatggtttggttctatgtccccacccaaatcttaccttgaattgtagtaatcgc

SEQ ID NO: 21124 - DNA, 381 bp, Homo sapiens
  chr14.fa.O7frz.100176786
  Located on chromosome 14
  Distance between a terminus base of telomere on chromosomal short arm and 5'-terminus of this base sequence : 99203030
  Distance between 3'-terminus of neighbour sequence of sequence listing upward to telomere on chrosomal short arm and 5'-terminus of this base sequence : 108049
tcatttactcattcctactcagactgttctgtacaggatttaaggtagttaacaacagcaaaacatacacacacacacacacacacacacactctctctctctctctctctctctctctctctctttctctctcttaaaaatgaaacctcagggccaggaaatttgtaagatacattttaggatgaaaaataaaaacacaaccacgagaggtcaaatctcagcataagaaaccccaaatgacttgttttaagctaatataaaagtagatgctcaatacaaatacttaactctttctgggcatgaaataagaggctgtagccaggaacattttgtgttctacacagattctgtttgcaatgttatttactctaacaggatgc

SEQ ID NO: 21125 - DNA, 339 bp, Homo sapiens
  chr14.fa.O7frz.100436445
  Located on chromosome 14
  Distance between a terminus base of telomere on chromosomal short arm and 5'-terminus of this base sequence : 99461019
  Distance between 3'-terminus of neighbour sequence of sequence listing upward to telomere on chrosomal short arm and 5'-terminus of this base sequence : 257608
tcacttagaatctagtgtggaaagaaagaaagagagagaaagaaagagagagagagagaaaagaaggaaggaaggaaggaaggaaggaaggagtacatgcttaatatatggtgattttttttttttgagacagggtctcattttgtcacccaggctggaatgcagtggcacagtctcagctcactgcagcctccacctcccaggctcaagcaatcctcccacctcagcctcctgaatagttgagattataggcatgtgccaccacgcttggctaatttttgcattttttgtagagatggggttttgctccattgcccaagctaatcttgaactggactc

SEQ ID NO: 21126 - DNA, 164 bp, Homo sapiens
  DISD22_0009340
  Located on chromosome 14
  Distance between a terminus base of telomere on chromosomal short arm and 5'-terminus of this base sequence : 99538696
  Distance between 3'-terminus of neighbour sequence of sequence listing upward to telomere on chrosomal short arm and 5'-terminus of this base sequence : 77338
tttggaacagagcaagtgagagtgtgagagtgtgtgtgtgtgtgtgtgtgtgtgtgagagagagagacagagagagagagagagtgtgtgtgtgtgtgtgtgtgtgtgtgtgtgtgtgttggggaggggtacattgacagaaggggcctgacctcaccctcttc

SEQ ID NO: 21127 - DNA, 187 bp, Homo sapiens
  DISD22_0009346
  Located on chromosome 14
  Distance between a terminus base of telomere on chromosomal short arm and 5'-terminus of this base sequence : 99754830
  Distance between 3'-terminus of neighbour sequence of sequence listing upward to telomere on chrosomal short arm and 5'-terminus of this base sequence : 215970
atattccaaattaggcagtggttttgcgaaagaaggaacacacacacacacacacacacacacacacacacacacacacacgtcacacacatattcatctccatttcggggctaaattatgaacatctttatcactcaaagaaaccagaaagttatcaaagcaaaaccagtgaactttgccaggtga

SEQ ID NO: 21128 - DNA, 428 bp, Homo sapiens
  chr14.fa.O7frz.100863002
  Located on chromosome 14
  Distance between a terminus base of telomere on chromosomal short arm and 5'-terminus of this base sequence : 100010775
  Distance between 3'-terminus of neighbour sequence of sequence listing upward to telomere on chrosomal short arm and 5'-terminus of this base sequence : 255758
aattaatagaggtggagcaaattcatggaggcagaggtccagaagaagggagactgcagtcctgctctgctctgctctgctctgctctgcgtgggtcattcttcccgcagaatgctgggactgcatctgagtacaacaaactggaatctacaagaagaagggcatccaaactggtgaaagatctgaaagcgggataatatggggaacaatcgaaggagtaacaagagatatttacttgaagaagatagaaactgaagggggcatgactgcgattttcaagtctctgaagggttccatgtggaagagaaatctcactttcaatgtggaccccggagaacagacctaggaatattgcgtggatgctataatgaagaagatattaacgcagtaaaaggatgagctttcttacaagcatactgttgaaagat

SEQ ID NO: 21129 - DNA, 247 bp, Homo sapiens
  Z67128
  Located on chromosome 14
  Distance between a terminus base of telomere on chromosomal short arm and 5'-terminus of this base sequence : 100152722
  Distance between 3'-terminus of neighbour sequence of sequence listing upward to telomere on chrosomal short arm and 5'-terminus of this base sequence : 141519
acaacgaagcgtctgtgacttcagtgtgtgcgtgtgtgtgtgtgtgtgtgtgtgtggcaggtggaggctgctcagaatagtgcaggggggagggagaaaaacagtaagagatgaggaaatgtatttagcacctattacatgccaggagtgttgtacgttatttcaatcacactttataacaatattgaacagtaatattccttttttacagatgaagaaattggcccagagagattcagaaactcct

SEQ ID NO: 21130 - DNA, 210 bp, Homo sapiens
  DISO7_00000520
  Located on chromosome 14
  Distance between a terminus base of telomere on chromosomal short arm and 5'-terminus of this base sequence : 100421023
  Distance between 3'-terminus of neighbour sequence of sequence listing upward to telomere on chrosomal short arm and 5'-terminus of this base sequence : 268054
gttgatgtcggttccctcttataggttatcctagagtagttgagagagagagagcaagagagagagagagagcgagagagagagagcgagagagagagagagagagagagagagagagagaggagacttcctgcctcagctcagagctcaccgggtagctgcttcctggtagatctgtgttagggtgccaccctggaaagttggagtgag

SEQ ID NO: 21131 - DNA, 131 bp, Homo sapiens
  D14S1006
  Located on chromosome 14
  Distance between a terminus base of telomere on chromosomal short arm and 5'-terminus of this base sequence : 100516108
  Distance between 3'-terminus of neighbour sequence of sequence listing upward to telomere on chrosomal short arm and 5'-terminus of this base sequence : 94875
ttctggcaaaacccaaccctgtccaaggaggtctgcccacctcccctcctgtgtgtgtgtgtgtgtgtgtgtgtgtgtgtgtgtggagtctctctgatatttattaagcatctactgcttgccctgtggaa

SEQ ID NO: 21132 - DNA, 136 bp, Homo sapiens
  D14S985
  Located on chromosome 14
  Distance between a terminus base of telomere on chromosomal short arm and 5'-terminus of this base sequence : 100633106
  Distance between 3'-terminus of neighbour sequence of sequence listing upward to telomere on chrosomal short arm and 5'-terminus of this base sequence : 116867
cagtgtgaccttaaacaagtcgcttaactactctaagtttcagtttctttcatggtctaaatggagattaaaacacacacacacacacacacacacacacacacacacacaccccctcgtgtatctaccccacagg

SEQ ID NO: 21133 - DNA, 367 bp, Homo sapiens
  chr14.fa.O7frz.101569883
  Located on chromosome 14
  Distance between a terminus base of telomere on chromosomal short arm and 5'-terminus of this base sequence : 100719430
  Distance between 3'-terminus of neighbour sequence of sequence listing upward to telomere on chrosomal short arm and 5'-terminus of this base sequence : 86188
acagatgaagtccattatgtaaaggtttctgtttctccagttatggttaaggatgaaaagattatctatctatctatctatctatctatctatctatctatctattcatctatctatctattatctatctatctatctatctatctatctttctatctatctacctacccacctatctattatatatctatctatctctataatatactactgtttttcttggttttgatggtagattcgtggtgttttacttgattatgttataaaaatcaataagtgaatacatttttaaaattcaaagaccttaaataaataggttatctgtcttctatatggtaaatattctatagacacgaaggtcacaaga

SEQ ID NO: 21134 - DNA, 330 bp, Homo sapiens
  chr14.fa.O7frz.101644195
  Located on chromosome 14
  Distance between a terminus base of telomere on chromosomal short arm and 5'-terminus of this base sequence : 100793580
  Distance between 3'-terminus of neighbour sequence of sequence listing upward to telomere on chrosomal short arm and 5'-terminus of this base sequence : 73783
tacctctttgaatgagatagacagtataaattttgaccgtattcaagttctgggtcagggacaattccaaagttctttattttcccttcctttcttccttcctttctttctttcctttcttccttcctttcttccttcctttctttcttttctttctttctttctttctttctttctttctttctttctttctttctttctctctctttctctctctctcttttccttccttccttccttccttccttccttccttccttccttccttccttccttccttccttccttccttccttctttctttttgagatggagtcttgctctatcact

SEQ ID NO: 21135 - DNA, 146 bp, Homo sapiens
  chr14.fa.O7frz.101721313
  Located on chromosome 14
  Distance between a terminus base of telomere on chromosomal short arm and 5'-terminus of this base sequence : 100870849
  Distance between 3'-terminus of neighbour sequence of sequence listing upward to telomere on chrosomal short arm and 5'-terminus of this base sequence : 76939
tctgaaattgcctaatgttaatgtctaccttctttgtgccctagactgtgagatttctcattggcagaaatttctctctctctctctctctctctctctctctctctctctctctcatcccctgctgtgttcagtagcagaacagt

SEQ ID NO: 21136 - DNA, 268 bp, Homo sapiens
  chr14.fa.O7frz.101837953
  Located on chromosome 14
  Distance between a terminus base of telomere on chromosomal short arm and 5'-terminus of this base sequence : 100987445
  Distance between 3'-terminus of neighbour sequence of sequence listing upward to telomere on chrosomal short arm and 5'-terminus of this base sequence : 116450
ttgtctatcagaaacattcaactatattcctccagtttgttatttatcttttaattttagtctgtgtgtgtgtgtgtgcgagtgtttgtgtgtgtggcgtgtgtgtgtgcatgtgcatctgtgtgtgtgcgtgtgtgtgtgcatctgtgtgtgtgcctgtgtgtgtgtgtgtgcgcatctgtgtgtgtgcctgtgtgtatgtgtgtgtacatgtgtatgtgtgtgtgtctttcagcactcagtggtctcatgatcttacattggttat

SEQ ID NO: 21137 - DNA, 166 bp, Homo sapiens
  DISD22_0009349
  Located on chromosome 14
  Distance between a terminus base of telomere on chromosomal short arm and 5'-terminus of this base sequence : 101145760
  Distance between 3'-terminus of neighbour sequence of sequence listing upward to telomere on chrosomal short arm and 5'-terminus of this base sequence : 158047
accttctctgttgcagggcctgccctcccttcctgcctgcctgcctgcctgcctgcctgcctgcctgccttccttccttccttccttccttccttccttccttccttccttccttccttccttccttccttccttctttcctctttctgtgttaggtttgcagctc

SEQ ID NO: 21138 - DNA, 455 bp, Homo sapiens
  chr14.fa.O7frz.101946865
  Located on chromosome 14
  Distance between a terminus base of telomere on chromosomal short arm and 5'-terminus of this base sequence : 101271235
  Distance between 3'-terminus of neighbour sequence of sequence listing upward to telomere on chrosomal short arm and 5'-terminus of this base sequence : 125309
gtcagaaattcaagaccagactggtcaatacagtgaaaccccgtctctaccaaaaatacaaaaattagctgggtctggtggtgcatgcctgtattcccagatactcaggaggctgaggcaggagaatcgcttgaacccaggaggtggaggttgcagtgagctacaatccccatggcactccaacctgggaaacaaagcaaaactctgtctcaataaacaaacaaacaaacaaacaaacaaaaaaagacattgactgaagactaagccatacatgtgcagggtgagactccataaagctgggtaaagaacttcagagctgtaagttgaacaatgcctagagctcactcaggacaagaataaatttgcatttcaactaaccagagaggggatacctcaggaacacccaggacattcaggagatctcagaatgggtatgactaagtagtcaggctgaa

SEQ ID NO: 21139 - DNA, 231 bp, Homo sapiens
  chr14.fa.O7frz.102140217
  Located on chromosome 14
  Distance between a terminus base of telomere on chromosomal short arm and 5'-terminus of this base sequence : 101465052
  Distance between 3'-terminus of neighbour sequence of sequence listing upward to telomere on chrosomal short arm and 5'-terminus of this base sequence : 193362
aagtacatggttgacattctgtttaaaacagtcaattgtcttttaaagacattaaaaagcgagaaaaaagtcttttaatagatatttttaaatgcatgtagcacaataatgtaaacagttcatgtaaaacaccaatttataatattctatatatatatatatatatatatatatatatatatatatatatatatatatatatatatatagtttccttcaggtaataggttg

SEQ ID NO: 21140 - DNA, 405 bp, Homo sapiens
  chr14.fa.O7frz.102268958
  Located on chromosome 14
  Distance between a terminus base of telomere on chromosomal short arm and 5'-terminus of this base sequence : 101593805
  Distance between 3'-terminus of neighbour sequence of sequence listing upward to telomere on chrosomal short arm and 5'-terminus of this base sequence : 128522
agtgagctatgatcatgtcactgcactccagccttggtgatagagcaagaccctgtctcaggacaggaaaaaaaggaaaagaaaagaaggaaggaaggaaggaaggaaggaaggaaggaaggaaggacggacggaagggagggagggagggaggaagggagggaaaggaaggaagatatttaaagaaataatgcccaaaatttcccaaatgtgataaagacaaaaattttaaggattcaagaagttcaggagaccccaaggagaatgaaaaaatgaaataaaaacacatactcatgcccaaataaaaacacaacagtcaaatttcagaaaactaaagataaacagaaaatcataaaagcagccagaggaaactacaattacgtgtagcagaacaattgaaatcac

SEQ ID NO: 21141 - DNA, 176 bp, Homo sapiens
  D14S1051
  Located on chromosome 14
  Distance between a terminus base of telomere on chromosomal short arm and 5'-terminus of this base sequence : 101741723
  Distance between 3'-terminus of neighbour sequence of sequence listing upward to telomere on chrosomal short arm and 5'-terminus of this base sequence : 147513
tgttgacggtcccttggcctctttctccaataatgttggtatttgaaaaaatttacctagttttggtattttattattgttcacattgtgtgtgtgtgtgtgtgtgtgtgtgggcgcgcgcacttgcgcgtcggccacttgtaaatttctttgcttcttggctttggcctcattga

SEQ ID NO: 21142 - DNA, 251 bp, Homo sapiens
  DISO7_10027192
  Located on chromosome 14
  Distance between a terminus base of telomere on chromosomal short arm and 5'-terminus of this base sequence : 101939185
  Distance between 3'-terminus of neighbour sequence of sequence listing upward to telomere on chrosomal short arm and 5'-terminus of this base sequence : 197286
acgaatgagcccaagatggaaattctttttctttaaatttattattattattattattattattattattattatttagagacggggtctcactctcttgcacaggctggagtgcagtagtgagatcacagctcactgcagcctcgacctccacctcaaccttttgagtagctgggaacaagggtgtgcaccaccacacctggccaaatgtggaatttccagggagtggaggggagatcctgggcacagag

SEQ ID NO: 21143 - DNA, 307 bp, Homo sapiens
  chr14.fa.O7frz.102827088
  Located on chromosome 14
  Distance between a terminus base of telomere on chromosomal short arm and 5'-terminus of this base sequence : 102150727
  Distance between 3'-terminus of neighbour sequence of sequence listing upward to telomere on chrosomal short arm and 5'-terminus of this base sequence : 211291
cacgagcagttggaactacaggcttgtgccaccatgcctggccagttttttgtatttttagtagagatgaggtctcaccatgttgcccaggctggtctcaaactcctgagctcagacaatccacccaccttggcctcccaaagtgctgggattacaggtgtgtgccaccgcgcccggcctgtttttttctttttttaaaattattattattattattattattattattattattattattattatttttatcaataggtttttggggaacaggaggtatttggttacatggataaattcttcagtg

SEQ ID NO: 21144 - DNA, 274 bp, Homo sapiens
  DISO7_10003975
  Located on chromosome 14
  Distance between a terminus base of telomere on chromosomal short arm and 5'-terminus of this base sequence : 102264213
  Distance between 3'-terminus of neighbour sequence of sequence listing upward to telomere on chrosomal short arm and 5'-terminus of this base sequence : 113179
ttaatatggtttacctgtataacggaatatactgtaaatatttaaaataatgggtggcaggtgcctgtagtcccaactatttgagaggctgacgcaggagaatcacttcaaccagggaagtggaggttgcagtaagctgagattgcgccactccactccagcctgggcaacaaagtgagactccgtctcaaaaataataataataataataataataataataataatgtccttaaaaactatacacacacacagaattaatactggctctgtc

SEQ ID NO: 21145 - DNA, 261 bp, Homo sapiens
  DISO7_10003976
  Located on chromosome 14
  Distance between a terminus base of telomere on chromosomal short arm and 5'-terminus of this base sequence : 102436299
  Distance between 3'-terminus of neighbour sequence of sequence listing upward to telomere on chrosomal short arm and 5'-terminus of this base sequence : 171812
tgcttctacctgtcatttcagagccaagcacggtggcgcacacctgttgtcctagctacttgggaggctgaggcaggaggattgcttgagcctgggaagctgagcctaatctaggcaacagagcaagctcctgtttcttaaaaaaaaaaaaaatacacacatatatatatatatatatatatatgtaattttagtttgactcacattatttttgttgaaagtttacacacggagtgtgtagggactttacaggcagagacc

SEQ ID NO: 21146 - DNA, 283 bp, Homo sapiens
  chr14.fa.O7frz.103345177
  Located on chromosome 14
  Distance between a terminus base of telomere on chromosomal short arm and 5'-terminus of this base sequence : 102669812
  Distance between 3'-terminus of neighbour sequence of sequence listing upward to telomere on chrosomal short arm and 5'-terminus of this base sequence : 233252
atttactgtcctgtggttatgtaggacagtatacctacccttagaaaacacttgctgaatgtttaagagtactgggtcataatatatgaaagctgctctcaagtagttcaggaaaaagttaacacacacacacacacacacacacacacacacgcttatttttattattaaaaatagcctctaacttaccccaccatgtggacataaccactattaaagtttgcttccggatcttttcggtatgcttatatgcactctgattttaagcacaaatggttacatc

SEQ ID NO: 21147 - DNA, 479 bp, Homo sapiens
  chr14.fa.O7frz.103424656
  Located on chromosome 14
  Distance between a terminus base of telomere on chromosomal short arm and 5'-terminus of this base sequence : 102749054
  Distance between 3'-terminus of neighbour sequence of sequence listing upward to telomere on chrosomal short arm and 5'-terminus of this base sequence : 78959
atggagttggatctattttgagaaggcattaaaggtcgaggtgggccaggtgcggtggctcacgcctgtaatcccagcactttggcaggccgaggtgagtggatcacctgaggtgaggagtttgagaccagcctgaccaacatggtgaatccccgtctctactaaaaaaatacaaaaattagccaggcgtggtggcgggcacctgtaatcccagctactcaagaggctgaggcaggagaatggcctgaacctgggaggctgaggttgcagtgagccgagatcatgccattgcactccagtccgggcaacagagcgagactccgtctcaaaaataaaggaaagaaagaaaggagggaaggaaaggaaggaaggaaggaaggaaagaaggaaggaaggaaggaaggtcggtcgagatgggcgtgaggctccaggcaaagctgcctgtaggatgccagccacgtccaagattcatgttctcc

SEQ ID NO: 21148 - DNA, 381 bp, Homo sapiens
  chr14.fa.O7frz.103756587
  Located on chromosome 14
  Distance between a terminus base of telomere on chromosomal short arm and 5'-terminus of this base sequence : 103081064
  Distance between 3'-terminus of neighbour sequence of sequence listing upward to telomere on chrosomal short arm and 5'-terminus of this base sequence : 331531
actccttaaattgctccttaaattgtgtggggtcagacccgtgtccgccctgctgtgggcctccgtgctgcgggttggagggtggccgattcctgagctgtgtttgaggagagggcggagtgccatctgggtagccgtccttcagcgttctgcaggaaggcaggaacccagctgtcagaggcttcccgggagggggtgtggcatggcagcctagaggcgcgcgcgcgtgtgtgtgtgtgtgtgtgtgtgtgtgtgtgtacagatgcccaggttcgggattggcgttagactttgagcctggccagaagaggggcagcggctgccgcatcagagccgctcccgcccccagccccctgccctgtcttccagtcctgacttcct

SEQ ID NO: 21149 - DNA, 356 bp, Homo sapiens
  chr14.fa.O7frz.103832511
  Located on chromosome 14
  Distance between a terminus base of telomere on chromosomal short arm and 5'-terminus of this base sequence : 103157360
  Distance between 3'-terminus of neighbour sequence of sequence listing upward to telomere on chrosomal short arm and 5'-terminus of this base sequence : 75915
atgcctgtaacactttcagaggctgaggtgggctgatcacttgagcccacgagttcaagaccagcctgggcaatatggtgaaactctgtctctacaaaaaatacaaaaattagccaggcatggtggtgtgcacttgcagtcccagctacttgggaggctgaggttggtggatcgtttgagcccaagaggttgaggctgcagtgagtggagattgtgccattgaactcagcatgggtggcagagtgaggccctgtcttaagaaagaaagaaagaaagaaagaaagaaagaaagaaagaaagaaagaaagaaagaatacagttaaaatgaaaacctgtgttcctcaaagtcactaatg

SEQ ID NO: 21150 - DNA, 104 bp, Homo sapiens
  DISO7_10003978
  Located on chromosome 14
  Distance between a terminus base of telomere on chromosomal short arm and 5'-terminus of this base sequence : 103265502
  Distance between 3'-terminus of neighbour sequence of sequence listing upward to telomere on chrosomal short arm and 5'-terminus of this base sequence : 107786
gacacatgctgttcccaggaaacaccgtggccacccccagggccaacacacacacacacacacacacacacacacatcccccagggcctggccagaagaaagaa

SEQ ID NO: 21151 - DNA, 402 bp, Homo sapiens
  chr14.fa.O7frz.104055699
  Located on chromosome 14
  Distance between a terminus base of telomere on chromosomal short arm and 5'-terminus of this base sequence : 103380563
  Distance between 3'-terminus of neighbour sequence of sequence listing upward to telomere on chrosomal short arm and 5'-terminus of this base sequence : 114957
ttagttgagtacgaataggatgacccaattagtatgatcagctttcacacatgaaggttgaatttatgaaacatgtaaatttgaaaatacatgtttacattgcaaaaagcttttttaacaaaaattttggccagtagtataaattcagtgaatatgttttcattgcacagatagtaaaaccacttgatacatacctcatggggatatggactgctttatgcgctgctttttaccacaccttaaatagtgcctggttgtgtgtgtgtgtgtgtgtgtgtgtgtgtgtgtgtgtgtgtgtgtgtaactcagtaaatattcaatgaatgaatgaagaaattcagaagataaaaaagagaaatttcccttatttttaaccttctgaacactatagtggttagcatt

SEQ ID NO: 21152 - DNA, 207 bp, Homo sapiens
  chr14.fa.O7frz.104139270
  Located on chromosome 14
  Distance between a terminus base of telomere on chromosomal short arm and 5'-terminus of this base sequence : 103464266
  Distance between 3'-terminus of neighbour sequence of sequence listing upward to telomere on chrosomal short arm and 5'-terminus of this base sequence : 83301
gttaggcctactgtagaaatcagaaaaatcggaaatattttgttgcttgctttgtgaaactcatgatgtgacatggattaaatttctaaaaagtttatttaattgcctttaaaattagtatgtcaaaaagtttatttatttatttatttatttattttaatttgaaacagtctctctctgtcacccagactggagtttagtggcatg

SEQ ID NO: 21153 - DNA, 101 bp, Homo sapiens
  DISO7_10003982
  Located on chromosome 14
  Distance between a terminus base of telomere on chromosomal short arm and 5'-terminus of this base sequence : 103815676
  Distance between 3'-terminus of neighbour sequence of sequence listing upward to telomere on chrosomal short arm and 5'-terminus of this base sequence : 351203
caggatcaagtctaactctgttatggcacacacacacacacacacacacacacagacacacacagctcttcacaatggggtccaacaggaccttccacatc

SEQ ID NO: 21154 - DNA, 197 bp, Homo sapiens
  D14S260
  Located on chromosome 14
  Distance between a terminus base of telomere on chromosomal short arm and 5'-terminus of this base sequence : 103901917
  Distance between 3'-terminus of neighbour sequence of sequence listing upward to telomere on chrosomal short arm and 5'-terminus of this base sequence : 86140
tttgaaaatgtaaaagtgttattcctctcacacacacacacacacacacacacacacacaatgttttttggaaaacatagtgacgttttagaaaaatacactgtttaacatcaaacgggtttatcattttaaaataaataagtaaaaacatttctcagttgtaatccctgatagacataacccacataaacaaaatc

SEQ ID NO: 21155 - DNA, 243 bp, Homo sapiens
  chr14.fa.O7frz.105138254
  Located on chromosome 14
  Distance between a terminus base of telomere on chromosomal short arm and 5'-terminus of this base sequence : 104002150
  Distance between 3'-terminus of neighbour sequence of sequence listing upward to telomere on chrosomal short arm and 5'-terminus of this base sequence : 100036
tctccttctaactattgatgtcacagaggtaaggatgaagtaattgagcttttccttcttcttaatctaaaatcatcatgttgtatacaggaagtttacacacacacacacacacacacacacacacacacacacacagaacttgtgcaccttggtaatcttgttaatgtgggtgagtttgaattatcactctacttgttaaattgaaatatgactaaaatggaaattgaaacatacttattc

SEQ ID NO: 21156 - DNA, 117 bp, Homo sapiens
  D14S292
  Located on chromosome 14
  Distance between a terminus base of telomere on chromosomal short arm and 5'-terminus of this base sequence : 104107976
  Distance between 3'-terminus of neighbour sequence of sequence listing upward to telomere on chrosomal short arm and 5'-terminus of this base sequence : 105583
ctgtgtggtgcatcaatgctctacactctcgtgtaagccatattcacacacacacacacacacacacacacacacacacacacacacacagcctctactcatgaggctgccttcatg

SEQ ID NO: 21157 - DNA, 101 bp, Homo sapiens
  DID22N_0010585
  Located on chromosome 14
  Distance between a terminus base of telomere on chromosomal short arm and 5'-terminus of this base sequence : 104184465
  Distance between 3'-terminus of neighbour sequence of sequence listing upward to telomere on chrosomal short arm and 5'-terminus of this base sequence : 76372
caagtgtgcatgcacatgcccatggatggacacacacagtgtgtgtgtgtgtgtgtgtgtgaagggaagcagggtgaggggactgctcatttaggaggaga

SEQ ID NO: 21158 - DNA, 101 bp, Homo sapiens
  DISD22_0009372
  Located on chromosome 14
  Distance between a terminus base of telomere on chromosomal short arm and 5'-terminus of this base sequence : 104574147
  Distance between 3'-terminus of neighbour sequence of sequence listing upward to telomere on chrosomal short arm and 5'-terminus of this base sequence : 389581
cagacaccagctagctggcgagcccccaccacacacacacacacacacacacacacacacacacacacacacacacgctgcctttctctgtgttcctgcag

SEQ ID NO: 21159 - DNA, 117 bp, Homo sapiens
  DISD22_0009376
  Located on chromosome 14
  Distance between a terminus base of telomere on chromosomal short arm and 5'-terminus of this base sequence : 104759467
  Distance between 3'-terminus of neighbour sequence of sequence listing upward to telomere on chrosomal short arm and 5'-terminus of this base sequence : 185219
atgtgctccataatcgggtggggggtgtgtgtgtgtgtgtgtgtgtgtgtatgtatgcatgcgtctggcacatggcaaggcccaagccaacccggcaccccgtagatgggcagctac

SEQ ID NO: 21160 - DNA, 239 bp, Homo sapiens
  AF111170.3_147778
  Located on chromosome 14
  Distance between a terminus base of telomere on chromosomal short arm and 5'-terminus of this base sequence : 105121084
  Distance between 3'-terminus of neighbour sequence of sequence listing upward to telomere on chrosomal short arm and 5'-terminus of this base sequence : 361500
cacctatgagttcttatttctcacacacacagttggaaactgggcacggtggtgcacacctgtggtcccaactactcaggaggccgaggcaggaggatcacttgagcccaggagttcgtggctgcagtgagccatgatcatgccactgcactccagcctgggtgacagagaaagaccccatctctaaaacaaacaaacaaacaaacaaacaaacccacttggtattgaaatgtaacagc

SEQ ID NO: 21161 - DNA, 309 bp, Homo sapiens
  AF111170.3_140142
  Located on chromosome 14
  Distance between a terminus base of telomere on chromosomal short arm and 5'-terminus of this base sequence : 105128722
  Distance between 3'-terminus of neighbour sequence of sequence listing upward to telomere on chrosomal short arm and 5'-terminus of this base sequence : 7399
tctgatgcttaagtgcttatcttcacagtttagaaagcaatgtttcctctagtataactggattctgtgctgttggcttttctttttgtttcctttctttttcagacatggtctcactttgtcaccaggctggagtgcagtggcttgatcacatttggcttttctttttctgtgtgtgtgtgtgtgtgtgtgtgtgtgtgtgtgcagatagggtcttgctatattgatcagattagtttcaaactcctggcctcaagggatcctcctacctcagcttcctaaagtgttagaattacagtgtgagccact

SEQ ID NO: 21162 - DNA, 315 bp, Homo sapiens
  chr14.fa.O7frz.106885823
  Located on chromosome 14
  Distance between a terminus base of telomere on chromosomal short arm and 5'-terminus of this base sequence : 105443706
  Distance between 3'-terminus of neighbour sequence of sequence listing upward to telomere on chrosomal short arm and 5'-terminus of this base sequence : 314675
catccaatcagttgaagactattaaaaaagacagattgaggtcccctgaggaagatggaattttgcctccagaagatctttggactcaagctggaacatcatctcttccctaggtcaggttccacactaccgatttgatgattttggacctgcaggcctccacacccatgtgagccaattccttaaaattctctctctctctctgtctctctctctctctctctctctcacacacacacacacacacacacacacacaccctattctattggttctgttaatctggagaactctcagtaatagaaacaaggctga

SEQ ID NO: 21163 - DNA, 345 bp, Homo sapiens
  AB019441.1_59978
  Located on chromosome 14
  Distance between a terminus base of telomere on chromosomal short arm and 5'-terminus of this base sequence : 105609040
  Distance between 3'-terminus of neighbour sequence of sequence listing upward to telomere on chrosomal short arm and 5'-terminus of this base sequence : 165019
gacaagatcgtgccattatactctagcctgggcaacaagagcaaaactccatctaaaaaagaaagaaagaaagaaagaaagaaagaaagaaagaaagaaagaaagaaagaaagaaagaaagggccctgcaaagctgttctttgtgggggaaaatttgcatctgtaaagaatctctattaacatagctagatctttttcttctagaacctcccaatcctaaagagttcaactaagatttgaataggaaacatttgtcacctattatctctaagggcagccactataagacttcaaaagaactttggactctacaatctttatcttaacctgaacattacctttcta

SEQ ID NO: 21164 - DNA, 413 bp, Homo sapiens
  AB019441.1_31065
  Located on chromosome 14
  Distance between a terminus base of telomere on chromosomal short arm and 5'-terminus of this base sequence : 105637844
  Distance between 3'-terminus of neighbour sequence of sequence listing upward to telomere on chrosomal short arm and 5'-terminus of this base sequence : 28459
cttagaaaatgtatttgctggacattgatgggactggagtagagatggatgtgggggagcccaaggattgtgctttcacacacaccacaatgacttctgctgtcccttccttccctctctccctctctctctttctttctttcttttctttccttccttcttccttcttctttctttctctttctttctttctttctttctttctttctttctttctttctttctttcttctttctttctttctttctgtttctttctttctctctttctttcttttcttcttttctttctgctgagtgagcacagaagtacacacaggtataaaactcactgaatcaccattagctgttcttccttttgcctcccacccaggtcaggaggaattacaagtcctacggaattctagttctaag

SEQ ID NO: 21165 - DNA, 228 bp, Homo sapiens
  AB019440.1_179060
  Located on chromosome 14
  Distance between a terminus base of telomere on chromosomal short arm and 5'-terminus of this base sequence : 105690011
  Distance between 3'-terminus of neighbour sequence of sequence listing upward to telomere on chrosomal short arm and 5'-terminus of this base sequence : 51754
cgagactcatttcagtaacaataaaactctggtttccaataaataaataaataaataaataaataaatgtcatggcaacaatcaattttatgtgtccccttgactcatagagtcatttattcagttacacactaacctaggtgttgtactgatcctataatataagtgttagtaaagcctgccatcatttttttcctaagtcaggaagattgtcctagataacctagg

SEQ ID NO: 21166 - DNA, 319 bp, Homo sapiens
  AB019440.1_122026
  Located on chromosome 14
  Distance between a terminus base of telomere on chromosomal short arm and 5'-terminus of this base sequence : 105746999
  Distance between 3'-terminus of neighbour sequence of sequence listing upward to telomere on chrosomal short arm and 5'-terminus of this base sequence : 56760
tctacagcaatgttcctgtatttaatactgtgttgtaaaagtgatttttgctgaaagggtagatcttagatattctcatcacacacacacacacacacacacacacacacacactccatttaaaaaaaaaatgtatgtgggatgataggcacacaaattaccttgatcatgatgagcattttacaatgtgtatctgatacagtttgcaactcgtcctggcctgaatctcgtgttgtattataatcctcaatcctgaagctgggacccagtgggagatgcttgggtcatggggtgggtctttcatgaatggtttagcact

SEQ ID NO: 21167 - DNA, 344 bp, Homo sapiens
  AB019440.1_85338
  Located on chromosome 14
  Distance between a terminus base of telomere on chromosomal short arm and 5'-terminus of this base sequence : 105783545
  Distance between 3'-terminus of neighbour sequence of sequence listing upward to telomere on chrosomal short arm and 5'-terminus of this base sequence : 36227
aggtagtggagctcaacatctggtcctggtcagggaagagccagagagagcccagcccaagccagtgacatgcgagggtgacagtgaaatccacgactgtgtctctggggatctttcaggcaggccttctgtcactcagaagaaagtctggagttcacctgtaatggtttgtgtcaaattttcaaagacgtccatgttgtttttagtttctaacacacacacacacaccacacacacacacacacacacacacacaatgttaaacatctgaatacgtgtgtgaacatatgattttaatcctttgtaggacatacttaggagtgagagttctaggtcatggatta

SEQ ID NO: 21168 - DNA, 299 bp, Homo sapiens
  AB019440.1_54401
  Located on chromosome 14
  Distance between a terminus base of telomere on chromosomal short arm and 5'-terminus of this base sequence : 105814536
  Distance between 3'-terminus of neighbour sequence of sequence listing upward to telomere on chrosomal short arm and 5'-terminus of this base sequence : 30647
aggatacatttaatcagtggacacatagtgagcacaaaaattttcaagggttttgggggatgctttatcttgtttggtctcctgcaattgaatattacatctaagaatacctgtaggtatatatacttgtggatcaatgcccactccatgtcttctttttctataacacacacacacacacacacacacacacacacacacagaactggttgatttttacaacagtgggcctctaacttgccatttttcctagtatcttgcaaatggtgagcaccctctacacggatactagacctgag

SEQ ID NO: 21169 - DNA, 396 bp, Homo sapiens
  AB019440.1_42835
  Located on chromosome 14
  Distance between a terminus base of telomere on chromosomal short arm and 5'-terminus of this base sequence : 105826075
  Distance between 3'-terminus of neighbour sequence of sequence listing upward to telomere on chrosomal short arm and 5'-terminus of this base sequence : 11240
tgaaacgattagactggcttagccttccagcctacatctttctcccgtgctggatgcttccttgtctcgaacatgggactccaagttcttcagctttgggactcggactggcttccatgctcctcggcttgcaaatggcctattgtgggaccttgtgatcatacgagttaatactccttaataaactctgtgtgtgtgtgtgtgtgtgtgtgtgtgtgtgtgtgtgtgtatcctgtgtgcgtatatatatcctgtttgttctgcccctctagggaaccctgactaatacaatcttacttcaaaagaattttttttaaaaataggtgattaggaattccaggatggaatgcagataacatagaaaatgtctaattccattacaaatgtatgaattca

SEQ ID NO: 21170 - DNA, 326 bp, Homo sapiens
  AB019440.1_8547
  Located on chromosome 14
  Distance between a terminus base of telomere on chromosomal short arm and 5'-terminus of this base sequence : 105860393
  Distance between 3'-terminus of neighbour sequence of sequence listing upward to telomere on chrosomal short arm and 5'-terminus of this base sequence : 33922
ttacaaactgtcatacttggtgactcgtgcaacattaattttattccatttatcagtgctgtgaactccaagatcaagatgctgacaagataggtttagtttgaggcttctacttttggctcagagcagccatcatattgttacttgatcatatgatcttttcatttagggcatgtgtgtgtgtgtgtgtgtgtgtgtgagagagagagagagagagagagaaatagagagagagaagtagagagagagagactgtctggtgtctttactcctgaggtcagtaatttcattctgatgtttcaccctcatcgtctcctttaaattca

SEQ ID NO: 21171 - DNA, 435 bp, Homo sapiens
  AB019439.1_127266
  Located on chromosome 14
  Distance between a terminus base of telomere on chromosomal short arm and 5'-terminus of this base sequence : 105941725
  Distance between 3'-terminus of neighbour sequence of sequence listing upward to telomere on chrosomal short arm and 5'-terminus of this base sequence : 81006
gataaacatgctggcaagataggttttattttgaggcttctactgttggctcatagcagccaccatattgctatttggtcacatgacatcttcacgtggagcgtgtgtgtgtgtgtgtgtgtgtgtgtgtgtgtgtgtgtgtgtgtgtatgtacacacagagaagggcacagagagagagagagagagagagagagacttttgtgtttttacctttacaggcgttaagtccattttaatgattccacacccctaatttgctgcacaattaaataatttttttgtttgtccattattgaattgtaaagaaatacctgaggctggataatttataaaggacataggttttatatggctcacagttgtgcaggctgtacagcaagtgtggtgctgacatctgtttctgctgagtgcctcagaaagcttacagtcaagg

SEQ ID NO: 21172 - DNA, 416 bp, Homo sapiens
  AB019439.1_54759
  Located on chromosome 14
  Distance between a terminus base of telomere on chromosomal short arm and 5'-terminus of this base sequence : 106014246
  Distance between 3'-terminus of neighbour sequence of sequence listing upward to telomere on chrosomal short arm and 5'-terminus of this base sequence : 72086
gtcctacagttgattatggcacctgagaatacctgcaggtgcaggtacatgtggatagaaacccactccaactctgctattcaactcacacatgcgcgcgcgtgtgtacacacacacacacacacacacacacatatatatatatacatcgtggctaatttttatattaacggatcccatgtttgccatttttttctggtatccatctcatggaaagcgctccctacactggtactaagactgaatatgtgtctactttctgtaaacagaagtaaagaaacagaatacaagtggacacttgggaagtgcatgcacattgaattcacctggtctcactttggaaccctgcagatgccccgtgaaaactaaatttgaggccaatgagggttacatcatttcattagtggtgaagttgc

SEQ ID NO: 21173 - DNA, 253 bp, Homo sapiens
  AB019438.1_181498
  Located on chromosome 14
  Distance between a terminus base of telomere on chromosomal short arm and 5'-terminus of this base sequence : 106087465
  Distance between 3'-terminus of neighbour sequence of sequence listing upward to telomere on chrosomal short arm and 5'-terminus of this base sequence : 72803
ggatcatacggtagttctatttgtagttttttgaggtacctccacactgctctccatagtgactgtactagtttacattctcctcaacaatgcataagagttttcttttctctgtatccttacgagcattggttagtgttttgtttgtgtgtgtgtgtgtgtgtgtgtgtgtgtgtttaatatgagccatgttaactgaggtgagatgataccttctaccatcctgcaggttgtttactcaccatgttgatta

SEQ ID NO: 21174 - DNA, 201 bp, Homo sapiens
  AB019438.1_110874
  Located on chromosome 14
  Distance between a terminus base of telomere on chromosomal short arm and 5'-terminus of this base sequence : 106158147
  Distance between 3'-terminus of neighbour sequence of sequence listing upward to telomere on chrosomal short arm and 5'-terminus of this base sequence : 70429
tattcaaagtcacgccaaatagtatctccacagagagaactacatggctcaaagctcacaaaaattaaaacacacatgtacacacacacacacacacacacacacacacacacacacagacgcacagtgtactatggctgatttttacaataattggctcctgattttggattttgcctagtgtaaccaaaggtttctgag

SEQ ID NO: 21175 - DNA, 216 bp, Homo sapiens
  AB019438.1_22195
  Located on chromosome 14
  Distance between a terminus base of telomere on chromosomal short arm and 5'-terminus of this base sequence : 106246888
  Distance between 3'-terminus of neighbour sequence of sequence listing upward to telomere on chrosomal short arm and 5'-terminus of this base sequence : 88540
ccactccaactctagtattcaaatcacacctacacacacacacacacacacacacagtggctaatttttacattaattggccccatgtttttcctttttttctggtattcatgtcatggaaagcactccctacactgacactaaggctgaatatgtgtttactttctgcaaatagaaataaaataaacaaaatacacgtggacacctgagaagtgc

SEQ ID NO: 21176 - DNA, 200 bp, Homo sapiens
  AB019437.1_45873
  Located on chromosome 14
  Distance between a terminus base of telomere on chromosomal short arm and 5'-terminus of this base sequence : 106423211
  Distance between 3'-terminus of neighbour sequence of sequence listing upward to telomere on chrosomal short arm and 5'-terminus of this base sequence : 176107
tttaccaggaaaattcgtatgtagagagtgtgtgtgtgtgtgtgtgtgtgtgtgttcccctggtttgggtatctgggttatagtagctttagagaataatttagggaggattctttttttctaaatttaaaaaatagtttcagaaaaaatggtagcaatttttctttgaattttgtgtagacttcaaatgtgaattcacc

SEQ ID NO: 21177 - DNA, 200 bp, Homo sapiens; identical to SEQ ID NO: 21176
  U29384.1_143
  Located on chromosome 14
  Distance between a terminus base of telomere on chromosomal short arm and 5'-terminus of this base sequence : 106423211
  Distance between 3'-terminus of neighbour sequence of sequence listing upward to telomere on chrosomal short arm and 5'-terminus of this base sequence : -200

SEQ ID NO: 21178 - DNA, 419 bp, Homo sapiens
  AB019437.1_5183
  Located on chromosome 14
  Distance between a terminus base of telomere on chromosomal short arm and 5'-terminus of this base sequence : 106463666
  Distance between 3'-terminus of neighbour sequence of sequence listing upward to telomere on chrosomal short arm and 5'-terminus of this base sequence : 40255
aatagtgaatcagccttaggaaacccagcgaactctgcagggacaccccaagaaaagatctcacgcatcaccagggagccgtttcctggagctcgagaggcactgaatcattggacacatggtgaacccaaacactcttcaggggtttggggggactcttatttcctttagggttctgcagttgattattgtacctgataatacctgtaggcgcaggtgcatgtggatagaagcccactccaactctactattcaactcagacacacacacacacacacacacacacacatacacattgtggctaatttttacattagtgggccccatgtttgcccttttttctggtatttttctcatgaaaagcactccctacactggaactaagactgaatatgtgtctactttctgcaaacagaat

SEQ ID NO: 21179 - DNA, 250 bp, Homo sapiens
  D15S1035
  Located on chromosome 15
  Distance between a terminus base of telomere on chromosomal short arm and 5'-terminus of this base sequence : 18080417
  Distance between 3'-terminus of neighbour sequence of sequence listing upward to telomere on chrosomal short arm and 5'-terminus of this base sequence : 0
aaggccaagacctgccttcttgctggggctggaggctgcttcctgccttccaggctgcggagtctgctggcagggctgccgggtgtgtgtgtgtgtgtgtgtgtgtgtgtgtgtgtgtgtgtgtgtgtgtgtgtgtgagtgatgaggttgcggagtctgctggtggggccgccagttgtgtgtgtgtgtgtgtgtgtgtgtgtgtgtgtgtgtgtggtgaggaggagtggactcactctgcatgggggtg

SEQ ID NO: 21180 - DNA, 152 bp, Homo sapiens
  DISO7_10003984
  Located on chromosome 15
  Distance between a terminus base of telomere on chromosomal short arm and 5'-terminus of this base sequence : 18309997
  Distance between 3'-terminus of neighbour sequence of sequence listing upward to telomere on chrosomal short arm and 5'-terminus of this base sequence : 229330
gggaacacatgtacgtgggtgtgtgtgtgtgtgtgtgtgtgtacgtacgtattatggtaatatacataaaacatgtttgtaaggattcataaaaaactcaggagagaggaacagtgttgggggaagatatttcccttctgtaccttctgagg

SEQ ID NO: 21181 - DNA, 239 bp, Homo sapiens
  DISO7_00042902
  Located on chromosome 15
  Distance between a terminus base of telomere on chromosomal short arm and 5'-terminus of this base sequence : 18557478
  Distance between 3'-terminus of neighbour sequence of sequence listing upward to telomere on chrosomal short arm and 5'-terminus of this base sequence : 247329
ctgcttgacaagggcatatccccaggcctagaggcactatgggcacacagccaatgcgctagacacagggagtaagacacagttccctctcattactgtgaggactctagacacagtgtgtgtgtgtgtgtgtgtgtgtgtgtgtgtgtgtgtgtgtccattactgtggggactctaaccacccgtgtgtgtgtgtgtgtgtgtgtgtgtgtgtgtgtgtattaggagtttcgcagtgg

SEQ ID NO: 21182 - DNA, 101 bp, Homo sapiens
  DISO7_12315110
  Located on chromosome 15
  Distance between a terminus base of telomere on chromosomal short arm and 5'-terminus of this base sequence : 18609615
  Distance between 3'-terminus of neighbour sequence of sequence listing upward to telomere on chrosomal short arm and 5'-terminus of this base sequence : 51898
ttcagtcaactattgaaggacacacaagattctcttttattattattattattattattattattattattattattaaagctgccatgttgaatctcttg

SEQ ID NO: 21183 - DNA, 280 bp, Homo sapiens
  DISO7_12315106
  Located on chromosome 15
  Distance between a terminus base of telomere on chromosomal short arm and 5'-terminus of this base sequence : 18753394
  Distance between 3'-terminus of neighbour sequence of sequence listing upward to telomere on chrosomal short arm and 5'-terminus of this base sequence : 143678
caactcatttaagatcacgattcttaaaaggagaggtcaaaaaatatatgcagccaggaccagtggctcacacctgtaatcccagcacttcaggaggctgaggcaggagaatcgtgtgaacctgggaggcagaggttgcagtgaactgagtttgtgccattgcactccagcgtgggtgacagtgcaagactccatctagaatacacacacacacacacacacacacacacacacatatatatatgcaacgtgcaagatttttgccaggtcttctgatgct

SEQ ID NO: 21184 - DNA, 209 bp, Homo sapiens
  DISO7_12295103
  Located on chromosome 15
  Distance between a terminus base of telomere on chromosomal short arm and 5'-terminus of this base sequence : 18846994
  Distance between 3'-terminus of neighbour sequence of sequence listing upward to telomere on chrosomal short arm and 5'-terminus of this base sequence : 93320
atcctagtcctgcatggggaacatttctttgttttcttttttgtttttttgtttttgttttgttttgtctttgagtgtgtgtgtgtgtgtgtgtgtgtgtgtgtgtgtgtgtgtgtggcggcggggggctttatttgcttttgctttgtgttttttggtgactgaaatttacttaagaaataactgtgtcccctttggcttccatcaat

SEQ ID NO: 21185 - DNA, 149 bp, Homo sapiens
  DISD22_0009392
  Located on chromosome 15
  Distance between a terminus base of telomere on chromosomal short arm and 5'-terminus of this base sequence : 19062325
  Distance between 3'-terminus of neighbour sequence of sequence listing upward to telomere on chrosomal short arm and 5'-terminus of this base sequence : 215122
catagctcagagatatggaatagtcaaaatgaatgggttgtttgagttatttctctctctctctcgctctctgtgtgtgtgtgtgtgtgtgtgtgtgtgtgtgtgtgtgtgtgtgtgtgtgtgtgtgctgtgcagtatctccatccctt

SEQ ID NO: 21186 - DNA, 147 bp, Homo sapiens
  DISO7_12295123
  Located on chromosome 15
  Distance between a terminus base of telomere on chromosomal short arm and 5'-terminus of this base sequence : 19464493
  Distance between 3'-terminus of neighbour sequence of sequence listing upward to telomere on chrosomal short arm and 5'-terminus of this base sequence : 402019
gactgcaccagagggatacccctccttgacacacacacacacacacacacacacacacacacacacacacacacacacacacgagatcctgtcccctgatggggtaagtaagggggagcaggccctgcagtgacctgttggccatct

SEQ ID NO: 21187 - DNA, 110 bp, Homo sapiens
  DISO7_12315112
  Located on chromosome 15
  Distance between a terminus base of telomere on chromosomal short arm and 5'-terminus of this base sequence : 19697233
  Distance between 3'-terminus of neighbour sequence of sequence listing upward to telomere on chrosomal short arm and 5'-terminus of this base sequence : 232593
  misc_feature (1)...(110): n = A,T,G or C
atgatatgtctgcataattccctttagtgtgtgtggaacacactnnnacntnacacacacacacacacacacacacacatatttcttttgccttgtctcttcctccttca

SEQ ID NO: 21188 - DNA, 392 bp, Homo sapiens
  DISO7_00042944
  Located on chromosome 15
  Distance between a terminus base of telomere on chromosomal short arm and 5'-terminus of this base sequence : 19810831
  Distance between 3'-terminus of neighbour sequence of sequence listing upward to telomere on chrosomal short arm and 5'-terminus of this base sequence : 113488
tctggtcataacattggcactatttatttatttatttatttatttatttatttatttatttgagatggagtctcgctctgtcgcccaggctggaatgcagtggcacaatctcagctcactgcaagctccgtctcccgggttcacgccattctcctgcctcagcctcccgagtagctgggactacaggcgtctgccaccatgcccggctaatttttttgtgtttttagtagagatagggtttcaccatgttagccaggatggtctcgatctcctgaccttgtgatccacccgcctcggcctcccaaagtgctgggattacaggcgtgaaccactgctactggccgacattggcactctgagaaagatgtataccagataggactttggatagg

SEQ ID NO: 21189 - DNA, 143 bp, Homo sapiens
  DISO7_12325105
  Located on chromosome 15
  Distance between a terminus base of telomere on chromosomal short arm and 5'-terminus of this base sequence : 19907017
  Distance between 3'-terminus of neighbour sequence of sequence listing upward to telomere on chrosomal short arm and 5'-terminus of this base sequence : 95794
atttggcagtatacatcaacaacaaatagtagaaggaaaataattatacctgtgtctcatatatatatatatatatatatatatatacacacatagagagagagagagagagagagaaaccatctcttaaattacctgtagca

SEQ ID NO: 21190 - DNA, 115 bp, Homo sapiens
  DISO7_10000168
  Located on chromosome 15
  Distance between a terminus base of telomere on chromosomal short arm and 5'-terminus of this base sequence : 20272586
  Distance between 3'-terminus of neighbour sequence of sequence listing upward to telomere on chrosomal short arm and 5'-terminus of this base sequence : 365426
cactgttcctgtctcctgagttttttatgaatccttacaaatatgtttttatgtatgttaccataatacgtacacacacacacacacacacacacgcacatgcacacttatgtgt

SEQ ID NO: 21191 - DNA, 321 bp, Homo sapiens
  chr15.fa.O7frz.19962069
  Located on chromosome 15
  Distance between a terminus base of telomere on chromosomal short arm and 5'-terminus of this base sequence : 20912232
  Distance between 3'-terminus of neighbour sequence of sequence listing upward to telomere on chrosomal short arm and 5'-terminus of this base sequence : 639531
atatccttatttgcggtacaactgggaatatcagtgtaggtacagggcatggaggttttactcttctttttctttatgacaccataacacagtgtttaagaaaatgggctttgagggaaaaattcttctgttaaatgaactttcttaagaacaagacagtgtggtatgtgcacagagatagaaaaataaatcaatgaaaaaaataagagagttaaaacacacacacacacacacacacacacacacacacacatatgcatatctaagcaatttataaaggagaaaattgggaaaagactagttatcaatactgttccagga

SEQ ID NO: 21192 - DNA, 392 bp, Homo sapiens
  chr15.fa.O7frz.19799093
  Located on chromosome 15
  Distance between a terminus base of telomere on chromosomal short arm and 5'-terminus of this base sequence : 20979620
  Distance between 3'-terminus of neighbour sequence of sequence listing upward to telomere on chrosomal short arm and 5'-terminus of this base sequence : 67067
gcagactagatctcctgtgataattttcttaaagtataataataacaaaatttaaaataaaataaaataaataaagaaagaaagaaagaaagaaagaaagaaagaaagaaagaaagaaagaaagaaagaaagaaacatcaattctaacaagtaccctcacggtataaaaataccgttacaaaagctaaggaaaacagatgaaagatcatagtacatggttatagcatgatattaagaaaagatgcatcaaagagagtaggaaattaagttttatattacccaaatcaccccttccccaacatcagtcagcacagtacagaaagagatatcgttcactctgggtaaagagagggaagcaactgtaggacattaccttggatctgagtactgag

SEQ ID NO: 21193 - DNA, 477 bp, Homo sapiens
  chr15.fa.O7frz.20065539
  Located on chromosome 15
  Distance between a terminus base of telomere on chromosomal short arm and 5'-terminus of this base sequence : 21100946
  Distance between 3'-terminus of neighbour sequence of sequence listing upward to telomere on chrosomal short arm and 5'-terminus of this base sequence : 120934
tgtaagcctacatgattagcaccacatggacacctccaaggtttagggcttgtacctcccagagctctgggacataagctccacctgggtttatggtaagcatctggaatgagcagagcaacatcctaacaatgtgcagggcagtggcccaggctgtccccagaaaccaccctgtccccttaggcctgtcggcctgcaatggatgaggcagcctagaaaatgactgaaatggttgtaggggcctctttcccgttgtcttgactactaacagctggctgtgctttagccattgtaatttctggcaagctatggctctgcgacatccttggatttttctcctgaaaatgctctttcattctctaccacatggctaggctgaaaatttttagaatttttctgtgtgtgtgtgtgtgtgtgtgtgtgtgtgtgtgtttgtgtgtgttttctctagcagttcaccttaagcagttagaagta

SEQ ID NO: 21194 - DNA, 430 bp, Homo sapiens
  chr15.fa.O7frz.20416461
  Located on chromosome 15
  Distance between a terminus base of telomere on chromosomal short arm and 5'-terminus of this base sequence : 21467922
  Distance between 3'-terminus of neighbour sequence of sequence listing upward to telomere on chrosomal short arm and 5'-terminus of this base sequence : 366499
ccgttcatactaccaaagtctatactagtcagggttatcgagagcaatggaaccaataggatagacacgtaggagctagcggtagatagatagatagatagatagatagatagatagggatttttaggggaactgaatcacatgattatggaggctgaccgtttccaccacatgccatgtaaagctggagatcctaggatgcttgttgggtaccatagtctaagtccaaaatgctcaaaccagagaaaaccttggttaaaccctcagtataaggctgaatgccatcagaaagtctttcaattgagtcccctgtcattttgaaataccaccatatttaaaatttaacattgttatgtggctgattcattggttgcattgtttttgagcattttgttgtttgatcaccactagatactccaggctaattgta

SEQ ID NO: 21195 - DNA, 137 bp, Homo sapiens
  G07908
  Located on chromosome 15
  Distance between a terminus base of telomere on chromosomal short arm and 5'-terminus of this base sequence : 21467971
  Distance between 3'-terminus of neighbour sequence of sequence listing upward to telomere on chrosomal short arm and 5'-terminus of this base sequence : -381
gaaccaataggatagacacgtaggagctagcggtagatagatagatagatagatagatagatagatagggatttttaggggaactgaatcacatgattatggaggctgaccgtttccaccacatgccatgtaaagct

SEQ ID NO: 21196 - DNA, 101 bp, Homo sapiens
  DISD22_0009414
  Located on chromosome 15
  Distance between a terminus base of telomere on chromosomal short arm and 5'-terminus of this base sequence : 21614832
  Distance between 3'-terminus of neighbour sequence of sequence listing upward to telomere on chrosomal short arm and 5'-terminus of this base sequence : 146724
ctacagaagctggaggcccaaaaccacagacagagagagagagagtgtgtgtgtttgtgtgtgtgtgtgtgtgtttattggtgagtgtggagcagatgagc

SEQ ID NO: 21197 - DNA, 136 bp, Homo sapiens
  D15S1021
  Located on chromosome 15
  Distance between a terminus base of telomere on chromosomal short arm and 5'-terminus of this base sequence : 21776008
  Distance between 3'-terminus of neighbour sequence of sequence listing upward to telomere on chrosomal short arm and 5'-terminus of this base sequence : 161075
acaaagattaacctctatgttttcgtgtgtgtgtgtgtgtgtgtgtgtgtgtgtggttgagacaaggtctcactctgtcatccaggctgtagtctagtggcactatcttggcttactgcaacttccaccttccagg

SEQ ID NO: 21198 - DNA, 379 bp, Homo sapiens
  chr15.fa.O7frz.21163733
  Located on chromosome 15
  Distance between a terminus base of telomere on chromosomal short arm and 5'-terminus of this base sequence : 22094936
  Distance between 3'-terminus of neighbour sequence of sequence listing upward to telomere on chrosomal short arm and 5'-terminus of this base sequence : 318792
gacagtgtctggtcacgacatcagatgccccgtgaggaggagcttatgctcaggctagggatggtggctgttatgtgagggcccttgggcctatgtctgcatggcctcgaggtcagagtttacatcctgctgattgaaggccttggtcttgaattgttgggttggtaggggctcaggtctggaggccgcagactatgactgcatgttgccatgttgggaaactcgtgttgggaaacacatgtgcatgagggagatacacacacacacacacacacacacacagccactcagcaatgtgtgtgtgcgcggtcggtctggcgccacacacagctccaagctgtttgcagagtgccactggtaaggtacattcatggaaaca

SEQ ID NO: 21199 - DNA, 379 bp, Homo sapiens
  AF018071.1_396
  Located on chromosome 15
  Distance between a terminus base of telomere on chromosomal short arm and 5'-terminus of this base sequence : 22318430
  Distance between 3'-terminus of neighbour sequence of sequence listing upward to telomere on chrosomal short arm and 5'-terminus of this base sequence : 223115
cattgaaaggtccaatacgtactgaaatacatgcttttattttgaaccaaccaccctataaacgttgtatggcttatttagatgagagcccaggttgtgtgtgtctgtgtgtgtgtgtgtgtgtgtgtgtgtgtgtgtgtgtgtgtgtgtgtgtgtgtgtacctgacagggaagcaagaacatcgagttgccaatgcactctgtctatggttagaatcatgctgaaaacgtggctcccccagttctggaatgagcccacagatcaagcattccccgaagacatagcaggctcaaatccctgtgtacacaatattttatgattatcttatgtcagtactttcaaagtatacagtttgtgtgaagacaaatccaatgtcat

SEQ ID NO: 21200 - DNA, 225 bp, Homo sapiens
  AF250841.1_194586
  Located on chromosome 15
  Distance between a terminus base of telomere on chromosomal short arm and 5'-terminus of this base sequence : 22318430
  Distance between 3'-terminus of neighbour sequence of sequence listing upward to telomere on chrosomal short arm and 5'-terminus of this base sequence : -379
cattgaaaggtccaatacgtactgaaatacatgcttttattttgaaccaaccaccctataaacgttgtatggcttatttagatgagagcccaggttgtgtgtgtctgtgtgtgtgtgtgtgtgtgtgtgtgtgtgtgtgtgtgtgtgtgtgtgtgtgtgtacctgacagggaagcaagaacatcgagttgccaatgcactctgtctatggttagaatcatgctga

SEQ ID NO: 21201 - DNA, 224 bp, Homo sapiens
  AF250841.1_198447
  Located on chromosome 15
  Distance between a terminus base of telomere on chromosomal short arm and 5'-terminus of this base sequence : 22322353
  Distance between 3'-terminus of neighbour sequence of sequence listing upward to telomere on chrosomal short arm and 5'-terminus of this base sequence : 3698
aaggaagagttgtgaactacctaagtgctgaatgggaaccataacacacacacacacacacacacacacacacagcaccttagtaaagggtgagaggcatgttagttagaagcattaaaggaaatctctttctagtcattatctgtgcactaacctaactgagcagagacttcagtatccacatactacagggcatataaactttacagaattagtccaggaaa

SEQ ID NO: 21202 - DNA, 228 bp, Homo sapiens
  AF250841.1_202798
  Located on chromosome 15
  Distance between a terminus base of telomere on chromosomal short arm and 5'-terminus of this base sequence : 22326632
  Distance between 3'-terminus of neighbour sequence of sequence listing upward to telomere on chrosomal short arm and 5'-terminus of this base sequence : 4055
aacagtaagtccttacgtgtcaataattactttaaatgtaaatggattaaattatccaaacaaaaaaacagactggacaaatggattttagaaacaacaacaacaacaaacaccgcacacacacacacacacacacacacacacacacacacacacacaaaccacccagacccaactatgtgctgcctacaagagatttacttccactttaaggacacatacaggctg

SEQ ID NO: 21203 - DNA, 381 bp, Homo sapiens
  chr3.fa.O7frz.155707366
  Located on chromosome 15
  Distance between a terminus base of telomere on chromosomal short arm and 5'-terminus of this base sequence : 22395623
  Distance between 3'-terminus of neighbour sequence of sequence listing upward to telomere on chrosomal short arm and 5'-terminus of this base sequence : 68763
tcacttcagttatcttactggaactgcttaatctatgttttttcttacaagtatttctgcatataatgcaagtatgctttatagctaaggtttaacatttctagatacatcaaaagctagagctaaggtttaccaaatttaagaactttatgaagtttataattttctatctcaaaaagggcgtcgtcttatgtatctctgatttacttagaacaaactacatacaaatggcatagctttttagttattaataaaacactagctagattatagataagggatgcgtgtgtgtgtgtgtgtgtgtgtgtgtgtgtgtgtgtgtgtgtgtgtgtgactaagaacagtaacagaaaggtcaactcaattagaatcaacaggcta

SEQ ID NO: 21204 - DNA, 151 bp, Homo sapiens
  D15S122
  Located on chromosome 15
  Distance between a terminus base of telomere on chromosomal short arm and 5'-terminus of this base sequence : 22471183
  Distance between 3'-terminus of neighbour sequence of sequence listing upward to telomere on chrosomal short arm and 5'-terminus of this base sequence : 75179
gataatcatgccccccaaaattagagtatttgaagacaactgccggagtaaaaattttaaattctatatacatatacacacacacacacacacacacacacacacacacacacacacacaaatactaatacactacgtgccagatactggg

SEQ ID NO: 21205 - DNA, 144 bp, Homo sapiens
  D15S210
  Located on chromosome 15
  Distance between a terminus base of telomere on chromosomal short arm and 5'-terminus of this base sequence : 22539180
  Distance between 3'-terminus of neighbour sequence of sequence listing upward to telomere on chrosomal short arm and 5'-terminus of this base sequence : 67846
tgaactaggcagcacacactttgtgtgtgtcctagaccaatacacacacacacacacacacacacacacacacacagagccaagcacttctggcagcaaaagccttaaaccctgtgcatgaattactgtgtccaagcattggtt

SEQ ID NO: 21206 - DNA, 286 bp, Homo sapiens
  Y09955.1_312
  Located on chromosome 15
  Distance between a terminus base of telomere on chromosomal short arm and 5'-terminus of this base sequence : 22751586
  Distance between 3'-terminus of neighbour sequence of sequence listing upward to telomere on chrosomal short arm and 5'-terminus of this base sequence : 212262
ccatcagtttatacttcctttgaattatgtctataaaaatttaatatacaaatcacatttccagtccccaaataatccttctaagcgcattaaatacactgacaaattgaggatcccaaacattgaaacaatattttaaccaccacagtaagaaacaaaatgaatgacacatatacacacacacacacacacacacacacacacacacacaattgttaaagtttcaaaaagctcaatgatagggcaacagagccacgcttttttcttgctctttattgaaagagca

SEQ ID NO: 21207 - DNA, 239 bp, Homo sapiens
  Y09954.1_118
  Located on chromosome 15
  Distance between a terminus base of telomere on chromosomal short arm and 5'-terminus of this base sequence : 22758289
  Distance between 3'-terminus of neighbour sequence of sequence listing upward to telomere on chrosomal short arm and 5'-terminus of this base sequence : 6417
gtgacagccacgtctttatactcccttgaaaatcagtaatccctgaagcgtgtgtgtgtgtgtgtgtgtgtgtgtgtgtgtgtgtgtgtgtctccaaacaattctggatagggcagctttctggttcagcctgggttgggagccccgcacccccagactcaccatttgcatcatgagaatattctacaccagacacagtgcatcttcggaaaaccatcttattctctgtcaaagtgcca

SEQ ID NO: 21208 - DNA, 442 bp, Homo sapiens
  AC044913.2_10054
  Located on chromosome 15
  Distance between a terminus base of telomere on chromosomal short arm and 5'-terminus of this base sequence : 22888035
  Distance between 3'-terminus of neighbour sequence of sequence listing upward to telomere on chrosomal short arm and 5'-terminus of this base sequence : 129507
ccaactagatggcatgaacagaaatgaggtgtctcacaggtctggaggccgaaagtctgaaatccaggtgccagcagagttggccggttctgaggaccgggagggagactctgttctcggtctctcccctggcttctgcggtttgctgctcatctttggcatttcttgtcttgcagagacatcactgcaatagcttctcctatggtcacatgacattctctctctgtgtgtgtgtgtgtgcgtgtgtgtgtccacgttccccctttttgtaaggacaccagtcacattggattagggcccacctgctccagcatgacctcattgtaacttaatgaattacatctgcaacagccctatttccaaataaagtcacattctaagatacttggggttaggacttcaacatataaatttgagaaggacatagatgaatccatagtaa

SEQ ID NO: 21209 - DNA, 251 bp, Homo sapiens
  Z67132
  Located on chromosome 15
  Distance between a terminus base of telomere on chromosomal short arm and 5'-terminus of this base sequence : 22928682
  Distance between 3'-terminus of neighbour sequence of sequence listing upward to telomere on chrosomal short arm and 5'-terminus of this base sequence : 40205
gagccatagtgcctagccttaatttttatatgttgattttatattctcaagtatactgaatttctttattggttgcaacagtttttctgtgtgtgcgtgtgtgtgtgtgtgtgtgtgtgtaatcattagggttttccacatataaggtcatgccatctgcaaacagagataattttacttctgcctttcaaatttggatgccgtttatttatttatttgcctaaatgctctggctaggaattctctgtact

SEQ ID NO: 21210 - DNA, 182 bp, Homo sapiens
  D15S986
  Located on chromosome 15
  Distance between a terminus base of telomere on chromosomal short arm and 5'-terminus of this base sequence : 23084069
  Distance between 3'-terminus of neighbour sequence of sequence listing upward to telomere on chrosomal short arm and 5'-terminus of this base sequence : 155136
gcaggaatatgtccagggtaccccggactgagagatggggaaagtgtggagcaggccaagccctggagaaacctggagggagtgggcagtgcggaacgggtacacacacacacacacacacacgcacgtatgcacacacacgcatgcacacacacacacaccccacctaaagaccagccatg

SEQ ID NO: 21211 - DNA, 452 bp, Homo sapiens
  chr15.fa.O7frz.22188765
  Located on chromosome 15
  Distance between a terminus base of telomere on chromosomal short arm and 5'-terminus of this base sequence : 23372822
  Distance between 3'-terminus of neighbour sequence of sequence listing upward to telomere on chrosomal short arm and 5'-terminus of this base sequence : 288571
acatgaggtgttaagaaccagagaatctcctgctgaaataaataggttaccaaaggaaaaaaaaaaaaaatatatatatatatatataatatatatattcatcctacatagcagacattaaaacacttaacaaaacccaccagcaataaaaacgatgtattaagattttttaagccagtggtatttttgatgttacatgacagccttcctttgtggtgactgctgtattttttagccttgctttgatcacggctgctggagacagctgtttctatgctccccgaaagcatgtggcaccgacattcgtcatgtggttctggatagccgccatccgtcatctcctctcccagtgagtttcactctcccatcactctctgcattctctgatcagttatcccagtgtgggaaaaacaaatctgcaagccagcctcctgatttaccacattaatcta

SEQ ID NO: 21212 - DNA, 119 bp, Homo sapiens
  Z67472
  Located on chromosome 15
  Distance between a terminus base of telomere on chromosomal short arm and 5'-terminus of this base sequence : 23540738
  Distance between 3'-terminus of neighbour sequence of sequence listing upward to telomere on chrosomal short arm and 5'-terminus of this base sequence : 167464
tcagtgaactttaagataggtcaatagttcacaaatggaaacacacacacacacacaaatacaaataacagaagaaaagttcccagcactgtggcacaatatgaaaaggtgtgacatgc

SEQ ID NO: 21213 - DNA, 431 bp, Homo sapiens
  chr15.fa.O7frz.21716735
  Located on chromosome 15
  Distance between a terminus base of telomere on chromosomal short arm and 5'-terminus of this base sequence : 23669500
  Distance between 3'-terminus of neighbour sequence of sequence listing upward to telomere on chrosomal short arm and 5'-terminus of this base sequence : 128643
taacgtttctgtccttactcaagaggtctgggtgtgggtaacagccacctcccaacaacgtcagaggtccgggttcagaattcctcaacgcgactcagtcactggctcaaataactactgtggagtaacgagaggtcattttaacacaacagagactccaattcaactctcttctgttaacacagtcagagttctcttctcaatgctctcacaagttttaaaaatggagaagctataaaataattttgttagaagaaaagtaattttcttctgaaatggagtaaagcaaacacatacccaaggatcttaaaaagtttttttttgtttttacagaatatatgtatgtatttgtgtgtgtgtgtgtgtgtgtgtgtgtagttacaaacactatttatagtatagctaatatgttaacttcatcgcagtgtcta

SEQ ID NO: 21214 - DNA, 101 bp, Homo sapiens
  DISO7_10003987
  Located on chromosome 15
  Distance between a terminus base of telomere on chromosomal short arm and 5'-terminus of this base sequence : 23865666
  Distance between 3'-terminus of neighbour sequence of sequence listing upward to telomere on chrosomal short arm and 5'-terminus of this base sequence : 195735
cctgtagaatggcaggatgggcgagggaggaataagtgtgtgtgtgtgtgtgtgtgtgtgtgtgtgtgtgtgtacaccagtactttatacaagcacatagc

SEQ ID NO: 21215 - DNA, 462 bp, Homo sapiens
  chr15.fa.O7frz.22895712
  Located on chromosome 15
  Distance between a terminus base of telomere on chromosomal short arm and 5'-terminus of this base sequence : 24018333
  Distance between 3'-terminus of neighbour sequence of sequence listing upward to telomere on chrosomal short arm and 5'-terminus of this base sequence : 152566
gaatacagtgatgcaatcgtagctcactgtaacctcaaactcctgggctcaggcaatcctcccacctcagcctcccaagtagctgggaccacaggcacacaccaccagatctagctatttctctctttctctctttctctctttccttctttccttccttccttccttcctttcttttttttttttttttttttttgagagacacggtctcactatgtttcccaggctgctctcaaactcctggccttaagcaatcctactgccctggcctcccaaagtgctgagatgatagacatgagccccatgtccagctgcatggcttttatttctagtttttatactattccgcacatcccacatttttacagcataaatttcttagcttaaaaataaaaataatatctaaagaaaaaaatgaaatgctgcactaaaagtagaatggcttcattaagatatttaaca

SEQ ID NO: 21216 - DNA, 247 bp, Homo sapiens
  D15S975
  Located on chromosome 15
  Distance between a terminus base of telomere on chromosomal short arm and 5'-terminus of this base sequence : 24264106
  Distance between 3'-terminus of neighbour sequence of sequence listing upward to telomere on chrosomal short arm and 5'-terminus of this base sequence : 245311
gctattgtttggtcctttgaatagtgaatgtaattgttaaactatattttaagtggttgagccaagtttaaaacagtaaaatgtgtgtgtgtgtgtgtgtgtgtgtgtgtgtgtgtgatttcttcctaatattaaaggaaattcaagaaaatagaaaaatttttaaaacacttattctataggaaatatcaaatatccatatctcaaacctacgtttttaggtacatacatacaagtgctacactgg

SEQ ID NO: 21217 - DNA, 316 bp, Homo sapiens
  AC019229.5_63374
  Located on chromosome 15
  Distance between a terminus base of telomere on chromosomal short arm and 5'-terminus of this base sequence : 24322515
  Distance between 3'-terminus of neighbour sequence of sequence listing upward to telomere on chrosomal short arm and 5'-terminus of this base sequence : 58162
gaaggagtctatgtagagccaggatctttgcaggggctgggcctggacaaactgcaaaggcctgagcagagggatcagagcccagagtggccgtgggaggcatctggtgcagggggtatcagggccggctgtgggtgcacctcccaattctgtctcagagcaccccaggcacctcacctctcattccatgtctgtctgtctgtctgtctgtgtctgtctctctctctctcaataaagctctaactatttgtctccctgctccctgactttgtgcctacccaactgtgctctatttccacagagcagtgctatgacc

SEQ ID NO: 21218 - DNA, 113 bp, Homo sapiens
  D15S1002
  Located on chromosome 15
  Distance between a terminus base of telomere on chromosomal short arm and 5'-terminus of this base sequence : 24517348
  Distance between 3'-terminus of neighbour sequence of sequence listing upward to telomere on chrosomal short arm and 5'-terminus of this base sequence : 194517
ctcttgctagagacagcaggtgtgtgtgtgtgtgtgtgtgtgtgtgtgtgtgtgttctatgctcattggggtttctgggttgctggcttcaccagggtatggccttgggatac

SEQ ID NO: 21219 - DNA, 172 bp, Homo sapiens
  D15S217
  Located on chromosome 15
  Distance between a terminus base of telomere on chromosomal short arm and 5'-terminus of this base sequence : 24742986
  Distance between 3'-terminus of neighbour sequence of sequence listing upward to telomere on chrosomal short arm and 5'-terminus of this base sequence : 225525
gatgatagctgatggatagatgctaaatgagtagatatagatagataggtgacagacagctagatgagagatgattgatagagacaagagatagaagatagatgatagatagatagatagatagatagatagatagatagagtgatcagaacaaatgaaagatactttcaga

SEQ ID NO: 21220 - DNA, 536 bp, Homo sapiens
  AC017046.3_12541
  Located on chromosome 15
  Distance between a terminus base of telomere on chromosomal short arm and 5'-terminus of this base sequence : 24827350
  Distance between 3'-terminus of neighbour sequence of sequence listing upward to telomere on chrosomal short arm and 5'-terminus of this base sequence : 84192
tgttggttctgtctataggaatactgaagagaggttccccttatgctgctaaatccttgttataagaagagactgctacaacctgaaagaaagtggggccaaaactgccatgaaaatcttcacatactgtatttaatgtgcccatcaggtcagatgaagacattttctaaagatgagctggtaccattctatgagatggcctcaaagagtgaattagagaagagtccctcctcttctgataccaaacctagcagagacacaacaaaaaaaaaaaagagaaagaaagaaagaaagaaaggaaagaaagaaagaaagaaagaaagaaagaaagaaagaaagaaagaaagaaagaaagcaagcaagcaagcaagcaagcaagcaagcaagcaagaaagaaagaaaaaaatttcaggccaatatccctgatgaacatagatgcaaaaatcctcaataaaatactagcaaattgaatccagcagctcatcaaaaagctaatccactatgattaggctctatctcttagatgcaagtttggt

SEQ ID NO: 21221 - DNA, 163 bp, Homo sapiens
  DISD22_0009430
  Located on chromosome 15
  Distance between a terminus base of telomere on chromosomal short arm and 5'-terminus of this base sequence : 25105673
  Distance between 3'-terminus of neighbour sequence of sequence listing upward to telomere on chrosomal short arm and 5'-terminus of this base sequence : 277787
atgagatcttgtagtcatgaataggaagattcaatactataaatacattaattctttccaaatcaacttataaatccaatggaattccaacaaagaccacaacaagactgtgtgtgtgtgtgtgtgagtgtgtgtgtgtgcatagtctgtgacaggatcattt

SEQ ID NO: 21222 - DNA, 111 bp, Homo sapiens
  DISD22_0009433
  Located on chromosome 15
  Distance between a terminus base of telomere on chromosomal short arm and 5'-terminus of this base sequence : 25182185
  Distance between 3'-terminus of neighbour sequence of sequence listing upward to telomere on chrosomal short arm and 5'-terminus of this base sequence : 76349
tatgtgcagatgatgactggaaaggcacacacacacacacacacacacacacacacacacacacacgcaaaaccctgtagcaggaaggggaggtgctaggagcccagaata

SEQ ID NO: 21223 - DNA, 409 bp, Homo sapiens
  chr15.fa.O7frz.24693754
  Located on chromosome 15
  Distance between a terminus base of telomere on chromosomal short arm and 5'-terminus of this base sequence : 25259903
  Distance between 3'-terminus of neighbour sequence of sequence listing upward to telomere on chrosomal short arm and 5'-terminus of this base sequence : 77607
aagtgaagtcaactgacacttaacgttctttagagagaatacaagacattaaaatacaagtgctgaaaatccaggagtcaattaaaatataagtgctgaaaatccaatgatttccattccaaacccaagctctcagtacacacacacacacacacacacacacacacacacacacactcaaattcatgaactcttctcggaaaaaaatatttaacagttaaggctgtaaaaaaatatgacagaagtccacataattggccaaatagaagttccttcacacaagtccaataatcacatcttctttatatactcacagtgaggctttttttggaaggtggcttttcaaatgtgtttattagaatgcacgctgactttgctataattaaaatacagttatgctgacatccac

SEQ ID NO: 21224 - DNA, 214 bp, Homo sapiens
  D15S1019
  Located on chromosome 15
  Distance between a terminus base of telomere on chromosomal short arm and 5'-terminus of this base sequence : 25423898
  Distance between 3'-terminus of neighbour sequence of sequence listing upward to telomere on chrosomal short arm and 5'-terminus of this base sequence : 163586
ttctggaccacgcatactagggtggagtttaggaaaggtaaactgtgccaccctcccataccaccacacccccgcaaacacacacacacacacacacacacacacacacacacacacacacgaaaccaactaatccaacaacaccaactttctaccttcattaacatagtccttcttttgtaaatataaataggacaatgaaagatggcctgat

SEQ ID NO: 21225 - DNA, 376 bp, Homo sapiens
  AC068866.2_14256
  Located on chromosome 15
  Distance between a terminus base of telomere on chromosomal short arm and 5'-terminus of this base sequence : 25430373
  Distance between 3'-terminus of neighbour sequence of sequence listing upward to telomere on chrosomal short arm and 5'-terminus of this base sequence : 6261
cagtgagccaagatcgtaccattgccctccagcctgggcaacagagtgagactctgtctcaaaaataataataataataataataataataataataataaaatgagccacaaggagagagcttgtgaataagtatgatgggtgaggaaggagaaggatgtctgagtgtctccccagtttctagaatgggtaggcggtggtgtcatcaactgagacagaaaatacaaagggacaagaagatgaggttgaaggaatgtaagtcatgtgatacctaattagagaagaaagataatgtccacacagactacagttggctggaaaaaaggaggatttgggagtcagaaaggtttgggttcaagtcctagctcattactta

SEQ ID NO: 21226 - DNA, 222 bp, Homo sapiens
  chr15.fa.O7frz.25304417
  Located on chromosome 15
  Distance between a terminus base of telomere on chromosomal short arm and 5'-terminus of this base sequence : 25663811
  Distance between 3'-terminus of neighbour sequence of sequence listing upward to telomere on chrosomal short arm and 5'-terminus of this base sequence : 233062
agttgagccatctcaaatagtagaactagtagcccttaccagagctgatgccaaaagggacacatgtacacacacacacacacacacacacacacacacacagctattatgccttggtgttgtatataatttggtgatgctatgggactgaaggaatagctgacctcatcagagaggcctaaaaaaagggagaaaaaagtagatttgttagaagcactgatg

SEQ ID NO: 21227 - DNA, 455 bp, Homo sapiens
  AC069331.3_140531
  Located on chromosome 15
  Distance between a terminus base of telomere on chromosomal short arm and 5'-terminus of this base sequence : 25877886
  Distance between 3'-terminus of neighbour sequence of sequence listing upward to telomere on chrosomal short arm and 5'-terminus of this base sequence : 213853
ttagaaatctgattgcttgtctgggcacggtggctcatgcctataatccgagcactttgggaggccaaggtgggcggattccctgaggtcaggagttcgagaccagcctggccaacatggtgaaacccccatctgtactaaaaacacaaaaattagctgggtgtggtggcaggcacctgtaatcccagccacttgggaggctgaggcaggagaatcgcttgaacccaggaggcggatgttgcagtgagcccagaccgtgccgctgcactccagcctgggcgacaaagcgagcctttgtctcaaaaaataaataaataaataaatctgattgcttgcaatatggacgatggtttgcaggaggtagaggctggaggaagggtttaggtgattcttgcaaaaggtcatgacaagagcctaaaaacagagtcctcagctcacaacgagttctcagatgc

SEQ ID NO: 21228 - DNA, 103 bp, Homo sapiens
  D15S1043
  Located on chromosome 15
  Distance between a terminus base of telomere on chromosomal short arm and 5'-terminus of this base sequence : 25960675
  Distance between 3'-terminus of neighbour sequence of sequence listing upward to telomere on chrosomal short arm and 5'-terminus of this base sequence : 82334
  misc_feature (1)...(103): n = A,T,G or C
gaacggaaataggagtaccagtgagaacttaaggctattaaacacacacnacacacacacacacacgcacacacacagaaggacacaggttacagatgataat

SEQ ID NO: 21229 - DNA, 195 bp, Homo sapiens
  G09256
  Located on chromosome 15
  Distance between a terminus base of telomere on chromosomal short arm and 5'-terminus of this base sequence : 25967106
  Distance between 3'-terminus of neighbour sequence of sequence listing upward to telomere on chrosomal short arm and 5'-terminus of this base sequence : 6328
catctgcccactttcctagaatgccacttttctttcactgggtctatccaaattggaaactccaaagcccatcccagttctctcccaccatcatcatcatcatcatcatcatcatcatcaatcatcatcatcgtcatctcatcatcatagatgtgatgatgatgatctctctctcccttgacctcttagggaaat

SEQ ID NO: 21230 - DNA, 368 bp, Homo sapiens
  AC026951.2_197849
  Located on chromosome 15
  Distance between a terminus base of telomere on chromosomal short arm and 5'-terminus of this base sequence : 26216777
  Distance between 3'-terminus of neighbour sequence of sequence listing upward to telomere on chrosomal short arm and 5'-terminus of this base sequence : 249476
actacagtaatgaagactgcagtactggtgaaggaatagaaatatagattgaaggaacagaatagagaacccggaactgatttttgacagaggtgaaaaagcaacttgacagaggaaagatggtcttggcaacaaatggtgctggaacaagggacaggcataggcacaaaaaacaagaaaaaaagaaagaaagaaagaaagagacttgacctaagtctcataccttgtatacagtaaaaattaacttaaaatggatcacaaacttgaatgtaaaatataagactacaaaactttttgaaaataaacatacgagaaaatcttagggatttagggttaggaaagaagtcgttactagacttcataccaaa

SEQ ID NO: 21231 - DNA, 458 bp, Homo sapiens
  AC026951.2_127764
  Located on chromosome 15
  Distance between a terminus base of telomere on chromosomal short arm and 5'-terminus of this base sequence : 26309861
  Distance between 3'-terminus of neighbour sequence of sequence listing upward to telomere on chrosomal short arm and 5'-terminus of this base sequence : 92716
gtaaacactctaactgcttcatctcctgaaatgttcatgcggaccctgcatcatcctcgtttcatagaaggctcagttaaggcttggagagatgcactagaagcagagagtcacagcagggatcaccaccatatgcagtgaacttgagtctctgtaacattaggggttctccagagaagcagaaccagtaaggggtgcgtgtgtgtgtgtgtgtgtgtgtgtatctatgtatgtatctatgcattatctatctatctatctatctatctatctatctatctatctatctatcatctatctgtcttctatctttctagagagatttaaggaattggctcacatgattgcggggattagcacatccaaaatctgcagggcagatgggcaggttggaaccccagggaagaaatgatactgcagctggagtctgaaggctgtctgaagactgatttccttct

SEQ ID NO: 21232 - DNA, 305 bp, Homo sapiens
  D15S1031
  Located on chromosome 15
  Distance between a terminus base of telomere on chromosomal short arm and 5'-terminus of this base sequence : 26309903
  Distance between 3'-terminus of neighbour sequence of sequence listing upward to telomere on chrosomal short arm and 5'-terminus of this base sequence : -416
accctgcatcatcctcgtttcatagaaggctcagttaaggcttggagagatgcactagaagcagagagtcacagcagggatcaccaccatatgcagtgaacttgagtctctgtaacattaggggttctccagagaagcagaaccagtaaggggtgcgtgtgtgtgtgtgtgtgtgtgtgtatctatgtatgtatctatgcattatctatctatctatctatctatctatctatctatctatctatctatcatctatctgtcttctatctttctagagagatttaaggaattggctcacatgattg

SEQ ID NO: 21233 - DNA, 218 bp, Homo sapiens
  AC023151.3_31506
  Located on chromosome 15
  Distance between a terminus base of telomere on chromosomal short arm and 5'-terminus of this base sequence : 26392333
  Distance between 3'-terminus of neighbour sequence of sequence listing upward to telomere on chrosomal short arm and 5'-terminus of this base sequence : 82125
ttgtaatttagccaggcatggtggcatgtacctgtagtcccattgcagcctggggcacaaagtgagaccctatttttttagagtaagtctctaaaaataatactaataataataataataaaataagtaaatgaaaagaaaaaataaaagggaaagggaaagaaagaaagcatctgtaaatcaaaatcatgtaagtaacacagatccaaacttatgag

SEQ ID NO: 21234 - DNA, 400 bp, Homo sapiens
  AC019322.3_151123
  Located on chromosome 15
  Distance between a terminus base of telomere on chromosomal short arm and 5'-terminus of this base sequence : 26752723
  Distance between 3'-terminus of neighbour sequence of sequence listing upward to telomere on chrosomal short arm and 5'-terminus of this base sequence : 360172
atttcttaatgcatctgtacaaacacacatgcatatattcacacaaataactatagtcattttatcaacgttttgttttgacttatttatttaaaaatattaaatgtattttataaatgaagaatgcgtgtatttatttatttatttatttatttttatttttattttgagacggagtcttgctctttcgcccaggatggagtgcagtggcgtgatctccgctcactgcaggctccgcttccggggttcatgccattatctggcctccaaaagtgctgggattacaggcgtgagccactgctctgggcctcattcaagtatatttatataggaatgtctgaaatactgccacctaatgtttagcaattattttcatttctgagcagtagaatttgagtga

SEQ ID NO: 21235 - DNA, 432 bp, Homo sapiens
  chr15.fa.O7frz.25853398
  Located on chromosome 15
  Distance between a terminus base of telomere on chromosomal short arm and 5'-terminus of this base sequence : 26990911
  Distance between 3'-terminus of neighbour sequence of sequence listing upward to telomere on chrosomal short arm and 5'-terminus of this base sequence : 237788
agagcagaagccatatctaaagaaatatctaggccgggcacagtggctcacgcctgtaatcccagcactttgggaggctgaggcaggcggatcatgaggtcaggagttggagaccagcctggccaatatggtgaaaacctgtctctactaaaaatacaaaaattagccaggcgtggtggtgcacacctgtagttccagctactcgggaggctgaggcagaagaattgcttgaatccaggtggcagaggttgtagtgagccaagatcgtgccattgcactccaacctgggcaacacagcgagactccatccccaaaaaaagaaggaaggaaggaaggaaggaaggaaggaaggaggaaaagatcgatcgatctggcaacaattgtccaaaacttgtgaatgaaaccaaggaacagattcaataagtcattctg

SEQ ID NO: 21236 - DNA, 334 bp, Homo sapiens
  AC023151.3_73214
  Located on chromosome 15
  Distance between a terminus base of telomere on chromosomal short arm and 5'-terminus of this base sequence : 27289405
  Distance between 3'-terminus of neighbour sequence of sequence listing upward to telomere on chrosomal short arm and 5'-terminus of this base sequence : 298062
gcagtactggtgaaggaatagaaatatagattgaaggaacagaatagagaacccggaactgatttttgacagaggtgaaaaagcaacttgacagaggaaagatggtcttggcaacaaatggtgctggaacaagggacaggcataggcacaaaaaacaagaaagaaagaaagaaagaaagagccttgacctaagtctcataccttgtatacagtaaaaattaacttaaaatggatcacaaacttgaatgtaaaatataagactacaaaactttttgaaaataaacatacgagaaaatcttagggatttagggttaggaaagaagtcgttactagg

SEQ ID NO: 21237 - DNA, 282 bp, Homo sapiens
  AC073220.3_6481
  Located on chromosome 15
  Distance between a terminus base of telomere on chromosomal short arm and 5'-terminus of this base sequence : 27344851
  Distance between 3'-terminus of neighbour sequence of sequence listing upward to telomere on chrosomal short arm and 5'-terminus of this base sequence : 55112
gattgctgagtcctactccagagattctgattcaccacgtccagggtagggcctgagaatttgcacttacagaaagttctcaggtgctgctgctgctgctgctgctgctgctagtccagagactacattactgagaaccactcttgtctactaactgtaaactgtagcactctaaacaaaagcttagtttggtctggcataagaagcacacaggttatggagcaaatcatgaaagattcaacccttgatcccagcctcgtgtgaaattcaggtaacaagcag

SEQ ID NO: 21238 - DNA, 456 bp, Homo sapiens
  AC073220.3_80180
  Located on chromosome 15
  Distance between a terminus base of telomere on chromosomal short arm and 5'-terminus of this base sequence : 27473556
  Distance between 3'-terminus of neighbour sequence of sequence listing upward to telomere on chrosomal short arm and 5'-terminus of this base sequence : 128423
ccgacatccaactatctgtaaggcccaggagccatttgtctctggaaaggcaggtagattggagtcagtgcttggcgttttgttttgttttgttttgttttgttttgtttttgagacagagtttcgctctgtcacccaggctggagtgcagtagcatgatctcggctcactgcaagctccgcctcctgggttcacgccattctcctgcctcagcctcccgagtagctgggactacaggcgcccgccaccatgcccggctaattttttgtatttttagtagagatggggtttcaccgtgttagccaggatggtctcgatctcctgaccttgtgatccacctgccttggcctctcaaagtgctgggattacagacttgagccaccgcgcccagccagtgcttgggttttaagctaccatttttccaaaaccccctcttccactgattttagaaagcat

SEQ ID NO: 21239 - DNA, 196 bp, Homo sapiens
  D15S165
  Located on chromosome 15
  Distance between a terminus base of telomere on chromosomal short arm and 5'-terminus of this base sequence : 27551411
  Distance between 3'-terminus of neighbour sequence of sequence listing upward to telomere on chrosomal short arm and 5'-terminus of this base sequence : 77399
gtttacgcctcatggatttaaacatctaaatagagaaacataattacaaaaaattaaaattagcaagaaactccaaaaatgcatgggtggctcaaagaggtacatcaaaaaaacaacacacacacacacacacacacacacacacacacacacacacaaactgtgtttaagtaaaatggtttgggactgtgtgccc

SEQ ID NO: 21240 - DNA, 142 bp, Homo sapiens
  D15S976
  Located on chromosome 15
  Distance between a terminus base of telomere on chromosomal short arm and 5'-terminus of this base sequence : 27653382
  Distance between 3'-terminus of neighbour sequence of sequence listing upward to telomere on chrosomal short arm and 5'-terminus of this base sequence : 101775
gcctatgacccagcaattccacccctaggaatataaccaacagaaatacatatgtgtgtgtgtgtgtgtgtgtgtgtgtgtgtgttcaccaaaagataggtcctaagaatgatcaaagcaggccgggcatagtggctcatgg

SEQ ID NO: 21241 - DNA, 431 bp, Homo sapiens
  chr15.fa.O7frz.27277891
  Located on chromosome 15
  Distance between a terminus base of telomere on chromosomal short arm and 5'-terminus of this base sequence : 27884587
  Distance between 3'-terminus of neighbour sequence of sequence listing upward to telomere on chrosomal short arm and 5'-terminus of this base sequence : 231063
ctgtcttcattactgtagcttcacagtaagccttaaaactggatagtgtgattcctctaatgttattcttctttttcaaaattgttttacatagtctagttccttggcctttccatttaattttcaaaataagttgacatagctgggcacagtggctcatgcctacaatcccagtgcttcgggagactgaggtaggaggattgcttgagctcaggagtttgagaccagcctgggaaacatagggagacttcgtctataacaacagcagcagcagcaacaacaacaacaacaacaacaacaacaacaacaacaacagttgacctatatctacaaaatatcctgctgggattttgattggtattgtgttaaatctacagataaacttggggagaactgacatctgtgccacgttgagtcttccaatacatgaa

SEQ ID NO: 21242 - DNA, 476 bp, Homo sapiens
  chr15.fa.O7frz.26727930
  Located on chromosome 15
  Distance between a terminus base of telomere on chromosomal short arm and 5'-terminus of this base sequence : 28099364
  Distance between 3'-terminus of neighbour sequence of sequence listing upward to telomere on chrosomal short arm and 5'-terminus of this base sequence : 214346
ggaagaattgaaggatgagtacatggatggatgcgtgcgtaggtgggtgggtggatggatggatggatggatggatagaggtacatgtgggtggatggacaggtggatgggtgggtgggtggacaggtgtatgggtgggtggatggcatggatggatgaatggatggacagatggatggatggatggatagatggacatgtgggtggatggacaggtggatgggtggttgggtggacagttgtgtgggtgggtgggtggatggcatgaatggatggacagatggatgcacagacagcagatggatggatggatggatggacaagtggatgggtggatcaatagatggatggatgaagagagagagggagggaaggaagagagatgggtgggtgggtgggtagatggatagatggatgaatggatggatagatagataggaagaaggatggataggttggtagatgttacatgaagg

SEQ ID NO: 21243 - DNA, 310 bp, Homo sapiens
  chr15.fa.O7frz.26604624
  Located on chromosome 15
  Distance between a terminus base of telomere on chromosomal short arm and 5'-terminus of this base sequence : 28198132
  Distance between 3'-terminus of neighbour sequence of sequence listing upward to telomere on chrosomal short arm and 5'-terminus of this base sequence : 98292
ctgttggactcaagactacaacactgacttgtgccgggatttccagccttccagccagccctgcgtacttcaaacttgccagtccccaaaacagtgcaagccaatttcttaaaatctctctctccctacctcctaccctcccactcctttttcctcttcccttccacctctccctccccttccccgtcttccttccctttcccttctccctccccttcccccttaagcctctctctctctctctctctctcgttctttttgcttagaagtagaaatggccagacatgtgattatgtaccaattatggact

SEQ ID NO: 21244 - DNA, 168 bp, Homo sapiens
  D15S1013
  Located on chromosome 15
  Distance between a terminus base of telomere on chromosomal short arm and 5'-terminus of this base sequence : 28204418
  Distance between 3'-terminus of neighbour sequence of sequence listing upward to telomere on chrosomal short arm and 5'-terminus of this base sequence : 5976
caatatcgctgattgaatagacactgctaatgaagtcaacccccaccccccgaccccccgacacacacctacacacacacacacacacacacacgtttgttcagagacatcagttgtcatgtgaactctttctttttttaagggaaacagtctttcttgaggaccaca

SEQ ID NO: 21245 - DNA, 468 bp, Homo sapiens
  AC074201.3_104973
  Located on chromosome 15
  Distance between a terminus base of telomere on chromosomal short arm and 5'-terminus of this base sequence : 28327677
  Distance between 3'-terminus of neighbour sequence of sequence listing upward to telomere on chrosomal short arm and 5'-terminus of this base sequence : 123091
gaatccacatttggataagatccccgtgtgtgtgtgtgtgtgtgtgtgtgtgtgtgtgtgtgtgtgtgtgtgttgtgcgggggagggtaaaattagaagagacttgcagggcctaggcgcactctcaatttattgtatttcattatggaaaggatttgggatgactagaattaataacttagaaggagtgaggtgacaaagaacattaaaaactattgcatctgggaccatttaatataggtttgtttgtttgtttgttttgagacggagtctcactttgccgcccaggctggagtgcagtggcatgatctcggttcactgcaacctctactccccaagttcaagtgattctcctgcctcagcctcctgagtagttgggattacaggcgcctgcctgtaattgtatttttagtagaaatggggtttcaccatcttggccaggctggtcttgaactcctaaccttgtga

SEQ ID NO: 21246 - DNA, 234 bp, Homo sapiens
  D15S1010
  Located on chromosome 15
  Distance between a terminus base of telomere on chromosomal short arm and 5'-terminus of this base sequence : 28452325
  Distance between 3'-terminus of neighbour sequence of sequence listing upward to telomere on chrosomal short arm and 5'-terminus of this base sequence : 124180
taggggcaaattcaatctctctaaggaaaacgaacacacacacacacacacacacacacacacacacacacacaccccgtctatattcagagttgaggtttttcttctacccccagctaataaaatcgggggctgcaacgaggctgagcggcacgcagtttgatgtccgcagcaggatacagggagtcagaagtggcgctgtaaatccaatgcggggcttccacgctgtgtgaa

SEQ ID NO: 21247 - DNA, 363 bp, Homo sapiens
  AC018870.4_157405
  Located on chromosome 15
  Distance between a terminus base of telomere on chromosomal short arm and 5'-terminus of this base sequence : 28514163
  Distance between 3'-terminus of neighbour sequence of sequence listing upward to telomere on chrosomal short arm and 5'-terminus of this base sequence : 61604
tgcagtgtcataccattgtactctggcctgggtgatagagtgagacagacagacaagaaaggaaagaaagaatgaaagaatgaaaggaggaaagaaaggcaaaggcaaaggcaaggcaaggcaggagggagggaggaaagaaggaagagagagacaaagagagaaagaaaaagaggaaggaaggaaggaaaaggaaaaaagaaaagggaggaaggaaggaaggaaggaaagaaaggagagaggaagaggtaggaagggagggaggaaggaaagaaggaaggaaggggaaaggaaagaaagaaaggaagaaagggaaaagtagatgaagaaaaaaggtttcttcatcttaactagattctcacg

SEQ ID NO: 21248 - DNA, 180 bp, Homo sapiens
  chr15.fa.O7frz.28164978
  Located on chromosome 15
  Distance between a terminus base of telomere on chromosomal short arm and 5'-terminus of this base sequence : 28594524
  Distance between 3'-terminus of neighbour sequence of sequence listing upward to telomere on chrosomal short arm and 5'-terminus of this base sequence : 79998
tcaacggtcctcacaatacgcaaattcccatgtctactgcaaacaaaataaaaattgtgtgtgtgtgtgtgtgtgtgtgtgtgtgtgtgtgtgtgtctgttcaatggagttcaaagactagtttaaagagggcaaacatatataaataacggatacaggagctactcataagatcagtaa

SEQ ID NO: 21249 - DNA, 165 bp, Homo sapiens
  D15S144
  Located on chromosome 15
  Distance between a terminus base of telomere on chromosomal short arm and 5'-terminus of this base sequence : 28933715
  Distance between 3'-terminus of neighbour sequence of sequence listing upward to telomere on chrosomal short arm and 5'-terminus of this base sequence : 339011
  misc_feature (1)...(165): n = A,T,G or C
agagacatcaatacatgattgggtattacaattggaagnngaacacacacacnacccacccacacacacacacacacacacacatatttttgagacagagtctcgctcttgttgcccaggctggagtgcaatggcatgatctcggctcacggcaatcttcacctc

SEQ ID NO: 21250 - DNA, 255 bp, Homo sapiens
  D15S995
  Located on chromosome 15
  Distance between a terminus base of telomere on chromosomal short arm and 5'-terminus of this base sequence : 28999340
  Distance between 3'-terminus of neighbour sequence of sequence listing upward to telomere on chrosomal short arm and 5'-terminus of this base sequence : 65460
  misc_feature (1)...(255): n = A,T,G or C
tgtagcctccatagtatccttgtctccttgctctgtgtgtctctggctttcttcctgtacgagtgtatgtgtgtgtgtggtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccccaccacgcatagatgtacacgtcagccagatctcatttttcctcaattatggtcagtgccaactatg

SEQ ID NO: 21251 - DNA, 179 bp, Homo sapiens
  D15S1007
  Located on chromosome 15
  Distance between a terminus base of telomere on chromosomal short arm and 5'-terminus of this base sequence : 29070655
  Distance between 3'-terminus of neighbour sequence of sequence listing upward to telomere on chrosomal short arm and 5'-terminus of this base sequence : 71060
ggggaacctacacttccgttttccagtctcagatgatgaatataaattcctttccctcctcatcccatttttctacaagaataaataccaccctttcccccaccaacacacacacacacacacacacacacacacacacacacacacacacacacacgaaagccatttgagattcctgg

SEQ ID NO: 21252 - DNA, 448 bp, Homo sapiens
  chr15.fa.O7frz.28844042
  Located on chromosome 15
  Distance between a terminus base of telomere on chromosomal short arm and 5'-terminus of this base sequence : 29197670
  Distance between 3'-terminus of neighbour sequence of sequence listing upward to telomere on chrosomal short arm and 5'-terminus of this base sequence : 126836
gactccaactgttcttcctaaggctcattaaattaaaaaaaaaaaactatatatacacacacacacacacacacacacacacacactgggctgggcacaatggctcacgcctgtaatcccagcactttgggaggccaaggtgggcgaatcacctgaggtcgggggttcgagaccagcctgaccaacatggagaaaccccgtctttactaaaaatacaaaaatagccgggcatagtggcgcatgcctgtaatgccagctactgaggaggctaagtcatgagaatcacttgaacccaagaggtggaggttgcagtgagccaagatcgtgccgttgcactccaacctgggcaacaacagcgaaattctgtctcaaaaaataaataaaaaataaaaataagataaaataaatacttgattttttgtatgcctctagtcaatttccagagtcc

SEQ ID NO: 21253 - DNA, 385 bp, Homo sapiens
  chr15.fa.O7frz.28944121
  Located on chromosome 15
  Distance between a terminus base of telomere on chromosomal short arm and 5'-terminus of this base sequence : 29294945
  Distance between 3'-terminus of neighbour sequence of sequence listing upward to telomere on chrosomal short arm and 5'-terminus of this base sequence : 96827
aagacgtgactatcctagctacttgtgtcagaaaagatacaggaagtaaccctgacagaatatatgaccaaaattccttctacctaaaagagcctgtgctgagatatagagaggaaacagggtttctagcaaaagaatgaagacaactgatccttatataaacctcacctaatttgcttaaagttagttgggactctcagcttccaggtgagacaagattctgatctctttgctttttagctattaggggtgtgtgtgtgtgggggggggggggggtgtgggtgtgtgggtgtgtgtggtgtgtgtgtgtgtgtgtgtgtgtttagtaacttctgcccttaaggcttctcagccagcaatctctacttggatacgtacctactgg

SEQ ID NO: 21254 - DNA, 201 bp, Homo sapiens
  D15S1040
  Located on chromosome 15
  Distance between a terminus base of telomere on chromosomal short arm and 5'-terminus of this base sequence : 29459627
  Distance between 3'-terminus of neighbour sequence of sequence listing upward to telomere on chrosomal short arm and 5'-terminus of this base sequence : 164297
tgggaggctgagtcacaagaatcatttgaacccagtgagcagaggttgcagtaagccgagatcatgccactgcactccagcatgggtgacagagcaaaaatctgtcttaaacacacacacacacacacacacacacacacacacacacagtgagattaacatggaaaatgcaaactaagttattcctctacatttggcttt

SEQ ID NO: 21255 - DNA, 378 bp, Homo sapiens
  chr15.fa.O7frz.29266113
  Located on chromosome 15
  Distance between a terminus base of telomere on chromosomal short arm and 5'-terminus of this base sequence : 29722176
  Distance between 3'-terminus of neighbour sequence of sequence listing upward to telomere on chrosomal short arm and 5'-terminus of this base sequence : 262348
tactaaagttccaagtcaacaaacctaaactaagttgttatttgacctgagaaatcaggagagagagagagccaatttcccaaacaggccactataaatcttcaatcagcataataaggaagttctctctgctttaattctaacacacacacacacacacacacacacacacacacacacagcctgaagtaacctgatgttaactaaccagttattttctgttgttctgtctggaagtaactaatacacccttgttctttgcttctgctttcttcaggccttctctgcctataaagccaaattcttctggtcagctcatcagaacatttatttcacaaaatgaagaattgcctgattctagaatcacaaataaagcca

SEQ ID NO: 21256 - DNA, 165 bp, Homo sapiens
  chr15.fa.O7frz.29411756
  Located on chromosome 15
  Distance between a terminus base of telomere on chromosomal short arm and 5'-terminus of this base sequence : 29836805
  Distance between 3'-terminus of neighbour sequence of sequence listing upward to telomere on chrosomal short arm and 5'-terminus of this base sequence : 114251
ggatactttcttaggaattctgactaatcttgtaacacacagacacacagacacatagacacacagacacagacacacacacacacacacacacacacacacacacacgcttctctctaaaatactaacatcaatggtggtctgtttccaaagaactgtatgtca

SEQ ID NO: 21257 - DNA, 254 bp, Homo sapiens
  chr15.fa.O7frz.29656519
  Located on chromosome 15
  Distance between a terminus base of telomere on chromosomal short arm and 5'-terminus of this base sequence : 30034244
  Distance between 3'-terminus of neighbour sequence of sequence listing upward to telomere on chrosomal short arm and 5'-terminus of this base sequence : 197274
aaagtacaactgcatgtattagtctcccttgccttgcctttggggagaagtttgtgtgtgtgtgtgtgtgtgtgtgtgtgtgtgtgtgtgtgtgtgtgtttgtcttttgttgttgttgttttgggacggagtcgcgctcttgctctgttgcccaggctggagtgcaatggcgtgatctcagctcgctgcaacctccgtctcccggctccaagcaattctcctgcctcagcctcctgagtagctaggattatagg

SEQ ID NO: 21258 - DNA, 166 bp, Homo sapiens
  DISD22_0009448
  Located on chromosome 15
  Distance between a terminus base of telomere on chromosomal short arm and 5'-terminus of this base sequence : 30157238
  Distance between 3'-terminus of neighbour sequence of sequence listing upward to telomere on chrosomal short arm and 5'-terminus of this base sequence : 122740
tggttccttcctcacactcgccgactggaagctcagggcggcacagccactaactctctctctctctctctctctctctctctctctctctctctctctctctctgtgtgtgtgtgtgtgtgtgtgtgtgtgtgtgtgtgtgtgtgtcccaagggaacagagcact

SEQ ID NO: 21259 - DNA, 129 bp, Homo sapiens
  DISD22_0009463
  Located on chromosome 15
  Distance between a terminus base of telomere on chromosomal short arm and 5'-terminus of this base sequence : 30284035
  Distance between 3'-terminus of neighbour sequence of sequence listing upward to telomere on chrosomal short arm and 5'-terminus of this base sequence : 126631
attccaggaatgccaaaccaaccaaatgaaaaaaaattatatatatatatatatatacatatatatatatatatatatatatatatatatatctcacacacacacactcgtgtcacttaacgacaggca

SEQ ID NO: 21260 - DNA, 427 bp, Homo sapiens
  AC012271.3_63583
  Located on chromosome 15
  Distance between a terminus base of telomere on chromosomal short arm and 5'-terminus of this base sequence : 30429723
  Distance between 3'-terminus of neighbour sequence of sequence listing upward to telomere on chrosomal short arm and 5'-terminus of this base sequence : 145559
aagtctaggttgagagctttctactttcatttcttaaatgatgttgctccactgttttctcacttgtgttgttattgaaaagaaatcaattgtcattcctacctttgttactctgcatgaaatttgcctttctttctttctttctttctttctttctttctttctttctttctttctttctttctttctttctttctctttctttcttttctttctctctctgtctctctttctttctttcattacaggatagggaatgcccaagcatgaaggcagagagaagtggtggggagaggggatttgcaagagaagataatggggaaagatctctctggggatcaggggaaaagaatggttaagagcatggacagcctggatttgaataccagttctgcacttaccaactgagttatctaaggcaaactaa

SEQ ID NO: 21261 - DNA, 384 bp, Homo sapiens
  chr15.fa.O7frz.30070288
  Located on chromosome 15
  Distance between a terminus base of telomere on chromosomal short arm and 5'-terminus of this base sequence : 30479813
  Distance between 3'-terminus of neighbour sequence of sequence listing upward to telomere on chrosomal short arm and 5'-terminus of this base sequence : 49663
atatttgtcttaagctcaggagtcatagccacctggaacctctgtgctgacagcttacacttgcagaattagctcccattacttaaacacacacacacacacacgcatgtgtgtgtgatacttactgattgttttcaataaaagacaaaaatgagcctaggccagacatgatggctcatgcctataatcccagcaatgtgcaaagcagaggtgagaggatcacttgagcccaggagttctatgttctccctgggcagcacagggagactctgcctctatttgtaaaacaaaacaaaacaaaacctaaaaatacttttccctccactcttcctcccaaaagcaaatttcaggagatgttctgtgactttctgtctcataagctag

SEQ ID NO: 21262 - DNA, 339 bp, Homo sapiens
  chr15.fa.O7frz.30288231
  Located on chromosome 15
  Distance between a terminus base of telomere on chromosomal short arm and 5'-terminus of this base sequence : 30697949
  Distance between 3'-terminus of neighbour sequence of sequence listing upward to telomere on chrosomal short arm and 5'-terminus of this base sequence : 217752
tcaccttcagaccatatgttacaaatctgctcaaatgtcctactttcagagagaatttgcctaattattctgaaataccagcccttgtctctatcctctaaccacactttaattcacagcatttactgtctcctgacattacattacatatagatatatagatatagatatagatatagatatagatatagatatagatatagatatatagatatctgtctgtccgtctgtctgacctactagaatgtaagctccaggagagcagggatcgtatctcccctcttttctgttgtactgttagcatcgaaaaggtggctaatacaaagtaggctcaactca

SEQ ID NO: 21263 - DNA, 208 bp, Homo sapiens
  D15S971
  Located on chromosome 15
  Distance between a terminus base of telomere on chromosomal short arm and 5'-terminus of this base sequence : 30833644
  Distance between 3'-terminus of neighbour sequence of sequence listing upward to telomere on chrosomal short arm and 5'-terminus of this base sequence : 135356
aagtctacttttgggtatgtgtgtgtgtgtatatatatatatatatgtgtgtgtgtgtgtgtgtgtgtgtatatatacatatttaaaattatttaaatgcataaatatatgtatatgtaaaaagttgcccattgtagtattatatacaatagcaaaagaccacctaatgctcttcagtaggggattaacccgaggttaagtagcaagc

SEQ ID NO: 21264 - DNA, 176 bp, Homo sapiens
  chr15.fa.O7frz.30646332
  Located on chromosome 15
  Distance between a terminus base of telomere on chromosomal short arm and 5'-terminus of this base sequence : 31025505
  Distance between 3'-terminus of neighbour sequence of sequence listing upward to telomere on chrosomal short arm and 5'-terminus of this base sequence : 191653
cctctagaatcctatcaccaacaccaaaatatgttcaacctaaagtaaaaacaatggccaccatttctagcaagaaagatggtttacttttttcattgggcacagatagtacacacacacacacacacacacacacacacacacacacacggagtcttagacaacttctgaatgcc

SEQ ID NO: 21265 - DNA, 376 bp, Homo sapiens
  chr15.fa.O7frz.30556356
  Located on chromosome 15
  Distance between a terminus base of telomere on chromosomal short arm and 5'-terminus of this base sequence : 31081134
  Distance between 3'-terminus of neighbour sequence of sequence listing upward to telomere on chrosomal short arm and 5'-terminus of this base sequence : 55453
tctttgttctcattagtttcaaagaacttcttcatttctgccttaatttcattattattattattattattattatttgagatggagtttcgctctgtcacccaggccggagtgcagtggcgtgatctcgactcactgcaacctctgcctcctggattccagcaattctcctgcttcagcctccctagtagctgggattataggcatgtgccaccacacctggctaatttttgtgtttttagtagaaatggagtttcatcatgttggccaggctcgtctcgaactcctaacttcaggtcatctgcctgccttgacctcccaaattgctaggattacaggtgtgagtcaccatgtccagcctaatttcattacttat

SEQ ID NO: 21266 - DNA, 474 bp, Homo sapiens
  chr15.fa.O7frz.30761991
  Located on chromosome 15
  Distance between a terminus base of telomere on chromosomal short arm and 5'-terminus of this base sequence : 31139549
  Distance between 3'-terminus of neighbour sequence of sequence listing upward to telomere on chrosomal short arm and 5'-terminus of this base sequence : 58039
gcactaattaacaagcagtcagattcttaggtccctctctaggctagctactgcttctcttctaccctggcagaatgctggaggtttattccctacagcagataaacagaggaactggcctgggagaaatgagacatagttaaggacacaggtatataataaaaatagatggaatcaatttatatatatacacacacacacacacacacacacacacacacacacacacacacacaagattctgagacctctagctatttttcccaatcaactcctagaaaaaagcaaattagagcatgctatctccttcaagacaggagaatggagaatcctttgctttggaatatgaacagctcagattaagtagtcttgctatactttctgtgatactgtgaaatagtaagaaataaatatctgttctctgcccctggttcccaagatggagctcccaatactcttgtagataggagtgcc

SEQ ID NO: 21267 - DNA, 380 bp, Homo sapiens
  chr15.fa.O7frz.30842490
  Located on chromosome 15
  Distance between a terminus base of telomere on chromosomal short arm and 5'-terminus of this base sequence : 31220099
  Distance between 3'-terminus of neighbour sequence of sequence listing upward to telomere on chrosomal short arm and 5'-terminus of this base sequence : 80076
aatacaactgcttaccactgtaacaatgtttaggaagaaatgctatattcaacattcaaattatctttaaaattttaaagaaaaaaatgtaaagaaaacactaggaatactttacccatacacacatacccacacatacacacacacacacacacacacacacacacacacacacaaagattgtaaaaatatgcagtggatttgggaaatggaattcttaaagctatattctcagtgaggttttactgaaaagaacttaatactatcaacactatttctaatagaatatttcaacaattatacaaagtaaaccatatatttaatggttaagagaaggtatgtatgaattcaatatcattaatctgcacagttctacctag

SEQ ID NO: 21268 - DNA, 260 bp, Homo sapiens
  chr15.fa.O7frz.30963986
  Located on chromosome 15
  Distance between a terminus base of telomere on chromosomal short arm and 5'-terminus of this base sequence : 31350491
  Distance between 3'-terminus of neighbour sequence of sequence listing upward to telomere on chrosomal short arm and 5'-terminus of this base sequence : 130012
tttgagtctataatccatttcaagttaaatctttgtatataaaaagtaagggtcccgggttgtagtctttctctctctctctgtgtgtgtgtgtgtgtgtgtgtgtgtgtgtatgtgtgtgtgtgtgtgaatatttaattcccagttgttccaacacattggaatttaacttttcacactggattgacttggcacttttaccaaatatcattgatcatatacgtttggctctatttctgaacttctgttccattaatcta

SEQ ID NO: 21269 - DNA, 503 bp, Homo sapiens
  chr15.fa.O7frz.31080403
  Located on chromosome 15
  Distance between a terminus base of telomere on chromosomal short arm and 5'-terminus of this base sequence : 31470275
  Distance between 3'-terminus of neighbour sequence of sequence listing upward to telomere on chrosomal short arm and 5'-terminus of this base sequence : 119524
ttcctgacagtcatgtctttacactatgcatagtttgaggagtaaattgttttcttcccaggtggttatagccggctatgcaagtcacaaatttttgcttaattcatgagcccaatttgaggaaattaatggataatgatgattttacagtgagtgctgtagtgcttgctctacagtagaaacacaggggatgattctgaactgagttgcagagcagaaaatacaataaagcatggcgccattcggcagcctcctctctaaacctagtagctgtaacacgcgcgcgcgcgcgcgcgcgcgtgcgcgcacacacacacacacacacacacacacacacacacacacacgaagagtgattctggggagccaagatagatactgacacactgatcactaaaaaactcatgctccttcttatcattcagaatgattagtctgctggttgtggcgatctgggcaacctgggaggtggcttgacaaggttacttaggtcagagcaggat

SEQ ID NO: 21270 - DNA, 492 bp, Homo sapiens
  chr15.fa.O7frz.31154649
  Located on chromosome 15
  Distance between a terminus base of telomere on chromosomal short arm and 5'-terminus of this base sequence : 31544300
  Distance between 3'-terminus of neighbour sequence of sequence listing upward to telomere on chrosomal short arm and 5'-terminus of this base sequence : 73522
gcttccacttttattcaatgtacatgtccatattgatctccttcttcttcttcctcttcctcttctttcttttcttcttcttcttcttcttcttcttcttcttcttcttcttcttcttcttcttcttcttcttcttcttcttctccttcttcttcttcttcttccttcttctccttctccttcttcttcttccttcttctccttctccttcttcttcttcttccgcttcttctttcttcttcttcttctctttttttttggagacagaatcttgttctgtcacccaggttgaagtgcaatggcgcgatctcagctcactgcaatctccacctcccgggttcaagcaattttcctgcctcagcctcccgagtagctgggattacaggtgtctgccaccatgcgtggctgatttttttgttgtatttttagtagagacggggtttcaccgtgttgtccaggctggtctcaaactcctgacctctggtattctac

SEQ ID NO: 21271 - DNA, 218 bp, Homo sapiens
  D15S118
  Located on chromosome 15
  Distance between a terminus base of telomere on chromosomal short arm and 5'-terminus of this base sequence : 31716103
  Distance between 3'-terminus of neighbour sequence of sequence listing upward to telomere on chrosomal short arm and 5'-terminus of this base sequence : 171311
tcaaagacccatatcaaccatgtttctataaacagagatttatagtagatgcttaactggaagcaatattattataattgatttccagactaaacacacacacacacacacacacacacacttaaaacttaaaatggttataattagagcacaatacaacccagtcttctttattggggatccacattgctgtcattataagtgtcgcttttcagcac

SEQ ID NO: 21272 - DNA, 188 bp, Homo sapiens
  D15S1042
  Located on chromosome 15
  Distance between a terminus base of telomere on chromosomal short arm and 5'-terminus of this base sequence : 31742869
  Distance between 3'-terminus of neighbour sequence of sequence listing upward to telomere on chrosomal short arm and 5'-terminus of this base sequence : 26548
gctgcttaatttccctgtagactatttgtgtgtgtgtgtgtgtgtgtgtgtgtgtgtgtgtgtgtatgtgcatgtgtgagacagagggggaaaagagaaagagtctgtgtttatttctgtatgtttgtgtgtccgtttgttccttggaggaaatagtcatgttctgcttatcatggcattagccagag

SEQ ID NO: 21273 - DNA, 415 bp, Homo sapiens
  AC069381.3_37092
  Located on chromosome 15
  Distance between a terminus base of telomere on chromosomal short arm and 5'-terminus of this base sequence : 32062008
  Distance between 3'-terminus of neighbour sequence of sequence listing upward to telomere on chrosomal short arm and 5'-terminus of this base sequence : 318951
agtttaatgcagtaaattcatcactatgcatttgtggcctctggattttatgatatccttaggttatgaaaatattcccccattttcttctagtgtttcaatggcatcatttttttttacatttaagttattgatctttatggaatatattttagggtaaagtgtgagcttatttttatctaacaaagcaaacttttacatttatttttacttatttttcattttaaaataatttttaattgactatttatttatttatttatttatttattttagagataggttctctctctgctgccccgggtggagtacaatggtgtgatcatagctcgctgcagcctcaaactcctgtgcttagatgatcctcctgcctcagcttccttagtagctgggagtgtaggtgcataccaacgaa

SEQ ID NO: 21274 - DNA, 255 bp, Homo sapiens
  HUMUT5157
  Located on chromosome 15
  Distance between a terminus base of telomere on chromosomal short arm and 5'-terminus of this base sequence : 32325177
  Distance between 3'-terminus of neighbour sequence of sequence listing upward to telomere on chrosomal short arm and 5'-terminus of this base sequence : 262754
atgacactgcaaattgcacagtacaactatgggctgcactgaaactctggaaatgagctatactcattttccttctttctttctttctttctctcttttctttcttttctctctcttttctctctttttctctttcttttctttctttctttctttctctctttctttctctctctctctctctgtctgtctgactttttgtctgactgtctttttttgacacagggtctcgctctattgcccaggctagagtgc

SEQ ID NO: 21275 - DNA, 349 bp, Homo sapiens
  chr15.fa.O7frz.33432057
  Located on chromosome 15
  Distance between a terminus base of telomere on chromosomal short arm and 5'-terminus of this base sequence : 32334690
  Distance between 3'-terminus of neighbour sequence of sequence listing upward to telomere on chrosomal short arm and 5'-terminus of this base sequence : 9258
ctaggtctttgatatctgcataacaacattaatattagtaatattaattcaatcggagaagcaaaaccattaggaagtgtgtgtgtgtgtgtgtgtgtgtgtgtgtgtgtgtgttttgcttgggaggagtggatttattatggagatttgaacttacacaatgggggctggttaaaaagtctttgtaaggctgttgtctttgtgcctgatgctggagcttgaagtccacagcatgggtcttcaggaagagaagataagatagaaagtaggagtgagcaagtacaatccggaatttacaaggacaggaacagactgcaacccatatcagttataatcgcctctaaccttg

SEQ ID NO: 21276 - DNA, 334 bp, Homo sapiens
  chr15.fa.O7frz.33359604
  Located on chromosome 15
  Distance between a terminus base of telomere on chromosomal short arm and 5'-terminus of this base sequence : 32363601
  Distance between 3'-terminus of neighbour sequence of sequence listing upward to telomere on chrosomal short arm and 5'-terminus of this base sequence : 28562
atcaaatacaccatgtagtctgtattagtcagggttccctagagggacagaatatatatatatatatatatatattacataaaatatattaagtattaatttacatgatgacaaggtcccacaataggctgtctgcaagcttgaggagcaaggagagcgtctgagtctcaaaactgaagaacttggagtcccatgttcgagggcaggaaacatccagcatgggagaaaggtgtgggctgcgatgctatgcccgtcttgccttttcatttttttctgctgtttatattcgctggcagctaattagattgtgcccaccagattaaggttgagtctg

SEQ ID NO: 21277 - DNA, 459 bp, Homo sapiens
  chr15.fa.O7frz.33015468
  Located on chromosome 15
  Distance between a terminus base of telomere on chromosomal short arm and 5'-terminus of this base sequence : 32531352
  Distance between 3'-terminus of neighbour sequence of sequence listing upward to telomere on chrosomal short arm and 5'-terminus of this base sequence : 167417
actaaactccatcaacttccaccaacacatacacacacacacacacacacacacacacacacactctctctctctctctctctctctgtctttcgtggaactatataacttcttataaaacccaaatgccaacatcttgttttgatgctctctccattggccctacctagaataaacagtctgccctgagcaaactttcccttcatgctcaatcactcctgtgtgtcccatgtatcctctgctttcctctgctatattacttattgtacaatactaagattggtacttttagtttccttccctgtaaccacactgtcagattactgagggtagagctatatctgatttatttttctatccctagctcttgatgcagagcctaggatatagtaaactcacaatgcaaacatttgaatgactggctgaatccattcaacagatcagcactacatcagtgat

SEQ ID NO: 21278 - DNA, 254 bp, Homo sapiens
  AC025542.5_41798
  Located on chromosome 15
  Distance between a terminus base of telomere on chromosomal short arm and 5'-terminus of this base sequence : 32777966
  Distance between 3'-terminus of neighbour sequence of sequence listing upward to telomere on chrosomal short arm and 5'-terminus of this base sequence : 246155
ctaatatctttccgcaaagatcaccatgacaatgaccagaataataaatatctataatcacatgcaatctttagctttagtaatagagtgtgacagagaactctgctgctgctgctgctgctgctgctgctgctgctgctgctgctgatagtgatggcgatgataaggaagacacaagataatctgaccttcctcagcctctgatggctgattacaggtagatgtggcttctgaagcaaagttacataattcac

SEQ ID NO: 21279 - DNA, 418 bp, Homo sapiens
  chr15.fa.O7frz.34094416
  Located on chromosome 15
  Distance between a terminus base of telomere on chromosomal short arm and 5'-terminus of this base sequence : 32909296
  Distance between 3'-terminus of neighbour sequence of sequence listing upward to telomere on chrosomal short arm and 5'-terminus of this base sequence : 131076
atccactgagtttatttgacatacatatatcttctttggtgaagtgttcattgaaatctttaatagatagatagatagatagatgtgtatatatatatttaaactgggatgttcgctttctttttttaagttctggggtacatgtgcaaaacatgcaggtttgtcacataggtatacacgtgccatggtggtttgctttacccatcaacccttcatctacattaggtaattctcctaatgctgtccctcccccagcccctcaccctcaccccactgacaggccccaatgtgtgatgcccctcccccatgtccacgtgttctcattgttcaactcccacttatgagtgagaacacgtggtgtttgatttcctgttcttgtgttagtttgctgagaatgatggtttctagtttcatccat

SEQ ID NO: 21280 - DNA, 417 bp, Homo sapiens
  chr15.fa.O7frz.34445389
  Located on chromosome 15
  Distance between a terminus base of telomere on chromosomal short arm and 5'-terminus of this base sequence : 33211336
  Distance between 3'-terminus of neighbour sequence of sequence listing upward to telomere on chrosomal short arm and 5'-terminus of this base sequence : 301622
atttctgtaattggagcagatcaaacgtgggtattctagctcaattcccctcttctcaggcatacataaccatcacatgtatttatttattttgcatgatgtgtgcgtgtgtgtgtgtgtgtgtgtgtgtgtgtgtgtgcatgcacgtgcctatgttggtggggatacatgtatggacagagaagccaatctgatttttcttgatagcatttgagcacatgttcttcagggtccactcattaattcctaaactctttggactggcatttggatcattccataagaattctctctggagacagattaaaatagatatgtccaggtcccacctgaaggttcagagtcagtagagttagggctcatatggggaatctgtatttttaagatctccccaggttacactgatgctagatttgg

SEQ ID NO: 21281 - DNA, 306 bp, Homo sapiens
  chr15.fa.O7frz.34524483
  Located on chromosome 15
  Distance between a terminus base of telomere on chromosomal short arm and 5'-terminus of this base sequence : 33297627
  Distance between 3'-terminus of neighbour sequence of sequence listing upward to telomere on chrosomal short arm and 5'-terminus of this base sequence : 85874
actcgctgtaggacctataaaccaattattcaaccactctgggcttcagattttcattcgtcagatgagggcagaaggattaatgcattgaatatatgtgaactaactggagcagggcctgactcatatgaagcattctgttaaccatcatcaccatcaccactaccaccaccaccaccatcatcatcatcatgatcatcatcatcatcaatttatcctcaatcagaaggtcatggaagcagattcagaaaatgggtaggcattaagggaggataagcagcaggattaatagcaaagtttacgctg

SEQ ID NO: 21282 - DNA, 412 bp, Homo sapiens
  chr15.fa.O7frz.34639752
  Located on chromosome 15
  Distance between a terminus base of telomere on chromosomal short arm and 5'-terminus of this base sequence : 33412314
  Distance between 3'-terminus of neighbour sequence of sequence listing upward to telomere on chrosomal short arm and 5'-terminus of this base sequence : 114381
catgattaattggcagtaagagcaacaaatatatttactatagtaaaaaagtcattgataaatatagaacattttacatcttcaccctgtggagaattagttgcacatgcatgtttatagcagcacaattcgcaaatgcaaaaaatgtggaaccaacccaaatgcccatcaatcaatgagtggataaagaaactgtgatatacatatgtgtatacacgtatacagatatacacatatatatacatctatatacacatatatacatatatatacacatatatatataaatacacacacacacacacacacacacacaagggaatactactcagccataaagaggaacgaattaatggcattcacagcaacctggatggaattggagagcatctaagcgaagtaattcaggaat

SEQ ID NO: 21283 - DNA, 418 bp, Homo sapiens
  chr15.fa.O7frz.34711228
  Located on chromosome 15
  Distance between a terminus base of telomere on chromosomal short arm and 5'-terminus of this base sequence : 33483808
  Distance between 3'-terminus of neighbour sequence of sequence listing upward to telomere on chrosomal short arm and 5'-terminus of this base sequence : 71082
aagctcatagtgtcacattgaggctgatggctgcatgcggcagggcctggctccaattcctgtgcagatgtctcttctctctcccagaaccacaagcaatcaggtccaatgatcagtagttagtggagttttttcatgttcaatttactgttagaagctgtgaatactgatttcggctttctctgagaagtccatcacacgtgttctgccttttgtggaataagcaatgccttcatcagcaaatggtcttagaagctgtctccaatatttttgtgtctctgtgtgtgtgtgtgtgtgtgtgtgtgtgtgtgtgtgtgtatacgcttagtatatgtgtatatatatgtcctgtgtgtgtatacacatttagtatgtgtgtgtggatatgttctgtgtgtttcttatgagctaattgcct

SEQ ID NO: 21284 - DNA, 362 bp, Homo sapiens
  chr15.fa.O7frz.35109424
  Located on chromosome 15
  Distance between a terminus base of telomere on chromosomal short arm and 5'-terminus of this base sequence : 33595490
  Distance between 3'-terminus of neighbour sequence of sequence listing upward to telomere on chrosomal short arm and 5'-terminus of this base sequence : 111264
gactccaagttctaaggtctttacttaaccccttgcctactgtgcaatattacaaatggaatcatgcgtcaattctgaatcccgactggcaggccaattgtgggtagtcagtaaacttacagtggatgaatgaatgaacaacaacctgaaggaagcttctactatccccacccaccccccaccacacacacacacacacacacacacacacacacacagagtttattcttcgaactggaatttgtaaagacagcttggtttcccagatgcatccaactcatcaggtactacaaattctgtaaccaggccccaatttagggatactacaactatgcatcatgtaatcatgtaggtcctccagt

SEQ ID NO: 21285 - DNA, 231 bp, Homo sapiens
  chr15.fa.O7frz.35196775
  Located on chromosome 15
  Distance between a terminus base of telomere on chromosomal short arm and 5'-terminus of this base sequence : 33688819
  Distance between 3'-terminus of neighbour sequence of sequence listing upward to telomere on chrosomal short arm and 5'-terminus of this base sequence : 92967
cttaagcctttgtatcagcactccagggaagagtctgtacttcccctgccctccctgcaaccccaaactacagttcctgatcttgctcaccttcgacttcccaaaagcccccaaattgttggtcttgcgccccccacactttaaaaccagcatctctttcctccacctctctctctctctctctctctctctctcatgctctctggaaagtaatcctgttgtccttcattt

SEQ ID NO: 21286 - DNA, 357 bp, Homo sapiens
  chr15.fa.O7frz.35305454
  Located on chromosome 15
  Distance between a terminus base of telomere on chromosomal short arm and 5'-terminus of this base sequence : 33804009
  Distance between 3'-terminus of neighbour sequence of sequence listing upward to telomere on chrosomal short arm and 5'-terminus of this base sequence : 114959
ggacattactagaaatgaacagagaaaggcctcattcaatagacacactcatatagtaccataatgtattgttaagtgaaaaagcaggctataaaatgtatgtagaatatgatcctggtttgtaaaaagacaaaaaaaggaggaaggaaggagaggagagggaaggagattgaagaagagaggaaaggaggagggggaaggggtgtctgtgtgtgtgtgtgtgtgtgtgtgtgtgtgtgtgtgtgtgtgtgtgtgtgtgtgtgttgggatgggggaaggtaagcatttggggtatgtgtgaatagggaaaacctcagacaggatcatgaccaagtgttaactatgcttgtatgcata

SEQ ID NO: 21287 - DNA, 271 bp, Homo sapiens
  DISO7_10004002
  Located on chromosome 15
  Distance between a terminus base of telomere on chromosomal short arm and 5'-terminus of this base sequence : 34100358
  Distance between 3'-terminus of neighbour sequence of sequence listing upward to telomere on chrosomal short arm and 5'-terminus of this base sequence : 295992
gctgccaggagcttacagtccatccatccatccatccatccatccatccatccatccatccattcatccatccatccatccatccatccatccacccacccatccacccatccatccacccacccatccatccacctgtccatccacccgtccatccacccatccatccactcgtccatccgtccgtccgtccatccatccatccatccagccatccatccatccatccatccaaagaatgtgcaaaccaacccctatcttgggcaaggtg

SEQ ID NO: 21288 - DNA, 266 bp, Homo sapiens
  D15S214
  Located on chromosome 15
  Distance between a terminus base of telomere on chromosomal short arm and 5'-terminus of this base sequence : 34240500
  Distance between 3'-terminus of neighbour sequence of sequence listing upward to telomere on chrosomal short arm and 5'-terminus of this base sequence : 139871
ggagggcacttcctgagaacagggccagggaatgctttattcctagcaaaggaactcaagccccgctgcagccatcccaacccctaagggctggaagagggatgctgaacttagactcctcctcctcttaggagaaggcagtagtcagacacccagatcctcgacagtgactaggaacacacacacacacacacacacacacacacacaccccagacctgggtgactccaggagagagtctcggcctccgagtcgtgatgccaggg

SEQ ID NO: 21289 - DNA, 218 bp, Homo sapiens
  D15S994
  Located on chromosome 15
  Distance between a terminus base of telomere on chromosomal short arm and 5'-terminus of this base sequence : 34422396
  Distance between 3'-terminus of neighbour sequence of sequence listing upward to telomere on chrosomal short arm and 5'-terminus of this base sequence : 181630
ctcctaagggcaaagtcagggcctggggccaccccttcctacttgtgaagagagagagagagagagagagagagagagagagagagagagtgtgtgtgtgtgtgtgtgtgtgtgtgtgtttaggaaggacacagcccttacacacctgcttgatcacctgcactacttcctggatgtgggagttgttaatctctctcttcaacctgttggtgtaattg

SEQ ID NO: 21290 - DNA, 306 bp, Homo sapiens
  AC019054.4_40015
  Located on chromosome 15
  Distance between a terminus base of telomere on chromosomal short arm and 5'-terminus of this base sequence : 34579946
  Distance between 3'-terminus of neighbour sequence of sequence listing upward to telomere on chrosomal short arm and 5'-terminus of this base sequence : 157332
tagcatacacctgtaattccagctactcaggaggctgagacaggagaattgtttgaacccaggagacagaggttgcagatcgcgccagtgcactccagtctgggcgacagagcaagactctgtctccagaataaataaataaataaataaataaataaataaataaataaataaataaataaaaataaaaatgattgaataactgagagatgatttccagagaaattgaaaggacttgaatttatttggcccagagggaggtagacaaggggcagttaatatgtctttgcatgttaagatgacagt

SEQ ID NO: 21291 - DNA, 224 bp, Homo sapiens
  AC019054.4_124732
  Located on chromosome 15
  Distance between a terminus base of telomere on chromosomal short arm and 5'-terminus of this base sequence : 34702341
  Distance between 3'-terminus of neighbour sequence of sequence listing upward to telomere on chrosomal short arm and 5'-terminus of this base sequence : 122089
cacgtcttcagtaccgagttccgagctcagcccctggcctactatgaggccgcggtccgggcgggccgcctgcaactcaacgagaagccggtgcaggacctcaacatcgtgctcaaggtggagtcctgatggggctggccagaagcgggcgaggaaaaggggccgggttttgttttgttttgttttgttttttagtcttagtaaagcataggtactggattaaa

SEQ ID NO: 21292 - DNA, 448 bp, Homo sapiens
  chr15.fa.O7frz.36498985
  Located on chromosome 15
  Distance between a terminus base of telomere on chromosomal short arm and 5'-terminus of this base sequence : 34984777
  Distance between 3'-terminus of neighbour sequence of sequence listing upward to telomere on chrosomal short arm and 5'-terminus of this base sequence : 282212
tataaagatactttgtcgttggatttggggcctaaccagctaatccaggatgatcgcatctggagatcctaattacttctgcaaagacccttttcccaaatcaggtcacgtttatgggttccaggggttagatgtgaacatatctttgaggggccaccattcagccccctacaggcagcgatcctgcactgtgcttgtcacccacccccatgcctgaccctgaggtggggaagcctcagacacaggcactgtcaagtcaaggaagggcgtggctcccgggaccccttgtaactggaggccgagtctgtctgaggtatttctattgtagaaaatagaaataagcctatcccctcaagtaagtgtctgtgtgtgtgtgtgtgtgtgtgtgtgtgtgtgtgtttactcaataagatcagatggcagtttgttcagtaatttgcttcagaaa

SEQ ID NO: 21293 - DNA, 404 bp, Homo sapiens
  chr15.fa.O7frz.36582927
  Located on chromosome 15
  Distance between a terminus base of telomere on chromosomal short arm and 5'-terminus of this base sequence : 35105411
  Distance between 3'-terminus of neighbour sequence of sequence listing upward to telomere on chrosomal short arm and 5'-terminus of this base sequence : 120186
ctcgcagatacttgtccaggctgggcctcactcattgatctctgcaggtgtggtccagccagccaggtgctcattgctcctggccctcagcccccaccgtgccgatcattgaggggttcattggcaataaagctggggttgtggtggtccagatcattctccttgaggtcaactttgaggtctggatgttggatgaggcccactaggggcaggtgtcactggaggtaaagggacagccctaggaccacctcttccaaggcgcagagggtggcccccagtctagagccatgcttcatgccacatatgcagagggcacacacacacacacacacacacacacgactcttgaagattaagctacaatgtttcatttattatagcttagccaactttagcaattatgt

SEQ ID NO: 21294 - DNA, 277 bp, Homo sapiens
  DISO7_10004006
  Located on chromosome 15
  Distance between a terminus base of telomere on chromosomal short arm and 5'-terminus of this base sequence : 35190853
  Distance between 3'-terminus of neighbour sequence of sequence listing upward to telomere on chrosomal short arm and 5'-terminus of this base sequence : 85038
atgcagagatcatgtcacgtcatatttaaaacctctcatatattggacgggtggctcatccctctaatcccaacacctggggaggccgatgcgagaggatcgcttgaagccaggagttcaagactagcctgggcagcaaagcgagaccttgtctctattaaaaaaattaaataaaacttctcatatcttgattttattcatatatacaagtctgtgtgtgtgtgtgtgtgcgtgtgtgtgtgtgtgtgtgtgtgtacttaacccaatgcattgagtt

SEQ ID NO: 21295 - DNA, 246 bp, Homo sapiens
  chr15.fa.O7frz.36932254
  Located on chromosome 15
  Distance between a terminus base of telomere on chromosomal short arm and 5'-terminus of this base sequence : 35302055
  Distance between 3'-terminus of neighbour sequence of sequence listing upward to telomere on chrosomal short arm and 5'-terminus of this base sequence : 110925
accaggacgatctatcatctacatttctggttgcagtgagctgagatcacatcactgcactccagtctgggcgaaaatagcgaaagtctgtttcagaaaaaataataattatatatatatatatatataatctacatttccgatcatctcacttccttgttcataactggcactcactctgccagttgagttgttcctgctaactagagttctgccatagccctctatcctatttccaagcttagt

SEQ ID NO: 21296 - DNA, 360 bp, Homo sapiens
  chr15.fa.O7frz.37214710
  Located on chromosome 15
  Distance between a terminus base of telomere on chromosomal short arm and 5'-terminus of this base sequence : 35597391
  Distance between 3'-terminus of neighbour sequence of sequence listing upward to telomere on chrosomal short arm and 5'-terminus of this base sequence : 295090
gaatctcaggtaggagattcagtgttcctcattgtccaaagaataaacctgttttgagtgtgtgtgtgtgtgtgtgtgtgtgtgtgtgtgtaaaaggtggatttatattaatcagcctaagtttataagacttgtgacatggtttcattaatctctggacatatcaccattagctgtgctgttaaatccttagcactttttcctttgctttcctttttccttttcttttttctttcttctttctttttcccttttcttcccctcccttcctccttcccccttcccttcctccttcccttcctcttccctttccctggtctcattatgttgcccgggctagaatacagtggctattcactg

SEQ ID NO: 21297 - DNA, 164 bp, Homo sapiens
  Z66932
  Located on chromosome 15
  Distance between a terminus base of telomere on chromosomal short arm and 5'-terminus of this base sequence : 35597402
  Distance between 3'-terminus of neighbour sequence of sequence listing upward to telomere on chrosomal short arm and 5'-terminus of this base sequence : -349
aggagattcagtgttcctcattgtccaaagaataaacctgttttgagtgtgtgtgtgtgtgtgtgtgtgtgtgtgtgtgtaaaaggtggatttatattaatcagcctaagtttataagacttgtgacatggtttcattaatctctggacatatcaccattagct

SEQ ID NO: 21298 - DNA, 316 bp, Homo sapiens
  chr15.fa.O7frz.37357585
  Located on chromosome 15
  Distance between a terminus base of telomere on chromosomal short arm and 5'-terminus of this base sequence : 35684029
  Distance between 3'-terminus of neighbour sequence of sequence listing upward to telomere on chrosomal short arm and 5'-terminus of this base sequence : 86463
tctggcattacaagaaagtaaggaaatagctcctcttgtatatttcctgccccaatcctagaatcagtcatttcttcaaggactcttgaagaagttattagagaataactgttattggagaatggtattagaaaccgagatctgggccaggcacagtggctcacacttgcaatcccaacactttgggaggcctagatgggaggacagccagaggccaggagtttgagatcagcttggtcaacaaagggagaccctcatctctaataataataataataataataataatattaaactaagatctgcgtggtaagta

SEQ ID NO: 21299 - DNA, 421 bp, Homo sapiens
  chr15.fa.O7frz.37427788
  Located on chromosome 15
  Distance between a terminus base of telomere on chromosomal short arm and 5'-terminus of this base sequence : 35805320
  Distance between 3'-terminus of neighbour sequence of sequence listing upward to telomere on chrosomal short arm and 5'-terminus of this base sequence : 120975
tttactatctgttcctttacaggaaaaatttgccaacctctgatttaagggtttaaaaaattatatacacatgcgtgtgcacacacacacacacacacacacactattttcccattttctattcagttactgatatatgattgctctgtcattctttgttttagctaatgttattggtaaacacactgatctttattcaggctttatttgctacatttgcggttgcttgaccatttttctcctactttaaactcttatttttgcttccttggcttttaccataccattcacgtggttctcctaactcttgattttttcccttctttcagttattcttactgactccttatattataatatattcagatatttattacatgaaggttatttcctagtattatgctctcgtagtccttagttt

SEQ ID NO: 21300 - DNA, 427 bp, Homo sapiens
  chr15.fa.O7frz.37669814
  Located on chromosome 15
  Distance between a terminus base of telomere on chromosomal short arm and 5'-terminus of this base sequence : 36047568
  Distance between 3'-terminus of neighbour sequence of sequence listing upward to telomere on chrosomal short arm and 5'-terminus of this base sequence : 241827
agtagatgtggccagtatcactctttagtacatgtgtctcagtcttggagacacacacacacacacacacacacacatcattggacacaatgagatctgtgtcagagtgtaagtgtgaactacatatacattcatatacatttaaaagggaggactttcctttctgctcattgagttattagcctagagaaaaactgtcattttgtcattttgatgacatttagtagagacggggtttcaccatgttagccaggctggtctcgaactcctgacctcaagtgatctgcccgccttggtttcctgaagtgttgggattacaggtgtgagccaccgtgcccagcctatagacaagaaagccaggctgtgcacatcacatgtgactgagaagagtctacatttgaaagaataagctaaattccacagaact

SEQ ID NO: 21301 - DNA, 236 bp, Homo sapiens
  chr15.fa.O7frz.37993220
  Located on chromosome 15
  Distance between a terminus base of telomere on chromosomal short arm and 5'-terminus of this base sequence : 36370484
  Distance between 3'-terminus of neighbour sequence of sequence listing upward to telomere on chrosomal short arm and 5'-terminus of this base sequence : 322489
actacatatgaacttgtcctcaagagcgaatgctctcatatgtatatatatatatgtgtgtgtgtgtgtgtgtgtgtgtgtgtgtatgtatgtatcacatatgtataccatataaaaggtgctctctattatacacacagacacatatatggtatatatagagagcactcagcctgctctcctatagtaaaagagctttttctggtcaggcgtggtaattcacacctgcaatagtg

SEQ ID NO: 21302 - DNA, 232 bp, Homo sapiens
  Z66730
  Located on chromosome 15
  Distance between a terminus base of telomere on chromosomal short arm and 5'-terminus of this base sequence : 36471810
  Distance between 3'-terminus of neighbour sequence of sequence listing upward to telomere on chrosomal short arm and 5'-terminus of this base sequence : 101090
gaaatcagttgccaaccacccccctccaacacacacacacacacacacacacacacacacacacacacacacacacacacagttatttaatcaggcagacatttttcagtgtctgggttatctggtttggggaacatacaggaatattgatcttgaaataaagcctctgacctttcgacaagaaagtaatattctaagagcccattgtcagatccccaaacaggctgaatta

SEQ ID NO: 21303 - DNA, 448 bp, Homo sapiens
  chr15.fa.O7frz.38468717
  Located on chromosome 15
  Distance between a terminus base of telomere on chromosomal short arm and 5'-terminus of this base sequence : 36797256
  Distance between 3'-terminus of neighbour sequence of sequence listing upward to telomere on chrosomal short arm and 5'-terminus of this base sequence : 325214
ttgcagtgacttctctgtttagattaaaaggagagtgtatgaattcattggtttttgtttatcctttaacacacacacacacacacacacacacacacacacaccccatacgtacactgttttaaaaaggcaatgtaattaggcagtataggcttagtcacaatacaggaaggttagtacctactacctatacatgccctggcttttgtgttacctgcttgacctctagggaaatgattctcaaactttagtgtgtatccgaatcacctggagggtttgttagaatgctgctgggccccagtccttcagagtttctgatttatttggtctggggtgggccaaactgtgcgtttctaacaagttcttaggtgaagtgggtgctgcgggtcctgggaccacaacttgagaatgactgctgtagagactactccaaaggagtaatctacct

SEQ ID NO: 21304 - DNA, 219 bp, Homo sapiens
  X69858.1_184
  Located on chromosome 15
  Distance between a terminus base of telomere on chromosomal short arm and 5'-terminus of this base sequence : 36970842
  Distance between 3'-terminus of neighbour sequence of sequence listing upward to telomere on chrosomal short arm and 5'-terminus of this base sequence : 173138
gatcaagatgaaccatggtttttaaactttgagggtgactataattcagggtgtgtgtgtgtgtgtgtgtgtgtgtatgtgtgtgttttcagggtcagaggtagtgtcagaaaaaatagaaaggtttccctcttctccccactatagccattattccaatattccttttctgaatttctttcctctgctccctcgacctaactccactaccatctaaag

SEQ ID NO: 21305 - DNA, 210 bp, Homo sapiens
  DISO7_10004010
  Located on chromosome 15
  Distance between a terminus base of telomere on chromosomal short arm and 5'-terminus of this base sequence : 37288541
  Distance between 3'-terminus of neighbour sequence of sequence listing upward to telomere on chrosomal short arm and 5'-terminus of this base sequence : 317480
gcgataagctgtgctcagaaattagtttcttaaacacacacacacacacacacacctgtcaatttctgcaactttatgatttgatgacagttgttaactatttaatcttctaatattaagacttaatttgaaacactaaataatttttcagaaaacatatgtagttattttcattatcttttttatcccccctacagagacaggttgagt

SEQ ID NO: 21306 - DNA, 174 bp, Homo sapiens
  DISO7_10004011
  Located on chromosome 15
  Distance between a terminus base of telomere on chromosomal short arm and 5'-terminus of this base sequence : 37391327
  Distance between 3'-terminus of neighbour sequence of sequence listing upward to telomere on chrosomal short arm and 5'-terminus of this base sequence : 102576
gtggcacaagctcaagagagaaggccccatcattaacgcttttctccccactgctcagaaggccctgagagagagagagagagagatacgagacagagacagggaaaacagtcgactggccctcctggatcccatggcagggtctctccacctggctgatgggtgagcattctc

SEQ ID NO: 21307 - DNA, 446 bp, Homo sapiens
  AC009825.3_4485
  Located on chromosome 15
  Distance between a terminus base of telomere on chromosomal short arm and 5'-terminus of this base sequence : 37430107
  Distance between 3'-terminus of neighbour sequence of sequence listing upward to telomere on chrosomal short arm and 5'-terminus of this base sequence : 38606
aacagccatctgcatgtatagaaagaaagaaagaaagaaagaaagaaagaaagaaagaaagaaagaaaaagaaagaaagaaaaagacattgaaacagccatctgcatgtgatgagctccgcgatgcaaagctcctgtcctctgacaccaaaacccaagacagccctgccctcactcacgcctccatctctccactcgggtcttggctcagcagtaaccactgcacaggggctttctttggccaccaagcatgatgctttacttcccaccatgtggtcactttctatcacaacaccctctctgttttcttcagggcacttaatatctagaattggttccacaaaagcaagagacctcagccatcttcaaatgcagattcccctgcctagaaaggagcctggtgcctaactgcagatatgcatggctaatgttcgtggaatacttacc

SEQ ID NO: 21308 - DNA, 446 bp, Homo sapiens
  chr15.fa.O7frz.31657381
  Located on chromosome 15
  Distance between a terminus base of telomere on chromosomal short arm and 5'-terminus of this base sequence : 38528914
  Distance between 3'-terminus of neighbour sequence of sequence listing upward to telomere on chrosomal short arm and 5'-terminus of this base sequence : 1098361
cagaactctttacattgcaaagccaaacaaatgactcgggcaagtataattgaataaatcctgggcttcagtgcagatggctgtttttactgtctgtctatgtcaggatctgctgaaggttctttagttcgtgtgtgtgtgcacgtgtgtgtgtgtgtgtgtgtgtgtagaaggcttttttatatgagatttggcatattgcatgtggcaggctgttgaaaaatgaataaagacaggggaaaaaaggcaatgcacatcccattggtaatgaaggaaagcaggttgctgactgcccatgtgccagttctccaggtttgcccaggggctcccaagatcatttctttgcccccagattttcatgttgaattaccgctcacagtttctaaatgaacatgcttcttattttatttaagacacagtgggcacttgtatttgacttcctgcta

SEQ ID NO: 21309 - DNA, 118 bp, Homo sapiens
  chr15.fa.O7frz.31912832
  Located on chromosome 15
  Distance between a terminus base of telomere on chromosomal short arm and 5'-terminus of this base sequence : 38703930
  Distance between 3'-terminus of neighbour sequence of sequence listing upward to telomere on chrosomal short arm and 5'-terminus of this base sequence : 174570
tgatcctgacagcacctactactaccaccatctttgtatgtgtgtgtgtgtgtgtacgtatacatagcaacatgtacagctaatcataaaagctttctgcttgttaatactaaggcaa

SEQ ID NO: 21310 - DNA, 281 bp, Homo sapiens
  chr15.fa.O7frz.32030733
  Located on chromosome 15
  Distance between a terminus base of telomere on chromosomal short arm and 5'-terminus of this base sequence : 38925720
  Distance between 3'-terminus of neighbour sequence of sequence listing upward to telomere on chrosomal short arm and 5'-terminus of this base sequence : 221672
aagcctttgagttcaagtttacagtgaactgtggtcattccactgcattccagcttgggtgacagagtgagaccctgtctctaactaaaataggtaggtaggtaggtaggtagatagatagatagataggtaggtagatagatagatagatagatagatagatagatagatagatagatagatagatatgagcatttaaagtctcaaaaggtgtgacgaacttgctgcctactcctaggcttagctgtacaaaaaactcctcaacgttaaattgaaccata

SEQ ID NO: 21311 - DNA, 183 bp, Homo sapiens
  chr15.fa.O7frz.32224594
  Located on chromosome 15
  Distance between a terminus base of telomere on chromosomal short arm and 5'-terminus of this base sequence : 39107788
  Distance between 3'-terminus of neighbour sequence of sequence listing upward to telomere on chrosomal short arm and 5'-terminus of this base sequence : 181787
agtaagatcaaatgtcaaagacatcggttattttggtgcacttcagctaccttttccgtttccagcaaaattgagaagtacgaccccaaaaagaatagacacacccatggaaaagacgtgtgtgtgtgtgtgtgtgtgtgtgtgtgtgtgtgtgtgtgtgtagctatggtgacaacttttaaa

SEQ ID NO: 21312 - DNA, 442 bp, Homo sapiens
  chr15.fa.O7frz.32385621
  Located on chromosome 15
  Distance between a terminus base of telomere on chromosomal short arm and 5'-terminus of this base sequence : 39271418
  Distance between 3'-terminus of neighbour sequence of sequence listing upward to telomere on chrosomal short arm and 5'-terminus of this base sequence : 163447
tgaatcctgttaactgttgaacagaaacatcctcatactggtccttgaccaaatcagtcccctcaatttacccgttaggaaccataaaatggctttgtttattgactggaacagtctaatcctttatagcagaagagaatgaaagcttccaacacttttagcctattcttcactaaatgtggttattctcgtttaaaaaatatatatatatatatatatttaattcattgtcatttgaaatatatatatatattgcttaccaattttaaaatatttaagaaaggatctctgttctcctaagtctcccattgaattctctaaaggatactgactgaccctagtagaaaagtacattcctctgccattataattcagcagattgcttaatctctgtggtgcaggataaaagaatgtacttgttactcagttacctgataagcac

SEQ ID NO: 21313 - DNA, 381 bp, Homo sapiens
  chr15.fa.O7frz.32495979
  Located on chromosome 15
  Distance between a terminus base of telomere on chromosomal short arm and 5'-terminus of this base sequence : 39390909
  Distance between 3'-terminus of neighbour sequence of sequence listing upward to telomere on chrosomal short arm and 5'-terminus of this base sequence : 119049
tgcaaagatgcataattctaacccaggcactcattcattgcattgctcaaagagaccaggaatcaacaacctacatgcctatggggtacaagtgtaatgcataaatgcatatatttggccagatgtaaaattaaaaggaatgcagggattttgctactgtccataataaactagccttctcacagaacaaatgtaaaagattcattaaagaaaaaaagcacacaccacacacacacacacacacacacacacacagagagagagagagagagagagagagagagagagagagagagagagagaaaatagctgtttgaaggcattggagcaatcaaagcatccagaaaaaagggaaacacctttagatgagccagacctaat

SEQ ID NO: 21314 - DNA, 408 bp, Homo sapiens
  chr15.fa.O7frz.32729876
  Located on chromosome 15
  Distance between a terminus base of telomere on chromosomal short arm and 5'-terminus of this base sequence : 39587861
  Distance between 3'-terminus of neighbour sequence of sequence listing upward to telomere on chrosomal short arm and 5'-terminus of this base sequence : 196571
tgatactgaactatgcaacataacaaccataagaaagactgccctgaaagcaaataatatttacattatgggataatacagatatagatataattatacatgcatttatatatatatatatatatatatatatatatatatatatatatatatgtcttgaaggctatttagaaaatcatttagatatatgtggtaaatttatagcctcaagaactagaattttattttttcttttttatgctcacttcctcttattaacaaggaatgagtgaattattcacttaaatgaaggtcaaaatcagcccaataaacaaggaaaatgttgtgttttaacggaaaaaaatagcagctgtgaaatattacctatattatctctgaaacaatcttactaacagagtaggtgattgg

SEQ ID NO: 21315 - DNA, 191 bp, Homo sapiens
  chr15.fa.O7frz.32805655
  Located on chromosome 15
  Distance between a terminus base of telomere on chromosomal short arm and 5'-terminus of this base sequence : 39663642
  Distance between 3'-terminus of neighbour sequence of sequence listing upward to telomere on chrosomal short arm and 5'-terminus of this base sequence : 75373
attcaacagaaacttactgaacacatacttgttatctggaacagttttaggtactatcaattaaacagcaaataacatcaataaattccttgtacttgtacaggttatattcaaatggtgagaggcaggatacacacacacacacagacacacacacacatatcaggtggtcataagtgctatgccaataa

SEQ ID NO: 21316 - DNA, 222 bp, Homo sapiens
  DID22N_0010963
  Located on chromosome 15
  Distance between a terminus base of telomere on chromosomal short arm and 5'-terminus of this base sequence : 39765576
  Distance between 3'-terminus of neighbour sequence of sequence listing upward to telomere on chrosomal short arm and 5'-terminus of this base sequence : 101743
aatgtgataatgtccattcctggggtggggggaagtgataaaatgaatgaaacacagagagctctttggaagaaaggtgatctatctatccatatctgtatatctacctatccatctatcatctatctatctatctatctatctatctatctatctatctatctatctgtaatatagtggatgagtacaggtaaatttagagcacattaataagatgagcaa

SEQ ID NO: 21317 - DNA, 401 bp, Homo sapiens
  chr15.fa.O7frz.40681770
  Located on chromosome 15
  Distance between a terminus base of telomere on chromosomal short arm and 5'-terminus of this base sequence : 40342542
  Distance between 3'-terminus of neighbour sequence of sequence listing upward to telomere on chrosomal short arm and 5'-terminus of this base sequence : 576744
gagttctttatgactgaactcaatgggtctgtcaatcttggatgtacattaaaactatctagaggttttttaaaaaataacactatacctgggctccataccgagagattatggtttaattggcctggatgggagtctgggaagctggtgagttgttgttgttgttgttgttgttgttgttgttgttgttgttgttgttgctgtttttgagatggagtctcactctgtcactcaggctggagtgcaatggcatgatctcggctcactgcaacctctgcctccgaggttcaagcgattctcttgcctcagcctcctgagtagctgggattataggcacgtgccaccatgcctggctaatttttgtattcttagtagagacagggtttcaccatgttagccag

SEQ ID NO: 21318 - DNA, 214 bp, Homo sapiens
  chr15.fa.O7frz.40578075
  Located on chromosome 15
  Distance between a terminus base of telomere on chromosomal short arm and 5'-terminus of this base sequence : 40425075
  Distance between 3'-terminus of neighbour sequence of sequence listing upward to telomere on chrosomal short arm and 5'-terminus of this base sequence : 82132
ttgccttattcctgagtagagcacacacgctctctctctgtctctccatctctgtgtgtgtgtgtgtgtgtgtgtgtgtgtgtatctctttgtgtgtgtgtgtgtgttttaagataccctttgtaaggttaagttcccttatgttccctgctatgaggttttatcatgaatgggtattggattttattgaatgcctattctgtatctattgaga

SEQ ID NO: 21319 - DNA, 287 bp, Homo sapiens
  HUMUT477
  Located on chromosome 15
  Distance between a terminus base of telomere on chromosomal short arm and 5'-terminus of this base sequence : 40620048
  Distance between 3'-terminus of neighbour sequence of sequence listing upward to telomere on chrosomal short arm and 5'-terminus of this base sequence : 194759
ggtgacagagtaaggtcccttctcaaaaaaatgtgtctctgtgtctgtgtgtgtgtgtgtgtgtgtgtgtgtgtgtgtgtgtgtatgggaaaagctcataacattggatttggcaatggtttcttggtcatgacaacaaaaacacacataacaaaaagaaaaacagataaattgggtgtcaaaacccaaaatttttgagccaggtgccatggctcacacctataatcccacctacttgggaggctgaggcagaaggaccgttttgaccagtctgagcaacaaggtga

SEQ ID NO: 21320 - DNA, 463 bp, Homo sapiens
  chr15.fa.O7frz.40289797
  Located on chromosome 15
  Distance between a terminus base of telomere on chromosomal short arm and 5'-terminus of this base sequence : 40694508
  Distance between 3'-terminus of neighbour sequence of sequence listing upward to telomere on chrosomal short arm and 5'-terminus of this base sequence : 74173
ccttgtgatcgtatgagttaatacttaataaactcccctttattcagatcatatattattcaaattttaaaattctatctttttttatccttctaggactcaagttacacacattttaaattttatttatttatttaagatggagtcttgctttgtcatccaggctttattaatacttaataaactcccctttatatatatatgtgtgtgtgtgtgtgtgtgtgtgtgtgtgtatgcatatatatatgtgtgtatatatatacatatacaggctgtatatgtatatatatacatacaggctggtctcaaactcctgatctctcgatccgcccgccttggccttccaaagtgctgggattacaggcgtgagccactgtgccctgccaagaactgttttaaacagctggagattcagcagtgaacaaaacagaccaagttattgtcctacgaagcttacattctt

SEQ ID NO: 21321 - DNA, 420 bp, Homo sapiens
  chr15.fa.O7frz.40015203
  Located on chromosome 15
  Distance between a terminus base of telomere on chromosomal short arm and 5'-terminus of this base sequence : 40955277
  Distance between 3'-terminus of neighbour sequence of sequence listing upward to telomere on chrosomal short arm and 5'-terminus of this base sequence : 260306
tattcaaggaacataaccattaatgataatagaagacagcaataatatcacaatagtatctaacattttattgagtacatattatgggccgggcactaagctgaaatgctttatatctggcaatggcattggcaaacattttattttattttattttattttattttattttattttattttattttatttttatttagagagaagtctcactctgttgcccaggctggaatgcagtggtaccatcatatttcactgtggccttgaattcctgggctcaagggatccacccaccttagcctcccaagtagctgggactacaggcttgtgccaccatgcccggctaatttttaaattactggtagaggtgtctcactgtgttggtcaggctggtctccaactcctagcttcagagatcctc

SEQ ID NO: 21322 - DNA, 155 bp, Homo sapiens
  DISO7_10004012
  Located on chromosome 15
  Distance between a terminus base of telomere on chromosomal short arm and 5'-terminus of this base sequence : 41112373
  Distance between 3'-terminus of neighbour sequence of sequence listing upward to telomere on chrosomal short arm and 5'-terminus of this base sequence : 156676
gaccacatggcaactctgaaacacacacacacacacacacacacacacacacacacacacagacacacacacacacacacaacacacacacacacacacatgcacatacagactcgggcccaaaaaaatgtgtccccttagcaggtttagccttc

SEQ ID NO: 21323 - DNA, 132 bp, Homo sapiens
  DISD22_0009512
  Located on chromosome 15
  Distance between a terminus base of telomere on chromosomal short arm and 5'-terminus of this base sequence : 41555233
  Distance between 3'-terminus of neighbour sequence of sequence listing upward to telomere on chrosomal short arm and 5'-terminus of this base sequence : 442705
catatggattgtggaaatatagaagagtgtgagtgtgtgttttgtgttaggagaagctatcagagagagagagagtttgtgtgagagagtgtgtgtgtgtgtgtctgtgtgtagctgtatggtggatatggg

SEQ ID NO: 21324 - DNA, 231 bp, Homo sapiens
  Z66715
  Located on chromosome 15
  Distance between a terminus base of telomere on chromosomal short arm and 5'-terminus of this base sequence : 41694873
  Distance between 3'-terminus of neighbour sequence of sequence listing upward to telomere on chrosomal short arm and 5'-terminus of this base sequence : 139508
gtgaatgtgtacctgttctccatcagccccctcagcgtcctctcttgcctctttcctggcctcttccatgatgatgggtgagtaagtgcgaatgtgtgtgtgtgtgtgtgtgtgtgtgtgtgtgtgtgtgtgtgtgtgtgtgtgtataatggggaggattccttttgggtggaaagaaattatctggctccagaggagactgtcaccttctaggttacaggacagacagtg

SEQ ID NO: 21325 - DNA, 228 bp, Homo sapiens
  AC009700.4_30060
  Located on chromosome 15
  Distance between a terminus base of telomere on chromosomal short arm and 5'-terminus of this base sequence : 41746864
  Distance between 3'-terminus of neighbour sequence of sequence listing upward to telomere on chrosomal short arm and 5'-terminus of this base sequence : 51760
cataccacttctgacttaactgagcctgttccacagggattctctgggtaatgaggactcagatttcatccatctacttatctatccattcatccatccatccatccatccatccatccatccatccatccactcattcattcattcattcattcttcattcttcccataaactagcatctcttagttcttaagtcattgggggctgcaaagctgtataagatacttc

SEQ ID NO: 21326 - DNA, 401 bp, Homo sapiens
  chr15.fa.O7frz.41210383
  Located on chromosome 15
  Distance between a terminus base of telomere on chromosomal short arm and 5'-terminus of this base sequence : 42026744
  Distance between 3'-terminus of neighbour sequence of sequence listing upward to telomere on chrosomal short arm and 5'-terminus of this base sequence : 279652
catcttcactctatcctagacagtttacgttacttgcctcatgggacctatttccagaaatgtaatcacttgttctattgttccttgtgccatctctaaatgttctagaatatcagagctggaaagaagtaagtgtgtgtgtgtgtgtgtgtgtgtgtgtgtgtgtgtgtcagagctggaaagaagtgtgtgtgtgtgtgtgtgtgtgtgtgtgtgtgtgtgttgcccaggttgctcttgaactcctgggctcaactgatcctccagcctcagctgggattataggcacagccactgtactcagctctggaaaaagttttagcagccactagtttaagccccttgtaataaagaagagggaactcaagtttagagttcaggtatttgctttcaaggtcaaa

SEQ ID NO: 21327 - DNA, 204 bp, Homo sapiens
  chr15.fa.O7frz.41684560
  Located on chromosome 15
  Distance between a terminus base of telomere on chromosomal short arm and 5'-terminus of this base sequence : 42118606
  Distance between 3'-terminus of neighbour sequence of sequence listing upward to telomere on chrosomal short arm and 5'-terminus of this base sequence : 91461
gcatttcatagtccttgaaatccaatggccttatttttgctatgaatataacacacacacacacacacacacacacacacacacacacacacaaagtgtttaacactttctagatatagtttctttgaactaacttattcagagctacattttatgttcttttatcttcttaaattcttttggtctaacagactatgcaacacc

SEQ ID NO: 21328 - DNA, 378 bp, Homo sapiens
  chr15.fa.O7frz.41765869
  Located on chromosome 15
  Distance between a terminus base of telomere on chromosomal short arm and 5'-terminus of this base sequence : 42166191
  Distance between 3'-terminus of neighbour sequence of sequence listing upward to telomere on chrosomal short arm and 5'-terminus of this base sequence : 47381
ggtccagttattgtacttttgatcttcaaaatttctttttagattatttttaaggttgcttttttctctctgtctctctttctctctgtctctctttctctctctctttttccttctctctctcattctttctctctctctttttcaacaggatcttgctatgtttcccaggctggtctcaagtgacccccctgccttctgagtggctgtgactgcaggcattcaccactgtgcctggcttagatcttacatctattttttgatattttcattttgttcatacattgatttcttgattttctccacatcttccttttgttctttaagcatctttataataattgttttaaagtgtttgtctagtaggtctgccatcaa

SEQ ID NO: 21329 - DNA, 226 bp, Homo sapiens
  chr15.fa.O7frz.41872407
  Located on chromosome 15
  Distance between a terminus base of telomere on chromosomal short arm and 5'-terminus of this base sequence : 42303244
  Distance between 3'-terminus of neighbour sequence of sequence listing upward to telomere on chrosomal short arm and 5'-terminus of this base sequence : 136675
agttatggtccactgaggtaagtgttttttggactaatgcacctgtcagctcaagaataatttctccggatgctgttggaggggaaagaggaagatgttttacctatatcatcacattcagctgggttgtaccatatgtgcaggctcctacacacacacacacacacacacacagagttgcaggttgggttatttagaagaagatagtaagatggagttcaaggtg

SEQ ID NO: 21330 - DNA, 263 bp, Homo sapiens
  chr15.fa.O7frz.42130828
  Located on chromosome 15
  Distance between a terminus base of telomere on chromosomal short arm and 5'-terminus of this base sequence : 42474503
  Distance between 3'-terminus of neighbour sequence of sequence listing upward to telomere on chrosomal short arm and 5'-terminus of this base sequence : 171033
caatttgctatcaaccagataccaccatagagatgcagtatatttgggggaatcaaataaatagagaaaacaaataagggagggagggacaaatggcggggggcggtggggagagatagaggaggggagggagggagggagcgaaggggagagagagagagagagagagagagagagagtttcagtttctccaaagggccaggctaattggtacccattgtctagtgtactgctgttgaatttaaggttcaaatggaataggt

SEQ ID NO: 21331 - DNA, 184 bp, Homo sapiens
  D15S659
  Located on chromosome 15
  Distance between a terminus base of telomere on chromosomal short arm and 5'-terminus of this base sequence : 42620795
  Distance between 3'-terminus of neighbour sequence of sequence listing upward to telomere on chrosomal short arm and 5'-terminus of this base sequence : 146029
tatttggcaagaatagatacaggaatgctctcttcttataaaaatgctgaataaataaaacgtcttcccaacataacatattgcttaaactaagttctctgtatctatctatctatctatctatctatctatctatctatctatctatctatctatcatacctatctgtcatgtgtctatccac

SEQ ID NO: 21332 - DNA, 363 bp, Homo sapiens
  chr15.fa.O7frz.42532996
  Located on chromosome 15
  Distance between a terminus base of telomere on chromosomal short arm and 5'-terminus of this base sequence : 42942375
  Distance between 3'-terminus of neighbour sequence of sequence listing upward to telomere on chrosomal short arm and 5'-terminus of this base sequence : 321396
gaacaattcagtgaattctaagagactcagctacttttccttagaatggaaataaaaacacccatttctgaggttgggtaaataatatcgattttatatatatatatatatatatatatatatatatatatacacacacacacacacacacacacacactcacacacacatatatattatatatatacacatatatataaatatatttatataaaataaagataagtttctctcatgtatcagacccttggtgcaccatctctggagttacaccttcctatcaaattcttctagctgctttgtctcttcacagaaatagtcaatgcacacttgacatatctatgtatattcagcaccttgttt

SEQ ID NO: 21333 - DNA, 465 bp, Homo sapiens
  chr15.fa.O7frz.42739553
  Located on chromosome 15
  Distance between a terminus base of telomere on chromosomal short arm and 5'-terminus of this base sequence : 43089485
  Distance between 3'-terminus of neighbour sequence of sequence listing upward to telomere on chrosomal short arm and 5'-terminus of this base sequence : 146747
taggaagtggtgaacatactaaatagtatttcctttttaaccacaaattttaaaagtatattttagctctttatgcatgcatttaatatatttatttatttatttatttatttgagacggagtttcactcatgttgccaggctggggtgcaatggcgcaatctcggctcactgcaacctccacctcccggaaagcaattctcctgcctcagcctcctgagtagtgagattacaggcgcccgccaccacgcccagctaatttttgtatttttagtagagacggggtttctccatgttggtcagcttggtctccaactcccgacctcaagtgatcctcccacctcggcctccccaaatgctgagattacaggcgtgagccactgcacccaacctattttttgttggtggtggttgagagtacttttgaaaagtttataaaaatctactgaactctttccaaatagtg

SEQ ID NO: 21334 - DNA, 376 bp, Homo sapiens
  chr15.fa.O7frz.42846793
  Located on chromosome 15
  Distance between a terminus base of telomere on chromosomal short arm and 5'-terminus of this base sequence : 43196640
  Distance between 3'-terminus of neighbour sequence of sequence listing upward to telomere on chrosomal short arm and 5'-terminus of this base sequence : 106690
tgtttagcctgaatctatgaacaacctttgtgtacgtggccagatgctgacagatgaaagtaaacacagaagccaaaaaataaaaagaaaaatctcatcagctcagctgagaaaagggtgtgtgtgtgtgtgtgtgtgtgtgtgtgtgtgtgtgtgtgtttcatttcaggccaattcaaaactaacagagatagtcatgaggtagtttacatcatgatataacctcatgggttctgcaaccatggtttttgttcagtaatcactagttgagtatttactgtgtgccaggcactgaaataggcattatgaaggatacaaaatattacagagacaaaaaaaggaagtccacaactgactgttaccaatttagtcttaa

SEQ ID NO: 21335 - DNA, 137 bp, Homo sapiens
  chr15.fa.O7frz.42973770
  Located on chromosome 15
  Distance between a terminus base of telomere on chromosomal short arm and 5'-terminus of this base sequence : 43351550
  Distance between 3'-terminus of neighbour sequence of sequence listing upward to telomere on chrosomal short arm and 5'-terminus of this base sequence : 154534
gataacttgtttggcttgattatgcaccacagattcacacccctcccaccccctcacacacacacacatgcgtgcacacacacacacacacacacacacacacacgcactgctgccttaaagtgcctctaaacttcc

SEQ ID NO: 21336 - DNA, 192 bp, Homo sapiens
  Z17186.1_107
  Located on chromosome 15
  Distance between a terminus base of telomere on chromosomal short arm and 5'-terminus of this base sequence : 43447902
  Distance between 3'-terminus of neighbour sequence of sequence listing upward to telomere on chrosomal short arm and 5'-terminus of this base sequence : 96215
ttactgaggattgtctcactgatgttcatcagggatattggcctgaagtggtgtgtgtgtgtgtgtgtgtgtgtgtgtgtgtgtgtgtgtgtgtcttcctggttttattatcaggatgatgctggcttcataaaatgagttaggaaggagtccttccttttcaattgttttgaatagtttcagaaggaatgg

SEQ ID NO: 21337 - DNA, 356 bp, Homo sapiens
  chr15.fa.O7frz.43207455
  Located on chromosome 15
  Distance between a terminus base of telomere on chromosomal short arm and 5'-terminus of this base sequence : 43579588
  Distance between 3'-terminus of neighbour sequence of sequence listing upward to telomere on chrosomal short arm and 5'-terminus of this base sequence : 131494
cttatttgtcagtccttaagtgacaatgattcaagttcccatctctctactctatagtaagtacatttctttctttctttctctttccttctttctttccttctttttctttctttctttttctttttctttctttctttctttcttctttatttctttttctttctttcctcctttcctttcctttcctttttagttttattgatttgttcattcatcttacttcctcaaatactttttggattccccagaacaggcttatatatttcacacatctgtaatgatgtctcttgtggctcaaccatccatttggctggctccactgctgaccacttcaacagtttctgaagtaccta

SEQ ID NO: 21338 - DNA, 337 bp, Homo sapiens
  chr15.fa.O7frz.43279425
  Located on chromosome 15
  Distance between a terminus base of telomere on chromosomal short arm and 5'-terminus of this base sequence : 43651500
  Distance between 3'-terminus of neighbour sequence of sequence listing upward to telomere on chrosomal short arm and 5'-terminus of this base sequence : 71556
ctgttgcaactagtcaattctatcattatagtgcaaaagcaactataggtaatatgtaagcaaataagtgtggctgtgttcaaataaaactttatttacaaaaacagagcgtgggccagatttatttcacaggctctaaattgccaattcttgccctaattccaactcttgccctggtcccaaatgtgtgcttcagagtgtgtgtgtgtgtgtgtgtgtgtaagtgtgtgtgtgtgtgtgtgtgtgtgtacgtgtgcacatgtgcatggggaggagggagttacaaagaaaattaatatttattgatcatctattatgtgtttggaatttactaaca

SEQ ID NO: 21339 - DNA, 157 bp, Homo sapiens
  chr15.fa.O7frz.43381891
  Located on chromosome 15
  Distance between a terminus base of telomere on chromosomal short arm and 5'-terminus of this base sequence : 43746902
  Distance between 3'-terminus of neighbour sequence of sequence listing upward to telomere on chrosomal short arm and 5'-terminus of this base sequence : 95065
atcaacatcagaggtaccaataatggacaggagggagtgactgtggaaacaggtacagtagccactggcgcgcgcgcacacacacacacacacacacacacacacacacacacacacacacacacacacacactactgtaacggttaaagactttca

SEQ ID NO: 21340 - DNA, 214 bp, Homo sapiens
  D15S1006
  Located on chromosome 15
  Distance between a terminus base of telomere on chromosomal short arm and 5'-terminus of this base sequence : 43793750
  Distance between 3'-terminus of neighbour sequence of sequence listing upward to telomere on chrosomal short arm and 5'-terminus of this base sequence : 46691
ccacttggctatggtgaataatctttttaatgtgctgttggatttgatttgctagtattttgttgagggtttttatgtctgtgttcatcagggatattgacctgtggttttgtgtgtgtgtgtgtgtgtgtgtgtgtgtgtgtgtgtgtgtccttgtctagttttggtaccagtgtaatgctagccttgtagaatgagttttgaagtattccct

SEQ ID NO: 21341 - DNA, 331 bp, Homo sapiens
  AC025843.3_179858
  Located on chromosome 15
  Distance between a terminus base of telomere on chromosomal short arm and 5'-terminus of this base sequence : 43882031
  Distance between 3'-terminus of neighbour sequence of sequence listing upward to telomere on chrosomal short arm and 5'-terminus of this base sequence : 88067
ttctttgcttagagttacctgtatcttccctgttgatttccttttaatgtaagccctcatctatctatactttaatccctattatagggctccccaaatttagagatttcactgaaaagtcttcagtttttttgccacatccatttaatctccgttattatacacaattcttttttaaaaaaacgatggattagttggatttttattattattattattattattatactttaagttttagggtacatatgcaccatgtgcaggtttgttacatatgtatatatgtgccatgttggtgtgctgcacccattaactcgtcatttagcgttag

SEQ ID NO: 21342 - DNA, 285 bp, Homo sapiens
  D15S161
  Located on chromosome 15
  Distance between a terminus base of telomere on chromosomal short arm and 5'-terminus of this base sequence : 43906607
  Distance between 3'-terminus of neighbour sequence of sequence listing upward to telomere on chrosomal short arm and 5'-terminus of this base sequence : 24245
tctgtgattttgccattatgagtattctccccttcccctaaacacgcacgctcacacgcgcgcgcgcgcgcacacacacacacacacacacacacacacacacacagagagagagaaagagagagagagtttaatacaattggcttcattattaaataatactgcaatctgtatttaagttgacaacataggcatctctttaacatcttaattaaagaatgttggagcgatgctttctgcttttttgatgacaagtcttggctcatagtcaaaaattccagttta

SEQ ID NO: 21343 - DNA, 191 bp, Homo sapiens
  D15S990
  Located on chromosome 15
  Distance between a terminus base of telomere on chromosomal short arm and 5'-terminus of this base sequence : 44008254
  Distance between 3'-terminus of neighbour sequence of sequence listing upward to telomere on chrosomal short arm and 5'-terminus of this base sequence : 101362
cttggaatgcctgaggacagttgctttaaggtgtgtgtgtgtgtgtgtgtgtgtgtatgtgcacgcatgtgcgtgtgtgtgtgtgtgtgtgtgtttagtggggggaggacttcaaaattgtcttcagtttttttcattttccttttctttttgagaaatgttaagaaatcaggacacttcaacctgttcag

SEQ ID NO: 21344 - DNA, 265 bp, Homo sapiens
  D15S1039
  Located on chromosome 15
  Distance between a terminus base of telomere on chromosomal short arm and 5'-terminus of this base sequence : 44010782
  Distance between 3'-terminus of neighbour sequence of sequence listing upward to telomere on chrosomal short arm and 5'-terminus of this base sequence : 2337
tgccggtagtaacatctgaggttaacaaatgtgtgtcaggagaatggaagacaattcctgaaatataccaacctccggtgatcagagttctacctggctgtgctctttctctctctctctctctctctctctctcacacacacacacacacacacacacacacacacacacacacacgaaaaagagaaagagagagagggaagggggaaggggatggagggagagaaaagagaatagatagaggacacaaatactttatccttgg

SEQ ID NO: 21345 - DNA, 175 bp, Homo sapiens
  Z67471
  Located on chromosome 15
  Distance between a terminus base of telomere on chromosomal short arm and 5'-terminus of this base sequence : 44045464
  Distance between 3'-terminus of neighbour sequence of sequence listing upward to telomere on chrosomal short arm and 5'-terminus of this base sequence : 34417
caagtcgtcatttcaggctgggggaaaatccaagcctgaattaccttggcgactcacccagtatattgttattttagtcttcaaggcctcctaactacatgggcatttacacacacacaaacacacacacacacacacacacacacacacacagcgttatcgactgccttgctca

SEQ ID NO: 21346 - DNA, 246 bp, Homo sapiens
  Z23284.1_193
  Located on chromosome 15
  Distance between a terminus base of telomere on chromosomal short arm and 5'-terminus of this base sequence : 44149995
  Distance between 3'-terminus of neighbour sequence of sequence listing upward to telomere on chrosomal short arm and 5'-terminus of this base sequence : 104356
gctttatcgtcattcctaatgtaggcagcacctagtggtgagaacatatgaaatcccagcctaaggaggcaacagcaaaggcacctgagtcaaggttgcacataattgattagcctacccactgccaccgtcctacatacacacacacacacacacacacacacacacacacacacgcatgcacacaagcacacacaaacatgtaggagtctaggacttagttacagaatctgtgctacagatacc

SEQ ID NO: 21347 - DNA, 197 bp, Homo sapiens
  D15S143
  Located on chromosome 15
  Distance between a terminus base of telomere on chromosomal short arm and 5'-terminus of this base sequence : 44150055
  Distance between 3'-terminus of neighbour sequence of sequence listing upward to telomere on chrosomal short arm and 5'-terminus of this base sequence : -186
ctaaggaggcaacagcaaaggcacctgagtcaaggttgcacataattgattagcctacccactgccaccgtcctacatacacacacacacacacacacacacacacacacacacacgcatgcacacaagcacacacaaacatgtaggagtctaggacttagttacagaatctgtgctacagataccagtctttacat

SEQ ID NO: 21348 - DNA, 191 bp, Homo sapiens
  D15S123
  Located on chromosome 15
  Distance between a terminus base of telomere on chromosomal short arm and 5'-terminus of this base sequence : 44311308
  Distance between 3'-terminus of neighbour sequence of sequence listing upward to telomere on chrosomal short arm and 5'-terminus of this base sequence : 161056
tttcatgccaccaacaaacttgttgtgtgtgtgcgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagct

SEQ ID NO: 21349 - DNA, 367 bp, Homo sapiens
  chr15.fa.O7frz.44340218
  Located on chromosome 15
  Distance between a terminus base of telomere on chromosomal short arm and 5'-terminus of this base sequence : 44699328
  Distance between 3'-terminus of neighbour sequence of sequence listing upward to telomere on chrosomal short arm and 5'-terminus of this base sequence : 387829
caatgattataatctgagatggaggagaggagagataaaggagggctaaatgtccaagtgagaaatgatattaaacattgtttttttgttaggttcattaattttttaagagaaacaccctacctttaaacaaaaccaaacatacacacacacacacacacacacacacacacacaaacataaatgtacttctcactcatcccactaggtggaatactaaaaaacaaaaataaataaacaaaaaccacataaacacatggatagactatcatctgcaatgccaaatgattatgttaaaggtaatcaccccatcatcacttctctatctttaggctaagatgaagtgtaaaggtaaccatcaaatcta

SEQ ID NO: 21350 - DNA, 254 bp, Homo sapiens
  D15S1024
  Located on chromosome 15
  Distance between a terminus base of telomere on chromosomal short arm and 5'-terminus of this base sequence : 44799275
  Distance between 3'-terminus of neighbour sequence of sequence listing upward to telomere on chrosomal short arm and 5'-terminus of this base sequence : 99580
ctaagtcctccacactagcccacctctacttgtattccctctctctctctctctctatcacacacacacacacacacacacacacacacacaccactgaaaattctcagctatcaatgcatttttatagtacttaagtacttacgtattcttcaaaccatttttcttcaaagcatttttctacagtttttcttattggagccacacaatagcctagtgaagcaggaaagaaaagtagccctgttcccattttag

SEQ ID NO: 21351 - DNA, 437 bp, Homo sapiens
  AC009834.3_156127
  Located on chromosome 15
  Distance between a terminus base of telomere on chromosomal short arm and 5'-terminus of this base sequence : 44956133
  Distance between 3'-terminus of neighbour sequence of sequence listing upward to telomere on chrosomal short arm and 5'-terminus of this base sequence : 156604
gcttcctttctcctgtaattagtttaccttctttgctaaggcacattcatttataaagaaaaataatgtttctcaacaaatctattttttctttttttttaaattagaaaacaggtggataaaagtggtggggaaggatgctcacttgtatatacttagtatatattcacatttcctacctgcctgcctgcctgccttccctccttccatgtctccttccctcctaccttctttccttctctccttccctttcttccttccttccttcccccctcccctcccctccctcctttccttccttccttccttcctttccttccttccttccttctctcctcccctccttccttctctctttccctccttcccttcagctacaggtctttgatcttaactgcctgtctgaaaatcttttgtatccaaagaccttcaagtct

SEQ ID NO: 21352 - DNA, 344 bp, Homo sapiens
  HUMUT1532
  Located on chromosome 15
  Distance between a terminus base of telomere on chromosomal short arm and 5'-terminus of this base sequence : 44956172
  Distance between 3'-terminus of neighbour sequence of sequence listing upward to telomere on chrosomal short arm and 5'-terminus of this base sequence : -398
ggcacattcatttataaagaaaaataatgtttctcaacaaatctattttttctttttttttaaattagaaaacaggtggataaaagtggtggggaaggatgctcacttgtatatacttagtatatattcacatttcctacctgcctgcctgcctgccttccctccttccatgtctccttccctcctaccttctttccttctctccttccctttcttccttccttccttcccccctcccctcccctccctcctttccttccttccttccttcctttccttccttccttccttctctcctcccctccttccttctctctttccctccttcccttcagctacaggtc

SEQ ID NO: 21353 - DNA, 270 bp, Homo sapiens
  D15S992
  Located on chromosome 15
  Distance between a terminus base of telomere on chromosomal short arm and 5'-terminus of this base sequence : 45086522
  Distance between 3'-terminus of neighbour sequence of sequence listing upward to telomere on chrosomal short arm and 5'-terminus of this base sequence : 130006
agctgagaaatgccttctataaatatgaactttctgtaatatcaagacagataaacggcagggagatggttttgatacattggttggcaaatgttatttctagaattggctttttatcaaatatccatgtgctaatagatatgtggtatataggttgtttgtatatcttctctctttcacacacacacacacacacacacacacacacacacacacacacacacacacacagtcacagaagcatgctaacatactatcaaggtggccctc

SEQ ID NO: 21354 - DNA, 296 bp, Homo sapiens
  AC027545.2_119126
  Located on chromosome 15
  Distance between a terminus base of telomere on chromosomal short arm and 5'-terminus of this base sequence : 45114200
  Distance between 3'-terminus of neighbour sequence of sequence listing upward to telomere on chrosomal short arm and 5'-terminus of this base sequence : 27408
cgtattaaatgttaaagtctccacactccaaataatgctctggcaaggaaatggtaaaccagctttagagctccgctcaattctttatgtatttacatatgtatgtatgtatgtatgtatgtatgtatgtatgtatgtatgtatttagggggtacaagcgcaggtttcttacatgcacatattgcataatggcaaactctggcttttactgtacccattatctgaattgtgagcattgtacccaataggtaatttttcaactttcaccctcctcctaccttctcacctttggtagt

SEQ ID NO: 21355 - DNA, 175 bp, Homo sapiens
  D15S1028
  Located on chromosome 15
  Distance between a terminus base of telomere on chromosomal short arm and 5'-terminus of this base sequence : 45243762
  Distance between 3'-terminus of neighbour sequence of sequence listing upward to telomere on chrosomal short arm and 5'-terminus of this base sequence : 129266
tgtcctgaaattcccaacccaaatcatagtttggagttgaaattctataaggcgcgcatgcacacacacacacacacacacacacacacacatacacacacacaatgcatttaaagcattctcaggttggaaaggcctctagacatgtcacagaagtgagcacagagcacagttc

SEQ ID NO: 21356 - DNA, 456 bp, Homo sapiens
  chr15.fa.O7frz.44972853
  Located on chromosome 15
  Distance between a terminus base of telomere on chromosomal short arm and 5'-terminus of this base sequence : 45316207
  Distance between 3'-terminus of neighbour sequence of sequence listing upward to telomere on chrosomal short arm and 5'-terminus of this base sequence : 72270
caatattggctcattaattgtaacaaatgtaccatactaacataaggtattagtagggaaaaatgggtgcagcatatcgtatataggaactctgcgtaatacaaatttttctgtaaattaaaaactgttccaaaaatatatttttaaaaaacctttattagaaacaaaaatactacctgagttaaaatgtttactgttcttcagttttagatgattccaaataaaatcttagaatattgtgtgtgtgtgtgtgtgtgtgtgtgtgtgtctgtgtgtatgggtgtgcgagacagagaaaatgaacaaactattaggtaggctttttaatgttataaaaggagcttttgcaatacaaaatgcaaatttgtatatgtaatatatatatatattttgtaagtagtctgtctatatacatagatctcatttaaaccacttctatttccattgaagtagaaa

SEQ ID NO: 21357 - DNA, 239 bp, Homo sapiens
  chr15.fa.O7frz.45075846
  Located on chromosome 15
  Distance between a terminus base of telomere on chromosomal short arm and 5'-terminus of this base sequence : 45419911
  Distance between 3'-terminus of neighbour sequence of sequence listing upward to telomere on chrosomal short arm and 5'-terminus of this base sequence : 103248
caattggatgtaccttacaaattgtgaggactaaatgatgatgtgtgtgagagtgtgtgtgtgtgtgtgtgtgtgtgtgtgtgtgtgtgtcttcatttaaggaagctagagaaaggagttctggggaaattctgattttgcaaggtaggggatttaaagaagattttgagtacacggtgtgattagggagagttttccaaatttatccatacatattataaatgttcgcttagatcaga

SEQ ID NO: 21358 - DNA, 241 bp, Homo sapiens
  D15S978
  Located on chromosome 15
  Distance between a terminus base of telomere on chromosomal short arm and 5'-terminus of this base sequence : 45521587
  Distance between 3'-terminus of neighbour sequence of sequence listing upward to telomere on chrosomal short arm and 5'-terminus of this base sequence : 101437
caccgggaaaccttgatccttgattctcacactgccccactgcgggggagtttgggtaagagaaagactctgtgtgtgtgtgtgtgtgtgtgtgtgtgtgtgtgtgtgtgtgtgtgtgtgtgtatttgtatgtgtgagtagaaggggccaggtaattggaaatgtgtacttattttcctgaattatacacttttctcctagaaacaaggggaattcaacaacaatttcagtgtatgaagct

SEQ ID NO: 21359 - DNA, 188 bp, Homo sapiens
  D15S126
  Located on chromosome 15
  Distance between a terminus base of telomere on chromosomal short arm and 5'-terminus of this base sequence : 45549051
  Distance between 3'-terminus of neighbour sequence of sequence listing upward to telomere on chrosomal short arm and 5'-terminus of this base sequence : 27223
gtgagccaagatggcactactgcactccagcctgggcaacaacagaggcagacacacacacacacacacacacacacacacccctcttgccagatcacattactcacttcttcatttctagttttccatctatttcttagaaatcttttttttttttaaacaatctaaaacttcccattattgctggc

SEQ ID NO: 21360 - DNA, 193 bp, Homo sapiens
  D15S119
  Located on chromosome 15
  Distance between a terminus base of telomere on chromosomal short arm and 5'-terminus of this base sequence : 45739909
  Distance between 3'-terminus of neighbour sequence of sequence listing upward to telomere on chrosomal short arm and 5'-terminus of this base sequence : 190670
acttttgtgccatttagagattacagtattgttcatcttgggattttcaaggaagtatgtcactaggaaattttgcttttattcttttaaggaataattaatggtggcaggcatatggagtgtgtgtgtgtgtgtgtgtgtgtgtgtgtgtgtgtatgtatgtgtgtgtatgttatgttacggattttctgtt

SEQ ID NO: 21361 - DNA, 379 bp, Homo sapiens
  AC010769.3_60417
  Located on chromosome 15
  Distance between a terminus base of telomere on chromosomal short arm and 5'-terminus of this base sequence : 45849466
  Distance between 3'-terminus of neighbour sequence of sequence listing upward to telomere on chrosomal short arm and 5'-terminus of this base sequence : 109364
attcgcaccaacagtgtagaagagttcccttttctctgcatcctcaccatcacttgttatttttttgtctttttgatagtagccattctaactgggtgagacgatacctcatggtggttttgatttgcatttccctgatgattagtgatgttaagcattttttcatattcctgttggccatttatatgtcttcttttgagaaatctctattcagaccctttgcctattttttaattggattttttgttgttgttgttgttgagttgtttgagttctttgtatattctggatattagttccttgttagatgaatagtttgcaggtattctctcccattctgcaagttgtctcttcactctattgataggtttcctttgct

SEQ ID NO: 21362 - DNA, 358 bp, Homo sapiens
  chr15.fa.O7frz.45670118
  Located on chromosome 15
  Distance between a terminus base of telomere on chromosomal short arm and 5'-terminus of this base sequence : 46170201
  Distance between 3'-terminus of neighbour sequence of sequence listing upward to telomere on chrosomal short arm and 5'-terminus of this base sequence : 320356
cacaacctgtaattacagctactcaggaggctgaaggaggagaattgcttgaacctgagaggcggaggttgtagtgcacctagatggcgccactgcactatagcctgagctacagagtgagactctatctcaaaataataataataataataataataataataataataataataataatatggcaaatgtaatgaatttatatacagaagaaagatgacagatatgtagagtactgaacatagttaagtaatcaatgacttgttttattcaaaaatggaaagttatgattttctaatcaagaatggcgaatctggtctttttgagagtgacaacagcatctcatgctttatgtaac

SEQ ID NO: 21363 - DNA, 421 bp, Homo sapiens
  chr15.fa.O7frz.45767135
  Located on chromosome 15
  Distance between a terminus base of telomere on chromosomal short arm and 5'-terminus of this base sequence : 46276972
  Distance between 3'-terminus of neighbour sequence of sequence listing upward to telomere on chrosomal short arm and 5'-terminus of this base sequence : 106413
tctagagctgaaagtattgatcagagctgtcctgcattggactgaaatagccaagcctttctgctccaacttgagctgtcactggatggttcctggaaagatgttttctcagaagaggaagttctctggaggtaagtaaaccaatgaaggggctgacagttgaagggtgtcccttaacagcactcttaggccctagagcacagatccttctttgaaaaggaattgggtggcatattttaatgtctactacactgctttatacacatagattagtttttgatcatctagtcatgtttaaatatatatatataaaacatacataatatgtatacatactatagacagacatagatagatagatagatagatagcaggttaatttccacattcctaattactccaacaattactaagcttacaa

SEQ ID NO: 21364 - DNA, 460 bp, Homo sapiens
  chr15.fa.O7frz.46046096
  Located on chromosome 15
  Distance between a terminus base of telomere on chromosomal short arm and 5'-terminus of this base sequence : 46328912
  Distance between 3'-terminus of neighbour sequence of sequence listing upward to telomere on chrosomal short arm and 5'-terminus of this base sequence : 51519
ttaaagtaaacaagaatcagaggataaaaaaacaataatttagaggattatgccagaaaatgactttcaatctgtaaatttaaatataaacagagcatcaattaaatgtgtggcatttttcagatttgcaagatactaaaaaaaaattcatctcatattagtttcttattgctgctgtaacaaacagctaacaaagtggcttaaaaaatcacaaagtttattatttcacaggtctagaggtcgggaatctgaaatgggtctgcagggctatgctcctttcatgttttgtgtgtgtgtgtgtgtgtgtgtgtgtgtgacagagtttcactcttgtcgcccagcatagtaaatttacttgtgtaacaaaaaaaacacaaaatatcaatggcttaatacacataattttttctcccagaagatctttttgtgagaaaaggggcttctagcagtcacctgctat

SEQ ID NO: 21365 - DNA, 284 bp, Homo sapiens
  DISO7_00000013
  Located on chromosome 15
  Distance between a terminus base of telomere on chromosomal short arm and 5'-terminus of this base sequence : 46422275
  Distance between 3'-terminus of neighbour sequence of sequence listing upward to telomere on chrosomal short arm and 5'-terminus of this base sequence : 92903
ctatggctacaggagccagcctgatgttggggtggacctggaacctgaggccatgatggctggcctggcactgtagtgggcttggaagctgggtccatgggggctagccttggtcagagtgagccttgtaacacacaatgttagattatatcaccccttgcttagaactctctaataacttcccatctctccctttctctccctttctctctctctctctctctctttctctttcacacacacacacacacaaataacaatcccaagtccttccctcagtctgc

SEQ ID NO: 21366 - DNA, 477 bp, Homo sapiens
  chr15.fa.O7frz.45965757
  Located on chromosome 15
  Distance between a terminus base of telomere on chromosomal short arm and 5'-terminus of this base sequence : 46714593
  Distance between 3'-terminus of neighbour sequence of sequence listing upward to telomere on chrosomal short arm and 5'-terminus of this base sequence : 292034
tagaattgctttgttcttgaatcttgggggttaaatttagaatcaacttactttcttgattgtctcaagcttttaaatttgcaactcaaaaatagggtgtgcatgtgtgtgtgtgtgtgtgtgtgtgtgtgtgtgtgtgtggttttgtctaaactgggataaaacagagctggggaaaaataccctgtgacggcccctaaaagaataagtgggtttgcattagcaaggctcttacacaactctgaatcaaagagccacagaagcttgttgaggcagaaattctctgacttgtcacactgtgaacagaggaaagccacataaagaaagtgatgccgctcttgggccaaaaactacccatcctgattttaaaggaaaaaaaaattttttttgaaaattcaccttgatcttatttcccacattcaaatttcaatgcataaaaccaggcacaaggcactaaacagcaatagagcttaacag

SEQ ID NO: 21367 - DNA, 451 bp, Homo sapiens
  chr15.fa.O7frz.46495101
  Located on chromosome 15
  Distance between a terminus base of telomere on chromosomal short arm and 5'-terminus of this base sequence : 47025512
  Distance between 3'-terminus of neighbour sequence of sequence listing upward to telomere on chrosomal short arm and 5'-terminus of this base sequence : 310442
aaacatatcacagtttaggacctaatatacttaagttactctggttttaaaattccatgagcaatacagccatacggtagatttatttatttatttatttatttattttttgagacggagtctcgctctgttgcccaggctggagtgcagtggcgtgatctcggctcactgcaagctccacctcccaggttcacaccattctcctgcctcagcctcccgagtagctgggagtacaggcgccagccaccacgcccggctaattttttgtatttttagtagagacagggtttcaccgtgttagccaggatggtctcgatctcctcacctcgtgatctgcccgcctcggcctcccatagtgctgggattacaggcgtgagccaccgcgcccggccgccatatggtagattaatgtagatggattcttggaaatcagtggttctcattggtagca

SEQ ID NO: 21368 - DNA, 368 bp, Homo sapiens
  AC027538.2_51271
  Located on chromosome 15
  Distance between a terminus base of telomere on chromosomal short arm and 5'-terminus of this base sequence : 47328310
  Distance between 3'-terminus of neighbour sequence of sequence listing upward to telomere on chrosomal short arm and 5'-terminus of this base sequence : 302347
taggctgttcttgaactattgacctcaagccactgggtctggccaatatacactttaaatgaatgaattttgtaatttgtgaaatgtatttcaataaagctataaagaaaagcacatgcaggctgggcgtaatggctcatgcctgtaatcccagcaatttgggaggcgaggtgggtggatcacctgaggtcaggggtttgaggccagcctggccaacatgatgaaaccccatctctaccaaaaaaataaataaataaataaataaataaataaataaataaataaataaataaaataaattagccaggcatggtggtgtgcgcctgtagtcccagctactcgggaggctgataggagaattgcttgaa

SEQ ID NO: 21369 - DNA, 359 bp, Homo sapiens
  chr15.fa.O7frz.46802796
  Located on chromosome 15
  Distance between a terminus base of telomere on chromosomal short arm and 5'-terminus of this base sequence : 47470119
  Distance between 3'-terminus of neighbour sequence of sequence listing upward to telomere on chrosomal short arm and 5'-terminus of this base sequence : 141441
gtcagaactgatttaagaccatagggcatggtaaagcttggcaaattctggcctaaaaacaatcaacttaaaaaaaatttttactatcttcagggaagggcctatacttggagactttatggtttggattttcataaacggaccaaattccaggtgattttaaacaactgatcaaatatataataagcatatctatctatctatctatctatctatctatctatctatctatctacaggatctcactctatcacccaggctacagaacagaggcatggttgcagctcactgctgccttcaactcctgggtgactcacctcaccctcctgagcagctgggactacaggcatgatccactg

SEQ ID NO: 21370 - DNA, 140 bp, Homo sapiens
  DISO7_10027360
  Located on chromosome 15
  Distance between a terminus base of telomere on chromosomal short arm and 5'-terminus of this base sequence : 47591064
  Distance between 3'-terminus of neighbour sequence of sequence listing upward to telomere on chrosomal short arm and 5'-terminus of this base sequence : 120586
tcaaagcaccaggtattgggggtgtgtgtgtgtgtgtgtgtgtgtgtgtgtgtgtgtggtgtggtgagagaaattgttttaaaaaaaatttttttttaatggattaaggaaaaaatgtgaagataagtttagccaacttc

SEQ ID NO: 21371 - DNA, 290 bp, Homo sapiens
  AC012678.2_6909
  Located on chromosome 15
  Distance between a terminus base of telomere on chromosomal short arm and 5'-terminus of this base sequence : 47701637
  Distance between 3'-terminus of neighbour sequence of sequence listing upward to telomere on chrosomal short arm and 5'-terminus of this base sequence : 110433
gcaaagatgactcatgtttaaaaatattatttttctaatgtttcatataattaagaagcatattttttatatgaaatggccttatgttgctttcttatgtattttcccattttttattatttatttaatttattattattattattattattattattatttgagacaagtctcattctgtcacccagactggagtgcagtgacatgatcttggctcactgcatcctccgcttcctgggttctagtgggttctcccaggttctcatgcctcagactttgaatgtggagta

SEQ ID NO: 21372 - DNA, 343 bp, Homo sapiens
  chr15.fa.O7frz.47705740
  Located on chromosome 15
  Distance between a terminus base of telomere on chromosomal short arm and 5'-terminus of this base sequence : 48039696
  Distance between 3'-terminus of neighbour sequence of sequence listing upward to telomere on chrosomal short arm and 5'-terminus of this base sequence : 337769
tgctagatccacctatgtataaacaagttttcatggacataaacattgagcaggacatttgaaagtgatgagggacagtcacttgtgatgtggatggtcctgaccactgcagagcatctgacatccccccctacccatccactaaatgtcaatggcatcccacattcaccgtcgtaacaaactgtgatagtaacaaatgcctccacaaatttccaaagatagctctaatgggtggaaccaccctcactgggaatcctgagttacagggcaggggtgtgtgtgtgtgtgtgtgtgtgtgtgtgtgtgtgtgtacatgtgtgtgtacgttaagtgtgacttccaa

SEQ ID NO: 21373 - DNA, 330 bp, Homo sapiens
  chr15.fa.O7frz.47900820
  Located on chromosome 15
  Distance between a terminus base of telomere on chromosomal short arm and 5'-terminus of this base sequence : 48232649
  Distance between 3'-terminus of neighbour sequence of sequence listing upward to telomere on chrosomal short arm and 5'-terminus of this base sequence : 192610
taccattgctagctgactaaactgggacaagtaattaagtttctctatgcttcagtgtccttacctctaaagtatggatagtaatattacatttttcttaaggttaccaggaaggttaagtgagttaatatatataaaacatttagaagacagcctgacatacaataatcactagataaaagtttgctagtagtagtagtagtagtagtagtagtagtagtagtagtagtagtagtggtagtggtagtagtagtagtagtagcagcatttttttcaggttaaataactttcccagctgttattattgttaaggttacaagtcaacttgtg

SEQ ID NO: 21374 - DNA, 143 bp, Homo sapiens
  D15S1017
  Located on chromosome 15
  Distance between a terminus base of telomere on chromosomal short arm and 5'-terminus of this base sequence : 48400743
  Distance between 3'-terminus of neighbour sequence of sequence listing upward to telomere on chrosomal short arm and 5'-terminus of this base sequence : 167764
ccacaagctggactgagaatcaggctggaaaaataccagagaaagtggtatgtatgtgtatatatgcatatgcatgggggtgtgtgtgtgtgtgtgtgtgtgtgtgtgtgtacttctatctgtataataattgccttacttga

SEQ ID NO: 21375 - DNA, 465 bp, Homo sapiens
  AC020685.3_124490
  Located on chromosome 15
  Distance between a terminus base of telomere on chromosomal short arm and 5'-terminus of this base sequence : 48429255
  Distance between 3'-terminus of neighbour sequence of sequence listing upward to telomere on chrosomal short arm and 5'-terminus of this base sequence : 28369
gattgacaaccatgtaggaatgtgattggacaaaaaggacatggtctaaacccagtaaggcctatctctgcagattcttcttggcctctctgtgcaacattccttcctccagggtacagggtaggaccctctatggatcaagggtgttatgacccacaatcagattagagtcctgccttggctgggtgaaaggagggcaggtcagagagaaagattctgcttcctgaggccttcttctgaggcccaaagtgccctaacattatgacaaaaggctgaaacaagggatatgggagttataagccaggaatcatggacgaaaacctatatagatagttagatgatggatggatggatagatagatagatagacagacagacagacagacagacagacagacagacagatgtcatagggtataacctcgtggggttttgtggggggcaattaaggtgatggctgtaaag

SEQ ID NO: 21376 - DNA, 309 bp, Homo sapiens
  AC009679.2_171876
  Located on chromosome 15
  Distance between a terminus base of telomere on chromosomal short arm and 5'-terminus of this base sequence : 48506901
  Distance between 3'-terminus of neighbour sequence of sequence listing upward to telomere on chrosomal short arm and 5'-terminus of this base sequence : 77181
ttccttcagataaagatccgtaactttcttcatctctgggaaatttattttttctccttaattatttgataacttcttctcttctgcttgcttgcttgctttctttctttctttctttctttctttctttctttctttctttctttctttctttctttctccttctggaactcttcttagatgaatgttgaatctctgcatctttcatccacatctcttaaggttttctcataatttctatcttcatctttttgctgtatatccttggaaatatcctcagtgttatcttctagatcaccaacttggtct

SEQ ID NO: 21377 - DNA, 254 bp, Homo sapiens
  AC009679.2_70394
  Located on chromosome 15
  Distance between a terminus base of telomere on chromosomal short arm and 5'-terminus of this base sequence : 48557602
  Distance between 3'-terminus of neighbour sequence of sequence listing upward to telomere on chrosomal short arm and 5'-terminus of this base sequence : 50392
attagccagacatagtggcacgcacctattgtcccagctacttgagaggctgaagtgggaggattgcttgagcccgggagtttgaggctgccatgagccatgttcatgccactacactttagcctgggtaacaggctcaaaacaaaacaaaacaaaacaaaacaaaaaacaaatctagtttgaagcccaggaaatttggaaggattgaaactgaggaaaaataataccttttgttcactgcgtaacattcaact

SEQ ID NO: 21378 - DNA, 124 bp, Homo sapiens
  D15S982
  Located on chromosome 15
  Distance between a terminus base of telomere on chromosomal short arm and 5'-terminus of this base sequence : 48778149
  Distance between 3'-terminus of neighbour sequence of sequence listing upward to telomere on chrosomal short arm and 5'-terminus of this base sequence : 220293
gacttcatctggattcacaaagccatatatatacacgtgtgtgtgtgtgtgtgtgtgtgtgtgtgtatatatattcatttatttattttctggttgaatactgtcacgttattaatttaaacat

SEQ ID NO: 21379 - DNA, 459 bp, Homo sapiens
  chr15.fa.O7frz.48650710
  Located on chromosome 15
  Distance between a terminus base of telomere on chromosomal short arm and 5'-terminus of this base sequence : 48847416
  Distance between 3'-terminus of neighbour sequence of sequence listing upward to telomere on chrosomal short arm and 5'-terminus of this base sequence : 69143
tatggttgtggttattgcttatgccgggggcagtcaatcagaggcttaacgttttgcagggaaaagcagaacacacacacacacacacacacacacacacacacagggaaaagcagaaaacacacacacacacacacacacacacacacacacacacacacacacacacacacacacaccctacctgctgtatctgggttcatgcacagaaatctctcttctatacaaagaaggaaagagtgcatttcctaccctcacagtccttgagttgtgtttatatgcctgcctcccagcagagctgaaatcctggcggcctcatggtggtacctacagggctctacacatgcctggctcgtaggaagtgttccgtgagtctctactgagtgtttaaaaccttcgatgcctcccactgctgtgcaggccaaaaacttaaagtgcttcttggatactgatgcatac

SEQ ID NO: 21380 - DNA, 159 bp, Homo sapiens
  D15S1032
  Located on chromosome 15
  Distance between a terminus base of telomere on chromosomal short arm and 5'-terminus of this base sequence : 49116374
  Distance between 3'-terminus of neighbour sequence of sequence listing upward to telomere on chrosomal short arm and 5'-terminus of this base sequence : 268499
agctttaacttccatgagtttctgatcttgtggggccacatctgcgttatagtcactaatctcatctatccaaccctctctctttctctctctctctgtcacacacacacacacacacacacacacacacacacacaatcactatgcaccagagattag

SEQ ID NO: 21381 - DNA, 441 bp, Homo sapiens
  AC073438.1_166268
  Located on chromosome 15
  Distance between a terminus base of telomere on chromosomal short arm and 5'-terminus of this base sequence : 49244878
  Distance between 3'-terminus of neighbour sequence of sequence listing upward to telomere on chrosomal short arm and 5'-terminus of this base sequence : 128345
acttcatattgccttgatcttcctgaatgacatcatgttatagtacttgtggaccccctctcatcctgtacctccaacacccacagacacacacttgccttacatgtcgtggtgatggaacctcttgaatagtgaaaatgacttagatccaaatggcctagattctagtcccagttccaacctagagcaagtcaggggagctttttaaaataataataataataataataataataataataataataataataaactttttattttagaacagttttagattacagaaaaattgcaaagatagtatggaattcccatatatcctgcaaccagtttcccctattataaatgtcttacatttttatgatacacttgttacaattaatcagccaatagtgacttgttataattaactgaaatacatacttgactcaggtttcc

SEQ ID NO: 21382 - DNA, 387 bp, Homo sapiens
  chr15.fa.O7frz.49149347
  Located on chromosome 15
  Distance between a terminus base of telomere on chromosomal short arm and 5'-terminus of this base sequence : 49356536
  Distance between 3'-terminus of neighbour sequence of sequence listing upward to telomere on chrosomal short arm and 5'-terminus of this base sequence : 111217
cagataagcctaattcatggtaatgtgataaatgaggtcaggcgcagtggctcatgcctgtaatcccagaactctgggaggccgaggcaggcacatcacttgatgtcaagagttcgaggccagcctggcgaacatggtgaaaccccatctctaccaaaaatacaaaaattagctgggcatggaggcacatgcttgtaatcccagctacttgggaggctgaggcggtaggattgcttgaacctgggaggcggaggctgaagtgagccaagatcacgctatgccactgcgctccagcctgggcgacaaagcaagactccatctcaaataaataaataaataaataattttttaaaagataaataaaataggaatagatcaaggtgctat

SEQ ID NO: 21383 - DNA, 136 bp, Homo sapiens
  DISD22_0009521
  Located on chromosome 15
  Distance between a terminus base of telomere on chromosomal short arm and 5'-terminus of this base sequence : 49512675
  Distance between 3'-terminus of neighbour sequence of sequence listing upward to telomere on chrosomal short arm and 5'-terminus of this base sequence : 155752
cgaagagctacgcagtccgtgtgtgtgtgtgtgtgtgtgtgtgtgtgtgtgtgtgtgtgtgtgtgtgtgtccgactgcttggcccaggccgggctctctttcctgggaggctctcagggtttcagtctaggctgga

SEQ ID NO: 21384 - DNA, 465 bp, Homo sapiens
  chr15.fa.O7frz.49464475
  Located on chromosome 15
  Distance between a terminus base of telomere on chromosomal short arm and 5'-terminus of this base sequence : 49728326
  Distance between 3'-terminus of neighbour sequence of sequence listing upward to telomere on chrosomal short arm and 5'-terminus of this base sequence : 215515
tgaaagttctagattggacagtacagcatgatgctttaagagttctagctttggcccatctctactaaaaatacaaaaaaaaaaaaattagctgggtgtggtggctggtgcctgtcgtcccagctactggggaggctgaggcagaagaatggtgtgaacccaggaggcggagcttgcagtgagccgagatcgcgccactgccctccagcctgggcgacagagtgagactccgtctccaaaaataaataaataaataaataaataaataaataaataaataaaataaaaaataagagttctagctttggggtcaggccaggttgattcctgtcctgcctcttaggagctagatgatcttggctaagttatgcaaactctctgagccttcatctgggaattgggaaaaaaataatagcacctgtctcacagggtgttgctgaggtttaaatgaggtaatgcataatg

SEQ ID NO: 21385 - DNA, 331 bp, Homo sapiens
  chr15.fa.O7frz.49536557
  Located on chromosome 15
  Distance between a terminus base of telomere on chromosomal short arm and 5'-terminus of this base sequence : 49800515
  Distance between 3'-terminus of neighbour sequence of sequence listing upward to telomere on chrosomal short arm and 5'-terminus of this base sequence : 71724
gcctaagatcattcagctaataaagagtgaagctgaaattcaaacccaagtctatatgaaaggagattcagcctatttgaagagacacagcaagagaaagagagagagagagagagagagagagagagcgcttcctggccttccttagctcagtgtggagccattttgaaaatctgcaatacgccaatgataccaatgatgcctcatgtcaaaattgcattaaaagtcattatgtgttgttacagttcttttgattccattaaagtcacccagtggtaactgccaagtgaaacaaaataaaaagtagagatagaagcttaggaattaaggt

SEQ ID NO: 21386 - DNA, 454 bp, Homo sapiens
  AC032018.2_166228
  Located on chromosome 15
  Distance between a terminus base of telomere on chromosomal short arm and 5'-terminus of this base sequence : 49876503
  Distance between 3'-terminus of neighbour sequence of sequence listing upward to telomere on chrosomal short arm and 5'-terminus of this base sequence : 75657
gaggtcaggaatttgagactagcctgaccaacatggtgaaaccccgtctgtactaaaaatacaaaaattagatgggcgtggtgatgggcacctgtaatcccagctactcaagatgctgaggcaggagaatggcttgagcccaggaggcgaaaattgcagtgagccgagatcacgccattcccctccagcatgggtgacaagagctaaactccatcttacaaaacaacaacaacaacaacaacaacaacaacaaaataaaaataaaaacaaactagaaaattctttatttagtaatgcattggtctctccttcagtcatttgatatagttctcatcattgtaattcttaagcattaattatgtatttctagttctggtaccataatagtttctaggtacaaatttttctactcccgttttcttccttccccatctatgtaccaaacctagaaatg

SEQ ID NO: 21387 - DNA, 159 bp, Homo sapiens
  Z67660
  Located on chromosome 15
  Distance between a terminus base of telomere on chromosomal short arm and 5'-terminus of this base sequence : 49996813
  Distance between 3'-terminus of neighbour sequence of sequence listing upward to telomere on chrosomal short arm and 5'-terminus of this base sequence : 119856
ccttgcctttatcctgagaggtgggtgctgggtgctctcccctggggcattcacccataaaatccttgtacagacccaagcattgctgtgtgtgtgtgtgtgtgtgtgtgtatcagcaggtaggctatttcctttaagtagcatttgatgaagctggta

SEQ ID NO: 21388 - DNA, 249 bp, Homo sapiens
  D15S1016
  Located on chromosome 15
  Distance between a terminus base of telomere on chromosomal short arm and 5'-terminus of this base sequence : 50013171
  Distance between 3'-terminus of neighbour sequence of sequence listing upward to telomere on chrosomal short arm and 5'-terminus of this base sequence : 16199
gatccgtcacataatggccattagagctaccgggttgggcgttgcatcagtcagggttttccagagaaacagaaccaatagaatacacacagacacacagacacacacacacacacacacacacacacacacacacacacaccatacgtataaggaaatttactataaggaactggctcatgtgattatgggggctgagagtcccacagtggctgtctgcaagctggagacccaggaaagctgaggtgt

SEQ ID NO: 21389 - DNA, 301 bp, Homo sapiens
  chr15.fa.O7frz.49886389
  Located on chromosome 15
  Distance between a terminus base of telomere on chromosomal short arm and 5'-terminus of this base sequence : 50136552
  Distance between 3'-terminus of neighbour sequence of sequence listing upward to telomere on chrosomal short arm and 5'-terminus of this base sequence : 123132
atcttaagtatgctcaccatacacacacacaaaagataactatgtcaggtgatatatatatatatataaatatatatatgtaaatagcttggttgtgctcttcatttcacaatgtatatgtatatcaaagtatctcattgtcacctttaacatatataattttaatttgtcaattatacttcattaaagctaaaaaatcaatgagacacatgaaaacatgattgcataaaattttagggactgtaaactcaagattaaaaacttctatcatcttctcttgtacgctgttaataagaatgca

SEQ ID NO: 21390 - DNA, 200 bp, Homo sapiens
  D15S209
  Located on chromosome 15
  Distance between a terminus base of telomere on chromosomal short arm and 5'-terminus of this base sequence : 50252914
  Distance between 3'-terminus of neighbour sequence of sequence listing upward to telomere on chrosomal short arm and 5'-terminus of this base sequence : 116061
aaacatagtgctctggaggcttagcatttcttttcattgcattttatgcagttctttctgaagacaaaaagaataataaatccttagactgtgccaggcataaatctaagtgctacacacacacacacacacacacacacacacacacacacaatttaatctttacaataaccttataaagcagacactgttgttagccc

SEQ ID NO: 21391 - DNA, 200 bp, Homo sapiens
  D15S1003
  Located on chromosome 15
  Distance between a terminus base of telomere on chromosomal short arm and 5'-terminus of this base sequence : 50391747
  Distance between 3'-terminus of neighbour sequence of sequence listing upward to telomere on chrosomal short arm and 5'-terminus of this base sequence : 138633
aatctttgtggatatggctctgcttttttattttgccaacattttcctgtttccttgtatgctttataattgtgtgtgtgtgtgtgtgtgtgtgtgtgtatgaaatgtgatcagtgagaatcctttgagatatatgtgacagtgcactctttaagagaggattttagtttgtgaataccaggtatccaggggtactacca

SEQ ID NO: 21392 - DNA, 415 bp, Homo sapiens
  AC022060.3_153226
  Located on chromosome 15
  Distance between a terminus base of telomere on chromosomal short arm and 5'-terminus of this base sequence : 50670491
  Distance between 3'-terminus of neighbour sequence of sequence listing upward to telomere on chrosomal short arm and 5'-terminus of this base sequence : 278544
ttggtcttgataactgtagttctagttgagtattttaagtcctttgattttgtataataaaaaccttgctgagcactggcatcttgtgataaaaatgctgctctatacaaatgttctcttattgggctaactcttccagctgtgagacccatgctgatagttcaatataagatcttctacattacttcctcctgctggtgcacatagtcctaaaaatgcagactttctccttttatacagagataatgaccaccacaaccaccaccaccatcatcatcatcatcatcatcatcatcttctactgttaaagttgggactattcaattatttttaaaccagtcatgcttatcttttaaatatggtgctagtgaaactatttgaaatgatcagggtaagatggtaaggttattgagtg

SEQ ID NO: 21393 - DNA, 392 bp, Homo sapiens
  chr15.fa.O7frz.50500542
  Located on chromosome 15
  Distance between a terminus base of telomere on chromosomal short arm and 5'-terminus of this base sequence : 50920205
  Distance between 3'-terminus of neighbour sequence of sequence listing upward to telomere on chrosomal short arm and 5'-terminus of this base sequence : 249299
tgacatttgtaattagaactccactggttgaattataagaagcatcacaaggggtgtgtgtgtgtgtgtgtattctgaaagtaccacaagtctataaaacagtggttgaattataagaagcattgcaaggtgtgtgcgtgtgtgtgtgtgtgtgtgtgtatgtgtgtgtctattctctaagcaccagacttgcatgcaccacaatttgggcaagtctataaagcaatggtgggattagggaaaaacagtttgaggaggatattatcatctttattttctttcttcactagtcattgaagttcttctctgcagtacagttctcatagcactaagttccttgagccgatgtgaaattcctctgtccatgattctgaactaggctggtaacttct

SEQ ID NO: 21394 - DNA, 366 bp, Homo sapiens
  chr15.fa.O7frz.50857957
  Located on chromosome 15
  Distance between a terminus base of telomere on chromosomal short arm and 5'-terminus of this base sequence : 51033954
  Distance between 3'-terminus of neighbour sequence of sequence listing upward to telomere on chrosomal short arm and 5'-terminus of this base sequence : 113357
ggaaagtacttgtaaatcagtgacaaaaatttattatgaatttgtctctatctctgagctaaacaatctaagatgaataattttcttctgatcaaaaatgcaaaagtagaaatttttgtttgtttgttttgttttgttttgttttgttttgttttgttttgagacggagtctcgctctgtcgcccaggctgcggtgcagtggcgccatctgggctcactgcaagctccgcctcccagattcacgccattctcctgcctcagcctctcgaggtagctgggactacaggcgcccaccactacgcctggctaatttttttgtatttttagtagagacagagtttcaccatgttagccagatggtcacaa

SEQ ID NO: 21395 - DNA, 217 bp, Homo sapiens
  chr15.fa.O7frz.50940693
  Located on chromosome 15
  Distance between a terminus base of telomere on chromosomal short arm and 5'-terminus of this base sequence : 51104766
  Distance between 3'-terminus of neighbour sequence of sequence listing upward to telomere on chrosomal short arm and 5'-terminus of this base sequence : 70446
tattgatctcaggtgctgttacccttagaaataatccagcaggtctccttttttgttcagattctttgccccacgtagactacaacaatactctgtgtgtgtgtgtgtgtgtgtgtgtgtgtgtgtttgtgtatgcacttgcagctttaattttgtaatttttaaaatagccatcagattcaatgaccctcagctaattcatgaagtagactatggc

SEQ ID NO: 21396 - DNA, 395 bp, Homo sapiens
  chr15.fa.O7frz.51062525
  Located on chromosome 15
  Distance between a terminus base of telomere on chromosomal short arm and 5'-terminus of this base sequence : 51228898
  Distance between 3'-terminus of neighbour sequence of sequence listing upward to telomere on chrosomal short arm and 5'-terminus of this base sequence : 123915
ggttccatatgaactttaggattgttcttttctaattctgtgaagaatgatgatggtattatgggaattgcattgaatatatagattgcttttggcagtgtgatcattttcataatattggtcctacccatccatgagcatgggatatgtttcaatttgtttgtatcatctgtttctttcagcagtgttttgtagttttccttatagagatctttcacctcttttgttaggtttactcctatgtattttatttatttatttatttatttatttatttatttatttatttatagttgttgcaaaagggtttgagttcttgatttgattctcatcttggtcactactggtgtatagcaatgctcctaatttgtgtacattgattttgtatcctgaag

SEQ ID NO: 21397 - DNA, 121 bp, Homo sapiens
  DISO7_10004020
  Located on chromosome 15
  Distance between a terminus base of telomere on chromosomal short arm and 5'-terminus of this base sequence : 51510607
  Distance between 3'-terminus of neighbour sequence of sequence listing upward to telomere on chrosomal short arm and 5'-terminus of this base sequence : 281314
atgcctggcactcatacccctaacaacaacaacaacaacaacaacaacaaagactagagcaataaataaacaattaaaattcacgtatagtgtctaaaaagagaactggagtaccacaagg

SEQ ID NO: 21398 - DNA, 185 bp, Homo sapiens
  HUMUT475
  Located on chromosome 15
  Distance between a terminus base of telomere on chromosomal short arm and 5'-terminus of this base sequence : 51672833
  Distance between 3'-terminus of neighbour sequence of sequence listing upward to telomere on chrosomal short arm and 5'-terminus of this base sequence : 162105
tgttttgctgtcctctgtacgctattcttatttctaattccaccttctagacatgagactcagttccttaaactgtttaacattcatcctctctctctcacacatacacacacacacacacacacacacacacagcatgcacctgcatcactttgcaagtcttttctgtgtgaataccacatagg

SEQ ID NO: 21399 - DNA, 437 bp, Homo sapiens
  chr15.fa.O7frz.51728912
  Located on chromosome 15
  Distance between a terminus base of telomere on chromosomal short arm and 5'-terminus of this base sequence : 51871257
  Distance between 3'-terminus of neighbour sequence of sequence listing upward to telomere on chrosomal short arm and 5'-terminus of this base sequence : 198239
acctgaggtaagagttcaagaccagcctgaccaacatggcgaaaccctgtctctactaaaaatacaaaaattagctgggcatggaggcacgcacctgaaatcccagctattcgtggggctgaggcaggagaattgcttgaacccgggaggcggagattgcagtgagccgagatcgcgccactgcactccagcctggtgacagagcaaggttccgtctcaaaaaaaaaaaaaaagaatacacagttgaagacaggaaaatgagacaagcgtttcagagtgacaaacaagaaacgagagagtttagaatccccagtctgtgacctcttaaatatttaattaatatagacagagagagagagagagagagagagagagagagaggaggggactgaaaaagagagaagtgagaccaggcagctaaatcatccttacctgat

SEQ ID NO: 21400 - DNA, 167 bp, Homo sapiens
  G09407
  Located on chromosome 15
  Distance between a terminus base of telomere on chromosomal short arm and 5'-terminus of this base sequence : 51995467
  Distance between 3'-terminus of neighbour sequence of sequence listing upward to telomere on chrosomal short arm and 5'-terminus of this base sequence : 123773
ttccttttagaggcacccttaacactttaatactttaataagcagcagctgaccacttctttcatgtccagttcatgctgctgctgctgctgctgctgctatgatcctattcccagaactcaaggagaacgacagtattttgctgaccctccaccacaagaccatag

SEQ ID NO: 21401 - DNA, 174 bp, Homo sapiens
  D15S1049
  Located on chromosome 15
  Distance between a terminus base of telomere on chromosomal short arm and 5'-terminus of this base sequence : 52235691
  Distance between 3'-terminus of neighbour sequence of sequence listing upward to telomere on chrosomal short arm and 5'-terminus of this base sequence : 240057
cactccagcctaaggaacacagtgagactctgtctcacacacacacacacacacacacacacacacacacacacaaagcatttgacaaaatccagcatccctttatgactaaaaccctcagcaaaatgggcacagaagggacataccttaaggtaataaaagccatctttgaca

SEQ ID NO: 21402 - DNA, 428 bp, Homo sapiens
  chr15.fa.O7frz.52181770
  Located on chromosome 15
  Distance between a terminus base of telomere on chromosomal short arm and 5'-terminus of this base sequence : 52315553
  Distance between 3'-terminus of neighbour sequence of sequence listing upward to telomere on chrosomal short arm and 5'-terminus of this base sequence : 79688
gtgagtaaacctagatgctcatagttagccaggttgaatttaagcaaaactcaaggatgttggagaaactgtggggggtgtgtgtgtgtgtgtgtgtgtgtaagatgaggactttcagtgaaggaaagggattataccaaaaaaggtacaattccacctgtgtttttttccatcactgcatatttttaaagttgaaggcagcttatcatttatcctaagaagccatttcagtttgtataatagccttcttcagacaaattatcatctggctattcttacagttcatcacttattccatccaaaagcatctatataacttttgacttagcattatgtagagacaaatgtagaactagcaggaaaattaattcaaacacatgaacgctattcatcagctatgattacagtttggctatgattcactatca

SEQ ID NO: 21403 - DNA, 295 bp, Homo sapiens
  D15S1029
  Located on chromosome 15
  Distance between a terminus base of telomere on chromosomal short arm and 5'-terminus of this base sequence : 52443435
  Distance between 3'-terminus of neighbour sequence of sequence listing upward to telomere on chrosomal short arm and 5'-terminus of this base sequence : 127454
aagagtaaaactccgtcacaaacacacacacacacacacacacacacacacacacacacacacacacacacactttgtgtgtgcacacaaagaagagaaaagaaaaaactgtgtgacagagatcaatagtgaaacttacttaactgaatgcagattaaattaaaaaccaacataatgagattataagcaaaataccatctggaaaactgcatagaaccacaggatgaagttctgtgtccctgcatctgaaaacagtctcccaccactgcttcttactgtgcagagactcaaatct

SEQ ID NO: 21404 - DNA, 260 bp, Homo sapiens
  D15S121
  Located on chromosome 15
  Distance between a terminus base of telomere on chromosomal short arm and 5'-terminus of this base sequence : 52533973
  Distance between 3'-terminus of neighbour sequence of sequence listing upward to telomere on chrosomal short arm and 5'-terminus of this base sequence : 90243
ttgtatcagggatttggttagcattttctttgctctagataaatgaaaagaacagagaagaaagggctgtgtggtgaagaatgtagaaagtaaaatgggtaatttgggggtggaagtcgaaaatccagagagaaagaaaaatgcacacacacacacacacacacacagaactagtaatgcgtgagaggaaccaggctaatgtcttagaagacgcagacatcgaaacaaaatgttgtactttatgtactgaagcgacaaca

SEQ ID NO: 21405 - DNA, 465 bp, Homo sapiens
  chr15.fa.O7frz.52531219
  Located on chromosome 15
  Distance between a terminus base of telomere on chromosomal short arm and 5'-terminus of this base sequence : 52664470
  Distance between 3'-terminus of neighbour sequence of sequence listing upward to telomere on chrosomal short arm and 5'-terminus of this base sequence : 130237
agttaaagtgtcacaactttgaagaatactttgctttaaaaagagtttctattaaatatgaattataggctgggcacggtggctcatgcctgtaatcctaacactctgggaggccaaggcaggtggatcacctgaggtcaggagtttgagaccagcctggtcaaaacggccaaaccccgtctctactaaaaatacaaaaattagccaggcgtggtggtggccacctagaatcccagctactcgtgaggcagaggcatgagaatcacttgaacctggaggggcagaggctgcagtgagctgagatcgcaccacttcactccagcctaggcaaaagagcaaaactccaactcaataaataaataaataaataaataaataaataaataaataaataaataaataaataataaatatgaattataaataattttccagggcaaatctactgtaaaaggcaaaggatta

SEQ ID NO: 21406 - DNA, 476 bp, Homo sapiens
  chr15.fa.O7frz.52636402
  Located on chromosome 15
  Distance between a terminus base of telomere on chromosomal short arm and 5'-terminus of this base sequence : 52769841
  Distance between 3'-terminus of neighbour sequence of sequence listing upward to telomere on chrosomal short arm and 5'-terminus of this base sequence : 104906
accacattagtcactgttgaagaagttacaagaatggaaagagaaaacttgaatgagtcttgtgttgttataatgaaattggtggtgttgatatgaactcaaaagtttttaacatatatatatagtatataaataaatgtagatgtaaacctctgctgcatacacacacacacacacacacacacacacacacacacaaatattttctacatttgtattctaagagggcctgggaacaatgacaccccaaaagcaatgagcatatcttgcatccatattttaactttttactaaaagaaaccagggctccttggaaaaatggctgattccaggactaggacaaggcaaataaaagttgagcctgaaacatcttgttatcccagaaaataatgaaagtaatgatggagacagaataaaaggacacaggaaccaacctgaaaaaagctcccactggccaaagatggcctaacttgagc

SEQ ID NO: 21407 - DNA, 462 bp, Homo sapiens
  chr15.fa.O7frz.52749564
  Located on chromosome 15
  Distance between a terminus base of telomere on chromosomal short arm and 5'-terminus of this base sequence : 52897963
  Distance between 3'-terminus of neighbour sequence of sequence listing upward to telomere on chrosomal short arm and 5'-terminus of this base sequence : 127646
gaattgcattcaatctgtagactgctctgggtagtatggtaattttaataatattaattcttctgatctatgagcatgggatgtcttttcatttatttgtatcttctttaatttcttttatcactgttttttagttttccttgtagaagtctttcgcatccttggttaagcgtattctgagggtttcttctgtgtgtgtgagtgtgtgtgtgtgtgtgtgtgtgtgtgtgtgtgtgtatgtggctaacataaatgggattactttcttgattgcttttttcagctagttcatatatacagtttttaatcttaaaaaagcatgatatttttccattttacaaaaggatagtaggcaaacattaaacgttaaggacttcctcatggatacaaatcccagtatatgtctaaataaattaggactcaaatttatatacatatagctactttccaagtccaatcttt

SEQ ID NO: 21408 - DNA, 284 bp, Homo sapiens
  D15S962
  Located on chromosome 15
  Distance between a terminus base of telomere on chromosomal short arm and 5'-terminus of this base sequence : 53055423
  Distance between 3'-terminus of neighbour sequence of sequence listing upward to telomere on chrosomal short arm and 5'-terminus of this base sequence : 156998
ggatattttggaactgcactagttattttaaagtttattctggataaagaaactgctactgttgtgaaaagtgaggtaaaaaataaatttgaggactgaatgtataatatgatccaatttgtgaaaatagagggggagaataaacatatatgtttttatttatagtgtgtacattgtgtggtgtgtgtgtgtgtgtgtgtgtgtgtgtgtgtacatatacacatacataacatttctggaaaaatacaacaaaatgttaacagtggtccccaatgagcagaatt

SEQ ID NO: 21409 - DNA, 310 bp, Homo sapiens
  DISO7_10004023
  Located on chromosome 15
  Distance between a terminus base of telomere on chromosomal short arm and 5'-terminus of this base sequence : 53198980
  Distance between 3'-terminus of neighbour sequence of sequence listing upward to telomere on chrosomal short arm and 5'-terminus of this base sequence : 143273
ctgattggtttctagagctctcccaaagctattttggtctgtgtatcatatagtcagtcttttaatggggaagcaaaggcctggagcttcctaatccaccattttgctgacaacactcttatcttttaaagaggtgttttttttttttttttttgaaaaggtgtatatatatatatatatatatatatatatatatatatacacacacacaaacacacacacacacacgtatgtatacataagattacacattactatttcttttttctccatcttttttatgtgtgtgtacagagattcacatttcctt

SEQ ID NO: 21410 - DNA, 337 bp, Homo sapiens
  chr15.fa.O7frz.53329921
  Located on chromosome 15
  Distance between a terminus base of telomere on chromosomal short arm and 5'-terminus of this base sequence : 53378519
  Distance between 3'-terminus of neighbour sequence of sequence listing upward to telomere on chrosomal short arm and 5'-terminus of this base sequence : 179229
gcacgttgatcttgtatcttacaaattacggaatttattagctctagtagctttcttgtggattatttgggattttctacatataagatcatatcatctgtgaatagttttactttttcctttttaatctggatgccattttatctttcatctatctatctatctatctatctatctatctatctatctatctatccatccatccatctatctgttttggctaaaacttccaatacaatgtcaaatagctgtggtgaaagcaggcatgtttgtcttgttcctgatcttggggaaaaggattttagtcttgcaccactgagtatgatttctgctacga

SEQ ID NO: 21411 - DNA, 269 bp, Homo sapiens
  Z67030
  Located on chromosome 15
  Distance between a terminus base of telomere on chromosomal short arm and 5'-terminus of this base sequence : 53591706
  Distance between 3'-terminus of neighbour sequence of sequence listing upward to telomere on chrosomal short arm and 5'-terminus of this base sequence : 212850
agctacaatacatgtagttactatgtgtagtaatcaaagtgtgtgtgtgtgtgtgtgtgtgtgtgtgtgtgtgtgtgtggtcttccatgaggaagcaaccttctttatcctcatcttctctaaaccctaattcatttgtactttcactcattttcccaaggaatatgttattcctttagaagtcatttttaatggctagagaaagataaagaaggctaaataggaaagccttgctcagaaagccctgttgctcctgctgctgctttgaa

SEQ ID NO: 21412 - DNA, 182 bp, Homo sapiens
  D15S1008
  Located on chromosome 15
  Distance between a terminus base of telomere on chromosomal short arm and 5'-terminus of this base sequence : 53692995
  Distance between 3'-terminus of neighbour sequence of sequence listing upward to telomere on chrosomal short arm and 5'-terminus of this base sequence : 101020
tcgagccttctgaaacagagtacttttattttatacacacacacacgtgtgtgtgtgtgtgtgtgtgtattatgttcttaacatgggaaatgacttaaaaacatcaactgaaacctaagggcccactgcttttatttttaatgggtttaattcctttattaactgctgttaggaggcagcac

SEQ ID NO: 21413 - DNA, 433 bp, Homo sapiens
  chr15.fa.O7frz.53612467
  Located on chromosome 15
  Distance between a terminus base of telomere on chromosomal short arm and 5'-terminus of this base sequence : 53712954
  Distance between 3'-terminus of neighbour sequence of sequence listing upward to telomere on chrosomal short arm and 5'-terminus of this base sequence : 19777
aagttagactgcacatctagacatgatgtctttagcaattgtttcttcttcttctttcttcttcctcttcttcttcttctcctcctcctcctcctcctccttcttcttctcctcctcctccttcttcttctccttcttctccttcttcttccttttcctcttcctcttcttcttcttctccttctcctcctcctcctccttctcctccttcttctccctctcctccttctccctctccttctccttctccctctcctccctatccttctccctctccttctccctctccctctcccctttcccctcctccccccttcctatccccttctctccccccccttctcctccttctccttctccttctccttcttctgagatgaggtctaactctgttgcccaggctggggtacagtggtatgatcatagcctactg

SEQ ID NO: 21414 - DNA, 239 bp, Homo sapiens
  D15S648
  Located on chromosome 15
  Distance between a terminus base of telomere on chromosomal short arm and 5'-terminus of this base sequence : 53858664
  Distance between 3'-terminus of neighbour sequence of sequence listing upward to telomere on chrosomal short arm and 5'-terminus of this base sequence : 145277
ggcatcattctgaggatgtcattgttgggggaaaaagaaaaaaaatagggtccctgtgctctcagaatttgtaagacataatctctaacttggatgatgatgataataataataataataataataataatataatgactagtgtttattatgtgcttactatgtgccaggaacttttccaagtgctacatatatttacttatttaatccttttgtaacaacctgtgaagtgaacgcat

SEQ ID NO: 21415 - DNA, 232 bp, Homo sapiens
  chr15.fa.O7frz.53807889
  Located on chromosome 15
  Distance between a terminus base of telomere on chromosomal short arm and 5'-terminus of this base sequence : 53937625
  Distance between 3'-terminus of neighbour sequence of sequence listing upward to telomere on chrosomal short arm and 5'-terminus of this base sequence : 78722
aagttcgcatcctttaatctaccagtttcccttctttgtgtctatcctgaaggaatgtatgtctgtgtgtgtgtgtgtgtgtgtgtgtgtgtgcgtacacgagatgtgcaaggatatttgtttcaatattgctcatgacaaaaaaatataaaaactatctttccgtagggaaatatataaactggttttatttgtataatggaatattgtatagcagtaaagatgctcaaac

SEQ ID NO: 21416 - DNA, 354 bp, Homo sapiens
  AC046203.2_45530
  Located on chromosome 15
  Distance between a terminus base of telomere on chromosomal short arm and 5'-terminus of this base sequence : 54187011
  Distance between 3'-terminus of neighbour sequence of sequence listing upward to telomere on chrosomal short arm and 5'-terminus of this base sequence : 249154
gataatcgcaccaaagataagcatagaggtgagtgcagtgaggaacagtacttgtgtgaagagacagacttttgagatagctgtgtggagttgttctgggttcaaggggagtctgcagtgtggttaactgccctgccctgttgaaactagatatatcatttccagaggtcaccgtggtgtttgccaattatctcacagtgaatttgtcacctgtgttcctcacacttttttaaaaccaaaacaacaacaacaacaacaacaacaaaccaacaaaaacaatccaccaaaaccaagatttgctttcacgtctcatccaccctacaatcaaatgattggtttcttaggccgaggtta

SEQ ID NO: 21417 - DNA, 424 bp, Homo sapiens
  chr15.fa.O7frz.54223873
  Located on chromosome 15
  Distance between a terminus base of telomere on chromosomal short arm and 5'-terminus of this base sequence : 54285633
  Distance between 3'-terminus of neighbour sequence of sequence listing upward to telomere on chrosomal short arm and 5'-terminus of this base sequence : 98268
cagttcagtggttttagtattcacacagttgtacaaccatcaccacagtcaatgttagaacattttcctaacccctaaaaagaaattccatcgccattagcagtcactcctggccccttccccatatccctccctgtacctccctgtagcagcccagggcaatcactaatctattttctgtctccgtagatttgctattccagactttcatataaatgtcaatatgggtgtgtgtgtgtgtgtgtgtgtgtgtgtgtgtgtgtgtgtgtttgtgtgattggcttctttaggataatatgttcaaagttcatccatgttgtggtgtgtgtcagtatttcattcctttgaatggccaaataatattccattctatggatatgccacattttgtttacccattcactgtttgatggacatgtagatt

SEQ ID NO: 21418 - DNA, 213 bp, Homo sapiens
  D15S998
  Located on chromosome 15
  Distance between a terminus base of telomere on chromosomal short arm and 5'-terminus of this base sequence : 54373824
  Distance between 3'-terminus of neighbour sequence of sequence listing upward to telomere on chrosomal short arm and 5'-terminus of this base sequence : 87767
ttggagcctgtgtatgtgtgtatgtgtgataggcatatatgtacgtgtgtgcacacttgtgtgtgtgtgtgtgtgtgtgtgtgatgtggtgcaggagaaaaggacttccttttccctgcagaattatgcatggactagacccagcctaataggagattgttgagcaccacaggtttggattgtctctgtggtctgagttacactttgatgctt

SEQ ID NO: 21419 - DNA, 247 bp, Homo sapiens
  DISO7_00003367
  Located on chromosome 15
  Distance between a terminus base of telomere on chromosomal short arm and 5'-terminus of this base sequence : 54445934
  Distance between 3'-terminus of neighbour sequence of sequence listing upward to telomere on chrosomal short arm and 5'-terminus of this base sequence : 71897
ctggagtatccagcaaaggcaggcgtcttctgcctttctctttttttataaattggagagttcagacattgctggggaagctcactgtctctttctctctctctctctgtctgcacgtgtgcgcatgcgtgcatgcgtgtgtgtgtgtgtgtgtgtgtgtgtgtgtgtgtgtgtgtgtgtgtgtgtgtgtgaatgctgatgactctccgggaataagccagcactggggatgaggtgatagattcag

SEQ ID NO: 21420 - DNA, 178 bp, Homo sapiens
  DISO7_10004026
  Located on chromosome 15
  Distance between a terminus base of telomere on chromosomal short arm and 5'-terminus of this base sequence : 54779526
  Distance between 3'-terminus of neighbour sequence of sequence listing upward to telomere on chrosomal short arm and 5'-terminus of this base sequence : 333345
gaatcagattgtttatcactgtctctcaacacacctaaatcacatttatcacacaaaattgttttgacatattcaaaattatttattttttaaataattacattaaagtcttggcctctctctctctctctctctcttactctcccagtgtcactctctatcctctggatctctgatc

SEQ ID NO: 21421 - DNA, 453 bp, Homo sapiens
  AC016050.4_143456
  Located on chromosome 15
  Distance between a terminus base of telomere on chromosomal short arm and 5'-terminus of this base sequence : 54954879
  Distance between 3'-terminus of neighbour sequence of sequence listing upward to telomere on chrosomal short arm and 5'-terminus of this base sequence : 175175
tactgctagtctccagaactgtggctttcctggatttgaaaggaaaacacaacagttgaagtgtttataaggctttaggaaatcatctgtgcttcaatacactggcattttcttgctcattgtagccactgagtggcaggggcaggtgaagaaaggactcttgtggcttagccagcagccagaatcccccacccactgcaagtccattttgccctggagacttggaaaaagcatagctttctccacagggagtggtagaggcttctggaaacaagtgcacctattggttctgtgcaggatcatcatcatcatcatcatcatcatcatcatcaccaccatcatccctcctttgtttacgaccaaggccacagcctgaaagtccacatctcaatgtggtgtctctgattccccctccacaaaaaatgtcatctgtattcctcaaatgaacatctg

SEQ ID NO: 21422 - DNA, 166 bp, Homo sapiens
  G09469
  Located on chromosome 15
  Distance between a terminus base of telomere on chromosomal short arm and 5'-terminus of this base sequence : 54955123
  Distance between 3'-terminus of neighbour sequence of sequence listing upward to telomere on chrosomal short arm and 5'-terminus of this base sequence : -209
acagggagtggtagaggcttctggaaacaagtgcacctattggttctgtgcaggatcatcatcatcatcatcatcatcatcatcatcaccaccatcatccctcctttgtttacgaccaaggccacagcctgaaagtccacatctcaatgtggtgtctctgattccc

SEQ ID NO: 21423 - DNA, 206 bp, Homo sapiens
  D15S198
  Located on chromosome 15
  Distance between a terminus base of telomere on chromosomal short arm and 5'-terminus of this base sequence : 54962747
  Distance between 3'-terminus of neighbour sequence of sequence listing upward to telomere on chrosomal short arm and 5'-terminus of this base sequence : 7458
ggggctttgacatggagatccagggaagttcagatgacagcgccaacgttaactgcacactctggtcataagcatgagacatttcactggtattttgtggtatgatgtgtgtgtgtgtgtgtgtgtgtgtgtgaaagagagagagagacagagaaagagaggcggctctaggtaaattcaatagagataaaactgtcccacataat

SEQ ID NO: 21424 - DNA, 148 bp, Homo sapiens
  D15S117
  Located on chromosome 15
  Distance between a terminus base of telomere on chromosomal short arm and 5'-terminus of this base sequence : 54970741
  Distance between 3'-terminus of neighbour sequence of sequence listing upward to telomere on chrosomal short arm and 5'-terminus of this base sequence : 7788
ccctaaggggtctctgaagagaaattgtgtgtgtgtgtgtgtgtgtgtgtgtgtgtgtgtgtgtgtgtcagggctgggggtggggtttcagaacacagtgtcacagtttgaaaatcattgataaagacttgggataagttgttggtgc

SEQ ID NO: 21425 - DNA, 382 bp, Homo sapiens
  chr15.fa.O7frz.55046675
  Located on chromosome 15
  Distance between a terminus base of telomere on chromosomal short arm and 5'-terminus of this base sequence : 55060686
  Distance between 3'-terminus of neighbour sequence of sequence listing upward to telomere on chrosomal short arm and 5'-terminus of this base sequence : 89797
aatagcctaaagtccttagcagagcatggattgatgaaatgactccaaccactgtacctcatccttgtgacactgcagcccaaattccaagtttcaagtatgggtgtgtatgcgtgtgtgtgtgtgtgtgtgtgtgagaaagagagagagagagagggacttggtagttaagcagaggcattagtgcttttctgttactaggtttgggcttgaagaatatgacaaagcctctagcttctgaagaggaagaacatgccattgatttattgcctctctcaatttctgtaggagaactgttgctctgaaaataatttggaccactgtaaaaaaagatctttggtactggggggctaaaacagtatcaactattactgccaaggta

SEQ ID NO: 21426 - DNA, 295 bp, Homo sapiens
  D15S150
  Located on chromosome 15
  Distance between a terminus base of telomere on chromosomal short arm and 5'-terminus of this base sequence : 55142912
  Distance between 3'-terminus of neighbour sequence of sequence listing upward to telomere on chrosomal short arm and 5'-terminus of this base sequence : 81844
ctgtatggcctcagtctcgggaaattgcagggggaatggtagccaacttggaagtgcaatcatgtccactttcctgctgtcttgccagccgcacagcagccatttaagacgcagaatttctttttgcagcacatcttccctaaagtctgagtcagcctcacccacatctatacaactgcatcaagctttctggtaacacacacacacacacacacacacacacacacacacacacacgtccgagtaacccagagcccgctgctgctgctgtgaccagggacttccgcacagagct

SEQ ID NO: 21427 - DNA, 161 bp, Homo sapiens
  D15S1033
  Located on chromosome 15
  Distance between a terminus base of telomere on chromosomal short arm and 5'-terminus of this base sequence : 55252453
  Distance between 3'-terminus of neighbour sequence of sequence listing upward to telomere on chrosomal short arm and 5'-terminus of this base sequence : 109246
taaacggcttcagggaacattttgtgtgtgtgtgtgtgtgtgtgtgtgtgtgtgtgtgtgtgtacgccttaagagactggatctcactctgttgcccaggctggagtgcagtggcatgatcgtagtttactctaacattgaactcctggcccaagtaatcc

SEQ ID NO: 21428 - DNA, 296 bp, Homo sapiens
  chr15.fa.O7frz.55400977
  Located on chromosome 15
  Distance between a terminus base of telomere on chromosomal short arm and 5'-terminus of this base sequence : 55370131
  Distance between 3'-terminus of neighbour sequence of sequence listing upward to telomere on chrosomal short arm and 5'-terminus of this base sequence : 117517
tcttaatatggaacagccaagccttacatatgaaacactcgacttacacatttattttgtagatttccctaggaactaacatttatctaggaaatcaagtaagtattttctactcccttctacatatgaaactctttgcattggtggctctgcagtgagtgtgtgtgtgtgtgtgtgtgtgtgtgtgtgtgtatcagtggttttcccattataaaacatttgaggcagaaggtatctgaagttctattcaacccttcttctgtcctcccacccttaagataaccacgttaactgtg

SEQ ID NO: 21429 - DNA, 134 bp, Homo sapiens
  D15S148
  Located on chromosome 15
  Distance between a terminus base of telomere on chromosomal short arm and 5'-terminus of this base sequence : 55534133
  Distance between 3'-terminus of neighbour sequence of sequence listing upward to telomere on chrosomal short arm and 5'-terminus of this base sequence : 163706
tgtaacctccaactcaagccgaattagggagagtgtgtgtgtgtgtgtgtgtgtgtaaattgttttgttttgctttctaaagacaaggtatccgctgtctcgccaggctgaagtgcagtggtgtgatcatagct

SEQ ID NO: 21430 - DNA, 142 bp, Homo sapiens
  D15S964
  Located on chromosome 15
  Distance between a terminus base of telomere on chromosomal short arm and 5'-terminus of this base sequence : 55577685
  Distance between 3'-terminus of neighbour sequence of sequence listing upward to telomere on chrosomal short arm and 5'-terminus of this base sequence : 43418
gggaaatgagtttctgagataaagtagaataaaagttttttttggggtgtgtgtgtgtgtgtgtgtgtgtgtgtgtgtgtgtgttttaagaataaaatatttttgttggagaagaggtcaaggaacagacaggcagggtatt

SEQ ID NO: 21431 - DNA, 329 bp, Homo sapiens
  chr15.fa.O7frz.55655139
  Located on chromosome 15
  Distance between a terminus base of telomere on chromosomal short arm and 5'-terminus of this base sequence : 55606901
  Distance between 3'-terminus of neighbour sequence of sequence listing upward to telomere on chrosomal short arm and 5'-terminus of this base sequence : 29074
attagccaggcacctctagctccacgtacttgggaggctgaggctgaaagatcacttgagcccaggaggtcaaggctgcagtgagccaatatcatgccactacactccagcctgggcaacagaacagaatctgtctcaaaaacaaaacaaaacaaaacaaaacaaaaaacagtatagagtcgttgatcattgattcatctgacaactcttttgttacagcatgaggcagcagtgttcaaattttaggagagaaagaagcaataaaaactattacaaaagtatattctctcaattaacaaaattccttctcaatgagctagaatgtatgg

SEQ ID NO: 21432 - DNA, 389 bp, Homo sapiens
  AC023890.4_106288
  Located on chromosome 15
  Distance between a terminus base of telomere on chromosomal short arm and 5'-terminus of this base sequence : 55953213
  Distance between 3'-terminus of neighbour sequence of sequence listing upward to telomere on chrosomal short arm and 5'-terminus of this base sequence : 345983
agtaagtgtcaaagtgcttgatacaagtgtagctcaaggccaggcacggtggctcacgcctctaatcccagcactttgggaggctgagatgagtggatcacttgaagtcgggagttcaagacgagcctggccaacgtggtgaaaccttgtctctcactaaaaatacaaacattagccaggggtggtggctcaggcctgtaatcccagctactcgggagcctgaggcaggagaaccacttggaccagggaggcagaagttgcagtgagctgagatcacgccactgcactccagcctgggtgacagagcgagactctgtctaaaacaaaacaaaacaaaacaaaacaaaacaaccacacaaatgtagctcaattaggataatttatggtcc

SEQ ID NO: 21433 - DNA, 426 bp, Homo sapiens
  AC023890.4_10896
  Located on chromosome 15
  Distance between a terminus base of telomere on chromosomal short arm and 5'-terminus of this base sequence : 55996350
  Distance between 3'-terminus of neighbour sequence of sequence listing upward to telomere on chrosomal short arm and 5'-terminus of this base sequence : 42748
tgaggacttcttgacttcagactctgggctccacaactgggagggaagaaactgctactgttttaagtcactcagtttgtggtgctttgttatggtggccccaggaatcctaaacaatatgctatcaggaaacaatggaaactgcactgaactatttatttattattattattattattattattattattattattattattattattttgagacgaagtctcgctctgtcgccaaggctggagtgcagtggcacgatctcagctcactgcaacctctgcctcctgggttcaagcgattctcctgcctcagccccctgagtagctgggtctacaggcacacaccatcacgcccagctaatttttgtatttttagtagagacggggtttcatcatgttggccaggctggtctcgaattcctgacct

SEQ ID NO: 21434 - DNA, 283 bp, Homo sapiens
  HUMUT7078B
  Located on chromosome 15
  Distance between a terminus base of telomere on chromosomal short arm and 5'-terminus of this base sequence : 56180215
  Distance between 3'-terminus of neighbour sequence of sequence listing upward to telomere on chrosomal short arm and 5'-terminus of this base sequence : 183439
cctgccactgatcgtgcataaattactctggttaacaaccttctacctagcaggctccaggaatcacaggaccaatgtgtcagggatctcctttttcacataaactctgggctgggattttttccagtgtagccttcttcttcttctttcttctcctcctcctccttctcctccttctcctccttcttcctcttcttcctattcctcctcttcttcttcttcttctttaaattttcctttttctttttgagacagggctccctctgttgcccatgctggagtg

SEQ ID NO: 21435 - DNA, 216 bp, Homo sapiens
  D15S643
  Located on chromosome 15
  Distance between a terminus base of telomere on chromosomal short arm and 5'-terminus of this base sequence : 56205265
  Distance between 3'-terminus of neighbour sequence of sequence listing upward to telomere on chrosomal short arm and 5'-terminus of this base sequence : 24767
atacctggagtccttggtccttcttgggaaaaagtattgaggttttaaagctcttatccttggggacagattaaacccttaaactatctatctgtctgtctgtctgtctatctatctatctgtctatctatctatctatctatctatctatctatctatctatctatctacctacctaactacctaccaaaaaagcattgaggttttaaagctgtt

SEQ ID NO: 21436 - DNA, 374 bp, Homo sapiens
  chr15.fa.O7frz.57171102
  Located on chromosome 15
  Distance between a terminus base of telomere on chromosomal short arm and 5'-terminus of this base sequence : 56420261
  Distance between 3'-terminus of neighbour sequence of sequence listing upward to telomere on chrosomal short arm and 5'-terminus of this base sequence : 214780
tttctttaatagaccagatcgtagatttatttatttatttatttatttatttatttattttttgtagagacagagtcttgctctgtcacccaggctagagtgctggagtgcagtggtgcgatctcagctcactgcaacctccgcctccagagttcaagcaattctcctgcctcagcctctcgagtagctgggattacaggtgcccgccaccacacccggctaatttcttttgtatttttagtagagatggggtttcattatgttgcccaggcttgtctcgaactcctgagctcaggcagtccacccacctcggcctcccaaagtgctaggattataggcgtgagccactgcactcggtccatagataatttagg

SEQ ID NO: 21437 - DNA, 265 bp, Homo sapiens
  D15S155
  Located on chromosome 15
  Distance between a terminus base of telomere on chromosomal short arm and 5'-terminus of this base sequence : 56532582
  Distance between 3'-terminus of neighbour sequence of sequence listing upward to telomere on chrosomal short arm and 5'-terminus of this base sequence : 111947
gatttccatagcacacatttgagtttttaatttggacttctagagagcagaaaaacattggaggtgatgttttaggcaacaagatgactacaacaaatgtttccatccaagaaagaggctattcatgtctgtgtgtgtagtgtatgtatgagagtgtgtgtatgtgtgtgtgtgtgtgtgtgtgtgtgtgtgtgtgtgtgtgtgcgctatagtcaccatctctagtgaggagtacctggagagatgggactacctgcctagaaaa

SEQ ID NO: 21438 - DNA, 152 bp, Homo sapiens
  HUMUT1232
  Located on chromosome 15
  Distance between a terminus base of telomere on chromosomal short arm and 5'-terminus of this base sequence : 56593657
  Distance between 3'-terminus of neighbour sequence of sequence listing upward to telomere on chrosomal short arm and 5'-terminus of this base sequence : 60810
tcatcacatgggctaattcccgtaataaatctctctctctctctctctctctctatctatctatatctatctatctatctatctatctatctatctatctatctatctatctatgtctatacatctattcatccttcttattaattttgctt

SEQ ID NO: 21439 - DNA, 430 bp, Homo sapiens
  chr15.fa.O7frz.56920301
  Located on chromosome 15
  Distance between a terminus base of telomere on chromosomal short arm and 5'-terminus of this base sequence : 56730936
  Distance between 3'-terminus of neighbour sequence of sequence listing upward to telomere on chrosomal short arm and 5'-terminus of this base sequence : 137127
aaatgcaacatcttagaaacttacaatgtactttgacatattaaggactctgagcccggacatcatgggtcacatctgtaatcccagcactttgggaggccaaagcaggacaattacttgagcccaggagttccagaccagcctgggcaacatagtgaaaccctgtctctacaaaaataaaaaaaatgagccagctgtggtggcatgtgcctgtagtcccagctactcaggaaactgcggcaggaggatcccttgagcccaggagtccaaggccgcagtgaggtaggatcgtgccactgcattctaacctgggtgacagagtgaaaccctgtctctaaaaataaataaataaataaataaataataatctgagaagtcctgagaaataaactctgtggaaatgtgttcagtgcaaagtttcacaagctat

SEQ ID NO: 21440 - DNA, 397 bp, Homo sapiens
  DISO7_00003373
  Located on chromosome 15
  Distance between a terminus base of telomere on chromosomal short arm and 5'-terminus of this base sequence : 56814917
  Distance between 3'-terminus of neighbour sequence of sequence listing upward to telomere on chrosomal short arm and 5'-terminus of this base sequence : 83551
cctgattggaccctgactaatacagaggagaaagaggagagatgcgacaggcaaaatgggagaaaaaacctgttctctctcaattccctacaaaattctctctttctctttctctgtctctctccctctctctctctctctctctctcacacagacacacacacacacacacacacacacacacacacacacacacccctacccaaaggccactgagaaccactagtttcctgcattctttgttgtagcctgggtttcccagaaagcagacccgagaagggcttatgtgctacacttttgttcgtgagtgcaatcacaggaagcaagagtaaagatcagggtgtgaaggcagggaatgagaggaacccaacgaaaagatccattatcacccttcaag

SEQ ID NO: 21441 - DNA, 387 bp, Homo sapiens
  AC012371.4_92885
  Located on chromosome 15
  Distance between a terminus base of telomere on chromosomal short arm and 5'-terminus of this base sequence : 56891791
  Distance between 3'-terminus of neighbour sequence of sequence listing upward to telomere on chrosomal short arm and 5'-terminus of this base sequence : 76477
cagtgaactataatcatgccagtgcactccagcctgggcaacagagcaagaagctgaaaaaagaaaagaaagaaagggaaagtaaagaaaagaagagaagagagaaagagaaagagggaaggaaggaaggaaggacgggagggagggaaggaaggaaggaaagaggaaagaaagaaagaaaggaaagaaagaaagaaagaaagaaagaaagaaagaaagaaagaaagagaaagaagagagaaagagaaagaagaaagaaagaaagaagaaaagaaagagggagggagggagagaggaaagaaagaatgaaagaaaaagaaagaaagaaacaaaggaaggaaggaaggaaagaaacatgagtatcttgtccatgtagtgctataatct

SEQ ID NO: 21442 - DNA, 387 bp, Homo sapiens; identical to SEQ ID NO: 21441
  AC022480.5_146635
  Located on chromosome 15
  Distance between a terminus base of telomere on chromosomal short arm and 5'-terminus of this base sequence : 56891791
  Distance between 3'-terminus of neighbour sequence of sequence listing upward to telomere on chrosomal short arm and 5'-terminus of this base sequence : -387

SEQ ID NO: 21443 - DNA, 166 bp, Homo sapiens
  HUMUT5937
  Located on chromosome 15
  Distance between a terminus base of telomere on chromosomal short arm and 5'-terminus of this base sequence : 56899149
  Distance between 3'-terminus of neighbour sequence of sequence listing upward to telomere on chrosomal short arm and 5'-terminus of this base sequence : 6971
atgacgccactccagagggactctgtctcaaaaaagaaagagagagacagagaaggaaagaaacaaggaaggaaggaaggaaggaaggaaggaaggaaggaaggaaggaaaagttggggtcgggaagaggggctaaactagtatgaggctggaaaggctgtcgtgg

SEQ ID NO: 21444 - DNA, 238 bp, Homo sapiens
  Z66910
  Located on chromosome 15
  Distance between a terminus base of telomere on chromosomal short arm and 5'-terminus of this base sequence : 56907620
  Distance between 3'-terminus of neighbour sequence of sequence listing upward to telomere on chrosomal short arm and 5'-terminus of this base sequence : 8305
gtgagccatgatcgtgccactgcactccagcctgggcaacatagtgagactccatctcaaacaataaaaaataaaaataaaaaggaaataagtctgtgaatacttaaataaaaagataaaaatctggtcttcttggaggtgagggtattttttcttttttctttgtgtgtgtgtgtgtgtgtgtgtgtgtttctggctttggtgttatgtttaaataggcattcctcacactaaaatt

SEQ ID NO: 21445 - DNA, 215 bp, Homo sapiens
  Z66754
  Located on chromosome 15
  Distance between a terminus base of telomere on chromosomal short arm and 5'-terminus of this base sequence : 56910425
  Distance between 3'-terminus of neighbour sequence of sequence listing upward to telomere on chrosomal short arm and 5'-terminus of this base sequence : 2567
agcatccctggcttctccccgtgagatgccagcagttaccaacaccccagttgtgatcatcaaaatgtctctagacattgccaaaaatcactcccagttgagacccactgccttagacgtgtgtgtgtgtgtgtgtgtgtgtgtaggcaagcagataggttgagagatttattcaatattgatatagagaggaaaaggctaacattaaacaaacc

SEQ ID NO: 21446 - DNA, 248 bp, Homo sapiens
  DISD22_0009627
  Located on chromosome 15
  Distance between a terminus base of telomere on chromosomal short arm and 5'-terminus of this base sequence : 57043856
  Distance between 3'-terminus of neighbour sequence of sequence listing upward to telomere on chrosomal short arm and 5'-terminus of this base sequence : 133216
cacactacttactcaaagcaagcaagcaagccccacactgcttattcacaggaaggaaggaatgagtgaaggaaggagggagggaggtagggaagtaaggaaggaaggacagaaggacggaaggaacgaaggaaggacgaatggaggaaggcaggcaggcaggcaggcaggcaggcaggcaggctggcaggcaggcaggcaggcccacactgcttattcacaaaatgcagaggaaacttctgaatctt

SEQ ID NO: 21447 - DNA, 245 bp, Homo sapiens
  AC012344.4_13218
  Located on chromosome 15
  Distance between a terminus base of telomere on chromosomal short arm and 5'-terminus of this base sequence : 57359436
  Distance between 3'-terminus of neighbour sequence of sequence listing upward to telomere on chrosomal short arm and 5'-terminus of this base sequence : 315332
gatttgaattcctgaatcctaggtgtatcttattccaaaggccatagacttcttaatacaccacctaaaaagcaccaagacaaacatgtagggccgactgaataacaacaacaacaacaaaagatgaacaaacaacaaaacaaacacgcaaaaaaacacttttcaatttctgtagtccgagttccctacaatggttcagatgagggagatggcattttatagggtatcaaataccaggtttccat

SEQ ID NO: 21448 - DNA, 448 bp, Homo sapiens
  chr15.fa.O7frz.57626461
  Located on chromosome 15
  Distance between a terminus base of telomere on chromosomal short arm and 5'-terminus of this base sequence : 57537523
  Distance between 3'-terminus of neighbour sequence of sequence listing upward to telomere on chrosomal short arm and 5'-terminus of this base sequence : 177842
ctatccataaacagcctttctcacaatgagatgttccgagtttaggagccttgctattttcaacaaagaattaattgcaaagtaattaagtttagagcaagggaatagatgaaccctgtctatcataaaggaacagtgtggatggtgacataatggagcaaggagacgatgcttcagattaacacacacacacacacacacacacacacacacacacaatctcttttctaaagcacacaaagaaacctcccatcacatatattgacaagataaatctaagctgcttaaagaagcacttaattttgttctcattaagtcgcagggttaagggctttaccctcaacgcccatggaagcaatgttaggttttcaccttggaaagttctctgaggccctaagtccattgacaaatatagcactaagatgtgttacagaaaattgcatctgaa

SEQ ID NO: 21449 - DNA, 423 bp, Homo sapiens
  chr15.fa.O7frz.57738634
  Located on chromosome 15
  Distance between a terminus base of telomere on chromosomal short arm and 5'-terminus of this base sequence : 57632598
  Distance between 3'-terminus of neighbour sequence of sequence listing upward to telomere on chrosomal short arm and 5'-terminus of this base sequence : 94627
accaggaagataagtaatctgatccattgagcttgaactctggcattaaggagacacatatttcaaaagtttccgtctggcaatagtcactaaattaattattatacatgagaaaaaaaaacttaattaatgtgtgagccccaaacaatgaaatgagctcagaagctttcctccaccccttccccttcatttccccaacagacacacacacacacacacacacacacacacacacacacacacacacaccacctgcagtgtacttacaaaatatgtatggaatattttacctatgaaatatacttcataatttatttagaaagtagcaaagcattcaaaaatgagtttaaaaagcttgttcaagatttgtctcaggaatcaagtactgaacttggagaaaccttaggactctacttagaatcc

SEQ ID NO: 21450 - DNA, 419 bp, Homo sapiens
  chr15.fa.O7frz.57838700
  Located on chromosome 15
  Distance between a terminus base of telomere on chromosomal short arm and 5'-terminus of this base sequence : 57733032
  Distance between 3'-terminus of neighbour sequence of sequence listing upward to telomere on chrosomal short arm and 5'-terminus of this base sequence : 100011
tcgctttgagaatagcctaggcaacacagtgagacattgtctctaaaaataaataaataaataaataaataaataaataaataaataaatttaaattagtcaggactggtggtacacacctatagtcccagctaccctggaggctgaggcgggaagatcacttgagcccaggagtttgaggctgcagtgagctatgatcatgccactgcatcagcctgggtgacagagtgatactctaactcttaaaaaaaaagagagaaatggaggcaggaaaggcagaactcttcagaaaacaaggcaatgcattctggcttttttggtttttgagaaacatcacataggctggatggtgaagtgctctaagaatatctattcaaaatgactatgaaaaggttctatctagcatacagttttcagga

SEQ ID NO: 21451 - DNA, 157 bp, Homo sapiens
  Z67427
  Located on chromosome 15
  Distance between a terminus base of telomere on chromosomal short arm and 5'-terminus of this base sequence : 57836280
  Distance between 3'-terminus of neighbour sequence of sequence listing upward to telomere on chrosomal short arm and 5'-terminus of this base sequence : 102829
gcctataaagtccacagtgggtcaaaaatttttttatggaagaagagatgatattggggtttgtgtgtgtgtgtgtgtgtgtgtgtgtttgattactgctattcttataaactgaaaacaaaatatgttaggtgcttgaattggttgttctcagacg

SEQ ID NO: 21452 - DNA, 254 bp, Homo sapiens
  D15S970
  Located on chromosome 15
  Distance between a terminus base of telomere on chromosomal short arm and 5'-terminus of this base sequence : 57847322
  Distance between 3'-terminus of neighbour sequence of sequence listing upward to telomere on chrosomal short arm and 5'-terminus of this base sequence : 10885
actagatacatttcaaaagtgacaagttttatttttaaatgtaaatatttataaaatgccagaaattaaatcctctgctattgaactatttaaacttatgataaaaaaaatttaaatgtcaaattttggataaacatgtggaggtataaagaatttcaaaattctctctctctctgtgtgtgtgtgtgtgtgtgtgtgtgtgtgtgtgtgtgtgtagtaaatgaacgacaaaaaatgaaacccactgtctaatg

SEQ ID NO: 21453 - DNA, 266 bp, Homo sapiens
  chr15.fa.O7frz.58240186
  Located on chromosome 15
  Distance between a terminus base of telomere on chromosomal short arm and 5'-terminus of this base sequence : 58057453
  Distance between 3'-terminus of neighbour sequence of sequence listing upward to telomere on chrosomal short arm and 5'-terminus of this base sequence : 209877
gtggctcataaatagatcatgaaaccaatgtggtggctcgtaatctgtattttaaataatagagcaaacacaatcacgcatcacaagtgaagggtaaatattttacatgaaatgtttgtgtgtgtgtgtgtgtgtgtgtgtgtgtgtgtactagttcacaatgtaattaatatgtttttctcattgtggatcacggtattaatgtctcaaagatatcgccctgagaggcaagcggttccagtgttaggacctgtaatattcaagct

SEQ ID NO: 21454 - DNA, 217 bp, Homo sapiens
  HUMUT7041
  Located on chromosome 15
  Distance between a terminus base of telomere on chromosomal short arm and 5'-terminus of this base sequence : 58155468
  Distance between 3'-terminus of neighbour sequence of sequence listing upward to telomere on chrosomal short arm and 5'-terminus of this base sequence : 97749
gagggcagaagttacaattgtttagaaagctatagtagatatttggggattttagtgtaaaaacagcttatgagtgaactagttaactggtaatctttttctctttctccttccttccttccttccttccttccttccttccttccttccttccttccttccttccttccttcctccctttcatggagtctggctctgtcacccaggctggagtaca

SEQ ID NO: 21455 - DNA, 314 bp, Homo sapiens
  chr15.fa.O7frz.58691131
  Located on chromosome 15
  Distance between a terminus base of telomere on chromosomal short arm and 5'-terminus of this base sequence : 58257845
  Distance between 3'-terminus of neighbour sequence of sequence listing upward to telomere on chrosomal short arm and 5'-terminus of this base sequence : 102160
tctttgaaattagcagtaaatgtcccacaatgtgtgtgtgtgtgtgtgtgtgtgtgtgtgtgtgtgtgtgtgtgtgtgatgtgtgtttggtagatgaaaacaaaacaatctttctgcaaactgagcagattatcagaaaatttctcataaactattctgaaaatactgctcttggaagcctcacaaagtgattatttaggtaataggacaggggtctggactggtcccctgtagagctggaatttcctttcacaatcaggcctgtcctatccagagggttattttcgaggcagtgaggaaatacttctgagagg

SEQ ID NO: 21456 - DNA, 273 bp, Homo sapiens
  Z66872
  Located on chromosome 15
  Distance between a terminus base of telomere on chromosomal short arm and 5'-terminus of this base sequence : 58354673
  Distance between 3'-terminus of neighbour sequence of sequence listing upward to telomere on chrosomal short arm and 5'-terminus of this base sequence : 96514
tgctcatggtgctgtacttaatacacaaacacacacacacacacacacacacataaaaatacacacacatacagatggaaagagtgaaagtagtaacatttactgaattcatattatatgccaggcagacttctaaatcttttataggttttaattcacttaatccttacaacatgcccatgaggtagatacaatttctatccccattttatagatgaggaaaatgaaaacgagagtttatgcaaggtaacacagccaatacatacgtgagct

SEQ ID NO: 21457 - DNA, 452 bp, Homo sapiens
  chr15.fa.O7frz.58991677
  Located on chromosome 15
  Distance between a terminus base of telomere on chromosomal short arm and 5'-terminus of this base sequence : 58461324
  Distance between 3'-terminus of neighbour sequence of sequence listing upward to telomere on chrosomal short arm and 5'-terminus of this base sequence : 106378
ggttcaaatcttggtcttctactcacacactccctcagaatggtctctcagatctcaactcgagatttttatccaaactccaactatctatctatctatctatctatctatctatctatctatctatctgtctatctatctccctccctccctatcatgtattcctttctcctctacatccactcagtcaccaagccttgtctcataagtcaaatcctcattctttaggccctccccacttcctaccatgatagctgccacagtctctatggtagacagaattctaagacaagtctccaagattccccaaccctggtatatatctctgtatagtgccctggactttgaatataatggattttacttccaagattaggttattataaggcacaggtgactctgagcaaaaatagtttatgtaggtgggcctgacctaagttcatggactataa

SEQ ID NO: 21458 - DNA, 120 bp, Homo sapiens
  DISD22_0009643
  Located on chromosome 15
  Distance between a terminus base of telomere on chromosomal short arm and 5'-terminus of this base sequence : 58789488
  Distance between 3'-terminus of neighbour sequence of sequence listing upward to telomere on chrosomal short arm and 5'-terminus of this base sequence : 327712
tcctaccacttagttgcctgtaatagaaataaaaatgtccagcctatatatatatatacatatatatatatgtatgtgtgtatatatatacagacacacactgtctactgttaaagacca

SEQ ID NO: 21459 - DNA, 351 bp, Homo sapiens
  chr15.fa.O7frz.59216268
  Located on chromosome 15
  Distance between a terminus base of telomere on chromosomal short arm and 5'-terminus of this base sequence : 58926220
  Distance between 3'-terminus of neighbour sequence of sequence listing upward to telomere on chrosomal short arm and 5'-terminus of this base sequence : 136612
aacctctcagtagctacaggagtgagtacttcagtcctgggaggggagtgagtagatgtgggaggcataccatagtacccactacagacttaaatattttttcccataaatatttctctctatatatatatctaaaggacaaaggcattttttaaaaacatatttctaatgccattaccataccctaatttagttatcaataattcattaatatccaatctgtattcagcattcaagtttccaactgtctgataaatataactatatattatttatttatttatttatttatttatttatttatagtttgcttgatttggggttcaagtaaggtccataaattacaatcaa

SEQ ID NO: 21460 - DNA, 348 bp, Homo sapiens
  chr15.fa.O7frz.59317369
  Located on chromosome 15
  Distance between a terminus base of telomere on chromosomal short arm and 5'-terminus of this base sequence : 59031384
  Distance between 3'-terminus of neighbour sequence of sequence listing upward to telomere on chrosomal short arm and 5'-terminus of this base sequence : 104813
gcgaatgctatactgtacgtagacacataaccccaacctatataaacactaagaatactgtaacatttcgagttggtctggtggagttatctccagccttctctctgtatccagttacagcaataaatccccttctttcctagtttgcttctcatttttgagcctcaagaaaacgcagccagacccagtctggctctgagaccactttcaagcatgttttatgtatattgtcatagtacttacacacaacacacacacacacacacacacacacacacacggtccttctctctccacaaatggtaacatactaaagatactcttctgtactttcacagtgcaagtacc

SEQ ID NO: 21461 - DNA, 116 bp, Homo sapiens
  D15S1036
  Located on chromosome 15
  Distance between a terminus base of telomere on chromosomal short arm and 5'-terminus of this base sequence : 59031577
  Distance between 3'-terminus of neighbour sequence of sequence listing upward to telomere on chrosomal short arm and 5'-terminus of this base sequence : -155
ctctgagaccactttcaagcatgttttatgtatattgtcatagtacttacacacaacacacacacacacacacacacacacacacacggtccttctctctccacaaatggtaacat

SEQ ID NO: 21462 - DNA, 291 bp, Homo sapiens
  HUMUT7521
  Located on chromosome 15
  Distance between a terminus base of telomere on chromosomal short arm and 5'-terminus of this base sequence : 59113256
  Distance between 3'-terminus of neighbour sequence of sequence listing upward to telomere on chrosomal short arm and 5'-terminus of this base sequence : 81563
gtcccagctactcaggcggctgaggcagaagaatcacttgaatccgggggacaaaggttgcagtgaggcgagatcgtgccactgccctccagcctgggcgacagactgagactccatctcaaaaatatagacagatgatagatagataagtagaaagatagatagatagatagatagatagatagatagatagatacatagatagatgatattcaaattttaacaattgtctcaacaacatcctttgtagcattttttttttcctaatcttccttccagttcaagatcccc

SEQ ID NO: 21463 - DNA, 398 bp, Homo sapiens
  AC015467.2_87965
  Located on chromosome 15
  Distance between a terminus base of telomere on chromosomal short arm and 5'-terminus of this base sequence : 59321438
  Distance between 3'-terminus of neighbour sequence of sequence listing upward to telomere on chrosomal short arm and 5'-terminus of this base sequence : 207891
aattgaggctggtttctaatacctgtacccaagcagtccttccacctcagcctcccaaagtgttgggattacaggtgtgagccaccgcccctggccactgaagtttaatagtgccactcagaggcctgccatgcatgccatgcatccatccatccatccatccatccatccatccatccatccagtgagttcctgctatgtgccaagaactctgctggccactagaggcgaaatctaggtatggcacatggtccctactcaagagctccagtctggttggggaatttgacaaatctacaattttgaatttatgtggtatatactgtatgtagtgtgctgtggaagtttagagaagagtggtttctctcaaccggaggtgtcagctgataacattgttt

SEQ ID NO: 21464 - DNA, 122 bp, Homo sapiens
  D15S974
  Located on chromosome 15
  Distance between a terminus base of telomere on chromosomal short arm and 5'-terminus of this base sequence : 59354252
  Distance between 3'-terminus of neighbour sequence of sequence listing upward to telomere on chrosomal short arm and 5'-terminus of this base sequence : 32416
tcatagaatcagccagccataacttcagtgcatgtgtatgcatacacacacacacacacacacacacacacacacacacacacacacacacacacattcatgcctgacccattcctgaccct

SEQ ID NO: 21465 - DNA, 408 bp, Homo sapiens
  chr15.fa.O7frz.59912888
  Located on chromosome 15
  Distance between a terminus base of telomere on chromosomal short arm and 5'-terminus of this base sequence : 59514455
  Distance between 3'-terminus of neighbour sequence of sequence listing upward to telomere on chrosomal short arm and 5'-terminus of this base sequence : 160081
caatgtgaacctttaacaagatagttttacttattatcacataagacataagatgttttcattttctggatgtcacacttccagaatttcatatttttcccctcttttctttccccttttcagagccctcccataggaagggaagggcttgaatttacccttaatctgcacctttagccaaggcagtgcatggaagatgaatggctcgtgggacagaatctaatgccagggagcaggagtgtttgaaagaattcatagtggggaaggtaaaagttaatggaagtacatgattttcaaaactggtaacagttaaaggcactcaccctccgcctctctctctctctctctctctggtgtgctatcatgtcttggactccatccacactatagtttcaaagttccactgac

SEQ ID NO: 21466 - DNA, 309 bp, Homo sapiens
  chr15.fa.O7frz.59841092
  Located on chromosome 15
  Distance between a terminus base of telomere on chromosomal short arm and 5'-terminus of this base sequence : 59533035
  Distance between 3'-terminus of neighbour sequence of sequence listing upward to telomere on chrosomal short arm and 5'-terminus of this base sequence : 18172
aatgtaccttccaggaataaatgaagaaactcaagggtttgcaagcaaactgctctgacagtgtctaacccttcacacacacacacacacacacacacacacacacacacacacacacacaccccactacaagccaagagggaggaaggacatgtttggaccatgagtaccatgagatcttatgtgctgagagctaaggagagctttaaggatgatgtagttcatacccccactttgcagatgggaaagtttagacaggctgagcaacctgaccaatgcgactgagttagtcaagtattaaagcttgga

SEQ ID NO: 21467 - DNA, 414 bp, Homo sapiens
  chr15.fa.O7frz.60101276
  Located on chromosome 15
  Distance between a terminus base of telomere on chromosomal short arm and 5'-terminus of this base sequence : 59697030
  Distance between 3'-terminus of neighbour sequence of sequence listing upward to telomere on chrosomal short arm and 5'-terminus of this base sequence : 163686
cctcatctgttaagtgaaggtaataatagtatctacctcaaaaggttgttatcgagaacaaatgagttaatacatataaatggctcaaaattattgccaggtgcagtggtgcatgcctgttgtcccagctacttgggaggctaagacagaaggatcacttgagcccaggagttcaaggccaacccagacaatatagcaagaacccatttctatataaaagaaaagagacaaagaaaaaaggaaggaaggaaggaaggaagaaagaaagaaagaaagaaagaaagaaagaaaaagaaaagaaagagaaagaaagaaagaaagaaaagaaagagagagagaaagaaagaaagagaaagaaattgaacaagcacatagtaagtgctcaataaactcttgctacaaggataatgatta

SEQ ID NO: 21468 - DNA, 163 bp, Homo sapiens
  D15S159
  Located on chromosome 15
  Distance between a terminus base of telomere on chromosomal short arm and 5'-terminus of this base sequence : 59882614
  Distance between 3'-terminus of neighbour sequence of sequence listing upward to telomere on chrosomal short arm and 5'-terminus of this base sequence : 185170
gtgttgctccataaaacttctgttttagaagggtgtgatgtgtgtgtgatgtgtgtgtgtgtgtgtgtgtgtgtgttttcattcagtcaaaaggagaaatatattcctcactgtgggttgaggttaaaaaaaaagtttgaaagccattcagtggactatgtca

SEQ ID NO: 21469 - DNA, 463 bp, Homo sapiens
  chr15.fa.O7frz.60303056
  Located on chromosome 15
  Distance between a terminus base of telomere on chromosomal short arm and 5'-terminus of this base sequence : 59907890
  Distance between 3'-terminus of neighbour sequence of sequence listing upward to telomere on chrosomal short arm and 5'-terminus of this base sequence : 25113
ttctgtccagaactgtaagataataaatttgtcttgttgcctgtaatttcagcactttgggaggccaaggtgggcagatcatctggggtcaggagttcgagatcagcctggccaacatggtgaaactgcgtctctactaaaaatacaaaaattagccgggcgtggtggcacacacctgtagacaccagctacttgggaggctgaggcaggggaattgcttgaacctgggaggcagaggttgcagtgagcggagatggcgccaatgcactccagcctgggcaacagagtgagactctgtctcaataaataaataaataaataaataaataaataaatacatttatgttgttttaagccattacatttatggtaattgattacagcaacaatagaaaattaatgcaataaatgaagatccatgtacccactacctagctctgtcaaagcttaacattcagtactc

SEQ ID NO: 21470 - DNA, 225 bp, Homo sapiens
  DISO7_10004031
  Located on chromosome 15
  Distance between a terminus base of telomere on chromosomal short arm and 5'-terminus of this base sequence : 60373137
  Distance between 3'-terminus of neighbour sequence of sequence listing upward to telomere on chrosomal short arm and 5'-terminus of this base sequence : 464784
agttgtgtcctccggaacaaggaaaacatttatttcctctcttacagagaagctctttaagtatttttaaggcagctattatgtgacacacacacacacacacacacacacacacacacacacacaaccccctccttggttttcacttctctaagctgaatatttttgatactttctagtccttctatgacataatttttggactttatcaatccaaggtattgc

SEQ ID NO: 21471 - DNA, 184 bp, Homo sapiens
  chr17.fa.O7frz.38064045
  Located on chromosome 15
  Distance between a terminus base of telomere on chromosomal short arm and 5'-terminus of this base sequence : 60740750
  Distance between 3'-terminus of neighbour sequence of sequence listing upward to telomere on chrosomal short arm and 5'-terminus of this base sequence : 367388
gctatgatcacgccactacactccagcctgggtgacagagcaagaccctgtcccttaaaaaaaaaaaaaaaaaaaaaatatatatatatatatatatatatatatatatatatgaaaaaaaacccacattcctagtgcaggtttgcttactgtgtgactttaggtaagttactgaagttcctgt

SEQ ID NO: 21472 - DNA, 183 bp, Homo sapiens
  D15S993
  Located on chromosome 15
  Distance between a terminus base of telomere on chromosomal short arm and 5'-terminus of this base sequence : 60885192
  Distance between 3'-terminus of neighbour sequence of sequence listing upward to telomere on chrosomal short arm and 5'-terminus of this base sequence : 144258
agaaacccaggctgacttgtagcgcacacacacacacacacacacacacacacacacacacacacacattatttacatttcaacaggagaagaaagcagaaagacttgagcaaacaagatgaatgccacgtcttggctaggccacactttccagcacctgcccggattagaccacaacagtgc

SEQ ID NO: 21473 - DNA, 212 bp, Homo sapiens
  D15S644
  Located on chromosome 15
  Distance between a terminus base of telomere on chromosomal short arm and 5'-terminus of this base sequence : 60953872
  Distance between 3'-terminus of neighbour sequence of sequence listing upward to telomere on chrosomal short arm and 5'-terminus of this base sequence : 68497
ccttcattggcagactcacttacaaataaaacattcttgattgtttttgattagaaaaagaagaatgttaaaagaaaaggaaggaaggaaggaaggaaggaaggaaggaaggaaggaaggaaggaaggaaggaaacgcacaaaaaggaagctaaaaaatgttccttagtcccacctttctaagataaccatcgttatcatcttggtgtctgc

SEQ ID NO: 21474 - DNA, 155 bp, Homo sapiens
  D15S1018
  Located on chromosome 15
  Distance between a terminus base of telomere on chromosomal short arm and 5'-terminus of this base sequence : 60959688
  Distance between 3'-terminus of neighbour sequence of sequence listing upward to telomere on chrosomal short arm and 5'-terminus of this base sequence : 5604
caaagcacttgcctgactactactactactactactacacacacacacacacacacacacacacacacagcccctaggtctgctccacaggactttgtgtaaaaaccaccccactacagcaaactcccccttatatcacagcatcccgcttttac

SEQ ID NO: 21475 - DNA, 325 bp, Homo sapiens
  chr15.fa.O7frz.61574989
  Located on chromosome 15
  Distance between a terminus base of telomere on chromosomal short arm and 5'-terminus of this base sequence : 61379522
  Distance between 3'-terminus of neighbour sequence of sequence listing upward to telomere on chrosomal short arm and 5'-terminus of this base sequence : 419679
tgaatatcttatttctgtccacatgtgataatggaatcagcttgtggacatcaagctctcaggcctgtacactatatgccatttgatgtagctgaggatatattgggccccatttactctgtgtgtggtattataccaccagcttgtgtagtttcagtacacaagaagacctatttgccattttgtaaaaatgtggtctttttcatatttaattttagaataaaggtgtgtgtgtgtgtgtgtgtgtgtgtgtgtgtgtgtgtgtctgtttaaagaggtggggtcttgctgtgttgcccaggttggaggacagtggctattcaca

SEQ ID NO: 21476 - DNA, 248 bp, Homo sapiens
  DISD22_0009671
  Located on chromosome 15
  Distance between a terminus base of telomere on chromosomal short arm and 5'-terminus of this base sequence : 61621836
  Distance between 3'-terminus of neighbour sequence of sequence listing upward to telomere on chrosomal short arm and 5'-terminus of this base sequence : 241989
tgattgtcgtaattaaactatagcccgagtttaaagaagaagccagccaaaaaaaaaaaattaactcatacattcatccctaaacaatcaaatctcagtaaaaattttaatattagcagcaagttctttttattttctagcagcagcttcttaagagagaggaaaagagggtaagcgtgagtgtgtgtgtgtgtgtgtgtgtgtgtgtgtgtgtgtgtctaggagagggggagagcacatatgtcaac

SEQ ID NO: 21477 - DNA, 148 bp, Homo sapiens
  D15S1009
  Located on chromosome 15
  Distance between a terminus base of telomere on chromosomal short arm and 5'-terminus of this base sequence : 61840052
  Distance between 3'-terminus of neighbour sequence of sequence listing upward to telomere on chrosomal short arm and 5'-terminus of this base sequence : 217968
ggccctctgacagaagagttcagggaggcgctgtgtgtgtgtgtgtttgtgtgtgtgtgtgtttgtgtgtgtgtgtgtgtgtgtgtgtgtggtgtgttaggggtgactttctggtggtccccagtgcctgatgtcagccaggtcctgt

SEQ ID NO: 21478 - DNA, 408 bp, Homo sapiens
  AC023671.3_17738
  Located on chromosome 15
  Distance between a terminus base of telomere on chromosomal short arm and 5'-terminus of this base sequence : 61844969
  Distance between 3'-terminus of neighbour sequence of sequence listing upward to telomere on chrosomal short arm and 5'-terminus of this base sequence : 4769
gtttcaccatgttggtcaggctggtctcgaactgctgacctcatgatccacccacctcggcctcccaaagtgctgggattacaggcatgagccaccacgcccggaccctattattattattattattattattagagatgtggtcctactatgttgctcaggctggtctcgaactgctggcctcaagccatcttcccacctcagcctcccaaaggggattacaggcatgagccaccttgtgcagcattctgttcttgctaaactcaggcctttctgatatatacccccacccccattgtttctacggctgggggctaagtgtcgcaaggaacaatagttttcaaaaaccaaacttttcatttggaaatacttttaaacttagagaaaaattgcaggaataagaatagg

SEQ ID NO: 21479 - DNA, 420 bp, Homo sapiens
  AC069368.3_11610
  Located on chromosome 15
  Distance between a terminus base of telomere on chromosomal short arm and 5'-terminus of this base sequence : 61844969
  Distance between 3'-terminus of neighbour sequence of sequence listing upward to telomere on chrosomal short arm and 5'-terminus of this base sequence : -408
gtttcaccatgttggtcaggctggtctcgaactgctgacctcatgatccacccacctcggcctcccaaagtgctgggattacaggcatgagccaccacgcccggaccctattattattattattattattattagagatgtggtcctactatgttgctcaggctggtctcgaactgctggcctcaagccatcttcccacctcagcctcccaaaggggattacaggcatgagccaccttgtgcagcattctgttcttgctaaactcaggcctttctgatatatacccccacccccattgtttctacggctgggggctaagtgtcgcaaggaacaatagttttcaaaaaccaaacttttcatttggaaatacttttaaacttagagaaaaattgcaggaataagaataggacaaaggccatg

SEQ ID NO: 21480 - DNA, 281 bp, Homo sapiens
  AC013553.14_56931
  Located on chromosome 15
  Distance between a terminus base of telomere on chromosomal short arm and 5'-terminus of this base sequence : 62069632
  Distance between 3'-terminus of neighbour sequence of sequence listing upward to telomere on chrosomal short arm and 5'-terminus of this base sequence : 224243
caggcactcttacatctgagactggatggaatgtcacaatccttcttggacagtgctctggacagtcagttggagctagaacacaagatcacatctgttggccattcttgtaactttgtctttccatgattttagatgggtaggtaggcagatagatagatagacagatagatcgatagatgatagatagatagatagatagatagatagatagatagatagaatctccctcaaatgagtaagtaggcagtgtgcatgtgagtccttgaaagtctaagaaa

SEQ ID NO: 21481 - DNA, 193 bp, Homo sapiens
  chr15.fa.O7frz.62390196
  Located on chromosome 15
  Distance between a terminus base of telomere on chromosomal short arm and 5'-terminus of this base sequence : 62182555
  Distance between 3'-terminus of neighbour sequence of sequence listing upward to telomere on chrosomal short arm and 5'-terminus of this base sequence : 112642
gatttagatgtagcttcagatcagcaaggccagcaggtgcttgtcattcactcattctctctctctctctctctctctctctctctcacacacacacacacacacacacacacacacacacgatttagatgaataaatgaacaaaattgcaaggggcatattaattacagtggaaccacataatctatgtatt

SEQ ID NO: 21482 - DNA, 415 bp, Homo sapiens
  chr15.fa.O7frz.62613234
  Located on chromosome 15
  Distance between a terminus base of telomere on chromosomal short arm and 5'-terminus of this base sequence : 62397464
  Distance between 3'-terminus of neighbour sequence of sequence listing upward to telomere on chrosomal short arm and 5'-terminus of this base sequence : 214716
cattctacgtttattgaaagctatggagaacagccttcaagctactgtggaaaactctctctctttcactcacacacacacacacacacacacacacacaccagcctgcaggcactctggagagaagaggggagagggaaaggcaatacaagaaggccaggagtgaaaaagtcctttctccctgggggtggggaggggacagagggttaaggggggctgggggcctgtttcatttgcaggctgcaaatgcctctcctattcaccggcccacattcccagccaaggcgcctggccgctgacaatgccaggaacaggaacagagaagatttgcacattgtgtttaaggggccagctggctgcctgtgacagtggagccaaggtgtgggaaccagaagcgttcgacttccacactcaa

SEQ ID NO: 21483 - DNA, 389 bp, Homo sapiens
  chr15.fa.O7frz.62731145
  Located on chromosome 15
  Distance between a terminus base of telomere on chromosomal short arm and 5'-terminus of this base sequence : 62528117
  Distance between 3'-terminus of neighbour sequence of sequence listing upward to telomere on chrosomal short arm and 5'-terminus of this base sequence : 130238
gaagagttcctaaagctcataatcaattgcctaggataaaaccaaacataagccacttgagaggctaaggcaagaggatcacttgagcctaaagtccaagacaagctggggcaatctagtgggaccctcacctctaaaaaaaattttttaaattagtaattgggtgtggtggcacatatctgtagtcccagctactcaggaggctgaggtgggaggattgcttgagcccaggagtttgaggctgcagtgagccatgatcttgccactgcactccagcctggatgacagcaagactttgtctcccccccaaaaaaaaagtgtgtgtgtgtgtgtgtgtgtgtgtgtgtgtgtgtatatataaatttattaagatgaattagctttcaagg

SEQ ID NO: 21484 - DNA, 227 bp, Homo sapiens
  D15S1020
  Located on chromosome 15
  Distance between a terminus base of telomere on chromosomal short arm and 5'-terminus of this base sequence : 62742092
  Distance between 3'-terminus of neighbour sequence of sequence listing upward to telomere on chrosomal short arm and 5'-terminus of this base sequence : 213586
tgcacaatggatactaaacagctattaaaaaagaagagtgagcaagttctctatgagtgccaaaataattaagtgaaaatagcaaagtgcaaactgtaaatagtatattaccttttgaataagaaaaggggaaaataacacacacacacacacacacacacacacacacacacacacacacacacatatatatatatatttttttttgagacagtcttgctctatcg

SEQ ID NO: 21485 - DNA, 407 bp, Homo sapiens
  chr15.fa.O7frz.63042237
  Located on chromosome 15
  Distance between a terminus base of telomere on chromosomal short arm and 5'-terminus of this base sequence : 62983557
  Distance between 3'-terminus of neighbour sequence of sequence listing upward to telomere on chrosomal short arm and 5'-terminus of this base sequence : 241238
agaagttagccttcaacagaatgacaagccttgtaactggacgagaggaggaaaggccacatacagatcaaatggagggctctctttccaatgagaacagacactgaaataaagagggcccttagccgggtgtggtggctcacaccagtaatcccagcactttgggaggccaaggcaggaagatcacttgagcctaggagttttgagaccagcctgggcaacatagggagaccttatctctacaaaataaataaataaataaataaggccctgcaggggccggtgctattatttttaaaaggagggtatagcttttaccacatagtattgaactaggtgctcaccctgtttgccctgaaatggaaaagctgtctgggatagaaacgttcattatcttgactgcagtg

SEQ ID NO: 21486 - DNA, 207 bp, Homo sapiens
  AC009433.2_134332
  Located on chromosome 15
  Distance between a terminus base of telomere on chromosomal short arm and 5'-terminus of this base sequence : 63100562
  Distance between 3'-terminus of neighbour sequence of sequence listing upward to telomere on chrosomal short arm and 5'-terminus of this base sequence : 116598
tgaagtggatcctaatagcacctgcttcggagggttgtcatgaggatcagaaaaaacgatgcatgtagcgcccacagtgcaagcagtgagaatggacccccagggaatttagctattattattattattattattaaacaacttaaatggccaacaatggggaactggttaggcagattatggtatatccagagaatactatgcagc

SEQ ID NO: 21487 - DNA, 188 bp, Homo sapiens
  D15S213
  Located on chromosome 15
  Distance between a terminus base of telomere on chromosomal short arm and 5'-terminus of this base sequence : 63249513
  Distance between 3'-terminus of neighbour sequence of sequence listing upward to telomere on chrosomal short arm and 5'-terminus of this base sequence : 148744
cacatccatgagggtaaggtagaatataatttctaatgtcattcattcatgcattcaataagcatttattgagtgcctactatatgccaggcactgctctaggccctaaggggacacacacacacacacacacacacacacacacacacacacacccttgccctaggaatttattcctgcccttctgc

SEQ ID NO: 21488 - DNA, 212 bp, Homo sapiens
  D15S153
  Located on chromosome 15
  Distance between a terminus base of telomere on chromosomal short arm and 5'-terminus of this base sequence : 63422918
  Distance between 3'-terminus of neighbour sequence of sequence listing upward to telomere on chrosomal short arm and 5'-terminus of this base sequence : 173217
gatcagtgtaggctccaaataatcaaggtaaaccttatggagttggaggtaatggaaaaggatcatgagagaaggatgggtggggacagtgaggataggacagacgtgtgtgtgtgtgtgtgtgtgtgtgtgtgtgtgtgtgtgtgtgtgttgtcaggaattattatctttatcattcagccttcaaatatctgcccaccctttcaggtact

SEQ ID NO: 21489 - DNA, 460 bp, Homo sapiens
  AC055855.3_109913
  Located on chromosome 15
  Distance between a terminus base of telomere on chromosomal short arm and 5'-terminus of this base sequence : 63426950
  Distance between 3'-terminus of neighbour sequence of sequence listing upward to telomere on chrosomal short arm and 5'-terminus of this base sequence : 3820
gagttcaaatacgattcactgaataaataattactgagcatctactctctactcagctaaccgttcttttcagacacaagcaaattcatggggaaaaacaactgagagcctttccccccccaatatacaaagaatctaacccattcattcattcaacatgtgtttattgaaaacctaatacagtatgtgccaggcattgttccaagcccttgggggaaagtaaacagaataaagttcctgccctcatggatcttacacccaatgtgggagacagacaataaacaaacgcatacataacatatgcatatcttacacataatatacatttataatgagaagcgcataataataatataatataatataatataatataataataatataatataatataattctggatcccaactgcctcggttcaaaccccacctttgtcaattactagctgttgaacttt

SEQ ID NO: 21490 - DNA, 418 bp, Homo sapiens
  chr15.fa.O7frz.63565907
  Located on chromosome 15
  Distance between a terminus base of telomere on chromosomal short arm and 5'-terminus of this base sequence : 63490876
  Distance between 3'-terminus of neighbour sequence of sequence listing upward to telomere on chrosomal short arm and 5'-terminus of this base sequence : 63466
gtttgagactgcagtgagttaggattgggccactgtattccagcctgagtgacagtgagaccaacacacacacacacacacacacaatagtggcgggggactgtgggtaggggtgagggggtggggtgggagagcctttcctaacactaacctttcttatttgtaactaccccctctacctggcaggaagaactccaatcaggtgttctcacgatttggccctaacacatctaacctcaaaatcagcattcctaaaatctgccttatccccttaatcttatttctgtatcattattgtacatgtgcttcccaatacttggaatctcctccaccaaaagcaaagtctttcctgtaaatcctcccgagatgctatgttccccacgatactttgcaagtttcactccaactagtcagtaag

SEQ ID NO: 21491 - DNA, 452 bp, Homo sapiens
  chr15.fa.O7frz.63774928
  Located on chromosome 15
  Distance between a terminus base of telomere on chromosomal short arm and 5'-terminus of this base sequence : 63813902
  Distance between 3'-terminus of neighbour sequence of sequence listing upward to telomere on chrosomal short arm and 5'-terminus of this base sequence : 322608
ggacagatacataaacagctgatgtggaagtgcagggtgggaggggtaaacgcaggctgtaggaaaacccaggaacagcctagacaacatagcaagaccccatctctacaaaaaattaggcatgcgtggtggtgggtgcctatagccccagctacttggggtgctgaggtggatcacttgagcccaggaggtccaggctgcagtgagccgtgaccatgtcactgtttaaaagaaaaagaaagaaggaaggaaggaaggaaggagaaagagagagagagagaaagaaaaagaaagaaaagaaagaagaaagaaagaaaagaaagaagaagaagaaagaaagaaagaaagaaagaaagaaagaaagaaagaaagaaagaaagaaagaaagaaagaaagaaaacaaaaaaagaaagaaaagaaaacaaaatccagagaacctagtctggcctgag

SEQ ID NO: 21492 - DNA, 239 bp, Homo sapiens
  AC013564.3_132971
  Located on chromosome 15
  Distance between a terminus base of telomere on chromosomal short arm and 5'-terminus of this base sequence : 63886008
  Distance between 3'-terminus of neighbour sequence of sequence listing upward to telomere on chrosomal short arm and 5'-terminus of this base sequence : 71654
ctatgaaatctgaccattagtgagtcattccattttctttcttttctctctctctcttccttccttccttccttttctcccctcccctcccctcccctcccctccccttcccttccctccccttccctttcctttcttccccaccccgctctctctctttcttttttcagacagggtctcactctgttgcccaggctgaagtgcagtagcatgatcatggctcactgcagcttcaaact

SEQ ID NO: 21493 - DNA, 373 bp, Homo sapiens
  chr15.fa.O7frz.64078152
  Located on chromosome 15
  Distance between a terminus base of telomere on chromosomal short arm and 5'-terminus of this base sequence : 64235856
  Distance between 3'-terminus of neighbour sequence of sequence listing upward to telomere on chrosomal short arm and 5'-terminus of this base sequence : 349609
ctaattacaattgattcactgctcagcggagtcacaaatgcctaataaataatgttatttgcgaacaaccttattagccacttttaaaatagatctcataaccatatatatatatacatatatataaaccctatgtttataatgttttatgaacattcatgtacatgtctttgtgtggacatatgtttttgtttccctcgggtaaatacctaagaatagaatgggtgaactatatggtaggtatgtgtttaactttttaaataactatcaaacggttttccaaagtgattgtgccattttacaaccctactagcagtgcatgaatgctagtggaatgcaaatgttccacattcttaccaacatgtggtatgat

SEQ ID NO: 21494 - DNA, 237 bp, Homo sapiens
  chr15.fa.O7frz.64391476
  Located on chromosome 15
  Distance between a terminus base of telomere on chromosomal short arm and 5'-terminus of this base sequence : 64479834
  Distance between 3'-terminus of neighbour sequence of sequence listing upward to telomere on chrosomal short arm and 5'-terminus of this base sequence : 243605
cagaatcaataacaggtgatactctctttagcatgaattagaaggcaacatgaagttcaaggtgaattccccaaacaccacaaatatctgttctcctacacacacacacacacacacacacacacacattttatctatatataaacatgcacacacacaacccttaccttatgtcctcacctatccacctcagccaaaaaagacaaatgcattctaaactaggcatgttgatactgt

SEQ ID NO: 21495 - DNA, 450 bp, Homo sapiens
  AC016348.3_47251
  Located on chromosome 15
  Distance between a terminus base of telomere on chromosomal short arm and 5'-terminus of this base sequence : 64576701
  Distance between 3'-terminus of neighbour sequence of sequence listing upward to telomere on chrosomal short arm and 5'-terminus of this base sequence : 96630
atctttgtgacatatgctttctagttagcttatgtaatatttacttcctgggaatactgaataacaccagcagagtgttcccatttcttgctttaataccatcttatattcttcctgaaccaaattaggatgaatgaaatagtgaatgaatgaatgaatcgatatatctgtctgtctatctatctatctatctatctatctatctatctatctatctatttatctatctatctgtctgctctgctttagcaatagagacaataaaaaaatgccacaaaataaaagtaaatgtagaattttggcaacttcatccagaaaaaaaatcacattttcatttctaaattatcttcatgagaacacatggcctactgtcatattagggatttataaattaatcggcatatatttattgagtacttgcaatatgtctggtattgtgcaagatactat

SEQ ID NO: 21496 - DNA, 382 bp, Homo sapiens
  chr15.fa.O7frz.64564289
  Located on chromosome 15
  Distance between a terminus base of telomere on chromosomal short arm and 5'-terminus of this base sequence : 64668580
  Distance between 3'-terminus of neighbour sequence of sequence listing upward to telomere on chrosomal short arm and 5'-terminus of this base sequence : 91429
gttgctgaaagtactgaatgagatcatgaatgtgaacctgtgatgagacaaagtattttacaaatagtattctaatgattcacatgaattggagtgtttgtctgttatggaaggtgtgtgtgtgtgtgtgtgtgtgtgtgtgtgtctgtgtgtacataagtttgttttgaacaaaataaacttgaatagctacagatcttcccttaccagcatctgcccttaaagttgtggcaattatgtttgaactatgcaaaatgacaaaaaccagagaacagaaagccccccaaaaactgagagcttgcatctgacgtcgatagacccattgtggctgttgggaccttgttgcttcttgggaaaacagtgttcttagcttgttaaacca

SEQ ID NO: 21497 - DNA, 91 bp, Homo sapiens
  D15S1015
  Located on chromosome 15
  Distance between a terminus base of telomere on chromosomal short arm and 5'-terminus of this base sequence : 64802665
  Distance between 3'-terminus of neighbour sequence of sequence listing upward to telomere on chrosomal short arm and 5'-terminus of this base sequence : 133703
tcacagagcgagaccctatctcaaaaaagaagaaaacacacacacacacacacacacacacacacagatttctgtctaaactgagtctgtg

SEQ ID NO: 21498 - DNA, 364 bp, Homo sapiens
  chr15.fa.O7frz.64975866
  Located on chromosome 15
  Distance between a terminus base of telomere on chromosomal short arm and 5'-terminus of this base sequence : 65005836
  Distance between 3'-terminus of neighbour sequence of sequence listing upward to telomere on chrosomal short arm and 5'-terminus of this base sequence : 203080
cagctttactgaggtacaattaacaaatagaaagtatatataaggtgtacaatgtgatgttttgataaacatatacattgtgaaaggattaccacaatcaagctaatatatctaaccccacacacagttactgtgtgtgtgtgtgtgtgtgtgtgtgtgtgtgtgtgtgtgtgtgtgttgataacacttacgatctactcccttggcaaattttaaatacataatacaggattattaattatactcaccatgctatatttatcttataaaagtaagtttgtcccctttgacgaacacctcctcatttcccccaccctccaagcccctggtaactactcttctactttgctactatgagttcagc

SEQ ID NO: 21499 - DNA, 286 bp, Homo sapiens
  chr15.fa.O7frz.65284589
  Located on chromosome 15
  Distance between a terminus base of telomere on chromosomal short arm and 5'-terminus of this base sequence : 65355821
  Distance between 3'-terminus of neighbour sequence of sequence listing upward to telomere on chrosomal short arm and 5'-terminus of this base sequence : 349621
ctgataaagttgctctgacaatttctggttatttgttcaatatttctgtggcggtgtgaaagtttgtagctgcctatttctccattttgctgatgtccctctctccacaaattcggacatattgcatcttcattatgcacacacacacacacacacacacacacacacacacacacacccctaaaaaagtaataataatgtaattatagagatggagaacaggctagtagttctctgggaattacggatgggtagagaggatgggtgttatcgatgtcaatgtttc

SEQ ID NO: 21500 - DNA, 368 bp, Homo sapiens
  chr15.fa.O7frz.65606216
  Located on chromosome 15
  Distance between a terminus base of telomere on chromosomal short arm and 5'-terminus of this base sequence : 65657922
  Distance between 3'-terminus of neighbour sequence of sequence listing upward to telomere on chrosomal short arm and 5'-terminus of this base sequence : 301815
tactggtgtctagtgagtcgaggccagagatgctgctaaccatcctacaatgcaccagatggtcccttacggcagagttatccagcccaagatgtcactaggacagaggtggaggatccctggcgtggtggtgagagcaggaaggagttctggagtcagaggcttctgagttccacttccagctcagagcttctagctgtgtgaccctgggcaagttcttctctctctctctctctctctctctctctctctctctctctctgaaccttgagttcctcagctgtaaaatagttctgttgtgaaaatcagcatttttaattcttagcagggcacttggcagccagtgagtacttggtacatggtagctc

SEQ ID NO: 21501 - DNA, 153 bp, Homo sapiens
  DISD22_0009688
  Located on chromosome 15
  Distance between a terminus base of telomere on chromosomal short arm and 5'-terminus of this base sequence : 65802314
  Distance between 3'-terminus of neighbour sequence of sequence listing upward to telomere on chrosomal short arm and 5'-terminus of this base sequence : 144024
aggcaatgtgcacatttgccccctctctttcagtgggctttcagtgggcatgatgggaacacacacacacacacacacacacacacacacacacacacgcatgcatgcatgcatgcatacatacacatgcagcaataataaacaatattcttc

SEQ ID NO: 21502 - DNA, 212 bp, Homo sapiens
  chr15.fa.O7frz.66026162
  Located on chromosome 15
  Distance between a terminus base of telomere on chromosomal short arm and 5'-terminus of this base sequence : 65970413
  Distance between 3'-terminus of neighbour sequence of sequence listing upward to telomere on chrosomal short arm and 5'-terminus of this base sequence : 167946
tttcctcagtaccattaagtttaatttaaaaaaaaagtttctgctctagtttctagaccctcagctggtgaggccccttgaattgtttccaaagtccaagaggaaatggttactccaacatacacacacacacacacacacacacacacacactcactccttggggacagcacagggtggacagtgcaaagaatttatctccaagtaagctc

SEQ ID NO: 21503 - DNA, 402 bp, Homo sapiens
  chr15.fa.O7frz.65922692
  Located on chromosome 15
  Distance between a terminus base of telomere on chromosomal short arm and 5'-terminus of this base sequence : 66107345
  Distance between 3'-terminus of neighbour sequence of sequence listing upward to telomere on chrosomal short arm and 5'-terminus of this base sequence : 136720
aaggatctgcctcgaatactatcacattggcaccgtctgagttctggtggagacacattcaaatcacagcagccatcataatcccattcgcaaggaccacggacttggtcctgaagtgggagtggggggaactgctgactggctttattccggggaatgacactaggtttatgttttaaaagaccactctgacatgtatttttttgattagtagaaataattttttttaaacactcttggtgctgtggaagggaagaattgggagacaggaagggttttgccatgattgagatatttggtcctgcccaaattaggggctgatcacacacacacacacacacacacacacacacacacacacacacgttttacctacatgttgtaattcactttgatatggaa

SEQ ID NO: 21504 - DNA, 423 bp, Homo sapiens
  chr15.fa.O7frz.66338411
  Located on chromosome 15
  Distance between a terminus base of telomere on chromosomal short arm and 5'-terminus of this base sequence : 66437717
  Distance between 3'-terminus of neighbour sequence of sequence listing upward to telomere on chrosomal short arm and 5'-terminus of this base sequence : 329970
tttattggttaaagcaagtcacaggccagctcagattcagtgtgggaggggatcacacaagggtgatgtgattcactaggggaggtctgatttgctagggaacatcttgggatactagctaccccttgactgaatgcccagtagcatttatggaggccagggtctggttgtcattagtgacgagattactataaaaaacctcagctgtctcttcctcagactattttcatcaagaataaaaagaacacacacacacacacacacacacacacacacacacacacacacacacacactcacactcacacatactcataccacctggaaaaccaccattccaacctgtaaaaaatataaaaaaatctctaagagggtgaaaatgtgcatattatgaaggaaagattaaacaccatcactattagc

SEQ ID NO: 21505 - DNA, 88 bp, Homo sapiens
  D15S1025
  Located on chromosome 15
  Distance between a terminus base of telomere on chromosomal short arm and 5'-terminus of this base sequence : 66480114
  Distance between 3'-terminus of neighbour sequence of sequence listing upward to telomere on chrosomal short arm and 5'-terminus of this base sequence : 41974
ccacgttaactgttcggttcatgcccttgctgatgttttcctacacaaacacacacacacacacacacaattttaaagcaacattggg

SEQ ID NO: 21506 - DNA, 199 bp, Homo sapiens
  DISO7_10004948
  Located on chromosome 15
  Distance between a terminus base of telomere on chromosomal short arm and 5'-terminus of this base sequence : 66676707
  Distance between 3'-terminus of neighbour sequence of sequence listing upward to telomere on chrosomal short arm and 5'-terminus of this base sequence : 196505
cgtggcaattgttagtgcagatctacactagaatgtgagctcttaagggatagaactgttgtgtctgcttcttcatccccatatctttcctaccatagctttggacatatagtaggtattcaggaaatgtgtgctgaatgaatgaatgaatgaatgaatgaatgaatgaatgaatgatcaagcatattcctgcccactc

SEQ ID NO: 21507 - DNA, 218 bp, Homo sapiens
  G07900
  Located on chromosome 15
  Distance between a terminus base of telomere on chromosomal short arm and 5'-terminus of this base sequence : 66676820
  Distance between 3'-terminus of neighbour sequence of sequence listing upward to telomere on chrosomal short arm and 5'-terminus of this base sequence : -86
aggtattcaggaaatgtgtgctgaatgaatgaatgaatgaatgaatgaatgaatgaatgaatgatcaagcatattcctgcccactctccacttctgctaccagccccagggcaggtgcaaactcggaactacattaacccaagcagcctaccaagttcgctgcctctcacctggctggttcctgaccactccccaaacacgtgacccctcctgtctcc

SEQ ID NO: 21508 - DNA, 241 bp, Homo sapiens
  DISO7_10004047
  Located on chromosome 15
  Distance between a terminus base of telomere on chromosomal short arm and 5'-terminus of this base sequence : 66760239
  Distance between 3'-terminus of neighbour sequence of sequence listing upward to telomere on chrosomal short arm and 5'-terminus of this base sequence : 83201
caagcttgattctaaatagtcacagttacctgggttatttccccctttctgtgtatgttatttatttgaaatatagttcaagtcatttgtttctttttgtgtaaattttacagtcccccaactccccaacacacacacacacacacacacacacacacacacacacatccccaggttgattttattaatttgtgttttctgtatgtaaacattaacatctaaccattcatgttacaaatgg

SEQ ID NO: 21509 - DNA, 296 bp, Homo sapiens
  DISO7_10004049
  Located on chromosome 15
  Distance between a terminus base of telomere on chromosomal short arm and 5'-terminus of this base sequence : 66987338
  Distance between 3'-terminus of neighbour sequence of sequence listing upward to telomere on chrosomal short arm and 5'-terminus of this base sequence : 226858
tgctatagtctcacaggtctctgaaaatgtgtgtgtgtgtgtgtgtgtgtgtgtgtatgtgtgtattttctctttgattttcagattgggtaatttcaattattctgtcttccagttcacagattccttcctctcttccctccattctgctgttgagcccaatcactgagtttttaattttggttagtgtatttttaaattctaacatttctatttgtttcatgtttatatcttttatttattgactgaggctttctattttgtcatttgtttcaagcatgttcataattgctatt

SEQ ID NO: 21510 - DNA, 101 bp, Homo sapiens
  DISO7_10004052
  Located on chromosome 15
  Distance between a terminus base of telomere on chromosomal short arm and 5'-terminus of this base sequence : 67032963
  Distance between 3'-terminus of neighbour sequence of sequence listing upward to telomere on chrosomal short arm and 5'-terminus of this base sequence : 45329
agtccatttggttacatgtgggcatcacacacacacacagacacacagacacacacacacacacacacacacacacacagacaccatgaaagcacattctt

SEQ ID NO: 21511 - DNA, 222 bp, Homo sapiens
  Z67161
  Located on chromosome 15
  Distance between a terminus base of telomere on chromosomal short arm and 5'-terminus of this base sequence : 67171913
  Distance between 3'-terminus of neighbour sequence of sequence listing upward to telomere on chrosomal short arm and 5'-terminus of this base sequence : 138849
tccctgggcacactatttagtatattgtgtgcacgtgtgcgcgcacacgtgcacacacacacacacacacacacacactccttattcccccccactttgtcttcctgtgtagcattgatcaccactgcatatactaattacttgtttgatagtttgttgtctgtcagtctgtctccctctatgacaatattctccttatctcttgccaggtaacatacttcc

SEQ ID NO: 21512 - DNA, 133 bp, Homo sapiens
  D15S650
  Located on chromosome 15
  Distance between a terminus base of telomere on chromosomal short arm and 5'-terminus of this base sequence : 67303587
  Distance between 3'-terminus of neighbour sequence of sequence listing upward to telomere on chrosomal short arm and 5'-terminus of this base sequence : 131452
gtgagtggagatcatgccattgcactccagagcgaaactccctctcaaaaataataataataataataataataattaaactgtaaaaattactctccaggaaaaaaaccagtattgaacatacatgagaaag

SEQ ID NO: 21513 - DNA, 232 bp, Homo sapiens
  D15S977
  Located on chromosome 15
  Distance between a terminus base of telomere on chromosomal short arm and 5'-terminus of this base sequence : 67514208
  Distance between 3'-terminus of neighbour sequence of sequence listing upward to telomere on chrosomal short arm and 5'-terminus of this base sequence : 210488
cctgttttatttctgggtgaggaagaggaatgttgagaaagagagagagagtgtgtgtgtgtgtgtgtgagagagagagaaagagagagagggacagagagagagagagagagagagtgtgagtgtgtgagagtgtgtgtgtgtgtgtgtgtgtgtgtgtgtgtggtggtggtgatggtgggagagagggcgtgaataagagaagagggaggatgaaagaccaagtaggctg

SEQ ID NO: 21514 - DNA, 243 bp, Homo sapiens
  Z67342
  Located on chromosome 15
  Distance between a terminus base of telomere on chromosomal short arm and 5'-terminus of this base sequence : 67573201
  Distance between 3'-terminus of neighbour sequence of sequence listing upward to telomere on chrosomal short arm and 5'-terminus of this base sequence : 58761
aactccttgtcagccacagccaatccgtagcaatccttggtctctgcttatctggggagaggaaaaaagaggacacccaggacctgacttctcacaaaatggttctttgcaaattggactggttgctctgctagcagatgctaagaagaacacacacatgcacatgtgtgcatgaacacatacacacacacacacacacacacacagagcaaaggagtctaatcagagagactaaatatgctg

SEQ ID NO: 21515 - DNA, 312 bp, Homo sapiens
  AC048383.2_160965
  Located on chromosome 15
  Distance between a terminus base of telomere on chromosomal short arm and 5'-terminus of this base sequence : 67641298
  Distance between 3'-terminus of neighbour sequence of sequence listing upward to telomere on chrosomal short arm and 5'-terminus of this base sequence : 67854
gtgtcatttgtcatacagttcacaataattggtttccaggcctatgtgccttactgtaatgtcagcacccagcatagtgcctgaaagtagggattatggaatgaatgaatgaatgaatgggtggtttttaccaggatgggagctgaggaacagcttttgtcttttacacatcctgttgagtttccaaattctgtataagcatgagctgtgcctcagttttctcatctgtaaaatgggaataataacagctcctacctcacagaattatgtagtgaggattaaatgagttactacaggtaaagcatgtagcag

SEQ ID NO: 21516 - DNA, 132 bp, Homo sapiens
  D15S967
  Located on chromosome 15
  Distance between a terminus base of telomere on chromosomal short arm and 5'-terminus of this base sequence : 67751755
  Distance between 3'-terminus of neighbour sequence of sequence listing upward to telomere on chrosomal short arm and 5'-terminus of this base sequence : 110145
tggggaacatagccctgtgcatggctggtgtgtgtgtgtgtgtgtgtgtgtgtgtgtgagagagagagagagagagagagaaagtgtgtgtgtgttctcagacagatggaagcacagtaactcacccagggt

SEQ ID NO: 21517 - DNA, 102 bp, Homo sapiens
  D15S145
  Located on chromosome 15
  Distance between a terminus base of telomere on chromosomal short arm and 5'-terminus of this base sequence : 67934136
  Distance between 3'-terminus of neighbour sequence of sequence listing upward to telomere on chrosomal short arm and 5'-terminus of this base sequence : 182249
ctaagtgtcgaggcagccatgcgttctttagtgtgtgtgtgtgtgtgtgtgtgtgtgtgtgtgtgtgtgtgtgtgtgtatgtgatatgcaggggcctctaaa

SEQ ID NO: 21518 - DNA, 165 bp, Homo sapiens
  D15S981
  Located on chromosome 15
  Distance between a terminus base of telomere on chromosomal short arm and 5'-terminus of this base sequence : 67965817
  Distance between 3'-terminus of neighbour sequence of sequence listing upward to telomere on chrosomal short arm and 5'-terminus of this base sequence : 31579
ataaactggcacatccagacaatggactataatttagtgctttaaaaagtgaactttttacttgaaaagtacatggagtggccttaagttcatacacacacacacacacacacacacacacacacacacatatatatatatattttcgagatggagttttgctct

SEQ ID NO: 21519 - DNA, 304 bp, Homo sapiens
  chr15.fa.O7frz.68151368
  Located on chromosome 15
  Distance between a terminus base of telomere on chromosomal short arm and 5'-terminus of this base sequence : 68083443
  Distance between 3'-terminus of neighbour sequence of sequence listing upward to telomere on chrosomal short arm and 5'-terminus of this base sequence : 117461
ggtacatcaacagaaagttatgatatattgtattactatttgaaattatttattctcctgcttccttacaaggtgagagagagagacagaggaacgggggggagggagggggaggagggggagagagggagagaggaagggagagagggagagggagagagagagagaatgtgtgtgtgtgtgtgtgtgtgtgtgtgtgtgtgtgtgtgtgtgtgtgttaggagttgacatccctaggttattgctttggggatcagccatgtgatatgtttggccaatagaatgtgaatagaagtgaggtaca

SEQ ID NO: 21520 - DNA, 388 bp, Homo sapiens
  chr15.fa.O7frz.68412191
  Located on chromosome 15
  Distance between a terminus base of telomere on chromosomal short arm and 5'-terminus of this base sequence : 68310738
  Distance between 3'-terminus of neighbour sequence of sequence listing upward to telomere on chrosomal short arm and 5'-terminus of this base sequence : 226991
catttacctgtctggtacttaaagaatatggaattccccttaaatcaacaatacattctttctgtatttaacaacctgtgtgtgtgtgtgtgtgtgtgtgtgtgtgtgtgtgtgtgtgtgtgtatctgtctgtctgtccaggttattagacgggttgaatttgtttcctttttatttgtttttagtattaaagatgtttttttttttgtaggactgaaactcagcttgctcaggaaggaaaataattgcctgaccattaagggcattgggcttggttaaaagaggagggtattttcttctttaaaaaattttgcttccatgcaagtaaggaagttgggattctccataaggaggatacttctggaagtgaaacagttaggcttgttta

SEQ ID NO: 21521 - DNA, 474 bp, Homo sapiens
  chr15.fa.O7frz.68489017
  Located on chromosome 15
  Distance between a terminus base of telomere on chromosomal short arm and 5'-terminus of this base sequence : 68372912
  Distance between 3'-terminus of neighbour sequence of sequence listing upward to telomere on chrosomal short arm and 5'-terminus of this base sequence : 61786
tctagctatgatttagatagccttatataaaaaatgtggcttctaccttggaaataataattaccaaattcagtgcagtatgagaagcatgtatatatatatatatatatatatatatatatagtgtgtatatataatataaataatgattccttttcactgtttcttatttcaaagtgaggaggaaatctacactgattttactgattataactgtagtatacactttaaaaatttcaaaaaccattgaagtatccaaaagtagaaagttagagttaccccctaatacaacctctgagaaataaactatttttagcagttattacttggttcataaacatatttttatatgtatggttcttactatagaaatactaatttgtaaactgtacttttttctagtcagaaaagtttatagattgggaaaacctatctgtgttgacatggaaagataaccataatgtagtaaacggc

SEQ ID NO: 21522 - DNA, 301 bp, Homo sapiens
  AC013752.3_111264
  Located on chromosome 15
  Distance between a terminus base of telomere on chromosomal short arm and 5'-terminus of this base sequence : 68449681
  Distance between 3'-terminus of neighbour sequence of sequence listing upward to telomere on chrosomal short arm and 5'-terminus of this base sequence : 76295
aagctcgaactaaggatacaaggaagtggtagaaaggaggggtgggattgaggtgggttttgccaacttggaacactagaatatttatttatttatttatttatttatttatttatttatttatttatttttagacacagggtcttgctctgtcacccaggctggagtttagtggtgcaatcatagctcactgcagcctcgaactccaaggcttaagtgatcctccagcctcagcctcctgagtaactaggaatacaggcatgcaccaccacacttggctaattggagcactagaatcttg

SEQ ID NO: 21523 - DNA, 370 bp, Homo sapiens
  chr15.fa.O7frz.68876809
  Located on chromosome 15
  Distance between a terminus base of telomere on chromosomal short arm and 5'-terminus of this base sequence : 68754336
  Distance between 3'-terminus of neighbour sequence of sequence listing upward to telomere on chrosomal short arm and 5'-terminus of this base sequence : 304354
tcagctactctaatttgctcaccaattttacttacttgtttcattcgagtattgatttgattctttggagagtgtgtgtgtgtgtgtgtgtgtgtgtgtgtgtagggagggagcaggctttggatgtttgtatggactcaggcatattgagtccttttttaaaaaaattgtgataatatgataaaatatatatatataaaaaacataaaacttaccatccaatatggtttggctgtgtcgccacccaaatctcatcttgaattgtagctcccataattcccatgtgttgtaggaggtgacccggtgggagataattgagtcatgggggtggttcccccatactgttctcatggtagtgaataagtctcat

SEQ ID NO: 21524 - DNA, 284 bp, Homo sapiens
  D15S1050
  Located on chromosome 15
  Distance between a terminus base of telomere on chromosomal short arm and 5'-terminus of this base sequence : 68997511
  Distance between 3'-terminus of neighbour sequence of sequence listing upward to telomere on chrosomal short arm and 5'-terminus of this base sequence : 242805
tccctgtttaatcatcttcattgttttgttttgtttttttcttttttgttgttgaggtttttttttgttttgtatctctgtgtgtgtgtgtgtgtgtgtgtgtgtgtgtgtgtctgtgacagagcaagagagagaagagagagaggtgcctgtaattttctaaaacctgtgtttgagggcaaaatgttaacatcttggaataatcaccccctgccagtgtttttttctttttcaattatttgcttactttgacattttcattccccactatgacagatgttcca

SEQ ID NO: 21525 - DNA, 393 bp, Homo sapiens
  DISO7_00003417
  Located on chromosome 15
  Distance between a terminus base of telomere on chromosomal short arm and 5'-terminus of this base sequence : 69045278
  Distance between 3'-terminus of neighbour sequence of sequence listing upward to telomere on chrosomal short arm and 5'-terminus of this base sequence : 47483
tctggcagatgactcactgcttcctcttccttggcacagtcaggccagcccggctgctcttggccagtaactcagctgatcactcattgtcctgaggcctccatcctgatctccatgtccaccaccaatatagcctgaagcacatgagttttgctagagctcctcctctgtgtgcatttggactatagtttccttcttcaatttgatctcatctgtctttcattgttcaaagattccccataatttctggtccatcaaggctgattgccctttcttgtcttcaaatgctgtctcatgcgcgtgtgcaaacacacacacacacacacacacacacacacagagagagatagagatacacacacatgaacacattcattcactttccagacgcac

SEQ ID NO: 21526 - DNA, 362 bp, Homo sapiens
  AC023120.3_175151
  Located on chromosome 15
  Distance between a terminus base of telomere on chromosomal short arm and 5'-terminus of this base sequence : 69146286
  Distance between 3'-terminus of neighbour sequence of sequence listing upward to telomere on chrosomal short arm and 5'-terminus of this base sequence : 100615
gaggctaaaggttcactgtaagccagaaccaagttgatctacaaagaatctctactcacgttttaggatttatatatttagatatatatttatatgtaaaataatatatatattatatttatatatattttatatatttatattttctactgtaatctgctaaaaggattacagtagaaaaagtacctttttgactgtaatctaatttattcatttatccatccatccatccatccatccatctataggtttatctaaccaacaaatatttattaaaacttactatgtgccatcactgttttaggcactgatgatataaaaaaaaaaaaaaaaaaaaaaaacaaataagtttcctgacctat

SEQ ID NO: 21527 - DNA, 470 bp, Homo sapiens
  chr15.fa.O7frz.69335834
  Located on chromosome 15
  Distance between a terminus base of telomere on chromosomal short arm and 5'-terminus of this base sequence : 69220735
  Distance between 3'-terminus of neighbour sequence of sequence listing upward to telomere on chrosomal short arm and 5'-terminus of this base sequence : 74087
taggaatttgtcatcctaatacactatcccatcctatggaatatctaatttcctcctgaaaggtcttatttacacacacacacacacacacacacacactcactactcacacacccattaaactaagtcctatgagactctaaacattgcagatatagcaatgaacaaaacataacactatcacagtgattgtaacatcataattaatggaggactcaccaggtaaagtagtagtatccaacaacaaatgaatggataaagaaaatgtggtatatacatacaatggaatgctattcagtcattaaaaaaagaataaaatcctatcatttggacaacatggacaaacatagagtacattatgttaactgaaataagccagacacagaaagacaaatactgcatgaccccactcgtatgtggaatctaaataagctgctctcacagaagtactgaatagagcagtgattacc

SEQ ID NO: 21528 - DNA, 295 bp, Homo sapiens
  Z24096.1_237
  Located on chromosome 15
  Distance between a terminus base of telomere on chromosomal short arm and 5'-terminus of this base sequence : 69293311
  Distance between 3'-terminus of neighbour sequence of sequence listing upward to telomere on chrosomal short arm and 5'-terminus of this base sequence : 72106
accatagtatggtgtttgaggtaaatgggtgtgtgtgtgtgtgtgtgtgtgtgtgtgtgtgtgtgtgaatggggtaaatgggtgtgtgtgtgtgtgtatgtgtgtgtgtaagtatgaagccatgtggggtatattaacctctactgtgaaacaacttcatatggaccctccgttataaatttccctcctgagtcagaagagtatgtgccctccaatcaaaaactaatccctccacttatgctatatatcccatcaactcctgttaattcaggaaccttaggttaccaagtacctc

SEQ ID NO: 21529 - DNA, 146 bp, Homo sapiens
  D15S197
  Located on chromosome 15
  Distance between a terminus base of telomere on chromosomal short arm and 5'-terminus of this base sequence : 69377718
  Distance between 3'-terminus of neighbour sequence of sequence listing upward to telomere on chrosomal short arm and 5'-terminus of this base sequence : 84112
cccaaacaaaacaggtggcacaagccagtttccatttacttgtaacaacaagacacacaccaccacttcagccaccaccttacttacacacacacacacacacacacacacacacacagagatttgaggctctaattcccatcacc

SEQ ID NO: 21530 - DNA, 160 bp, Homo sapiens
  Z23499.1_94
  Located on chromosome 15
  Distance between a terminus base of telomere on chromosomal short arm and 5'-terminus of this base sequence : 69377740
  Distance between 3'-terminus of neighbour sequence of sequence listing upward to telomere on chrosomal short arm and 5'-terminus of this base sequence : -124
agccagtttccatttacttgtaacaacaagacacacaccaccacttcagccaccaccttacttacacacacacacacacacacacacacacacacagagatttgaggctctaattcccatcacctagatgaagtaaaaaacatcaggccataaacattta

SEQ ID NO: 21531 - DNA, 406 bp, Homo sapiens
  chr15.fa.O7frz.69676648
  Located on chromosome 15
  Distance between a terminus base of telomere on chromosomal short arm and 5'-terminus of this base sequence : 69518886
  Distance between 3'-terminus of neighbour sequence of sequence listing upward to telomere on chrosomal short arm and 5'-terminus of this base sequence : 140986
tgtaatttaatgtgtagaagtccagttcctcaaaagtaaattgaggacaatttacttttatggtggagtttgatgatgtatgtgaatgattccaacactgcccaataggcatcctctttctttgggaattgactagtcctggagggctgtccttgtgacacacacacacacacacacacacacacacagaagttttcatccaaagttccttgcttataactcccacagctcttgttagtcttttgtttataatgttgggggcactttaggctcagaagcaggcctcagagaacagaattctctctctctccctctctggccttcttctgccttcctttcacctgttccttttcccccaaggcagaaatcttcccccaactttgtgtcttggagctggctataaata

SEQ ID NO: 21532 - DNA, 268 bp, Homo sapiens
  chr15.fa.O7frz.69820138
  Located on chromosome 15
  Distance between a terminus base of telomere on chromosomal short arm and 5'-terminus of this base sequence : 69622921
  Distance between 3'-terminus of neighbour sequence of sequence listing upward to telomere on chrosomal short arm and 5'-terminus of this base sequence : 103629
ggacatgagctttaagtacgtaatggacattcagatgatatgaagatgttggctacctgagcttggaccccagaggaaatacacatacatatattatatatatgtttgtcggtcagtctatcatctatctatctatctatctatctatctatctatctatctatctgtctaatctatctgtctatctacctacctacctacctatctatctatggctgtccaggtgtaagactgcacactaagactgtctaaatgagatcactaggaa

SEQ ID NO: 21533 - DNA, 424 bp, Homo sapiens
  chr15.fa.O7frz.70340572
  Located on chromosome 15
  Distance between a terminus base of telomere on chromosomal short arm and 5'-terminus of this base sequence : 70040301
  Distance between 3'-terminus of neighbour sequence of sequence listing upward to telomere on chrosomal short arm and 5'-terminus of this base sequence : 417112
ttagtgaaatgtgaataccgactgggtaataggtgatattaagaaactattattattattattattattattattattattattattacttgagacagagtcttgttctgtcgcccaggctgaagtgccgtggcacaatcctggctcactgcaacctccacctcctgggttcaagcgattctccggtctcagcctcccgagtatctgggactacaggcatgagtcaccacgcctggctaatttttgtatttttaatagagacgggtttttgccaagttggccaggctagtcttgaactcctgacctcaggtgatcacccgcctcggccccactaagtgccaggattacaggcgtgagccaccatgcccggccaataaattattttagataccagcctgatgatggtatcatggttatgtttaga

SEQ ID NO: 21534 - DNA, 198 bp, Homo sapiens
  D3S1556
  Located on chromosome 15
  Distance between a terminus base of telomere on chromosomal short arm and 5'-terminus of this base sequence : 70195798
  Distance between 3'-terminus of neighbour sequence of sequence listing upward to telomere on chrosomal short arm and 5'-terminus of this base sequence : 155073
tgcaggcatgagccatcatgcccagcctcccagacgctttttctttttcttttttttttttttttgagatggagtctccctctgttgcccaggctggggtgcagtggtgcaatcttagctcactgcaacctccgcctcctaggttcaagtgattctcctgcctcagcctccctgagtagctgggactacaggtgtgca

SEQ ID NO: 21535 - DNA, 263 bp, Homo sapiens
  D15S215
  Located on chromosome 15
  Distance between a terminus base of telomere on chromosomal short arm and 5'-terminus of this base sequence : 70209759
  Distance between 3'-terminus of neighbour sequence of sequence listing upward to telomere on chrosomal short arm and 5'-terminus of this base sequence : 13763
gggaaccaaggaaatgttactaagacaacttggtggggagggaggtaggtgtgtgtgtgtgtgtgtgtgtgtgtgtgtgtgtgtgtgtgtgtgtgtgtataaatatatatatattataaatataaataacatctatttatttatttttttgagacggagtttcactcttgttgcccaggctggagtacagtggtgcgatcttggctcactctgcaacctctgcctcctgggttcaagcaattctcttatttcagcctcccgag

SEQ ID NO: 21536 - DNA, 209 bp, Homo sapiens
  D15S1026
  Located on chromosome 15
  Distance between a terminus base of telomere on chromosomal short arm and 5'-terminus of this base sequence : 70242828
  Distance between 3'-terminus of neighbour sequence of sequence listing upward to telomere on chrosomal short arm and 5'-terminus of this base sequence : 32806
agtcaagttgggttccctggaggaaatggaaagtggttagtgtgtgtgtgtgtgtgtgtgtgtgtgtgtgtgtgtgtgtgtggatgtgtgcacgcgcacatgcttattatggaggaaagagtgaatggagtagccgggcatggataaggcctgcagcattctcacagtggggtcatcaaggatagagctgggggcaggtgttcaattca

SEQ ID NO: 21537 - DNA, 450 bp, Homo sapiens
  AC012681.2_45879
  Located on chromosome 15
  Distance between a terminus base of telomere on chromosomal short arm and 5'-terminus of this base sequence : 70316120
  Distance between 3'-terminus of neighbour sequence of sequence listing upward to telomere on chrosomal short arm and 5'-terminus of this base sequence : 73083
ttaaacgtaatccaacatttgtaagttgggtagaggggacagagccccaaagaagactgataagaggcctggcacagtggcttatccctgtaatcccagcactttgggaggccaagatgggtggatcacttgaggtcagaagttcagaccagactggccaacatggtgaaacccgaggctacttgggaggctgaggcaggagaatcccttgagcctaggagacagaggttgcagtgagccaagattgtgccactgcactccagcctgggcaacagagtgagactctgtctcaaaataaataaataaataaataaataaataaataaataaataggaaaatacaacaagatagccgaataggaacagctccgatctgcagctcccagcaagatcaacacagaaggcgggtgatttctgcatttccaactgaggtacctggttcatctcatt

SEQ ID NO: 21538 - DNA, 400 bp, Homo sapiens
  HUMUT744
  Located on chromosome 15
  Distance between a terminus base of telomere on chromosomal short arm and 5'-terminus of this base sequence : 70660153
  Distance between 3'-terminus of neighbour sequence of sequence listing upward to telomere on chrosomal short arm and 5'-terminus of this base sequence : 343583
gcactctagcctggggaacagagtgagattctgtctcaaaaaataaataaataaaaaagaaagacagaaagaaagaagaaaaaaaggaaggaaggaaggaaggaaggaaggaagaaagaaagaaagaaagaaagaaagaaagaaagaaaaagaaagaaagaaagaaagaaagaaagaaggaaagaaagaaaaagaaagagagagagaaaggaacccttaaatctagatagcctcagcccaaggtcagagagctttgttgccacggattggttggttagtaacttgctttatgttgaagacaggcctggctttgactttatacagttacttgcagattctttgaacctcagttttcctacctgtaaaatgggattgatatagctactttgaagagtgttcg

SEQ ID NO: 21539 - DNA, 350 bp, Homo sapiens
  chr15.fa.O7frz.72200291
  Located on chromosome 15
  Distance between a terminus base of telomere on chromosomal short arm and 5'-terminus of this base sequence : 70739741
  Distance between 3'-terminus of neighbour sequence of sequence listing upward to telomere on chrosomal short arm and 5'-terminus of this base sequence : 79188
ctggttgaggcagacatacacacacatgcacacacacacacacacacacacacacaaactactgagctctcacaggattgggtagtgtaagctcaactgagggcagagtcagcaaggagggttcccttgagaaggcaggatttgagctgggttcctttgagctaggttccagaggcatgctctgcacctatctggggatgtgagtgcagacacccgagccaaagctgggtggccaacgactggtggattgcattgcattgatggcccagtgcttcctgctccctgtgtcctggccctctgcggtgtgcttttgtattgtcctcccactatgaacagaggttacgtcacta

SEQ ID NO: 21540 - DNA, 105 bp, Homo sapiens
  D15S124
  Located on chromosome 15
  Distance between a terminus base of telomere on chromosomal short arm and 5'-terminus of this base sequence : 71071139
  Distance between 3'-terminus of neighbour sequence of sequence listing upward to telomere on chrosomal short arm and 5'-terminus of this base sequence : 331048
aaatgctacaatgaacctccttaatcagtattgtgtgtgtgtgtgtgtgtgtgtgtgtgtttgtgtaaactttttaggagtggaatcattaggtttaagggtagc

SEQ ID NO: 21541 - DNA, 277 bp, Homo sapiens
  chr15.fa.O7frz.71651773
  Located on chromosome 15
  Distance between a terminus base of telomere on chromosomal short arm and 5'-terminus of this base sequence : 71131644
  Distance between 3'-terminus of neighbour sequence of sequence listing upward to telomere on chrosomal short arm and 5'-terminus of this base sequence : 60400
gactcctacctggcaagtagccccatagttaaagaaattgaaaattttccctaatgcagatcatctgtcatctatctacctatctaatccctaataaaatctactatctatctatctatctatctatccatccatccatccatccatccatccatccatccatccatccatcatcatctatctatcttcaatggccaagtagctctgcatatcaaggaactcataatctagttacaaagaccaaaatcacaaatgagacgattaacagataccatga

SEQ ID NO: 21542 - DNA, 153 bp, Homo sapiens
  D15S160
  Located on chromosome 15
  Distance between a terminus base of telomere on chromosomal short arm and 5'-terminus of this base sequence : 71530921
  Distance between 3'-terminus of neighbour sequence of sequence listing upward to telomere on chrosomal short arm and 5'-terminus of this base sequence : 399000
tactacatgggaatggagtctaacggcttgaggagtgtgtgtgtgtgtgtgtgtgtgtgtgtgtgtgtgtgtgtgtgtgtgtgtcttgagagacctggaaaatggtcggagaatgcaatatgacagcagtagcctcagaactcagagcaattt

SEQ ID NO: 21543 - DNA, 180 bp, Homo sapiens
  Z23814.1_206
  Located on chromosome 15
  Distance between a terminus base of telomere on chromosomal short arm and 5'-terminus of this base sequence : 71530934
  Distance between 3'-terminus of neighbour sequence of sequence listing upward to telomere on chrosomal short arm and 5'-terminus of this base sequence : -140
tggagtctaacggcttgaggagtgtgtgtgtgtgtgtgtgtgtgtgtgtgtgtgtgtgtgtgtgtgtgtgtcttgagagacctggaaaatggtcggagaatgcaatatgacagcagtagcctcagaactcagagcaatttatcaggagcagtaattctctgagttacagaaaccagatgg

SEQ ID NO: 21544 - DNA, 155 bp, Homo sapiens
  G07910
  Located on chromosome 15
  Distance between a terminus base of telomere on chromosomal short arm and 5'-terminus of this base sequence : 71571989
  Distance between 3'-terminus of neighbour sequence of sequence listing upward to telomere on chrosomal short arm and 5'-terminus of this base sequence : 40875
gctaagatggcgccattgcagtccagcctgggcaacagagctagactccgtatctatctatctatctatctatctatctatctatctatctatctatctatctaggtagatagatagaacaggaggccagctagaagggacatagaggatgcaca

SEQ ID NO: 21545 - DNA, 142 bp, Homo sapiens
  D15S965
  Located on chromosome 15
  Distance between a terminus base of telomere on chromosomal short arm and 5'-terminus of this base sequence : 71721155
  Distance between 3'-terminus of neighbour sequence of sequence listing upward to telomere on chrosomal short arm and 5'-terminus of this base sequence : 149011
atgtgccagggtcagtgactgacctaggggaagttttgccagagattcccccccaccactacgcacgcacacgcacacacacacacacacacacacacacacctcactgctttttcccccaagaacattccttcctagagct

SEQ ID NO: 21546 - DNA, 412 bp, Homo sapiens
  chr15.fa.O7frz.72531353
  Located on chromosome 15
  Distance between a terminus base of telomere on chromosomal short arm and 5'-terminus of this base sequence : 71818188
  Distance between 3'-terminus of neighbour sequence of sequence listing upward to telomere on chrosomal short arm and 5'-terminus of this base sequence : 96891
ccactagcttggtgactctatcagggtgcactcctgagttcagattaaatgtttttcagtacaatccaatttcttcctgacacacggactagaaaagcccagtccatgtgtgcagacagacagacacacacacacacacacacacacacacatttggtgctaaatatccaatcaagtccgcagataatagagaccagccagttcactcccagtttaatcagataaaatgctcattcatcggctcctgccagagctgccgtcccctccttagggcggagtcgagggggcggggagggcctgtgggggaaggggctgagacccgagtggcttgagcatgtgggctgcgcctttaaatcttcaaggaggggggacagcgttgcccacgggggactaattatccttcagcctttag

SEQ ID NO: 21547 - DNA, 256 bp, Homo sapiens
  DISD22_0009720
  Located on chromosome 15
  Distance between a terminus base of telomere on chromosomal short arm and 5'-terminus of this base sequence : 72250915
  Distance between 3'-terminus of neighbour sequence of sequence listing upward to telomere on chrosomal short arm and 5'-terminus of this base sequence : 432315
tgagtccacctttctcaggatttttggtgtgtgtgtgtgtgtgtgtgtgtgtgtgtgtgtgtgtgtgtgtgttgtaccctgacctgtaatttggcactttacacacattatctcattaaacctcccacccaacctgtaagataagattatcatccccagttgcgagatgagaaagtctagactcagaaagtttatgtcacaggcccaaggttagtgggtgagctgggattttcttctggatctgtgagccagcctc

SEQ ID NO: 21548 - DNA, 438 bp, Homo sapiens
  chr15.fa.O7frz.73010028
  Located on chromosome 15
  Distance between a terminus base of telomere on chromosomal short arm and 5'-terminus of this base sequence : 72403256
  Distance between 3'-terminus of neighbour sequence of sequence listing upward to telomere on chrosomal short arm and 5'-terminus of this base sequence : 152085
gaagactatcagtgaagagcatacgacaggacagagctgagtactcaagaattgagggtcccttgcagttgtcactatgtggggctttcattttggtgaaacttccaaactgttaataagataaggagcccaactgaaagatgctgaacatattaaatttgctgagcagcagatacctgcattagtttggaaatacagtctttccccaaaatgtttcagctgttcatatatatattatatataatatacacacacacacacacccctccatatacattatatatatatatatatatatatatatatatatatatatatatgcactgggtatgcacagaggattctgaatggctctaacagcgggtgtgatggttaattttatgtgtaaacttgactgggccacaagatgcccaaatagctggttaaacactatttctg

SEQ ID NO: 21549 - DNA, 283 bp, Homo sapiens
  chr15.fa.O7frz.73324990
  Located on chromosome 15
  Distance between a terminus base of telomere on chromosomal short arm and 5'-terminus of this base sequence : 72601179
  Distance between 3'-terminus of neighbour sequence of sequence listing upward to telomere on chrosomal short arm and 5'-terminus of this base sequence : 197485
acggaggtttactatgtaaacaccaatcacaataaaatcctgtcttcactcccagcccatctctccaagtgggtctctctcaaccctccaaagctctgggtttttaaacatttacccttgcctctactctctcttggtattcatctctgcatatcactgtctctttcattcctttttctgagtctctttctttttctaagcctctcctctctctctctctctctctctgctcctttgcgtaatttgtctctatttcttgcctctttcttgcttcattatgctc

SEQ ID NO: 21550 - DNA, 292 bp, Homo sapiens
  chr15.fa.O7frz.74944339
  Located on chromosome 15
  Distance between a terminus base of telomere on chromosomal short arm and 5'-terminus of this base sequence : 72829058
  Distance between 3'-terminus of neighbour sequence of sequence listing upward to telomere on chrosomal short arm and 5'-terminus of this base sequence : 227596
ctattgagctggatattaattgagaacaaatagaaactaatgaactctgaaaaacataaaacatgagcaacatgacttcactgcgaaagacaaatcagcacatagccttcttgtgaatgtattttgctgacagtccacgagctaataatcagcctgaactcagcagtgttctgttcccttaggagacacacacacacacacgcacacacacacacacacacacacacacaccaagttggtggctgtgccacctacaataactcagtaactatcctggattaatagatgacaa

SEQ ID NO: 21551 - DNA, 324 bp, Homo sapiens
  chr15.fa.O7frz.74834206
  Located on chromosome 15
  Distance between a terminus base of telomere on chromosomal short arm and 5'-terminus of this base sequence : 72862509
  Distance between 3'-terminus of neighbour sequence of sequence listing upward to telomere on chrosomal short arm and 5'-terminus of this base sequence : 33159
gagattgcagtaagcctagattgtgcctctgaactctagcctaggtgacagagtgagaccccgtctcaaaaaaaaatgtatatatatatgtgtgtgtttatacatgtatgtgtatatgtgtatatacatgtgtgtgtgtgtgtgtgtgtgtgtgtgtgtgtgtatatatatatatatatatatatatatatatatataatgaatttcagtacaaatcccagcagatttatttttggaagttgacaaaatgactctaacatttgtttaaaagggtaaatgataaaaaaataaagaatagacttgttcaaccagatgttcaataaa

SEQ ID NO: 21552 - DNA, 101 bp, Homo sapiens
  DISO7_10004062
  Located on chromosome 15
  Distance between a terminus base of telomere on chromosomal short arm and 5'-terminus of this base sequence : 73029671
  Distance between 3'-terminus of neighbour sequence of sequence listing upward to telomere on chrosomal short arm and 5'-terminus of this base sequence : 166838
tcagcaagatagctcactagagacacctggcacccatactccacacacacacacacacacacacacacacacacacaagcaaggaccaaggcaatgaataa

SEQ ID NO: 21553 - DNA, 123 bp, Homo sapiens
  DISD22_0009728
  Located on chromosome 15
  Distance between a terminus base of telomere on chromosomal short arm and 5'-terminus of this base sequence : 73389196
  Distance between 3'-terminus of neighbour sequence of sequence listing upward to telomere on chrosomal short arm and 5'-terminus of this base sequence : 359424
attgctccattgctctgggttttaaggtggtgaatttaaaaagaagtaacctttttattgacatcacacacacacacacacacacacacacacacacacacacccctatggccactcacctac

SEQ ID NO: 21554 - DNA, 461 bp, Homo sapiens
  chr15.fa.O7frz.74240580
  Located on chromosome 15
  Distance between a terminus base of telomere on chromosomal short arm and 5'-terminus of this base sequence : 73586448
  Distance between 3'-terminus of neighbour sequence of sequence listing upward to telomere on chrosomal short arm and 5'-terminus of this base sequence : 197129
atcatttgaggtcaggagttagagaccagcctggccaacatggtgaagccccatgtctactaaaaatacaaaaattagctggatgtggtggtggccacctgtaatcccagctacttgggaggctgaggcaggagaatcgcttgaacctgggaggcagaggttgcaatgagctgagatcacgtcactgaactccagcctgggcgacaagagcgagactccatctccatctcaaaaataaataaataaataaaaataaaataaaataaaataaaataaaataaaaaaaagaatccacaacccctacacaagttttgggataagatgattttacaaccttccttaaaaagagaggtgtaggtacagcttagcttattaaagaaaaaggaagactatataagaagaattttgctttttttactctttatataagtcttggggtagctaagtcatggttatgaaac

SEQ ID NO: 21555 - DNA, 181 bp, Homo sapiens
  D15S114
  Located on chromosome 15
  Distance between a terminus base of telomere on chromosomal short arm and 5'-terminus of this base sequence : 73616997
  Distance between 3'-terminus of neighbour sequence of sequence listing upward to telomere on chrosomal short arm and 5'-terminus of this base sequence : 30088
agaatgagcagcactgtttgcccatgcttgcgtgcactctctctctctctctctctctctctcacacacacacacacacacacacacacacacacagagaaatgtccactgtcagaatagatttaaaaattgtattaacacaatgaaggacttactctacagcagagaaaagcagtgacaa

SEQ ID NO: 21556 - DNA, 439 bp, Homo sapiens
  AC051643.2_171786
  Located on chromosome 15
  Distance between a terminus base of telomere on chromosomal short arm and 5'-terminus of this base sequence : 73955819
  Distance between 3'-terminus of neighbour sequence of sequence listing upward to telomere on chrosomal short arm and 5'-terminus of this base sequence : 338641
aatatggatgtccttacctgaggttctcctttcaatgtgctaaactgagtggcggggctgagcacagtggctcacccctgtaatctcagcactttgggaggccaagggggggcggatcatctgaggtcaggaggtcgagaccaacctggccaacatggtgaaaccccatctctactaaaaatacaaaaattagccaggtgtggtggcacatgcctgtaatcccagctactcgagaggctgagtcaggagaatcacttgaacccaggaggcagtggaggttgcagtgagccaagattgcgccattgcactccagtctgggtgacagagcaagactccatctcaaaaataaataaataaataaataaataaataaataagtaaatcaagtggaagcatctctaatggtttgcttggttgaatgactgaaactaggattcag

SEQ ID NO: 21557 - DNA, 364 bp, Homo sapiens
  AC051643.2_53971
  Located on chromosome 15
  Distance between a terminus base of telomere on chromosomal short arm and 5'-terminus of this base sequence : 73983320
  Distance between 3'-terminus of neighbour sequence of sequence listing upward to telomere on chrosomal short arm and 5'-terminus of this base sequence : 27062
gagccatatttatgccactacactgcagcctgggcaacagagagacctcatttctaaaaataaataaataaataaataaataaataaataaataaataaataaaaatttcctctttaggattataatagtgtggataaatattaataaatggtagcagttggaggggcaagcagttctgttttgatttaaaagaatattgaagaaagcatttacagttcacataaatttatatttaatcaactttttaaaactttatgcatttgttaactatcagctttagattagttaggattttattttttaaggggaaaatgtatcttttgttttctttttatttgggtcttcattctacagtggactaaa

SEQ ID NO: 21558 - DNA, 203 bp, Homo sapiens
  DISO7_10004058
  Located on chromosome 15
  Distance between a terminus base of telomere on chromosomal short arm and 5'-terminus of this base sequence : 74085310
  Distance between 3'-terminus of neighbour sequence of sequence listing upward to telomere on chrosomal short arm and 5'-terminus of this base sequence : 101626
gagagcctgacatttgctgggcacctgttccatcctgggcatttaaagagagatatatatatatatatacacacacacacacacacacacacacatacacacacacactttctaaagaaacaaaatcaactaatataagatcctaaaaggaaagtggggaaatggagaaaaataggaaaagaagaagcacctttagtctcatc

SEQ ID NO: 21559 - DNA, 364 bp, Homo sapiens
  AC016693.4_98452
  Located on chromosome 15
  Distance between a terminus base of telomere on chromosomal short arm and 5'-terminus of this base sequence : 74294369
  Distance between 3'-terminus of neighbour sequence of sequence listing upward to telomere on chrosomal short arm and 5'-terminus of this base sequence : 208856
tcacatagctagtaaatggcagagccaggatgaatgcatgcatgcacgtatgcatgcataaatggtatagcttcatggcatctggaggctgctttaaacataaacatggcagtgtctgaaagacagtccacacagcagcagcagcagcagcagcactgtccaccatagtggaattccaccatgaatgaagaagtgtaagaaataggcacacccacaccttcccctcctcagctctaagatgatcagtccaggtgctcactgcagaataagccagaaggaaacaaacaggcataaacttagctagtaggctgtctcaaagttgtgttttttgtgtttcagagtgttgaggaagtaatattacgag

SEQ ID NO: 21560 - DNA, 374 bp, Homo sapiens
  chr15.fa.O7frz.75528817
  Located on chromosome 15
  Distance between a terminus base of telomere on chromosomal short arm and 5'-terminus of this base sequence : 74483130
  Distance between 3'-terminus of neighbour sequence of sequence listing upward to telomere on chrosomal short arm and 5'-terminus of this base sequence : 188397
tagcctatcatttgaatatgctattattttacacatgagtttaaaaagaaaactatgcctgactatcacatttcctaaaactgtaagtttctaaggactgcactgactctgtataacaatattatatatatatatatatatacataatcccataaaaataaagcaagcaagcattttgtaattcttatttcacctgtaaaaaggccaaccacatgacaattttacgaagcatctcatttctttagtaaactattgaaagatcatctctctctctttgacatacatgggcagtggaagtcataagcaaaagcaaaatgaaatgatcgtcaaaaattcgtgcttcttacagagtacggaattcaatagtctaactg

SEQ ID NO: 21561 - DNA, 473 bp, Homo sapiens
  chr15.fa.O7frz.75613871
  Located on chromosome 15
  Distance between a terminus base of telomere on chromosomal short arm and 5'-terminus of this base sequence : 74567281
  Distance between 3'-terminus of neighbour sequence of sequence listing upward to telomere on chrosomal short arm and 5'-terminus of this base sequence : 83777
cctatcttatttaacatctgcaactttttacttgattagccactacccttctcaaaagtcttcctgccttggcctctgcaatcgtcttctctccagttatcttaatgcccttctcagtctcctttcctagtttttctaccttgctcatacaatgatattgcttcagctgagttctatcctgacttttccttcttctcactgtctttctggagaatatctagcactgcccattatttccatgggctaatgcttctcgagtctatctttatgcccttttgttccacttctgttctcctggggcatgtttccagttgtctgtggtacatttctacttaattatgctacaggtgtttcaaatttatcattttcttgtgtgtctgtccacacacacacacacacacacaccctgtttttactttgattaatattaagtacataatcatcaattggaaacctcagaattatctttgact

SEQ ID NO: 21562 - DNA, 377 bp, Homo sapiens
  chr15.fa.O7frz.75708359
  Located on chromosome 15
  Distance between a terminus base of telomere on chromosomal short arm and 5'-terminus of this base sequence : 74703991
  Distance between 3'-terminus of neighbour sequence of sequence listing upward to telomere on chrosomal short arm and 5'-terminus of this base sequence : 136237
ggaaggttctttgtagaaagagtgtgagaaggcaggttcatttcccaatacatttaaggcattcttgatgctgacctctgtttggttgtggaagaatgaatgaatgaatgaatgaacgaacaagcgaacgaatgaatatccctgggtgctgtgggctcagtagagctgtgctgacaacaatctacttgtgtgtgttcagtttcttcaatgttatttcatagtgaagttgttaagaatgtggaccctggagccaaaagtctgggctcaagtctcagctccaccactgcctagttctgtgactttgggcaagttacttaatctctctgggcctgtttccttatctataaagtgagagtaacaatagtatccacctcaag

SEQ ID NO: 21563 - DNA, 220 bp, Homo sapiens
  D15S984
  Located on chromosome 15
  Distance between a terminus base of telomere on chromosomal short arm and 5'-terminus of this base sequence : 74728613
  Distance between 3'-terminus of neighbour sequence of sequence listing upward to telomere on chrosomal short arm and 5'-terminus of this base sequence : 24245
gcagacacgctcgcatgcccgtctccatgccgcggcctctctccttcctggaatcacagcgcggccaggctggcccctgggctcagtgctcacctccccctcaaacagacacagacacacacacacacacacacacacacacacacacacacacacacacacacacacggacttgcaggggggcagcccccggaagcctcgctcctgccctcggagcctc

SEQ ID NO: 21564 - DNA, 158 bp, Homo sapiens
  DISD22_0009736
  Located on chromosome 15
  Distance between a terminus base of telomere on chromosomal short arm and 5'-terminus of this base sequence : 74860626
  Distance between 3'-terminus of neighbour sequence of sequence listing upward to telomere on chrosomal short arm and 5'-terminus of this base sequence : 131793
gatcccaggtgacactccagggccaccccgtttcctgccctcagcactgctgggagcagctgcagctggaggaagtgtgtgtgtgtgtgtgtgtgtgtgtgtgtgtgtgcgcgcgcatgttgggggcaggggagggaggcccttcatgtggttctatt

SEQ ID NO: 21565 - DNA, 250 bp, Homo sapiens
  D15S973
  Located on chromosome 15
  Distance between a terminus base of telomere on chromosomal short arm and 5'-terminus of this base sequence : 74973196
  Distance between 3'-terminus of neighbour sequence of sequence listing upward to telomere on chrosomal short arm and 5'-terminus of this base sequence : 112412
atccacctgactcaaggaagtggagactcacttcacctactggctcaaaagagacagggtaacaacagtggcagcaataccagcaggcctgggttgtgtagccaccatttactgagcacttacaatgacactgtgctaggcagttcttatttataaccttaacactcactcccacccatccagtagagaggcttactacacacacacacacacacacacacacacacacacgcaatttactgatggagaa

SEQ ID NO: 21566 - DNA, 130 bp, Homo sapiens
  chr15.fa.O7frz.76023460
  Located on chromosome 15
  Distance between a terminus base of telomere on chromosomal short arm and 5'-terminus of this base sequence : 75206183
  Distance between 3'-terminus of neighbour sequence of sequence listing upward to telomere on chrosomal short arm and 5'-terminus of this base sequence : 232737
atggttactggacatctttatctatttattcagagcctgactttatttatttatttatttatttatttatttatttattttttgagacaagttctcactctgttgctcaggctggagtgcagtggtacat

SEQ ID NO: 21567 - DNA, 293 bp, Homo sapiens
  chr15.fa.O7frz.76352492
  Located on chromosome 15
  Distance between a terminus base of telomere on chromosomal short arm and 5'-terminus of this base sequence : 75384503
  Distance between 3'-terminus of neighbour sequence of sequence listing upward to telomere on chrosomal short arm and 5'-terminus of this base sequence : 178190
aacataccataagcttccatttgcatagcattcaaaatagggtgtaggggatgaggaaatggcagcctaggaggaaaacagctgcggttataaaatggcaacaggaaggatccttggaaatgttccatatcttgactgtagtgatggccacacaaagccacacacgtgaactaaatacacacgtgcatgtgcgcatgtgtgcgcgtgcgcgcgcgcgcgcacacacacacacacacacacacacacacacacacacaccctacaaaggagtacatgtagaactgcctaaatct

SEQ ID NO: 21568 - DNA, 350 bp, Homo sapiens
  chr15.fa.O7frz.76454622
  Located on chromosome 15
  Distance between a terminus base of telomere on chromosomal short arm and 5'-terminus of this base sequence : 75486124
  Distance between 3'-terminus of neighbour sequence of sequence listing upward to telomere on chrosomal short arm and 5'-terminus of this base sequence : 101328
tgtagaccatgctcttcactaccacagagttccatgctactttctctccctctccctcctctcctgtccctgctacacacacacacacacacacacacacacacacatgcacactcactcacacacactaggaggaacaaatgagatcattcacatgaaagcacttatgtttctgaaatttaagggactgtggtttttatctaggttgacctctcaagctaaaaactgggaaccagaataatggactgaaacttgggtttcacttccagaccagtgttgatcctctgaattgatgaaactgtatagatttccctcttgattgcccctgctaacatggatttcctttcact

SEQ ID NO: 21569 - DNA, 188 bp, Homo sapiens
  DISD22_0009743
  Located on chromosome 15
  Distance between a terminus base of telomere on chromosomal short arm and 5'-terminus of this base sequence : 75762172
  Distance between 3'-terminus of neighbour sequence of sequence listing upward to telomere on chrosomal short arm and 5'-terminus of this base sequence : 275698
cggccatatgtaggtgtgtgtgtgtgtatatatatatatatatatgtatatttatatatatatttatatatatgtatatttatatatatatttatatttatatatatatgagtatttatagctatttatagaacaaggcaggggcataccacagaggggccacaagttttcagcaatggtcacacctg

SEQ ID NO: 21570 - DNA, 416 bp, Homo sapiens
  chr15.fa.O7frz.76839312
  Located on chromosome 15
  Distance between a terminus base of telomere on chromosomal short arm and 5'-terminus of this base sequence : 75957902
  Distance between 3'-terminus of neighbour sequence of sequence listing upward to telomere on chrosomal short arm and 5'-terminus of this base sequence : 195542
aatcgaatcacttgcaagtagcacgcccagccccagtactaacctctgtccctatttactacctctatggcaggggtggccaatcttttcgcttccctggccgcattggaagaagaattgtcttgggccacacgtaaaatacactaacacactaacgatagctaataagctggaaaaaaatcacaaaaaaatctcttaatgttttaagaaagtttaccaatttgtgttgggctgcatttaaaaccatcctgggccatatgcggcccttaggccacgggttggacaagcttgctctatagtgaggggccatgaaggaggggacaagagaacactcaatcaaacacacacacacacacacacacacacccatccgaaatccagagccatgtgggcaaatgtatggagttgccagattg

SEQ ID NO: 21571 - DNA, 309 bp, Homo sapiens
  chr15.fa.O7frz.77001181
  Located on chromosome 15
  Distance between a terminus base of telomere on chromosomal short arm and 5'-terminus of this base sequence : 76077531
  Distance between 3'-terminus of neighbour sequence of sequence listing upward to telomere on chrosomal short arm and 5'-terminus of this base sequence : 119213
ggattttgattagactttggactggagctcaacttaagcatttgttgagatgggtgtcctgtgggtctgactggatgggaggtgcccgctagtgaggatttctagtgtgtgtgtgtgtgtgtgtgtgtgtgtgtgtgtatgtgtgtgtgtgatgtgtgttgtctattgcatgtgtggaagtttctgagtggtatggtgtgtatgtgtgtggggcatgcagcgtgtgtgtggatggaatatctagagaacctctgcttccttggcaacatattccataagaaaaatgtagtttccatgtcatttaaagaa

SEQ ID NO: 21572 - DNA, 147 bp, Homo sapiens
  Z67251
  Located on chromosome 15
  Distance between a terminus base of telomere on chromosomal short arm and 5'-terminus of this base sequence : 76215480
  Distance between 3'-terminus of neighbour sequence of sequence listing upward to telomere on chrosomal short arm and 5'-terminus of this base sequence : 137640
gggaagtattgggaaagcaagaaggcagcagaggcggctgtgcgtgtgtgtgtgtgtgtgtgtgtgtgtgtgtatgtgtgtgtgtggccaagcacttgagatttcaaggctcatgggatttagacacaaattcctgaaactaagtgc

SEQ ID NO: 21573 - DNA, 404 bp, Homo sapiens
  chr15.fa.O7frz.77223083
  Located on chromosome 15
  Distance between a terminus base of telomere on chromosomal short arm and 5'-terminus of this base sequence : 76273530
  Distance between 3'-terminus of neighbour sequence of sequence listing upward to telomere on chrosomal short arm and 5'-terminus of this base sequence : 57903
tgaaaagcttattgatgcatagggctttaacacaacaatgctgtgtaggaccacagaggaataaaaataattaaaattgacagaaagagaggagagaaagaccattcacacacacacacacacacacacacacacacacacacacacacagagagagagagagagagagagagagagagatcagtaggagaattaaggagaaaagaggaaggggatggagagacagaaacggagacttgttgtcaatgtatttaataaacacacagtgcccttgaatggtggtagttttcctggaaatctagcagaacacataaacacaacaacatcagactcatgtagttatcagaacaatgcatttgaggaagcagaaagatacacactagactcttaaccatggttacttc

SEQ ID NO: 21574 - DNA, 207 bp, Homo sapiens
  chr15.fa.O7frz.77420482
  Located on chromosome 15
  Distance between a terminus base of telomere on chromosomal short arm and 5'-terminus of this base sequence : 76301750
  Distance between 3'-terminus of neighbour sequence of sequence listing upward to telomere on chrosomal short arm and 5'-terminus of this base sequence : 27816
gctgatacttattggatacaagacaaaggggcaggctaaggagtgtgagccatctccaatgattggtaaggtcacgtgtccactggacagggggcccttccctgcctggcagccaaggcagagagagagagagaagagagagagacagcttatgccattatttctgcatatcagagacttttagtactttcactaatttgctactgc

SEQ ID NO: 21575 - DNA, 217 bp, Homo sapiens
  DISO7_10004063
  Located on chromosome 15
  Distance between a terminus base of telomere on chromosomal short arm and 5'-terminus of this base sequence : 76359338
  Distance between 3'-terminus of neighbour sequence of sequence listing upward to telomere on chrosomal short arm and 5'-terminus of this base sequence : 57381
gtggatatgtcatcctaggtattcaaaatagcaaaccctaagtggagagtgtgtgcatgtgtgtgtgtgtgtgtgtgtgtgtgtgagagagagagagagagagaatgtggggagggattttcaagtgcaggtgtggggagggagttttgagtgtaggtgtgtcttatttttgtacttttacagtctctaatacagtgtctgaagtatggagagtatt

SEQ ID NO: 21576 - DNA, 177 bp, Homo sapiens
  Z67064
  Located on chromosome 15
  Distance between a terminus base of telomere on chromosomal short arm and 5'-terminus of this base sequence : 76630533
  Distance between 3'-terminus of neighbour sequence of sequence listing upward to telomere on chrosomal short arm and 5'-terminus of this base sequence : 270978
ccctggaataattacagccttctcaaatgagaagatgaagaggggttttttagtgtgtgtgtgtgtgtgtgtgtgtgtgtgtgtgttttgatagtttgagatttaaaattacatagtagaactaataggccctttctgtctcataattatgtttgtcttgatacaaacccttaaacg

SEQ ID NO: 21577 - DNA, 167 bp, Homo sapiens
  DISD22_0009750
  Located on chromosome 15
  Distance between a terminus base of telomere on chromosomal short arm and 5'-terminus of this base sequence : 76791420
  Distance between 3'-terminus of neighbour sequence of sequence listing upward to telomere on chrosomal short arm and 5'-terminus of this base sequence : 160710
gaaggattgcactgtgctatagattaatttttttctttcctgttctttattttctttcccttgcctctcacctgggaagaaaccacaattcagtgtgtgtgtgtgtgtgtgtgtgtgtgtgtgtgtgtgtgtgtgtgtgtgtgaaaagtggaggataatcaggtgtg

SEQ ID NO: 21578 - DNA, 281 bp, Homo sapiens
  D15S969
  Located on chromosome 15
  Distance between a terminus base of telomere on chromosomal short arm and 5'-terminus of this base sequence : 77068225
  Distance between 3'-terminus of neighbour sequence of sequence listing upward to telomere on chrosomal short arm and 5'-terminus of this base sequence : 276638
ctatcttgttgaatcacacatcctaggttttgatttagaagatatggtcaccataggtgttacttgacttggccactaggaggaagagaagttgccaaaggaaattcttgcaaagaaagatttcattagtatcatattttctatttagttgttaaggggtgtgtgtgtgtgtgtgtgtgtgtgtcggcacacgtgcacatgtgtagtttctcaccctattaggtgattttatatcagaatggggtgagaaggaaggaggaggatgtacgtgaaaatctaga

SEQ ID NO: 21579 - DNA, 395 bp, Homo sapiens
  chr15.fa.O7frz.78337904
  Located on chromosome 15
  Distance between a terminus base of telomere on chromosomal short arm and 5'-terminus of this base sequence : 77241815
  Distance between 3'-terminus of neighbour sequence of sequence listing upward to telomere on chrosomal short arm and 5'-terminus of this base sequence : 173309
tatttgttcagatgtttcgaattttaatgtagtaagccacattaatcttttcttttataatttttgctttttgtgacttcttaaatcctttcctgtcctgatgtcaaatatactctcatctatctatctatctatctatctatctatctatctatctatctatcatctatctatctatctatctatctatttatctatctatctatattagaattctacaactttgtttttcacatttaggtttataatccatctgagatagtttttttcatgtggggggtttatatttatgtctccctatagggataaacaattgtctcatccctatttattgacgaatctgtcttctcccagggatttgtaatgccacttctagtttccatctacatgagttc

SEQ ID NO: 21580 - DNA, 313 bp, Homo sapiens
  chr15.fa.O7frz.78412018
  Located on chromosome 15
  Distance between a terminus base of telomere on chromosomal short arm and 5'-terminus of this base sequence : 77309953
  Distance between 3'-terminus of neighbour sequence of sequence listing upward to telomere on chrosomal short arm and 5'-terminus of this base sequence : 67743
tgctaacaagtctcttgtcaacacattctgttgatgctgtcctgggactctctttaaccagtaaaatcaggtgacgtttctagacctagcccttaagaggcctggcagctttctctgtcactattctgggatccagctccatataaataagctcagacaagatgattgaatgatgagagactgccgagagagagagagagagacagagagagagagagagagagaaagaggagggccagagagctccgacctattctagccactgcagctaaggcaccagatttagctactagctaagtgtaactgcatgagt

SEQ ID NO: 21581 - DNA, 217 bp, Homo sapiens
  chr15.fa.O7frz.78522604
  Located on chromosome 15
  Distance between a terminus base of telomere on chromosomal short arm and 5'-terminus of this base sequence : 77415247
  Distance between 3'-terminus of neighbour sequence of sequence listing upward to telomere on chrosomal short arm and 5'-terminus of this base sequence : 104981
aactctgtaagtatcagtcaccagatctatagaatgaaaataatattaactacattaaagagttactttaaagggttaaatgaaatctatataaaacaattttgcaatattttagacactttgtagatatagacatagtttgtatatatatatatatatatatatatatatatatatatatatgcacatatatatagacgttgacctaaatactcac

SEQ ID NO: 21582 - DNA, 347 bp, Homo sapiens
  AC027478.2_32706
  Located on chromosome 15
  Distance between a terminus base of telomere on chromosomal short arm and 5'-terminus of this base sequence : 77432515
  Distance between 3'-terminus of neighbour sequence of sequence listing upward to telomere on chrosomal short arm and 5'-terminus of this base sequence : 17051
agattcactaagacacaaggtcatagggagattatttctgcatcttttccagatccagcaatccattcatttttatctatctatctatctatctatctatctatctatctatctatctatctatctatcatctatctacctacctatcatctgtctaccatctctctctctctctctctttctctttccctccttttgtggggcaggtcaggctgttggactagctcaccacacgaaactctttgttcaatgaagaaaagttatttctcagttttagccaagctcctttccaattgagggctcttgtttatgttgtgtccctcttcttggaatgattaattgctcac

SEQ ID NO: 21583 - DNA, 199 bp, Homo sapiens
  DISO7_10004065
  Located on chromosome 15
  Distance between a terminus base of telomere on chromosomal short arm and 5'-terminus of this base sequence : 77575012
  Distance between 3'-terminus of neighbour sequence of sequence listing upward to telomere on chrosomal short arm and 5'-terminus of this base sequence : 142150
aatgttccctgcagttctgagcttcctatgatttgtgtgtgtgtgtgtgtgtgtgtgtgtgtgtgtggttaggagcatatattttagagttcaacagacctgattttaggtcctgcctgtgattagctgcttgacctcaggcaagttttctaccattttgagcctcagttaaaataatgatgatggttaccatagctgc

SEQ ID NO: 21584 - DNA, 229 bp, Homo sapiens
  D15S551
  Located on chromosome 15
  Distance between a terminus base of telomere on chromosomal short arm and 5'-terminus of this base sequence : 77656227
  Distance between 3'-terminus of neighbour sequence of sequence listing upward to telomere on chrosomal short arm and 5'-terminus of this base sequence : 81016
tgcacccagcctgctatgtctttaatattctggatgtcttgctgtgtgtgtgtgtgtgtgtgtgtgtgtgtgtgtgtgtgtccatcaacaattttcagtgaaaattgaaaaccagaattaaaattaaaaacggaaatctggaattaccacatgtgtgataatccaacaaagatggggtacatggaggaccagtgagaagggctgtatatgataggtgcaggaaactcca

SEQ ID NO: 21585 - DNA, 246 bp, Homo sapiens
  D15S1037
  Located on chromosome 15
  Distance between a terminus base of telomere on chromosomal short arm and 5'-terminus of this base sequence : 77708837
  Distance between 3'-terminus of neighbour sequence of sequence listing upward to telomere on chrosomal short arm and 5'-terminus of this base sequence : 52381
ctgctgaagtggtggcagccacactcagtgaagtaagaggcgcccctgcccagcggcctgaaagccacttctcctcagccagcaggaatcgcattccatagcacaggaagcctctgttcagaggaggtccagtcaggagtgaaggctgtggagtcaaggccgtgagtgtgtgtgtgtgtgtgtgtgtgtgtgtgtgtgtgtgtgtgtttaatttgtggcttcaacagaggccagacttaagaatga

SEQ ID NO: 21586 - DNA, 231 bp, Homo sapiens
  D15S211
  Located on chromosome 15
  Distance between a terminus base of telomere on chromosomal short arm and 5'-terminus of this base sequence : 77770281
  Distance between 3'-terminus of neighbour sequence of sequence listing upward to telomere on chrosomal short arm and 5'-terminus of this base sequence : 61198
aaaagccccaggtaggggtgtgtgtgtgtgtgtgtgtgtgtgtgtgtgtgtgtgtgtgtgtgtgtgtgtgtgtgtgtgtgtctgtgtgtgtgtctgtgtgtgtgtgtgtattttgtgtgtgtattttgtgtctgtctgttctggagaggctcacattcctcctattcatccccaagcccattctctggctctccatctccctgttgacaggatcaaggattccacctgctt

SEQ ID NO: 21587 - DNA, 146 bp, Homo sapiens
  Z66684
  Located on chromosome 15
  Distance between a terminus base of telomere on chromosomal short arm and 5'-terminus of this base sequence : 77827255
  Distance between 3'-terminus of neighbour sequence of sequence listing upward to telomere on chrosomal short arm and 5'-terminus of this base sequence : 56743
gaacttgcttaggctcccatgattggaagaaacttggcaatccccatccactgcaaaacacacacacacacacacacacacgaaattggctcatgcaattacagagaccaacaagtcctaagactggcagtctacaagcctgagac

SEQ ID NO: 21588 - DNA, 467 bp, Homo sapiens
  chr15.fa.O7frz.79091832
  Located on chromosome 15
  Distance between a terminus base of telomere on chromosomal short arm and 5'-terminus of this base sequence : 77972986
  Distance between 3'-terminus of neighbour sequence of sequence listing upward to telomere on chrosomal short arm and 5'-terminus of this base sequence : 145585
agaccaaatatcttagcctcactgaagggcagccgctggagaaagagaagaccgaggaagcacatgatgatgatgatgatgatggtgatgatgggcaacttttattgagcacttagtatgagcctggcactgctcacgtcaaatttatatgtattaactcattaactcatttacttgttgcagtaagtgaacaaaatagatagtattactgtagtgttgtgataaagactggttttcatctatgattcctggctcataactcccataacacaagttacaggcttttgttataatgctggatgtgtttggcctcaggaaacagaatctcctgccctcctttcacttgccccaaggcaggactctagtctttccccacccttctgattggagtctcaagatcctccccagggaggatcccaccctatatcctggagaaaggattggggaccttatgaaccttccataaa

SEQ ID NO: 21589 - DNA, 379 bp, Homo sapiens
  chr15.fa.O7frz.79219108
  Located on chromosome 15
  Distance between a terminus base of telomere on chromosomal short arm and 5'-terminus of this base sequence : 78021987
  Distance between 3'-terminus of neighbour sequence of sequence listing upward to telomere on chrosomal short arm and 5'-terminus of this base sequence : 48534
tgctcactagatgaagtagcacccctccactcatgacaacacaaagcgtctctaaacattgctaaatgtccctgggaggggtctgctatttaaggaccaatagtctagacctacttctagctgttttttatttgccatttataaaggatgctgtaaaatgggtatttatctctctctctctctctctctccttccttttctttctttcctttttttgtgtcctatagagattagaatatgtggtctctaacatgacttccagatatattaataatctgcttttagcatctgagctggactttgatggaaacttagaatattggcagggggagactggctctccaggatgcagccgctgtatggacctgtgtacagtgac

SEQ ID NO: 21590 - DNA, 241 bp, Homo sapiens
  DISO7_10004067
  Located on chromosome 15
  Distance between a terminus base of telomere on chromosomal short arm and 5'-terminus of this base sequence : 78275910
  Distance between 3'-terminus of neighbour sequence of sequence listing upward to telomere on chrosomal short arm and 5'-terminus of this base sequence : 253544
gattcttcacactaaccctgggtcgtagggttatagcccaaagcacgtgtgtgtgtgcatgtgtgtgagtgtgcgtgtgtgtgtgtgtgtgtgtgtgtgtgtgtgtgtgtgttctgtgtattttcctctctctttgacctcttcccccaccaccatccaaaataaaactaggagcaaaagtctattcacaggtacaattttcttaaaactggataagactagagataagaggaaagaggaa

SEQ ID NO: 21591 - DNA, 168 bp, Homo sapiens
  chr15.fa.O7frz.79578653
  Located on chromosome 15
  Distance between a terminus base of telomere on chromosomal short arm and 5'-terminus of this base sequence : 78486172
  Distance between 3'-terminus of neighbour sequence of sequence listing upward to telomere on chrosomal short arm and 5'-terminus of this base sequence : 210021
ttctatcaaagagtacaaccagaggaaacctatggctaaggagattcataacattcgtacatatatatatatatatatatttttttttcacgttctgaattcaatatcactttattggtaaaaaaatattgtgcctgaacaggaattaacctaccaatggaagttaga

SEQ ID NO: 21592 - DNA, 138 bp, Homo sapiens
  DISO7_10027495
  Located on chromosome 15
  Distance between a terminus base of telomere on chromosomal short arm and 5'-terminus of this base sequence : 78706626
  Distance between 3'-terminus of neighbour sequence of sequence listing upward to telomere on chrosomal short arm and 5'-terminus of this base sequence : 220286
cagttgtgagagcgttggctgaggtcatatatatatatacacacacacacacacacacacacacacacacttatattttaaagagttgaactaggttttctgtttatactgtaagtctcttgaagaatgtgtaaggac

SEQ ID NO: 21593 - DNA, 418 bp, Homo sapiens
  chr15.fa.O7frz.80346152
  Located on chromosome 15
  Distance between a terminus base of telomere on chromosomal short arm and 5'-terminus of this base sequence : 78930577
  Distance between 3'-terminus of neighbour sequence of sequence listing upward to telomere on chrosomal short arm and 5'-terminus of this base sequence : 223813
gtttatggagagcaaatgataacttggaaaaagacatacaatatgatgttaagcaaaataaacagaatgcccattatatgtagaatatcatgtccactattttaatgaagtacataaagtctagaaggatataataataataataataataataatagtaaatacaatattagtaatagctactacttcttgaacacttatcgtatgccttttctgtgttaggcagtttatatatacattatcctcacatcgaccctatgtggcaggcactgctatcatccccattttgtagatgagtcaactgtgtctcagggagggtatcttgtgcaaggccacacagttagtatattgttgaactgggatttgagccttaatcggtgtggcagctataagactgtgcttcacagatatccaacta

SEQ ID NO: 21594 - DNA, 287 bp, Homo sapiens
  chr15.fa.O7frz.79661880
  Located on chromosome 15
  Distance between a terminus base of telomere on chromosomal short arm and 5'-terminus of this base sequence : 79118282
  Distance between 3'-terminus of neighbour sequence of sequence listing upward to telomere on chrosomal short arm and 5'-terminus of this base sequence : 187287
tcaaagtaacagctggttctagcatttcttttgggaaggcaactgtgttcattaaggaaaataacttgatatgtattttgagttgaaggtgattgaggggcttgaatgagtcccaaactaccaaaggagaaataggtttgatgatccagagacaggaggagaaaggaagagagagacagagagagatagagagacagagactcagagagagagagagagagagagagagactcagaaagagagagagagagagagaaaggaaggtttagtaaagcatgaagaaactg

SEQ ID NO: 21595 - DNA, 275 bp, Homo sapiens
  D15S206
  Located on chromosome 15
  Distance between a terminus base of telomere on chromosomal short arm and 5'-terminus of this base sequence : 79163045
  Distance between 3'-terminus of neighbour sequence of sequence listing upward to telomere on chrosomal short arm and 5'-terminus of this base sequence : 44476
aacttttggtgctgagggccctcacttacaaaggcgtatttaagatttgggggactggagaataggactggggaggagccattaagatttattaattgtgctcttgctctctctctctctctctcacatacacacacacacacacacacacacacacacacacacacactcttaaactacttcacacaagttcctcattgcttgttgcagtgaggtcaggagatgaagcctcacgtattaataacatatttctggatatcaccagcaagtgccag

SEQ ID NO: 21596 - DNA, 222 bp, Homo sapiens
  Z24204.1_169
  Located on chromosome 15
  Distance between a terminus base of telomere on chromosomal short arm and 5'-terminus of this base sequence : 79163065
  Distance between 3'-terminus of neighbour sequence of sequence listing upward to telomere on chrosomal short arm and 5'-terminus of this base sequence : -255
ctcacttacaaaggcgtatttaagatttgggggactggagaataggactggggaggagccattaagatttattaattgtgctcttgctctctctctctctctctcacatacacacacacacacacacacacacacacacacacacacactcttaaactacttcacacaagttcctcattgcttgttgcagtgaggtcaggagatgaagcctcacgtattaat

SEQ ID NO: 21597 - DNA, 248 bp, Homo sapiens
  chr15.fa.O7frz.79953583
  Located on chromosome 15
  Distance between a terminus base of telomere on chromosomal short arm and 5'-terminus of this base sequence : 79189815
  Distance between 3'-terminus of neighbour sequence of sequence listing upward to telomere on chrosomal short arm and 5'-terminus of this base sequence : 26528
gtgaatcctgattggtctaatccaatcagggtcatcccatctccctaccacaggggttaaccaggtaattggcctaagccaattagtgccaggctatccccagcctcagcgactgatcttcataaccttggcgtaggccaatgtttcttttaaaacacacacacacacacacacacacaaacataaaggaaaagattggcaaattgagcttcattaaatgaagactgtctatttatcaagacaccatt

SEQ ID NO: 21598 - DNA, 190 bp, Homo sapiens
  D15S115
  Located on chromosome 15
  Distance between a terminus base of telomere on chromosomal short arm and 5'-terminus of this base sequence : 79367774
  Distance between 3'-terminus of neighbour sequence of sequence listing upward to telomere on chrosomal short arm and 5'-terminus of this base sequence : 177711
gcctggctgggtctctacatttaataagagtgtgtgtgtgtgtgtgtgtgtgtgtgtgtgtgtgtgtatacatattttcccaaaagtggtaagatttggaaagtgtaccatttgtgtaagttgaactttgccaggccacactgtcatggggaaacagaaggaatcccatccctttgcctcctacccatct

SEQ ID NO: 21599 - DNA, 124 bp, Homo sapiens
  DISO7_10004073
  Located on chromosome 15
  Distance between a terminus base of telomere on chromosomal short arm and 5'-terminus of this base sequence : 79661342
  Distance between 3'-terminus of neighbour sequence of sequence listing upward to telomere on chrosomal short arm and 5'-terminus of this base sequence : 293378
cctctggcagttactttgggtcaggaaaataaagtgtattcaggttatgtgtgtgtgtgtgtgtgtgtgcctgtgcggtgtgtgtgtgtaacttaaaacacatggaacagatagaactacatga

SEQ ID NO: 21600 - DNA, 255 bp, Homo sapiens
  G10085
  Located on chromosome 15
  Distance between a terminus base of telomere on chromosomal short arm and 5'-terminus of this base sequence : 79764023
  Distance between 3'-terminus of neighbour sequence of sequence listing upward to telomere on chrosomal short arm and 5'-terminus of this base sequence : 102557
atccttatttttagaagagtcatgctaaagtattaatacttagaagtaagtgttgtgatgtctgtaaattaacaagggtcagctagctagttggatggaggaattagatagatagatagatagatagatagatagatagatagatagatagagatagagtgatagggataatgaaccaatgtagcaaaatataagtaattagtgaatctagttgaaaaaatgtacagtagtgaattgtgttattttatcaacttt

SEQ ID NO: 21601 - DNA, 194 bp, Homo sapiens
  D15S200
  Located on chromosome 15
  Distance between a terminus base of telomere on chromosomal short arm and 5'-terminus of this base sequence : 80044087
  Distance between 3'-terminus of neighbour sequence of sequence listing upward to telomere on chrosomal short arm and 5'-terminus of this base sequence : 279809
gccctgctaagaacaaattgacattaccaataccaatcctgttatttttatgtgcttgtgtgtgtgtgtgtgtgtgtgtgtgtgtgtgtgtacagcctatattcttatacattacttattctgatccttaatgaaccctttatgttagataaggcttacattattatcccattttcagaggtttggagaggtac

SEQ ID NO: 21602 - DNA, 256 bp, Homo sapiens
  DISO7_12375112
  Located on chromosome 15
  Distance between a terminus base of telomere on chromosomal short arm and 5'-terminus of this base sequence : 80111766
  Distance between 3'-terminus of neighbour sequence of sequence listing upward to telomere on chrosomal short arm and 5'-terminus of this base sequence : 67485
cgaatggtttcaccattaatatagagaggccatggctggcctggtggctcatgcctgtaatctcagtgctttggaagacaaaggcgggaggatcgcttgacgccaggagttgagactgcagtgagcaatgatcaccactgcactctagaccgggtgacagagtgagaccctgtctctgtacgtacacacacacacacacacacacacacacacacacatacagagagagcaagagagagagaggcaagatggaagg

SEQ ID NO: 21603 - DNA, 408 bp, Homo sapiens
  chr15.fa.O7frz.81083930
  Located on chromosome 15
  Distance between a terminus base of telomere on chromosomal short arm and 5'-terminus of this base sequence : 80443379
  Distance between 3'-terminus of neighbour sequence of sequence listing upward to telomere on chrosomal short arm and 5'-terminus of this base sequence : 331357
gagacatgtcatttgagaattaagtatgaggaagaattatggctgagggtgtgggatgataggaggaaagccgttctgagcagaggaaacaggaaaacaggaggggagacatgaaattgatgtgtgtgtgtgtgtgtgtgtgtgtgtgtgtgtgtgtgttgatgacaagcaaatttgtttttcaacatcaacattgcaggctcttccagctatggcagagctcacgttgtaaaacctgttccccaccagcaccgctgggtctgttgcttctcaccacctctccccgcaaccccagcccccattttgctagagccagggtagacagatttcattcaacgtccacatttgtggtgaggtctcatcctgcttctcccacaaattggcccatagaaagcaactgcaattaga

SEQ ID NO: 21604 - DNA, 336 bp, Homo sapiens
  chr15.fa.O7frz.81251741
  Located on chromosome 15
  Distance between a terminus base of telomere on chromosomal short arm and 5'-terminus of this base sequence : 80609716
  Distance between 3'-terminus of neighbour sequence of sequence listing upward to telomere on chrosomal short arm and 5'-terminus of this base sequence : 165929
ctggagtacactatgaaatcagacagatacttcaccctcaaccagctgactcttgaatgggataaggaagtgttggccaacaataaaagtgtcaccactggctagaggtctctggttattcctagagaagaggcagccctagaaacctcttatccagtttaatggctctcacccacatacctgctgcatcccacatccccctccaacagtgggaaagatgggcagagagagagagagagagagagtgtgtgtgtgtgtgtgtgtgtagtgtgtgagagtgaagcctttgggcttggggacctggaggataaatgctttgaggataaatgtgaggtt

SEQ ID NO: 21605 - DNA, 157 bp, Homo sapiens
  G10265
  Located on chromosome 15
  Distance between a terminus base of telomere on chromosomal short arm and 5'-terminus of this base sequence : 80657124
  Distance between 3'-terminus of neighbour sequence of sequence listing upward to telomere on chrosomal short arm and 5'-terminus of this base sequence : 47072
ggacaaatgtatgcttgccactaagcattttggtcattgcaggtggcttatagagtaaatgggagggaaatatataaatctatctatctatctatctatctatctatctatctatctatctatctatctatcattagccctgtaatcagtgtgtcag

SEQ ID NO: 21606 - DNA, 448 bp, Homo sapiens
  chr15.fa.O7frz.81480962
  Located on chromosome 15
  Distance between a terminus base of telomere on chromosomal short arm and 5'-terminus of this base sequence : 80730310
  Distance between 3'-terminus of neighbour sequence of sequence listing upward to telomere on chrosomal short arm and 5'-terminus of this base sequence : 73029
gtgagtaaaatgtattggaaacacttgcctgacttaaatcagtgcctttccttctcctcagaacttttagggaagtaagaactactccaggatcttatatagcagcactgttccataaaaatgtaatgcaagccacatatataactgtacattttctagtagctgtattaaaataagctaaaaggggtgggttcagtggctcacacctgtaattccagtgctttgaggggctgaggtaggaggactacttgagttgaggagttcgagatgagtctgggcaacacagcaggaccctgtctctacaaacaaacaaacaaacaaacaaacaaacagttagctggcatagtggaggtcctgttgtcctggctacttaggaggctgaggtgggggagtcccttgagcccaggagtttgaagttgcagtgagctatgattgtaccactgcactt

SEQ ID NO: 21607 - DNA, 311 bp, Homo sapiens
  chr15.fa.O7frz.81390323
  Located on chromosome 15
  Distance between a terminus base of telomere on chromosomal short arm and 5'-terminus of this base sequence : 80791788
  Distance between 3'-terminus of neighbour sequence of sequence listing upward to telomere on chrosomal short arm and 5'-terminus of this base sequence : 61030
aatagctagatctacttccaggagtgacaagacttgaagaaattctaattaaatttttatttctgagtttgctttaagaaataaaataaattcttaggccgggcacggtagctcatgccagtaatctcagcactttgggaggccaaggtgggaggttcacctgaggtcaggagtttgagaccagcctggccaacatagtgaaaccctgtctctactaaaaacacacacacacacacacacaaattagctaggcatggcggcaggcgcctgtaatcgcagctactcaggaggttgaggtagaattgcttgaa

SEQ ID NO: 21608 - DNA, 435 bp, Homo sapiens
  AC068128.4_42329
  Located on chromosome 15
  Distance between a terminus base of telomere on chromosomal short arm and 5'-terminus of this base sequence : 81012251
  Distance between 3'-terminus of neighbour sequence of sequence listing upward to telomere on chrosomal short arm and 5'-terminus of this base sequence : 220152
catcttaccaatgatcttagctagatcttctgggtaacttgctgcagcttctccatcagcacttgctgcttcatcttgcacatttatgttacggagacagcttcttcccttaaacctcatgaaccaaaaaaaaagaaaagaaaagaaaagaaaagaaaaagaaaaacctcatgaaccaacctctgctagcttccaaattttcttgtgcagcttcctcacctctctcagccttctcagaagagtgttagggccttcctctggattaagttttggcataagggaatgttgtggctgatctgatcttctatctcgactactcaaactttcccatatcagcaaaaagcctgtcttgctttcttatcattcatgtgcttacctgagtagcccttttagtttactgcaggaacttgtgccttgcattcacaacttgactat

SEQ ID NO: 21609 - DNA, 413 bp, Homo sapiens
  chr15.fa.O7frz.83461214
  Located on chromosome 15
  Distance between a terminus base of telomere on chromosomal short arm and 5'-terminus of this base sequence : 81219514
  Distance between 3'-terminus of neighbour sequence of sequence listing upward to telomere on chrosomal short arm and 5'-terminus of this base sequence : 206828
tcaattgccatcaaatataaagcaggcagaaaaacatgaaaaggagagatggacctagcctcccagcctacatttctcccatgctggatgctctctgcccttgaacatcagactccaagttctccagttttgggactcagactggctctccttgctcctcagcttgcagacagcctattgtgggaccttgtgatcgtgtaagttattacttaataaactcccctttgtgtgtgtgtgtgtgtgtgtgtgtgtgtgtgtgtgtgtgtgtgtgtgtatcccattagttctgtccctgtaagagtctaatagactcactgagggaacccttctgtggctgatatcatagcccatgtgtctccataacacaacagtacaaggaccccaaacacaggttctctttgcaataagtttcc

SEQ ID NO: 21610 - DNA, 296 bp, Homo sapiens
  chr15.fa.O7frz.83767564
  Located on chromosome 15
  Distance between a terminus base of telomere on chromosomal short arm and 5'-terminus of this base sequence : 81355617
  Distance between 3'-terminus of neighbour sequence of sequence listing upward to telomere on chrosomal short arm and 5'-terminus of this base sequence : 135690
ctggctaacatggtgaaagcccgtctctaccaaaaatacaaaaaattagctgggtgtactggtgcccgccagtagtcctagctgctcaggaggctgaggaaggagaatcgcttgaacccgggaggcagaggttgcagtgagccaagattgcaccactgaactccagcctggcgacagagcgagactccgtctcaaaaacaacaaaaaacagcaacaacaacaacaacaacaacaaaaaagggaggccatgtcttattcatcatcacattaccagcaagtgtccagtgcagttccta

SEQ ID NO: 21611 - DNA, 159 bp, Homo sapiens
  chr15.fa.O7frz.82053974
  Located on chromosome 15
  Distance between a terminus base of telomere on chromosomal short arm and 5'-terminus of this base sequence : 81473794
  Distance between 3'-terminus of neighbour sequence of sequence listing upward to telomere on chrosomal short arm and 5'-terminus of this base sequence : 117881
gtttcctggtactgactacataagggtgagagagagagagagagagagagagagagagagagagtgtgtgtgtgtgtgtgtgtgtgtgtgtgtgtgtattttttttctaccttaactaatgctttggacatcaacaggtagagctaaatccttgaaacc

SEQ ID NO: 21612 - DNA, 405 bp, Homo sapiens
  AC068128.4_93170
  Located on chromosome 15
  Distance between a terminus base of telomere on chromosomal short arm and 5'-terminus of this base sequence : 81631912
  Distance between 3'-terminus of neighbour sequence of sequence listing upward to telomere on chrosomal short arm and 5'-terminus of this base sequence : 157959
gaagtgacatggtaacagctcactgcagcctcgatttcctgggctcacatgatcctgctgcctcagtctccctagtagctggaaccacaggcacacaccaccatgcctttttttttttttggtagaaatggggtctcccatgttgctcaggctggtctcaaacccctggggctcaagcaatcctcttgcctcagcctcccacagtgctgattgtaagcgtgagccactgtgcccagtctggcctctcctttatttatttatttatttagagacagtctcactctgttgcccaggctggagtgcagtggcatggtcttggctcaccgcaacctccacctcccgggttcaagagattctcctgcctgagcctcttgggtagctgggattagaggtgcctgcaactac

SEQ ID NO: 21613 - DNA, 136 bp, Homo sapiens
  DISD22_0009882
  Located on chromosome 15
  Distance between a terminus base of telomere on chromosomal short arm and 5'-terminus of this base sequence : 81718551
  Distance between 3'-terminus of neighbour sequence of sequence listing upward to telomere on chrosomal short arm and 5'-terminus of this base sequence : 86234
aactcagcagtgctgttcccttgggagacacacacacacacacacacacacacacacacacacacacacacacgagttggtggttttctgccccccacccccaccccaacacacacacgagttggtgggttgtgct

SEQ ID NO: 21614 - DNA, 227 bp, Homo sapiens
  DISD22_0009904
  Located on chromosome 15
  Distance between a terminus base of telomere on chromosomal short arm and 5'-terminus of this base sequence : 82032105
  Distance between 3'-terminus of neighbour sequence of sequence listing upward to telomere on chrosomal short arm and 5'-terminus of this base sequence : 313418
ctggttatgggacacgttactttcatactttgctgttcaataaatgtggggtggagaataaagtaaattgacagaattaccatataaaataaaattctaagtcctctgacaacaaaagaaacttataacacacacacacacacacacacacacacacacacacacacacacacagagttttccctgctaatcattttacatctaaacaaccaagtagctaacccaga

SEQ ID NO: 21615 - DNA, 394 bp, Homo sapiens
  chr15.fa.O7frz.83044178
  Located on chromosome 15
  Distance between a terminus base of telomere on chromosomal short arm and 5'-terminus of this base sequence : 82131961
  Distance between 3'-terminus of neighbour sequence of sequence listing upward to telomere on chrosomal short arm and 5'-terminus of this base sequence : 99629
taagagatttcctatgactgtcagtggctacttttgcttcacacacacacacacacacacacacacacacacacacgcaaaacagacaaacaaaaaaactagttgttagtatcagagcaaccttcttagctgaaggactgttcacaccaagcctttatatcccccaggggtactaagaaccagccaaggaaggcaaatttcagaagctttcccgacaaacacaattcagggataaggggttcaatgtgcaaagtcttttatttaaaattttagaagttaagacttacgaccacctcagtatatgccattcctaatagaaggaggtatgacggtttcaaactcgtgcagagctgcattttcatttacaagtctctgtaggcactttagaagtgaa

SEQ ID NO: 21616 - DNA, 470 bp, Homo sapiens
  chr15.fa.O7frz.82945889
  Located on chromosome 15
  Distance between a terminus base of telomere on chromosomal short arm and 5'-terminus of this base sequence : 82280195
  Distance between 3'-terminus of neighbour sequence of sequence listing upward to telomere on chrosomal short arm and 5'-terminus of this base sequence : 147840
ctaaacaaggctaggatgagtcagcccaccagggccctgtcaggcagaggtgatgctttcctggtggtcagaacttagtccaggtgagggagagtcatctgcgccagtgctcctgctggctgacctgtgatggaagcccttggggtcacagagaagacaggcaaggccctggggttcttccaactcacagtaggcttgtgggaagatagtgggcctccgctagctcctgtctcccccagggacccctctggccagagtgctactgtcttccttgaggcagcctactgtctccagcacaggggcttccctcctccactctcctcagctctgttgtagattctgtgttgtgtgtgtgtgtgtgtgtgtgtgtgtgtgtttgcatgtgggtgcacatgttcatattgggatggaaggaggaagcatcaacagtgggcaagttgcacaaagggattgagtcttctgaaacagga

SEQ ID NO: 21617 - DNA, 246 bp, Homo sapiens
  Z66702
  Located on chromosome 15
  Distance between a terminus base of telomere on chromosomal short arm and 5'-terminus of this base sequence : 82516637
  Distance between 3'-terminus of neighbour sequence of sequence listing upward to telomere on chrosomal short arm and 5'-terminus of this base sequence : 235972
acatcaatggcaagttctggcagtcaagtagccttgacagtcataaatacctcctaaatgaagaaggaaaaatcaggctccagaatcacaaataccctacacacacacacacacacacacttttttttttttacatgaaaccagtgctttttacccactgacacaaatgcaaatacagtcatgtaccacaaaatgactttccagtcaaccacgaaccgcatataagacagcagtcggtcacataag

SEQ ID NO: 21618 - DNA, 373 bp, Homo sapiens
  AC022221.5_64725
  Located on chromosome 15
  Distance between a terminus base of telomere on chromosomal short arm and 5'-terminus of this base sequence : 82711711
  Distance between 3'-terminus of neighbour sequence of sequence listing upward to telomere on chrosomal short arm and 5'-terminus of this base sequence : 194828
taatgagctaatgaaactcatttccagtaaattatgagtaattaataatattgctaagcattattgtgtattcactgtgtgccaggcactgtgcaaaatgctttagaaatgtattatctcacctaattgtcatatgttttaaaaaacatatgagatgggtacttttgtgattactcccatttgacaaatgagaaaactaaggctcagagaaataatttacctagggtcacgctattactgagtagtagtagtggtggtggtggtgatggtggtggtggtggtggtggtggcagtagtggtagtagtggtagtagtacctgaatctgaaccgaggtctggtaccatcgtccgtattcttaaccactgtacggtt

SEQ ID NO: 21619 - DNA, 171 bp, Homo sapiens
  D15S999
  Located on chromosome 15
  Distance between a terminus base of telomere on chromosomal short arm and 5'-terminus of this base sequence : 82721657
  Distance between 3'-terminus of neighbour sequence of sequence listing upward to telomere on chrosomal short arm and 5'-terminus of this base sequence : 9573
aggcggaggttacagtcagccaaagatcgcgccattgcacttcagcctgggtgacagagcaagactcacacacacacacacacacacacacacacacaaaaggagtgaaaaggattgaaagcaacaaaatagtatgtagtcatcttctcaaaggaaccaaagtaatgggct

SEQ ID NO: 21620 - DNA, 225 bp, Homo sapiens
  D15S972
  Located on chromosome 15
  Distance between a terminus base of telomere on chromosomal short arm and 5'-terminus of this base sequence : 82791433
  Distance between 3'-terminus of neighbour sequence of sequence listing upward to telomere on chrosomal short arm and 5'-terminus of this base sequence : 69605
caacagttctcaggatagattcagaattgctatgaccaccatggctggtccacagcaatgatgcctttatattccccatttcctccctttttgaacaggaatgtctatagtgattatcttttgcctgtttccccattgtacattgagtgtatgtgtatgtatgtgtgtgtgtgtgtgtgtgtgtgtgtgtgtgtagggggcacaatacttgcctatttcgcagac

SEQ ID NO: 21621 - DNA, 384 bp, Homo sapiens
  chr15.fa.O7frz.84371796
  Located on chromosome 15
  Distance between a terminus base of telomere on chromosomal short arm and 5'-terminus of this base sequence : 82878597
  Distance between 3'-terminus of neighbour sequence of sequence listing upward to telomere on chrosomal short arm and 5'-terminus of this base sequence : 86939
tttctattcaggaagttccttaaccctctctacgactcagtttcctcatttgtaaaagcatggggtccaggagccatggctcatgcctgtgatctttgggaggctgaggcaggagaatcgcttgaacccgcgggggcagaggttgatatgagctgagatcacactactactgcattccagcctgggagacagcgaggctctgtctcaaaaaataataataataataataataataataataataataataataaaagaagagcaccaaagagctagcccttttctctccatgcgaaggcactaaggctttgtagggacagagcaagaggcagccatttgcaagccaggaggagatactgaatcagctgaccagataccgaatca

SEQ ID NO: 21622 - DNA, 220 bp, Homo sapiens
  D15S201
  Located on chromosome 15
  Distance between a terminus base of telomere on chromosomal short arm and 5'-terminus of this base sequence : 82989283
  Distance between 3'-terminus of neighbour sequence of sequence listing upward to telomere on chrosomal short arm and 5'-terminus of this base sequence : 110302
taaaggccacagtaaacacacagacactcacacattatttgcacacaagagagatgtgtacactgcaggaaaatgagaaagttcaaataggagaaaaaaaaatgaaaaccacctatgttcactccctatactttaaaaactaccaattccaggtgtgtgtgtgtgtgtgtgtgtgtgtgtgtgtgtgtgtatgtatgtatgtgtatgcagttttacatca

SEQ ID NO: 21623 - DNA, 447 bp, Homo sapiens
  chr15.fa.O7frz.84638760
  Located on chromosome 15
  Distance between a terminus base of telomere on chromosomal short arm and 5'-terminus of this base sequence : 83145061
  Distance between 3'-terminus of neighbour sequence of sequence listing upward to telomere on chrosomal short arm and 5'-terminus of this base sequence : 155558
tcaatagtcgtgataagtggactgattggcccagcttaaatgatctgcccccccggacccatcaactggggccagtggggaggttaaaactataggaacatgatggaccccacaatggctaggtggtataaaaatggaagagcatatctcagaaaagtagtttgtgtgtgtgtgtgtgtgtgtgtgtgtgtgtgtatgtatttgcacgtttgtctgtatgtggaaactagtagataaaagttgtccagtatgactgtgcagactgcaagtatctcctggttgtggggtcctagtagctgcatagtttgccacacatcacttttaattctatccttgtggatggctccccacaagggacaaaagtagaaagattcgagtggtgcctgaagaaagccaaggaagaaaagaatttgtccataatctgttcttagcatcaaatctaaatgt

SEQ ID NO: 21624 - DNA, 338 bp, Homo sapiens
  chr15.fa.O7frz.84837732
  Located on chromosome 15
  Distance between a terminus base of telomere on chromosomal short arm and 5'-terminus of this base sequence : 83485120
  Distance between 3'-terminus of neighbour sequence of sequence listing upward to telomere on chrosomal short arm and 5'-terminus of this base sequence : 339612
taaattgattaccaggaattgtactctttttgctgctaagattagtgggatttaaacaaaatcatttctgaattttcattgctaatgtatagagatacaattgacgtttgtatgttaatctgttatcatggccaccttgcaaaacttgtttattagttttaatagtttttagtgactaagatttttctgtacccaagatcacgccatctgcaaatagacatagttttatttcttattttccaaactacatgccatttatttatttatttatttatttattcatttatgcttaagtgccctgactacaatctccagtataatgttaagcagaggtagca

SEQ ID NO: 21625 - DNA, 306 bp, Homo sapiens
  chr15.fa.O7frz.84943854
  Located on chromosome 15
  Distance between a terminus base of telomere on chromosomal short arm and 5'-terminus of this base sequence : 83711011
  Distance between 3'-terminus of neighbour sequence of sequence listing upward to telomere on chrosomal short arm and 5'-terminus of this base sequence : 225553
cgatcaagaatctgttatcaagggctaaattgacatgtgtgattgtcctatcaccaccatgggatggagaataataataataataataataataataacagttaatggaagttaaccagtttattccaggcaatgtgcctaccatttcatagccacaatctcatttattcctcataaccatcctatgaggttgattttcttactagacaaggaaatgagtccagtagttagccccaagacacatattcgtgaatgatatcattgaagctttaacccaaggtagagtatgtacctactgtgcctttg

SEQ ID NO: 21626 - DNA, 316 bp, Homo sapiens
  chr15.fa.O7frz.85399591
  Located on chromosome 15
  Distance between a terminus base of telomere on chromosomal short arm and 5'-terminus of this base sequence : 84104363
  Distance between 3'-terminus of neighbour sequence of sequence listing upward to telomere on chrosomal short arm and 5'-terminus of this base sequence : 393046
ggatacctatcagaatggctactttttttttaagtgatagcactaaatattgatgagaatgtagagaacctggatcactcattcattcctggtagaaatgtgacagatgatagatggatggatagatagatagatagatagatagatagatagatagatagatagatagacagatgagataaattatagatacacatgcagttgtaagaaataatacagagagattccaggtacctttcattgagttcccttcagcagtaacttcttgcaaaaaaaaaatattacaatcagaatatttcacactgatgtaatccac

SEQ ID NO: 21627 - DNA, 381 bp, Homo sapiens
  chr15.fa.O7frz.85276570
  Located on chromosome 15
  Distance between a terminus base of telomere on chromosomal short arm and 5'-terminus of this base sequence : 84107270
  Distance between 3'-terminus of neighbour sequence of sequence listing upward to telomere on chrosomal short arm and 5'-terminus of this base sequence : 2591
ccagtgaaattagttacagacatcttgtcttcagaaatataacagaatacatttgtattgttttaagaaaccaaatttgtggtaatttgttgcaatagccataagaaaggaatatgccattagtatcagcaaaaaggattaacacagtgcaaattactcactgcctgcaccaaggctgtgataaagtttaaaattacatatacagtcatatataattcatatggtcataaagttcaaaagtatatatatatatatatatatatatatactgtgtatttatatggtataataaatattatatatatagtatgtatataattgaatatattattgtccttaaattgatgacatgatgttgactggacctagtgagtaggaaat

SEQ ID NO: 21628 - DNA, 469 bp, Homo sapiens
  chr15.fa.O7frz.85497913
  Located on chromosome 15
  Distance between a terminus base of telomere on chromosomal short arm and 5'-terminus of this base sequence : 84210118
  Distance between 3'-terminus of neighbour sequence of sequence listing upward to telomere on chrosomal short arm and 5'-terminus of this base sequence : 102467
tttggtaacaataggaatctacataaaaaaaattacattatttcactgaaaaattacagcaacaaaatgaatagtggtgcttttgctgctgctgctgctgctgctgctgctgctgctgctgctgctgctgctggttgttgtattgatcaattccatgctaacaaatctttttcatttgatacgtttctgaaattttaaggtatgtgtgtggtgtgaggtggaggggggaccttgggtagaaatactctgaattctattttcctagagttatttgcttcttaaaacaagccagtgccatcatttataactataaccctgaaggcatcatggttgcctaaatatataagcaaaatgaaatgtacaatttgcagaatctttatttgaatactttaaaattcttgaatggtttaggggaagacatgcaagcagtaaaaaaaaatcaagtgtgatgctatctagcaatgtttat

SEQ ID NO: 21629 - DNA, 225 bp, Homo sapiens
  D15S1030
  Located on chromosome 15
  Distance between a terminus base of telomere on chromosomal short arm and 5'-terminus of this base sequence : 84290663
  Distance between 3'-terminus of neighbour sequence of sequence listing upward to telomere on chrosomal short arm and 5'-terminus of this base sequence : 80076
tataaaaggcccaacagaggctactatgtccaatttttaatagagataactatttagaaatataaatgctgagaaggagaataggctcaggtatgctctgctaaatcaaggtgacccttcatgttagtttcttctagtacttttctttgtatatacaaatttatacacacacacacacacacacacacacacacacacacgcttgcatatctgctcattattcag

SEQ ID NO: 21630 - DNA, 257 bp, Homo sapiens
  D15S151
  Located on chromosome 15
  Distance between a terminus base of telomere on chromosomal short arm and 5'-terminus of this base sequence : 84362086
  Distance between 3'-terminus of neighbour sequence of sequence listing upward to telomere on chrosomal short arm and 5'-terminus of this base sequence : 71198
aattcttcacaggtaatggcaattttacctaaatcaaaaggagaaaactgaaagaaaatctattataaataatgataattttataattgggttacatacatagtaaatatttaaaactaactagtttttctgtatagcaacaataacacgtcagatcatttggcacttaaagaaaaccaacagcacgcatgtgcatacacacacacacacacacacacacacacatacacaagaccattagaagtcagcagaacatc

SEQ ID NO: 21631 - DNA, 473 bp, Homo sapiens
  AC011629.5_96895
  Located on chromosome 15
  Distance between a terminus base of telomere on chromosomal short arm and 5'-terminus of this base sequence : 84393141
  Distance between 3'-terminus of neighbour sequence of sequence listing upward to telomere on chrosomal short arm and 5'-terminus of this base sequence : 30798
ggattctagactgaggcttagtactccatagatttgtgagagaagccctggtccttatctcctgggttgcttcaggtttccaggagctcttaataggaagggagagttcttggtgtccccaggtacacaagggcagtaggatgctctgaaattccaaaaagagaaaaatgataaaatggatgaggtattagtcagagttctctagagaaatagaaccaatagaatagctacctatctatctatctatccatccgtattctctccctcatctatctatccatccatcttctctctctcatctatctatccatccatccatccatcttctctctctcatctatctatctatctatctatctatctatctatctatctatctatctatctatctatctttctctccctcttatatatatataagagagaattctcagtccaagtttacagacccaagaattaggagctttgatgtc

SEQ ID NO: 21632 - DNA, 449 bp, Homo sapiens
  chr15.fa.O7frz.85806046
  Located on chromosome 15
  Distance between a terminus base of telomere on chromosomal short arm and 5'-terminus of this base sequence : 84447443
  Distance between 3'-terminus of neighbour sequence of sequence listing upward to telomere on chrosomal short arm and 5'-terminus of this base sequence : 53829
gattatggaaactggtgaagtaaactatgatatcttccccaaatggaattgtaagcaactaaacaacaacaaaaagaatatgcatatatatgtatgcatctctctctctctctctctctctctctctctctctctctatatatatatatatatatatatatatataaatatacacatacagagagagaaagagatttaaaacaattgcaattggatcatgtgattgtggggtctggcaagtttgaagtctgcagggcaggctggcaggctggagacccaggcaaaagtatgtgttatagtcttgagttgaaggcaacctggtggcagaattccttcctctttgtagggtggatatgtggagctcagtcttttctctgaagccactgaactgattggatgataacaaccagcattatggtgggtaatgagctttactcaaagtctacttg

SEQ ID NO: 21633 - DNA, 163 bp, Homo sapiens
  DISD22_0009930
  Located on chromosome 15
  Distance between a terminus base of telomere on chromosomal short arm and 5'-terminus of this base sequence : 84785689
  Distance between 3'-terminus of neighbour sequence of sequence listing upward to telomere on chrosomal short arm and 5'-terminus of this base sequence : 337797
tcgtaattggccacactccattgtttcatatatatatacacacacacatatatatatacacgtgtgtgtatatatatatatatacacacacacacacacatatacacatacacacacacacacacacacataatcttgaaatggtgtgatttagattctgcct

SEQ ID NO: 21634 - DNA, 146 bp, Homo sapiens
  D15S1046
  Located on chromosome 15
  Distance between a terminus base of telomere on chromosomal short arm and 5'-terminus of this base sequence : 84927120
  Distance between 3'-terminus of neighbour sequence of sequence listing upward to telomere on chrosomal short arm and 5'-terminus of this base sequence : 141268
cccttttaacacacagggttaaaagtatttccattggtagttttaaagaggtgtgtgtgtgtgtgtgtgtgtgtgtgtgagagagagagagagagagagagattgagagagagagagagattgagattgaggccaactttagtgtg

SEQ ID NO: 21635 - DNA, 368 bp, Homo sapiens
  chr15.fa.O7frz.86825432
  Located on chromosome 15
  Distance between a terminus base of telomere on chromosomal short arm and 5'-terminus of this base sequence : 85094394
  Distance between 3'-terminus of neighbour sequence of sequence listing upward to telomere on chrosomal short arm and 5'-terminus of this base sequence : 167128
ttctgttaagaccaatagcaacctcagcccagaacctctgtttactggggccaccaaactacaaggaggcagtgttcaggtgcatgcatggtgtgtgtgtgtgtgtgtgtgtgtgtgtgtgtgtgtgtgtgtgtgtgttcctaacccttcctcccctgcgaaaacagtaacaatttcttaaacaccataacaaatgggttctagtatatatactttcattattttaaaagattgttaaaatattttgttctactttgggaaatgtggtcaggccccactgagcttgtgaatcatgagatagtacacgttttaaaaaataatttcttttcagtctttgtaattcacttaatcaagtggtcaagacatag

SEQ ID NO: 21636 - DNA, 440 bp, Homo sapiens
  chr15.fa.O7frz.86398729
  Located on chromosome 15
  Distance between a terminus base of telomere on chromosomal short arm and 5'-terminus of this base sequence : 85458880
  Distance between 3'-terminus of neighbour sequence of sequence listing upward to telomere on chrosomal short arm and 5'-terminus of this base sequence : 364118
ggagcaaagctgatattaaataacttcctgagcctggcccgtctgccaacgctccctcctggatctcaggtggagaaatgaagaggctgcaaggatgagagccagggtcaccccaaaccagcctcagagctactcctctgctgagaggaggctggagtttcttcaccagtaaagcccaaagcttagcagtgacccctacccctgcttctcacttgatcccatcccccatagcatgcacacacacacacacacacacacacacacacacacacacactgagcaaaaggtattcaatcatgtctgacactcaaatttaagctaaaagaggcttttttgtcaaccagaccaacccctacatttcccaggtaaacaaactgaggttcagagatctggagtctcttggctaaggccaaccagatagactgtatgaaagcatgtca

SEQ ID NO: 21637 - DNA, 165 bp, Homo sapiens
  D15S979
  Located on chromosome 15
  Distance between a terminus base of telomere on chromosomal short arm and 5'-terminus of this base sequence : 85504819
  Distance between 3'-terminus of neighbour sequence of sequence listing upward to telomere on chrosomal short arm and 5'-terminus of this base sequence : 45499
cagtgctacatccacggaagagcatcctggggaagggagggcctcacagcagatggtgtgggaaacagtgtgtgtgtgtgtgtgtgtgtgtgtgtgtgtgtgtgtgtgtgtgtgtgtgtgtgtgtgcgtgcatgcaagtgcatgtacccaggatgttgggcagca

SEQ ID NO: 21638 - DNA, 104 bp, Homo sapiens
  DISD22_0009938
  Located on chromosome 15
  Distance between a terminus base of telomere on chromosomal short arm and 5'-terminus of this base sequence : 85693269
  Distance between 3'-terminus of neighbour sequence of sequence listing upward to telomere on chrosomal short arm and 5'-terminus of this base sequence : 188285
ggagattctccaagaaacttgaataagagaaagagagagagagagagagagagcggtctgccagaaaccaaggctcagctccccagcatcctgggtcttcagct

SEQ ID NO: 21639 - DNA, 446 bp, Homo sapiens
  AC013489.3_135175
  Located on chromosome 15
  Distance between a terminus base of telomere on chromosomal short arm and 5'-terminus of this base sequence : 85833469
  Distance between 3'-terminus of neighbour sequence of sequence listing upward to telomere on chrosomal short arm and 5'-terminus of this base sequence : 140096
ggcaggaatacaattagaattagtgatcagaaaaagcatttcccagccttttatttatttatttatttatttatttatttatttatttatttatttttgagacagagtctcactctgtcccaggctggagtgcagtggtacagtcctgactcactgcaacctccacctcctgggttcaagtgattcttgtgcctcagcctcccgactagctgggattacaggtgaatgccaccaactcagctaattttttgtatttttggtagagagaggggtttgctatgttggtcaggctggtctcgaactcgtgacgtcaggggatctgcccacctcggtctcccaaagtgctgggagtataggcatcagccaccttgcctggcctcccagcctttctgcctgggatccctctgcctggggggtaccttgccctaaggtgagcaccaagttac

SEQ ID NO: 21640 - DNA, 463 bp, Homo sapiens
  AC068969.2_34710
  Located on chromosome 15
  Distance between a terminus base of telomere on chromosomal short arm and 5'-terminus of this base sequence : 86207603
  Distance between 3'-terminus of neighbour sequence of sequence listing upward to telomere on chrosomal short arm and 5'-terminus of this base sequence : 373688
gatcagactcacatcttaagacacttccctgcaggggctgagtggaaggtagacctgggggcagcaagaccagaatgacagcaggcagctgcaaacataactatgattatcatgtagcaacgtggaagaatgcttagggtgtaagttaaaatagacaaagcagaacatacaattgcctctgctatgattgcaaccatgtggtcttgtgaatgcctgtgtacaggacccagaagatgaggaaacacttaaagaggaagggagggaggacagaagggagaaaggaaggaaggaaagaaggaagggagggagggagggagggagggaggaaggggaggaaggaaggaaaggaaggaaggaaggaaagggaaggagggaggaaaggaggcaggcagacacacacagcattggcttgttagagtgatgggattgtggaggaaacattcttgtttccagaacagttagg

SEQ ID NO: 21641 - DNA, 376 bp, Homo sapiens
  AC067805.2_163149
  Located on chromosome 15
  Distance between a terminus base of telomere on chromosomal short arm and 5'-terminus of this base sequence : 86207690
  Distance between 3'-terminus of neighbour sequence of sequence listing upward to telomere on chrosomal short arm and 5'-terminus of this base sequence : -376
gctgcaaacataactatgattatcatgtagcaacgtggaagaatgcttagggtgtaagttaaaatagacaaagcagaacatacaattgcctctgctatgattgcaaccatgtggtcttgtgaatgcctgtgtacaggacccagaagatgaggaaacacttaaagaggaagggagggaggacagaagggagaaaggaaggaaggaaagaaggaagggagggagggagggagggagggaggaaggggaggaaggaaggaaaggaaggaaggaaggaaagggaaggagggaggaaaggaggcaggcagacacacacagcattggcttgttagagtgatgggattgtggaggaaacattcttgtttccagaacagttagg

SEQ ID NO: 21642 - DNA, 218 bp, Homo sapiens
  D15S1045
  Located on chromosome 15
  Distance between a terminus base of telomere on chromosomal short arm and 5'-terminus of this base sequence : 86381813
  Distance between 3'-terminus of neighbour sequence of sequence listing upward to telomere on chrosomal short arm and 5'-terminus of this base sequence : 173747
agcaggcaggctaatcttagaatttcatggtggccaaagcagtactgtttgatgtaaatgcctcctaatccctaattcaatatgactgctgtctttattaaaaaggagggtttggacccagagacagacagacagacagacagacagacagacagacagacacacacacacacacacacacgacacacacacaaggagaaagccatgtgaagatgagg

SEQ ID NO: 21643 - DNA, 102 bp, Homo sapiens
  DISO7_10004090
  Located on chromosome 15
  Distance between a terminus base of telomere on chromosomal short arm and 5'-terminus of this base sequence : 86478576
  Distance between 3'-terminus of neighbour sequence of sequence listing upward to telomere on chrosomal short arm and 5'-terminus of this base sequence : 96545
tcttacattgaactgagaaagtcccaagtgattgtgaggcaattgatccctaacacacacacacacacacacacacacactcacactgagaattactgcacc

SEQ ID NO: 21644 - DNA, 111 bp, Homo sapiens
  DISD22_0009969
  Located on chromosome 15
  Distance between a terminus base of telomere on chromosomal short arm and 5'-terminus of this base sequence : 86744675
  Distance between 3'-terminus of neighbour sequence of sequence listing upward to telomere on chrosomal short arm and 5'-terminus of this base sequence : 265997
ttaggcaaagcttctcctgggctgcagagggagagagagagagagagagagagagagagagagagagagagagagagagagagaacgagagaagaaggaggattacggcaa

SEQ ID NO: 21645 - DNA, 178 bp, Homo sapiens
  D15S116
  Located on chromosome 15
  Distance between a terminus base of telomere on chromosomal short arm and 5'-terminus of this base sequence : 86908881
  Distance between 3'-terminus of neighbour sequence of sequence listing upward to telomere on chrosomal short arm and 5'-terminus of this base sequence : 164095
agcttccaactccgccctccccgcccccttgcaattcacacacacacacacacacacacacacacacacacacacacacacacacacacaccgctgcatgcctcttaccagtgcaggggggaggggaaggagggatctgaaatgcaacctattcatgtacccgcgatgtaacacccct

SEQ ID NO: 21646 - DNA, 239 bp, Homo sapiens
  chr15.fa.O7frz.87332919
  Located on chromosome 15
  Distance between a terminus base of telomere on chromosomal short arm and 5'-terminus of this base sequence : 86930694
  Distance between 3'-terminus of neighbour sequence of sequence listing upward to telomere on chrosomal short arm and 5'-terminus of this base sequence : 21635
gctataatcacttgttagttccaggagttttttgtttgtttgtttgtttgttttttttagtagagatggggtttcaccgtgttagccaggatggtctcgatctcctgacctcgtgatctgcccacctcagcctcccaaagtgctgggattacaggcgtgagccaccacacccggcccagttccaggagttttgttgtttgttctttcagattttctaatcatgtcatatcaccaaagac

SEQ ID NO: 21647 - DNA, 466 bp, Homo sapiens
  chr15.fa.O7frz.88213489
  Located on chromosome 15
  Distance between a terminus base of telomere on chromosomal short arm and 5'-terminus of this base sequence : 87131799
  Distance between 3'-terminus of neighbour sequence of sequence listing upward to telomere on chrosomal short arm and 5'-terminus of this base sequence : 200866
cttaactggcctggttctcagcaataccagctttcttcatggtatgaaattgcagggattcccacttcaccttctccttccaagccgtcaccagatgacatcccttctttctgtattttcttcaggtccacctctttctttgcttttctttccattacccgaatccagtctttctcccaacttccttcacccagtctaatcttctgtaggaaacatttcttccatcttcccttcaatctacattctttcctctggcctccaagatctctggaatgtggatcctctcagccctcaggctgtctctgctctgggacacagaccccttggcacatgagacttgtcttcctctgttttctacacacacacacacacacacacacacacgcacacaccaagtcccacctctctgccgttgtccatgccactgccccaccctgtagtgccctcattcctacttagcaagctt

SEQ ID NO: 21648 - DNA, 251 bp, Homo sapiens
  HUMUT479
  Located on chromosome 15
  Distance between a terminus base of telomere on chromosomal short arm and 5'-terminus of this base sequence : 87437273
  Distance between 3'-terminus of neighbour sequence of sequence listing upward to telomere on chrosomal short arm and 5'-terminus of this base sequence : 305008
accagcctgcgtgacagagtgagaccctgtctcaaaaaaagaaagaacaaaagaaagaaagaatgaaggaaagaaggaaggaaggaaggagagtgagaaagaaagaaagaaagaaagaaagaaagaaaggaaggaagaaagagaaagaaagaaagaaagaaagaaagggagagaagaaaggcatttggatttacgtatttaatttatgaacattcatttattacaagtcaacttggaaccatgtagacagt

SEQ ID NO: 21649 - DNA, 246 bp, Homo sapiens
  HUMUT942
  Located on chromosome 15
  Distance between a terminus base of telomere on chromosomal short arm and 5'-terminus of this base sequence : 87437278
  Distance between 3'-terminus of neighbour sequence of sequence listing upward to telomere on chrosomal short arm and 5'-terminus of this base sequence : -246
cctgcgtgacagagtgagaccctgtctcaaaaaaagaaagaacaaaagaaagaaagaatgaaggaaagaaggaaggaaggaaggagagtgagaaagaaagaaagaaagaaagaaagaaagaaaggaaggaagaaagagaaagaaagaaagaaagaaagaaagggagagaagaaaggcatttggatttacgtatttaatttatgaacattcatttattacaagtcaacttggaaccatgtagacagt

SEQ ID NO: 21650 - DNA, 469 bp, Homo sapiens
  AC027638.5_172390
  Located on chromosome 15
  Distance between a terminus base of telomere on chromosomal short arm and 5'-terminus of this base sequence : 87491540
  Distance between 3'-terminus of neighbour sequence of sequence listing upward to telomere on chrosomal short arm and 5'-terminus of this base sequence : 54016
gcgtcaactcttgctaattaacttcgaggccgggcacggtggctcacacctataatcccagcacttcgggaggccaagctgggtggatcacttgagcccaggagtttgagaccagcctgggtaacacggtgaaacaccatgtctactaaaaaatccaaaaatgagccaggcgtggtggcgcgctcctgtagtcccagctactcgggtggctgaggcacgagaatcgcttgaagccagaaggtggaggttgcagtgagctgagatcatgccactgcactccagcctgggttacagagcaagactaaataataataataataataataataataataataatttggagaatcagaatcacttaagaagcctctagaaaatcccatgtccaggccctgaacccagagattctggtttaactggtctagagtgagaccccggtattggcattctgatcaaacgataccagttc

SEQ ID NO: 21651 - DNA, 256 bp, Homo sapiens
  HUMUT478B
  Located on chromosome 15
  Distance between a terminus base of telomere on chromosomal short arm and 5'-terminus of this base sequence : 87628037
  Distance between 3'-terminus of neighbour sequence of sequence listing upward to telomere on chrosomal short arm and 5'-terminus of this base sequence : 136028
gggcaacacagagagactccatcgaaagaaagagagagagaggtagagagaaagaaggaagaaaggaagggaaggaaagggagaaagaaagaaggaaggaaggaaggaaggaaggaaggaaggaaagaaagaaagaaagaaagaaagaaagaaagaaagaaagaaagaaagaaagaaagaaagaaaaaggaaggagacagaggcacagagagagggtaagaaacttgcccaaggtcacatatctgggaagtggaaa

SEQ ID NO: 21652 - DNA, 419 bp, Homo sapiens
  AC027478.2_220179
  Located on chromosome 15
  Distance between a terminus base of telomere on chromosomal short arm and 5'-terminus of this base sequence : 87659649
  Distance between 3'-terminus of neighbour sequence of sequence listing upward to telomere on chrosomal short arm and 5'-terminus of this base sequence : 31356
taggctaccaactgttatttgtgtctcccctcctttctctgacatgcgcctatcgggagagcttatctaccaaacaaaggagtatgttagaccctaaattttacctgttcactggtggctggtgtttctaggatttcagtcaaggtctctcctggctggaaccggatgacatccacaattaaacgttttgtactgaaacgagatgggggaggcatttaaatattaccagtgttctagttcctctcaagtggaccgaagcagcagcagcagcagcagcacaaacagtacctcacagaagtcccaagcggcagctgccagtacacagtactcaaggcacaaggcttatttacccagccattccataagtaggtacgagggttaggatttccaagatttacatttcactgtagcatattagc

SEQ ID NO: 21653 - DNA, 196 bp, Homo sapiens
  D15S996
  Located on chromosome 15
  Distance between a terminus base of telomere on chromosomal short arm and 5'-terminus of this base sequence : 87702948
  Distance between 3'-terminus of neighbour sequence of sequence listing upward to telomere on chrosomal short arm and 5'-terminus of this base sequence : 42880
gaaggatggtttgagcccaagagtttgaggctgcagtaaaccataatcgcaactgcagcctaaacaacaaagtgtaactctgtctcttaaagaaaaaaaaaaatatatatatacacacacacacacacacacacacacacacacacacagttttgaaggacatacaaaaaaatgccagtaatgattattcctaagt

SEQ ID NO: 21654 - DNA, 467 bp, Homo sapiens
  chr15.fa.O7frz.89784541
  Located on chromosome 15
  Distance between a terminus base of telomere on chromosomal short arm and 5'-terminus of this base sequence : 88029027
  Distance between 3'-terminus of neighbour sequence of sequence listing upward to telomere on chrosomal short arm and 5'-terminus of this base sequence : 325883
tgaactttagaatcaacttgtctagtgccagaactctgttgatatttatattgagattgcattaaatttatatattaacttaggtatatgtattaacttaaatatatatatatatatatatatatatatatatatatatatatatatatattaacttaggcacttttatgatgttgttgtcctgtcctagaacaaaagatttcatttgtttaaggctatttttgttattcagaagtgttttaaagatttcttcacctaggttttacatgtttttaaattcctaaatattttctctttttcttgttgctgtaaatgggattttacccttcattatatattcaaacttgttgtgtatatgaagactactgatttttgcatattcttataaaattccttttctgtttagttagtttcattattgattttctgcagtattccagacacactaccatatcacctgcaagtag

SEQ ID NO: 21655 - DNA, 453 bp, Homo sapiens
  chr15.fa.O7frz.89713056
  Located on chromosome 15
  Distance between a terminus base of telomere on chromosomal short arm and 5'-terminus of this base sequence : 88100579
  Distance between 3'-terminus of neighbour sequence of sequence listing upward to telomere on chrosomal short arm and 5'-terminus of this base sequence : 71085
agacaagctctttgtccttaaggattttacaatggggtgtgtgtgtgtgtgtgtgtgtgtgtgtgtgtgtgtgtggtgtgagtgagagagagaacaagtttttgattattgatttccttccacctgatttattttatccagaaacttaaagtgtttttccctcatactatatcttcacactttatcctaaatgcctggcattttcccttgttttcttttcatctctccattaatttccctcacttgccacataggtttctcttgttgatcttctgcttaataatccaatttcctgtaagcctatttatttccgcttccagggacaatctgatatgatgaagcacccagttccccctgcactgtccctgtctaatctccctcagaataggtaatagctgttttctaaaatctccttacatttcatatgagagatctatttcaggaaataggatt

SEQ ID NO: 21656 - DNA, 316 bp, Homo sapiens
  AC027478.2_187215
  Located on chromosome 15
  Distance between a terminus base of telomere on chromosomal short arm and 5'-terminus of this base sequence : 88221777
  Distance between 3'-terminus of neighbour sequence of sequence listing upward to telomere on chrosomal short arm and 5'-terminus of this base sequence : 120745
gaaaccaaagtccagattttactataaaatcccaatattcattgttagtcctaattaaaaccaaccaaccaaccaaccaaccaactaaccacattttgggccaaaaccaaaaacatgttagagggcaaaatacagaatttaagccaccagtttacaatatctgttccatcaattcttcctaggcagccaaatctacttctgtggctacataacaaaaattcccccatttttctcagtagctcagccttccttctcgagctgcaaaaccatctaaacagctgcctgctggaccatctctacttatgtgcctcacagg

SEQ ID NO: 21657 - DNA, 130 bp, Homo sapiens
  D15S127
  Located on chromosome 15
  Distance between a terminus base of telomere on chromosomal short arm and 5'-terminus of this base sequence : 88343976
  Distance between 3'-terminus of neighbour sequence of sequence listing upward to telomere on chrosomal short arm and 5'-terminus of this base sequence : 121883
ccaaccacactgggaatcccctccatgaacgggaggagcctctatcacacacacacacacacacacacacacacacacacacacacacacggagaccacagagagaacatgggcaccgtgggcaactgtt

SEQ ID NO: 21658 - DNA, 271 bp, Homo sapiens
  D15S963
  Located on chromosome 15
  Distance between a terminus base of telomere on chromosomal short arm and 5'-terminus of this base sequence : 88525397
  Distance between 3'-terminus of neighbour sequence of sequence listing upward to telomere on chrosomal short arm and 5'-terminus of this base sequence : 181291
gcaacttcttgtaagtagcctagcgtgagtagagcatagttcatgtaggggaatctggtgagggttcaggctagaaggtaggacagaagccagatcataaacatgtgtgtgtgtgtgtgtgtgtgtgtgtgtgtgaaaacgtagatgtatggatgcatgcacgtgtgattgtgtgtgtgcacatgggtgtttgcatgtatgtgtatgggcccataaactgaaagcagggagagggaaaagagacttagaggagtgctccagagatttgctg

SEQ ID NO: 21659 - DNA, 438 bp, Homo sapiens
  AC002426.1_9650
  Located on chromosome 15
  Distance between a terminus base of telomere on chromosomal short arm and 5'-terminus of this base sequence : 88527683
  Distance between 3'-terminus of neighbour sequence of sequence listing upward to telomere on chrosomal short arm and 5'-terminus of this base sequence : 2015
tgaagcagataaggaactagttagaaagccagaaattcaatcttccctcaatttcactcaacaagctcggtggcatattagggaaatgatcccttaatatactgagatttttgaggaaattgaaaaccaggattgctacttgcagagcaaaggaggaagaggagaagaaggaggaggaggaggaggaggaggaggaggaggaggttgaaaggaggagcgatgtggtggagtggaaaagacttttaattggtggtaacacaacaaaggaaatagaatacccctccttggaagagggaggagcctgcagtgacaggcaccatgcaagaaagagcccagttctgagactgagacatctgggccatggtcctggctccatgactaccacagcatgcctgtgggcagcccattcagcctctctgaccactattacatctttgt

SEQ ID NO: 21660 - DNA, 205 bp, Homo sapiens
  AC002426.1_34672
  Located on chromosome 15
  Distance between a terminus base of telomere on chromosomal short arm and 5'-terminus of this base sequence : 88552733
  Distance between 3'-terminus of neighbour sequence of sequence listing upward to telomere on chrosomal short arm and 5'-terminus of this base sequence : 24612
tgaaggttgttaaactggacacagcagtgcagtgcagcagggcagggctctggaaaggtcctcctggtggggatgtggtcctggtttttaataaaaaatctaacggcaatgaaaccaggtagaagctttcatgtatgcacgtgtgtgtgtgtgtgtgtgtgtgtgtgtgtgtgtgcgcacatgcttggtaatagtccacaggtga

SEQ ID NO: 21661 - DNA, 324 bp, Homo sapiens
  AC002426.1_57903
  Located on chromosome 15
  Distance between a terminus base of telomere on chromosomal short arm and 5'-terminus of this base sequence : 88576026
  Distance between 3'-terminus of neighbour sequence of sequence listing upward to telomere on chrosomal short arm and 5'-terminus of this base sequence : 23088
aggtttctggtacaaacgtaatactccattttaacaaatgtgctcatttgcctccaggagacctccaaacacacacctacacacacacacacacacacacacacacacacacacacacatacacgtgcttcttggctgaaaaccaaaagctgtcactgagaagaaaaagcaatgagaaaaatccgttcagtgccgaaggtaatggctttgttttaataggccttggtgccttgatgaaagcattttcttttaaaatgttagtatattgagaaatatttcaaatacagaaatttgaagagaaagtgattgacataatgaaccacc

SEQ ID NO: 21662 - DNA, 87 bp, Homo sapiens
  D15S158
  Located on chromosome 15
  Distance between a terminus base of telomere on chromosomal short arm and 5'-terminus of this base sequence : 88576080
  Distance between 3'-terminus of neighbour sequence of sequence listing upward to telomere on chrosomal short arm and 5'-terminus of this base sequence : -270
caggagacctccaaacacacacctacacacacacacacacacacacacacacacacacacacacatacacgtgcttcttggctgaaa

SEQ ID NO: 21663 - DNA, 185 bp, Homo sapiens
  AC002426.1_88065
  Located on chromosome 15
  Distance between a terminus base of telomere on chromosomal short arm and 5'-terminus of this base sequence : 88606206
  Distance between 3'-terminus of neighbour sequence of sequence listing upward to telomere on chrosomal short arm and 5'-terminus of this base sequence : 30039
ctactcattggccagagaaattggcctctttggtctgaagagtgtgtgagaaatttcttttctctctctctctctctctctctctctctctctctctctctcgtatctcaccattttgcccaaaggtagacccattcacaaaaagtgtggaactgtgcagggaggctaaacttcagatttctacc

SEQ ID NO: 21664 - DNA, 101 bp, Homo sapiens
  DISD22_0009977
  Located on chromosome 15
  Distance between a terminus base of telomere on chromosomal short arm and 5'-terminus of this base sequence : 88691221
  Distance between 3'-terminus of neighbour sequence of sequence listing upward to telomere on chrosomal short arm and 5'-terminus of this base sequence : 84830
gtggtttgagctctggatgcttctgtacacacacacacacacacacacacacacacacacacacacacacaccttccttcaagcagaggtgctacacttat

SEQ ID NO: 21665 - DNA, 261 bp, Homo sapiens
  DISD22_0009980
  Located on chromosome 15
  Distance between a terminus base of telomere on chromosomal short arm and 5'-terminus of this base sequence : 88826313
  Distance between 3'-terminus of neighbour sequence of sequence listing upward to telomere on chrosomal short arm and 5'-terminus of this base sequence : 134991
aggtgttctgtaaatcaagaattcatatttaaaaaaaatttttttctagagacagtgttttgctatgttgcccaggctggtctcgaacatgtcgcctcaagcaatcctcctgccttggcctcccaaagtgttgggattataggcatgagccacacccagccccatatatatatatatatatatatatatatatatatatatgttttttttttaactaaaaagtataggattatagacatgaatataaagatagtctcagcc

SEQ ID NO: 21666 - DNA, 285 bp, Homo sapiens
  D15S652
  Located on chromosome 15
  Distance between a terminus base of telomere on chromosomal short arm and 5'-terminus of this base sequence : 89045421
  Distance between 3'-terminus of neighbour sequence of sequence listing upward to telomere on chrosomal short arm and 5'-terminus of this base sequence : 218847
gcagcacttggcaaatactctcaatacaggaatttacacaactcatttttattcatgagtctgtctctgaaaactgcaagttcccccaggatacactgcaaatgctaagaaggcttagagaaataataataataataataataataataataataacaataatgaaaatggtgtccgtttaggtcaggctgacctcctatgaagggacctggctttctggaacctgctgtcctggttcttatccttactgttggaccccaggctgaccttgagccttgagtgatg

SEQ ID NO: 21667 - DNA, 289 bp, Homo sapiens
  chr15.fa.O7frz.90806775
  Located on chromosome 15
  Distance between a terminus base of telomere on chromosomal short arm and 5'-terminus of this base sequence : 89088324
  Distance between 3'-terminus of neighbour sequence of sequence listing upward to telomere on chrosomal short arm and 5'-terminus of this base sequence : 42618
ggtcgcttaaggtaacatagttgccttaagggattgggatgtggaggtttttgggggccactgttcttcctgccatggtagtggaacccctgtgagtccacttaccccagctttatttatttatttattatttatttatttatttatttatttatttattttgagatggagtctgtctctgtcgcccaggctggagtgcagtggcgtgatctcggctcactacaagctccgcctcctgggttcacgccattctcctgcctcagcctcctgagtagctgttgactacagg

SEQ ID NO: 21668 - DNA, 475 bp, Homo sapiens
  chr15.fa.O7frz.90879309
  Located on chromosome 15
  Distance between a terminus base of telomere on chromosomal short arm and 5'-terminus of this base sequence : 89337868
  Distance between 3'-terminus of neighbour sequence of sequence listing upward to telomere on chrosomal short arm and 5'-terminus of this base sequence : 249255
ttaattccaaccattccttaaccccacaaagaccactctagcccatggaacctaactctaactctaactctctctctctctccctccctccctccctccttccctccctctctcttctttttctgagacagggtctcactctgttgctcaggctggagtgcagtggcatgatcacagctcactacatccttgacctcctgggctgaagcaatcctccctactcagcctcccgagtagctgggaccacaggcatgtgtcaccacacctggctaatttttgtactttttgtagagatgggggtctcactgtgttgtccagctggtctcgaactcctgggttcaatctgcttgcctcagcctcccaaagtgttgggattacaggcatgagtcactgtgcccagtcagcaacattcttttatcatccattgctccctcaagttctcattctccttctttctcagcttaaatccatagcc

SEQ ID NO: 21669 - DNA, 305 bp, Homo sapiens
  chr15.fa.O7frz.91208842
  Located on chromosome 15
  Distance between a terminus base of telomere on chromosomal short arm and 5'-terminus of this base sequence : 89642587
  Distance between 3'-terminus of neighbour sequence of sequence listing upward to telomere on chrosomal short arm and 5'-terminus of this base sequence : 304244
gtttcaccatgttggctaggctggttttgaactcctgacctcaagtgatccacccgcctcagcctcccaaagtgctgggattacaggcatgagccaccgcgcctggctaacatattataaatgttttaaaatttaatctccttaatatatatatagtccctaaaaaccaataaaaaagatcaataatctaattgaaaaactggtaaagaacataacacaggcagttcacacacacacacacacacacaaacctaaatggctccgcattcttaactatgaaaaaatgtccaatctcactttcaata

SEQ ID NO: 21670 - DNA, 369 bp, Homo sapiens
  chr15.fa.O7frz.91379589
  Located on chromosome 15
  Distance between a terminus base of telomere on chromosomal short arm and 5'-terminus of this base sequence : 89908905
  Distance between 3'-terminus of neighbour sequence of sequence listing upward to telomere on chrosomal short arm and 5'-terminus of this base sequence : 266013
gacagcaccaaatcatgagagatccacccccatgattcaatcacctcccaccaagccccatctccaaaactggggattgcaattcaacatgagatttagagggttcaggatctaagaaatatatcagctataatataatctctctctctctctctctctctctctctctcttcgggtatatatcccatttctgtgtcccagagaggtggaagtagtggtcggggccactgtgctagcatagacttgctccagcgtcagtcagtaccgtggagctgcatagatctgggtgtgttggttgtcccagggtttctggtttgtgaacgttaccatcctgtctgattcaggagctcacagatcaagctagatttg

SEQ ID NO: 21671 - DNA, 323 bp, Homo sapiens
  chr15.fa.O7frz.91608204
  Located on chromosome 15
  Distance between a terminus base of telomere on chromosomal short arm and 5'-terminus of this base sequence : 90133639
  Distance between 3'-terminus of neighbour sequence of sequence listing upward to telomere on chrosomal short arm and 5'-terminus of this base sequence : 224365
aattaagtggtttagcaggaagggattggggatgggtttctagaattagctctgaccttcggcaagtcatctagctctgctgggcctcagtttcctcatctatgaatagtagggtgtgtgtgtgtgtgtgtgtgtgtgtgtgtgtgtgtgtgtgtgtggtcttcctgccctgacattctgtgccctgacattcagtgaataaccaatttcttcatctttcatagctcagctccaacatcttccccaccctctagggagtcctcacatccgtgcctttccttcctaacactgagctcactcggtaattaggcgctcattagagt

SEQ ID NO: 21672 - DNA, 382 bp, Homo sapiens
  AC023114.4_58181
  Located on chromosome 15
  Distance between a terminus base of telomere on chromosomal short arm and 5'-terminus of this base sequence : 90240223
  Distance between 3'-terminus of neighbour sequence of sequence listing upward to telomere on chrosomal short arm and 5'-terminus of this base sequence : 106261
gttactaaggctggaaacctacaaactatgtttccctttcatccagggtgtattagtttgcttggatgccataacatgataccacagactggatggcttaaacaacagatagttattgtctcacagttctggaggctggaagtcgaagatccaagtgttggcagggttgatttctcctgagggctctctccttggctcgcagatggcctcctcctcctcctcctccctgtgtctttacgtggtttttcctctttgtatatgtgcattcccagcatcttttcctcttcttataaggacaccagtcatattggctccctccgccccttatgagctcatttaacccaaattactcccttaaatgtcctgtctccaaatacagtct

SEQ ID NO: 21673 - DNA, 440 bp, Homo sapiens
  chr15.fa.O7frz.91904814
  Located on chromosome 15
  Distance between a terminus base of telomere on chromosomal short arm and 5'-terminus of this base sequence : 90356358
  Distance between 3'-terminus of neighbour sequence of sequence listing upward to telomere on chrosomal short arm and 5'-terminus of this base sequence : 115753
agccggaattagtgtcatctaagggctaagctcaagtcctgggagcaaggtgtggcccttcataggagaaggggacaaaaggtcggaagccataaaggaggagccaggaagaaaatggaatataaagtgggtaaaaatgaatgacttgggaaagtggagaaagggagggggtgacacacacacacacacacacacacacacacacacgaaagagagagagagagagagagagagagagagagagagagagatgggctctgaacagagcctctccccagcagtgggggcagcccatagctactctgttcttgggcagtggtctctggacagcagaatgcacgtggatgttggagttgccagatctaacccatcgggagtgtgggccagtttggaaggtttcctgtcttgcttagggaggtcactcgaggaaagtccagagt

SEQ ID NO: 21674 - DNA, 126 bp, Homo sapiens
  DISO7_10006113
  Located on chromosome 15
  Distance between a terminus base of telomere on chromosomal short arm and 5'-terminus of this base sequence : 90446671
  Distance between 3'-terminus of neighbour sequence of sequence listing upward to telomere on chrosomal short arm and 5'-terminus of this base sequence : 89873
  misc_feature (1)...(126): n = A,T,G or C
cagagtgagtgatgagagggagaaaaagagaaagagaggaaggggggtgaggagagagagagagagagagagagagagagangagnnagagagagagagagagactgaacctacacatggaaattc

SEQ ID NO: 21675 - DNA, 166 bp, Homo sapiens
  DISD22_0009982
  Located on chromosome 15
  Distance between a terminus base of telomere on chromosomal short arm and 5'-terminus of this base sequence : 90633337
  Distance between 3'-terminus of neighbour sequence of sequence listing upward to telomere on chrosomal short arm and 5'-terminus of this base sequence : 186540
gagccagttgtgttgctgctgctctgtcgcaggatccctgcttatcactgggccttggagcgagttagcccggcacagagaacttatctttctttctttctttctttttttttttttttttacatttcctgcttcagctccacgtggagagaaggtgcacctaggg

SEQ ID NO: 21676 - DNA, 103 bp, Homo sapiens
  DISD22_0009985
  Located on chromosome 15
  Distance between a terminus base of telomere on chromosomal short arm and 5'-terminus of this base sequence : 90714713
  Distance between 3'-terminus of neighbour sequence of sequence listing upward to telomere on chrosomal short arm and 5'-terminus of this base sequence : 81210
gggtgacagtggatatgaatcaattgttgacatgggtttaaatcaagcgtgtgtgtgtgtgtgtgtgtgtgtgtgtgtgtgttgtggtgttgtggttgtagct

SEQ ID NO: 21677 - DNA, 255 bp, Homo sapiens
  D15S1004
  Located on chromosome 15
  Distance between a terminus base of telomere on chromosomal short arm and 5'-terminus of this base sequence : 90828300
  Distance between 3'-terminus of neighbour sequence of sequence listing upward to telomere on chrosomal short arm and 5'-terminus of this base sequence : 113484
ggcaagactccatctcaaaaaaacaaaaacaaaacaaaacaaaacaaaaaaacgaaaaacaggattatggtagagaacaaaagaattaataacctattatggtaaaaatgtaaacacaacataaatgtacaccagtgtggatttgataagtacacaaaccacacacacacacacacacacacacacacacacacacactgattatatattagagtaaggtttttttctggttggtggtttacaggctttttattc

SEQ ID NO: 21678 - DNA, 273 bp, Homo sapiens
  Z67094
  Located on chromosome 15
  Distance between a terminus base of telomere on chromosomal short arm and 5'-terminus of this base sequence : 90951055
  Distance between 3'-terminus of neighbour sequence of sequence listing upward to telomere on chrosomal short arm and 5'-terminus of this base sequence : 122500
ggccaaaaagtggcattttggggattatgtcctagtggtttattctttgtaagaaaatatccaatgtgatcacatctttagtctctgccataagaacatatacaacaattttagggatggcaaggataaagagattaacttgggacaagaatgggggttaggatgagatgtgtgtgtctgtgtgtgtgtgtgtgtgtgtgtgtgagagagagagagagagagagagagagagggagagagaaagagagagggagacctgggattaggggttcc

SEQ ID NO: 21679 - DNA, 222 bp, Homo sapiens
  D15S130
  Located on chromosome 15
  Distance between a terminus base of telomere on chromosomal short arm and 5'-terminus of this base sequence : 91137004
  Distance between 3'-terminus of neighbour sequence of sequence listing upward to telomere on chrosomal short arm and 5'-terminus of this base sequence : 185676
ggcctccatgaactaaactgtatcgtgtgtgtgtgtgtgtgtgtgtgtgcgcgcgcgtgtgcgtgtgtgtgtgtacacgtttcctcttaagggtactgacagaaagatctttttacctgcgtacctctgttaataactagttctaaactatgttggagaatgggtatggattctacaaccagattaaatagatatggcctatctgacaaagcaaacctgaga

SEQ ID NO: 21680 - DNA, 451 bp, Homo sapiens
  AC020562.4_9029
  Located on chromosome 15
  Distance between a terminus base of telomere on chromosomal short arm and 5'-terminus of this base sequence : 91279799
  Distance between 3'-terminus of neighbour sequence of sequence listing upward to telomere on chrosomal short arm and 5'-terminus of this base sequence : 142573
gactcagattgctcaccaccttcatcaagttcttttgatccactcttcccaaacacataggctgttttatgactattactaatataattcataataataataataataaatagaatagcaacaccaatctaatgctacttactgagggtttatgtgtaaggaactctgctaatttctacataaatattatcagaccacatctatttggtttcctctgtatgcgaagagtcctcgcacagtgtctgtctgagaaaaggctttcagtaaataccctctgagtgatttaattattctaacaacctataagaatctgttttgatccattgagagatgttcccatgtcttgaattttaggtatatttttcaaggacagaaagctagaaagtagcagaggtgggactcaaatccaggtcttttggactccagagccttgttcactaccatgtacagc

SEQ ID NO: 21681 - DNA, 145 bp, Homo sapiens
  D15S1038
  Located on chromosome 15
  Distance between a terminus base of telomere on chromosomal short arm and 5'-terminus of this base sequence : 91404046
  Distance between 3'-terminus of neighbour sequence of sequence listing upward to telomere on chrosomal short arm and 5'-terminus of this base sequence : 123796
attcttgctcactctgcttcagacacaaggagtccatgctgcctttttaaaaaaaaacaaacaaaaaaaacccaaaaacaatcacacacacacacacacacacacacacacacacacacacacacacacacactggaaggctggg

SEQ ID NO: 21682 - DNA, 265 bp, Homo sapiens
  chr15.fa.O7frz.92956768
  Located on chromosome 15
  Distance between a terminus base of telomere on chromosomal short arm and 5'-terminus of this base sequence : 91553696
  Distance between 3'-terminus of neighbour sequence of sequence listing upward to telomere on chrosomal short arm and 5'-terminus of this base sequence : 149505
cctttgaaatctagtacaatcaagatgttagattgtaagttattttctggttattaagatgcatttcaatcctcatctttaatcaactgaagattcgcaagatggctttgattcgcacactggggtgtgtgtgtgtgtgtgtgtgtgtgtgtgttgtgcacacctcaaattgatgtgctgtctctctcatttcctgcatctcaggatgttccctccggtatatgttattaataaggaatctgtgttcagtttcatgcacttaaaa

SEQ ID NO: 21683 - DNA, 376 bp, Homo sapiens
  chr15.fa.O7frz.93033027
  Located on chromosome 15
  Distance between a terminus base of telomere on chromosomal short arm and 5'-terminus of this base sequence : 91621868
  Distance between 3'-terminus of neighbour sequence of sequence listing upward to telomere on chrosomal short arm and 5'-terminus of this base sequence : 67907
tattcaaagcattttgttcaacaacttatgataagaattatattttacatcacacacacacacatctgaaataagagtatcccaagacaataataacactactttgggtgggacacactaataacctattctattctattctattctattctattctattctattctattctattctattgtaatccatttcacttcttttttacatgcctcttgcactccactaaattgatttcacacaacccagtattgggttaaaacctgcatttgcaaaacgtagccaaatggaaccacagaaaatgagctacataaggaaacacaggtaaaacctttgctaaaatgtgtcatacatggtagatcctagattacggttcatt

SEQ ID NO: 21684 - DNA, 398 bp, Homo sapiens
  AC022308.17_57903
  Located on chromosome 15
  Distance between a terminus base of telomere on chromosomal short arm and 5'-terminus of this base sequence : 91741120
  Distance between 3'-terminus of neighbour sequence of sequence listing upward to telomere on chrosomal short arm and 5'-terminus of this base sequence : 118876
gcatgttcctgtaatctgaactgcttgggaggctgaggcagcagaactccttgaatctgggaggcggaggatgcagtgagctgagattgtaccactgcactccagcctgggtgacagagcaagaatctgtcaaaagaaagaaagaaagagagacaggagaggggaggggaggggaggggaagaaagaaagtaagaaagaaagaaaaagaaagaaagaaagagagagagaaagagaggaaggaaggaaggaaggaaggaaggaagaaagaaagaaagaaagaaagaaagaaagaaagaaagaaagaaagaaagaaagaaagaaagaaagaaagaaagaaagaaaggaaagaaagaaagagaaagaaagaaagaaaactgactaactcactaaaggaagc

SEQ ID NO: 21685 - DNA, 376 bp, Homo sapiens
  AC022308.17_54591
  Located on chromosome 15
  Distance between a terminus base of telomere on chromosomal short arm and 5'-terminus of this base sequence : 91744508
  Distance between 3'-terminus of neighbour sequence of sequence listing upward to telomere on chrosomal short arm and 5'-terminus of this base sequence : 2990
cttctgatcagttctaacgttgtcctcggtttgacagatataatgggtctatgaattttcaatgcttataaactacaaccccagtggattcaggaagacctgtgcagacatgcttatgtggctacatgcacacacaggcacatatgcccatacacagatacacatacacacacacacacacacacacaatcatgcacacatgcatgcagacttatagatctaacccaaaccctaagaatatcaatacatgttagaaagcactgcattctctgtcacttatagctccacacaagttttgaaatcaggcaagtccaaagttacatcccagccagaatgctcacaagttggtgatgtgagcaagctatttaactggtag

SEQ ID NO: 21686 - DNA, 438 bp, Homo sapiens
  AC022308.17_37280
  Located on chromosome 15
  Distance between a terminus base of telomere on chromosomal short arm and 5'-terminus of this base sequence : 91761878
  Distance between 3'-terminus of neighbour sequence of sequence listing upward to telomere on chrosomal short arm and 5'-terminus of this base sequence : 16994
ttcaagagctactgtttcagagacagaaaagaaaatttccctcccttcctctttcttccttccctccctcctttcttttcctttccctttccttcctttcttcattccttccttccttccttccttcctgccttcctgcctttctgccttcctgcctttctaccttccttctcctttgccttcttcctcttcttcctttcttaaatgctgacttgctggggaactatacataaataatttgcatctcaccctgcttgctctcctctgcactatgacaagagtagtgctagtcagataaacaaaaacaaaacagagaaaccaaaacacacacacacacacacacatacacacacacacacacacagacacacatgagataacttagggttaatttagcatgaaatgcttcttaccatgtgttagtccaatcagactttg

SEQ ID NO: 21687 - DNA, 296 bp, Homo sapiens
  HUMUT647
  Located on chromosome 15
  Distance between a terminus base of telomere on chromosomal short arm and 5'-terminus of this base sequence : 91769987
  Distance between 3'-terminus of neighbour sequence of sequence listing upward to telomere on chrosomal short arm and 5'-terminus of this base sequence : 7671
acctgttttgtgaaatggcattcatctactaggctgtgatttacttgtcaatttcaaggaattaaatgtgtgtgtgtgtgtgtgtgtgtgtgtgtaagttctggcttgtgttttcactcttttttatatcttttgatgaatctgtttttaattttaatcatatcaaattgataatctctcattttacaatttgcattttcagggtaatgtttaagaaaccttaatttacttggaaacataaaaatttgccatttttattcaggcacaatggctcatgcctgtaatatcagcacttt

SEQ ID NO: 21688 - DNA, 402 bp, Homo sapiens
  AC021111.3_121341
  Located on chromosome 15
  Distance between a terminus base of telomere on chromosomal short arm and 5'-terminus of this base sequence : 91873740
  Distance between 3'-terminus of neighbour sequence of sequence listing upward to telomere on chrosomal short arm and 5'-terminus of this base sequence : 103457
gtaggattagaaaccaagaatttcattgtcacaagaaaagtacaaaatttaggaaaaattaagcaaaaccctacaatattaatattaaatttgaattggaaatatacgtataaactcatgatttatacatgactctatctatctatctatctatctatctatctatctatctatctatctattcactccttgcctaaaaatcttaatatcccagtagcagtgacgcacctaacactcaaatcttgagttctaagttccactgctgtctttgaatagaggggtgagagaacagctgatttcaagtctccttcagagaaaagtgcaaggtgagcagtagcatgtgcttgtagcagaaaagaaaataagggcatatctcaaaaggacttaggatcttgatttaag

SEQ ID NO: 21689 - DNA, 412 bp, Homo sapiens
  AC021111.3_88369
  Located on chromosome 15
  Distance between a terminus base of telomere on chromosomal short arm and 5'-terminus of this base sequence : 91888245
  Distance between 3'-terminus of neighbour sequence of sequence listing upward to telomere on chrosomal short arm and 5'-terminus of this base sequence : 14103
tggcctcatagagtgacttagggaggagtccctactcctcaattttttggaatagtttatgtagaattggtaccagctcttctttatatgtctcgtagaattcagctgtgaattcttctggtccagagctttttctagttggtagggtttgtttgtttgtttgtttgtttgtttgtttgtttgtgttttgagacagatttttactcttgttgtccaggctggagtgcaatggcgcgatcttggctcactgcaatctctgccttctgggttcaagcagttctcctgcctcagctttctgagtagctgggattacaggcacctgccaccacgttagcccagctaatttttgtatttttagcaaagatggggtttcaccctgttggccaggctggtctcaaactcctgacttcag

SEQ ID NO: 21690 - DNA, 268 bp, Homo sapiens
  chr15.fa.O7frz.93545651
  Located on chromosome 15
  Distance between a terminus base of telomere on chromosomal short arm and 5'-terminus of this base sequence : 92200753
  Distance between 3'-terminus of neighbour sequence of sequence listing upward to telomere on chrosomal short arm and 5'-terminus of this base sequence : 312096
gagatagaagcattgagtaaacatttcagttccaaaagggagaaattgggtggggacagatatcaaaattatatcacacacatacacacacacacatccaaattatagctcacacacacacacacacacacaccacacacaaagcatgctactccatacagtcctacctcatttctgtgaagatatcaggagttacctatacctaaaacaaaaaatagaccctattcctaaaaatagtagtagggagattaggaaatcgctttctaga

SEQ ID NO: 21691 - DNA, 115 bp, Homo sapiens
  D15S157
  Located on chromosome 15
  Distance between a terminus base of telomere on chromosomal short arm and 5'-terminus of this base sequence : 92259625
  Distance between 3'-terminus of neighbour sequence of sequence listing upward to telomere on chrosomal short arm and 5'-terminus of this base sequence : 58604
agtgcatggtgttgccaaaattataatattatacacacacacacacacacacacacacacacacacatatattcagagaaagcatggtatactgtcagatactgtggaacttcac

SEQ ID NO: 21692 - DNA, 453 bp, Homo sapiens
  chr15.fa.O7frz.93787169
  Located on chromosome 15
  Distance between a terminus base of telomere on chromosomal short arm and 5'-terminus of this base sequence : 92371497
  Distance between 3'-terminus of neighbour sequence of sequence listing upward to telomere on chrosomal short arm and 5'-terminus of this base sequence : 111757
gtattcagactgaattaaaccactggctttgccggttctgcagcttgaagacagccggccatgggacttctcagcttccataaccgtattagccaattccaataccaaatctattttgacatatccatctatctatctatctatctatctatctatctatctatctatctatctatctacctatctatctatctatatctatctttcattcatccatcctattggttctgtttctctggagaaccctaatataatgatgctgtggacctggatgatgatgatgatggtgatggcataaacatttgtttgcatagaagtgatttctgcaattccaagtttggattagactcaactgtttgacaggctttacataagtgaactgataaattagaatgggtggtaggggagacaaggttgccactcgattttgttgaattactcagttcattgttt

SEQ ID NO: 21693 - DNA, 297 bp, Homo sapiens
  chr15.fa.O7frz.93905888
  Located on chromosome 15
  Distance between a terminus base of telomere on chromosomal short arm and 5'-terminus of this base sequence : 92492704
  Distance between 3'-terminus of neighbour sequence of sequence listing upward to telomere on chrosomal short arm and 5'-terminus of this base sequence : 120754
ctgagaatagcaattggttaatagttccaaaaaaagtaatggtcatttcattgagggcttacaatggcctaggggcctgtcctgaagcgaaagtaaaatagggctgcggctgctgcttctttacgttttcctcctcttcctcctcctccttctcctcctcctcctttttgccttcttcttcttcttcttcttcttcttcttcttcttctgcttctgcttctgcttctgcttctacttcttgttttgttcttcttctcaacagaaaggaaaaaaaaaatctttgaaggattaacttcg

SEQ ID NO: 21694 - DNA, 172 bp, Homo sapiens
  D15S207
  Located on chromosome 15
  Distance between a terminus base of telomere on chromosomal short arm and 5'-terminus of this base sequence : 92635820
  Distance between 3'-terminus of neighbour sequence of sequence listing upward to telomere on chrosomal short arm and 5'-terminus of this base sequence : 142819
  misc_feature (1)...(172): n = A,T,G or C
acttcctcaattcccaagaaatggagaacacctggaaaaggattcttcacatgaaaaatacaaactccccaccccccccaccgccncacacacacacacacacacacacacacacacacacacacacacgaacaagatacatgagaacggccgctccattctcagttcaaaa

SEQ ID NO: 21695 - DNA, 416 bp, Homo sapiens
  chr15.fa.O7frz.94142372
  Located on chromosome 15
  Distance between a terminus base of telomere on chromosomal short arm and 5'-terminus of this base sequence : 92730856
  Distance between 3'-terminus of neighbour sequence of sequence listing upward to telomere on chrosomal short arm and 5'-terminus of this base sequence : 94864
aaggctatttcttaatcttacgtcatcaatgattccgtgatcatactggagggaagtagctacaaaatatttctgctggtgtataattaaatgtaggccatgccttctgctctatgtattacacagatatctttgacctctatatcaccccaaaattaaaactcttccataccccatctcctctctattaatactagcatgttaaatacacacacacacacacacacacatgcaaacacacatacacatatctctttccaaaatgagaacatgaatagctcccatctgaccacgatgttttgagtcctgctaaaacaaaatcccagcccctataattaatatagcaaatgcttcactggctcctacaggtccaaaggcacaacagaattgcaaacttagtaattccattatggtcc

SEQ ID NO: 21696 - DNA, 397 bp, Homo sapiens
  chr15.fa.O7frz.94260428
  Located on chromosome 15
  Distance between a terminus base of telomere on chromosomal short arm and 5'-terminus of this base sequence : 92847527
  Distance between 3'-terminus of neighbour sequence of sequence listing upward to telomere on chrosomal short arm and 5'-terminus of this base sequence : 116255
ttcatgtttccttatgatcaagttttcttcctttgctcatatgtgctttagagatgattatagaatctgaacctgcagcatgttaccacaaaaatttaagactcattcaatgaatttcataatatcccgatagttttattctttcctgtctctgaaaaacatgttcactctcagcgtctaccacactctgtatcatcaaattgatagagtgttttaaaaattcagatgagggtgggtttgctctgtgtgcgtttgtgtgtgtgtgtgtgtgtgtgtgtgtgtgtgtgtgtgtagttcttgttttccctttagagatgaagaatttagtttctgtttctgttttaaattttatttccttagaggggactggaagctgtaaccatctgaaagttacaac

SEQ ID NO: 21697 - DNA, 273 bp, Homo sapiens
  chr15.fa.O7frz.94356922
  Located on chromosome 15
  Distance between a terminus base of telomere on chromosomal short arm and 5'-terminus of this base sequence : 93003857
  Distance between 3'-terminus of neighbour sequence of sequence listing upward to telomere on chrosomal short arm and 5'-terminus of this base sequence : 155933
atgccacagtgatcagtactagatgtagagatgaaagatggaaatacagatgaaaattgatggttattttctgtgtagtttcaggttggaggtaattttcgaagatttgttttgtcgttaagattccttacactgatgagacccaactgcttaactctttaagcacttccagagaaactcgggaatgcacacacccgcccacacacacacacacacacacacacacacacaggcacacacatgactacataacaggtagataaagcttatgca

SEQ ID NO: 21698 - DNA, 343 bp, Homo sapiens
  D15S657
  Located on chromosome 15
  Distance between a terminus base of telomere on chromosomal short arm and 5'-terminus of this base sequence : 93129900
  Distance between 3'-terminus of neighbour sequence of sequence listing upward to telomere on chrosomal short arm and 5'-terminus of this base sequence : 125770
tctacattggacagaaatgggattataacaacagtagttcttcaccatttacaaaacactttcccacatatatatatagagaaaaagaatacatctctctgtgatatatatctcacatatatattatataaaaaatagaaatatatagaatagaaatatatatagaaaatagaaaatatatagaaagaagacagatagatgatagatagatagatagatagatagatagatagatagatagatagatagatgggagatagaaagttagagttctttgatgacaagcctcaaatgtcccaaaataaagattttcttagaactcgcatgaatcagaatgtgtatc

SEQ ID NO: 21699 - DNA, 186 bp, Homo sapiens
  chr15.fa.O7frz.94660976
  Located on chromosome 15
  Distance between a terminus base of telomere on chromosomal short arm and 5'-terminus of this base sequence : 93283307
  Distance between 3'-terminus of neighbour sequence of sequence listing upward to telomere on chrosomal short arm and 5'-terminus of this base sequence : 153064
agcattagaggactattaggtcacagggtttagaacagtaaactcactctcttctttgccttccaactaagagagagaaagatctaaaagttaaaacacacacacacacacacacaaacattttatgaaatgttaaatgatgacctccaagaagccttcataccctctctgaaatactgccaacct

SEQ ID NO: 21700 - DNA, 161 bp, Homo sapiens
  DISD22_0009993
  Located on chromosome 15
  Distance between a terminus base of telomere on chromosomal short arm and 5'-terminus of this base sequence : 93416288
  Distance between 3'-terminus of neighbour sequence of sequence listing upward to telomere on chrosomal short arm and 5'-terminus of this base sequence : 132795
atagaagccagtatactttcctctctcctcccgcatgcgtgtgcgtggtgtgtgtgtgtgtgtgtgtgtgtgtgtgtgtgtgtgtgttgcagggctctttggcccttccccttgttctttgtttaataagatactgccctggtccctctaagtatgacatc

SEQ ID NO: 21701 - DNA, 468 bp, Homo sapiens
  chr15.fa.O7frz.95194721
  Located on chromosome 15
  Distance between a terminus base of telomere on chromosomal short arm and 5'-terminus of this base sequence : 93893788
  Distance between 3'-terminus of neighbour sequence of sequence listing upward to telomere on chrosomal short arm and 5'-terminus of this base sequence : 477339
caggccatacaagtacaaatagccccctttttcaaagaggggaaatagcggatccctacctggaactgtacaacagacatggaaggcaaaacgaggctagggaatgctctgtaaatggccactctgtcactactgcccaccatgtgccggcgcattccaatcatcagcacaggaaagaaataattcataacttgatccttgggggaaagaaaggagggataaaattacatataaaagagtggaaggagagaaaaaggagagagagagagagagagagactgaggaatgagggaagaagggagaaaaaaattgccggtatgcttgtgtgaatgaaagatagtgaggcagaaaaatgaaaaggctgcaaagtcaaaaacggggagatactgacaccaaatctctgcaaagcgttcaaaattctccagctgccacgcttttaatttgctaccattctaattaaaatgcaaa

SEQ ID NO: 21702 - DNA, 459 bp, Homo sapiens
  chr15.fa.O7frz.95291609
  Located on chromosome 15
  Distance between a terminus base of telomere on chromosomal short arm and 5'-terminus of this base sequence : 94007068
  Distance between 3'-terminus of neighbour sequence of sequence listing upward to telomere on chrosomal short arm and 5'-terminus of this base sequence : 112812
gttggataaaggaaattgagacggtgagaaaatgaattcagaggtgctaaagtgcctctgtgtgtatatacctaggcacagaatctgcgctataagccatgcaaatatccaagttttaagagattagtgcagactgtcaaaatgatggtacctttttatgatcccacaagcaaagtataaaagttaccatttcttggtatccttgacaacatttggcactttcagatttttaaacatatgccaataaagtgagtaaagtgatatttaattatggttttaatttgcatttctctgattgttaatgagattgagtatgaaataactattcatatcctttgccctttgtctcttgagatatatatatatatatatatatatatatataaaataaactgtactgtatatgacacttttcctttgatatttgtgagtaattttaatgccttatgacttggtagt

SEQ ID NO: 21703 - DNA, 386 bp, Homo sapiens
  chr15.fa.O7frz.95384404
  Located on chromosome 15
  Distance between a terminus base of telomere on chromosomal short arm and 5'-terminus of this base sequence : 94099987
  Distance between 3'-terminus of neighbour sequence of sequence listing upward to telomere on chrosomal short arm and 5'-terminus of this base sequence : 92460
acagctgtttatcaatagctctaggggctatggacattctgggtttccatacttcagatacataagaaggaaatatttgtagagtttgggtgggggtgggaggactgtaagtgaacaattttatgtattccaaacactttttctcattattttgtcagaaacattctgcttgtgcatgttagctggttttttaaaataagcaaaataaacagtccatgtagcattacacaacacacacacacacacacacacacacacacacacacacacacacacacacacacagtgaaaacagaggtttttcagacccaaatgttgtgaaggctttcccgtaatgtaatggcaagtttgtttaactctgatggtgatatcaagtaccattccaa

SEQ ID NO: 21704 - DNA, 380 bp, Homo sapiens
  chr15.fa.O7frz.95516474
  Located on chromosome 15
  Distance between a terminus base of telomere on chromosomal short arm and 5'-terminus of this base sequence : 94174625
  Distance between 3'-terminus of neighbour sequence of sequence listing upward to telomere on chrosomal short arm and 5'-terminus of this base sequence : 74252
catgtatcaatactggtggaaggacatcagcctagagagaagagcttatctggaaaattgtatattatatacaaaagtgtaaatcccgctattttcactctattccttcaaaacaatggatacaattaaaatagaaatttccaactctacagtgtcactgatattctcagtgtcttataagttatttactagtgaagatgtgatttctcctatttctgtttcctatttttcttctgcctaatgtgtgtatgtgtgtagcgttcctagatttgaatggcctcctttgcctttgtagcatacacacacacacacacacacacacacacacacgcacacatacacatacgcatacacatactcttgaaataaagtgcctgatc

SEQ ID NO: 21705 - DNA, 390 bp, Homo sapiens
  chr15.fa.O7frz.95627152
  Located on chromosome 15
  Distance between a terminus base of telomere on chromosomal short arm and 5'-terminus of this base sequence : 94346672
  Distance between 3'-terminus of neighbour sequence of sequence listing upward to telomere on chrosomal short arm and 5'-terminus of this base sequence : 171667
ggtccttgaaggtataagagtaatgttaggctgggcgcagtggctcatgcctgtaatccctgcattttgggaggccgaggctggtggatcacttgaggccaggagttcgagaccgacctggccaacatggtaaaaccccatctctactaaaaatacaaaaattagccaggcgtggtggtgcacacctctgtagtcccagctacttaggaggctgaggcaggagaatctcttgaagccaggaggtggaggttgcagattgtaccactgcactccagccagggtgacagagcaagactccatctcgataaataaataaataaataaataaataaataaataaataaataagtaagtaatgttgattttctaaggttagatgacatgttcatt

SEQ ID NO: 21706 - DNA, 232 bp, Homo sapiens
  D15S1034
  Located on chromosome 15
  Distance between a terminus base of telomere on chromosomal short arm and 5'-terminus of this base sequence : 94420697
  Distance between 3'-terminus of neighbour sequence of sequence listing upward to telomere on chrosomal short arm and 5'-terminus of this base sequence : 73635
agaagcaatgccttggaatatatctggggtgtgtgtgtgtgtgtgtgtgtgtgtgtgtgtgtgtgtgtgtagaaagagagagtgaaaaaagtcatattcattaactcactagtcttaaccatgtttttcatcacactgaaacaggtggcctattaccatagtgaggtggacttttgaggcaaggtaggcagcatcaccaagcctaggataatgttgtccacaacgtgtttga

SEQ ID NO: 21707 - DNA, 188 bp, Homo sapiens
  HUMUT6950
  Located on chromosome 15
  Distance between a terminus base of telomere on chromosomal short arm and 5'-terminus of this base sequence : 94428477
  Distance between 3'-terminus of neighbour sequence of sequence listing upward to telomere on chrosomal short arm and 5'-terminus of this base sequence : 7548
ccaacagacaaaatcactgtgagtttttttcttttttctttctcgttctttctttcccttccttccctccttccttccttccttccttccctctctttctttctttctttctttctttctttctttctttctttctttctttctttctttctttttctttttctttttatggagttttgcttttgttg

SEQ ID NO: 21708 - DNA, 213 bp, Homo sapiens
  D15S212
  Located on chromosome 15
  Distance between a terminus base of telomere on chromosomal short arm and 5'-terminus of this base sequence : 94619121
  Distance between 3'-terminus of neighbour sequence of sequence listing upward to telomere on chrosomal short arm and 5'-terminus of this base sequence : 190456
cagatttcagatgtgcctagtcaacccccacaatcacatggcatataccaattcgttgaactaaaatttctaaacgatggtgcaaacaccacacacacacacacacacacacacacacacacacacacacacaggttctgtttctttggtagaactctgatggatatatagtagtcgatgtccaaaagcaccacatgcactcacttgctaagg

SEQ ID NO: 21709 - DNA, 214 bp, Homo sapiens
  Z24426.1_118
  Located on chromosome 15
  Distance between a terminus base of telomere on chromosomal short arm and 5'-terminus of this base sequence : 94619190
  Distance between 3'-terminus of neighbour sequence of sequence listing upward to telomere on chrosomal short arm and 5'-terminus of this base sequence : -144
ctaaacgatggtgcaaacaccacacacacacacacacacacacacacacacacacacacacacaggttctgtttctttggtagaactctgatggatatatagtagtcgatgtccaaaagcaccacatgcactcacttgctaagggtacaagactataccaggctgtaatgatttttcacccactgtgagtgatattgcacatttaattcacgtc

SEQ ID NO: 21710 - DNA, 471 bp, Homo sapiens
  chr15.fa.O7frz.95988156
  Located on chromosome 15
  Distance between a terminus base of telomere on chromosomal short arm and 5'-terminus of this base sequence : 94710128
  Distance between 3'-terminus of neighbour sequence of sequence listing upward to telomere on chrosomal short arm and 5'-terminus of this base sequence : 90724
cctgaggttaggagtttaagaccatcttggccaacatggtgaaacctcgtctctactaaaaatacaaaaaaaaattagccgggcatggtggtggtttcctgtaatcccagctactcgggaggctgaggcaggagaaccacgagaaccacttgaacccaggagcaggaggttgcagtgagccaagaccacgccactgcactccagcctgggcaacaaaagcaaaactccatctaaaaaaaaaaaagaagaagaagaagaagaagaagaaggtgatttactatcacaggacatatccagaaaagcatttctgcagaagcaaccaatcagaggtattttcaattttccagctgccatgcagaaaaagttggggtggggcgggagggggtggtgtggtttgcaaagggagtagcttcccccttgtcacttaggtgtggaaagctgaggttcccctttagattcagttcctggaag

SEQ ID NO: 21711 - DNA, 362 bp, Homo sapiens
  chr15.fa.O7frz.96095863
  Located on chromosome 15
  Distance between a terminus base of telomere on chromosomal short arm and 5'-terminus of this base sequence : 94816966
  Distance between 3'-terminus of neighbour sequence of sequence listing upward to telomere on chrosomal short arm and 5'-terminus of this base sequence : 106367
caggcatgtttatgtctgtatctatccaccatctatatctatctatccatctgtctgtctgtctctatctatctatctatctatctatctatctattcatctatctagagagaaagacagaggaaacattcaatataagatttaatggctctgtttcttccatagcccacttgtttctttccttgtagactgtgagtattttcctgctgaggacttaggttcagatttgaagtggccaattggtacctttccccttaagctcctttctgacttctcacagcttggggagcttgaatcaaagcttagagaatttgtttcttctgtaacagaggtcttgtgtacaaggtcttgagtcttactga

SEQ ID NO: 21712 - DNA, 308 bp, Homo sapiens
  chr15.fa.O7frz.96292528
  Located on chromosome 15
  Distance between a terminus base of telomere on chromosomal short arm and 5'-terminus of this base sequence : 94890934
  Distance between 3'-terminus of neighbour sequence of sequence listing upward to telomere on chrosomal short arm and 5'-terminus of this base sequence : 73606
ttacgagcatgagaacacttacttaacaccaagaagtatgtaggtgagagcctttgttacctgtttgcataaaaatcacaaattgtgacttgctaaacatatgatgtcatttatttggacttatattaaactatatatatatatatatatatatatgtatatataaaatactgaattaaacttacttgaacaattctgtattagctgcccaatgtctgtggagactgaaagaaagccatcagggcaggatataaaaataaatatatatttaatattacctaacacttagtactgccagataaatttgt

SEQ ID NO: 21713 - DNA, 186 bp, Homo sapiens
  D15S985
  Located on chromosome 15
  Distance between a terminus base of telomere on chromosomal short arm and 5'-terminus of this base sequence : 95191065
  Distance between 3'-terminus of neighbour sequence of sequence listing upward to telomere on chrosomal short arm and 5'-terminus of this base sequence : 299823
ctgacaaatcacaactgaagactgggggggtggggggactctctacaagtgtccagagtgcagtgtgtgtgtgtgtgtgtgtgtgtgtgcgcgtgtgtgtgtattttataagatgtgtatcgttttcaaaattggtctggaacaaattagaaaaagaaaccaaaaagcacaccagtgtcattcagc

SEQ ID NO: 21714 - DNA, 472 bp, Homo sapiens
  chr15.fa.O7frz.96744253
  Located on chromosome 15
  Distance between a terminus base of telomere on chromosomal short arm and 5'-terminus of this base sequence : 95332071
  Distance between 3'-terminus of neighbour sequence of sequence listing upward to telomere on chrosomal short arm and 5'-terminus of this base sequence : 140820
ttggtcaattcaactgagtaaccaatcaagttaacaaatatatcaattctagcttgctttttagatgaaaaagatctggcagcatgcaagaaagatggatggatggcggatggatggatggatggatggatggatggatggtggctgggtggatggatggatggatggattgatggatagtggatggatggaggatggatgggtgatggatggatggatggatggatggatggatggatggatggatggtggatgaatggatggatggtggatggatggatggatggatggatggatggatggatggatggatgggtggatgggtgggaggtgggtggatggatatgcgaattgagaacaacagagaaagagagagaaggtgagagaggaattcttgctgatatgatctgtttcaaaccccttcctaactataggctccagattttagctatcttcagtaggactcatgtca

SEQ ID NO: 21715 - DNA, 404 bp, Homo sapiens
  chr15.fa.O7frz.96946915
  Located on chromosome 15
  Distance between a terminus base of telomere on chromosomal short arm and 5'-terminus of this base sequence : 95460345
  Distance between 3'-terminus of neighbour sequence of sequence listing upward to telomere on chrosomal short arm and 5'-terminus of this base sequence : 127802
tcaggctatcagtgtaaatcaggaaacggcttccaggaagagaaagtgagagtgaaagcaaccgacagagagcaggcagggccaggagagagggctgcaggctccctcgcaggggaaccccaaagagcacattctttggggagtgaccaccctccggagcgaggagccttggggatgggatccttgccagtgcagtgtgtgtatgtgtgcgtcagtgcagtgtgtgtaagtgtgcgtgtgtgtgtgtgtgtgtatgtgtgtgtgtacatgcgcatgagctgagagagagaggaggaggagcaggaggtggcggaggcagggcagaaggtatcttttcccattgagacttttttttggtcttttaaaacctcttccgcgagctcagtctttgtaaacatacctgt

SEQ ID NO: 21716 - DNA, 138 bp, Homo sapiens
  Z67468
  Located on chromosome 15
  Distance between a terminus base of telomere on chromosomal short arm and 5'-terminus of this base sequence : 95774256
  Distance between 3'-terminus of neighbour sequence of sequence listing upward to telomere on chrosomal short arm and 5'-terminus of this base sequence : 313507
tgtcttcaagtgggggtttgatgagagagagagagagtgtgtgtgtgtgtgtgtgtgtgtgtgtttacagaaaatatgctaggtttgtacattcaaatttgtgttatcctcttcaagaaagtcaccttggtagacagc

SEQ ID NO: 21717 - DNA, 163 bp, Homo sapiens
  D15S120
  Located on chromosome 15
  Distance between a terminus base of telomere on chromosomal short arm and 5'-terminus of this base sequence : 95952159
  Distance between 3'-terminus of neighbour sequence of sequence listing upward to telomere on chrosomal short arm and 5'-terminus of this base sequence : 177765
  misc_feature (1)...(163): n = A,T,G or C
tttgtgatggtcttttataggcatatgtattattattatggtagaatgtgatatacatttgcataaacacacacnacacacacacacacacacacacacacacacaggctgcatcctcaaaatactctcctgatgggagtgctcagtgcaaacactttgagcc

SEQ ID NO: 21718 - DNA, 401 bp, Homo sapiens
  chr15.fa.O7frz.97490817
  Located on chromosome 15
  Distance between a terminus base of telomere on chromosomal short arm and 5'-terminus of this base sequence : 96060314
  Distance between 3'-terminus of neighbour sequence of sequence listing upward to telomere on chrosomal short arm and 5'-terminus of this base sequence : 107992
gatttcaaggtttacttagttacctacatttttaacctgtggatacctaagtttggacatccatcatgtaacctagagagaggggagaaggaagaaaagggcccaggagctccgaggaagaccaacagtctaagccagggccttgctcaaattttcccagttgtgattttggggccgagggagagcacacagaggggctaacagctgttgctgttaacttgcttcattcattcattcattcattcattcattcattcattatttttcaagcttcttgaaggaaatagagacttaatatttgtaaactaaatttattctggcaattacatattatgccaaaagctttagaataaaaattactagttgggaatttttattagacgttgagcttctagatagtt

SEQ ID NO: 21719 - DNA, 338 bp, Homo sapiens
  chr15.fa.O7frz.97884696
  Located on chromosome 15
  Distance between a terminus base of telomere on chromosomal short arm and 5'-terminus of this base sequence : 96408716
  Distance between 3'-terminus of neighbour sequence of sequence listing upward to telomere on chrosomal short arm and 5'-terminus of this base sequence : 348001
ttgtccttcataatcttgtgagtcaatttccataataaatctatctatctatctatctatctatctatctatctatctatctatctatctgtctgtctgtctagctagctagctatgtagctatttttctgtctatccacctgctatctctctatcatctatctatctatcatctatctatctatctatcatctatctatctatcatctatctatcatctatctatctatctatcatctatctatctaccatctctctatctcctattcgatctgtttctttggagagctctaataaggtatctcagtcagttagagatgctatagcaagatactgca

SEQ ID NO: 21720 - DNA, 433 bp, Homo sapiens
  U49020.1_340
  Located on chromosome 15
  Distance between a terminus base of telomere on chromosomal short arm and 5'-terminus of this base sequence : 96732202
  Distance between 3'-terminus of neighbour sequence of sequence listing upward to telomere on chrosomal short arm and 5'-terminus of this base sequence : 323148
tacttgcaagccatctgacctctctcttttttttccttcagtgctggagggcagttatctcagggttccaatttatccattaataccaaccaaaacatcagcatcaagtccgaaccgatttcacctcctcgggatcgtatgaccccatcgggcttccagcagcagcagcagcagcagcagcagcagcagccgccgccaccaccgcagccccagccacaacccccgcagccccagccccgacaggaaatggggcgctcccctgtggacagtctgagcagctctagtagctcctatgatggcagtgatcgggaggatccacggggcgacttccattctccaattgtgcttggccgacccccaaacactgaggacagagaaagcccttctgtaaagcgaatgaggatggacgcgtgggtgacctaaggcttccaag

SEQ ID NO: 21721 - DNA, 393 bp, Homo sapiens
  chr15.fa.O7frz.98189055
  Located on chromosome 15
  Distance between a terminus base of telomere on chromosomal short arm and 5'-terminus of this base sequence : 96794141
  Distance between 3'-terminus of neighbour sequence of sequence listing upward to telomere on chrosomal short arm and 5'-terminus of this base sequence : 61506
taagtgaaatgtgactttggagtttggaaggagaaagaaagaaggaaggaagaaagggagggagggaagaaaggaaggaaggaagaaaggaaggaaagaaggagaaaaggaaaaggaaaagaaaggaaaggaagaaggaaggaagaagaaatggagggaggggagggacagagggagggaaggaggaaaggaaagaagcaaagaaggaaggaagcagaaaaggaaaaggaaggaaggaaaaggaaagaaaggaaggaaacgaaggaaaggaaggaaacaaaggaaagaaaaaggaaaggaaaagaaagtaaagaaaaaaaggaaaggaattaatatacatccaaccattaaaaatgatgacgccagaaaatatttactgcaacagaaatatgc

SEQ ID NO: 21722 - DNA, 136 bp, Homo sapiens
  chr15.fa.O7frz.98530929
  Located on chromosome 15
  Distance between a terminus base of telomere on chromosomal short arm and 5'-terminus of this base sequence : 97174987
  Distance between 3'-terminus of neighbour sequence of sequence listing upward to telomere on chrosomal short arm and 5'-terminus of this base sequence : 380453
actagtcctgactaactccaagacacacacacacacacagacacacacacatacatacatatatatatatatatatatccagtaaagacgtgtggaatgtatgaatgggatgaatactttcatctgtaaaccagtg

SEQ ID NO: 21723 - DNA, 301 bp, Homo sapiens
  chr15.fa.O7frz.99910169
  Located on chromosome 15
  Distance between a terminus base of telomere on chromosomal short arm and 5'-terminus of this base sequence : 97306881
  Distance between 3'-terminus of neighbour sequence of sequence listing upward to telomere on chrosomal short arm and 5'-terminus of this base sequence : 131758
catgtaaattccttacaaagaaaggtggaaaataagggttttttgtttggagggggtgagggggtgtgtgtgtgtgtgtgtgtgtgtgtatgtgtgtgtgtgcgcatgcacgcgcacgtgcatttacgatatatgattaagatcccaaatgaaaacagacctgatgaaatttggagtctaaaatcagtccccatactagaaaggaggtatgacccatgcctgcattcttgaatacagcaggccagggtagggaagccgggctggaccttcctatccatggttacagccatgtagataccaa

SEQ ID NO: 21724 - DNA, 229 bp, Homo sapiens
  AC027020.3_8973
  Located on chromosome 15
  Distance between a terminus base of telomere on chromosomal short arm and 5'-terminus of this base sequence : 97423773
  Distance between 3'-terminus of neighbour sequence of sequence listing upward to telomere on chrosomal short arm and 5'-terminus of this base sequence : 116591
aaataactcatatgcaccattaagaaggaagaaaccgaatgtgatagaaaagcaggcaaaggacatgaacaggcaatttacaaaaaagtcaacacaactgacgactatactatactatactatactatactatactatactatactatactatatgctcaatcttagtaatcagtaaaatgcaaattcaaataataagataaaatctcatgtgcattaacctagtaaat

SEQ ID NO: 21725 - DNA, 418 bp, Homo sapiens
  AC027020.3_174196
  Located on chromosome 15
  Distance between a terminus base of telomere on chromosomal short arm and 5'-terminus of this base sequence : 97476836
  Distance between 3'-terminus of neighbour sequence of sequence listing upward to telomere on chrosomal short arm and 5'-terminus of this base sequence : 52834
agtcagatttagtgacctggttccaataaaaaatacaaggttggaaatgacgtgatgtgactactgaggctgtttatgaaaaaagatgcagcatctctctagcactctcttgaaatgctcacccttgaaatgcaggtgccatgcgatgaggaggccaaggccaactagaggggctgtgggtattccagcggacagcccccagctgaagtcccagccaataagcacaagcagcatcagccagctgattttcttatcttctttccttctttccttccttccttccttccttccttccttccttccttccttccttccttccttcctccctccctccctccctccctccctctctccctctctccctctctccctctctctttctctctttctttctttctttcttgatggagtctttctc

SEQ ID NO: 21726 - DNA, 187 bp, Homo sapiens
  chr15.fa.O7frz.100157051
  Located on chromosome 15
  Distance between a terminus base of telomere on chromosomal short arm and 5'-terminus of this base sequence : 97584062
  Distance between 3'-terminus of neighbour sequence of sequence listing upward to telomere on chrosomal short arm and 5'-terminus of this base sequence : 106808
actacctgaatccattacttcagctctgccactttactggctgggtgatcttgggcaagctacttaatctccatgtctgcaaaacaagaataataataataataataataataataatgataataggacctactttctaacattgttacaaggattagaagagcacttaacagtggctagcaagtag

SEQ ID NO: 21727 - DNA, 453 bp, Homo sapiens
  AC025229.4_142014
  Located on chromosome 15
  Distance between a terminus base of telomere on chromosomal short arm and 5'-terminus of this base sequence : 97728630
  Distance between 3'-terminus of neighbour sequence of sequence listing upward to telomere on chrosomal short arm and 5'-terminus of this base sequence : 144381
tagaaaggtcactgtaacagctgtgtctaggccagatgggaggagaggaagatgaagagtgcagagctggatatggcaagattgacataggggcagactctagagaatttaggagaaagaatcactaaaagtaggtgacctgacccagtaggagtgtgtgcatgtgtgtgtgtgtgtatgcacacaaagttttgtgtatgtgtgtgtggtgttggaggtggaggtggaggtggtggtgaagactgtggaggtgatggaggtggaggtggtgttggtggtggtggtggtggtgatggaagctagaggtgacaatgatggtgatggtggtggaagagaagctagaggcgaagatgaggcagtggaggtgatagtggtggaagagaagctagaggcgaagatgaggcagtggaggtgatgatagtgttgatgttgttagtggtagaggtggaggta

SEQ ID NO: 21728 - DNA, 443 bp, Homo sapiens
  chr15.fa.O7frz.100358098
  Located on chromosome 15
  Distance between a terminus base of telomere on chromosomal short arm and 5'-terminus of this base sequence : 97850346
  Distance between 3'-terminus of neighbour sequence of sequence listing upward to telomere on chrosomal short arm and 5'-terminus of this base sequence : 121263
ttatttcaaagcagattccagacatcataccattttgtctgcaaatactgaagtatatatatatatatatatatatatatatatatatatatatatctccaaaaaattggaattgttttttaaaaatcatatgcacaatatcattaccacatgtaattttcaaacaaaaagcccttaaaatcatcaatactcaaggtttctcctgaatgtgagcactgtggggtgagagttaggggtcagggctcaggctcagagttttaggatgaggccatcctagaaatctacaatcttgctggaactcactgttccaacctacaagcccccttactttgtcccttctccttccttaaagccttccagttctgctttaagtctgaaatatagaaaaaatttggatgtgcttggcagatgcccctggtcccttactcattagcttggtttca

SEQ ID NO: 21729 - DNA, 333 bp, Homo sapiens
  chr15.fa.O7frz.100546085
  Located on chromosome 15
  Distance between a terminus base of telomere on chromosomal short arm and 5'-terminus of this base sequence : 98095789
  Distance between 3'-terminus of neighbour sequence of sequence listing upward to telomere on chrosomal short arm and 5'-terminus of this base sequence : 245000
ttggaattagtgttgaaatcagggctcaaagtgtggggtctggggtacaggctgcagaggctgacaggagccacgtgtgtgcgtgtgtgtgtgtgtgtgtgtgtgtgtgtgtgtgtgtgtattctctcgtggtggacacatctgtcttcagcaaccctggcctccgggagctccctcctgagctggggcagctgggcaacctctggcagctggacactgaagacctgaccatcagcaatgtgcctgcagaaatccaaaaagaaggtagggcttccgcagccctgtcccctgccatcacctcttggaaagacaactccagtccacttgttaagt

SEQ ID NO: 21730 - DNA, 352 bp, Homo sapiens
  chr15.fa.O7frz.100788066
  Located on chromosome 15
  Distance between a terminus base of telomere on chromosomal short arm and 5'-terminus of this base sequence : 98376643
  Distance between 3'-terminus of neighbour sequence of sequence listing upward to telomere on chrosomal short arm and 5'-terminus of this base sequence : 280521
tccactcctagactcatttagaccatgttgctatctatctatctatctatctatctatctatctatctatcatctatcaatctatcatctatctatctatctctgtcgtttttgattgattgattgagacagggtctcgctctatttctcaggctggctgcaaatgcctgggctcaagccatcctcttgcttctaacctctcagaatgttaggattacaggtgtgagccactgtggctggcccttttatttttttaagttctgtccaccccccctcccatttcaggtgtgtcttctgtacaaagtgccattctcaccagtcctttgaagagtcgcaagatacaaagtcagta

SEQ ID NO: 21731 - DNA, 383 bp, Homo sapiens
  chr15.fa.O7frz.100680405
  Located on chromosome 15
  Distance between a terminus base of telomere on chromosomal short arm and 5'-terminus of this base sequence : 98488134
  Distance between 3'-terminus of neighbour sequence of sequence listing upward to telomere on chrosomal short arm and 5'-terminus of this base sequence : 111139
gacctaaacttcatgtcactagagtggacaggaggagaggaaaaagggccaggagtggtggctcacacctgtaatcccagccctttgggaggccaaggccggaggattgcttgtgcccaggagttcgaggttacagtgagctatgactgccccactgcactccagcctgagcaacacagcgagaccctgtctctaataatggaggaggagtgaggaggaggaggaggaggaggaggaggaggaggaggaaaaaaagtagtgggggctggaaaagttctcgaagaaataatggctaaacgctctccaaatttggcaagagatataaacctacagattcaccaagtttactttcaagttttctaaattacatttgatggttgaag

SEQ ID NO: 21732 - DNA, 354 bp, Homo sapiens
  DISO7_00044446
  Located on chromosome 15
  Distance between a terminus base of telomere on chromosomal short arm and 5'-terminus of this base sequence : 98689492
  Distance between 3'-terminus of neighbour sequence of sequence listing upward to telomere on chrosomal short arm and 5'-terminus of this base sequence : 200975
cctgtcatggtctaggagtgttcttaaagtgaacacaaagatttaaaactcttgatgtgcatgattttgtgggggttttctgcgtcaagtgaacagtaaaccactttcacaggtcaccagagaccgcttataggcagagctcccattctctttagatgtaaccttctcctctggttggatggaacaggggccatggtaaaagttgcccacaagacccagaaatgcgtgcgtgagtgcatgcgcgcgcgcgcgcgcacacacacacacacacacacacacacacacccatggagagcctctccaacagagcagagggaagacaggacagactcttcacatggaaggctcagaaca

SEQ ID NO: 21733 - DNA, 124 bp, Homo sapiens
  DISO7_10006120
  Located on chromosome 16
  Distance between a terminus base of telomere on chromosomal short arm and 5'-terminus of this base sequence : 114993
  Distance between 3'-terminus of neighbour sequence of sequence listing upward to telomere on chrosomal short arm and 5'-terminus of this base sequence : 0
cagcagctgcagagactgggcattcccaacacacacacacacacacacacacacacacagacacacacagacacataaacacacacacagacacacagacacacgagtcgctgtcaggactggt

SEQ ID NO: 21734 - DNA, 242 bp, Homo sapiens
  DISD22_0010053
  Located on chromosome 16
  Distance between a terminus base of telomere on chromosomal short arm and 5'-terminus of this base sequence : 1751405
  Distance between 3'-terminus of neighbour sequence of sequence listing upward to telomere on chrosomal short arm and 5'-terminus of this base sequence : 1636288
attcagtcaattgaatccagacattttcagtcaacggccagcaaggttccggctggttcgttcattcattcattcattcattcattgattcattcattcattgcacggataactcactaagcacccgccacaggtcaggcactgctccagacaccaagaatacggcagtgaacgcacaggcaaatgtccctgctctcctggatccgcaagagggcacgacccagggaacaggtttcagagcc

SEQ ID NO: 21735 - DNA, 227 bp, Homo sapiens
  D16S3024
  Located on chromosome 16
  Distance between a terminus base of telomere on chromosomal short arm and 5'-terminus of this base sequence : 2055251
  Distance between 3'-terminus of neighbour sequence of sequence listing upward to telomere on chrosomal short arm and 5'-terminus of this base sequence : 303604
agctgccagtatatggaggagcctgctggcaacaggggagccgctgaccagcgctgcatcgcgctgcaagggcgtgtgtgtgtgtgtgtgtgtgtgtgtgtgtgtgtgtgtgtgtggaggggggagcagttcctaaggggccacttagccactttcacctgaaggattaatgcattaattacaaaaatggatgaaggagtgtcttctttgcaggtggcacagcatgt

SEQ ID NO: 21736 - DNA, 437 bp, Homo sapiens
  AL031710.10_27300
  Located on chromosome 16
  Distance between a terminus base of telomere on chromosomal short arm and 5'-terminus of this base sequence : 2175851
  Distance between 3'-terminus of neighbour sequence of sequence listing upward to telomere on chrosomal short arm and 5'-terminus of this base sequence : 120373
catgtattccagctctttgtactgctgcctgtttctgtaatgggccccagattgtgtgtggaaataagtaaatcaggccactgtggccccatagcacttttgcttcagagtgaattctgacccccagatcacaagtctgtggtcctgaaggtccttcctgaatcttttgaacagagctcctgcagcccctggggtccccacctcttcacactgctgaggagtgatggctccttctcaggcaggagggtgggcccgctggtgtagccccattgaagtgacagcgcctaggtggggggcacagctgatcagggtgtctgtcccctgcaaggcgaagtagcagaaagggtttattattattattattattattattattattattataagaacagttggtttacttacctttaaaagtctttgcttaaactctactgtca

SEQ ID NO: 21737 - DNA, 399 bp, Homo sapiens
  chr16.fa.O7frz.4005530
  Located on chromosome 16
  Distance between a terminus base of telomere on chromosomal short arm and 5'-terminus of this base sequence : 2483725
  Distance between 3'-terminus of neighbour sequence of sequence listing upward to telomere on chrosomal short arm and 5'-terminus of this base sequence : 307437
aaataactcagcatccgtagtccgtgcccagggacctggagtggttcctgcgtgctgcatgtctggcaccccgtactagagggagcagaagagggcatgagcacacaaggcacaggctttgacctttggaagcctatcccatgggaaatttactgaggtgacaacagaaggaagggcccatgtcttgggagtgctgtcatggccatgtttcagcaccatttatattaaacacacacacacacacacacacacacacacacacacatatatttttttttttttttttgagatagagtctcgctctgtcacaaaggctggagtgcagtggcacaatcctgactcactgcaacctccacctcccgggttccagcgattctcctgtcttggccttccaagtag

SEQ ID NO: 21738 - DNA, 287 bp, Homo sapiens
  DISO7_10006144
  Located on chromosome 16
  Distance between a terminus base of telomere on chromosomal short arm and 5'-terminus of this base sequence : 2773378
  Distance between 3'-terminus of neighbour sequence of sequence listing upward to telomere on chrosomal short arm and 5'-terminus of this base sequence : 289254
aagagtgcccgctacaaccgcttctccggggggcccagcaatcttcccaccccagacgtcaccacaggggtaagggtgtgcccctctgcaagcccaacatccccaggacccccagcatgccccagggatctggtgttgcctgcagagctcccagcgcagtcccgtcccgagctggggtctcaggggagctcggtgggggggggtgtggtgtgtgtgtgtgtgtgtgtgcgcgcgcgcgcgcgcgcgcgcacgcgtgcgtgtgtggttggggcgtgttagtgctgtgt

SEQ ID NO: 21739 - DNA, 358 bp, Homo sapiens
  DISO7_00003527
  Located on chromosome 16
  Distance between a terminus base of telomere on chromosomal short arm and 5'-terminus of this base sequence : 2900024
  Distance between 3'-terminus of neighbour sequence of sequence listing upward to telomere on chrosomal short arm and 5'-terminus of this base sequence : 126359
gctcatgcatctgcttatgtgtttcctcactcatcagtgtctccggccaccatgcacagctaatttttgtatttttagtagacatagggtttcaccatgttggccaggctgatctggaactcctgacctcaagtgatccacccaccttggcctctcaaagtgctgggattacaggcatgaaccaccaaggctggcagaggaggtgattttttaatattatgtgaattacatcacacacacacacacacacacacacacacacacacacacaccccttcctagagctccccgccgattaggaaacacaactgaggctgcagcaggcaggaggcaccccccggctggcttagcaacattg

SEQ ID NO: 21740 - DNA, 401 bp, Homo sapiens
  chr16.fa.O7frz.2850461
  Located on chromosome 16
  Distance between a terminus base of telomere on chromosomal short arm and 5'-terminus of this base sequence : 3306766
  Distance between 3'-terminus of neighbour sequence of sequence listing upward to telomere on chrosomal short arm and 5'-terminus of this base sequence : 406384
cacaagcatcagaaaggaggctaggccaggcgcagtggctcacacctggaatcccagctcttcgggaggccgaggcaggcagatctcttgaggccagaagttcaagaccaacctggccaacacggcaaaaccccgtttctactaaaaatgcaaaacttagctgggcgtggtggcaggtacctgtagtcccagctattcagaaggcccaggtgggagaatcaaatgaacccgggaggcagaggttgcaatgagtcaagatcatgccactgcactctagcctgggcaacagagcaagacttctatcttaaacaaacaaacaaacaaacaacaacaacaataacaaacaacaacaacaacaaaaaccaacctgggaaagcaatgttaatactgaacataggctg

SEQ ID NO: 21741 - DNA, 394 bp, Homo sapiens
  AC004233.1_11166
  Located on chromosome 16
  Distance between a terminus base of telomere on chromosomal short arm and 5'-terminus of this base sequence : 3561047
  Distance between 3'-terminus of neighbour sequence of sequence listing upward to telomere on chrosomal short arm and 5'-terminus of this base sequence : 253880
gcttactcattgtttcagaataacaggctgggcgaggtggtcacgcctgtaatcccagcaatttggcaggctgaggcgggcaggtcacttgagctcagaagttagagaccagcctgggcaatatggcaaaaccctgtctctacaaaacattcaaaaattagctgggcatggtggtgtgtacctgtgctcccagctagtcaagagggtgaggtgggaggatcgcttgagcccaggaggtggatgctgcagtgtgccgagatggcgccactgcactccagcctgggcgacagagcgagactcggtctcaaattaataataataataataataataataataataataataataataaaatagtaagaccccctcatctgtacagtctgttgcagtt

SEQ ID NO: 21742 - DNA, 163 bp, Homo sapiens
  D16S3070
  Located on chromosome 16
  Distance between a terminus base of telomere on chromosomal short arm and 5'-terminus of this base sequence : 3629471
  Distance between 3'-terminus of neighbour sequence of sequence listing upward to telomere on chrosomal short arm and 5'-terminus of this base sequence : 68030
cacgggaggtggaggttgcagtgagcccagactgtgccactgcactccagcctgggcgacagagtgagactccattaaacacacacacacacacacacacacacacacacacacaaaacaacaacaacaaaaaaaccctccttgctctcttaaaccactttca

SEQ ID NO: 21743 - DNA, 166 bp, Homo sapiens
  AJ003147.1_3176
  Located on chromosome 16
  Distance between a terminus base of telomere on chromosomal short arm and 5'-terminus of this base sequence : 3629529
  Distance between 3'-terminus of neighbour sequence of sequence listing upward to telomere on chrosomal short arm and 5'-terminus of this base sequence : -105
acagagtgagactccattaaacacacacacacacacacacacacacacacacacacaaaacaacaacaacaaaaaaaccctccttgctctcttaaaccactttcagagctgcctgggagcccactctgctctcccagaaagcctcatcgttgagtaatcaaactct

SEQ ID NO: 21744 - DNA, 200 bp, Homo sapiens
  D16S3082
  Located on chromosome 16
  Distance between a terminus base of telomere on chromosomal short arm and 5'-terminus of this base sequence : 3652761
  Distance between 3'-terminus of neighbour sequence of sequence listing upward to telomere on chrosomal short arm and 5'-terminus of this base sequence : 23066
gtttcgaggacagccctggccggtctttccaggctgtgaggggctcctgggactgctgtctcctcttatcctgtacctctgccatgtgtctctgtgtgtgtgtgtgtgtgtgtgtgtgtgtgtgtgtgtgtgtataaattatcctggaggaaaggttaaggtgacacatggagacagagtgtcaccgttatttccgcagg

SEQ ID NO: 21745 - DNA, 335 bp, Homo sapiens
  AC009115.5_64769
  Located on chromosome 16
  Distance between a terminus base of telomere on chromosomal short arm and 5'-terminus of this base sequence : 3770055
  Distance between 3'-terminus of neighbour sequence of sequence listing upward to telomere on chrosomal short arm and 5'-terminus of this base sequence : 117094
tataagtgcatttgcctatcactaaggtaaaaggatttccaggcaggatagtgatgtcagaaatcacaaaggaaatgtacagattttacccaagtttttaaaacggcaaatgacaatccaaagaaaatacaatctgaatgacaaatcaagggcttattaccgggcttcatagttttgttttgttttgttttgttttgagacacagtttcgctcttgttgcccaggctggagtgcagtggcacaatctcggctcactgcaacctccgcctcctgggttcaagcaattctcctgcctcagcctcccgagtagctggaactacaggcttgagtcacca

SEQ ID NO: 21746 - DNA, 262 bp, Homo sapiens
  AJ003147.1_226098
  Located on chromosome 16
  Distance between a terminus base of telomere on chromosomal short arm and 5'-terminus of this base sequence : 3852418
  Distance between 3'-terminus of neighbour sequence of sequence listing upward to telomere on chrosomal short arm and 5'-terminus of this base sequence : 82028
ataaggaaccttgagccagtaccgaaggaaacacgtcccagacctatctccaaacacacacacacacacacacacacacacacactgcaggcataacatttatgcagacagactgttctttagggcataattgtctcatgtctcaattcctctgaagctccagagcagaaactgaaattttaaaaatgcagttgagataaactgaaatgactgacaggccatttgccaagaaaagctttggttctttggaacaaagacagtg

SEQ ID NO: 21747 - DNA, 403 bp, Homo sapiens
  AC004232.1_9102
  Located on chromosome 16
  Distance between a terminus base of telomere on chromosomal short arm and 5'-terminus of this base sequence : 3865641
  Distance between 3'-terminus of neighbour sequence of sequence listing upward to telomere on chrosomal short arm and 5'-terminus of this base sequence : 12961
aacagtttccaacctatctaggacattgaggacttacagtgttaagaaagtagaatctgtactggtttcaaaggcgcttacttctcttcactacttacttttcaccaaagccctaaagtagcagttcttagtctttttggcggtttttagaacttgatgaaagctatgaacccacttactagaacatacagatacacacacacacacacacacacacacacacacacacacacacacacatccaattttgcatacagtatcaaaaggtttacaaaaatctccaaacccatccatggatcctctggaactgcattggccagtatggtaatacttggcaagactaactccattttaagtgcccattggctaccatcacagaaagttctattggatagcactgctc

SEQ ID NO: 21748 - DNA, 311 bp, Homo sapiens
  AC004778.1_9290
  Located on chromosome 16
  Distance between a terminus base of telomere on chromosomal short arm and 5'-terminus of this base sequence : 4261943
  Distance between 3'-terminus of neighbour sequence of sequence listing upward to telomere on chrosomal short arm and 5'-terminus of this base sequence : 395899
ggaaccatcctagaaatctcacgtctaggccaggtgtggaggctcatgcctataatcccagtactctgggaggccagatcacttgaggccaggagtttgagaccagcctggccaacatagcgaaaatctgtctctactaaaacacacacacacacacacacacacacacacacaaataaccgggtgtggtggcacacagctactcaggaggctgaggcacgagaattgcttgaacccgggaggtggaggctgcagtgagccgagatcacgccattgcactccagcctcagtgacaggagacactgtcctag

SEQ ID NO: 21749 - DNA, 85 bp, Homo sapiens
  D16S3084
  Located on chromosome 16
  Distance between a terminus base of telomere on chromosomal short arm and 5'-terminus of this base sequence : 4262052
  Distance between 3'-terminus of neighbour sequence of sequence listing upward to telomere on chrosomal short arm and 5'-terminus of this base sequence : -202
ggccaacatagcgaaaatctgtctctactaaaacacacacacacacacacacacacacacacacaaataaccgggtgtggtggca

SEQ ID NO: 21750 - DNA, 348 bp, Homo sapiens
  AC005211.1_4699
  Located on chromosome 16
  Distance between a terminus base of telomere on chromosomal short arm and 5'-terminus of this base sequence : 4322162
  Distance between 3'-terminus of neighbour sequence of sequence listing upward to telomere on chrosomal short arm and 5'-terminus of this base sequence : 60025
gtcgtataatttcatgtgccacaaaatatcatttgatcgctttccaaccatttgaaaatgtaaaagttctatggcctccgtaacaagttactacaagcttagtggcataaaacaacataaatttgaccaggaatcatggctcatgcctgtaatctcagcactttgggaggctgatgcaggaggatcacttgaggccagcagttggagaccagcctgggcagcaacatagggaaattccatctccacaaatatatgtctgtgtgtctgtgtgtgtgtgtgtgtgtgtgtgtgtgtgtataattttaaaaaacaacacaaatttattctctgaaggtcagaagtccagat

SEQ ID NO: 21751 - DNA, 241 bp, Homo sapiens
  AC009171.4_73357
  Located on chromosome 16
  Distance between a terminus base of telomere on chromosomal short arm and 5'-terminus of this base sequence : 4327287
  Distance between 3'-terminus of neighbour sequence of sequence listing upward to telomere on chrosomal short arm and 5'-terminus of this base sequence : 4777
cagtggcttatgtctgaagtcctggctactcaggaggctgaggcgggaggattgcttgagcctaggagttaaggctgcagtgagtcgtgatcatgccactgcacttcaacctgagcaacagagcaagaccatgtctcaaataaataaataaataaataaatacaaataaaaggtgggtctctgtaaagaaagtaatcagcagagtgtggtggcacacatctgtaatttcagctactccaga

SEQ ID NO: 21752 - DNA, 233 bp, Homo sapiens
  AC005211.1_9696
  Located on chromosome 16
  Distance between a terminus base of telomere on chromosomal short arm and 5'-terminus of this base sequence : 4327295
  Distance between 3'-terminus of neighbour sequence of sequence listing upward to telomere on chrosomal short arm and 5'-terminus of this base sequence : -233
tatgtctgaagtcctggctactcaggaggctgaggcgggaggattgcttgagcctaggagttaaggctgcagtgagtcgtgatcatgccactgcacttcaacctgagcaacagagcaagaccatgtctcaaataaataaataaataaataaatacaaataaaaggtgggtctctgtaaagaaagtaatcagcagagtgtggtggcacacatctgtaatttcagctactccaga

SEQ ID NO: 21753 - DNA, 359 bp, Homo sapiens
  chr16.fa.O7frz.7277862
  Located on chromosome 16
  Distance between a terminus base of telomere on chromosomal short arm and 5'-terminus of this base sequence : 4524514
  Distance between 3'-terminus of neighbour sequence of sequence listing upward to telomere on chrosomal short arm and 5'-terminus of this base sequence : 196986
gtattcagctatcctgaagctaatgcaaaccctggtgtgtgtgtgtgtgtgtgtgtgtgtgtgtgtgtgtgtgtttatggaggcttcattacaaaggcataattgaatacgttattggccactggtgatcaactcaacctttagaccttctcccgtcccctgaggttaagggggtagggctgaaagttcccaccctctaatcacatggttggttccccaggcaatcagcccccatctaggagcccaccaagagttacttacttacaacaaaagatgctcctattacccaggaaattccaagggatttaggaaattacaaaagttttaggagctctgtgtcaggaactgaggttaaagac

SEQ ID NO: 21754 - DNA, 229 bp, Homo sapiens
  AC006111.2_16325
  Located on chromosome 16
  Distance between a terminus base of telomere on chromosomal short arm and 5'-terminus of this base sequence : 4729600
  Distance between 3'-terminus of neighbour sequence of sequence listing upward to telomere on chrosomal short arm and 5'-terminus of this base sequence : 204727
ttaacaatcagctttcgtgaactggtacaaacaaatttaggcacactactgatcctagcctcttttctagtgcaaaatggcaaatggtagagttatttaaaattaactttaaaattaaaaaaaaaccacacacacacacacacacacacacatcttgatttgcctcaaaagcatggttctgggaatatggtggtggatcaactcaatgttacttcatgtatccagctgc

SEQ ID NO: 21755 - DNA, 229 bp, Homo sapiens; identical to SEQ ID NO: 21754
  AC004644.1_20544
  Located on chromosome 16
  Distance between a terminus base of telomere on chromosomal short arm and 5'-terminus of this base sequence : 4729600
  Distance between 3'-terminus of neighbour sequence of sequence listing upward to telomere on chrosomal short arm and 5'-terminus of this base sequence : -229

SEQ ID NO: 21756 - DNA, 235 bp, Homo sapiens
  AC004645.1_13711
  Located on chromosome 16
  Distance between a terminus base of telomere on chromosomal short arm and 5'-terminus of this base sequence : 4809115
  Distance between 3'-terminus of neighbour sequence of sequence listing upward to telomere on chrosomal short arm and 5'-terminus of this base sequence : 79286
gtttcttgtaaggatggtagtgacaacttctaagctcctgacatgcctcactgaagaatgaaagtcctttgccttcattttttaatgatatttttggtagataaaaataattccagttgaccagtttttgtgagtgtgtgtgtgtgtgtgtgtgtgtgtgtgtgtgtgtttttcccagtactttaaagatgttacttctttgtctttccgcttacagcagaagtatcatgtcatt

SEQ ID NO: 21757 - DNA, 235 bp, Homo sapiens; identical to SEQ ID NO: 21756
  AC006111.2_95847
  Located on chromosome 16
  Distance between a terminus base of telomere on chromosomal short arm and 5'-terminus of this base sequence : 4809115
  Distance between 3'-terminus of neighbour sequence of sequence listing upward to telomere on chrosomal short arm and 5'-terminus of this base sequence : -235

SEQ ID NO: 21758 - DNA, 83 bp, Homo sapiens
  G07934
  Located on chromosome 16
  Distance between a terminus base of telomere on chromosomal short arm and 5'-terminus of this base sequence : 4830865
  Distance between 3'-terminus of neighbour sequence of sequence listing upward to telomere on chrosomal short arm and 5'-terminus of this base sequence : 21515
actgcatccctttaaacacttttttttttagatagatagatagatagatagatagatagactctcactccttcacccaagcta

SEQ ID NO: 21759 - DNA, 158 bp, Homo sapiens
  D16S3065
  Located on chromosome 16
  Distance between a terminus base of telomere on chromosomal short arm and 5'-terminus of this base sequence : 4943418
  Distance between 3'-terminus of neighbour sequence of sequence listing upward to telomere on chrosomal short arm and 5'-terminus of this base sequence : 112470
tacatccataagtacccttaacaattaaaaatttaaaaaaaaaattctctctgaaacacaaacacacacacacacacacacacacacacacacacacacgttagttactgaaagagaactgtttcagtgcagtggttctatactggggatacacttca

SEQ ID NO: 21760 - DNA, 349 bp, Homo sapiens
  AC004495.1_14825
  Located on chromosome 16
  Distance between a terminus base of telomere on chromosomal short arm and 5'-terminus of this base sequence : 4994965
  Distance between 3'-terminus of neighbour sequence of sequence listing upward to telomere on chrosomal short arm and 5'-terminus of this base sequence : 51389
tctagtcagacagttcctatcgagcagcagaccttcccagcaaggagaccactaggcagctatcacgttgccacccgcccctagctctcttcagcagtgatgctcttatctttaggacactggaagttgaaaaggctgtggcaacacacacacacacacacacacacacacacacacactcatctaggaacatgaagtgtgttaaagtctttcaggagggaggtactgtgcagtggtgacacacacagggccacgttctcccaagccaaaggtaagagacacaagccacaaggaaatcagacatgtgcggttaacaggtgccaccaacatcgactgctaaatggagttt

SEQ ID NO: 21761 - DNA, 403 bp, Homo sapiens
  AC005736.1_214480
  Located on chromosome 16
  Distance between a terminus base of telomere on chromosomal short arm and 5'-terminus of this base sequence : 5098432
  Distance between 3'-terminus of neighbour sequence of sequence listing upward to telomere on chrosomal short arm and 5'-terminus of this base sequence : 103118
aagtgctaagattatagatgcaagccaccacacccagccattttatttatttatttatttatttatttatttatttatttatttatggagatggagtctcactctgttgctcaggctggagtgcagtggcacgatctctgctcactacaacctctgcttccccagttcaagtgattctcctgcctcagccttctgagtagctgggattacaggtatgtgccaccatgtctggctaatttttgtattttagtagagatggggtttcaccgtgtaggtcgggctggtctcgaactcctgacctcaggtgatctgcccgccttggcctcccaaagggcagggattacaggcgtgagccacagcgcccagccattgacgaaccataaacgcatgttactaagtgaaa

SEQ ID NO: 21762 - DNA, 344 bp, Homo sapiens
  AC005736.1_178704
  Located on chromosome 16
  Distance between a terminus base of telomere on chromosomal short arm and 5'-terminus of this base sequence : 5134015
  Distance between 3'-terminus of neighbour sequence of sequence listing upward to telomere on chrosomal short arm and 5'-terminus of this base sequence : 35180
cagacgtgtctttggaaactacaaatgattacagcccatgtgacaggaagcacgcggccttcggctctccggatcgtgtgcaaatgtgcagggggagcccccgcgggtgacgtcagtgtggatgaagtcacgggtgtggcagagcctgtggggctctcaagctattcgagggttttgtaactgatgctctacatttgtttgcattggataaaattgtgtgtgcttgtttaccatatatatatatatatatatatatatatatatatatatatatatatggatatataattcgatctgagctgggactgagaagaaaatagcaattgcaactcaaagcaactatt

SEQ ID NO: 21763 - DNA, 169 bp, Homo sapiens
  AC005736.1_172238
  Located on chromosome 16
  Distance between a terminus base of telomere on chromosomal short arm and 5'-terminus of this base sequence : 5140685
  Distance between 3'-terminus of neighbour sequence of sequence listing upward to telomere on chrosomal short arm and 5'-terminus of this base sequence : 6326
gctgagtagcacaatttcttaaagtttgtttgaaatatatatatatatatatatatatatatatatatatatatgtatttttttttttttttaagaagagacagggtctgtctctgtcatccaagctggactgcagtggtgcgatcctagctcactgcagctttgacct

SEQ ID NO: 21764 - DNA, 238 bp, Homo sapiens
  AC005736.1_140838
  Located on chromosome 16
  Distance between a terminus base of telomere on chromosomal short arm and 5'-terminus of this base sequence : 5171993
  Distance between 3'-terminus of neighbour sequence of sequence listing upward to telomere on chrosomal short arm and 5'-terminus of this base sequence : 31139
agtccatcatgaagtcaagataagaaaatatttggcatctggggaaatttcatggaaatgcaatatttcactctctggcaatgccagttcaatgattccgcacatacatttccatccctctctctacacacacacacacacacacacacacacacacacacacacatatataatttcttactttgaaataattttagacttgcagagagtgggaaagacagttcaaggactctgcata

SEQ ID NO: 21765 - DNA, 266 bp, Homo sapiens
  D16S3027
  Located on chromosome 16
  Distance between a terminus base of telomere on chromosomal short arm and 5'-terminus of this base sequence : 5172020
  Distance between 3'-terminus of neighbour sequence of sequence listing upward to telomere on chrosomal short arm and 5'-terminus of this base sequence : -211
atatttggcatctggggaaatttcatggaaatgcaatatttcactctctggcaatgccagttcaatgattccgcacatacatttccatccctctctctacacacacacacacacacacacacacacacacacacacacatatataatttcttactttgaaataattttagacttgcagagagtgggaaagacagttcaaggactctgcatatatcctccgtacatactcaccgtacagttatcaaaaccaaagcaactcatgctgg

SEQ ID NO: 21766 - DNA, 356 bp, Homo sapiens
  M16_5350542
  Located on chromosome 16
  Distance between a terminus base of telomere on chromosomal short arm and 5'-terminus of this base sequence : 5350520
  Distance between 3'-terminus of neighbour sequence of sequence listing upward to telomere on chrosomal short arm and 5'-terminus of this base sequence : 178234
taaagagggcttcagagagacttttgtttgtttgtttgtttgtttgttttgagacagagtctcactctgttgtccaggcaggagtgcagtggcacaatcttggcacactgcaacctgtgcctcccgggctcaagcaattctcctgcctcagcctcccaagtagctgggattacaggcgcccgctaccatgccctaatttttgtatttttagtagagacggggttttgccatgttggccaggctggtctcaaactcccgaccttaagtgatccgcccacctcgggattacaggtgtgagccactgtgcccagcccatactcttttttaaattccaaaagctaacctccactaggaaa

SEQ ID NO: 21767 - DNA, 414 bp, Homo sapiens
  chr16.fa.O7frz.8400514
  Located on chromosome 16
  Distance between a terminus base of telomere on chromosomal short arm and 5'-terminus of this base sequence : 5608098
  Distance between 3'-terminus of neighbour sequence of sequence listing upward to telomere on chrosomal short arm and 5'-terminus of this base sequence : 257222
acatacactaagctgtcgacaccccgccctcacccctccaatcccccctctgaccccctcttcctcacatggggtcgggggcctgggagttcattctggaccagcccacctatctccatttccttttatacagactttgagacttgccatcagcacagcacacagcagcacccttcccctgaggccggtggggaggggacaagtgtcagcaggattggcgtgtgggaaagctcttgagctgggcactggccccccggacgaggtggctgtgtgttcacacacacacacacacacacacacacacacacacacaggctctcgccccaggatagaagctgcccagaaactgctgcctggctttttttcttccgagcttgtcttatctcaaaccccttccagtcaaggaactagaat

SEQ ID NO: 21768 - DNA, 418 bp, Homo sapiens
  AC027687.3_44472
  Located on chromosome 16
  Distance between a terminus base of telomere on chromosomal short arm and 5'-terminus of this base sequence : 5962441
  Distance between 3'-terminus of neighbour sequence of sequence listing upward to telomere on chrosomal short arm and 5'-terminus of this base sequence : 353929
cattggtttgttcatccatccatccatccctccatccatccatccatccctccatccatccatctatccatccatccattcatccatctatccctccatctctccatccctccatctctccttccctccctcccttccttcctccatccatccattcatccatctcttcatcccttcatccctccattcctccatccatccatccatccatccatccatctcttcatccctccattcctccatccatctcttcatccctccattcctgcatccatccatccatatcttcatccctccattcttccctctctccctcccttcctccatccatccatccatccatctatccatccatccatccatcccttcatttgtcaaatatttactaagcacctgctacgtgacaagtcctgttcta

SEQ ID NO: 21769 - DNA, 327 bp, Homo sapiens
  AC007011.1_28113
  Located on chromosome 16
  Distance between a terminus base of telomere on chromosomal short arm and 5'-terminus of this base sequence : 6071417
  Distance between 3'-terminus of neighbour sequence of sequence listing upward to telomere on chrosomal short arm and 5'-terminus of this base sequence : 108558
tttacttgcttaatctggcaactccgtgtgtgtgtgtgtgtgtgtgtgtgtgtgtgtgtgtgtgtgtgtgtgtgtgtgtgtgtgtgttggtggggggacaccctgttcctttgccccgggggcagaatgctggccatactgttttccatgaagatgtcccgggtagggtaggcgtatccgatggcctcagctctgcggttcaagtccatcatgttggcgcagaagaggttgatatagtcctggctctgttggagtggtccctgtgtgcaccccctctggggagacaaacacccaaagacaagggagtcagtggtacagatgacagac

SEQ ID NO: 21770 - DNA, 164 bp, Homo sapiens
  D16S3134
  Located on chromosome 16
  Distance between a terminus base of telomere on chromosomal short arm and 5'-terminus of this base sequence : 6134148
  Distance between 3'-terminus of neighbour sequence of sequence listing upward to telomere on chrosomal short arm and 5'-terminus of this base sequence : 62404
ggccaaggtgtttgttgtctttgttgttgttgttgttgttgttggtggtggtgtgtgtgtgtgtgtgtgtgtgtgtgtgtgtgtgtgtgagagagagagagagagagagacagagagagagagattcctatgaggaaggagacatctttcccagaatttcccag

SEQ ID NO: 21771 - DNA, 263 bp, Homo sapiens
  AC005347.1_16903
  Located on chromosome 16
  Distance between a terminus base of telomere on chromosomal short arm and 5'-terminus of this base sequence : 6387339
  Distance between 3'-terminus of neighbour sequence of sequence listing upward to telomere on chrosomal short arm and 5'-terminus of this base sequence : 253027
gctgcggtattaattgttacactgtgtaggtagctttgccctgtgggccctgtctcctgaggcaatagaaagcacccctgggggtggctctggaagggtgtgtgtgtgtgtgtctgtgtgtgtgtgtgtgtgtgtgtgtatgtgtgtatgtgcatacacacaaacacaatgcatgcatttggagtccttactgaacttccccatggcagaaatgtaccccaggcaaaccttgagaagccagagaggtacaaacttgctattgc

SEQ ID NO: 21772 - DNA, 257 bp, Homo sapiens
  AC005563.1_30354
  Located on chromosome 16
  Distance between a terminus base of telomere on chromosomal short arm and 5'-terminus of this base sequence : 6406572
  Distance between 3'-terminus of neighbour sequence of sequence listing upward to telomere on chrosomal short arm and 5'-terminus of this base sequence : 18970
agaactcagagcctggagttaggcatgaggtcaaatcctggctctgcaccgtataagctgtgtgactttaaacctattacttaccttctctgagccattccctgtctctcatcattcaatgtcaatcaatcaatcaatctctctctctctctctctctctctctctctcgacgcagtcttgctgtttcacccatgctggagtgcagtggcatgctttcagctcactgcagccttcacttcactgcaactgaattcaa

SEQ ID NO: 21773 - DNA, 256 bp, Homo sapiens
  AC005563.1_10567
  Located on chromosome 16
  Distance between a terminus base of telomere on chromosomal short arm and 5'-terminus of this base sequence : 6426392
  Distance between 3'-terminus of neighbour sequence of sequence listing upward to telomere on chrosomal short arm and 5'-terminus of this base sequence : 19563
acatgttaggcatttaatggacgttttgagaatgaatgaataaaacattcttttttaaatctaagagaaaaacaaagccaaagcaattgtttcaatgtagactcaatgtttcttctctctctctctctctctctcttttttttttttaatgcaggatctactgtgcctgccatacagcctggttgagggtcaggtaagtgctcattttgtcctgacttaggatgtctgtgaagtctagtggaaatgaaagcaatag

SEQ ID NO: 21774 - DNA, 322 bp, Homo sapiens
  AC005737.1_13347
  Located on chromosome 16
  Distance between a terminus base of telomere on chromosomal short arm and 5'-terminus of this base sequence : 6503130
  Distance between 3'-terminus of neighbour sequence of sequence listing upward to telomere on chrosomal short arm and 5'-terminus of this base sequence : 76482
ttgctggatcctgttaatcttgtccatcccacactcacacctggggccactgggccatggtaccagggtctcccctgtcactgccttgactgacgtgagactgggttttctattcctgcctcttgacgacttagacaacagcctagcgtttcagaggagtctgcgtgttacacacacacacacacacacacacacacacaaaaagggcagcaggtgttatttgggctaaattgaccttgaaattgatttctttattttatgacttactgagaggagattaatacttttttttcctgcagtctgaaacgatttacatggtaat

SEQ ID NO: 21775 - DNA, 442 bp, Homo sapiens
  AC023822.5_197780
  Located on chromosome 16
  Distance between a terminus base of telomere on chromosomal short arm and 5'-terminus of this base sequence : 6538726
  Distance between 3'-terminus of neighbour sequence of sequence listing upward to telomere on chrosomal short arm and 5'-terminus of this base sequence : 35274
cgttcttcataaccagtcaagttttgcggaggagtttggatttactcttttaatattttttgttatttatttacttatttatttatttatttatttattttcgagatggagttttgctctgtcaccccggctcgagtatggtggtgcaatcttggcttactgcaacctccgcctcctgggttcaagtgattctccttcctcagcctcctgagtagctgggactacaggtgcccaccaccatgctcagcaaatttttgtatttttggtagagacagggtttcatcattttggccaggctggtttcaaactcctgacctcaggtgatctgtctgcctcagcctcccaaagtactgggattacaggtgtgagccaccgtgtccagccctggatttactctttaatatcttattttatttttttgagatggagtttcactcttgtt

SEQ ID NO: 21776 - DNA, 308 bp, Homo sapiens
  AC005737.1_96155
  Located on chromosome 16
  Distance between a terminus base of telomere on chromosomal short arm and 5'-terminus of this base sequence : 6585940
  Distance between 3'-terminus of neighbour sequence of sequence listing upward to telomere on chrosomal short arm and 5'-terminus of this base sequence : 46772
tccattagctggagataatgatgtcaagaggaaaaaaactttagcggttgttggtttgcctgtaatttgtgtggctcacaagcagcccagctaaattcagtggtttctgatggtcctacctagaccagagaaataagagagggatgatcagaaatccttcaccgtaggtgtgtgtgtgtgtgtgtgtgtgtgtgtgtgtgtgtctgggttttcatttttaataattaatagtagttcattctccatcctgaacttttgcagaaataattagggagcttggggttgggtcagtaattgctcagaaacgt

SEQ ID NO: 21777 - DNA, 289 bp, Homo sapiens
  D16S510
  Located on chromosome 16
  Distance between a terminus base of telomere on chromosomal short arm and 5'-terminus of this base sequence : 6605202
  Distance between 3'-terminus of neighbour sequence of sequence listing upward to telomere on chrosomal short arm and 5'-terminus of this base sequence : 18954
atgtaacacgaaggctgagtgtcacattcttcacctctgctaagaatgtgcacatttggtaactctttttttatttttttttgccattctgtgtacatccccaaatgactgggaaagtgtcatggttattgatttgaaggttatggataaactgtagtaactttaataaactaggcaaattcacaaataccaaacccatgcataatagggactgactgtgtgtgtgtgtgtgtgtgtgtgtgtgtgtgtgtgtgtgtgtgtgtgtttgtgtttcactgctagcagatgc

SEQ ID NO: 21778 - DNA, 198 bp, Homo sapiens
  AC005737.1_115466
  Located on chromosome 16
  Distance between a terminus base of telomere on chromosomal short arm and 5'-terminus of this base sequence : 6605330
  Distance between 3'-terminus of neighbour sequence of sequence listing upward to telomere on chrosomal short arm and 5'-terminus of this base sequence : -161
ttgatttgaaggttatggataaactgtagtaactttaataaactaggcaaattcacaaataccaaacccatgcataatagggactgactgtgtgtgtgtgtgtgtgtgtgtgtgtgtgtgtgtgtgtgtgtgtgtgtttgtgtttcactgctagcagatgcacagaagctccatttgttggctttaaagaagcaagat

SEQ ID NO: 21779 - DNA, 426 bp, Homo sapiens
  AC005751.1_5160
  Located on chromosome 16
  Distance between a terminus base of telomere on chromosomal short arm and 5'-terminus of this base sequence : 6780143
  Distance between 3'-terminus of neighbour sequence of sequence listing upward to telomere on chrosomal short arm and 5'-terminus of this base sequence : 174615
attatcagtacatggacattgctcacagccctccccacttatttttttcttgacaagattgttataatatgttgaaaatactaattatcctattcaccttattaacagggctggataaacaaatcatgttgctgtgcttggtggaagaaaatgcatgtgtgtgtgtgtgtgtgtgtgtggtgtgtgttgcaacctttgtcccctcgggtcataacaaattattgatgccagttcctttaaaaagacaattaatccaattaccttcttgttgaatcaatactaatgtctttttttgtttaacttgcaggtttcggcaagtcaggctacaggcaaagctgaggtaggaaacgtggtttttctgtccctttagaagatagtttgaagtgggtttcttttgtgatggagtgtaacgagcattctagcaat

SEQ ID NO: 21780 - DNA, 195 bp, Homo sapiens
  D16S740
  Located on chromosome 16
  Distance between a terminus base of telomere on chromosomal short arm and 5'-terminus of this base sequence : 6780274
  Distance between 3'-terminus of neighbour sequence of sequence listing upward to telomere on chrosomal short arm and 5'-terminus of this base sequence : -295
ctgtgcttggtggaagaaaatgcatgtgtgtgtgtgtgtgtgtgtgtggtgtgtgttgcaacctttgtcccctcgggtcataacaaattattgatgccagttcctttaaaaagacaattaatccaattaccttcttgttgaatcaatactaatgtctttttttgtttaacttgcaggtttcggcaagtcaggcta

SEQ ID NO: 21781 - DNA, 355 bp, Homo sapiens
  AC005751.1_45731
  Located on chromosome 16
  Distance between a terminus base of telomere on chromosomal short arm and 5'-terminus of this base sequence : 6820833
  Distance between 3'-terminus of neighbour sequence of sequence listing upward to telomere on chrosomal short arm and 5'-terminus of this base sequence : 40364
tggtataattaagacgcgaactcaaggagactatttatcatcatcatcatcatcatcatcatcatcatcatcatcatcatttgagatggcatcttttctctattgcccaggctggagtgtagtggtatgatctcagctcactatagcctctgcctcccaggttcaagcaattctcctgcctcagcctcccagctagctaggattacaggcatgcaccaccatgcccagctaatttttttactgttagtagagactggatttcactatgttggccaggctgatctcaaactgctgacctcaagttctccaccctcttcggcctctgcaagtgctgggattacaggcatgagccata

SEQ ID NO: 21782 - DNA, 196 bp, Homo sapiens
  AC005751.1_127853
  Located on chromosome 16
  Distance between a terminus base of telomere on chromosomal short arm and 5'-terminus of this base sequence : 6902886
  Distance between 3'-terminus of neighbour sequence of sequence listing upward to telomere on chrosomal short arm and 5'-terminus of this base sequence : 81698
gtagcttatcttggtcatgagaatgatcctgggctaagtcatccaggtagaggttgacacccaccgaactctttataagaaatgagagactagtaacaccccctaacacacacacacacacacacacacacacacacacacaccacccctgttttataataggagtaaccacccaggttggtctgaggctaaatcc

SEQ ID NO: 21783 - DNA, 326 bp, Homo sapiens
  AC005751.1_131350
  Located on chromosome 16
  Distance between a terminus base of telomere on chromosomal short arm and 5'-terminus of this base sequence : 6906465
  Distance between 3'-terminus of neighbour sequence of sequence listing upward to telomere on chrosomal short arm and 5'-terminus of this base sequence : 3383
ctgcctatttgataatgctgtacgtgtgtgtgtgtgtgtgtgtgtgtgtgtgtgtgtgtgtgtgtgtgagagagagagagacagagagagagagagagagagaaggagacagagagagacagagactttcaagcctgttttgtatgaagctctcagtaaacacatctggtgaaggaggcagaaaatacagccaagtctgtagaattcaccttcttacccagcaagcatgagtctgtgttcattgaaatgttggccattattctatttgacttctctgatgttctcaggttgatatgtttaagattaatgaggcattagttctccat

SEQ ID NO: 21784 - DNA, 137 bp, Homo sapiens
  D16S423
  Located on chromosome 16
  Distance between a terminus base of telomere on chromosomal short arm and 5'-terminus of this base sequence : 6906467
  Distance between 3'-terminus of neighbour sequence of sequence listing upward to telomere on chrosomal short arm and 5'-terminus of this base sequence : -324
gcctatttgataatgctgtacgtgtgtgtgtgtgtgtgtgtgtgtgtgtgtgtgtgtgtgtgtgtgagagagagagagacagagagagagagagagagagaaggagacagagagagacagagactttcaagcctgtt

SEQ ID NO: 21785 - DNA, 210 bp, Homo sapiens
  chr16.fa.O7frz.9195114
  Located on chromosome 16
  Distance between a terminus base of telomere on chromosomal short arm and 5'-terminus of this base sequence : 7035392
  Distance between 3'-terminus of neighbour sequence of sequence listing upward to telomere on chrosomal short arm and 5'-terminus of this base sequence : 128788
taacgtcctgattgtctcatctgctagtctgtgagcctcttgacagtggggaacagtcctcaataatttgtgtatttctgttatttataacagaaccttgtgtctaaaagataaacacacacacacacacacacacacacacacacacacacatttttaaaggagctttcaacctgctgggaattcttgaatgaacaaatgcactttatg

SEQ ID NO: 21786 - DNA, 370 bp, Homo sapiens
  chr16.fa.O7frz.9324841
  Located on chromosome 16
  Distance between a terminus base of telomere on chromosomal short arm and 5'-terminus of this base sequence : 7145665
  Distance between 3'-terminus of neighbour sequence of sequence listing upward to telomere on chrosomal short arm and 5'-terminus of this base sequence : 110063
aaactgttacatcagtgaccacttgtggtacatgttaggtatgaaatagactatccagatagaaactaattaaagaagggtctatttgggtaagttggccaggaaaggttttttggacgaatgataattaagctgaaatctgaatgttgagaagggtacagtcaaggaaaaggaagtcggggctgttttagagatagaggggtgtgtgtgtgtatgtgtttgtgtgtgtgtgtgtgtgtgtaggtgtgtgtgtgtgtgtgtgttccttataagccaacaggtaccgaatttagtgtaggtctaagggatatgttgaaagtatgaagttcataatggcagtttccgtgtttaaattcagtgaatgagactc

SEQ ID NO: 21787 - DNA, 337 bp, Homo sapiens
  AL360083.13_256688
  Located on chromosome 16
  Distance between a terminus base of telomere on chromosomal short arm and 5'-terminus of this base sequence : 7227159
  Distance between 3'-terminus of neighbour sequence of sequence listing upward to telomere on chrosomal short arm and 5'-terminus of this base sequence : 81124
gtttcgtctgttctgaacatagcacttactaatggagccaggatcaggcgctgcagacccaatttctggcactatgctagacagagatggggaagggaaatgacttttggggaggctgagtgtgtctaaaattagccataggatgactaagccgatagttccttctttccttccttccttccttccttccttccttccttccttccttccttccttccttccttcctccattccttccttccttccttacttctttccttccccctccctccgtccctccctgtttccctaccttccatcttttcttccttgggtaaatatttactgaatgtctgcc

SEQ ID NO: 21788 - DNA, 215 bp, Homo sapiens
  AC006112.2_154177
  Located on chromosome 16
  Distance between a terminus base of telomere on chromosomal short arm and 5'-terminus of this base sequence : 7280674
  Distance between 3'-terminus of neighbour sequence of sequence listing upward to telomere on chrosomal short arm and 5'-terminus of this base sequence : 53178
gaaatagaagccacattctaacttctttggctccttgcctgactttcatatggtctctggtcgagaatggtggccattctatgtgtgtgtgtgtgtgtgtgtgtgtgtgtgtgtgtgtgtctgcctgcctgtatctatgtctgtatctagaaaatatatatttatacctggaacatatgtacgtataaataaaattctggaagatgcatcttgct

SEQ ID NO: 21789 - DNA, 403 bp, Homo sapiens
  AC006112.2_153014
  Located on chromosome 16
  Distance between a terminus base of telomere on chromosomal short arm and 5'-terminus of this base sequence : 7281872
  Distance between 3'-terminus of neighbour sequence of sequence listing upward to telomere on chrosomal short arm and 5'-terminus of this base sequence : 983
gctggacattatgtcactgtaggtttagcccttcttggattttctttgtttgtttgttttgttttgttttgttttgttttgtttttaaggtgtagtctcacaccgttgcctgggctggagtgcaatggtgtgatcttggctcactgcaacctctgcctcccgggttcaggtgattcccctgcctcagcctcctgagtagctgggattacaggcatgcaccaccatgcccggctaattttttgcatttttactagagacagggtttcactatattggtcaggctggccccgaactcctgacctcatgatccacccatctcggcctcccaaagtgctgggattacaggcgtgagccaatgcgcctggccccttcttggattttcttatgcatttgaaatcaggta

SEQ ID NO: 21790 - DNA, 309 bp, Homo sapiens
  AC006112.2_88336
  Located on chromosome 16
  Distance between a terminus base of telomere on chromosomal short arm and 5'-terminus of this base sequence : 7346403
  Distance between 3'-terminus of neighbour sequence of sequence listing upward to telomere on chrosomal short arm and 5'-terminus of this base sequence : 64128
gtagtcctggctactttaccagctttgtgacttggagcaaatcattcttggtgactcagttttctcatctgtaaaatggggctaacactggtcatttacagagttattgtgatgatttaaggagtttatttatgaacatgtccagaaatatgcttgcttgcttgctttctttctttctttctttctttctttctttctttctttctttctttctttctttctttctttctttttcttttttgaaatagagacagggtcatattctatcaccaaggctgtagtgccactgcacgactatagcttattgta

SEQ ID NO: 21791 - DNA, 385 bp, Homo sapiens
  AL360083.13_216974
  Located on chromosome 16
  Distance between a terminus base of telomere on chromosomal short arm and 5'-terminus of this base sequence : 7346403
  Distance between 3'-terminus of neighbour sequence of sequence listing upward to telomere on chrosomal short arm and 5'-terminus of this base sequence : -309
gtagtcctggctactttaccagctttgtgacttggagcaaatcattcttggtgactcagttttctcatctgtaaaatggggctaacactggtcatttacagagttattgtgatgatttaaggagtttatttatgaacatgtccagaaatatgcttgcttgcttgctttctttctttctttctttctttctttctttctttctttctttctttctttctttctttctttctttttcttttttgaaatagagacagggtcatattctatcaccaaggctgtagtgccactgcacgactatagcttattgtagcctctaactcctgagttcaacggaacctcctgccacagcctcccaagaagatgagactataggtgcataccatca

SEQ ID NO: 21792 - DNA, 290 bp, Homo sapiens
  AC006112.2_1497
  Located on chromosome 16
  Distance between a terminus base of telomere on chromosomal short arm and 5'-terminus of this base sequence : 7433209
  Distance between 3'-terminus of neighbour sequence of sequence listing upward to telomere on chrosomal short arm and 5'-terminus of this base sequence : 86421
aggtgaaattcagaccacttactgcctccagctcttggggcttcttgacattgtcctagtgtttgccttaagggccacccggagtaactgccctttgaattttatctatgtatgtatctgtccatccgtccgtccgtccatccatccatccatctatctctgtctgtctgtctatccatctatctatccatctgtctgtctgtctgtgtgtctgtctatctatctatctatctatctatctatctatctatctatctatctatctgtcttcctgcagaagtagcaaacgt

SEQ ID NO: 21793 - DNA, 210 bp, Homo sapiens
  Z67080
  Located on chromosome 16
  Distance between a terminus base of telomere on chromosomal short arm and 5'-terminus of this base sequence : 7436679
  Distance between 3'-terminus of neighbour sequence of sequence listing upward to telomere on chrosomal short arm and 5'-terminus of this base sequence : 3180
agtaaaaacgtccttgcatctagaaaaactggcatgtgttttctttgaatcaatttccaaagattatgcagtatcttttaatggcactctggggacccacagtgtgtgtgtgtgtgtgtgtgtgtgtgtgtgtgtgtgtgtgtcttaaaaattaggatgaacattttatgtctcccaagtagataaacctctgccctacccccagtgaag

SEQ ID NO: 21794 - DNA, 206 bp, Homo sapiens
  Z66952
  Located on chromosome 16
  Distance between a terminus base of telomere on chromosomal short arm and 5'-terminus of this base sequence : 7469277
  Distance between 3'-terminus of neighbour sequence of sequence listing upward to telomere on chrosomal short arm and 5'-terminus of this base sequence : 32388
ttgtgcagacttgtccatcagtcactgaaagtgtggaaatcttcagtccatcctctggcctccagtagacacagacacacacacacacacacacacacacacacacagacacacacacaaaggtacacagacacacacacagacacacacagataaacacacagacacacagacacacacagactctccctctcactctcgctctg

SEQ ID NO: 21795 - DNA, 157 bp, Homo sapiens
  D16S506
  Located on chromosome 16
  Distance between a terminus base of telomere on chromosomal short arm and 5'-terminus of this base sequence : 7527575
  Distance between 3'-terminus of neighbour sequence of sequence listing upward to telomere on chrosomal short arm and 5'-terminus of this base sequence : 58092
agcccccgtacagttcacgtgccaagtgagagaaggcaggtgccagtcccagcatgtgtgtgtgtgtgtgtgtgtgtgtgtgtgtgtgtgtgtgagtgtgtgtgtgtgttttggaattcacaggataaatactgtggtacaggaactgtcaggcctg

SEQ ID NO: 21796 - DNA, 243 bp, Homo sapiens
  D16S3042
  Located on chromosome 16
  Distance between a terminus base of telomere on chromosomal short arm and 5'-terminus of this base sequence : 7590595
  Distance between 3'-terminus of neighbour sequence of sequence listing upward to telomere on chrosomal short arm and 5'-terminus of this base sequence : 62863
agctttacgtggacaccaagggcgatgggagaggagaggttctcaaaaggaaaagaggtcctcaaaaggtttaaaggaaaactgaagggaagtcaacataggggtttggggttgggggtgttattatcagaagtaggtagaaggatgctgcctaggggacacacacacacgcgcacacacacacacacacacacacacacacacacacacacttccctaggtcaactaggatcagataggtag

SEQ ID NO: 21797 - DNA, 182 bp, Homo sapiens
  D16S3135
  Located on chromosome 16
  Distance between a terminus base of telomere on chromosomal short arm and 5'-terminus of this base sequence : 7674034
  Distance between 3'-terminus of neighbour sequence of sequence listing upward to telomere on chrosomal short arm and 5'-terminus of this base sequence : 83196
ccatagtgctgggacccaattaattctttagtcaaccaacttcatttcttgatatgtcagttgtctgtgtgtgtgtgtgtgtgtgtgtgtgtgtgtgtgtgtgtgtgtgtgtgtattttcagtttttgtccatctgacagttgctgttgttttcattgttaggatatgagttccagttccag

SEQ ID NO: 21798 - DNA, 196 bp, Homo sapiens
  D16S3030
  Located on chromosome 16
  Distance between a terminus base of telomere on chromosomal short arm and 5'-terminus of this base sequence : 7772925
  Distance between 3'-terminus of neighbour sequence of sequence listing upward to telomere on chrosomal short arm and 5'-terminus of this base sequence : 98709
gcgcaacagagtgagaccttgtctgggaagaaaaaaagaaaaaaagaaatttaatctagaactccctagcgtacgattaagtaagttatcaataatttttttctctttcacctttaagccttccccacatatgcacacacacacacacacacacacacgtgcacatacacacactcaaaacccctgtgttctggac

SEQ ID NO: 21799 - DNA, 132 bp, Homo sapiens
  D16S3058
  Located on chromosome 16
  Distance between a terminus base of telomere on chromosomal short arm and 5'-terminus of this base sequence : 7807430
  Distance between 3'-terminus of neighbour sequence of sequence listing upward to telomere on chrosomal short arm and 5'-terminus of this base sequence : 34309
cactacagcctgggaaacagaccaagactccatcatacacacacacacacacacacacacacacacacacacacacacacaacaaaagaaaaaggaaattggatttgtttatgtttggtcattctagtcctg

SEQ ID NO: 21800 - DNA, 337 bp, Homo sapiens
  chr16.fa.O7frz.10186107
  Located on chromosome 16
  Distance between a terminus base of telomere on chromosomal short arm and 5'-terminus of this base sequence : 7967652
  Distance between 3'-terminus of neighbour sequence of sequence listing upward to telomere on chrosomal short arm and 5'-terminus of this base sequence : 160090
gatgttatcattcgaagtcagactgtcaaatcctgtgtattgggaaacactctttgttcccttgacttggggactcctgcatttcttttgaagttttttttttttttttttaaatcattacattgttcaccctactccaatgtcttgttagtggttgggtggtatggctaagatggctgatgaactgaaataagggcagactgtacagctgtgtgtgtgtgtgtgtgtgtgtgtgtgtgtgggtgtgtgtgtgtgttgagagagagagagattgagacagagggtaagagaatttttctgcttacatttaaataactcacttatggataacatttgg

SEQ ID NO: 21801 - DNA, 211 bp, Homo sapiens
  D16S3088
  Located on chromosome 16
  Distance between a terminus base of telomere on chromosomal short arm and 5'-terminus of this base sequence : 8038898
  Distance between 3'-terminus of neighbour sequence of sequence listing upward to telomere on chrosomal short arm and 5'-terminus of this base sequence : 70909
ctctgaatagggtggggatgttcatcttgatttgccttctgctagaccaggaatgaagagatggatgatattactccttttgatgtttttattcttgaatagatatgttggattctctgtctcttgccccctgcaccccaccgcatgcacatacacacacacacacacacacacacacacacacatacatacatacaccccagatttcctt

SEQ ID NO: 21802 - DNA, 207 bp, Homo sapiens
  D16S509
  Located on chromosome 16
  Distance between a terminus base of telomere on chromosomal short arm and 5'-terminus of this base sequence : 8191675
  Distance between 3'-terminus of neighbour sequence of sequence listing upward to telomere on chrosomal short arm and 5'-terminus of this base sequence : 152566
tgctggaaaaacaaagggaccagggagccagtgagagaggggtaaagagacacataagggccagagacgactggagtttggaaatcttgacctagagttggattttttgccaagacgaatgaagaagacagaacacacacacacacacacacacaaacacacacacacacaataagagggtttaggcaggagttaaatgaccatatt

SEQ ID NO: 21803 - DNA, 467 bp, Homo sapiens
  chr16.fa.O7frz.10526165
  Located on chromosome 16
  Distance between a terminus base of telomere on chromosomal short arm and 5'-terminus of this base sequence : 8306001
  Distance between 3'-terminus of neighbour sequence of sequence listing upward to telomere on chrosomal short arm and 5'-terminus of this base sequence : 114119
tgattatctcgtttgattccttaccttaactctaacaagggatcctattttttacatgtcttttattattattgttgttgttattttgagtaggactctcactgtgttggccaggctggagggcagtggtgcaatcatagagctcactgcagcctcaagcttgtgggctcaaggaattctcctgcctcagcctcctaagtagctggggctacaggtctgcaccaacatgcgcagttaattttttaattttgtgtgtgtgtgtgtgtgtgtagatgggttcttactgtgttgcccagactggtctcaagctcctgaactcaagtgatccttccactttggcctcccaaagtgtgggattatgggcgtgagccaccgcgccactgtgcccggcttaatatgtcttttatttttaaaaaatgctggtaaaatacacgtaacataaaatgtgtcatcggtgatatttaatg

SEQ ID NO: 21804 - DNA, 208 bp, Homo sapiens
  D16S3092
  Located on chromosome 16
  Distance between a terminus base of telomere on chromosomal short arm and 5'-terminus of this base sequence : 8384111
  Distance between 3'-terminus of neighbour sequence of sequence listing upward to telomere on chrosomal short arm and 5'-terminus of this base sequence : 77643
cttgaagtctgctgctgcacttgactgtaaggtctatagggacaaagatggttttggattttgcttaccgttgcattaaatgtgaatgaatgaattcgtttacataatgtgtactaggagccaagccctgtgtgtgtgtgtgtgtgtgtgtgtgtgtgtgtgtgtctgtgtctgtgtctgtgtctgtgtgtggtttttggtgatgtga

SEQ ID NO: 21805 - DNA, 204 bp, Homo sapiens
  AC006075.1_78070
  Located on chromosome 16
  Distance between a terminus base of telomere on chromosomal short arm and 5'-terminus of this base sequence : 8384212
  Distance between 3'-terminus of neighbour sequence of sequence listing upward to telomere on chrosomal short arm and 5'-terminus of this base sequence : -107
acataatgtgtactaggagccaagccctgtgtgtgtgtgtgtgtgtgtgtgtgtgtgtgtgtgtctgtgtctgtgtctgtgtctgtgtgtggtttttggtgatgtgatttttaattagatccttacaataatatggtgaagctactcatcattggtcccattaaacagaagcaaaaactagtgcttggagtatcacaataactt

SEQ ID NO: 21806 - DNA, 168 bp, Homo sapiens
  AC006075.1_79171
  Located on chromosome 16
  Distance between a terminus base of telomere on chromosomal short arm and 5'-terminus of this base sequence : 8385263
  Distance between 3'-terminus of neighbour sequence of sequence listing upward to telomere on chrosomal short arm and 5'-terminus of this base sequence : 847
cgtagcttgctccttgaatcatgcccggggaaaggagaggagttttggtgaagagagtgtgtgtgtgtatgtgtgtctgtgtgtgtgtgtgtgtgtgtgtgtgtgggcgcgcgcgcacgcgcgcacgcgcgctttctgcttgatgtgtggaactgagctgatcttaga

SEQ ID NO: 21807 - DNA, 180 bp, Homo sapiens
  AC006075.1_84166
  Located on chromosome 16
  Distance between a terminus base of telomere on chromosomal short arm and 5'-terminus of this base sequence : 8390232
  Distance between 3'-terminus of neighbour sequence of sequence listing upward to telomere on chrosomal short arm and 5'-terminus of this base sequence : 4801
gagatttaagtacagcatggaaacaagagttaaaaatactgtattatatactggaagtgtgctaagaggatagatcttaaattaaatctctccacacacacatacacacacacacacacacacacacaaatggagatcatgtagaagtgatggatatgctaattacctggaatgtggtca

SEQ ID NO: 21808 - DNA, 325 bp, Homo sapiens
  AC006075.1_85826
  Located on chromosome 16
  Distance between a terminus base of telomere on chromosomal short arm and 5'-terminus of this base sequence : 8391837
  Distance between 3'-terminus of neighbour sequence of sequence listing upward to telomere on chrosomal short arm and 5'-terminus of this base sequence : 1425
gccaaagtcacatctaattgaccacagacaataggagaggcagctatttggtgtgcctaattgctaagtttttttcctcgctctgtctttctgactgtgtgatcccatctcctgagaccatggaaagtttagacctttgggttacaatttcttatgccgtgtgtgtgtgtgtgtgtgtgtgtgtgtgtgtgtgtgtgtgtgtgtgttgtggtagaactgtggaggaggaggtaaagagagagagctgtttcctgaaatggaagcatttgtattcaggtttttgttgtgtgtgtttttaaaattcttctgagttggctgtaattgt

SEQ ID NO: 21809 - DNA, 357 bp, Homo sapiens
  AC006075.1_86237
  Located on chromosome 16
  Distance between a terminus base of telomere on chromosomal short arm and 5'-terminus of this base sequence : 8392246
  Distance between 3'-terminus of neighbour sequence of sequence listing upward to telomere on chrosomal short arm and 5'-terminus of this base sequence : 84
ggcattgactaatgagactgagagttaaatccaatatttttcagaaatgcttaaaatggggatgtcagagaggacagtctttgtccaaattaggccctgaatttgtatcagctgcttcattttggcactggggacatcatacacgcatacacacacacagacacacacacacacacacacacaacataacacacaaccacacagacactgggaccattaaaaggatactccctattcccattatgtgagccaagtcacataaaactttgattaaattcaaatgcttacataaattgtctctcctctcaagaacacacacgttcaatttagtctctcttggcactttaagtatcaaat

SEQ ID NO: 21810 - DNA, 327 bp, Homo sapiens
  AC006075.1_158621
  Located on chromosome 16
  Distance between a terminus base of telomere on chromosomal short arm and 5'-terminus of this base sequence : 8464616
  Distance between 3'-terminus of neighbour sequence of sequence listing upward to telomere on chrosomal short arm and 5'-terminus of this base sequence : 72013
ttaatggttcagaaacctgaactgttgctatggcctcattttcatcgtttggtgctggacagacagccaggaaatgagtgggcccttacgagccaggaactcaccttcttgcctttcattctctagagcagttcttcaggcaggccactcaatgctgaaggctgtgtgtgctgggtgtgtgtgtgtgtgtgtgtgtgtgtgtgtgtgtgtgtgtgtatgcggacatataaacccatatgtacttaagggatggacgcagtgtctcatacctaacattctagccctttaggaagctgaggtgggagtattgtatgaagccaggagttc

SEQ ID NO: 21811 - DNA, 174 bp, Homo sapiens
  D16S418
  Located on chromosome 16
  Distance between a terminus base of telomere on chromosomal short arm and 5'-terminus of this base sequence : 8464717
  Distance between 3'-terminus of neighbour sequence of sequence listing upward to telomere on chrosomal short arm and 5'-terminus of this base sequence : -226
caccttcttgcctttcattctctagagcagttcttcaggcaggccactcaatgctgaaggctgtgtgtgctgggtgtgtgtgtgtgtgtgtgtgtgtgtgtgtgtgtgtgtgtgtatgcggacatataaacccatatgtacttaagggatggacgcagtgtctcatacctaaca

SEQ ID NO: 21812 - DNA, 447 bp, Homo sapiens
  AC027683.2_32595
  Located on chromosome 16
  Distance between a terminus base of telomere on chromosomal short arm and 5'-terminus of this base sequence : 8479165
  Distance between 3'-terminus of neighbour sequence of sequence listing upward to telomere on chrosomal short arm and 5'-terminus of this base sequence : 14274
agcactgttctaagcactgtacataagtttaatgtatttaatgctcatggcgattttccaaatgaggataccaaaatgcaaaaagttggtattactgctctgagatttcagctggtcaggaggaggccagattttgaaatcaggctttgatcatctcagaaatcgtgttctttacaaccagttgatactggtggggttttgtttgtttgtttgtttgtttgtttgttttgagatggagttttgctctgtctcccaggctggagtgcagtggcgcggtctcagttcactgcaagctccgcctcccgggttcaagtgattctcctgcctcagcctcctgagtagctgggactacaggtatccgccaccatgcccggctaatttttgtatttttagtggagatggggtttcaccctgttagccaggatggtctccatctcctgacctcat

SEQ ID NO: 21813 - DNA, 305 bp, Homo sapiens
  AC005774.1_108440
  Located on chromosome 16
  Distance between a terminus base of telomere on chromosomal short arm and 5'-terminus of this base sequence : 8532949
  Distance between 3'-terminus of neighbour sequence of sequence listing upward to telomere on chrosomal short arm and 5'-terminus of this base sequence : 53337
ttaaggacaatggtacttggagtttagtcaatcaactctgaaatactctaagcagcacactagagtgttctccagcaaaccagtgtcacagctgcgtgtgtgtgtcagtacagcgtgtgtgtgtgtgtgtgtgtgtgtgtgttgtaaaatgccttcccttggctcaatatgctttgcttacatgtgggttcattctgctacagaaacctgctggaatcctttggtattaaagttgtgtttctattagaacctcagcttcattcaatggtggggctcattggtcctttgccagaatcataagtcat

SEQ ID NO: 21814 - DNA, 165 bp, Homo sapiens
  D16S3108
  Located on chromosome 16
  Distance between a terminus base of telomere on chromosomal short arm and 5'-terminus of this base sequence : 8533010
  Distance between 3'-terminus of neighbour sequence of sequence listing upward to telomere on chrosomal short arm and 5'-terminus of this base sequence : -244
agagtgttctccagcaaaccagtgtcacagctgcgtgtgtgtgtcagtacagcgtgtgtgtgtgtgtgtgtgtgtgtgtgttgtaaaatgccttcccttggctcaatatgctttgcttacatgtgggttcattctgctacagaaacctgctggaatcctttggta

SEQ ID NO: 21815 - DNA, 160 bp, Homo sapiens
  AC005774.1_94812
  Located on chromosome 16
  Distance between a terminus base of telomere on chromosomal short arm and 5'-terminus of this base sequence : 8546653
  Distance between 3'-terminus of neighbour sequence of sequence listing upward to telomere on chrosomal short arm and 5'-terminus of this base sequence : 13478
ttaatttctgtgacaacgcaccttgctcacatacacatacacacacacacacacacacacacacaccgtacaaccttcttatggtcttccacataagaccacggtttcatctaactcataggaagaaaaacagaccatgatcctacaaggtttacttcaa

SEQ ID NO: 21816 - DNA, 288 bp, Homo sapiens
  AC005774.1_88938
  Located on chromosome 16
  Distance between a terminus base of telomere on chromosomal short arm and 5'-terminus of this base sequence : 8552417
  Distance between 3'-terminus of neighbour sequence of sequence listing upward to telomere on chrosomal short arm and 5'-terminus of this base sequence : 5604
cctattcagactctccttaggaagaaaaagtgaaagcaattgtcctagacagctttcgggtaactagaaacacacagttatacctgtgagattcctattacaaagcacacatgccagataaatttcttaatacttctatgtgtgtgtgtgtgtatatatatatatatatatatataaaacagtgctcctcttaaagtgatgttgattgtatattctccaaaaaattaggataactaagataattctatttcctcctgatctgctctgtagactgtcactgatgtatgg

SEQ ID NO: 21817 - DNA, 379 bp, Homo sapiens
  AC005774.1_73757
  Located on chromosome 16
  Distance between a terminus base of telomere on chromosomal short arm and 5'-terminus of this base sequence : 8567613
  Distance between 3'-terminus of neighbour sequence of sequence listing upward to telomere on chrosomal short arm and 5'-terminus of this base sequence : 14908
gtgttctaggttaattcaccagacgtctttttgctgaaagttagtggctgaaaaacaattaacaatatgctagtccctgaaaaccccagacaggttgaaacagttgttttagacacagagtccaagagggtgtgtgtgtgtgtgtgtgtgtgtgtgtgtgtataaagggggtaggtggaggctgggactcactagcaggaagatatgccccttccaccatgccaggacccaccatgcattcccttagcaaatctggggacatgttttcatctcagttcctgatgagtatgggacacaaccatgtggggtgagggtagggtctgcaagaaagccttgagcaaatgaacaatctgcaaaagctgttgaaactgttctctgt

SEQ ID NO: 21818 - DNA, 259 bp, Homo sapiens
  D16S502
  Located on chromosome 16
  Distance between a terminus base of telomere on chromosomal short arm and 5'-terminus of this base sequence : 8739429
  Distance between 3'-terminus of neighbour sequence of sequence listing upward to telomere on chrosomal short arm and 5'-terminus of this base sequence : 171437
agcctatttgagttatgtggaagaatgtcctgatttttagatgtgtgctgaagtatttagaaatcaagtgccatgatgtctgcaacttactttcaactaggtcagcagataaacacacaaacacatacacacacacacacacacacacacacatataaatatattataaatcatataaatatataatatatttaaaatatataatatatattatattttatatatatatatatatagaaagataggtacacataaaaca

SEQ ID NO: 21819 - DNA, 101 bp, Homo sapiens
  DISO7_10004101
  Located on chromosome 16
  Distance between a terminus base of telomere on chromosomal short arm and 5'-terminus of this base sequence : 8902099
  Distance between 3'-terminus of neighbour sequence of sequence listing upward to telomere on chrosomal short arm and 5'-terminus of this base sequence : 162411
aaggtgagttctcttctcatccactcccccaataaacatatgtatagtgtgtgtgtgtgtgtgtgtgtgtgcaggcatgcacacatgtccgcattccatta

SEQ ID NO: 21820 - DNA, 341 bp, Homo sapiens
  AC027684.2_191767
  Located on chromosome 16
  Distance between a terminus base of telomere on chromosomal short arm and 5'-terminus of this base sequence : 9022991
  Distance between 3'-terminus of neighbour sequence of sequence listing upward to telomere on chrosomal short arm and 5'-terminus of this base sequence : 120791
agcatttaaaggtagacggtattttttactagagacaaggtttcactattagccagttgtggaggcgggcatctgtagtcccagctactcaggaggctgaggcaggagaattgcttgaacccgggaggtggaggctgcagtgagccgagactgcgccactgcactccagcctgggcaacaaagcaagactccaactcaataaataaataaataaataaataaagatagacagtaacgttaaagatgcacattataaacctgatgacatcactaaactgaacagagcattattgcctttaaggccttccacggatttaatgagttccacctaagttacgaag

SEQ ID NO: 21821 - DNA, 142 bp, Homo sapiens
  D16S495
  Located on chromosome 16
  Distance between a terminus base of telomere on chromosomal short arm and 5'-terminus of this base sequence : 9023858
  Distance between 3'-terminus of neighbour sequence of sequence listing upward to telomere on chrosomal short arm and 5'-terminus of this base sequence : 526
ggaggcaaactttctggtttcaaaccaaagactttcctaatatcttacatgaactgtatttgtagttcatatcccacacacacacacacacacacacagacacacacacagacacatatacagacagccagatagagggggc

SEQ ID NO: 21822 - DNA, 193 bp, Homo sapiens
  D16S3052
  Located on chromosome 16
  Distance between a terminus base of telomere on chromosomal short arm and 5'-terminus of this base sequence : 9041367
  Distance between 3'-terminus of neighbour sequence of sequence listing upward to telomere on chrosomal short arm and 5'-terminus of this base sequence : 17367
gaaattgcaggtgcctatgcatgcagtctgtctctttgtctctcttatgcgacgtacacacacacacacacacacacacacacacatacacacattattatgatacgagccaaaggcaacaacgtcaggcctccctttctgtgcaaagcctgatgagtggttaacttcagcatccactcctggcttgaaaaca

SEQ ID NO: 21823 - DNA, 348 bp, Homo sapiens
  AC018767.3_156843
  Located on chromosome 16
  Distance between a terminus base of telomere on chromosomal short arm and 5'-terminus of this base sequence : 9135136
  Distance between 3'-terminus of neighbour sequence of sequence listing upward to telomere on chrosomal short arm and 5'-terminus of this base sequence : 93576
agatcatttgaagtcaggagttcaagaccagccttgccaacatggtgaaaccccatctctactaaaaatacaaaaattagccgggcatggtggcccatgcctgtagtcccagggaggctactcgggaggctgaggctagagaatcacttgaacctgggaggcagaggttacaatgagccgagatcgtgccactgcactccagcctgggtgatagagtgagaatcagtctaaataaaataaaataaaataaaataaaataaaataaaataaaataaaataaaataaactggatttcaggaaggacagttgtaccgctgctgccactctcagtagcagtctagaatgcat

SEQ ID NO: 21824 - DNA, 212 bp, Homo sapiens
  AC018767.3_109634
  Located on chromosome 16
  Distance between a terminus base of telomere on chromosomal short arm and 5'-terminus of this base sequence : 9182500
  Distance between 3'-terminus of neighbour sequence of sequence listing upward to telomere on chrosomal short arm and 5'-terminus of this base sequence : 47016
tctaagtttccaatgcacagtcttttaggtgatagaaaagctccctatgagaagccactaaaaggttttaagcaggttgttctctgagataattcctgtgtgtgtgtgtgtgtgtgtgtgtgtgtgtgtgtatgtgtttcataattgattgaattatttcctcccttcctttcctttcttttctccccctctgcctttaagaactagttgtc

SEQ ID NO: 21825 - DNA, 258 bp, Homo sapiens
  D16S513
  Located on chromosome 16
  Distance between a terminus base of telomere on chromosomal short arm and 5'-terminus of this base sequence : 9182563
  Distance between 3'-terminus of neighbour sequence of sequence listing upward to telomere on chrosomal short arm and 5'-terminus of this base sequence : -149
ggttttaagcaggttgttctctgagataattcctgtgtgtgtgtgtgtgtgtgtgtgtgtgtgtgtgtatgtgtttcataattgattgaattatttcctcccttcctttcctttcttttctccccctctgcctttaagaactagttgtctgacctcttgaaatgaggtaacaattctcaaaagaggggagaaccagaaggtagttcccaaggtagccccatgctacagaggatccctcagcagggactggattccaca

SEQ ID NO: 21826 - DNA, 323 bp, Homo sapiens
  AC018767.3_97675
  Located on chromosome 16
  Distance between a terminus base of telomere on chromosomal short arm and 5'-terminus of this base sequence : 9194505
  Distance between 3'-terminus of neighbour sequence of sequence listing upward to telomere on chrosomal short arm and 5'-terminus of this base sequence : 11684
aaacttacagtcatggcagaagtgaaggagaagcaggcaacctcttcacaaggtggcaggagagagagagagagagagagagagataatgcaaggaagtgccacactttaaaaccatcaactctgctgagaactcactcactgtcatgagaacagcctgggggaaactgcccccatgatccagtcacctcccaccaggcccttcccttgacacatggggtttacaattcaagatgcgatttgggtggggacacagagccaaatcttaccaattagttagaggtgccatgttcacacatgtctagtcaactgtagttggttctg

SEQ ID NO: 21827 - DNA, 407 bp, Homo sapiens
  AC018767.3_71545
  Located on chromosome 16
  Distance between a terminus base of telomere on chromosomal short arm and 5'-terminus of this base sequence : 9220480
  Distance between 3'-terminus of neighbour sequence of sequence listing upward to telomere on chrosomal short arm and 5'-terminus of this base sequence : 25652
gctaatgctgatagcagattaaacaggataaaacacaaagcatattgcatggagctaaacttccccccttaggctgggggttttcaaaaagcagctctttagccagcaaatgggctttgttttccatagatgggcaccctctcctccactcaaatggggctcttggccaacttgtttctccctgtctctgccattcatgcttctacacacacacacacacacacacacacacacacacactaatagccaggcatgctagattagctccaggagacttaagtgtaccctaagcaccaagccatcagcagcaaatggatgtcccttgcacagatctgcagtgcatattaacaggccaccacctccctcaatgttccaggatgtgtctccttacaagacttctacttgga

SEQ ID NO: 21828 - DNA, 389 bp, Homo sapiens
  AC018767.3_51971
  Located on chromosome 16
  Distance between a terminus base of telomere on chromosomal short arm and 5'-terminus of this base sequence : 9240153
  Distance between 3'-terminus of neighbour sequence of sequence listing upward to telomere on chrosomal short arm and 5'-terminus of this base sequence : 19266
tcacaaagtgctaggattacaggcgtgagccaccacacccggctatatatatatatatctatcttacctcctgttggttccatataaattatctatctatctatctatctatctatctatctatctatctatctatctatccatccaacctgttggttcttttctctggagaaccctagctaatacgtcatatcctcccaccagcccctggcaaccaccgttctgctctttgattccattaatttggctcttttgatacctcatataaggggcatcatgcagtatttgtccttttttgactgccttatttcatttagcataatgccttccagattcatctctgttgcagcaaacggcagagtttcctactttgtaaaggctgaatgata

SEQ ID NO: 21829 - DNA, 389 bp, Homo sapiens; identical to SEQ ID NO: 21828
  AC018769.2_18198
  Located on chromosome 16
  Distance between a terminus base of telomere on chromosomal short arm and 5'-terminus of this base sequence : 9240153
  Distance between 3'-terminus of neighbour sequence of sequence listing upward to telomere on chrosomal short arm and 5'-terminus of this base sequence : -389

SEQ ID NO: 21830 - DNA, 121 bp, Homo sapiens
  G12414
  Located on chromosome 16
  Distance between a terminus base of telomere on chromosomal short arm and 5'-terminus of this base sequence : 9240215
  Distance between 3'-terminus of neighbour sequence of sequence listing upward to telomere on chrosomal short arm and 5'-terminus of this base sequence : -327
cttacctcctgttggttccatataaattatctatctatctatctatctatctatctatctatctatctatctatctatccatccaacctgttggttcttttctctggagaaccctagctaa

SEQ ID NO: 21831 - DNA, 138 bp, Homo sapiens
  D16S768
  Located on chromosome 16
  Distance between a terminus base of telomere on chromosomal short arm and 5'-terminus of this base sequence : 9240218
  Distance between 3'-terminus of neighbour sequence of sequence listing upward to telomere on chrosomal short arm and 5'-terminus of this base sequence : -118
acctcctgttggttccatataaattatctatctatctatctatctatctatctatctatctatctatctatctatccatccaacctgttggttcttttctctggagaaccctagctaatacgtcatatcctcccacca

SEQ ID NO: 21832 - DNA, 324 bp, Homo sapiens
  AC018769.2_19249
  Located on chromosome 16
  Distance between a terminus base of telomere on chromosomal short arm and 5'-terminus of this base sequence : 9241150
  Distance between 3'-terminus of neighbour sequence of sequence listing upward to telomere on chrosomal short arm and 5'-terminus of this base sequence : 794
tgaattcaacatggcttatctcagaggtcttccaggactacttctatcaaacaaccccaccttctctccatcccttcattgtggtttatctttccccttttatttacaatacactacaatttttcagtggtggctgtgtgtgtgtgcgtgtgtgtgtgtgtgtgtgtgtgtgtgtgtgtgtgttgtctgcctcccctactaatggggaagcaattccagagcaggacctgtctttgatttctccatcaaactgcctgggttgaaatcccacctctttcacattataaacgcatgaccttgagctcatgtttcctcacctagaaa

SEQ ID NO: 21833 - DNA, 240 bp, Homo sapiens
  Z67449
  Located on chromosome 16
  Distance between a terminus base of telomere on chromosomal short arm and 5'-terminus of this base sequence : 9241181
  Distance between 3'-terminus of neighbour sequence of sequence listing upward to telomere on chrosomal short arm and 5'-terminus of this base sequence : -293
ccaggactacttctatcaaacaaccccaccttctctccatcccttcattgtggtttatctttccccttttatttacaatacactacaatttttcagtggtggctgtgtgtgtgtgcgtgtgtgtgtgtgtgtgtgtgtgtgtgtgtgtgtgttgtctgcctcccctactaatggggaagcaattccagagcaggacctgtctttgatttctccatcaaactgcctgggttgaaatcccac

SEQ ID NO: 21834 - DNA, 328 bp, Homo sapiens
  AC018769.2_23316
  Located on chromosome 16
  Distance between a terminus base of telomere on chromosomal short arm and 5'-terminus of this base sequence : 9245276
  Distance between 3'-terminus of neighbour sequence of sequence listing upward to telomere on chrosomal short arm and 5'-terminus of this base sequence : 3855
cagctttactcttcagttaatcactttccctcctgccacctgtgtctactagaaattctcttgttcattagtttactctattttattttattttattttattttatttttgagatagagtctcgctctgtcacctaggctgaagggcagtggcgcaatctcggctcactgcaacctctgcatcccaggttgaagtgattttcctggctcagtctcctgagtagctgggattacaggcatgtgccaccatacccagctgatttttatattttcagtagagactgggtttcaccatgttggccagactggtcttgaactcctgacttcag

SEQ ID NO: 21835 - DNA, 268 bp, Homo sapiens
  AC018767.3_18223
  Located on chromosome 16
  Distance between a terminus base of telomere on chromosomal short arm and 5'-terminus of this base sequence : 9273959
  Distance between 3'-terminus of neighbour sequence of sequence listing upward to telomere on chrosomal short arm and 5'-terminus of this base sequence : 28355
ataaatgtgaagacgtggtcacaggcagagcataggagagcccagggttgtaaggggcgtgtgtgtgtgtgtgtgtgtgtgtgcacatgcatgtgtacacttgtgcaaagaagccaacatcccagcctctttggccaacattgtgacaccaccaaccccaaaagccagcaacaattcatcaaggctctctcccaagttcacaataagtttcatgcctcaactggcttccattgaaggattgatgctgtcactttaagtagctactgca

SEQ ID NO: 21836 - DNA, 266 bp, Homo sapiens
  AC018769.2_51983
  Located on chromosome 16
  Distance between a terminus base of telomere on chromosomal short arm and 5'-terminus of this base sequence : 9273961
  Distance between 3'-terminus of neighbour sequence of sequence listing upward to telomere on chrosomal short arm and 5'-terminus of this base sequence : -266
aaatgtgaagacgtggtcacaggcagagcataggagagcccagggttgtaaggggcgtgtgtgtgtgtgtgtgtgtgtgtgcacatgcatgtgtacacttgtgcaaagaagccaacatcccagcctctttggccaacattgtgacaccaccaaccccaaaagccagcaacaattcatcaaggctctctcccaagttcacaataagtttcatgcctcaactggcttccattgaaggattgatgctgtcactttaagtagctactgca

SEQ ID NO: 21837 - DNA, 431 bp, Homo sapiens
  AC018769.2_80894
  Located on chromosome 16
  Distance between a terminus base of telomere on chromosomal short arm and 5'-terminus of this base sequence : 9302698
  Distance between 3'-terminus of neighbour sequence of sequence listing upward to telomere on chrosomal short arm and 5'-terminus of this base sequence : 28471
aaatggtaggtccgtatgagacatgtttggggggtacctatccacacttgtcctccttcctccttcctgggaatctgaccccctccacagcctctgatatttatgtaacacccttgtatgtatacagggatatatataggagatagatagatagatagatagatagatagatagatagatagatagatgatagatagatagatagatagatagatagatatagatagatgatagatagatagatagatagatagatagatagatagatagatagataagtagactcccctattggttctgtttctctggaaaaccctaaaacaggcagtgagcatcttacaataatatcatctatccccgatccccagccataagggctgctatccccagctgcttggactatgggtaagtactcaatgcaaagacagttc

SEQ ID NO: 21838 - DNA, 236 bp, Homo sapiens
  AC018769.2_99188
  Located on chromosome 16
  Distance between a terminus base of telomere on chromosomal short arm and 5'-terminus of this base sequence : 9321059
  Distance between 3'-terminus of neighbour sequence of sequence listing upward to telomere on chrosomal short arm and 5'-terminus of this base sequence : 17930
tacatcgtgattagctacagtcaccatgatgtccaatcgttctcttgaatttattcctcctttctaactgaaatgttgagtcatttgaccaacatttccccattgtccctcaacaactgctccatcctgacattgatattctctgagccagtggcaggacacgtgtgtgtgtgtgtgtgtgtgtgtgtgtgtgtgtgtgtgtgtgtttttacaggtaaaccaacagtcaatttgga

SEQ ID NO: 21839 - DNA, 157 bp, Homo sapiens
  Z16537.1_77
  Located on chromosome 16
  Distance between a terminus base of telomere on chromosomal short arm and 5'-terminus of this base sequence : 9321130
  Distance between 3'-terminus of neighbour sequence of sequence listing upward to telomere on chrosomal short arm and 5'-terminus of this base sequence : -165
aatgttgagtcatttgaccaacatttccccattgtccctcaacaactgctccatcctgacattgatattctctgagccagtggcaggacacgtgtgtgtgtgtgtgtgtgtgtgtgtgtgtgtgtgtgtgtgtgtttttacaggtaaaccaacagtc

SEQ ID NO: 21840 - DNA, 182 bp, Homo sapiens
  D16S406
  Located on chromosome 16
  Distance between a terminus base of telomere on chromosomal short arm and 5'-terminus of this base sequence : 9321157
  Distance between 3'-terminus of neighbour sequence of sequence listing upward to telomere on chrosomal short arm and 5'-terminus of this base sequence : -130
cccattgtccctcaacaactgctccatcctgacattgatattctctgagccagtggcaggacacgtgtgtgtgtgtgtgtgtgtgtgtgtgtgtgtgtgtgtgtgtgtttttacaggtaaaccaacagtcaatttggaagaacagggaagcatctgagaagagactgttttgctgaaccagc

SEQ ID NO: 21841 - DNA, 249 bp, Homo sapiens
  AC018769.2_131180
  Located on chromosome 16
  Distance between a terminus base of telomere on chromosomal short arm and 5'-terminus of this base sequence : 9353110
  Distance between 3'-terminus of neighbour sequence of sequence listing upward to telomere on chrosomal short arm and 5'-terminus of this base sequence : 31771
atgcctaaagagtaatgcataaagagatacatttaataaatagatatgtttagtatgtacccacaaacattataaataagaaaattttggagtagtaataattcacacacacacacacacacacacacacgttcgtcttcctggcagacttgttctgaacctttggtgtccatctttcatgtgtgaacctggcttcataaacccggttccaatctggcccaccagctctgataactatgctagtgcctt

SEQ ID NO: 21842 - DNA, 220 bp, Homo sapiens
  Z66933
  Located on chromosome 16
  Distance between a terminus base of telomere on chromosomal short arm and 5'-terminus of this base sequence : 9358990
  Distance between 3'-terminus of neighbour sequence of sequence listing upward to telomere on chrosomal short arm and 5'-terminus of this base sequence : 5631
agcctgaggagactgacactgttgtaataccaaggacaaacttgggctccacccccatatctctctctctctctctctctctctctctcccccccccccacacacacacacacacccgcacacaaccaggagccttaagcaaaccttgatcttgtaatgtttgaaaccctatcagaaaacagagtccctatgccttcttatctcggtctcagcgcagaaa

SEQ ID NO: 21843 - DNA, 343 bp, Homo sapiens
  AC018769.2_155847
  Located on chromosome 16
  Distance between a terminus base of telomere on chromosomal short arm and 5'-terminus of this base sequence : 9377687
  Distance between 3'-terminus of neighbour sequence of sequence listing upward to telomere on chrosomal short arm and 5'-terminus of this base sequence : 18477
aattgccactgtgtaaagtgaggcacacctcatttctcatgtgagcagatataaccatgtcatgtcactctaccatatataattctcagtggcttccccctgaggccaaccaagccccctagcatggaacacaaaacatcatagctgattccagacagctttccagtctcacccccaataccagtgcatgcaaacacacacacacacacacacacacacacatacacaaatacatcactttctgcccttcccaagcacagcatatcattttaagcctctactcacaattataataagctgacatctaataaatggtttcccctatgctggaagctttctattg

SEQ ID NO: 21844 - DNA, 213 bp, Homo sapiens
  chr16.fa.O7frz.11719528
  Located on chromosome 16
  Distance between a terminus base of telomere on chromosomal short arm and 5'-terminus of this base sequence : 9388216
  Distance between 3'-terminus of neighbour sequence of sequence listing upward to telomere on chrosomal short arm and 5'-terminus of this base sequence : 10186
gccagaactagtttcctgatagtttctgatatgaatttgttcacccaaaatgcgcacacacacacacacacgcacacactctttctcttttgaaggaattcataagttctgataaaggaggaagatgcatctcacgtcaccccactctcccattctgctgcagaagatgtacctggctcatgcaccatgctgttctagttaataggcatcaac

SEQ ID NO: 21845 - DNA, 135 bp, Homo sapiens
  DISO7_10004107
  Located on chromosome 16
  Distance between a terminus base of telomere on chromosomal short arm and 5'-terminus of this base sequence : 9548982
  Distance between 3'-terminus of neighbour sequence of sequence listing upward to telomere on chrosomal short arm and 5'-terminus of this base sequence : 160553
agaggcaaccacatttagcaatttctttgtatctttccagagttgttttatgcagacaaatatagcttttggagaggtgtgtgtgtgtgtgtgtgtgtgtgtgtgtgtgtgtgtatctgtctgtgcatgcatttc

SEQ ID NO: 21846 - DNA, 393 bp, Homo sapiens
  chr16.fa.O7frz.12135301
  Located on chromosome 16
  Distance between a terminus base of telomere on chromosomal short arm and 5'-terminus of this base sequence : 9618894
  Distance between 3'-terminus of neighbour sequence of sequence listing upward to telomere on chrosomal short arm and 5'-terminus of this base sequence : 69777
gagaccaggatttcgagaccagcctggccaatatggcaaaaccccatttctacttaacatacaaaaactagctgggtatggtggtacacgtctgtaatcccagcttctcgggaggctgagacacaagaatcgcttgaaccggggaggcagaggttgcagtgagccaagatagcgccactgcactccagcctgggtgacagagcaagactccgtctcaaaaagaaagaaaaaaaagaacgaatgaaagagagagagagaaaaaaagaaagagagaaaaaaatgagagagagagaaagaaaagaaagaaagacagaaagaaaaaaagaaaagagaagagaaaggaaaagaaaaaaaaaaaaaaaagaaaagagctttcttagttacacattcatc

SEQ ID NO: 21847 - DNA, 96 bp, Homo sapiens
  D16S3020
  Located on chromosome 16
  Distance between a terminus base of telomere on chromosomal short arm and 5'-terminus of this base sequence : 9722390
  Distance between 3'-terminus of neighbour sequence of sequence listing upward to telomere on chrosomal short arm and 5'-terminus of this base sequence : 103103
gccagactctgctgtattttctctctgtctctgtgtgtgtgtgtgtgtgtgtgtgtgtgtgtgtgtgtgtgtgtgtgtgtgtgaatgctctcacct

SEQ ID NO: 21848 - DNA, 121 bp, Homo sapiens
  DISD22_0010079
  Located on chromosome 16
  Distance between a terminus base of telomere on chromosomal short arm and 5'-terminus of this base sequence : 9961664
  Distance between 3'-terminus of neighbour sequence of sequence listing upward to telomere on chrosomal short arm and 5'-terminus of this base sequence : 239178
acgatgacctagagcaagcaagttaaaataaataaaaaataaataaataaataaataaataaataaataaataaaaaagagtcacctcaaaccacttaaaaggaagacaggacaattgcca

SEQ ID NO: 21849 - DNA, 399 bp, Homo sapiens
  AC040167.3_167636
  Located on chromosome 16
  Distance between a terminus base of telomere on chromosomal short arm and 5'-terminus of this base sequence : 10149541
  Distance between 3'-terminus of neighbour sequence of sequence listing upward to telomere on chrosomal short arm and 5'-terminus of this base sequence : 187756
tgaacagtgaattcttgaagagagagatcaggatgatgatgatgatggtggtgatgatatggtgatgatggtaatgatgatgatggtgatgatatggtgatgatagtgatgatgatgatgacaatggtggtaatgatgatggtgatgatatggtgatgatggtgacaataattatgatgatggtgatgattatggtaatggtgataatgctgctgatgatatgataatggtggtgatgatggtggtgatatgatgatagtgatgatgagaatgataatggtatggtgatgatagtgatattgttgatgatgttgatgatgacatggtgatggtggcaataatgatggtgatggtgatgatatctgatgatggtgatgatagtgacaattatggtgttgg

SEQ ID NO: 21850 - DNA, 186 bp, Homo sapiens
  HUMUT1547
  Located on chromosome 16
  Distance between a terminus base of telomere on chromosomal short arm and 5'-terminus of this base sequence : 10156758
  Distance between 3'-terminus of neighbour sequence of sequence listing upward to telomere on chrosomal short arm and 5'-terminus of this base sequence : 6818
atgtaccaccctcgtaatccacagttcgttcctttcttccttccttccttccctccttccttccttccttccttccttccttccttccttccttccttccttccttttttttttttgagatggggtcttgctctgtcacccaggctggagtgcagtggcacaatcttggcttactacaacctccac

SEQ ID NO: 21851 - DNA, 425 bp, Homo sapiens
  AC040167.3_143577
  Located on chromosome 16
  Distance between a terminus base of telomere on chromosomal short arm and 5'-terminus of this base sequence : 10173616
  Distance between 3'-terminus of neighbour sequence of sequence listing upward to telomere on chrosomal short arm and 5'-terminus of this base sequence : 16672
taattggcgataatgacattagttagaaccaaatgtgtattacccgttggaagatgttatgcacgatttatttatttatttatttatttatttatttatttatttttgagacagagtttcgctctgtcacccaggctggagtgcagtgtcgtgatctcagctcactgcaacctccatctccccgtttcaagcgatcctcctgcctcagcctcccgagtagctgggattacaggcatagccaccacacccagctaatttttgtatttttagtagagacagggtttcatcatgttggccaggctgttctcgaacccctgacctcaagtgatccgcccgcctcagcctcccaaagtgctgggattacaggcatgagccaccgtacccagcctggtatgcaggttttcttgaagctcctttggtagtac

SEQ ID NO: 21852 - DNA, 318 bp, Homo sapiens
  AC040167.3_26810
  Located on chromosome 16
  Distance between a terminus base of telomere on chromosomal short arm and 5'-terminus of this base sequence : 10208959
  Distance between 3'-terminus of neighbour sequence of sequence listing upward to telomere on chrosomal short arm and 5'-terminus of this base sequence : 34918
aggtgcctgtaatcttaggtacttgggaggctgaggcaggagaatcgcttgaacctgggaggcggaggttgcagtgaaccaagattgggccattgcactccagcccaggtgacagagtgagacttcgttttcaaaacaaacaaacagcaaactatttatctatctatctatctatctatctatctatctatctatctatctatccatctgtctctcatatgcccataaatatatacacctactatatacccacaaaaattaaaaataaaaaattttttttagaagtgttctgctgtgtgaccttaggctgattatttc

SEQ ID NO: 21853 - DNA, 230 bp, Homo sapiens
  HUMUT7613
  Located on chromosome 16
  Distance between a terminus base of telomere on chromosomal short arm and 5'-terminus of this base sequence : 10208960
  Distance between 3'-terminus of neighbour sequence of sequence listing upward to telomere on chrosomal short arm and 5'-terminus of this base sequence : -317
ggtgcctgtaatcttaggtacttgggaggctgaggcaggagaatcgcttgaacctgggaggcggaggttgcagtgaaccaagattgggccattgcactccagcccaggtgacagagtgagacttcgttttcaaaacaaacaaacagcaaactatttatctatctatctatctatctatctatctatctatctatctatctatccatctgtctctcatatgcccataaata

SEQ ID NO: 21854 - DNA, 436 bp, Homo sapiens
  AC040167.3_81754
  Located on chromosome 16
  Distance between a terminus base of telomere on chromosomal short arm and 5'-terminus of this base sequence : 10269445
  Distance between 3'-terminus of neighbour sequence of sequence listing upward to telomere on chrosomal short arm and 5'-terminus of this base sequence : 60255
ccttcataacttcaatacagtcacttccacccaacccaatttaatccaatctatccatctatccacccacctactcatccatccatccactcaactatccatccatccacccacttgctcaactatccatctatccacccgcccactcaactatgcatccatccacccacctattatacatcatccatccatccatccatccatccatccatccatccacttagccactcattcatccatccatcaatccacctacccacccaccaaaatatccatcatccatccatgcatttctccattcatgcattcacctacccatttacccattcactatttaattcaaccattctctctttctctctcatatcatttgttctttcaaccattccataaacacttattgagcacctactatgtatctggaaatgtagatgag

SEQ ID NO: 21855 - DNA, 454 bp, Homo sapiens
  chr16.fa.O7frz.12740522
  Located on chromosome 16
  Distance between a terminus base of telomere on chromosomal short arm and 5'-terminus of this base sequence : 10396560
  Distance between 3'-terminus of neighbour sequence of sequence listing upward to telomere on chrosomal short arm and 5'-terminus of this base sequence : 126679
gctaaatattgagtacatgtggacacaaagaagggaacaacagacgccagagctgcgtgagggtggaaggttggaggagggtaaggataaaaaaaattacgtattgggtactatgcttattacctgggaaaggaaataatttgtgcaccaaaccccagcaataggcagtttacccatgtaacaagcgtgtgtatgtacccccaaatctaaactaaaagttagaaggagaaaaagttctcttggcatcacctcccctctaaaatgtatttggatgggatggcagatttgccatcttccttcctgtttctctattccctcatgggaccttgaatcaatctctccgttttaccttcctctctctctgtctttgacacacacacacacacacacacacacacacacacacacacacacagctcttcatttatttgcctatttacttgccttcatgtca

SEQ ID NO: 21856 - DNA, 238 bp, Homo sapiens
  chr16.fa.O7frz.12833105
  Located on chromosome 16
  Distance between a terminus base of telomere on chromosomal short arm and 5'-terminus of this base sequence : 10489399
  Distance between 3'-terminus of neighbour sequence of sequence listing upward to telomere on chrosomal short arm and 5'-terminus of this base sequence : 92385
ggcagatgaatttagaggatacactttaaatgactatggttgggagtcagagtgggtaagagaattataaagaaagaggttgagagaattgacacgcacatacacagagagagaaagggagagagagagagagagagagtgatttacagaaagagacagtgtgagacatgggagagtgagaaaaatacaaagaatttaaagaagtgtgtagaaagagtctgagatagttgacatgcac

SEQ ID NO: 21857 - DNA, 302 bp, Homo sapiens
  AC007221.2_172869
  Located on chromosome 16
  Distance between a terminus base of telomere on chromosomal short arm and 5'-terminus of this base sequence : 10602053
  Distance between 3'-terminus of neighbour sequence of sequence listing upward to telomere on chrosomal short arm and 5'-terminus of this base sequence : 112416
gactagtgacagaggcaatatcacacacacacacacacacacacacacacgaaggtagcaaatgcatgataaaggtgcctttttaattggtgtggagcatacggattgtttaatctatagtgcttgaacaactggctaagtattgggagaaaaaacagatagctccctactttcagcaaaacaccaagcaaaatcgctagtggctgagcttgctgtcctctcgtataactcgcttcctccagccatccgtgtttagtgcaacggtcaacagcattcattacagtgacgtaatttcctgttta

SEQ ID NO: 21858 - DNA, 123 bp, Homo sapiens
  D16S404
  Located on chromosome 16
  Distance between a terminus base of telomere on chromosomal short arm and 5'-terminus of this base sequence : 10623337
  Distance between 3'-terminus of neighbour sequence of sequence listing upward to telomere on chrosomal short arm and 5'-terminus of this base sequence : 20982
ttaaagtatgtggcagtccctgccaactctctctctctctctctctctctctcacacacacacacacacacacacacacactttctcctgccttcaccatgggaactgccttctcctacctcg

SEQ ID NO: 21859 - DNA, 382 bp, Homo sapiens
  AC006531.1_45757
  Located on chromosome 16
  Distance between a terminus base of telomere on chromosomal short arm and 5'-terminus of this base sequence : 10798673
  Distance between 3'-terminus of neighbour sequence of sequence listing upward to telomere on chrosomal short arm and 5'-terminus of this base sequence : 175213
ttccttagaaatcctatgcataccccagaaaataagcatcaggtaatctctccaagggcacaactgtgcctaaatattattattattattattattattattcagatggagtctcactccattgcccaggctggagtgcaatggtgcgatctcagctcactgcaacctccacctcctgggttcaagtgattcttgtgcctcagcctcccaaatagctgggattacaggtgcctgccaccactcccggctaatttttatatttttagtagagacagggtttcaccaggttggtcaggctggtcttgaactcctggcctcaagtgatccacccacctcggcttcccaaagtgctgggattacaggtgctaattatgattagatc

SEQ ID NO: 21860 - DNA, 393 bp, Homo sapiens
  AC006531.1_100786
  Located on chromosome 16
  Distance between a terminus base of telomere on chromosomal short arm and 5'-terminus of this base sequence : 10853654
  Distance between 3'-terminus of neighbour sequence of sequence listing upward to telomere on chrosomal short arm and 5'-terminus of this base sequence : 54599
gaaatcatacagtccttgtcaatcacatgctatttttggagcttggagggaaaatgaagttccaggacaccttgccaaacttctggttatatttatacacaaccaggacaggcaagcacgcttgtgtgtgtgtgtgtgtgtgtgtgtgtgtgtgtgctgtatacatgtacatgtatatgcacatatggatcccattgagttttcaggcatcaacttcattgctacagaacccctctcttctctcctttacatggcacaggacaagagggttcagaatcattaatagcacaggcttagagatcagacagatgaacaggttcaaatcttgtcactgctttagccatgtgaccttgaacaagccacataatctttttgaacctcagttcactcaat

SEQ ID NO: 21861 - DNA, 443 bp, Homo sapiens
  AC006531.1_105403
  Located on chromosome 16
  Distance between a terminus base of telomere on chromosomal short arm and 5'-terminus of this base sequence : 10858193
  Distance between 3'-terminus of neighbour sequence of sequence listing upward to telomere on chrosomal short arm and 5'-terminus of this base sequence : 4146
aagcaataccatcagtacacctacacatatatgtatacatattcctatacatctatacatgaacctctacataaaagcacacttatatacaggtacattcatgcctacccacgctcacattataatcacatacgctcacacccacacgtacaactacaaatacacacatacctaacacaaacacatatactcgaacctctacacacacacacacacacacacacacacacacacagagaggatatgaagctacaatgatgcatacacttttcacaaaacacaccctgaacgacacccactttcctgcctatgcctacactatttcttctgcctggaattcttctccttattatctccccctactgaaatcctacccactcttttcaggcctagctcaaatgccaatactcccatggaacctaattctccatctggaattcatt

SEQ ID NO: 21862 - DNA, 154 bp, Homo sapiens
  DISO7_10006166
  Located on chromosome 16
  Distance between a terminus base of telomere on chromosomal short arm and 5'-terminus of this base sequence : 10934221
  Distance between 3'-terminus of neighbour sequence of sequence listing upward to telomere on chrosomal short arm and 5'-terminus of this base sequence : 75585
gagcatgatttcttaattcaaggttcatttttcagatatatgttattggtaagaagtatattctgtctagttcgtcacacacacacacacacacacacacacacacacacacacacacacactcctccagccccagttcagagataacctctga

SEQ ID NO: 21863 - DNA, 308 bp, Homo sapiens
  AC026423.5_50636
  Located on chromosome 16
  Distance between a terminus base of telomere on chromosomal short arm and 5'-terminus of this base sequence : 10966870
  Distance between 3'-terminus of neighbour sequence of sequence listing upward to telomere on chrosomal short arm and 5'-terminus of this base sequence : 32495
tattgcaacgtgattcttactcccattttgcaggaaaaaaggaggaggctgaaagaggttgaaaatagatacaagttaatctccccgacactccccctatccattcaatgacaatctctctaggctttgtattgcttccttccttcttctctcccctgcatctatcatttctttgcctctattgacttgtatgtatgtatgtatgtatgtatgtatgtatgtatgtatgtatacatgtacgtatgtatgtatttagagatggagtttcgctcttattacccaggctggagtgcaatggtacgatcttg

SEQ ID NO: 21864 - DNA, 308 bp, Homo sapiens; identical to SEQ ID NO: 21863
  AC027685.4_25460
  Located on chromosome 16
  Distance between a terminus base of telomere on chromosomal short arm and 5'-terminus of this base sequence : 10966870
  Distance between 3'-terminus of neighbour sequence of sequence listing upward to telomere on chrosomal short arm and 5'-terminus of this base sequence : -308

SEQ ID NO: 21865 - DNA, 275 bp, Homo sapiens
  D16S3126
  Located on chromosome 16
  Distance between a terminus base of telomere on chromosomal short arm and 5'-terminus of this base sequence : 10978535
  Distance between 3'-terminus of neighbour sequence of sequence listing upward to telomere on chrosomal short arm and 5'-terminus of this base sequence : 11357
aaacgcttggaggctatacagtcctatatacatataagggactatgggactatatatatatatatatatatatatatatatatatatatatatatatatatgtatacgtatgtatttatctaggacttatattctgtgtgtgtgtgtgtgtgtgtgtgtgtgtatgagataaaagtatatatacccaagatatttatattatattgaaaatgaaactatagactctggtgatattggaaaattcccctatataactagggaatagtccagacatg

SEQ ID NO: 21866 - DNA, 175 bp, Homo sapiens
  D16S3064
  Located on chromosome 16
  Distance between a terminus base of telomere on chromosomal short arm and 5'-terminus of this base sequence : 10986986
  Distance between 3'-terminus of neighbour sequence of sequence listing upward to telomere on chrosomal short arm and 5'-terminus of this base sequence : 8176
tacagttgatgtcaggggcaggaatcaagagtgaagaaaaggagatgtcaagatgtctggggagtgtgtctctcctgaacactgaaggaaagagatcataggggtgtgtgtgtgtgtgcgtgtgtgtgtgtgtgtgtgtgtgtgacacagaaagaggtcttacaaacacacattt

SEQ ID NO: 21867 - DNA, 150 bp, Homo sapiens
  D16S407
  Located on chromosome 16
  Distance between a terminus base of telomere on chromosomal short arm and 5'-terminus of this base sequence : 11101455
  Distance between 3'-terminus of neighbour sequence of sequence listing upward to telomere on chrosomal short arm and 5'-terminus of this base sequence : 114294
ctcgcgctgggtacagttatccccctccacgcacaggcgcgccgacacacacacacacacacacacacacacacacacacacacagagtctgctccaatgcttctccctgtgcctcgccacccccgtacgggaacccactcctctgatct

SEQ ID NO: 21868 - DNA, 222 bp, Homo sapiens
  AC027277.2_161755
  Located on chromosome 16
  Distance between a terminus base of telomere on chromosomal short arm and 5'-terminus of this base sequence : 11450620
  Distance between 3'-terminus of neighbour sequence of sequence listing upward to telomere on chrosomal short arm and 5'-terminus of this base sequence : 349015
tatttctagagcctcagaggacccatccaccattcattcattcattcattcattcattcattcattcattcatcaacataaatcataacttgcatgcatgtgccaggcacaggggataccctctagagacaatctcctcctagggctcatggcctagtggaggagacagattaaaacttaattagaaaaactggctgggtacagtggctcatgcttgtaatc

SEQ ID NO: 21869 - DNA, 403 bp, Homo sapiens
  chr16.fa.O7frz.14184960
  Located on chromosome 16
  Distance between a terminus base of telomere on chromosomal short arm and 5'-terminus of this base sequence : 11530355
  Distance between 3'-terminus of neighbour sequence of sequence listing upward to telomere on chrosomal short arm and 5'-terminus of this base sequence : 79513
ataactgaccgtctgaattctttttcaggtaaatcagggatttcttcttggtttggatccactgctggtgagctagtgtgattgtgtgtgtgtgtgtgtgtgtgtgtgtgtgtgtgtttgggcgggggggtgggggatgttaaggaaccttgttttgtcatattaccagagttggttttctggttccttcccatttgggtaggctctgtcagaggaaaggtttagggatcaagactgttgttcagattcttttgtcccacgggatgttcccttgatgcagtactcttccccttttcctaggaatgtggctttctgagagctgagctgtagtgattgttatctctctttaaaattaaatacctagtaactaaccgaagatgtgaaagatacctacaatgaagac

SEQ ID NO: 21870 - DNA, 270 bp, Homo sapiens
  chr16.fa.O7frz.14538438
  Located on chromosome 16
  Distance between a terminus base of telomere on chromosomal short arm and 5'-terminus of this base sequence : 11669862
  Distance between 3'-terminus of neighbour sequence of sequence listing upward to telomere on chrosomal short arm and 5'-terminus of this base sequence : 139104
tttgttctgaacctccaatagccattagagttgccaatcagtgctcagcaggaagaaagcaaagtaagggagtgagggagaagaagagggagaggaagggaaggaggaaggcaggcctttcagattgacagagactgttaatctgaaataatctctaagccaatctctaagccagtttcacttcatctgggttttttcatatatacatacatacgtgtgtgtgtgtgtgtgtgtgtgtgtgtgtgtgtgtattcaaacagactcagagtt

SEQ ID NO: 21871 - DNA, 445 bp, Homo sapiens
  AC007595.5_102369
  Located on chromosome 16
  Distance between a terminus base of telomere on chromosomal short arm and 5'-terminus of this base sequence : 11791214
  Distance between 3'-terminus of neighbour sequence of sequence listing upward to telomere on chrosomal short arm and 5'-terminus of this base sequence : 121082
gacttagcaaacgagtgtaaataggaatgaatggttttgtggggtttattttattttattttattttattttattttatttattttattgagacagagtttcactcttgttgcccaggctggagtgcagtgtcgcgatctcggctcaccacaacctccgcctcccgggctcaagcagttctcctgcctcagcctcctgaatagctggcattacagacacacgccaccacgtccagctattttttgtatttttagtagagttggggtttcaccatgttgaccaggctggtctcgaactcctgacctcaggtgatcctcccgcctcagcctcccgcagtgtttggattacaggtgtgagccactgtgcctggctgggtgtcttttaatagaacttcgaagtcagtcacagaggaccgcatgttgtgtgattccacttacatgaaatg

SEQ ID NO: 21872 - DNA, 237 bp, Homo sapiens
  U95741.1_9322
  Located on chromosome 16
  Distance between a terminus base of telomere on chromosomal short arm and 5'-terminus of this base sequence : 12187522
  Distance between 3'-terminus of neighbour sequence of sequence listing upward to telomere on chrosomal short arm and 5'-terminus of this base sequence : 395863
caaataaacgctggcatttttacagtgcttacttaccggcaaggaatcattcggggggcctgcatcttccactagacccaattcaagggaggctcatgtgaacaggtcaatgggtgggtgtgtgtgtgtgggtgggtgtgtgggtgggtgtgtgtgtgtgtgtgtgtgtgtgttcaaatcccagttcctcataacatagagggaggagtgttggtataacaagaagccaagtcatgt

SEQ ID NO: 21873 - DNA, 356 bp, Homo sapiens
  U95741.1_11190
  Located on chromosome 16
  Distance between a terminus base of telomere on chromosomal short arm and 5'-terminus of this base sequence : 12189276
  Distance between 3'-terminus of neighbour sequence of sequence listing upward to telomere on chrosomal short arm and 5'-terminus of this base sequence : 1517
ccacaatttcagtatcatttaaagctaatggttttccctttaattattgcagattaaagcttccctcatttatatgcattatttgagagttttatctggaacacatgaatatcaaagaaggcctttgagctttttcaaaacacattccttctcactgtttaaaacaattacaagtttctgtacagaaaattttctagctctatgttgttaaacaagttcaagggtaattggactctgcttgtttaaatgataaagacagatgatagatagatagatagatagatagatagatagatagatagatagataggaaaattaggcacatagctaaatagttattcgtggtacatggatag

SEQ ID NO: 21874 - DNA, 151 bp, Homo sapiens
  G07929
  Located on chromosome 16
  Distance between a terminus base of telomere on chromosomal short arm and 5'-terminus of this base sequence : 12189488
  Distance between 3'-terminus of neighbour sequence of sequence listing upward to telomere on chrosomal short arm and 5'-terminus of this base sequence : -144
caagttcaagggtaattggactctgcttgtttaaatgataaagacagatgatagatagatagatagatagatagatagatagatagatagatagataggaaaattaggcacatagctaaatagttattcgtggtacatggatagagatagg

SEQ ID NO: 21875 - DNA, 268 bp, Homo sapiens
  U95743.1_94179
  Located on chromosome 16
  Distance between a terminus base of telomere on chromosomal short arm and 5'-terminus of this base sequence : 12315782
  Distance between 3'-terminus of neighbour sequence of sequence listing upward to telomere on chrosomal short arm and 5'-terminus of this base sequence : 126143
tttaggactgcattatcctaataccaaaccagacaaagaaatgaaagaaatgcaaaaggaagcaagcaaacaaggaagcaagcaagacagacagacagaaagaaggaaagagagaaagaagaaagaaagaaagaaagagagagaaagaaagaaagaaagagagaaagaaagagagagagagagagagaaagaaagaaagaaagaaagaaagaaagaaagaaagaaagaaagagtccaaaatcggttgtccaatagagctttctgctat

SEQ ID NO: 21876 - DNA, 195 bp, Homo sapiens
  U95743.1_110605
  Located on chromosome 16
  Distance between a terminus base of telomere on chromosomal short arm and 5'-terminus of this base sequence : 12332352
  Distance between 3'-terminus of neighbour sequence of sequence listing upward to telomere on chrosomal short arm and 5'-terminus of this base sequence : 16302
cttctgaataacttagcaaacgagtcttctgagggggcaggacacacacacacacacacacacacacacacacacacacacacaccccaaggtcatcaaatctgcgcccttggctctggtaggaacccaatcaaggcatcacagataggcactgctcctatatgcagaatcctactgtatgagtttcctattgcc

SEQ ID NO: 21877 - DNA, 283 bp, Homo sapiens
  U95743.1_166833
  Located on chromosome 16
  Distance between a terminus base of telomere on chromosomal short arm and 5'-terminus of this base sequence : 12388543
  Distance between 3'-terminus of neighbour sequence of sequence listing upward to telomere on chrosomal short arm and 5'-terminus of this base sequence : 55996
taaggaagtattgccaagacaaagaatttcctagtaagagtactgaggatgccctgctgaagagttaagttatatatttctctctctctctctctctctctctctctctctctttctctctttctctccccctccccaacgccctactttctactctagagttttaaaaaagctacctcagttacccttgggaagataaatcacaactgaagcacaaatgtcatattaaaaacctttagaaacgggtttcccaacttcagcactattgacatttggaatggac

SEQ ID NO: 21878 - DNA, 456 bp, Homo sapiens
  U95743.1_181435
  Located on chromosome 16
  Distance between a terminus base of telomere on chromosomal short arm and 5'-terminus of this base sequence : 12403071
  Distance between 3'-terminus of neighbour sequence of sequence listing upward to telomere on chrosomal short arm and 5'-terminus of this base sequence : 14245
gtaggttgagttgcagtcaaagcataatccagacacaacaatacagtcaccaaggacctggtttctatctgtctcagggctctgccttccagaagttggcttcatcctctgactccaagcagtgatccttgatcatccctcccacaccactccacacacacacacacacacacacacacacacacacacacacacacacaaacacacagacacatgctctctgtctcatgatagctaaacaacagaagctattccacatctcacattctcattctcaaacgcatcttacaaaataaagaaagagtcttctgacaacttgagcacaagtctgaaaattcacttttcccattggcctgaattatataatgtgcccatccctgacccagtcactgtggccaatggtgcacaacttgctaattgccttgcaccacccactgtagcaagaatgtcaactcc

SEQ ID NO: 21879 - DNA, 278 bp, Homo sapiens
  U95743.1_184721
  Located on chromosome 16
  Distance between a terminus base of telomere on chromosomal short arm and 5'-terminus of this base sequence : 12406393
  Distance between 3'-terminus of neighbour sequence of sequence listing upward to telomere on chrosomal short arm and 5'-terminus of this base sequence : 2866
ggttcagtcatacaatagtgagaattacacacagtgcttacaaataatgaaccaggtctctcttatcacatggagcaatctcaaaaacactgagtgagaaaaacaagttgtagaatcacacacacacacacacacacacacacgcatacacatacaaaatgataccattcacaaaattattaaaatccattaaactgtatattgttgatgtattagccacaagtttaaaaacataggtcaggagcatttacaccatcttcatgaaagtgattgcttct

SEQ ID NO: 21880 - DNA, 464 bp, Homo sapiens
  U95743.1_186030
  Located on chromosome 16
  Distance between a terminus base of telomere on chromosomal short arm and 5'-terminus of this base sequence : 12407625
  Distance between 3'-terminus of neighbour sequence of sequence listing upward to telomere on chrosomal short arm and 5'-terminus of this base sequence : 954
ggcctttggtaacttctaatctaccttctgtctctataaatttccctattctagatatttcatacaagtagaatcacacaatatttgtcctttttgttggcctatatcacttagcataatgctttcaaagtcaatccatgttgtaacatgtatcagaactttctttctttttatggctgaataataccccagcgtgtgtgtgtgtgtgtgtgtgtgtgtgtgtgtgtgtgtaccacattttgtttatttattcatctgttgatgaactcttgggttgttttcaccttttggctattgtgaataatgctacaataaacattgccatggaagtaactattggagtccgtgtttccaattttttgttgtatacctaggaacagaattgctaggtcatatggtaactctatgtttcattttttgaggaaccactatactcctttccatagcatctaaaccgtcctaca

SEQ ID NO: 21881 - DNA, 315 bp, Homo sapiens
  U91322.1_39435
  Located on chromosome 16
  Distance between a terminus base of telomere on chromosomal short arm and 5'-terminus of this base sequence : 12584765
  Distance between 3'-terminus of neighbour sequence of sequence listing upward to telomere on chrosomal short arm and 5'-terminus of this base sequence : 176676
cagtgataggagcactcagtagtgactaaaccagactgggagtatcacggaagtcttcctggaggaggtgacatctgaactgtcaccttatgagacttatgagactgaaaaaatgacttctgccatttaggtgatcccaccaaaacacgctggagcctcacatgacaacacttggtgtctaagactcccgtagtccctagtaaaggccttgtcattcattcattcagtcagtcagtcagtcagtcagtctactaagtgtcaataaacaccaactggtgacaagatgatcctcacctaggttctccacaagcatta

SEQ ID NO: 21882 - DNA, 242 bp, Homo sapiens
  Z67674
  Located on chromosome 16
  Distance between a terminus base of telomere on chromosomal short arm and 5'-terminus of this base sequence : 12709024
  Distance between 3'-terminus of neighbour sequence of sequence listing upward to telomere on chrosomal short arm and 5'-terminus of this base sequence : 123944
tccattggtcagtggtttacatttttaaagataaaatgtgtgtgtgtgtgtgtgtgtgtgtgtatgcttatctatatataacaaaatgcacaaatctaaggcacactgttggatgagttttgatatatgcatatgcctaagtgcccgaaacatttaccaagatacagagcattgctatcaccgcagaaagtttctttctgctctttcgcaatcattttctaccctagcccctctgagacagc

SEQ ID NO: 21883 - DNA, 219 bp, Homo sapiens
  D16S3079
  Located on chromosome 16
  Distance between a terminus base of telomere on chromosomal short arm and 5'-terminus of this base sequence : 12885240
  Distance between 3'-terminus of neighbour sequence of sequence listing upward to telomere on chrosomal short arm and 5'-terminus of this base sequence : 175974
cctgggagatggagattacagtgagccaacattgcaccattgcactccagcctgggaaagagcaaaactccatgtcacacacacacacacacacacacacacacacacacacacacacacacaaaggggacttgaggaagcatgggtaggaagtggggaagagagtcaagaaaggaagcccacccacaggggtgtgttatgaaatgagttacctctgtg

SEQ ID NO: 21884 - DNA, 121 bp, Homo sapiens
  DISO7_10006180
  Located on chromosome 16
  Distance between a terminus base of telomere on chromosomal short arm and 5'-terminus of this base sequence : 13074023
  Distance between 3'-terminus of neighbour sequence of sequence listing upward to telomere on chrosomal short arm and 5'-terminus of this base sequence : 188564
tgcctcttcctctgaagacaaaaacacttgttatctgtattcattcattcatgcatgcattcattcattcatccatccatccatccatccatccatccatcccccaccttgactcactccc

SEQ ID NO: 21885 - DNA, 156 bp, Homo sapiens
  AC002045.1_123159
  Located on chromosome 16
  Distance between a terminus base of telomere on chromosomal short arm and 5'-terminus of this base sequence : 13232867
  Distance between 3'-terminus of neighbour sequence of sequence listing upward to telomere on chrosomal short arm and 5'-terminus of this base sequence : 158723
cctagtgcatagtctggcttcctttgtgtgtgtgtgtgtgtgtgtgtgtgtgtgtgtgtgtgtgtgtgtgtgtgtgtgtttaatatagagacagggtctcactatgttgcctaggctggtttcaaactcctggtctccagtgatattactgcttcg

SEQ ID NO: 21886 - DNA, 258 bp, Homo sapiens
  AC002045.1_40898
  Located on chromosome 16
  Distance between a terminus base of telomere on chromosomal short arm and 5'-terminus of this base sequence : 13315021
  Distance between 3'-terminus of neighbour sequence of sequence listing upward to telomere on chrosomal short arm and 5'-terminus of this base sequence : 81998
ccttgaggtgagcttgaagctttgggtatcttcctctcagagaatgtaaacccatttttccaacattgttgtaaaatattctgttcccacctttcccacaatcagcttgcctgaccccaccacagggtgtgtcatcttgtgcttctggcacacacacacacacacacacacacacacacactcagagccctgccatctgaaggcagccagctccagaaaggccaacccttagctgtaactcagcatagcactgttcat

SEQ ID NO: 21887 - DNA, 289 bp, Homo sapiens
  AC002045.1_31279
  Located on chromosome 16
  Distance between a terminus base of telomere on chromosomal short arm and 5'-terminus of this base sequence : 13324596
  Distance between 3'-terminus of neighbour sequence of sequence listing upward to telomere on chrosomal short arm and 5'-terminus of this base sequence : 9317
cctatgaaagtcatggatgtcttaggctgggttttcccagaggcagatcctgtgatgaggatttccatgtaatggtttatttgtagggtgactctgggaagcaccagtaggagaatgggagtgtattagtcagggttctttagagaagtagaaccaatagaatagcacacacacatacacacacacatatgcatatacatatacacacacacacacacacacacatatataagcatatggggaatccataagcttccttccatgaggtgctcctggctaatgactgagc

SEQ ID NO: 21888 - DNA, 396 bp, Homo sapiens
  AC002045.1_31082
  Located on chromosome 16
  Distance between a terminus base of telomere on chromosomal short arm and 5'-terminus of this base sequence : 13324864
  Distance between 3'-terminus of neighbour sequence of sequence listing upward to telomere on chrosomal short arm and 5'-terminus of this base sequence : -21
gctcctggctaatgactgagcatggcagggacactaaagcagacctctccccaggagacacaggattcccctgtccccagctttggcttagagacttctctatggtccatatatatatatatatatatgtgtgtgtgtgtgtgtgtgtgtgtgtatatatacacacatgtatatgtacacacacacacacacacacatatatgtgtgtgtatgtgtgtatatatatatacacatacatatatgtatctatatgcacttttatatacatacattcacatacatatatgtatctatatgcacttttatatatatgtgtgtgtgtgtgtgtatgtgtgtgtgtgtatgcaattatggaggctgacaagtcctaagatctgcagaatgagtcagtaagct

SEQ ID NO: 21889 - DNA, 279 bp, Homo sapiens
  AC002492.1_7582
  Located on chromosome 16
  Distance between a terminus base of telomere on chromosomal short arm and 5'-terminus of this base sequence : 13326007
  Distance between 3'-terminus of neighbour sequence of sequence listing upward to telomere on chrosomal short arm and 5'-terminus of this base sequence : 747
tcaaacatcaggctctatccacccagcagtgttggaccttggagtggcacaggcatcagaatcttccctggggattaacttattgtggttcttgaacagagaggatatatatctggaggtgccagcctctacttgccctcccacatggagagagatggagaataaggctgagcaaagacaaacagtgaagagaaatggagacagagagagagagagagagagagagagagcgagagagagagagagagagagtatacatgtactttgaggcagtgagtc

SEQ ID NO: 21890 - DNA, 202 bp, Homo sapiens
  AC002045.1_29863
  Located on chromosome 16
  Distance between a terminus base of telomere on chromosomal short arm and 5'-terminus of this base sequence : 13326084
  Distance between 3'-terminus of neighbour sequence of sequence listing upward to telomere on chrosomal short arm and 5'-terminus of this base sequence : -202
acttattgtggttcttgaacagagaggatatatatctggaggtgccagcctctacttgccctcccacatggagagagatggagaataaggctgagcaaagacaaacagtgaagagaaatggagacagagagagagagagagagagagagagagcgagagagagagagagagagagtatacatgtactttgaggcagtgagtc

SEQ ID NO: 21891 - DNA, 394 bp, Homo sapiens
  AC002045.1_28133
  Located on chromosome 16
  Distance between a terminus base of telomere on chromosomal short arm and 5'-terminus of this base sequence : 13327842
  Distance between 3'-terminus of neighbour sequence of sequence listing upward to telomere on chrosomal short arm and 5'-terminus of this base sequence : 1556
actgaaacttcattaggttgaaggggaatttaccttttcactacgtctgagcaaagggtttattcggtaaggtatatttatattatattatattatattatattatattatattatattatattagtgccccatggaaattatatttgtttctctacagataacaaagattcttatttctctcttaaaattcaaaataaagagtcttactgacatctaccataaatcctctgctgtaaccaggtagagtataaataactccataaaaagagagtaatgctgtcttgcatttgcacagcactttacagtttagaaagtatttgcttgccatgtccctttcgatcctcctgataggtttgcggggtaggaaggagaggtactgtcatttccatctt

SEQ ID NO: 21892 - DNA, 447 bp, Homo sapiens
  AC002492.1_91853
  Located on chromosome 16
  Distance between a terminus base of telomere on chromosomal short arm and 5'-terminus of this base sequence : 13410065
  Distance between 3'-terminus of neighbour sequence of sequence listing upward to telomere on chrosomal short arm and 5'-terminus of this base sequence : 81829
ttcatgcatctctttctacaagatgagaaggatcagagggtgaggattggagctgggtgtcttaaaaatctgtgagagtggaagctaagccagttatgtttgctttgtagctattcttgtgatattataatcctttagagtggtgaggttggtgggagtggtaaaaacaaacaaacaaacaaacaaacaaaacctagtttctttgtcttggattttcctatctcagtttatagagagagactatccatcatattttattttagcttaaccaaagttttactttttgttgtttctttttttctttgctgggatcttaaaagagattgaataaaaattcagttgtaggaatggctttaccttcctctctggtcttggtgttttgtttttagactatgatatcacatgtcaagactatgatatcatatcaggactaggatatcaagttta

SEQ ID NO: 21893 - DNA, 359 bp, Homo sapiens
  AC002492.1_98187
  Located on chromosome 16
  Distance between a terminus base of telomere on chromosomal short arm and 5'-terminus of this base sequence : 13416460
  Distance between 3'-terminus of neighbour sequence of sequence listing upward to telomere on chrosomal short arm and 5'-terminus of this base sequence : 5948
ttgctaaattggctctgtctaggcagggggccaggtgaacccattggatggtatatttctcaagagtcaaatattaataggtttaacatgtaagactgacatatgtgtgtgtgtgtgtgtgtgtgtgtgtttacatatacatatatttcaatagcttttggggttcaagtggtttttggttacatggatgaattataaattatatagtggtaaagtctaagattttagtacctgtcacctgagtagtgtacactgtacccaatatgtagtttttgtatccttcattcccttttcatcctctcctcttctgagtctccagtgtccattatatcactctgtatgcctttatgtacctatgg

SEQ ID NO: 21894 - DNA, 385 bp, Homo sapiens
  AC002492.1_151371
  Located on chromosome 16
  Distance between a terminus base of telomere on chromosomal short arm and 5'-terminus of this base sequence : 13469604
  Distance between 3'-terminus of neighbour sequence of sequence listing upward to telomere on chrosomal short arm and 5'-terminus of this base sequence : 52785
ggaatagttggtgtacctcatccgtctatctctccatccacctacccacctatatacccaactaccctccatccatccacctactctccattcacccacccactcacccatccacccatccacccacccacccatccatctacccatccatccatccatccatccatccacgcattcatccaaacacccatctatccatccacccacccatccgtccatgggttcattcatccatccatctaccaatccactcatccatccaataaatatttttgagcacctgtgctaaatgcatatacacacacacatatctatgcacacacatacatacacactgatatatatcacacacatgcatacacacacacggagaataaccggtact

SEQ ID NO: 21895 - DNA, 213 bp, Homo sapiens
  D16S499
  Located on chromosome 16
  Distance between a terminus base of telomere on chromosomal short arm and 5'-terminus of this base sequence : 13570370
  Distance between 3'-terminus of neighbour sequence of sequence listing upward to telomere on chrosomal short arm and 5'-terminus of this base sequence : 100381
ggtggaccctaattgcataggattggtgtccttgtaagaaggggagattagacacacacacacacacacacacacacacacacacacgcagagggaagggcacatgaagacacaaggagaagacggccatctacaagcccaggagacaggcctcagaagagacaaccctactgtcaccttaatcttggacttccagcctccagaactgtgaga

SEQ ID NO: 21896 - DNA, 174 bp, Homo sapiens
  Z23839.1_81
  Located on chromosome 16
  Distance between a terminus base of telomere on chromosomal short arm and 5'-terminus of this base sequence : 13570387
  Distance between 3'-terminus of neighbour sequence of sequence listing upward to telomere on chrosomal short arm and 5'-terminus of this base sequence : -196
taggattggtgtccttgtaagaaggggagattagacacacacacacacacacacacacacacacacacacgcagagggaagggcacatgaagacacaaggagaagacggccatctacaagcccaggagacaggcctcagaagagacaaccctactgtcaccttaatcttggact

SEQ ID NO: 21897 - DNA, 206 bp, Homo sapiens
  AC004020.1_3786
  Located on chromosome 16
  Distance between a terminus base of telomere on chromosomal short arm and 5'-terminus of this base sequence : 13647529
  Distance between 3'-terminus of neighbour sequence of sequence listing upward to telomere on chrosomal short arm and 5'-terminus of this base sequence : 76968
agcattaggacgattacctaatgcatgcggggcttaagacctagatgatgggttgataggtgcagcaaaccaccatggcacatgtatacctacgtaacagacctgcacgttctgcacttgtatcccagaacttaaagtataataataataataataataataataataataataataataaagcttatcctagctgttggatgtag

SEQ ID NO: 21898 - DNA, 152 bp, Homo sapiens
  AC004097.1_44360
  Located on chromosome 16
  Distance between a terminus base of telomere on chromosomal short arm and 5'-terminus of this base sequence : 13748488
  Distance between 3'-terminus of neighbour sequence of sequence listing upward to telomere on chrosomal short arm and 5'-terminus of this base sequence : 100753
gaattggtgaatcctatccatagagcctctgattagtgtgaggtgtgtgtgtgtgtgtgtgtgtgtgagagagagagagagacagagagagagatttatctcactcaactattaatacaaaataaagagtaatcaggtacttaaggaaagcc

SEQ ID NO: 21899 - DNA, 193 bp, Homo sapiens
  AC004097.1_75424
  Located on chromosome 16
  Distance between a terminus base of telomere on chromosomal short arm and 5'-terminus of this base sequence : 13779524
  Distance between 3'-terminus of neighbour sequence of sequence listing upward to telomere on chrosomal short arm and 5'-terminus of this base sequence : 30884
tacttaaggccatacagctagtaaggggaagcggtgggatttgagtctgacttctgtccatctacacaggtgatgatgatgatgatgatgatgatgatgagttattactacaccatgctagttcagtggttctcaacttggcattacttaaatgtagtgggtagaggccagggatgctacgtatcctgaaatg

SEQ ID NO: 21900 - DNA, 183 bp, Homo sapiens
  HUMUT6629
  Located on chromosome 16
  Distance between a terminus base of telomere on chromosomal short arm and 5'-terminus of this base sequence : 13779530
  Distance between 3'-terminus of neighbour sequence of sequence listing upward to telomere on chrosomal short arm and 5'-terminus of this base sequence : -187
aggccatacagctagtaaggggaagcggtgggatttgagtctgacttctgtccatctacacaggtgatgatgatgatgatgatgatgatgatgagttattactacaccatgctagttcagtggttctcaacttggcattacttaaatgtagtgggtagaggccagggatgctacgtatcctga

SEQ ID NO: 21901 - DNA, 470 bp, Homo sapiens
  chr16.fa.O7frz.24794667
  Located on chromosome 16
  Distance between a terminus base of telomere on chromosomal short arm and 5'-terminus of this base sequence : 13883314
  Distance between 3'-terminus of neighbour sequence of sequence listing upward to telomere on chrosomal short arm and 5'-terminus of this base sequence : 103601
tactgctacgatggaaatagagttgattcacaccaccaccgggagttctgctggcagcccgtgatgggtgggaaggtgtaactctgaaaatgtgcaaaactactgtctaacacttgtttgtcagtgttcagattccattttgtgctgttggttttcttttctcaatgtgttggtctcggtggccaatgacctcatcaagggcagggactaagccctctgaacagctagctctgggctgagctacgtagtagatgctcagtgtgcatttggtgaccaattgctattgtcgtgtgtgtgtgtgtgtgtgtgtgtgtaagtgaaggggtgctagatgtttaattgtgtgggggctgagatatgggcttgttcttatattaatgagagtaaaatatttctccagattttaccatcattgctgattcttttttaatgtgctcaattctttgctctcttcggtaggaataacattt

SEQ ID NO: 21902 - DNA, 428 bp, Homo sapiens
  M16_14261187
  Located on chromosome 16
  Distance between a terminus base of telomere on chromosomal short arm and 5'-terminus of this base sequence : 14260975
  Distance between 3'-terminus of neighbour sequence of sequence listing upward to telomere on chrosomal short arm and 5'-terminus of this base sequence : 377191
aggaacaatggttaccactgtgcacttactgacctttactgtgtgcgcgtgtgtgtggatatttgtgtggatgtgtgtggatgtgtgtggatgtggatgtgtggatgtgtgtgggggtgttcgtatgtgggtgtctggatgtgtgtgtatatgtgtatagtggatgtgtgtgtgtggatgtgtgtgggtgtgtggatgtgtgtgtgtggatctgtgtgtgtgtatgtgtgtgtgaggatgtgtgtgtgcctgtgtgggtgtgtgtgtggatgtgggtgtgtatgtgtgcgtgtggatgtgtgtgcatgtgtggatgtgtgtgtgggtgtggatgtgtgcgtgtgtggatgtgggtatggatgtatggatatgtgtgtgtgtatggatgtgcacatgcctgtcacttagcccaggcttaaggacaagaa

SEQ ID NO: 21903 - DNA, 445 bp, Homo sapiens
  chr16.fa.O7frz.22371705
  Located on chromosome 16
  Distance between a terminus base of telomere on chromosomal short arm and 5'-terminus of this base sequence : 14262201
  Distance between 3'-terminus of neighbour sequence of sequence listing upward to telomere on chrosomal short arm and 5'-terminus of this base sequence : 798
cttcaagtttataaactccatgagggcagagaccttatccaatttcctcacaacgtcttcccagcatttggaacaatgcctggcactgagtgtcatgaatatttgtcaaatgtgcaataaattattctttctcactccatccttaccccaacaatcctcttacacacacacacacacacacacacacacacacacgtgagacactcttggcacagagtaggagagaaaaaaatttcagaccctactgatcattttcaggctcaggcgaggaagctttaagtgacaggaatgtgacagccctgggctgaaagactcccggtggccgtagtgtaatagccgcggtgagatttgttttgtcacacctgctgcgaagtaatcaccttaatgcccatcagctgctgcagagaccatgtgagtcagcccctatttcatggttgagaatgtg

SEQ ID NO: 21904 - DNA, 196 bp, Homo sapiens
  D16S3060
  Located on chromosome 16
  Distance between a terminus base of telomere on chromosomal short arm and 5'-terminus of this base sequence : 14509526
  Distance between 3'-terminus of neighbour sequence of sequence listing upward to telomere on chrosomal short arm and 5'-terminus of this base sequence : 246880
tgccacaggggatataagccaagtgttgctggaacttctgatttttctagataatggaaacccagagtttttatgtgaagtgtacccatgttttttggtgtgtgtgtgtgtgtgtgtgtgtgtgtgtgtgtgtgtgtgtgtgagactgagtcttgctgtcacccaggttggagtgcattggtgcaatctcggctca

SEQ ID NO: 21905 - DNA, 120 bp, Homo sapiens
  D16S3127
  Located on chromosome 16
  Distance between a terminus base of telomere on chromosomal short arm and 5'-terminus of this base sequence : 14520306
  Distance between 3'-terminus of neighbour sequence of sequence listing upward to telomere on chrosomal short arm and 5'-terminus of this base sequence : 10584
cacagcccatgtccaatctggaaagcagtgattctcagactttctcatggtgtacatgggtatacacacgcacacatacacacacacacacacacacacacgcacgtatgtttgagccag

SEQ ID NO: 21906 - DNA, 454 bp, Homo sapiens
  AF001548.1_43887
  Located on chromosome 16
  Distance between a terminus base of telomere on chromosomal short arm and 5'-terminus of this base sequence : 14531882
  Distance between 3'-terminus of neighbour sequence of sequence listing upward to telomere on chrosomal short arm and 5'-terminus of this base sequence : 11456
gtccagaaatcaagtgtctgatggccaagaatgatgaaacatcttgcggtgactttgtgtggtcccttcccttcctagaggccttccttcccaatggccacattatttcacatggcctcagaggcagtttatgaaatggggaccatgaaggcattaccccatttccccagaaggggaaactaagaccagaatatatgtgtgtgtgtgtgtgtgtgtgtgtgtgtgtgtgtgtgtgtgtaaaagaggagaactggccaggtgcagcagagaactggccacgtttataatagcagctactcaggaggctgagttgggaggatgccttgaggccaggagtttgagagaagcctgggcaacatagcaagatcccatctcttaagacagagaagaattggcgtttgtcattggggggatatagggggaagggtccctttgctaaatgctctacatgaat

SEQ ID NO: 21907 - DNA, 211 bp, Homo sapiens
  U91323.1_55716
  Located on chromosome 16
  Distance between a terminus base of telomere on chromosomal short arm and 5'-terminus of this base sequence : 14703617
  Distance between 3'-terminus of neighbour sequence of sequence listing upward to telomere on chrosomal short arm and 5'-terminus of this base sequence : 171281
ggacatttcttcctatcttgactttgatcaacatatgttgttgttattattattattattattattattattattattattattcagagacagggtctacctctgttgcccaggctggagtgcagtgttgcaatcgtacacaattcaccgcagtctggaactctggggctcaagcaattctcctatctcagtttcctgagtagctaggacc

SEQ ID NO: 21908 - DNA, 365 bp, Homo sapiens
  AC026452.5_167627
  Located on chromosome 16
  Distance between a terminus base of telomere on chromosomal short arm and 5'-terminus of this base sequence : 14796187
  Distance between 3'-terminus of neighbour sequence of sequence listing upward to telomere on chrosomal short arm and 5'-terminus of this base sequence : 92359
tcttcatggagacagaactagtaggatggatggatggatggatagatgatagatagatggatgatagattgatagatgataggtagatgatagacggatagttggtggatgtatacatggtaggtagatggatagatgatagatagatggatgattgatagatgatggatggatggatggatggaggatgagaggggatctactagggaaactggatcatgtgattatggaggctgagaagtcccaccctaggtcatctgcaacctggagaacccaggaagctggtagcatggctcaggcctagtccaaaagtctcagacccagggaagctgatggtggaattctcagtccatagtcaaaggcct

SEQ ID NO: 21909 - DNA, 387 bp, Homo sapiens
  U91318.1_111421
  Located on chromosome 16
  Distance between a terminus base of telomere on chromosomal short arm and 5'-terminus of this base sequence : 14989894
  Distance between 3'-terminus of neighbour sequence of sequence listing upward to telomere on chrosomal short arm and 5'-terminus of this base sequence : 193342
taacattaacacgtttcgcttaaaaaagtatcgatcatttatcatggaaaaatacaccagcttacacaaattcctaaagcgtttttcgtgtgtgtgtgtgtgtgtgtgtgcgtgtgtgtgtgtagagatggggtttcgccatattgcccaggctggtctcgaactcctgggttcaagcgatccacccacctcagcctcccaaagtgctgggattacaggcgtgagccacacacccggccctaaagctttttgtgagattatatattttacctgcgaaatatatgggtcagaaagatttgagaaagttgttagataattccaccaacaaaatctcccgtcctttccagctgtgatggtgaattctaaagtagaattcatctttggagc

SEQ ID NO: 21910 - DNA, 101 bp, Homo sapiens
  DISD22_0010090
  Located on chromosome 16
  Distance between a terminus base of telomere on chromosomal short arm and 5'-terminus of this base sequence : 15074024
  Distance between 3'-terminus of neighbour sequence of sequence listing upward to telomere on chrosomal short arm and 5'-terminus of this base sequence : 83743
ccgaaggtagcatgagaacgtgtgtgtgtgtgtgtttgtgtgtgtgtgtgtgtgtttgtgcatgtgtatgtggaaggactggtgagatggctggaggaaga

SEQ ID NO: 21911 - DNA, 438 bp, Homo sapiens
  chr16.fa.O7frz.21490069
  Located on chromosome 16
  Distance between a terminus base of telomere on chromosomal short arm and 5'-terminus of this base sequence : 15365491
  Distance between 3'-terminus of neighbour sequence of sequence listing upward to telomere on chrosomal short arm and 5'-terminus of this base sequence : 291366
ctcacgcctataattaccaacactttgggaggccaaggcaggaggatcacttgagctcaggaacttgagaccagcctgggcaacacagtgagacctgtctctacaaaaatagaaaaaaagtagctgggtgcggtggtacactgtagtcccagctactcggggaggctgaggtgggcagatcacttgggcccaggaggtcgaggctggagtgggccaagatcacacactgccacactccagcctgggcaacagagtgagaccctgtctcaaattaaaaaagaaagaaaagaaagaaagaaatgcagacacctttccaggcaggggtctcattcagggatgtgaatcagaaccaccagtgaaatttaaaataaaagccaagactcacagcaccagcttctgattctcattgagaagacccaatgagacctatccatgcaa

SEQ ID NO: 21912 - DNA, 234 bp, Homo sapiens
  HUMUT480B
  Located on chromosome 16
  Distance between a terminus base of telomere on chromosomal short arm and 5'-terminus of this base sequence : 15530452
  Distance between 3'-terminus of neighbour sequence of sequence listing upward to telomere on chrosomal short arm and 5'-terminus of this base sequence : 164523
tgggtaacagactgagactctgtctcaaaaaaaaaaaaaaatcaaacagtataaaaaggcataaaggcataaggagaaaagtgagtttacttttcatttctaactcccagaacctcactctcctaatgccccccaaggaccaaaactactggttacctttgaaatcagtttttgtgtgtgtgtgtgtgtgtgtgtgtgtgtgtgtgtgtgtgtgcatctttccagagttatctg

SEQ ID NO: 21913 - DNA, 426 bp, Homo sapiens
  AC002990.1_95360
  Located on chromosome 16
  Distance between a terminus base of telomere on chromosomal short arm and 5'-terminus of this base sequence : 15620376
  Distance between 3'-terminus of neighbour sequence of sequence listing upward to telomere on chrosomal short arm and 5'-terminus of this base sequence : 89690
agttagtcaacacaagatgaaacagatattttaggatgttacaactagagtattcttgtcttagaattttggataagtccccagacctgtgagtaatagaggccaaggattcccatattctaaatggaggtgctagacggttttggtaacttttgtaggcccccaaattgcgtttttcagcattagcccatccccagtctccagactatgggggagaaggctaaagattcatttgtgagtaaaagtgtctttagaagtgtgtgtgtgtgtgtgtgtgtgtgtgtgtgtgtgtgtgtgtgttggacttaaagatatctgcttgaaaggttgaattctatcctttgaaactcaaggaatagagtaactgttacctgttgcacacctaaacattcaaaaccaagatgctggctagaagtagatggtgag

SEQ ID NO: 21914 - DNA, 237 bp, Homo sapiens
  Z67687
  Located on chromosome 16
  Distance between a terminus base of telomere on chromosomal short arm and 5'-terminus of this base sequence : 15663710
  Distance between 3'-terminus of neighbour sequence of sequence listing upward to telomere on chrosomal short arm and 5'-terminus of this base sequence : 42908
ggttcagaggatttaactatacccagcaaaaactccaggtggaactcaaatccaggtcttacagcccttctttcttgcaggaaaggcatttagaatggctggagaggagataagacaaataatgtgatggtgtaaatggatgtggagtgtgtgtgtgtgtgtgtgtgtgtgtattgtatacatagtcaaatttgaggaaggcgtgaacatagcaaactcaaattcctacaggggcaa

SEQ ID NO: 21915 - DNA, 266 bp, Homo sapiens
  DISD22_0010105
  Located on chromosome 16
  Distance between a terminus base of telomere on chromosomal short arm and 5'-terminus of this base sequence : 15826641
  Distance between 3'-terminus of neighbour sequence of sequence listing upward to telomere on chrosomal short arm and 5'-terminus of this base sequence : 162694
gtgaagggctcagctctggagacctttccttcatctaacaattattgagctcttatgtgttgagtactgggttaggtgtcgaagatacagagatataagatagtctttgacctcaaaaagctcacagtctaataggaaggacagacaagtagacaggcaattacaatgcaaaggaggtacggtgtgtgtgtgtgtgtgtgtgtgtgtgtgtgtgtgtgtatgagagagagaggagagaggagagacagaatatgagcaagatgcaa

SEQ ID NO: 21916 - DNA, 387 bp, Homo sapiens
  chr16.fa.O7frz.24452165
  Located on chromosome 16
  Distance between a terminus base of telomere on chromosomal short arm and 5'-terminus of this base sequence : 15924480
  Distance between 3'-terminus of neighbour sequence of sequence listing upward to telomere on chrosomal short arm and 5'-terminus of this base sequence : 97573
ctaggaagctcaaagacaattcatatctctcacatgtctcataagctcagagacagaggtcatatctctcataaaacctatggtattattttaaatgcttctggtggcaaattgaatttcccatcatgtatatataatatatataatatttagaacctttcaaaaaacatatatatagacacacacagatatatatgtgtatatgtgtgtgtgtgtgtgtgtgtgtgtatggtttagtgggcaccaccatgcccggctagctggctaattatttatgggtttttttgtagagacgatgttttgccatgttgcccaggctggtcttgaactcctggggtcaagagatccacaggtctcggcctccctaagtgctaggattacaggtgt

SEQ ID NO: 21917 - DNA, 262 bp, Homo sapiens
  AC021115.4_10261
  Located on chromosome 16
  Distance between a terminus base of telomere on chromosomal short arm and 5'-terminus of this base sequence : 15945515
  Distance between 3'-terminus of neighbour sequence of sequence listing upward to telomere on chrosomal short arm and 5'-terminus of this base sequence : 20648
ataactgtggaataacgcaatggaatgctgcaattaattagaggcaaactgtgttcaaatagtaacgaagaagaggccagccttcgggacacttaaaaacaaacaaacaaacaaacaaacaaaaaacagttaggaggcctctctccatagaaaagctcttctgtgtgtgaggcattttgttccaaaacagacatggttgttgtcatttctggaaggctctgctctctctccctctgtccttgggtctgactttgcaacctca

SEQ ID NO: 21918 - DNA, 330 bp, Homo sapiens
  AC021115.4_74960
  Located on chromosome 16
  Distance between a terminus base of telomere on chromosomal short arm and 5'-terminus of this base sequence : 15977334
  Distance between 3'-terminus of neighbour sequence of sequence listing upward to telomere on chrosomal short arm and 5'-terminus of this base sequence : 31557
atgaatggactggatgagtagatggatggatggatcatggatggatggactgggtgggtgagtggatggatgaatgggatgaatggatggatagatggactgggtgagtggatggatggatgatggatggatggatggatgaatggactggatgagtggatggatggatggatcatggatggatggactgggtgggtgagtggatggatgaatgagatgaatggatggatggatgaatggatggatggatggatgaattacaggggtccaagtctgcaagtgaagagtccagtaagcatgcctttggggtagtctaggcaagaaatgaca

SEQ ID NO: 21919 - DNA, 322 bp, Homo sapiens
  chr16.fa.O7frz.20446167
  Located on chromosome 16
  Distance between a terminus base of telomere on chromosomal short arm and 5'-terminus of this base sequence : 16146323
  Distance between 3'-terminus of neighbour sequence of sequence listing upward to telomere on chrosomal short arm and 5'-terminus of this base sequence : 168659
cactagactaaatggatgtgaaacctttccccaaacattggggattattattattaccctacgcttacattggcccttcatgtgataagaagacaatgccccacttgagatgacagatttctctctctctctctctctcacacacacacacacacacacacacactcacacacacacgtgcctcaccttggtaaaatcagaacagcaaggatgaaggtgagattcagggtatgaacagaaaacatctggatttgctcaattttctctaaaatatgagccttagaatcacatatctcaagaactggcaggaatagtacaaata

SEQ ID NO: 21920 - DNA, 264 bp, Homo sapiens
  chr16.fa.O7frz.20300686
  Located on chromosome 16
  Distance between a terminus base of telomere on chromosomal short arm and 5'-terminus of this base sequence : 16301235
  Distance between 3'-terminus of neighbour sequence of sequence listing upward to telomere on chrosomal short arm and 5'-terminus of this base sequence : 154590
gctactttcctgaaggtatcactttgcccagccacacacgcgcacacacacacacacacacacacacacacatgcacatgcatgcatgaatgcacgcatgcacacacacacatatgcatgcacatatacaaacacacaaaattattatcctcccaagggaggaaccggaactttgttgaattctgtgtgcacatctttgacagatgccccgagaagccacagggactgctcaaggctgtgtctgtccactagcaagtttggtaa

SEQ ID NO: 21921 - DNA, 111 bp, Homo sapiens
  DISO7_10004109
  Located on chromosome 16
  Distance between a terminus base of telomere on chromosomal short arm and 5'-terminus of this base sequence : 16425629
  Distance between 3'-terminus of neighbour sequence of sequence listing upward to telomere on chrosomal short arm and 5'-terminus of this base sequence : 124130
aagtccatggaacttgttaaatcaatcaatctctctttttctctctctctctctctctctctctctctgtttttccttgttgtgtgtcctttcctttgcctctgctctgta

SEQ ID NO: 21922 - DNA, 136 bp, Homo sapiens
  D16S410
  Located on chromosome 16
  Distance between a terminus base of telomere on chromosomal short arm and 5'-terminus of this base sequence : 17115298
  Distance between 3'-terminus of neighbour sequence of sequence listing upward to telomere on chrosomal short arm and 5'-terminus of this base sequence : 689558
attgtaaacatttctgcccagtgcctttatatttatataacattttcactgtgaccagacttgatgatattcaagttttctatttgtgtgtgtgtgtgtgtgtgtgtgtgatgaacacaacgaaaacgtactgcgt

SEQ ID NO: 21923 - DNA, 210 bp, Homo sapiens
  AC003003.1_7574
  Located on chromosome 16
  Distance between a terminus base of telomere on chromosomal short arm and 5'-terminus of this base sequence : 17238412
  Distance between 3'-terminus of neighbour sequence of sequence listing upward to telomere on chrosomal short arm and 5'-terminus of this base sequence : 122978
ggataatgtcttcaaagttcatctgtgttgtagcatgagtcagaatttccttcctttctaaggctgaactgaataatattcctgtgtgtgtgtgtgtgtgtgtgtgtgtgtgtgtgtgtgtgtcatattttgttgattcattcatcctttaatggacacttggattgcctccacccaatggacaacggtgcctccaccgtttggctatta

SEQ ID NO: 21924 - DNA, 210 bp, Homo sapiens; identical to SEQ ID NO: 21923
  AC010494.4_27264
  Located on chromosome 16
  Distance between a terminus base of telomere on chromosomal short arm and 5'-terminus of this base sequence : 17238412
  Distance between 3'-terminus of neighbour sequence of sequence listing upward to telomere on chrosomal short arm and 5'-terminus of this base sequence : -210

SEQ ID NO: 21925 - DNA, 433 bp, Homo sapiens
  AC003003.1_84740
  Located on chromosome 16
  Distance between a terminus base of telomere on chromosomal short arm and 5'-terminus of this base sequence : 17315421
  Distance between 3'-terminus of neighbour sequence of sequence listing upward to telomere on chrosomal short arm and 5'-terminus of this base sequence : 76799
ggcttaacagaattgttcttgtgttagctcatcccagggaacgccctgtgggtatgtatgtgtatgtcctcgtgcatgtgccctcacaggcgaacacgtgtgtgcctatgtgtcctcttggagagcatggcgatgggccaggacctcagccctgagcactgccttctctctgcctctcctgtccagtgagagtccaaccagtgtcctcctgtctgtcagagatcccactttggataaaagtagtgtgtgtgtgtgtgtgtgtgtgtgtgtgtgtgtgtaaagtaaataggatatgatagagcaaaagtaacattttttgaccgaatcatggtgattgtgacccacgaaagacatacaaagacttgatatatggattaaaatggctatcacaccccatccatgatgatcttcttccttaatcatactctgagga

SEQ ID NO: 21926 - DNA, 394 bp, Homo sapiens
  U91321.1_44116
  Located on chromosome 16
  Distance between a terminus base of telomere on chromosomal short arm and 5'-terminus of this base sequence : 17377201
  Distance between 3'-terminus of neighbour sequence of sequence listing upward to telomere on chrosomal short arm and 5'-terminus of this base sequence : 61347
tgctgaggataggtaactgttatcttgctaccagctgaaattgactgaaattaaccacaatttaccatccaagccttctcttggaagttgcaatccttcaaatagatgccagtgttataaaatagttacatcaaatacaaatatatatatatatataatatatatatatagagagagagagagagagattgagagagagggagagacagagagacaggagagagagagagagagagagagagacagagagacaggagagagagagagagtgtgggccggtctcaaactcctgagctcaagtgattcacccacctcggcctctaaaagtgctggcattgcaggtgtgagccattgtgctcagccaaaaatagttacatcaaatagattctgccag

SEQ ID NO: 21927 - DNA, 298 bp, Homo sapiens
  U91321.1_83702
  Located on chromosome 16
  Distance between a terminus base of telomere on chromosomal short arm and 5'-terminus of this base sequence : 17416881
  Distance between 3'-terminus of neighbour sequence of sequence listing upward to telomere on chrosomal short arm and 5'-terminus of this base sequence : 39286
ggaggtcacatttcaacataagatgtaaaggggacacacatccaaagtatatcaaccaggaaatataaaagacaagcctgaagaatcttgtagtgccagaaaggaaggaaatgcacgcacgcgcacacacacacacacacacacacaacccacaatggtggggtatgccaaagggagacagatgccaactaaaagggtctcagtaaccaaaactagaataatctgagcaacaaaaagccccccaaaacataaagttatattagattagaactcaaaagaactcctgagtccatactga

SEQ ID NO: 21928 - DNA, 270 bp, Homo sapiens
  D16S3041
  Located on chromosome 16
  Distance between a terminus base of telomere on chromosomal short arm and 5'-terminus of this base sequence : 17425232
  Distance between 3'-terminus of neighbour sequence of sequence listing upward to telomere on chrosomal short arm and 5'-terminus of this base sequence : 8053
cagcctaggtgacagagaaaggccctgtgtgtgtgtgtgtgtgtgtgtgtgtgtgtgtgtgtgtgtgtgtgtgtgtatgaatgaacgaaagaaagaaaggaacaaagacagaaagaaacagacactcagcaccccagagcacaaagcgtgataagaagtgcgatccaggatatatattttggaaatgctctaccatgctatgtgccaaagtctggaaagttcccaaaagaccaccagacagggactggtaaactaaccaaggcagggact

SEQ ID NO: 21929 - DNA, 385 bp, Homo sapiens
  HUMUT1556
  Located on chromosome 16
  Distance between a terminus base of telomere on chromosomal short arm and 5'-terminus of this base sequence : 17512667
  Distance between 3'-terminus of neighbour sequence of sequence listing upward to telomere on chrosomal short arm and 5'-terminus of this base sequence : 87165
aaaaccaaatagatgacaggcacatagattattatgcttttaaaaataaacagaggataggattgtactataagcccttctttctttcttttcttttcctttccttttgtctttctttctttctttctttctttctttctttctttctttctttctttctttcttttccttccttccttccttccttccttccttccttccttccttccttccttccttcctccctccctccctccctcccttcctggaccccaaaatgtctttcataacttgcttattcagactaggattcagtcaacaatcagattttacattctgtgtccgcccccgccttaaatctctattaatctaaaataatcagccgggtacggtggctcactcctgt

SEQ ID NO: 21930 - DNA, 254 bp, Homo sapiens
  AC003108.1_19546
  Located on chromosome 16
  Distance between a terminus base of telomere on chromosomal short arm and 5'-terminus of this base sequence : 17560542
  Distance between 3'-terminus of neighbour sequence of sequence listing upward to telomere on chrosomal short arm and 5'-terminus of this base sequence : 47490
tatcctgcatatggatatccagtttacccagtaccagttattgaagagagttcctttcccccactgtaatgttcttggtgccttcatggaaaatcagttggctgtaaatatatggatttatttcttggttctctattgtattccactggtctatgtatctgttttgtgtgtgtgtgtgtgtgtgtgtgtgtgtgtgtgtgtgtgtcagtatttataccaataccatgctgttttggttactgtggctttgtagt

SEQ ID NO: 21931 - DNA, 160 bp, Homo sapiens
  D16S3036
  Located on chromosome 16
  Distance between a terminus base of telomere on chromosomal short arm and 5'-terminus of this base sequence : 17560618
  Distance between 3'-terminus of neighbour sequence of sequence listing upward to telomere on chrosomal short arm and 5'-terminus of this base sequence : -178
ggtgccttcatggaaaatcagttggctgtaaatatatggatttatttcttggttctctattgtattccactggtctatgtatctgttttgtgtgtgtgtgtgtgtgtgtgtgtgtgtgtgtgtgtgtgtcagtatttataccaataccatgctgttttgg

SEQ ID NO: 21932 - DNA, 280 bp, Homo sapiens
  AC003108.1_41949
  Located on chromosome 16
  Distance between a terminus base of telomere on chromosomal short arm and 5'-terminus of this base sequence : 17583005
  Distance between 3'-terminus of neighbour sequence of sequence listing upward to telomere on chrosomal short arm and 5'-terminus of this base sequence : 22227
gccagtttaatatacggatgtataattacctttagaaactatcctagttctctttttattcttttgcaaagttggattatttagatacaaaatatctatttttacattcattcattcattcattcattcatttttgagacaaagtttagttaaactttggagtaagcatgtaggtgcaggagtcttattactgaatcatttttgcttaatcaatgtcctggacaagttagtctttgttagagagggaatcgtttacgtaagacatttcattacttgctgt

SEQ ID NO: 21933 - DNA, 261 bp, Homo sapiens
  AC003108.1_48266
  Located on chromosome 16
  Distance between a terminus base of telomere on chromosomal short arm and 5'-terminus of this base sequence : 17589392
  Distance between 3'-terminus of neighbour sequence of sequence listing upward to telomere on chrosomal short arm and 5'-terminus of this base sequence : 6107
attctgtttcttgaaacaagaaagagagagagaggagagagagagagagagagagagagagagaaaggaaggaaggaaagaaaagaaaagagggagggagggaagggaagggaagggagaaggaaggaaggataatttgaggaagaaaaacttgaaataaataataattgctgataattacatgtacttttggctaagcctaaaatgatatcattttgggacataattaaaaggtttagcatgttacaataaactgttcat

SEQ ID NO: 21934 - DNA, 260 bp, Homo sapiens
  AC003108.1_92923
  Located on chromosome 16
  Distance between a terminus base of telomere on chromosomal short arm and 5'-terminus of this base sequence : 17633988
  Distance between 3'-terminus of neighbour sequence of sequence listing upward to telomere on chrosomal short arm and 5'-terminus of this base sequence : 44335
ctttgtcaagtataggatctcctactctgtggcttgtctttttgttttcataattgtgtctttgaagtgtggaagtatgtatgtatgtatgtgtatatttatttatttatttatttatttgagacagagtttcgctctcgttgcccaggctggagtgcagtggcatgatctcagctgactgcaacctccgcttcctgggttccaccgattctcgtacctcagcctcctgagtagctgggattacaggagcctgctatcac

SEQ ID NO: 21935 - DNA, 270 bp, Homo sapiens
  AC002550.1_75512
  Located on chromosome 16
  Distance between a terminus base of telomere on chromosomal short arm and 5'-terminus of this base sequence : 17716315
  Distance between 3'-terminus of neighbour sequence of sequence listing upward to telomere on chrosomal short arm and 5'-terminus of this base sequence : 82067
tgatgttaatcagaagcctttaagctgagtgtgtgtgtgtgtgtgtgtgtgtgtgtgctgtgttccttcagacattttgatggctatttaacaaaaatggtgtgcactagaatagattcaaactgacctgggtttgagctgcagctctactaccaacactggaacttcatacacaggacactgttgcaggatgaattgcttctctttccttcccttatttctcgtctgtgaagtacacgtgttgacagcaccttcctcgcactggtagac

SEQ ID NO: 21936 - DNA, 461 bp, Homo sapiens
  chr16.fa.O7frz.32982402
  Located on chromosome 16
  Distance between a terminus base of telomere on chromosomal short arm and 5'-terminus of this base sequence : 18381933
  Distance between 3'-terminus of neighbour sequence of sequence listing upward to telomere on chrosomal short arm and 5'-terminus of this base sequence : 665348
aattgtccatagacaatcacattggatgggatctaggaagtacattttcttatctctctctccttctctcctttctttctttctctttctttcttttttctttctttctttctctttctttctttcttttctttctttctttctctctctctctctctttctttctttctttctttctttctttctttctttctttctttctttctttccttccttccttccttctctctctctttcccttccttccttcctttctctctttctcgcctctccttctcttactctttctttctttcttccctgtccatgatcccagatccatctttctccagtcctctgtaatcaatgccagatgacagccattcctgattttgtcctgggaactgcatggtggattctcacattcttggagtagaccatttagaagacaaacaaatctctgtcttatgactattgattcc

SEQ ID NO: 21937 - DNA, 306 bp, Homo sapiens
  AC003661.1_68156
  Located on chromosome 16
  Distance between a terminus base of telomere on chromosomal short arm and 5'-terminus of this base sequence : 18567430
  Distance between 3'-terminus of neighbour sequence of sequence listing upward to telomere on chrosomal short arm and 5'-terminus of this base sequence : 185036
gatcgagaccatctggttaacagagtgaaaccctgtctctactaagaatacaaaaaattagccgggcgtggtggcaggcacctgtagtcccagctactcaggaggctgaggcaagagaatggcgtgaacccgggaggcagagcttgcagtgagccgagatagagccactgcactccagcctgggtgacagggcgagactccgccaaaaagcaagcaaacaaacaaacaaacaaacaaacaaaccatgaagcttatacacagggctgggtaggatgtcaattttgctttctcaggcagtttaatttc

SEQ ID NO: 21938 - DNA, 204 bp, Homo sapiens
  AC003661.1_87610
  Located on chromosome 16
  Distance between a terminus base of telomere on chromosomal short arm and 5'-terminus of this base sequence : 18587002
  Distance between 3'-terminus of neighbour sequence of sequence listing upward to telomere on chrosomal short arm and 5'-terminus of this base sequence : 19266
agacagtttcctaaggcctaagtcacccaacattataacaaaagactgtaacaagggatatgggagttatgaactgggaattgtggatgaaaacctacacacacacacacacacacacacacacgcacacacacacatatcataacaccacacgtcttcttactttccattatgatgaatcatgtcctggcatgtttcataatt

SEQ ID NO: 21939 - DNA, 385 bp, Homo sapiens
  AC002287.1_94962
  Located on chromosome 16
  Distance between a terminus base of telomere on chromosomal short arm and 5'-terminus of this base sequence : 18689137
  Distance between 3'-terminus of neighbour sequence of sequence listing upward to telomere on chrosomal short arm and 5'-terminus of this base sequence : 101931
atcctagctcaagcttcaagtaacccccaacaccatctttcttggctatcacccagataagatggccccagcttctgtgagcaggaattcagacaacagaggcctcatgagaatagcatgggcttctttagctttgtaaagacaacatctccacgtgtgtgtgtgtgtgtgtgtgtgtgtgtgtgtgtgtgtgtgtgtggtgttaatatgtgcaggatgtccagaggtcagaggtaaccccagcaaaacccccaggaaaaccatgatacacaaacttgctgtttttttttttttttttcaaaattgctctattttattttattttattttatttttttgcccacagctttattcaaaatttctttcttatagacactttggttgc

SEQ ID NO: 21940 - DNA, 363 bp, Homo sapiens
  AC002287.1_83359
  Located on chromosome 16
  Distance between a terminus base of telomere on chromosomal short arm and 5'-terminus of this base sequence : 18700665
  Distance between 3'-terminus of neighbour sequence of sequence listing upward to telomere on chrosomal short arm and 5'-terminus of this base sequence : 11143
gaggtcaggagatcgaaaccatcctggctaacacggtgaaaccccatctctactaaaaatacaaaaaattagttgggcatggtggcacatgcctgtaatcccagctactccgggggctgaggcaggagaatcgcttgaacccagaggtggcagtgagccgagatcatgccactgcactacagcctgggtgatggaatgagactccgtctcaaaataaataaataaataaataaaataaaataaaataaaataaaataaaataaaataaaataaacgagtctggctctgttccccagcatgtccctgtgctcagcagaggcactggcacagagcaaatacacagtgaataccactgaatggata

SEQ ID NO: 21941 - DNA, 360 bp, Homo sapiens
  AC002287.1_81016
  Located on chromosome 16
  Distance between a terminus base of telomere on chromosomal short arm and 5'-terminus of this base sequence : 18703025
  Distance between 3'-terminus of neighbour sequence of sequence listing upward to telomere on chrosomal short arm and 5'-terminus of this base sequence : 1997
cttgaactcatgaccttaggtgatctgtccaccttggcctcccaaagtgttggggttacaggtttgagccactgtgctgggccctttctgcaatgttttcatcagattttgttgtcagttatgctagctttataaaactatttgagaaacatttcttcctcctcctcctcctcctcctcttcttcttcttcttcttcttcttattcttcttcttcttcttcttcttcttcttcttcttcttcttcttcttcttcttcctcttcttgttcttcttcttcttttttgctctaactcttctaggagtctgtaaataacctgctctttgcatgtttaacaaaactcatccataaattgtctgag

SEQ ID NO: 21942 - DNA, 402 bp, Homo sapiens
  AC002287.1_59935
  Located on chromosome 16
  Distance between a terminus base of telomere on chromosomal short arm and 5'-terminus of this base sequence : 18724050
  Distance between 3'-terminus of neighbour sequence of sequence listing upward to telomere on chrosomal short arm and 5'-terminus of this base sequence : 20665
ataggcagatgagtagatggacagatggatgaatggatagctagatgtgtggatgcatgcatggaaggatgaatgagtggatgcatggatggatggatggatggatggatggatggatggatggatggatgcatggatggatggatgcatggatggatgcatggatggatggatggatgcatggatggatggatggatggatagatgcatggatagatggatggatgcatggatagatggatggatagatgagtggatggatggacggatgggtggatggatggatggatggatggatggatggatggatggacggacgaatgacaaggatggtttccccacttccccttgttcaaactatagagttttgagtagtccattttagaacaattcatggagctc

SEQ ID NO: 21943 - DNA, 427 bp, Homo sapiens
  AC002287.1_58810
  Located on chromosome 16
  Distance between a terminus base of telomere on chromosomal short arm and 5'-terminus of this base sequence : 18725238
  Distance between 3'-terminus of neighbour sequence of sequence listing upward to telomere on chrosomal short arm and 5'-terminus of this base sequence : 786
gtcatagccacagctctagttaagctaccgtggtgttttaggagctcacagagggaggcggtggggagagcggcaatcaaatgattggatattttcccctttatcataaagatatttgaattgcagtttaagtggctgtgagggtctttaatctctctttctgtttctgtccctctctgtctctctctgcctctctctctcacacacacacacacacacacacacacacacacacacacacacacacacatttagtctgtatatctcttttgcttttatatgttgcattggcaagcatatacaatgataatggtgcctgagactgttagccaaagagagaaaaaaagtctgcatgaggaaaaaacaaaagattcacagctggatcaaaagttcaagggggtatcttaagttatggttaagatgcagc

SEQ ID NO: 21944 - DNA, 361 bp, Homo sapiens
  AC002287.1_24863
  Located on chromosome 16
  Distance between a terminus base of telomere on chromosomal short arm and 5'-terminus of this base sequence : 18759277
  Distance between 3'-terminus of neighbour sequence of sequence listing upward to telomere on chrosomal short arm and 5'-terminus of this base sequence : 33612
tgtccaatctgagctgaagcagagccctgcccacccacaaaagttatccattaattaacgtgtctgtcttctggagattctgtgaatcaatcaggtagaactgcttggctctcaatgaatgatagctgctattattattattattattattattattagctggagggtttataaacaatgcctggctcccaagaagcaggctgtgtgtaatctaaaagctaacatagtttgggttgagatttcactgttgtcaaatgatgaagccaggatttcaacacaggcaacacgatccccagtgtgtggcctaagccactatggcccatgacctctccaggggaaatcactgatggcatttattaaa

SEQ ID NO: 21945 - DNA, 367 bp, Homo sapiens
  AC002287.1_17333
  Located on chromosome 16
  Distance between a terminus base of telomere on chromosomal short arm and 5'-terminus of this base sequence : 18766821
  Distance between 3'-terminus of neighbour sequence of sequence listing upward to telomere on chrosomal short arm and 5'-terminus of this base sequence : 7183
cctgagtatgtagctccatcacccagtgtgaacttgggcaagtccttaccttttcccctctgcatcctctccatccacttccctcactgacattccaaaacacacacacacacatacacacacacacacacacacacacacacatttttattttaagacaattgttgattcacatgcagttttaagaaatgctagagatcacagaccaggcacagtggctcatgcctgtaatccaggcattttgggaggtcgaggcaggtggatcacttgaggtcaggagttcgagactagcctggccaatgtggcgaaaccccatctctactaaaaatacaaaaattagctgggagtgttggcatgcacctgtaat

SEQ ID NO: 21946 - DNA, 250 bp, Homo sapiens
  D16S3076
  Located on chromosome 16
  Distance between a terminus base of telomere on chromosomal short arm and 5'-terminus of this base sequence : 18766855
  Distance between 3'-terminus of neighbour sequence of sequence listing upward to telomere on chrosomal short arm and 5'-terminus of this base sequence : -333
tgggcaagtccttaccttttcccctctgcatcctctccatccacttccctcactgacattccaaaacacacacacacacatacacacacacacacacacacacacacacatttttattttaagacaattgttgattcacatgcagttttaagaaatgctagagatcacagaccaggcacagtggctcatgcctgtaatccaggcattttgggaggtcgaggcaggtggatcacttgaggtcaggagttcg

SEQ ID NO: 21947 - DNA, 458 bp, Homo sapiens
  AC002287.1_14371
  Located on chromosome 16
  Distance between a terminus base of telomere on chromosomal short arm and 5'-terminus of this base sequence : 18769646
  Distance between 3'-terminus of neighbour sequence of sequence listing upward to telomere on chrosomal short arm and 5'-terminus of this base sequence : 2541
caggaagttacaaaccaattacagctgctgagcctcaggcctttatgaatcacagagcacagcaagggatggaggaggccagagtggggacgggagggagacagtgaggtgggaatcaaaggtcaattaaaataaaacagtcaattttaatttgaatgtcttgcttatattcacatcccattcccataagtggaaaagcaaatgaagcttattcatttgtgtgggcatggtgtgtgtgtgtgtgtgtgtgtgtgtgtgtgtgtgtgtgtgtgtgtgtgtgttaggacaataaaggcttttgaaatggtttcagagtcccagagatttgaaatttgaaatgtcccagggagaaaacatgcaatctggtgacctgcccaaatgtcagggtagctgcctaaacaaagagccatcagcgttagtcttggggcatgtgagtctaaatgacaccagttctagct

SEQ ID NO: 21948 - DNA, 146 bp, Homo sapiens
  D16S403
  Located on chromosome 16
  Distance between a terminus base of telomere on chromosomal short arm and 5'-terminus of this base sequence : 18769855
  Distance between 3'-terminus of neighbour sequence of sequence listing upward to telomere on chrosomal short arm and 5'-terminus of this base sequence : -249
tattcatttgtgtgggcatggtgtgtgtgtgtgtgtgtgtgtgtgtgtgtgtgtgtgtgtgtgtgtgtgtgttaggacaataaaggcttttgaaatggtttcagagtcccagagatttgaaatttgaaatgtcccagggagaaaac

SEQ ID NO: 21949 - DNA, 469 bp, Homo sapiens
  chr16.fa.O7frz.21881875
  Located on chromosome 16
  Distance between a terminus base of telomere on chromosomal short arm and 5'-terminus of this base sequence : 18884231
  Distance between 3'-terminus of neighbour sequence of sequence listing upward to telomere on chrosomal short arm and 5'-terminus of this base sequence : 114230
ggcataagcactgcttataaccaagcaaaacactccctctgtgccaacataggtggggcaggtcacgctggggtctgtttgccctgtctgcccgctgcagcctccttggggagggccagggttgtctgtgcatcctgtgagccccagggtctatgtgcacatatgtgtgtctgtgcctttctctctctctcagtttgtgtgtgtgtgtgtgtgtgtgtctgtgctgctctctgtgtgtgtgtgtgtgtgtgtgtgtgtgtgtgtacacggcgcatctgaattgtcctgagtgctgtctcgggtatccttgagctgtgtgtgcatgtgtccccctagcagtatctcagtatttttgcctgtgggagctgcacaccgtgagctgcacacctgagggccaggtgagtctggggctggtcctgtgcctgcgcatctgtgtgctggcggtgtctgcatagtattctgtggctac

SEQ ID NO: 21950 - DNA, 434 bp, Homo sapiens
  chr16.fa.O7frz.21779846
  Located on chromosome 16
  Distance between a terminus base of telomere on chromosomal short arm and 5'-terminus of this base sequence : 18986225
  Distance between 3'-terminus of neighbour sequence of sequence listing upward to telomere on chrosomal short arm and 5'-terminus of this base sequence : 101525
atcaagttgtcagttcatgaaggggacacaaaatcctaaatatgtacattcttaaatacaacttaacttacatgaagcaaaacttgatagaactgaacagaaaaatagagaaattcaaaattatagctggaggcttcagtacccctgtatcagttcagtcagagtgtaaccagaggagcagaatttgtctgtcgtctgtctgtctgtctatctatctatctatctatctatctatctatctatctatctatcatctatctgtagttgatccttgaacaacatgggtttgaactgcagggtccacttataggtggatttcctcccacctcttccagccctgatacagcaagattagtcccctcttcttcctcctctgcctcagcctacccaatgtgaagataatgaggatgatgacctttacaatgatctacttc

SEQ ID NO: 21951 - DNA, 98 bp, Homo sapiens
  chr16.fa.O7frz.33277679
  Located on chromosome 16
  Distance between a terminus base of telomere on chromosomal short arm and 5'-terminus of this base sequence : 19051497
  Distance between 3'-terminus of neighbour sequence of sequence listing upward to telomere on chrosomal short arm and 5'-terminus of this base sequence : 64838
gtgaatgagtgaatgaatcaatgagtgagggaatgagtgagtgaatgagtgaatgaatgagtgagtgactgagtgagtgaatgactgagtgaatgagt

SEQ ID NO: 21952 - DNA, 347 bp, Homo sapiens
  chr16.fa.O7frz.60891795
  Located on chromosome 16
  Distance between a terminus base of telomere on chromosomal short arm and 5'-terminus of this base sequence : 19324622
  Distance between 3'-terminus of neighbour sequence of sequence listing upward to telomere on chrosomal short arm and 5'-terminus of this base sequence : 273027
atctgcttaagctctcagttagtatttgaaatatctttaaaaacatttttttggaccaaatagtttttctaaatagtgtctcctagagtatttttcccttcattataaaatacccattgatgaaaattcaaagatacaagaaagtataatggagaaaactaaaagcatctacaattttagttggcagaagataaccactgtcaatatgattatgaattttctctaataatttcatactgaatatttacataggtatatatgcatgtgtgtgtgtgtgtgtgtgtgtgtgtgtgtgtatatggctccttttgtagaatatatcaacgtacttacctttccacttaata

SEQ ID NO: 21953 - DNA, 269 bp, Homo sapiens
  D16S3035
  Located on chromosome 16
  Distance between a terminus base of telomere on chromosomal short arm and 5'-terminus of this base sequence : 19494042
  Distance between 3'-terminus of neighbour sequence of sequence listing upward to telomere on chrosomal short arm and 5'-terminus of this base sequence : 169073
aaagccaaccttgcttcagccacacccgtttgataactgccaagggccctcattgctctctgaggcactgttcatgtggcatgacacacgtgcctacatacatacccctacacacacacacacacgcatacccctacacacgtacctacacacacgcatacctacacaggtatacccctatacgtgcacatcctacgctcacatacctgtgtacacacacacacacacacacacacacacacacacacagcacttacctgtttccaaga

SEQ ID NO: 21954 - DNA, 384 bp, Homo sapiens
  chr16.fa.O7frz.60638224
  Located on chromosome 16
  Distance between a terminus base of telomere on chromosomal short arm and 5'-terminus of this base sequence : 19580935
  Distance between 3'-terminus of neighbour sequence of sequence listing upward to telomere on chrosomal short arm and 5'-terminus of this base sequence : 86624
tggaaactaaacagcaataagatattttgaaaggattgattgattgattgattgattgattgattgagacagggcctcgctctgtcacacaggctggagttcagtggcatgatcatagctcactacaacctcaacctcccaggctcaagcaaccctcttgccttagcctctggagtaactgggactacaggcatgcaccaccatacttagctaattttttgtaagtttgtggagatggggtcttgctacgttgccccagctggtcttgaactcctggatcagatgatcctctcacctcagcctcccaaagcattgggattatgggcatgagccaccacgtccagcctgaaagggttttaagcaatggaaagctgtagttaccac

SEQ ID NO: 21955 - DNA, 198 bp, Homo sapiens
  DISD22_0010147
  Located on chromosome 16
  Distance between a terminus base of telomere on chromosomal short arm and 5'-terminus of this base sequence : 19801767
  Distance between 3'-terminus of neighbour sequence of sequence listing upward to telomere on chrosomal short arm and 5'-terminus of this base sequence : 220448
ggtcagggatagcaatgtgtgagctgccccagggcctgggaccccatgctgactttgagcgtaaaaactatatatatatatatatacatatatatatatatatacatgtatatatatatatatatatgtatatatatatggctgctgcttcacttccgcctttcagctttcaccaaatgtctgtttcagccaacatga

SEQ ID NO: 21956 - DNA, 268 bp, Homo sapiens
  HUMUT1334
  Located on chromosome 16
  Distance between a terminus base of telomere on chromosomal short arm and 5'-terminus of this base sequence : 20069187
  Distance between 3'-terminus of neighbour sequence of sequence listing upward to telomere on chrosomal short arm and 5'-terminus of this base sequence : 267222
tgggtgggagaattgcttgagcctgggcagtcaaggctgcagtgaaccatgattgcgtcactgcattccagcctgggcaacacagcaagaccccatctccatagattagatagatagatagatagatagatagatagattagatagatagacagacagacagacaggtaataaaccaatgacaatgacgtccacaacagactgagaccctgccatgtttaaagaaccctgtgaaccctcccagcaaacctagcaggtgacagggctcc

SEQ ID NO: 21957 - DNA, 322 bp, Homo sapiens
  AC002286.1_3458
  Located on chromosome 16
  Distance between a terminus base of telomere on chromosomal short arm and 5'-terminus of this base sequence : 20140893
  Distance between 3'-terminus of neighbour sequence of sequence listing upward to telomere on chrosomal short arm and 5'-terminus of this base sequence : 71438
cttgaagcagaacagctaagagtaaaggccccctctgatcacacttcccagagctggccccttcctccctttatgagtcacttaaatccatactaacataggtacagtgacctaaagccctgggagctgcaccccacgtcccgtgtgacaaagtgtgtgcaggcatcactgaagggggaaaaggctgtgtgtgtgtgtgtgtgtgtttgtgtgtgtgcgcgcgcaccagcgccatgtggcttcccgggtggtgcagattctgtctctctctcaaacctcagcttcatgattcagcagcgctgacgtcaatttacaagaatga

SEQ ID NO: 21958 - DNA, 127 bp, Homo sapiens
  D16S3122
  Located on chromosome 16
  Distance between a terminus base of telomere on chromosomal short arm and 5'-terminus of this base sequence : 20272439
  Distance between 3'-terminus of neighbour sequence of sequence listing upward to telomere on chrosomal short arm and 5'-terminus of this base sequence : 131224
tgggtgacaatttgttcacatataccttgtataatatcactacaaattaatgataaagatgacaattgtgtgtggtgtgtgtgtgtgtgtgtgtgtgtgtgtttgtagccaactgagaacagatccc

SEQ ID NO: 21959 - DNA, 377 bp, Homo sapiens
  AC007014.1_31732
  Located on chromosome 16
  Distance between a terminus base of telomere on chromosomal short arm and 5'-terminus of this base sequence : 20315077
  Distance between 3'-terminus of neighbour sequence of sequence listing upward to telomere on chrosomal short arm and 5'-terminus of this base sequence : 42511
gtgactcagaaccttctggagtgaggtctgggtacagattgttttcaaagtcctgctgggccagaaaccacagggccttcgcaccacccaccctcacgcttggtcacagctctgtcctggcctggcctaggagcaaatcagatgcccctagagcggttcccctgtggcaaacacattttcacttctattttcaggcaggtcaaagtaaaaatgaaaatttatgcttttacatgtcccaagctcagtattctgtacatttctctaaacacacacacacacacacacacacacacacacacacacacacacacgtttttttttgtagagatggagtttcaccatgttggccaggctagtcataactcctagcctcaagt

SEQ ID NO: 21960 - DNA, 250 bp, Homo sapiens
  AC007014.1_86818
  Located on chromosome 16
  Distance between a terminus base of telomere on chromosomal short arm and 5'-terminus of this base sequence : 20370398
  Distance between 3'-terminus of neighbour sequence of sequence listing upward to telomere on chrosomal short arm and 5'-terminus of this base sequence : 54944
aagctttaagtttcttaggcctatatatacatatatatatatatatatatatttttgagatggaatctcgctctgttgcccaggctggagtgcagtggtgtgatctcggctcactgcaagctctgcctcccgggttcacgccattctcctgcctcagcctcctgagtagctgggaccacaagcgctcgccaccacgcccagctaattttttgtatttttagtagagacggggtttcaccgtgttagccag

SEQ ID NO: 21961 - DNA, 162 bp, Homo sapiens
  D16S497
  Located on chromosome 16
  Distance between a terminus base of telomere on chromosomal short arm and 5'-terminus of this base sequence : 20406531
  Distance between 3'-terminus of neighbour sequence of sequence listing upward to telomere on chrosomal short arm and 5'-terminus of this base sequence : 35883
tgcataatgatggataaatggataaagaaagaaaaagaaaatgtggtatatttcttggtacacacacacacacacacacacacacacacattgagccttaaagaaataaattctgatatatgcgacaacatggatgaatctcgaggacattacattaagtga

SEQ ID NO: 21962 - DNA, 154 bp, Homo sapiens
  Z23659.1_172
  Located on chromosome 16
  Distance between a terminus base of telomere on chromosomal short arm and 5'-terminus of this base sequence : 20406532
  Distance between 3'-terminus of neighbour sequence of sequence listing upward to telomere on chrosomal short arm and 5'-terminus of this base sequence : -161
gcataatgatggataaatggataaagaaagaaaaagaaaatgtggtatatttcttggtacacacacacacacacacacacacacacacattgagccttaaagaaataaattctgatatatgcgacaacatggatgaatctcgaggacattacat

SEQ ID NO: 21963 - DNA, 321 bp, Homo sapiens
  AC007014.1_150688
  Located on chromosome 16
  Distance between a terminus base of telomere on chromosomal short arm and 5'-terminus of this base sequence : 20434081
  Distance between 3'-terminus of neighbour sequence of sequence listing upward to telomere on chrosomal short arm and 5'-terminus of this base sequence : 27395
ccacaagtagctttattggataaccttgctgatgaaaatataaagctaccctgaacctatattcaggaacttgctcagtgctgcctaattctgtctgaatccatgaaaaggtaatatccttcttattcggatatctaataagaaaccaggttaaaaatagaacacttttacttttcaaaaatgagttttaaaagtggcctcaatatttataatacagacacacacacacacacacacacacacacacacacacccgtgtttagtggttgtcataacccagccccaaatccttctgcactaagacatcaaggcagatctatt

SEQ ID NO: 21964 - DNA, 153 bp, Homo sapiens
  D16S414
  Located on chromosome 16
  Distance between a terminus base of telomere on chromosomal short arm and 5'-terminus of this base sequence : 20434223
  Distance between 3'-terminus of neighbour sequence of sequence listing upward to telomere on chrosomal short arm and 5'-terminus of this base sequence : -179
aaaccaggttaaaaatagaacacttttacttttcaaaaatgagttttaaaagtggcctcaatatttataatacagacacacacacacacacacacacacacacacacacacccgtgtttagtggttgtcataacccagccccaaatccttctg

SEQ ID NO: 21965 - DNA, 229 bp, Homo sapiens
  chr16.fa.O7frz.15863633
  Located on chromosome 16
  Distance between a terminus base of telomere on chromosomal short arm and 5'-terminus of this base sequence : 20468475
  Distance between 3'-terminus of neighbour sequence of sequence listing upward to telomere on chrosomal short arm and 5'-terminus of this base sequence : 34099
ccagacactcatagacagctacggagacacccggagcccagctcacacacatgacagacacctaggccctccaacaaacacccacagacacacccacacatacacagacacactcctacatatccccccatacacagcccccaacacacacacacacacacacctatagagacacccagaccaccccctcacatatacacatgtggacactatctgctcactgataaag

SEQ ID NO: 21966 - DNA, 335 bp, Homo sapiens
  chr16.fa.O7frz.16035475
  Located on chromosome 16
  Distance between a terminus base of telomere on chromosomal short arm and 5'-terminus of this base sequence : 20652471
  Distance between 3'-terminus of neighbour sequence of sequence listing upward to telomere on chrosomal short arm and 5'-terminus of this base sequence : 183767
gttagcaattctgaaactatgaacttatttacttctttgtggtaagtacattatacataattacagccaggactctcactgttgcagtaagaagttatatattaataagagaaggctaaaataaaccctgtgatgttaaattgaaatcagagagaatgagtataaacttaaggcttttgatacacacacacacacacacacacacacacacacacagagggagagagaggggatggatagagaaatacagatatatgcacatgtgtgggtataatacacttcctagttctatctactgagaagacctagaagtaatgacatcctaataccaaaga

SEQ ID NO: 21967 - DNA, 190 bp, Homo sapiens
  D16S748
  Located on chromosome 16
  Distance between a terminus base of telomere on chromosomal short arm and 5'-terminus of this base sequence : 20997004
  Distance between 3'-terminus of neighbour sequence of sequence listing upward to telomere on chrosomal short arm and 5'-terminus of this base sequence : 344198
gtctgtaacctaggccggcattatattattattattattattattatttattattattattttgaggtggagtcttgctctttcgcccaagctggagtacagtggcgcgatctctgctcaccaagcctccaggttcaagcgattctcctgcctcagcctcccgagtagctgggattacaagcgcctgcca

SEQ ID NO: 21968 - DNA, 116 bp, Homo sapiens
  DISO7_10006173
  Located on chromosome 16
  Distance between a terminus base of telomere on chromosomal short arm and 5'-terminus of this base sequence : 21012549
  Distance between 3'-terminus of neighbour sequence of sequence listing upward to telomere on chrosomal short arm and 5'-terminus of this base sequence : 15355
ctcaacttcattatgttgttgatgttttggtacttttcctcctagtcatggtgtgtgtgtgtgtgtgtgtgtgtgtgtgtgtgtgtgtgtgtatctctgttaaccatgtgatgacc

SEQ ID NO: 21969 - DNA, 307 bp, Homo sapiens
  chr16.fa.O7frz.17309775
  Located on chromosome 16
  Distance between a terminus base of telomere on chromosomal short arm and 5'-terminus of this base sequence : 21081744
  Distance between 3'-terminus of neighbour sequence of sequence listing upward to telomere on chrosomal short arm and 5'-terminus of this base sequence : 69079
tgctagtccatgtctcaagtactgtggcttcgtgtttcttgtccagttttttaattcttccaggcaggagggtaaacccagtgtgtgttcctcctccttggctagaagaagaaataagtcctcactgtggtattaatttcctttttataattcttagagaagttgagcttgcttgcttgcttgcttgcttgcttgcttgcttgcttgcttgcttgctttctctctctctctctctctctctctctttcacagagtcttgctctgtcgcccaggctggagtgcagtggcacaatctcactgcaagctc

SEQ ID NO: 21970 - DNA, 199 bp, Homo sapiens
  Z67333
  Located on chromosome 16
  Distance between a terminus base of telomere on chromosomal short arm and 5'-terminus of this base sequence : 21196204
  Distance between 3'-terminus of neighbour sequence of sequence listing upward to telomere on chrosomal short arm and 5'-terminus of this base sequence : 114153
cagggttctccacaaaagtggaccaataggggtgtgtgtgtgtgtgtctgtgtgtgtagacagattgagattgatcgatattttaaggaattgacccatgttatggtggcatctgtcaactccagaatctgcagggtgggcctctaggctggagtccagagagaaactgatgttgcaactcaagtccaaaggccgtctg

SEQ ID NO: 21971 - DNA, 174 bp, Homo sapiens
  D16S3102
  Located on chromosome 16
  Distance between a terminus base of telomere on chromosomal short arm and 5'-terminus of this base sequence : 21449681
  Distance between 3'-terminus of neighbour sequence of sequence listing upward to telomere on chrosomal short arm and 5'-terminus of this base sequence : 253278
atcgtgtaatgactgccacaatcagattaacatatccaccacctcccgaagtgagtgtgtgtgtgtgtgtgtgtgtgtgtgtgtgtgtgtgtgtgtgagatgacacttaaagttggctttctcatcacattttgagtaaacagtaccatggtattgttagccagagtccccatg

SEQ ID NO: 21972 - DNA, 447 bp, Homo sapiens
  AC007612.3_149453
  Located on chromosome 16
  Distance between a terminus base of telomere on chromosomal short arm and 5'-terminus of this base sequence : 21453308
  Distance between 3'-terminus of neighbour sequence of sequence listing upward to telomere on chrosomal short arm and 5'-terminus of this base sequence : 3453
ccataagagctgtagatgacagtcccatgctctgagcagcccccggttattgtatttgacatgtatccatcaggcacatgcacagacacacgggtgacttcctgcttctgtgggattgagaggggcaggacctgtcagtaagacactccctggcagtgctctcatggacgggcaaatacactgcctgcatccactctgacctgttcgttcattcgtttgttcgtttgttcgttcgttagttcgttcgttcgttcattcattcattcattccattcactcattcattcattcattctgtccttcttaaaagtttagtcctgggaatatatactgagtgtttcttttgtacttcctgtggataaaattgaccagatccatgtcctcatggagctgttcctctggttgaaggagaaagacaacaaacaggtctacctagcatgccagatg

SEQ ID NO: 21973 - DNA, 226 bp, Homo sapiens
  D16S3069
  Located on chromosome 16
  Distance between a terminus base of telomere on chromosomal short arm and 5'-terminus of this base sequence : 21467274
  Distance between 3'-terminus of neighbour sequence of sequence listing upward to telomere on chrosomal short arm and 5'-terminus of this base sequence : 13519
agctggttgaactgtgattgtcttttatacatatatatatatatacacacacacacacacatatacatacacacatatacacatatatacacacacatatatacatatatatatatatacacatatatacacacatatatatacacatatgtacatatacatatagacacacacacacacacacacacacacacacacacacacacaccccaaatgtcaccctgtc

SEQ ID NO: 21974 - DNA, 367 bp, Homo sapiens
  chr16.fa.O7frz.17238083
  Located on chromosome 16
  Distance between a terminus base of telomere on chromosomal short arm and 5'-terminus of this base sequence : 21691074
  Distance between 3'-terminus of neighbour sequence of sequence listing upward to telomere on chrosomal short arm and 5'-terminus of this base sequence : 223574
ctacttctcaaacataatggtcagaataatgaagggtaacatgattattcacatttaatcgacttcatttacatagataaagcctaaaggaaaaatccaatctgtatttatgtgcatgcactgatgtttaaaaatccactggaggaaaaggaaaatttagtcagcaaaatcttttctagataaatgctagaaatcattattccaagaaaagaatcctccacttttactatatgtgtgtgtgtgtgtgtgtgtgtgtgtgtgtgtgtgtactcattaaaaaatacataagagctcctccatggcttgagaatattttatgaagttataaaaatcagtattacctgtcaagtactatgttacatgtgca

SEQ ID NO: 21975 - DNA, 354 bp, Homo sapiens
  chr16.fa.O7frz.17409103
  Located on chromosome 16
  Distance between a terminus base of telomere on chromosomal short arm and 5'-terminus of this base sequence : 21809528
  Distance between 3'-terminus of neighbour sequence of sequence listing upward to telomere on chrosomal short arm and 5'-terminus of this base sequence : 118087
ctgttaggtagcttctggtctctgctaaggaccttgagacagagatttgagatctctttgatcaaaaggagagtgaaagtgttaggtggtaaagaaacagtaaatgcaaaccaagacgttctccttaaagcaatgaagtacattgaaaagggaatactgccaggacctcctttgtggtgatgggttctgtatcaggattatgctggtggttgtacagaggtatgcacaaaataaaattgcatagaactacacacacaaacacacacacacacacaaatacatgtaaaaactggtgaaatctgaatgaagtctgtagcctagttaacaatattgtaccaatgcctatttcttgat

SEQ ID NO: 21976 - DNA, 124 bp, Homo sapiens
  D16S3062
  Located on chromosome 16
  Distance between a terminus base of telomere on chromosomal short arm and 5'-terminus of this base sequence : 21899928
  Distance between 3'-terminus of neighbour sequence of sequence listing upward to telomere on chrosomal short arm and 5'-terminus of this base sequence : 90046
ttgcacccagaaaatgagattgtgtgtgtgtatgtgtgtgtgtgtgtgtgtgtgtgtgcaagcaacagagaaagacaacccttaaagggaaaaaaatcactttctgtaagttgtctcctgggct

SEQ ID NO: 21977 - DNA, 248 bp, Homo sapiens
  Z67294
  Located on chromosome 16
  Distance between a terminus base of telomere on chromosomal short arm and 5'-terminus of this base sequence : 22023652
  Distance between 3'-terminus of neighbour sequence of sequence listing upward to telomere on chrosomal short arm and 5'-terminus of this base sequence : 123600
agctttggttaggagtatgtgtgtgtgtgtgtgtgtgtgtgtgtgtgtgtgtgtgtgtgtgtgtgtatgtgtatgtgtctgtgtgtgttggatttgcaggcttactcctggtattttgcctcatagatatctaggattcatttctggcaagttgaagatcatctccaagtctccctttccccatctgtaaaataatcaggttgaccagatgacgtaggattcattgtaagattgtctatcaggtgcct

SEQ ID NO: 21978 - DNA, 196 bp, Homo sapiens
  AC009134.6_190007
  Located on chromosome 16
  Distance between a terminus base of telomere on chromosomal short arm and 5'-terminus of this base sequence : 22033226
  Distance between 3'-terminus of neighbour sequence of sequence listing upward to telomere on chrosomal short arm and 5'-terminus of this base sequence : 9326
tgatggctacatgtcattgaccagtggtgtggtgtatttgtgtgtgtgtgtgtgtgtgtgtgtgtgaatgtgtatgtgtggtgggagatgtctcccatagctagggatccaggcaggaccagcacacataataccgttgctcactaactaaccaatagctcagcaaggggaagtacataattctagaccatttggc

SEQ ID NO: 21979 - DNA, 354 bp, Homo sapiens
  AC009134.6_178636
  Located on chromosome 16
  Distance between a terminus base of telomere on chromosomal short arm and 5'-terminus of this base sequence : 22044536
  Distance between 3'-terminus of neighbour sequence of sequence listing upward to telomere on chrosomal short arm and 5'-terminus of this base sequence : 11114
tagcagctcacgtggactaagagaaagggtgtcacttggaaatttgggggcttccattttatgtattgtggttttagctgtttttcctttaaaaacatcaaccctttaaagtacgtgtgtgtgtgtgtgtgtgtgtgtgtgtgtgcacgcatgtgtctgtggaaactgccaaagaagacatggaattcctcctcttctccctcctcccatccttttccattttttctccccgtgcccctcatgttgctctgtcccccggactctgcctccatctctgtgtctccctccctctctctttctctcctccttccgtatgcccagcacccagtctctgtgttggcacaggagtactgg

SEQ ID NO: 21980 - DNA, 228 bp, Homo sapiens
  U91325.1_5733
  Located on chromosome 16
  Distance between a terminus base of telomere on chromosomal short arm and 5'-terminus of this base sequence : 22096243
  Distance between 3'-terminus of neighbour sequence of sequence listing upward to telomere on chrosomal short arm and 5'-terminus of this base sequence : 51353
caaactgcatcaatgctaactccgtggggatgggggcagggaaggggaatgggcaatttcaaagcttcattttgtcagtttttgttcaaattctttttacaatgaacactattgcttttataataggtcacaacattaaacacctatacacacatacacacacacacacacacacacacacacacacacacacacacacacacacagaacaggcctacataacagaca

SEQ ID NO: 21981 - DNA, 228 bp, Homo sapiens; identical to SEQ ID NO: 21980
  AC009134.6_126907
  Located on chromosome 16
  Distance between a terminus base of telomere on chromosomal short arm and 5'-terminus of this base sequence : 22096243
  Distance between 3'-terminus of neighbour sequence of sequence listing upward to telomere on chrosomal short arm and 5'-terminus of this base sequence : -228

SEQ ID NO: 21982 - DNA, 230 bp, Homo sapiens
  U91325.1_57033
  Located on chromosome 16
  Distance between a terminus base of telomere on chromosomal short arm and 5'-terminus of this base sequence : 22147547
  Distance between 3'-terminus of neighbour sequence of sequence listing upward to telomere on chrosomal short arm and 5'-terminus of this base sequence : 51076
agtaaagaccagtgcattaggagctcaacatataatgatgctttaatgaccccgataatgtcccttttatcaaatggaaaaaggagtttgtttcattgaaaatacattttcttctctgtatgaatattatttgaaaaggaattgtttatcagtcagaagagatgcacgtgcgcacacacacacacacacacacacacattcattctcactcatttaccaatccagaaaca

SEQ ID NO: 21983 - DNA, 230 bp, Homo sapiens; identical to SEQ ID NO: 21982
  AC009134.6_75611
  Located on chromosome 16
  Distance between a terminus base of telomere on chromosomal short arm and 5'-terminus of this base sequence : 22147547
  Distance between 3'-terminus of neighbour sequence of sequence listing upward to telomere on chrosomal short arm and 5'-terminus of this base sequence : -230

SEQ ID NO: 21984 - DNA, 276 bp, Homo sapiens
  U91325.1_57255
  Located on chromosome 16
  Distance between a terminus base of telomere on chromosomal short arm and 5'-terminus of this base sequence : 22147791
  Distance between 3'-terminus of neighbour sequence of sequence listing upward to telomere on chrosomal short arm and 5'-terminus of this base sequence : 14
tttgattaacaccttagcgttaacaatgcaatataaacacacagaaatgctgaaggtatcccagaagaacaaaactcttatatgctttgatatatatatatcctatatatttcagacactacaatgtggaaatggcatgtatgtgtgcatgtacacacacacacacacacacacacacacacacattttcctaattgtagattagattggttgcatgtttaccatgttccaggacctgtgctgataataggagtgtaaagaacaagaggacactgt

SEQ ID NO: 21985 - DNA, 346 bp, Homo sapiens
  U91325.1_80978
  Located on chromosome 16
  Distance between a terminus base of telomere on chromosomal short arm and 5'-terminus of this base sequence : 22171527
  Distance between 3'-terminus of neighbour sequence of sequence listing upward to telomere on chrosomal short arm and 5'-terminus of this base sequence : 23460
ttcacacctgtaatccagctactcggaggctgagatgggaggatcacttgaacctgggaggtggagattgcagtgagctgagatcatgccactgcactccagcctgggtgacagagtgaaactgtatctctctctctgtacatacacacacacacacacacacacacacacacacatatatgtgtatatatatatagagagagagagagagagagagagataacatgagaagctcttttcctactgtctggaacacggtgtgtgctcgacaaaacaacactatttgaccatctagtgcctttctgggctattcctccttgggatatgctttgaaggagtcattatg

SEQ ID NO: 21986 - DNA, 241 bp, Homo sapiens
  G09532
  Located on chromosome 16
  Distance between a terminus base of telomere on chromosomal short arm and 5'-terminus of this base sequence : 22174826
  Distance between 3'-terminus of neighbour sequence of sequence listing upward to telomere on chrosomal short arm and 5'-terminus of this base sequence : 2953
tggtatgtttctttatcctttatcgccacttgagttgtgtgatgagctgccaatcacggtaactgtcttagtttgtgtttccccggaagtcactaagataaggactttgcacaaaaacagtagctatccaccaaaaaatatatcatgaaacacacacacacacacacacacacacacacacagcagcagcagcagcagcagcagcatacaatgagaacttaacagtaagccatttcccaca

SEQ ID NO: 21987 - DNA, 175 bp, Homo sapiens
  U91325.1_118797
  Located on chromosome 16
  Distance between a terminus base of telomere on chromosomal short arm and 5'-terminus of this base sequence : 22209435
  Distance between 3'-terminus of neighbour sequence of sequence listing upward to telomere on chrosomal short arm and 5'-terminus of this base sequence : 34368
tcttgttctaggtggagtttctagtgtgtcttgtttggactgttggcccatttttatgctgttcttgggttgacatgccagtctctaactctctctctctctctctctctctctctcttctctttcttccccttcttcatccacccgttccgatgtgtagctgacaaggtcaatg

SEQ ID NO: 21988 - DNA, 175 bp, Homo sapiens; identical to SEQ ID NO: 21987
  AC009134.6_13803
  Located on chromosome 16
  Distance between a terminus base of telomere on chromosomal short arm and 5'-terminus of this base sequence : 22209435
  Distance between 3'-terminus of neighbour sequence of sequence listing upward to telomere on chrosomal short arm and 5'-terminus of this base sequence : -175

SEQ ID NO: 21989 - DNA, 412 bp, Homo sapiens
  U91325.1_122658
  Located on chromosome 16
  Distance between a terminus base of telomere on chromosomal short arm and 5'-terminus of this base sequence : 22213112
  Distance between 3'-terminus of neighbour sequence of sequence listing upward to telomere on chrosomal short arm and 5'-terminus of this base sequence : 3502
ctgaataaacttcatcaattgaactgggctccttggggtctgcagttgtaattttggcagcaaaggtgcagactggtcattaagatgtagccacaatgatggcccaagaaggacacgtactttccaagtagtcctgtctaggatggaaagctcaggaagtgcttcatagtttattatcttccagttggttttgggagatgaactgaagagggaagtttggatagggaaggtctttttattcttttttttttaatgtatccatggagtatttattattattattattattattattattattattatactttaagttttagggtacatgtgcacaatgtgcaggttagttacatatgtatacacgtgtcatgctggtgtgctgcacccattaactcgtcatttagcattagct

SEQ ID NO: 21990 - DNA, 412 bp, Homo sapiens; identical to SEQ ID NO: 21989
  AC009134.6_9938
  Located on chromosome 16
  Distance between a terminus base of telomere on chromosomal short arm and 5'-terminus of this base sequence : 22213112
  Distance between 3'-terminus of neighbour sequence of sequence listing upward to telomere on chrosomal short arm and 5'-terminus of this base sequence : -412

SEQ ID NO: 21991 - DNA, 435 bp, Homo sapiens
  AC003119.1_60656
  Located on chromosome 16
  Distance between a terminus base of telomere on chromosomal short arm and 5'-terminus of this base sequence : 22237009
  Distance between 3'-terminus of neighbour sequence of sequence listing upward to telomere on chrosomal short arm and 5'-terminus of this base sequence : 23485
tgtctatatcagaaggcttatcaggttgtatcacacttgttgacctgctgctttgcccaatagcctggaggatcttttaagacagaaactctactttatttactttttcaacttgacccatagaaggatcaatagagaacttccatattctggcccggtgagtaagttctcaaaaaaattgttattgtggaaggaaggaaggaaggaaggaaggaaggaaggaaggaagggagggaggaaggaaggaaggaaggaaggaaggaaggaaagaaggaagaggcagggagggagggaaggaagaaaacagatgttagctactcccttgtgtaatggaacactccagcatgaagtatggtttttggggtgagctacattcactgtgcttacccagttgagagatataaagctaatttttgctcattcaggtttaagtta

SEQ ID NO: 21992 - DNA, 295 bp, Homo sapiens
  AC003009.1_135251
  Located on chromosome 16
  Distance between a terminus base of telomere on chromosomal short arm and 5'-terminus of this base sequence : 22303105
  Distance between 3'-terminus of neighbour sequence of sequence listing upward to telomere on chrosomal short arm and 5'-terminus of this base sequence : 65661
tcagccttctgagtagctagaattacaggtgcccaccaccacgcctggctaaatatatgtgtatacacacacacacacacacacacacacacacacacacacacacacatatatattgtatttttatcagagacgtgattttgccacgttggccaggctggtcttgtacccctgacctcgggcgatccacccgcctcagcttcccaaagtgctgggattacaggtgtgagccaccatacccagcctagcaacatttttcataagaggcagcctactgcactggtgatataggagt

SEQ ID NO: 21993 - DNA, 397 bp, Homo sapiens
  AC003009.1_68918
  Located on chromosome 16
  Distance between a terminus base of telomere on chromosomal short arm and 5'-terminus of this base sequence : 22369278
  Distance between 3'-terminus of neighbour sequence of sequence listing upward to telomere on chrosomal short arm and 5'-terminus of this base sequence : 65878
caccatagcacttaggacagtattgtgtcactgctaatatggtgggggaaatatattgagatatttatttgtatttaattgctgtagaagaatcaggacgaatgagaggcagcaatgctttgctttttatactctgcccctcacttgcacacaaacgaatcccaaggagtccatagggcccctcccttcctctgccactgtcattttaaagcaaaagcagtatctggggtgtgtgtgtgtgtgtgtgtgtgtgtgtgtgtgtgtgtgtggctgtttgtgtgtgtgcatgtgtagggggttggtttatcttatgaaatcctaagaaattctagtgaaatcccagaaggggaatgatgaggaagaatgtggctttgcagtctggctatgaaatgttcct

SEQ ID NO: 21994 - DNA, 187 bp, Homo sapiens
  U91319.1_86773
  Located on chromosome 16
  Distance between a terminus base of telomere on chromosomal short arm and 5'-terminus of this base sequence : 22514688
  Distance between 3'-terminus of neighbour sequence of sequence listing upward to telomere on chrosomal short arm and 5'-terminus of this base sequence : 145013
tactttcagtccagtgcttaaatcctttcaactcagtgtccagtgtatatgtatacacagatatatgcatgtgcatacatgcccacacacacacacacacacacacacacacataaacctcctatagcagatcattcttggtgctccctcatgttccctcactcttataacttcaatgcagaccaac

SEQ ID NO: 21995 - DNA, 317 bp, Homo sapiens
  AF001551.1_33930
  Located on chromosome 16
  Distance between a terminus base of telomere on chromosomal short arm and 5'-terminus of this base sequence : 22587179
  Distance between 3'-terminus of neighbour sequence of sequence listing upward to telomere on chrosomal short arm and 5'-terminus of this base sequence : 72304
aaacttctgacctcaagtgatccacccccgctcagcctcccaaagtgctgggattacaggtgtgaaccatcgtgcctggacaagaataagtgttttaaagtcatccattttactcatcatggaaaactcagtgcctggcacagcctctgctatatagtagatacttaatatatatttcttgaatgaatgaatgaatgaatgaatgaatgaatgagtgaatgaatgaatgaatgacttgactgtgcgttacttctgagcttcacttttccctcttctggaaaacagggctggcagtgtgtatcttccaaattatcgtg

SEQ ID NO: 21996 - DNA, 385 bp, Homo sapiens
  AF001551.1_43638
  Located on chromosome 16
  Distance between a terminus base of telomere on chromosomal short arm and 5'-terminus of this base sequence : 22596871
  Distance between 3'-terminus of neighbour sequence of sequence listing upward to telomere on chrosomal short arm and 5'-terminus of this base sequence : 9375
tgcagatacaggacaaaggtactggatttccagccacctattggattggagctctatacatttttttttctttttaaaaaatttatttttgtattgtatgtattaaaggtgtacaacatgttttgatgtacatatacatggtgaaataggtactacatcaagccaattaatatatccatcatctcaaacagttactgtgtgtgtgtgtgtgtgtgtgtgtgtgtgtgtgtgtgtgtgtgtgtgtgttaggagcatctaaaatctactattttggaaaatctatacattttagattaatatttaaggacataattatctaaaaaatctggagttgccaatgaaagcatggaaggcttcccagaggaagtgacatttaaactgagtc

SEQ ID NO: 21997 - DNA, 288 bp, Homo sapiens
  AC003034.1_14611
  Located on chromosome 16
  Distance between a terminus base of telomere on chromosomal short arm and 5'-terminus of this base sequence : 22997556
  Distance between 3'-terminus of neighbour sequence of sequence listing upward to telomere on chrosomal short arm and 5'-terminus of this base sequence : 400300
tatgtactccgcaacttaggatggggttacatcccgataaatgtatcacaatgtcaaaaaaattgtaagttgaaccattataagtcaagaatcctctgtacacacacacacacacacacatacagagaatgagagagagagcgagagagagacagagagagagagagagagagagagagagagattggctcaaagaattatgtagtttgagaattcccaagatctacagcttggaagctgaagacccaggaaagccaatgtgtatatccagtcttagtctgaagacct

SEQ ID NO: 21998 - DNA, 159 bp, Homo sapiens
  AC002394.1_20466
  Located on chromosome 16
  Distance between a terminus base of telomere on chromosomal short arm and 5'-terminus of this base sequence : 23371736
  Distance between 3'-terminus of neighbour sequence of sequence listing upward to telomere on chrosomal short arm and 5'-terminus of this base sequence : 373892
ttcagtcatcaataagtctgaagactcaaagacaactatggccccagaataaactgcgtgcgctcatgcacacacacacacacacacacacacacacacacacacacacacacaaatgttgcatccaacaatagggggtccatgaaattacatgcaact

SEQ ID NO: 21999 - DNA, 104 bp, Homo sapiens
  D16S3046
  Located on chromosome 16
  Distance between a terminus base of telomere on chromosomal short arm and 5'-terminus of this base sequence : 23371778
  Distance between 3'-terminus of neighbour sequence of sequence listing upward to telomere on chrosomal short arm and 5'-terminus of this base sequence : -117
cccagaataaactgcgtgcgctcatgcacacacacacacacacacacacacacacacacacacacacacacaaatgttgcatccaacaatagggggtccatgaa

SEQ ID NO: 22000 - DNA, 240 bp, Homo sapiens
  AC002394.1_49947
  Located on chromosome 16
  Distance between a terminus base of telomere on chromosomal short arm and 5'-terminus of this base sequence : 23401148
  Distance between 3'-terminus of neighbour sequence of sequence listing upward to telomere on chrosomal short arm and 5'-terminus of this base sequence : 29266
ctgcggtatgattaagtataccacacaagcatatcctgaaatttgcaaaacagtgtgtggcatgtgaggcattacacttccctttttggattctagtaaccaaaaactgaatctgaaacaggaaataagtctgtggttgtgtgtgtgtgtgtgtgtgtgtgtgtgtgtgtgtttaattgataggaggatatgggaccagaaatgtatggagaacaatttcacttaaaggttattggattg

SEQ ID NO: 22001 - DNA, 327 bp, Homo sapiens
  AC002394.1_58325
  Located on chromosome 16
  Distance between a terminus base of telomere on chromosomal short arm and 5'-terminus of this base sequence : 23409558
  Distance between 3'-terminus of neighbour sequence of sequence listing upward to telomere on chrosomal short arm and 5'-terminus of this base sequence : 8170
ctgagtcaggataatcacttgaacctgggaggcggaggttgcagtgagccgagattgcgccattgcactccagcctgggcaacaaaagcgaaactctgtctcaaaaataataataataataataataataataattaaataaataaataaaacttgcaaagcaatactataaatgttatgtgtaaagatatgcacaataaacaataaattcagcatagtgattccttctaggagaggaagggaaatgttatttggaaggggtacagtgggggtttctactggatacataatttattctttaaggtctgttgtaactgtatggctatt

SEQ ID NO: 22002 - DNA, 288 bp, Homo sapiens
  AC002394.1_90032
  Located on chromosome 16
  Distance between a terminus base of telomere on chromosomal short arm and 5'-terminus of this base sequence : 23441268
  Distance between 3'-terminus of neighbour sequence of sequence listing upward to telomere on chrosomal short arm and 5'-terminus of this base sequence : 31383
atcttcagttgaaatcaacgagggaccccagaatcccacagatgactccaggcttagcagaacccaatcagaacaggaatcatactgtatcagtagcacaggacacacacacacacacacacacacacgctgggagaacacaaccctagccctccctcatacagttttctggggagtgggcatgaaagcagatgagactgaattacctctcgcccaccctggcttcctctctgctcccccagtgggcctggctttggacccaaacagaactgagtttggatcctagct

SEQ ID NO: 22003 - DNA, 288 bp, Homo sapiens
  AC002394.1_104866
  Located on chromosome 16
  Distance between a terminus base of telomere on chromosomal short arm and 5'-terminus of this base sequence : 23456032
  Distance between 3'-terminus of neighbour sequence of sequence listing upward to telomere on chrosomal short arm and 5'-terminus of this base sequence : 14476
gacaggccagctaacagtaacagaacagctatatcaacaataacaacatggctgggtgtggtggctcacacctgtaatcccaacactttgggaggccgaggtgggaggatcacttgagctcaggagttggagaccagcctgggcaacacagtgagaccttgtctctatttaaacacacacacacacacacacacacacacacacacacacacacacaccccaacacaaaaggtggggttcacattaaattttggactcagaaaaaaactcattggcttctgttaatta

SEQ ID NO: 22004 - DNA, 316 bp, Homo sapiens
  AC008551.5_83063
  Located on chromosome 16
  Distance between a terminus base of telomere on chromosomal short arm and 5'-terminus of this base sequence : 23692086
  Distance between 3'-terminus of neighbour sequence of sequence listing upward to telomere on chrosomal short arm and 5'-terminus of this base sequence : 235766
ttgataaatctttggaaaggtctctcctggtcactgtagctacagtagccctccacttccgtctgctagtcattctgccctattttattttcttcagagcatttattactaacagaaatattttattgtttgtcctgtctatggatttattcatccattcatccaaccatccatccattcatccatccatccatctgtccatccatccatccatccatccatccatccatccatccatgtctattgtctaggtctccctcagttaaaatagaagctccatgaaggtagagaacttaatagcatacttcgcaaatat

SEQ ID NO: 22005 - DNA, 418 bp, Homo sapiens
  AC008551.5_51606
  Located on chromosome 16
  Distance between a terminus base of telomere on chromosomal short arm and 5'-terminus of this base sequence : 23723577
  Distance between 3'-terminus of neighbour sequence of sequence listing upward to telomere on chrosomal short arm and 5'-terminus of this base sequence : 31175
gaaactgactcaggatagctgaaacgagaagaccaaatgggtgtctcatggaacccaaggccaaatagcacagccaagcctcacaaaagatggatctagaacccagaagcctcttctcttaggaactccttccatctctctgatcttggctcctctttcctggccctgccttagtcagtctctctctctctctctctctctctccctccccacccccccccccaagactggctttctctatcactccgtcacacagagaaacataattctcactcagcccaaactagtatagaatgtcatggtttggattctaaactccttgggttaaaatataattgggtttggttggttttagtacccaatccctgcccagtcaaccatgatcagaggaacaaggtcatgttccataagcattcac

SEQ ID NO: 22006 - DNA, 400 bp, Homo sapiens
  AC008551.5_48690
  Located on chromosome 16
  Distance between a terminus base of telomere on chromosomal short arm and 5'-terminus of this base sequence : 23726597
  Distance between 3'-terminus of neighbour sequence of sequence listing upward to telomere on chrosomal short arm and 5'-terminus of this base sequence : 2602
tctggataagatattcagccatttaacctctctgagccacatttttaccctaagttaaacacacacacacacacacacacacacacacacacacacacacctacctcaatatttatgcatttttataaaataaaattaaacactctcagcaaacactttgagaatgttgttgatagtcacataatttaagttaatttcatcttgaaaatacagattgctaaaaaaagattttaattttaaattatacgaatgtattattactcttatggccattgagccttattcattatagcacatgatggagatagagggagtgtatatccatagagatcacccatttgaatttcacttgggagtgggagaaattgacatctcactggatatttgttagttgatcagc

SEQ ID NO: 22007 - DNA, 235 bp, Homo sapiens
  D16S3045
  Located on chromosome 16
  Distance between a terminus base of telomere on chromosomal short arm and 5'-terminus of this base sequence : 23767645
  Distance between 3'-terminus of neighbour sequence of sequence listing upward to telomere on chrosomal short arm and 5'-terminus of this base sequence : 40648
atgtaggacggctgaatgtctgtcatcacctacatacatggataatatgtaaagtgcaagtacatatccacgtgcacattcaagcgccagtccacacacacacacacacacacacacacacacaccccaaaagctgccaagtccccatatatgtaaagtcatttagggactccccaatgtccctggcacaaagtttaactccttatcagggcccatgagactatgtgatctggcc

SEQ ID NO: 22008 - DNA, 351 bp, Homo sapiens
  AC008551.5_7617
  Located on chromosome 16
  Distance between a terminus base of telomere on chromosomal short arm and 5'-terminus of this base sequence : 23767692
  Distance between 3'-terminus of neighbour sequence of sequence listing upward to telomere on chrosomal short arm and 5'-terminus of this base sequence : -188
tgtaaagtgcaagtacatatccacgtgcacattcaagcgccagtccacacacacacacacacacacacacacacacaccccaaaagctgccaagtccccatatatgtaaagtcatttagggactccccaatgtccctggcacaaagtttaactccttatcagggcccatgagactatgtgatctggccccgcctgcctctgcaatctcatttcctgctctttctcagcctcagcttagcagtctccagcagtcctgtcttgtttccaagacaagcccaggtttcatcacctcaaggcttttgctctttttattcctcttcctgggactcttgcctcagtttatctcagagt

SEQ ID NO: 22009 - DNA, 439 bp, Homo sapiens
  chr16.fa.O7frz.32061172
  Located on chromosome 16
  Distance between a terminus base of telomere on chromosomal short arm and 5'-terminus of this base sequence : 23895162
  Distance between 3'-terminus of neighbour sequence of sequence listing upward to telomere on chrosomal short arm and 5'-terminus of this base sequence : 127119
cacctgcacttgtatgtttatcgcagcactatccacaataacaaagtcatggaatcaacctaagtgtccatcaatccatgataggatgaagaaaatgtagtatatatatatatatatatatacaccatggaatactactcagccatataaaagaataaaatcatgccttttgcagcaacttggatggaactgggggccattatcctaagtgaaataagtcaaagtcatataccacatgttctcacttataagtgggagctagacactgtgtacacacggacatacagagtgtaagaatagacactgaagactccaaaaggtggcaaggtgggagggtggtgagggatgaaaaattatctatttggtataatgtacactattgattacaccaaaagcccagacttcaccactgtgaaatacatccatgtaacaaagctac

SEQ ID NO: 22010 - DNA, 435 bp, Homo sapiens
  AC002040.1_20340
  Located on chromosome 16
  Distance between a terminus base of telomere on chromosomal short arm and 5'-terminus of this base sequence : 24000366
  Distance between 3'-terminus of neighbour sequence of sequence listing upward to telomere on chrosomal short arm and 5'-terminus of this base sequence : 104765
tattgcaattcagtttacaatcatcaccttcactaatatgtgggcttcaacccagtagagacccatcttactcattattcggtacccagtaaggtagccattatataacaggttgattatttggcaactttatacctaaacaatgtcgtgtgtgtgtgtgtgtgtgtgtgtgtgtgtgtgtgtgtgtatgtgtgtgtgatggagtctcactctaacaaccaggctggagtgcagtggcgggatctcagctcacctgcaacccccatctcctgggttcaagcaattctcctgcctcagactcctgagtagctgggattacaggcacttgccagcacacctggctaatttttgttttttgttttttgttttgttttgttttgtgagcagcagcaagatttattgtgaagagcaaaagaataaagcttccacagcgta

SEQ ID NO: 22011 - DNA, 119 bp, Homo sapiens
  D16S412
  Located on chromosome 16
  Distance between a terminus base of telomere on chromosomal short arm and 5'-terminus of this base sequence : 24000472
  Distance between 3'-terminus of neighbour sequence of sequence listing upward to telomere on chrosomal short arm and 5'-terminus of this base sequence : -329
aacaggttgattatttggcaactttatacctaaacaatgtcgtgtgtgtgtgtgtgtgtgtgtgtgtgtgtgtgtgtgtgtatgtgtgtgtgatggagtctcactctaacaaccaggct

SEQ ID NO: 22012 - DNA, 470 bp, Homo sapiens
  AC002040.1_10131
  Located on chromosome 16
  Distance between a terminus base of telomere on chromosomal short arm and 5'-terminus of this base sequence : 24010495
  Distance between 3'-terminus of neighbour sequence of sequence listing upward to telomere on chrosomal short arm and 5'-terminus of this base sequence : 9904
ttgaggtcaggagtttgagaccagcctggccaacatggtgaaaccctgactctactaaaaatacaaacattagccaggtgtggtggcgggtgtgtgtaattccagctacttgggaggctgaggcaggagaatcacttgaatccaagaggcagaggttgcagtgagcgaagatcatgccactgcactccaacctgggcaatagagtgacactctgtctccaaaacaaaatatatatatatatatatatatgtgtgtgtgtgtgtgtgtgtgtgtgtatatgtgtgtatatatatgtgtatatatgtatatattgcactaaaatattctttgatgcccccttaaaacttgtacctgagaagactccctcactagtcctactccagtcccagcccagcccttaaaagacgcacagagtttccatgggaggccgtgagattcactcacttcagtgctatcgtctaagactggtg

SEQ ID NO: 22013 - DNA, 241 bp, Homo sapiens
  D16S3130
  Located on chromosome 16
  Distance between a terminus base of telomere on chromosomal short arm and 5'-terminus of this base sequence : 24150042
  Distance between 3'-terminus of neighbour sequence of sequence listing upward to telomere on chrosomal short arm and 5'-terminus of this base sequence : 139077
ttatttatgtcaacaagtagtgggtttattatagtgtaatgcattaataaatatttttaggtatcagttttagtttctcatatggaaagtatcattatataaacaaaataacatatatgtgttaaaaacacgtgtgtgtgtgtgtgtgtgtgtgtgtgtattccacataaacaaaaagtctcaggtattctgtaatttttaaaagtacagaagattcctggctgggcatggtggctcacac

SEQ ID NO: 22014 - DNA, 147 bp, Homo sapiens
  HUMUT7512
  Located on chromosome 16
  Distance between a terminus base of telomere on chromosomal short arm and 5'-terminus of this base sequence : 24158543
  Distance between 3'-terminus of neighbour sequence of sequence listing upward to telomere on chrosomal short arm and 5'-terminus of this base sequence : 8260
gggacagaactcataggatggatggatagatgatagatagataaatgatgatagatagatagatagatagatagatagacagatagatagctaaagaggagtttattaaatattaactcacatgatcacaaggtcccacaataggct

SEQ ID NO: 22015 - DNA, 223 bp, Homo sapiens
  chr16.fa.O7frz.31467535
  Located on chromosome 16
  Distance between a terminus base of telomere on chromosomal short arm and 5'-terminus of this base sequence : 24428037
  Distance between 3'-terminus of neighbour sequence of sequence listing upward to telomere on chrosomal short arm and 5'-terminus of this base sequence : 269347
ttgtagttagccaagatagcaccataccactccagcctgggcgacagagtgagactgtctgaaaaaaaaaaaaaagaaagtgtgtatacacacacacacacacacacaccacacacactctccatggaatactatgcagccataaaaaatgagatcatgtcctttatggtaacatggatgcagctggaaccagtatcctaagtgaactatcacaggatcagaa

SEQ ID NO: 22016 - DNA, 380 bp, Homo sapiens
  chr16.fa.O7frz.31331160
  Located on chromosome 16
  Distance between a terminus base of telomere on chromosomal short arm and 5'-terminus of this base sequence : 24564399
  Distance between 3'-terminus of neighbour sequence of sequence listing upward to telomere on chrosomal short arm and 5'-terminus of this base sequence : 136139
tgtttactatgcttggattcaggcatttctcatgcaaaaaatttgacttgcataaaatacaaactgcaaatgaactggaataaattgtgtgtgtgtgtgtgtgtgtgtgtaatgataaaagcaatatacattctagaaactttgtaaaattcagaaaaatttaaataagaaaatatctggacaggtgtggtggctcacacctgtagtcccagctactcaggaggctgaggtgggaggatcacttgagcctaggagctggaggctgcagttagctgtgactgcaccactgcactccagcctgggctaaagagcaagacactatctcaaaaatattaataataatcagctgggtgcaggggctcatcctgtaatctcagcac

SEQ ID NO: 22017 - DNA, 387 bp, Homo sapiens
  chr16.fa.O7frz.31658250
  Located on chromosome 16
  Distance between a terminus base of telomere on chromosomal short arm and 5'-terminus of this base sequence : 24585963
  Distance between 3'-terminus of neighbour sequence of sequence listing upward to telomere on chrosomal short arm and 5'-terminus of this base sequence : 21184
atcatgcatattgttctacaactagctttttcatgtgacatatcttggagatcttcctatatgagtttgtagaaaggtttctcccttccttctttcttgccttcctctccttccttccttcctttcttccttccatccttccttccctccttccatccttccttccttccttccctccttccttccctccttccttccttccttccttccttccttccttccttccttccttccttccttccctccttccttccctccttccctccctccctctgctccctccctccctccatccctccctccctccctccctccctcccttccttccttccttctttccttcttctctctccttccctctttcttacagcttcattttatttcatg

SEQ ID NO: 22018 - DNA, 410 bp, Homo sapiens
  AC002302.1_13630
  Located on chromosome 16
  Distance between a terminus base of telomere on chromosomal short arm and 5'-terminus of this base sequence : 24614627
  Distance between 3'-terminus of neighbour sequence of sequence listing upward to telomere on chrosomal short arm and 5'-terminus of this base sequence : 28277
atccattgtagccaggtaaatgcaacactctggttagccagacctgctcacatgcttgccccagtactatggactgaagtcaatcccacttgaaccaaatgcaatgtgtatgtgtgtgtgtgtgtgtgtgtgtgtgtgtgttgattccctaaaggaatatcagaatgttgttatgggaagaaggaggctgcatgttggacaggcaaaatccacagataactatatactagttagtttgcttttggctacaaataacagaattgccagctaacagtggcttaaataattaaaacaattatctcacattataagatgtctctggtggtaggcagtcttagagttattgaatgactcatcaatataattgagactccaagatgttttatccttctattcctcagtatgttggc

SEQ ID NO: 22019 - DNA, 232 bp, Homo sapiens
  Z16998.1_129
  Located on chromosome 16
  Distance between a terminus base of telomere on chromosomal short arm and 5'-terminus of this base sequence : 24614659
  Distance between 3'-terminus of neighbour sequence of sequence listing upward to telomere on chrosomal short arm and 5'-terminus of this base sequence : -378
gttagccagacctgctcacatgcttgccccagtactatggactgaagtcaatcccacttgaaccaaatgcaatgtgtatgtgtgtgtgtgtgtgtgtgtgtgtgtgtgttgattccctaaaggaatatcagaatgttgttatgggaagaaggaggctgcatgttggacaggcaaaatccacagataactatatactagttagtttgcttttggctacaaataacagaattgc

SEQ ID NO: 22020 - DNA, 128 bp, Homo sapiens
  D16S417
  Located on chromosome 16
  Distance between a terminus base of telomere on chromosomal short arm and 5'-terminus of this base sequence : 24614701
  Distance between 3'-terminus of neighbour sequence of sequence listing upward to telomere on chrosomal short arm and 5'-terminus of this base sequence : -190
tgaagtcaatcccacttgaaccaaatgcaatgtgtatgtgtgtgtgtgtgtgtgtgtgtgtgtgtgttgattccctaaaggaatatcagaatgttgttatgggaagaaggaggctgcatgttggacag

SEQ ID NO: 22021 - DNA, 378 bp, Homo sapiens
  AC002302.1_136864
  Located on chromosome 16
  Distance between a terminus base of telomere on chromosomal short arm and 5'-terminus of this base sequence : 24737946
  Distance between 3'-terminus of neighbour sequence of sequence listing upward to telomere on chrosomal short arm and 5'-terminus of this base sequence : 123117
agtcatctacacagctgttcactcgtccatccatccatccatccatccatccatccatccatccatccatccatccatccgtccatccacattcaatgtagtgtaatgattaagagcatagagtttggagttatcctgcttaggtttgaatcccagctctgccactcaccaagcatgtgatcttggttcagttttaaaacctctccttgtctcagtctcctcagctataaaatgagattgatgttgaaattaataacagagcctaccttacggcattataaaggttatgtgagtcagtatgtgtaaggtgctttcagtagtgcctgggtcatagcagtgctatctaagtgttagctattagcattatggcatctactc

SEQ ID NO: 22022 - DNA, 343 bp, Homo sapiens
  AC002302.1_144631
  Located on chromosome 16
  Distance between a terminus base of telomere on chromosomal short arm and 5'-terminus of this base sequence : 24745569
  Distance between 3'-terminus of neighbour sequence of sequence listing upward to telomere on chrosomal short arm and 5'-terminus of this base sequence : 7245
agccttatcctaatgttttcatagaaattatttttaaatactcaacaattagcttttgaattaaaggaatgcacacaagtgaagttaatctcttataggcaaaaccaaatgaaggattggaaaatgcctctgaagagtcagctggaaggctcttcatccatccatccaaccatccatccatccatccatccatccatccatccatccatccactcatccatccattcatccatccatccacccacccatctacccacccatccatccatccattcacccacccactcatccatctatccattcatccatccatccaataagcagtcattgagtgcctactgtg

SEQ ID NO: 22023 - DNA, 184 bp, Homo sapiens
  AC002302.1_151006
  Located on chromosome 16
  Distance between a terminus base of telomere on chromosomal short arm and 5'-terminus of this base sequence : 24752011
  Distance between 3'-terminus of neighbour sequence of sequence listing upward to telomere on chrosomal short arm and 5'-terminus of this base sequence : 6099
ctgactcagagctgtggtaaagagccccgcttttgttgtcctgctcaggacaaaaatacatggccccaggcttttgtgagtaggatccggaagggaacttaagtgtgtgtgtgtgtgtgtgtgtgtgtgcacccacgtgtgtgtgggggagtgatagagattctcctggtttctgtcctagttt

SEQ ID NO: 22024 - DNA, 381 bp, Homo sapiens
  AC002299.1_104988
  Located on chromosome 16
  Distance between a terminus base of telomere on chromosomal short arm and 5'-terminus of this base sequence : 25031452
  Distance between 3'-terminus of neighbour sequence of sequence listing upward to telomere on chrosomal short arm and 5'-terminus of this base sequence : 279257
gtcttatttgatcctcatgacaagccaacaagttaatccttttacaaaggaaactagagcctgggatgtgacagcagttgccgaaggtgatgtggttagctcatgacaaagcctgacctgctgcttatccctcccatctgtgggctggaggggaggcaacttcaccagccacacagttgagggtttcttgtgcttgcctgaatcacgaccagcgaggaacttctgagaaccacagatcctgggcctccacctgcagagattctaatgggatgatgcttgggcatcccacattgtttcttgtgtgtgtgtgtgtgtgtgtgtgtgtgtgtgtgtgtgtgtgtgtttgagacagggtctcactctgtctactcactgcaagct

SEQ ID NO: 22025 - DNA, 421 bp, Homo sapiens
  AC002299.1_147084
  Located on chromosome 16
  Distance between a terminus base of telomere on chromosomal short arm and 5'-terminus of this base sequence : 25073544
  Distance between 3'-terminus of neighbour sequence of sequence listing upward to telomere on chrosomal short arm and 5'-terminus of this base sequence : 41711
ggactgaggtcttcagtttctcactggctcttggcaggaggttgccctcagtttgttaccatgtgggtcttgccaaagtggaagcttgcttcatgaaattatacacactaagaaggcaatatagtgagaataccagtagtttggaagacccattcttctgtaacctaatcatagaagtgacattatatcctttttgctgtattttattaattacaagcaagtcattaggcccagtccacactcaaggggaaggaattacacaaggatattatggtatgaaatatatatgtatgtgtgtgtgtgtgtgtgtgtgtgtgtgtgtgtgtgtgttttcatctacagttcctggctcatacctcccataacccttgttatagttttgttataatgttgggtgctttagacctcaggaaatagaagc

SEQ ID NO: 22026 - DNA, 191 bp, Homo sapiens
  D16S420
  Located on chromosome 16
  Distance between a terminus base of telomere on chromosomal short arm and 5'-terminus of this base sequence : 25073768
  Distance between 3'-terminus of neighbour sequence of sequence listing upward to telomere on chrosomal short arm and 5'-terminus of this base sequence : -197
ttaggcccagtccacactcaaggggaaggaattacacaaggatattatggtatgaaatatatatgtatgtgtgtgtgtgtgtgtgtgtgtgtgtgtgtgtgtgtgttttcatctacagttcctggctcatacctcccataacccttgttatagttttgttataatgttgggtgctttagacctcaggaaat

SEQ ID NO: 22027 - DNA, 283 bp, Homo sapiens
  AC004125.1_12268
  Located on chromosome 16
  Distance between a terminus base of telomere on chromosomal short arm and 5'-terminus of this base sequence : 25106127
  Distance between 3'-terminus of neighbour sequence of sequence listing upward to telomere on chrosomal short arm and 5'-terminus of this base sequence : 32168
tattgtcaactgcttggatctctggcttgagatggggtctttaaccctgcttaaattggatttcgaagggagggggagggaagggaggagaagggacaagaggaaagaagtgaggggggagagagagagagagagagagagagagagagagagagagagagagagagagagagagagatcctgacccggtctggcacattctgagctatttcattatttctcaacatagacttatcagtttctcctgagtttgctctaactagatattgtcatgaacttccac

SEQ ID NO: 22028 - DNA, 374 bp, Homo sapiens
  AC004125.1_60220
  Located on chromosome 16
  Distance between a terminus base of telomere on chromosomal short arm and 5'-terminus of this base sequence : 25154061
  Distance between 3'-terminus of neighbour sequence of sequence listing upward to telomere on chrosomal short arm and 5'-terminus of this base sequence : 47651
ataggagatgctatgcatgaatggggatgaggaatatgggaaatctctgtaccttctgctcggtttttctgtgagcctaaaactgctctaaaaactaaaaagtatatatatatatacaaacttatatacataaatatgtgtgtgtgtgtgtgtgtgtgtgtgtgtgtgtgtgtgtgtgtgtgtagacaggtttagagacaggtttgctctgtcacccaggctggagtggaatagggtgatcatagctcactgcagcctccaactcctgggctcaagggatcctcccacctcagcctcctgagtagccgttgcacccagttaatatttttttaaattattttaccatcattattggaaaactaacataggaacag

SEQ ID NO: 22029 - DNA, 294 bp, Homo sapiens
  AC004125.1_69633
  Located on chromosome 16
  Distance between a terminus base of telomere on chromosomal short arm and 5'-terminus of this base sequence : 25163558
  Distance between 3'-terminus of neighbour sequence of sequence listing upward to telomere on chrosomal short arm and 5'-terminus of this base sequence : 9123
agacatgtggcagctacattttgaagcctggcaaattctcctaggactctcgcctcctcctcctcctcctcctcctcctcctcctcctccaacctccacctactctccttcattttcatgccttccaggagtcccacacaatcaggaaacccaagtaggtgacaggaggatggaaaataggggctgcaggttccgagggttatgatgatcgaaaaaccagagtccctgagcttgcaagtctgtgaatcccttgggccactgcataaagaagctgtgagcttgtgcaagatagtt

SEQ ID NO: 22030 - DNA, 374 bp, Homo sapiens
  AC004125.1_82355
  Located on chromosome 16
  Distance between a terminus base of telomere on chromosomal short arm and 5'-terminus of this base sequence : 25176118
  Distance between 3'-terminus of neighbour sequence of sequence listing upward to telomere on chrosomal short arm and 5'-terminus of this base sequence : 12266
tgccaataaacaaagcttaaaggacagttcatccaggctgggtgctgtgactgatgcctgtaatcccagcactttgggagggcaaagtgagaggatcacttgagccctcacttcgaactcctcaccaggagttcgaaagcagcctgggcaaaataagaacttgtttctacgaatatatatatgtgtgtgtgtgtgtgtatatatatatatatatacacacacacacacacacacacatatactatgaatatatacatatatatatatatgggggggctgaggttggggggatcgtttgagctcaggagttaaaggatgcagtgagctatgattgtaccgctgcactccagcctcagtgacatagtgagaacctg

SEQ ID NO: 22031 - DNA, 167 bp, Homo sapiens
  HUMUT2083
  Located on chromosome 16
  Distance between a terminus base of telomere on chromosomal short arm and 5'-terminus of this base sequence : 25367698
  Distance between 3'-terminus of neighbour sequence of sequence listing upward to telomere on chrosomal short arm and 5'-terminus of this base sequence : 191206
ccatggactcaagcagttcaaacccaggttgttcaagggccaactgcagatagatagatagatagatagatagatagatagatagatagatagatagatagatagatagatataattttggtagcatattatacattggtttttactgtgcttttcacttgtctata

SEQ ID NO: 22032 - DNA, 397 bp, Homo sapiens
  chr16.fa.O7frz.35559765
  Located on chromosome 16
  Distance between a terminus base of telomere on chromosomal short arm and 5'-terminus of this base sequence : 25375721
  Distance between 3'-terminus of neighbour sequence of sequence listing upward to telomere on chrosomal short arm and 5'-terminus of this base sequence : 7856
tatttgtggttatggcattaagtgaaaaaacagctaatgctgctgggcacagtggctcaggcctggaatcccagcactttgggaagcagaggtaggaggatcacttgagcccaggagtttgagaccagcctgggcaatatagtgagaccccacccgtacaaaaaatttaaaaattagccaggagtggtggcacgtgcctgtggtcccagctacacaggaggctgaggcagaaggatcgcttgagccgaggaggttgaggctgcagaaagctgtggttgtgccactgcactccatcctgggcaacacagcaagaccctgtctcaaaaaacaaacacacacacacacacacacacacacacacacaaacaccaccagctaatgccataaccgtaaataa

SEQ ID NO: 22033 - DNA, 273 bp, Homo sapiens
  AC002565.1_74563
  Located on chromosome 16
  Distance between a terminus base of telomere on chromosomal short arm and 5'-terminus of this base sequence : 25523549
  Distance between 3'-terminus of neighbour sequence of sequence listing upward to telomere on chrosomal short arm and 5'-terminus of this base sequence : 147431
taatctggaactaattggaaagagactttgcaagttatagaatctggattttaggtgaaagtgggccatcctttcctctccgttgcaacggagttccacataaaagcaggcaaattcaatgtattgtgacagaagctgagactctgtaaagtaattcttttaaatattatttattctcttacaacactgcccccaccacacacacacacacacacacacacacacacacacacacacacatctttgtctaagtctgaacaatcatgtgacgta

SEQ ID NO: 22034 - DNA, 176 bp, Homo sapiens
  D16S401
  Located on chromosome 16
  Distance between a terminus base of telomere on chromosomal short arm and 5'-terminus of this base sequence : 25523722
  Distance between 3'-terminus of neighbour sequence of sequence listing upward to telomere on chrosomal short arm and 5'-terminus of this base sequence : -100
ttctcttacaacactgcccccaccacacacacacacacacacacacacacacacacacacacacacatctttgtctaagtctgaacaatcatgtgacgtaaacttttcttaaagggatcacaagagagattatggaaagactgccaaagtaaccatctctgtcaagccatccaaat

SEQ ID NO: 22035 - DNA, 250 bp, Homo sapiens
  AC002565.1_61418
  Located on chromosome 16
  Distance between a terminus base of telomere on chromosomal short arm and 5'-terminus of this base sequence : 25536710
  Distance between 3'-terminus of neighbour sequence of sequence listing upward to telomere on chrosomal short arm and 5'-terminus of this base sequence : 12812
aggtgatgtgcacctgtagtcccagctagtctaggggctgaggcaggaagatcacttgagccctgaggaatccaggctacaatgagctatgatcatgttactacactcccgtctgggtgacagagcaagagaaggagaaggagaaggagaggaagaggaagaggaagaagaggaagaggaagaggaagaagaagaagaagaagaagaagaagaagaagaagaagcagcttattccaactttcttggacat

SEQ ID NO: 22036 - DNA, 188 bp, Homo sapiens
  D16S3133
  Located on chromosome 16
  Distance between a terminus base of telomere on chromosomal short arm and 5'-terminus of this base sequence : 25556283
  Distance between 3'-terminus of neighbour sequence of sequence listing upward to telomere on chrosomal short arm and 5'-terminus of this base sequence : 19323
tgatccacctgctttggcctaccaaagtgctaggattacaggcatgtgccaccgcatccagccagataaacaatttaaatgtaaataaataaaacaggatgaaaggggaacatgggcgcacacacacacacacacacacacacacacatcttaaataagagaaaatctttctaagccagacacaaaac

SEQ ID NO: 22037 - DNA, 450 bp, Homo sapiens
  chr16.fa.O7frz.35849055
  Located on chromosome 16
  Distance between a terminus base of telomere on chromosomal short arm and 5'-terminus of this base sequence : 25620502
  Distance between 3'-terminus of neighbour sequence of sequence listing upward to telomere on chrosomal short arm and 5'-terminus of this base sequence : 64031
attacatgtttcttgaggatacacacccatccacacacgccccctgtaaagttatctgagcctggtgcatgttatgttatgttatgttatgttatgttatgttatgttatgttttatgttatgttatgttatgttgttatgttatgttatgttatgttatgttatgttatgttatgttattcaggagttggggccttaccatattgcccatgcctgacttgaactttttggctcaagcgatcctcctgcctcaggactacagacatctgctgctgtgcctggcttttttgtttttgtattcctggtgtgttttggagggataaatcttgggagaccctttcagagtttctgctgttatactataggaccttctattcctctgtgagcctattttggtaaattatatttgataaagcagagtttggaaaactacagtctgcaagtgaaatc

SEQ ID NO: 22038 - DNA, 423 bp, Homo sapiens
  chr16.fa.O7frz.35977085
  Located on chromosome 16
  Distance between a terminus base of telomere on chromosomal short arm and 5'-terminus of this base sequence : 25757240
  Distance between 3'-terminus of neighbour sequence of sequence listing upward to telomere on chrosomal short arm and 5'-terminus of this base sequence : 136288
accagctacaggctaggaggcttaggcaggagaatcgcttgaacctggaagaggaagttgcagtgagccgagattgtgccacgcactccagtctgggcgacagagtgagactccatctcaagaaaaaataaaaataaaaataaaaaaattaattaaagaaaaagaaattagctgggtgtgatggtacatgcctgtaattccagctacttgggaggctggagcctgtgaggctagggttgcagtgagccaagatggcaccactgaactccagcctgggcgacagagcaagaccccatctcaaaaacacgcgcgcgcgcgcacacacacacacacacacacacacacacacacacacacacacagagtttagaaatgcagtatttacagagccaatcttctctacctgagctttgaaataaacta

SEQ ID NO: 22039 - DNA, 390 bp, Homo sapiens
  AC008741.4_80574
  Located on chromosome 16
  Distance between a terminus base of telomere on chromosomal short arm and 5'-terminus of this base sequence : 25987537
  Distance between 3'-terminus of neighbour sequence of sequence listing upward to telomere on chrosomal short arm and 5'-terminus of this base sequence : 229874
gttactcgtgactcgaaagacgttcaacaccttgaccttgacactgcaggggagaatagaaagagctggtgacttctctgaggaaggaagttgctcaggtgcaaacttccatccatccatccatccatccatccatccatccatccatgggtgagttctttaacttctttgtgcctcgtttttatcatctgaagatggtgataataagtgataggacttatctcaaaggggggttacaaatacataccgagtgtttagcatggtgttggagatgtagtgagtagttgagaaatgtcttctcaatcttgcagtttgagaagacagaaaggtgaaaactagacttacttccaatggctagttgccctgagctccaagtggtaatacattgaa

SEQ ID NO: 22040 - DNA, 346 bp, Homo sapiens
  AC008741.4_107121
  Located on chromosome 16
  Distance between a terminus base of telomere on chromosomal short arm and 5'-terminus of this base sequence : 26014135
  Distance between 3'-terminus of neighbour sequence of sequence listing upward to telomere on chrosomal short arm and 5'-terminus of this base sequence : 26208
aagatcacgtcattgcactccaacctggacaaccggagcaaaactccatctcaaaaaaaaaaaaaaatttaatttgccgggtatggtggtgcatacctgtggtcccagcaacttgggaggctgaggcaagaggatcgcttgagtccaggagtttgaggctgcagtgagacatgatcgcaccagtgcactccagcctgggcaacagaatgaggccctatctcaaaaacaataataatgataataataataataataataataataataaggccacccagaagctgaaagctaattgaaggtatcagtgtgagttggggtggggtttaaattaagaacacaggtctgg

SEQ ID NO: 22041 - DNA, 160 bp, Homo sapiens
  chr16.fa.O7frz.36420171
  Located on chromosome 16
  Distance between a terminus base of telomere on chromosomal short arm and 5'-terminus of this base sequence : 26120691
  Distance between 3'-terminus of neighbour sequence of sequence listing upward to telomere on chrosomal short arm and 5'-terminus of this base sequence : 106210
gatttattctgttgaaccataaagctaagccaaaaaagaatcttagcaattagtttaagagagagagagagagagagagagagagaaagagagagagaaactaacgccggcaaatatttttccagtgcttgccacatgctaagctcagtgttatgaatgc

SEQ ID NO: 22042 - DNA, 449 bp, Homo sapiens
  AC013495.2_5176
  Located on chromosome 16
  Distance between a terminus base of telomere on chromosomal short arm and 5'-terminus of this base sequence : 26201501
  Distance between 3'-terminus of neighbour sequence of sequence listing upward to telomere on chrosomal short arm and 5'-terminus of this base sequence : 80650
aatcacctctttaaagatcctgtctccaaggtcaggtgtggtggctcacatctgtaatcccagcactttgggggctgaggtgggaggatcacttgagcccaggagtttgagaccagcctgggcaacatagtgagaccctgtctctacaaaaaatacgaaaatgagctgggtgtggtggtgtgtgcctgtggtcccagctactagggaggctgaggtgagaggattgcttgagcctgggatgtcaaggctgcagtgagctgtgattgcaccactgcactccagcctgggtgacaaggcaagaccctgtctcaaaaacaaacaaacaaacaaacaaacaaacaaacatcctgtctccttagctcaacacaaaaggccttggttccttgcatgacctgggttccaaggaatgggccaggatccagttgttcttcataggtatggcgtaaaca

SEQ ID NO: 22043 - DNA, 453 bp, Homo sapiens
  chr16.fa.O7frz.36534745
  Located on chromosome 16
  Distance between a terminus base of telomere on chromosomal short arm and 5'-terminus of this base sequence : 26349013
  Distance between 3'-terminus of neighbour sequence of sequence listing upward to telomere on chrosomal short arm and 5'-terminus of this base sequence : 147063
ctagacttgtctgatttggaatactattctaactgcttcagtattttttctctctacttacaagcagccgtatgcctgggcattttccaaacctatgtaataaagatttcaacctctctctctgtgaaaaaacaaacaaacaaacaaaaaaaaaactgttattcttagaggacataaattcaatattcacctgcctgaaggaagatgcatacttaaagtttttatgttaggttccttctgtatttttgaggattctagcacacttgaaaggtttgaaatttaatatctcattgtaaagtatgtatattttctatcttgcctcctttaaagcttgtgtgtgtgtgtgtgtgtgtgtgtgtgtgtgtatacgtcttgggccttccactgatttgctatctcttgatggaaactaactcactagagttcataatctttagttgaactaagccatca

SEQ ID NO: 22044 - DNA, 263 bp, Homo sapiens
  AF265340.1_46387
  Located on chromosome 16
  Distance between a terminus base of telomere on chromosomal short arm and 5'-terminus of this base sequence : 26521237
  Distance between 3'-terminus of neighbour sequence of sequence listing upward to telomere on chrosomal short arm and 5'-terminus of this base sequence : 171771
tccaacttatgaggattaaatgagacaatgtatatgaaataatagccaacacttacagcacttactacatgccacgtactatatatatatatatatatatatatatatatatatattcatgacaaccgtttgggttgggaactctcgttatcctcagcctattcagatggggaaactgaggcacagagggggcccaagttttcctagctagaaagtggtagagatgcaattcaaactaaggctggttctacagtccatgaaag

SEQ ID NO: 22045 - DNA, 239 bp, Homo sapiens
  D16S3131
  Located on chromosome 16
  Distance between a terminus base of telomere on chromosomal short arm and 5'-terminus of this base sequence : 26912012
  Distance between 3'-terminus of neighbour sequence of sequence listing upward to telomere on chrosomal short arm and 5'-terminus of this base sequence : 390512
ctgcttccatcttgcctatgctcacataacctcgtgtgtgtgtgtgtgtgtgtgtgtgtgtgtgtgtgtgtgtgtgtgtgtgtgtgtgtgtggtggagagagagagagagagagaatctgtcttccccttcttagaagaacacttatcccatcatgggtaaccatccctcatgaccttatctaaatctaattacctcccaaaggctccatctccaaataccatcacatttgggggctag

SEQ ID NO: 22046 - DNA, 348 bp, Homo sapiens
  chr16.fa.O7frz.37029331
  Located on chromosome 16
  Distance between a terminus base of telomere on chromosomal short arm and 5'-terminus of this base sequence : 27147311
  Distance between 3'-terminus of neighbour sequence of sequence listing upward to telomere on chrosomal short arm and 5'-terminus of this base sequence : 235060
tacctaatgctagatgacgagttagtgggtgcagcgcaccagcatggcacatgtatacatatgtaactaacctgcacaatgtgcacatgtaccctaaaacttaaagtataattaaaaaaaaaaaagaaagaaagtataaggaattcacaaatagatcaaaggtcaaaagagagtaaaaacagaaaacatgctttgtagacatcttatataaatagtatcatacaatatgaactcctctctctctctctctctctcattcgtgtgtgtgtgtgtgtgtgtgtgtgtctagcttctttcacttcacattttattttcatggtttatctatgccatagaatgtattggtat

SEQ ID NO: 22047 - DNA, 369 bp, Homo sapiens
  chr16.fa.O7frz.37139005
  Located on chromosome 16
  Distance between a terminus base of telomere on chromosomal short arm and 5'-terminus of this base sequence : 27278948
  Distance between 3'-terminus of neighbour sequence of sequence listing upward to telomere on chrosomal short arm and 5'-terminus of this base sequence : 131289
tttagtgactccactaagtttcagtgagcactttgacagacagggaaggcagagatggaacgagatgggtgggtgatggtggcgtttgctatgagtctcaaggttaagggcagcaagaggaataaactattgaaatgatgaacaaagaactccacactggtcaatcactttcactgagagctccaatttgctcattttacattttattttatttatttatttatttatttatttatttatttatttttcagacggagtcttgctctgccatccaagctggaatgcagtggtgcaatctcagctcactgcaacctcctgcccctgggttcaagtgattctcctgcctcagcctcctgagtagccgagatt

SEQ ID NO: 22048 - DNA, 402 bp, Homo sapiens
  AC002289.1_92191
  Located on chromosome 16
  Distance between a terminus base of telomere on chromosomal short arm and 5'-terminus of this base sequence : 27354785
  Distance between 3'-terminus of neighbour sequence of sequence listing upward to telomere on chrosomal short arm and 5'-terminus of this base sequence : 75468
aacctattgtgctactgagcactagatcttttatctaactgttttttgtacccattaaaagacctcactttattccttctcccctctagccttcccagactctggtaaccaccattctattcattaatccatgagatgaattttttcagttcccacatttgagtgagaaccagtaatatttgtctatgtgtgcctggcttatttcatttaacataatatcctctagttccatccatgttgtagcaaatgacagaattttgttacttttcatgcctgaataatattccattgtgtgtgtgtgtgtgtgtgtgtgtgtgtgtgtgtgtgtgtatctcacatattctgtacccattcatctgttgaacattttgatgccatatcttggctactgtgaatagtgct

SEQ ID NO: 22049 - DNA, 245 bp, Homo sapiens
  AC002289.1_141214
  Located on chromosome 16
  Distance between a terminus base of telomere on chromosomal short arm and 5'-terminus of this base sequence : 27403973
  Distance between 3'-terminus of neighbour sequence of sequence listing upward to telomere on chrosomal short arm and 5'-terminus of this base sequence : 48786
gacagatctttggataccatttagtcaagcagtatgaaggaaaagttgcatatcagttaaggtttagtcagaaaagtagaaaactagaataattcagaaatttggaaaggtagaaccagtaagagtgtgtgtgtgtgtgtgtgtgtgtgtgtgtgtaagagatttcttagataactgacatgcaattgtggaatttggttaagcagtctctgtaagcttctgtgtccatgtctgatactagatcc

SEQ ID NO: 22050 - DNA, 444 bp, Homo sapiens
  AC008756.5_89621
  Located on chromosome 16
  Distance between a terminus base of telomere on chromosomal short arm and 5'-terminus of this base sequence : 27420167
  Distance between 3'-terminus of neighbour sequence of sequence listing upward to telomere on chrosomal short arm and 5'-terminus of this base sequence : 15949
ctatgttaggcttctcagatacaggatacaaaaatgaaaaaaaaaaaagttgggtcgggcacagtggctcaagcctgtaattccagcactttgggaggccaaggcaggcggatcacaaagtcaggagttcaagaccagcctggccaacatggtgaaaccccgtccctactaaaaatacaaaaattagccaggcatgatggcaggtgcctgtagtcccagctactcgggaggctgaggcaggataatcacttgaacctgggaggcggaggttgcagtgagctgaggtcatgccactgcactccagcctgggtgacagagcaagactccatctcaaaataaaataaaataaaataaaataaaataatatgaaaattaaaaaaatagttgaagatgttcctggcccactgattgaaggagggtgtcttgagttctataatggagtca

SEQ ID NO: 22051 - DNA, 323 bp, Homo sapiens
  AC002289.1_160030
  Located on chromosome 16
  Distance between a terminus base of telomere on chromosomal short arm and 5'-terminus of this base sequence : 27422657
  Distance between 3'-terminus of neighbour sequence of sequence listing upward to telomere on chrosomal short arm and 5'-terminus of this base sequence : 2046
agctaaccagactaaccagctctagtatcggtgatgggtttaggaatggacaattgacccaagtaagccaaagaaaacctgcctgcagacttaatcttttgattttgttaatgtaagtctgtggctgctaatggccatctttaccatttcttagggaaagaatatttcaacacacaaaaatacagagattagagatagaggcagagatagcgatagagatagatatagatagatagatgatgatgatagatagagtgagagagagagagagagagagagagagactgctgatattttgagtaccagttaggtgaatcaatacg

SEQ ID NO: 22052 - DNA, 363 bp, Homo sapiens
  AC002289.1_162158
  Located on chromosome 16
  Distance between a terminus base of telomere on chromosomal short arm and 5'-terminus of this base sequence : 27424900
  Distance between 3'-terminus of neighbour sequence of sequence listing upward to telomere on chrosomal short arm and 5'-terminus of this base sequence : 1920
catgaaaggcagtctatcagagctattgaaaacttccctcagcaggagccagtctgggcctgaatgctggttccaccaccttttaagcttggaaaatttatttctctgtttggctcctgatctaatcacccatgaaataaggtgtgtgtgtgtgtgtgtgtgtgtgtgtgtgtgtgtgtatgtgtgtatgtgtgtgagatatcagttcagttgataaagatgctgtgcagatgccattaaataatgaatgtaaaatacttaatatagttccaggtatatgataggcacttgatttctcttgttacagaaatataaactccagggcaaagacatggatttctcgaattcttgttctaaagaaca

SEQ ID NO: 22053 - DNA, 310 bp, Homo sapiens
  AC002331.1_18739
  Located on chromosome 16
  Distance between a terminus base of telomere on chromosomal short arm and 5'-terminus of this base sequence : 27496202
  Distance between 3'-terminus of neighbour sequence of sequence listing upward to telomere on chrosomal short arm and 5'-terminus of this base sequence : 70939
aagcatccagatcttaggctagtatgttttttctctttttaatgaagtgtaacacatatgcacatatctctctctatatatatatatatgtgtgtgtgtgtgtgtgtgtgtataacttatctattgaaagtgcacaaaccatcaatgtacagctcaataaatttctacaagttgaacatacctatataaccagcatccaggcaaaagcacagaacattaccaccatctctccctccacccaccagagcttccctttctctgattccagtctctcctcctccaggggtaaccactatcctcatttctagca

SEQ ID NO: 22054 - DNA, 169 bp, Homo sapiens
  D16S3100
  Located on chromosome 16
  Distance between a terminus base of telomere on chromosomal short arm and 5'-terminus of this base sequence : 27496240
  Distance between 3'-terminus of neighbour sequence of sequence listing upward to telomere on chrosomal short arm and 5'-terminus of this base sequence : -272
ttaatgaagtgtaacacatatgcacatatctctctctatatatatatatatgtgtgtgtgtgtgtgtgtgtgtataacttatctattgaaagtgcacaaaccatcaatgtacagctcaataaatttctacaagttgaacatacctatataaccagcatccaggcaaaag

SEQ ID NO: 22055 - DNA, 315 bp, Homo sapiens
  AC002331.1_91857
  Located on chromosome 16
  Distance between a terminus base of telomere on chromosomal short arm and 5'-terminus of this base sequence : 27569234
  Distance between 3'-terminus of neighbour sequence of sequence listing upward to telomere on chrosomal short arm and 5'-terminus of this base sequence : 72825
gaggaagtgacatttcataggtccaagaagcataggtgggtgctcaagatgtcagcagatttcaccttctcttctctttcatctcttccctgcccctcctctctttccttctatcctcctcctcctcttcttccctccaccctctgctgctctttcactctcttagacacacatacacacacacacacacacacacacatcttcctcaatttgtgaataaaatagtttcacaaacacacagacgatctcactatacccacctctgctgtctccagttggtgtctcagaagcagactctgagtcaagttcttgagt

SEQ ID NO: 22056 - DNA, 396 bp, Homo sapiens
  AC020898.3_153534
  Located on chromosome 16
  Distance between a terminus base of telomere on chromosomal short arm and 5'-terminus of this base sequence : 27657515
  Distance between 3'-terminus of neighbour sequence of sequence listing upward to telomere on chrosomal short arm and 5'-terminus of this base sequence : 87966
aaatccaatctgtcatttaagcttcagaggttgtcttggtttcagtgagccaaagtttccacatctccaggggccatattcccccaggaaaagctgtcatccctccattcttctcagaagtcagagaatggggactgtctttctctccttcattttccagtttttgatcttccccagtcagcacaacacacacacacacacacacacacacacacacacacacacacactagcacacatactgcatgtttttaaataaataaatttattctactgaataaaataaaagtcaagctcctcataatgtcatccaaggccctgaattagaatccacctttccttggtccacctctccttgtatctcttttcctccctcactaagttccagccatagtag

SEQ ID NO: 22057 - DNA, 298 bp, Homo sapiens
  D16S3093
  Located on chromosome 16
  Distance between a terminus base of telomere on chromosomal short arm and 5'-terminus of this base sequence : 27660996
  Distance between 3'-terminus of neighbour sequence of sequence listing upward to telomere on chrosomal short arm and 5'-terminus of this base sequence : 3085
ccaaaaggttgattctctgaagatgacatttttgttttagaataaagggaaggtacacctacatttaaaattctactgaacctgttcagggtggagaagaatcatccagttgaagcctagtgaaaaagaaatggtattggtatttactttgaaatgagcttatgaataaagacattctttttgtttttgtttttgtttttgtttttgtgtgtgtgtgtgtgtgtgtgtgtgtttgtgtgtgtgtgtttttgagatgttgtttgtgtgtgtgtgtttttgagatggagttttgcccttg

SEQ ID NO: 22058 - DNA, 379 bp, Homo sapiens
  AC003049.1_42033
  Located on chromosome 16
  Distance between a terminus base of telomere on chromosomal short arm and 5'-terminus of this base sequence : 27789685
  Distance between 3'-terminus of neighbour sequence of sequence listing upward to telomere on chrosomal short arm and 5'-terminus of this base sequence : 128391
gctaactcatgtgcagtgaacatgcagtgttagctaaatttttttttttctaaagaacaaacatttattttcttataattctggaggccagaattctgagaggaagctcttgacagggctggtttcttctgaggagtctctccttggtgtggagacatctgtctgcaccccttgtcctcacttagtcatccctctctgggtgtctgtgtcctcaactctccttcttttctgtattttttaactgaaaataaaaattgcatacacacacacacacacacacacacacacacatgcacacacacacacatatgtatatggtgtatgatgtgatgttttgaaacacatatacattgtggaatggctaaattgagtcaactaa

SEQ ID NO: 22059 - DNA, 141 bp, Homo sapiens
  D16S3145
  Located on chromosome 16
  Distance between a terminus base of telomere on chromosomal short arm and 5'-terminus of this base sequence : 27843931
  Distance between 3'-terminus of neighbour sequence of sequence listing upward to telomere on chrosomal short arm and 5'-terminus of this base sequence : 53867
cagcaaccaaatgcttctctaatgtctctctgagtgttccgctatcactaaatacacacacacacacacacacacacacacacacacacacacatcacagacagagaccattggcctagacttctactggccttccacgtt

SEQ ID NO: 22060 - DNA, 252 bp, Homo sapiens
  AC003049.1_96072
  Located on chromosome 16
  Distance between a terminus base of telomere on chromosomal short arm and 5'-terminus of this base sequence : 27843962
  Distance between 3'-terminus of neighbour sequence of sequence listing upward to telomere on chrosomal short arm and 5'-terminus of this base sequence : -110
gagtgttccgctatcactaaatacacacacacacacacacacacacacacacacacacacacatcacagacagagaccattggcctagacttctactggccttccacgttgtacatgggactttccccctctctcctgcccccctgatgtcaacctctacagctgcatccaccttcacagctttatctcctagaggtgggaagaaggtgcaatcagaggtgagcctgaagataggatagacattctgcctca

SEQ ID NO: 22061 - DNA, 400 bp, Homo sapiens
  chr16.fa.O7frz.37905751
  Located on chromosome 16
  Distance between a terminus base of telomere on chromosomal short arm and 5'-terminus of this base sequence : 28207923
  Distance between 3'-terminus of neighbour sequence of sequence listing upward to telomere on chrosomal short arm and 5'-terminus of this base sequence : 363709
gccactcctaagaaactgtaaggaccgggtggccatgtggaaactgcttttgataaatgattggaggggagaggcagggctgctgcttcatcattgctgttactcccagtgggtcagagatattttgcgtgtgtgtgtgtgtgtgtgtgtgtgtgtgtgtgtgtgtgtgtgtaagatgggaaaagaataggaatgagaagaccttaagatggtgaagttggagatagtaagttttcctttattgcagaatgtctgtgaaagcagtttataatgaaacaaacatttttgatgaaatggttaagaaaaaaaccaccttgatctcatgaggagcaaatagtaatagtagcagtaataataacaaacgttgtctattgttgttactggtactcttgacagctaa

SEQ ID NO: 22062 - DNA, 446 bp, Homo sapiens
  AC004525.1_24955
  Located on chromosome 16
  Distance between a terminus base of telomere on chromosomal short arm and 5'-terminus of this base sequence : 28363462
  Distance between 3'-terminus of neighbour sequence of sequence listing upward to telomere on chrosomal short arm and 5'-terminus of this base sequence : 155139
gtttatttgttgagtatcgtggacttttctggttcctcaattcttatataacttaaacacatagttttctaatctttataaattaaaagtttcttatcattgccttattatgttaattagcacctctagtataagatgtttttgtttttgccctgacctcagtaaggaagtgttcaatatttcacaattaaggataatgttagctatgtatagtgtgtgtgtgtgtgtgtgtgtgtgtgtgtgtgtgtgtgatcgtaattagattaaagaagactcctctatttctgctttcctgacaggttttaaaaatcatgaatgggtgttgcaatttattaaatgtgctttctgaacttattaaatgataatataaattttcttgtttattgagttaatgtggtgaaattgattatggtttctaaatgtcatactaaccttacattcctgaa

SEQ ID NO: 22063 - DNA, 446 bp, Homo sapiens; identical to SEQ ID NO: 22062
  AC002303.1_10444
  Located on chromosome 16
  Distance between a terminus base of telomere on chromosomal short arm and 5'-terminus of this base sequence : 28363462
  Distance between 3'-terminus of neighbour sequence of sequence listing upward to telomere on chrosomal short arm and 5'-terminus of this base sequence : -446

SEQ ID NO: 22064 - DNA, 233 bp, Homo sapiens
  AC002303.1_36501
  Located on chromosome 16
  Distance between a terminus base of telomere on chromosomal short arm and 5'-terminus of this base sequence : 28389693
  Distance between 3'-terminus of neighbour sequence of sequence listing upward to telomere on chrosomal short arm and 5'-terminus of this base sequence : 25785
gcaaggttcattagttaatctgacaaatatatatatatatatatatatatatagagagagagagagagagagagagagagagagcgagcaagcgcgcgccagggtgtagctttgtcctccagcctggggtgcagtggcacaaccatagctcattgcagcctggaactcctgggctcaagcgatcctcccacttcggcctcctgagtggttgggactacaggtgcacatcacca

SEQ ID NO: 22065 - DNA, 197 bp, Homo sapiens
  AC002551.1_25903
  Located on chromosome 16
  Distance between a terminus base of telomere on chromosomal short arm and 5'-terminus of this base sequence : 28521816
  Distance between 3'-terminus of neighbour sequence of sequence listing upward to telomere on chrosomal short arm and 5'-terminus of this base sequence : 131890
catccttaaatcctaggttctttgtcttaaggcaaaaaagaaaacacacacacacacacacacacacacacacacacacaatgaagacaaaggcaggcatgtagccagtttcagattagttcattctatccgggaatcctggcctctgttagtctaccccaaggcttgtggctggtagtaactcagcatgacagctc

SEQ ID NO: 22066 - DNA, 454 bp, Homo sapiens
  AC016597.4_25303
  Located on chromosome 16
  Distance between a terminus base of telomere on chromosomal short arm and 5'-terminus of this base sequence : 28682850
  Distance between 3'-terminus of neighbour sequence of sequence listing upward to telomere on chrosomal short arm and 5'-terminus of this base sequence : 160837
agttgattctcaccaactgtaaagaaggaagataagggcaaaatgtgggccaggaaaggtgttcccattaactacaaaccagccacagagtttcaaactgtccttttcaaaatccattgcaaagggtgtttgaggcagcatgaacaaaaggcataaaaataactctagttaaagaaggaaaaaaaatattcacaccaaggaaacaagaaggacacacacacacacacacacacacacacacacacacacatatgcagagagagagacagggttctaaaggttaaggttaagacattcggcaggaaggaatttcatggtgcacttcatggaagaagacagaagaagggagaaagagcctggggttaaagccctgacgactggagggggaggaagcaggctggttcttgaggagagaaaggattttccccctggatcctttcgtaaagatgtcctt

SEQ ID NO: 22067 - DNA, 329 bp, Homo sapiens
  HUMUT8173B
  Located on chromosome 16
  Distance between a terminus base of telomere on chromosomal short arm and 5'-terminus of this base sequence : 28899985
  Distance between 3'-terminus of neighbour sequence of sequence listing upward to telomere on chrosomal short arm and 5'-terminus of this base sequence : 216681
gcacagcttcctgatctgaaaaaaggagaagaaagaagaagaaggaggaggaggagagaaagaaagaaagaaaaagaaagaaagaaagaaagaaagaaagaaagaaagaaagaaagagaaggaaggaaggaaagaagaaggaagaaagggagggagaagagaaagaaaggaagaaagaaagaaagagaaagaaagaaggaaagaaagaaaaagaaagaaagaatgaaggaaagaaagaaagaaagaaagaaagaaagaaagaaagaaagaaagaaagaaagaaagaaaaagaaagaaagaaaaagaaaagttctctgtgggttgtgtga

SEQ ID NO: 22068 - DNA, 460 bp, Homo sapiens
  chr16.fa.O7frz.39096382
  Located on chromosome 16
  Distance between a terminus base of telomere on chromosomal short arm and 5'-terminus of this base sequence : 29007300
  Distance between 3'-terminus of neighbour sequence of sequence listing upward to telomere on chrosomal short arm and 5'-terminus of this base sequence : 106986
cttaggaagttcctgtactgattaaaacacacacacacacacacacacacacacacacacagccaggcacagtggctcacacctgtaatcctagcactgtgggaggccaagatgggaggattgcttgagcccaggagtttgagaccagcctcggcaacatagtgagaccccatatctaaaaataaataaaaacacacacaagaaaatcaacttactctcacccataccaacccagtcctaaacagcgccctctctctctctctgtcactcacactcatttctctctaggtccattgcctcagcctctcctctggactccttgcttccacaccatcagccacaggaatacttgtagaacccatatctgaattctgctcaggaacctccaattgcctttagctctcaccagaatggtgccctcaaacacttctggaaaatgtggactcctaaagatgcatat

SEQ ID NO: 22069 - DNA, 222 bp, Homo sapiens
  DISO7_10000175
  Located on chromosome 16
  Distance between a terminus base of telomere on chromosomal short arm and 5'-terminus of this base sequence : 29106276
  Distance between 3'-terminus of neighbour sequence of sequence listing upward to telomere on chrosomal short arm and 5'-terminus of this base sequence : 98516
ccaagactgacacaaagccccactctttttttcttttcttaaattattattattattattattattattattattatggcagagatgaagtttcaccatgttgcccaggctggtctcaaactcctggactaaagcgatcctctcgcctcggcctcccaaagtgctgcgattacagctgtgagccactgtgcccggcccaaaaggcccactcttgtccagctc

SEQ ID NO: 22070 - DNA, 411 bp, Homo sapiens
  chr16.fa.O7frz.33169459
  Located on chromosome 16
  Distance between a terminus base of telomere on chromosomal short arm and 5'-terminus of this base sequence : 29389696
  Distance between 3'-terminus of neighbour sequence of sequence listing upward to telomere on chrosomal short arm and 5'-terminus of this base sequence : 283198
agcactgtgcttataaccaagcaaaacactccctctgtgccaacataggtggggcaggtcacgctggggtctgtttgccctgtctgcccgctgcagcctcctcggggagggccagggttgtctgtgcatcctgtgagccccagggtctatgtgcacatatgtgtgtctgtgcctttctctctctctctgtgtgtgtgtgtgtgtgtgtgtgtgtgtgtgtgtgtgtacacggcgcatctgaattgtcctgagtgccgtctcgggtatccttgagctgtgtgtgcatgtgtccccctagcggtaagtctcctcggaataagggaagaaaaggtgctcttttgatgttattattcccccagcccctcccccgctcacctaatcccatgtgtacagtgtcatggaaccttacca

SEQ ID NO: 22071 - DNA, 382 bp, Homo sapiens
  chr16.fa.O7frz.30811207
  Located on chromosome 16
  Distance between a terminus base of telomere on chromosomal short arm and 5'-terminus of this base sequence : 29586725
  Distance between 3'-terminus of neighbour sequence of sequence listing upward to telomere on chrosomal short arm and 5'-terminus of this base sequence : 196618
tggtccatagcactttcagccccaggtggctttctagggacaaaaagaggagtccaggggacatcagaggttccagtggatacagtccctcctgctgtgtgtgtgtgtgtgtgtgtgtccacagtggctgggggtgccactgaccctcccaatcccactgcagtgtgccttcctcatggcctccctgaagaaccattcaggaaaagtactgggaagttcagccctcccgaaagaaaaaccaaagacacttcagctaagaagtcagcccaagaagctctgccctcccaggcccaccgtccccctgggggccagaatggtttgactcccctcctaataacacgcagaagatttggtttcctgtttgtcttctggtctttcctgg

SEQ ID NO: 22072 - DNA, 307 bp, Homo sapiens
  chr16.fa.O7frz.30934912
  Located on chromosome 16
  Distance between a terminus base of telomere on chromosomal short arm and 5'-terminus of this base sequence : 29710320
  Distance between 3'-terminus of neighbour sequence of sequence listing upward to telomere on chrosomal short arm and 5'-terminus of this base sequence : 123213
gccaggagtttaagaccagtctggccaacatgatgaaacctcatccctacaaaaaatataaaaattagccaggcatggtggcatgtgcctgtaattccagctacttaggaggctgaggcaagagaattgcttgaacctgggaggtggaggttgcagtgagctgagatcacgccactgcactacagcctgggtgacaacgtgagaccctgccacacacacacacacacacacacacacacacacacagaaaagatacttcttagaagaataaagaaggaaataaaactattccgttactaattgtgca

SEQ ID NO: 22073 - DNA, 129 bp, Homo sapiens
  DISD22_0010166
  Located on chromosome 16
  Distance between a terminus base of telomere on chromosomal short arm and 5'-terminus of this base sequence : 29784006
  Distance between 3'-terminus of neighbour sequence of sequence listing upward to telomere on chrosomal short arm and 5'-terminus of this base sequence : 73379
aagatgtactaaagaggataggagggacaattttacattacctagcttaccccctccccagccccaggcagcacagggtggagagagagagagagagagagagagagagaccctctacttggaggaagg

SEQ ID NO: 22074 - DNA, 103 bp, Homo sapiens
  DISD22_0010168
  Located on chromosome 16
  Distance between a terminus base of telomere on chromosomal short arm and 5'-terminus of this base sequence : 29915963
  Distance between 3'-terminus of neighbour sequence of sequence listing upward to telomere on chrosomal short arm and 5'-terminus of this base sequence : 131828
tacacatgtgcgtgcatgtgcacacacacacacacacacacacacacacacagtcaggcaacttttccatctttttttgtctttcaagagatatgagagtcct

SEQ ID NO: 22075 - DNA, 303 bp, Homo sapiens
  AC022147.4_53094
  Located on chromosome 16
  Distance between a terminus base of telomere on chromosomal short arm and 5'-terminus of this base sequence : 30169946
  Distance between 3'-terminus of neighbour sequence of sequence listing upward to telomere on chrosomal short arm and 5'-terminus of this base sequence : 253880
actgaggtcaggagttctagaccagcctggccaatgtggtgaaacccccgtgtctactaaaaatataaaaattagccaggcgtggtggcgggcacctgtaatcccagctattcaggaggctgaggcaggagaattgcttgaacccgggaggtggaggttgcatgagccgagatcatgccattgtactccagcctgggtgacagagaaagactccatctcaaaaataaataaataaataaataaataaataaataaataaataaataagtccacaatgaggtatcacgtcacacctattagaac

SEQ ID NO: 22076 - DNA, 424 bp, Homo sapiens
  AF001549.1_151693
  Located on chromosome 16
  Distance between a terminus base of telomere on chromosomal short arm and 5'-terminus of this base sequence : 30311748
  Distance between 3'-terminus of neighbour sequence of sequence listing upward to telomere on chrosomal short arm and 5'-terminus of this base sequence : 141499
agcatcttcactctaaaggaaggaaaaaaaacccaagtataatttctttctttctttctctttctttctctctctctctttctttctttcctttctttcttttttctttctttctttctttcctccttcctttctttcttttcctttcttccttccttccttccttccttccttccttccttccttccttcctttctttctttctttctttccttctctctttctctctctctttctctctttctctctttctttctctttctttctttcctttctttctctctttctttctttctctctctctctcttctttctttctttctttctttcctctccctctctctctctttctttctttctttctttctttcttttctttctgacagagttttgctcttgttgcccagtctggagtgcaatggta

SEQ ID NO: 22077 - DNA, 338 bp, Homo sapiens
  AF001549.1_144759
  Located on chromosome 16
  Distance between a terminus base of telomere on chromosomal short arm and 5'-terminus of this base sequence : 30318732
  Distance between 3'-terminus of neighbour sequence of sequence listing upward to telomere on chrosomal short arm and 5'-terminus of this base sequence : 6560
tgaactcctgacctccagtgatccaccagcctcagcctcctaaagtgctgggattacaggcatgagccaccacgcccattctgaaaacacataattattacacacacacacacacacacacacacacacacacacacacacacaaacaaccaatacagagaaagtaaaatttccccaaattttccccagagcagttgttctcaacagagtactgttttgccctcttaggggacttttggccatgtctgcaaacatttttggttgtcacaaccggagcagagctactggcctctagtgggtagaggccaggggtggagctcaacatcctacaatgcgta

SEQ ID NO: 22078 - DNA, 375 bp, Homo sapiens
  chr16.fa.O7frz.33518077
  Located on chromosome 16
  Distance between a terminus base of telomere on chromosomal short arm and 5'-terminus of this base sequence : 30491433
  Distance between 3'-terminus of neighbour sequence of sequence listing upward to telomere on chrosomal short arm and 5'-terminus of this base sequence : 172363
gtgacttcaaacataagctgtaactggtaataagcgaagcagctatggaattatacaaggcaatccaatcaaacaacatggagcacactgaagcgcaaacatcaaattttacctttttcctcctaaaaactttattccctaattacatccattactttctttctttgtttctttctttttttttttttcttttgagacagagtctggttctgtagcccaggctggagtgcggtggtgtgatctcagctcactgcaacctccacttcctgggttcaagcaattctcctacctcagcctccaaagtagctaggattacaggtgtgcaccaccacccctggctaatttttctatttttagtagaggcgaactttcacc

SEQ ID NO: 22079 - DNA, 387 bp, Homo sapiens
  AC002301.1_96966
  Located on chromosome 16
  Distance between a terminus base of telomere on chromosomal short arm and 5'-terminus of this base sequence : 30746294
  Distance between 3'-terminus of neighbour sequence of sequence listing upward to telomere on chrosomal short arm and 5'-terminus of this base sequence : 254486
ttgagcagaatcagttactcctttgagagtgtgttcttatcttcgtttcctaaatcacagcaaagtgtggatatctatcctaccagactgaaaaactccaagagcagggatatcagatctatctctgtattcctaacaccaatagagagatgaggatggagtaggtgttaggtggatgctttttaaggtctttgtacaagaaaggggatagagacgttctcttaaatccaaggtccagatgagagtagaatcccttacccacccccaccccactccaccccttacacacacacacacacacacacacacacacgctaatttctttctttcttcctgcaggtttgatgccttctatggggagaggagtactcagcaggacatctatgc

SEQ ID NO: 22080 - DNA, 102 bp, Homo sapiens
  DISD22_0010173
  Located on chromosome 16
  Distance between a terminus base of telomere on chromosomal short arm and 5'-terminus of this base sequence : 30915931
  Distance between 3'-terminus of neighbour sequence of sequence listing upward to telomere on chrosomal short arm and 5'-terminus of this base sequence : 169250
atatactaaattgagactccgtcgccaataaataaataaataaataaataaataaatacagttagtagggattgaaataaaaggtctgctatcctctagcca

SEQ ID NO: 22081 - DNA, 101 bp, Homo sapiens
  DISO7_12455111
  Located on chromosome 16
  Distance between a terminus base of telomere on chromosomal short arm and 5'-terminus of this base sequence : 31160532
  Distance between 3'-terminus of neighbour sequence of sequence listing upward to telomere on chrosomal short arm and 5'-terminus of this base sequence : 244499
gacaacactcaggacaattcagatgtgccgtgtatatacacacacacacacacacacacacacacagagcagcacagacacacatatgtgcacatagaccc

SEQ ID NO: 22082 - DNA, 224 bp, Homo sapiens
  chr16.fa.O7frz.38545966
  Located on chromosome 16
  Distance between a terminus base of telomere on chromosomal short arm and 5'-terminus of this base sequence : 31458146
  Distance between 3'-terminus of neighbour sequence of sequence listing upward to telomere on chrosomal short arm and 5'-terminus of this base sequence : 297513
gatgaattgtactttgagtctcacccatacctgattgattgattgatttttttaaattttatttatttatttatttatttatttatttatttagcgagagagtgagcctcactctgtcacccaggctggagtgcactggtgggatctcggctcactgcaacctctgcctcccaggtttaagtgattctcctgcctcagcttcctgagtagctgaattacaggtg

SEQ ID NO: 22083 - DNA, 384 bp, Homo sapiens
  chr16.fa.O7frz.38853258
  Located on chromosome 16
  Distance between a terminus base of telomere on chromosomal short arm and 5'-terminus of this base sequence : 31497813
  Distance between 3'-terminus of neighbour sequence of sequence listing upward to telomere on chrosomal short arm and 5'-terminus of this base sequence : 39443
aactaggaatcgagattccacagtagacgtcccttgccgtgctcgctctctctctcgcgcgctctctctctctctctctctctctctctctctctctcctctctttctctctctccctctctctgttaagatcctgttcgggagtttccccagccgttgtagtgtatagtatgttagagttgggaggggaccaatagttatgtagcccagccccctcattcccagaggcacccagagggccagcctccagcctgaccccagagcagaaccggaacaccaggttggggccctggtgctgccacctcctctgctggtcgggctgggaccctttgccccttaggagaggtgttggtcacagatgtttacctcagtttatgtcactgt

SEQ ID NO: 22084 - DNA, 114 bp, Homo sapiens
  Z66836
  Located on chromosome 16
  Distance between a terminus base of telomere on chromosomal short arm and 5'-terminus of this base sequence : 31613252
  Distance between 3'-terminus of neighbour sequence of sequence listing upward to telomere on chrosomal short arm and 5'-terminus of this base sequence : 115055
tgcctggcatatagaaagcaatacacacacacacacacacacacacacacatattaactattatattgttagattgtaaccacagtacctagggttgtaaacttcatagcagga

SEQ ID NO: 22085 - DNA, 295 bp, Homo sapiens
  DISD22_0010185
  Located on chromosome 16
  Distance between a terminus base of telomere on chromosomal short arm and 5'-terminus of this base sequence : 31921073
  Distance between 3'-terminus of neighbour sequence of sequence listing upward to telomere on chrosomal short arm and 5'-terminus of this base sequence : 307707
ggtaaacaggattcagatctcctaaaagtgccttatctgagccttggttccttatgcatcaaatgggaataataatggcttttgacttcacagcgttactggtttagctgagtagatgcatgttaagcacttaggaagtgctcaggaagcaggggctattatttatttatttatttatttatttatttatttatttatttatttttgagacggagtctcactctgtcacccaggctggagtgcctggttggactgggctcccagtcctcacaggaccgctgtcccatgttctgaa

SEQ ID NO: 22086 - DNA, 356 bp, Homo sapiens
  HUMUT1882
  Located on chromosome 16
  Distance between a terminus base of telomere on chromosomal short arm and 5'-terminus of this base sequence : 31999728
  Distance between 3'-terminus of neighbour sequence of sequence listing upward to telomere on chrosomal short arm and 5'-terminus of this base sequence : 78360
cccgtaatcccagctacttgggaggctaaggcagaatcgcttgagcctgggaggcggaggttgtggtgagccaccacactccagtctgggtgacagagtgagaccctgtcgaaagaaagaaagagagagagagagaaggaaggaaggaaggaaggaaggaaggaaggaaggaaggaaggaaggaaggaaaaagaaagaaggaaggaaggaaggaaaggaaggaaggaaggaaggaaagaaagaaagagaaagaaagaaagaaagaaagaaagaaagaaagaaagaaagaaagaaagaaagaaagaaagaaagaaagaaaagaaagaaagaaagaaagacagacctccttccttcct

SEQ ID NO: 22087 - DNA, 108 bp, Homo sapiens
  DISD22_0010187
  Located on chromosome 16
  Distance between a terminus base of telomere on chromosomal short arm and 5'-terminus of this base sequence : 32174021
  Distance between 3'-terminus of neighbour sequence of sequence listing upward to telomere on chrosomal short arm and 5'-terminus of this base sequence : 173937
agcaggagttccaagtggccccctggtaaaataaataaataaataaataaataaataaataaaaacagccagctgtcactccaaaaatggtgagatgagttcaggatg

SEQ ID NO: 22088 - DNA, 234 bp, Homo sapiens
  chr16.fa.O7frz.28007380
  Located on chromosome 16
  Distance between a terminus base of telomere on chromosomal short arm and 5'-terminus of this base sequence : 32474220
  Distance between 3'-terminus of neighbour sequence of sequence listing upward to telomere on chrosomal short arm and 5'-terminus of this base sequence : 300091
ccgtccacttgtcacttactgtttattgcccttccctcccttcctcccttccttccttccttccttctttccttccttccttcctccctctctcattccctgcttccctctttccctccttccctcccttccctcccttccttccttccttccttccttccttccttccttccttccttccttccttcctgccttccttccttcatttctttctttcctttatgacatggtctt

SEQ ID NO: 22089 - DNA, 179 bp, Homo sapiens
  DISD22_0010190
  Located on chromosome 16
  Distance between a terminus base of telomere on chromosomal short arm and 5'-terminus of this base sequence : 32569655
  Distance between 3'-terminus of neighbour sequence of sequence listing upward to telomere on chrosomal short arm and 5'-terminus of this base sequence : 95201
tctatggtgatgggagcctgaggtcatcttttcttgatggggctgagaggtgtgtatcaggggagagggtcaaagagtgtgtgtgtgtgtgtgtgtgtgtgtgtgtgtgcatgtgcatgcacgtgcacgcaggcatgcattggtcatgggtttcttcacacacttcaggttcctctgta

SEQ ID NO: 22090 - DNA, 340 bp, Homo sapiens
  AC002519.1_27035
  Located on chromosome 16
  Distance between a terminus base of telomere on chromosomal short arm and 5'-terminus of this base sequence : 33106873
  Distance between 3'-terminus of neighbour sequence of sequence listing upward to telomere on chrosomal short arm and 5'-terminus of this base sequence : 537039
agttatctaatccagaacctggagggggctggggaaggccttctactgagacactactgtaaatggcttcattctgtacacacacatacacacacacacacacacacacacacgtgggtgaacaagtatgtaaaccttgatatacagatgtagatattcattctattagttctgtttctctgtcttcttgagtatagccatcttagtgggtgtgaattaacacttcattgtggttttgatttgaatttccctaatgaataagaattctgagcatcttttcatgtgctcattggccatttatgttttattgcaatatcctcatgcattgttatcaccaata

SEQ ID NO: 22091 - DNA, 392 bp, Homo sapiens
  AC002519.1_19084
  Located on chromosome 16
  Distance between a terminus base of telomere on chromosomal short arm and 5'-terminus of this base sequence : 33114813
  Distance between 3'-terminus of neighbour sequence of sequence listing upward to telomere on chrosomal short arm and 5'-terminus of this base sequence : 7600
gtgaggttcaatattgaccaagaaaatagagacatctgtgtaattcaatgcaagttgatacacacatgtagactgcatatgtatgtgtgtgtgtgtgtgtgtgtgtgtgtgtgtgtgtgtgtgtttggaatatatgttttatcaaaatgtaactcaatagagatagactctaaactgagcaatattcatagaagaaacaaagacatttaataaggaatttcctcacacacacacaaacaccaagtttatgtagttgaaagggaaattctaccgataaagtaatccataaaccaatgctacttaaacttctcaagagttatagtgtggtcaatctttcctgaaatactttttaggaagggtttataaaggtgatactcgaaccttgcctagat

SEQ ID NO: 22092 - DNA, 252 bp, Homo sapiens
  Z66902
  Located on chromosome 16
  Distance between a terminus base of telomere on chromosomal short arm and 5'-terminus of this base sequence : 33370535
  Distance between 3'-terminus of neighbour sequence of sequence listing upward to telomere on chrosomal short arm and 5'-terminus of this base sequence : 255330
aggtaatttgtgtatctatcatctcacatacattttttttaaatggagtgtgtgtgtgtgtgtgtgtgagatgagaatatctaagatctaccctttcagcaaaaatcacttttataacacagtattaaatactggaacattgctgtacattagatctccagaactcattcaacctgcacacctgaaattctgtacactttaaacatcacccaatttccctctcctcccgcatcctgggacgcattattttac

SEQ ID NO: 22093 - DNA, 322 bp, Homo sapiens
  chr16.fa.O7frz.26591685
  Located on chromosome 16
  Distance between a terminus base of telomere on chromosomal short arm and 5'-terminus of this base sequence : 33813714
  Distance between 3'-terminus of neighbour sequence of sequence listing upward to telomere on chrosomal short arm and 5'-terminus of this base sequence : 442927
ggaatacagattacttggctagttaatgctacttttggatgcaagtggaaaaattattattattattattattattattattattattttatttatttatttttgagatacagtctcactctgtcacccaggctggagtccagtggagcgatctcagctcactgcaagctctgcctcccaggttcatgccattctcctgcctcagcttcccaagtagctgggactacaggcacccgccaccacgcccagctaatttttttgtatttttagtagagacagggtttcaccgttttagccaggatggtctcgatctcctgacctc

SEQ ID NO: 22094 - DNA, 140 bp, Homo sapiens
  DISD22_0010206
  Located on chromosome 16
  Distance between a terminus base of telomere on chromosomal short arm and 5'-terminus of this base sequence : 34166687
  Distance between 3'-terminus of neighbour sequence of sequence listing upward to telomere on chrosomal short arm and 5'-terminus of this base sequence : 352651
ggcaatggtgtaaatctactatgataacaactatatatatatatatatatatatatatatatatatatatatatatataatgaaatatgtttatagaaaatgtctggaatctttttacagtctagagtccttctcaatgg

SEQ ID NO: 22095 - DNA, 462 bp, Homo sapiens
  AC002041.1_32464
  Located on chromosome 16
  Distance between a terminus base of telomere on chromosomal short arm and 5'-terminus of this base sequence : 34390461
  Distance between 3'-terminus of neighbour sequence of sequence listing upward to telomere on chrosomal short arm and 5'-terminus of this base sequence : 223634
agtaatcacaatgtagtggattcaggcagagatgagagacactctgattttagtagaaaaagactgtgctaaattacctctttgccttttttcactctgttcctaggataccaatataataaatagtacctttagaactgtgatacactgagaaaagttctaatttaaatctcaatagatgattacacaggtagtgtttacacacacacacacacacacacacacacacacacacacacacacaatgacaggagtttttaaagatattagtatctcggaatttttgtattctgaaaactgtccaagcttttatcattaaatcacttgttatgaaacacactttagaaacaccctttcctatttttaatagcctatgatagtcatacagaatgagttaatcataattgattggtcaattgctaattccgaattctttggccatagcacgtcagctgattctat

SEQ ID NO: 22096 - DNA, 350 bp, Homo sapiens
  AC002041.1_165767
  Located on chromosome 16
  Distance between a terminus base of telomere on chromosomal short arm and 5'-terminus of this base sequence : 34523803
  Distance between 3'-terminus of neighbour sequence of sequence listing upward to telomere on chrosomal short arm and 5'-terminus of this base sequence : 132880
gaatggaaatagaaacagctacacaggaaaataattcttagtttcttgtaaaattatatatgcccttaacacattacctaaaaatccccctcctgaatatttgcttcagagaaatataattttatattcaaacaaaacctctatgcaaatattcaacatagtgtgtgtgtgtgtgtgtgtgtgtgtgtgtgtgtgtgtgcatgtgttagaaactaaaaataacatgaatgtatgaaaattcgaatgggcaaagaaggtaggcaccatctatacattgaataccatcagcataaaaactaacaaatgaccgatacacaaactattacaagtgaactccagacattacgcta

SEQ ID NO: 22097 - DNA, 364 bp, Homo sapiens
  chr16.fa.O7frz.26203476
  Located on chromosome 16
  Distance between a terminus base of telomere on chromosomal short arm and 5'-terminus of this base sequence : 47751488
  Distance between 3'-terminus of neighbour sequence of sequence listing upward to telomere on chrosomal short arm and 5'-terminus of this base sequence : 13227335
ctttgtaattatgtgagccaattctccttaataaattatatttcatatacatgtaaatatattctcttttagatgcatgtatatgtatctctattatctattatctatatctatatctatatctatatctatttcttattggatctgaccctctggagaactctgattaatacatagtcaaagaacaagtcacaaggaaaattagaaaatgtcttgagacaaataaaaatggaaacacaacattccaaagcttgtgggatgcagcaaaatgaatatgaagaggacagtttatatatctaactacctaccttaaaaaagaagaaagatctgaaatcagcaacttaactttacacctcacgaaact

SEQ ID NO: 22098 - DNA, 159 bp, Homo sapiens
  DISD22_0010220
  Located on chromosome 16
  Distance between a terminus base of telomere on chromosomal short arm and 5'-terminus of this base sequence : 48476773
  Distance between 3'-terminus of neighbour sequence of sequence listing upward to telomere on chrosomal short arm and 5'-terminus of this base sequence : 724921
tctcaggctatagtagaaatgtgactttaatatctaccatttagaatgtgtgtgtgtgtgtgtgtgtgtgtagatagatgatagatagatagatagatagatagatagatagatagatagataacagatagatattcctcaataggtaaatagaggctg

SEQ ID NO: 22099 - DNA, 102 bp, Homo sapiens
  DISD22_0010228
  Located on chromosome 16
  Distance between a terminus base of telomere on chromosomal short arm and 5'-terminus of this base sequence : 48828915
  Distance between 3'-terminus of neighbour sequence of sequence listing upward to telomere on chrosomal short arm and 5'-terminus of this base sequence : 351983
actatgaacactggaattctggtttacacacacacacacacacacacacacacacacacaccatctgcctgctggcaagcagggatccttgttggcaaagaa

SEQ ID NO: 22100 - DNA, 105 bp, Homo sapiens
  DISD22_0010230
  Located on chromosome 16
  Distance between a terminus base of telomere on chromosomal short arm and 5'-terminus of this base sequence : 48929964
  Distance between 3'-terminus of neighbour sequence of sequence listing upward to telomere on chrosomal short arm and 5'-terminus of this base sequence : 100947
aaatgtgcctctgtgcacatcatcggggtgtgtgtgtgtgtgcgtgtgtgtgtgtgtagccactcattcatctctttatatggggtattgtcttatttcagcctg

SEQ ID NO: 22101 - DNA, 321 bp, Homo sapiens
  AC007225.2_168977
  Located on chromosome 16
  Distance between a terminus base of telomere on chromosomal short arm and 5'-terminus of this base sequence : 49240892
  Distance between 3'-terminus of neighbour sequence of sequence listing upward to telomere on chrosomal short arm and 5'-terminus of this base sequence : 310823
aggttaaggaatttgtctgacacttttgaatggattgggcactgtagtgttatgggatagatagatggatagatagatagacagatagatgttatgagagatatatatagcccgcatatatatatatgtatatgtatatatatatagcccacatatatatgtatgtgtatatatatatatagcccgcatatatgtatgtatgtgtatatatatgtgtgtatatatatatgtgtgtgtgtatgtgtatatatatgtgtgtgtgtgtgtgtgtgtgtgtgtgtgtgtgtgtatgtttattcctggcttctaacttgcatagtc

SEQ ID NO: 22102 - DNA, 195 bp, Homo sapiens
  D16S3105
  Located on chromosome 16
  Distance between a terminus base of telomere on chromosomal short arm and 5'-terminus of this base sequence : 49282834
  Distance between 3'-terminus of neighbour sequence of sequence listing upward to telomere on chrosomal short arm and 5'-terminus of this base sequence : 41621
gatcttcccaaagcgcctgggagagaccaagctatacacacacacactgccatacacacacacactgcctctctctctccacacacacacacacacacacacacacacacacacacactctctctctctctctctctctctctctctctctctctcaactttgggaccacaaattaactagcttggctgacggga

SEQ ID NO: 22103 - DNA, 140 bp, Homo sapiens
  DISO7_12465111
  Located on chromosome 16
  Distance between a terminus base of telomere on chromosomal short arm and 5'-terminus of this base sequence : 49354840
  Distance between 3'-terminus of neighbour sequence of sequence listing upward to telomere on chrosomal short arm and 5'-terminus of this base sequence : 71811
gaactcaatgtagaaaggaatcgtttcaaattcaagaaacgagatagagagatagagagatagagagagacagacagagagagagagagagagagagagagagagagagagagagacacacagagacattcagacagaca

SEQ ID NO: 22104 - DNA, 103 bp, Homo sapiens
  DISO7_10006348
  Located on chromosome 16
  Distance between a terminus base of telomere on chromosomal short arm and 5'-terminus of this base sequence : 49520632
  Distance between 3'-terminus of neighbour sequence of sequence listing upward to telomere on chrosomal short arm and 5'-terminus of this base sequence : 165652
gactgatgacatcacgcgcgcacacacacacacacacacacacactcacacacaccccaagagggtatgaacattttattgctcacatagtaagtgtttctgg

SEQ ID NO: 22105 - DNA, 473 bp, Homo sapiens
  AC007533.2_32200
  Located on chromosome 16
  Distance between a terminus base of telomere on chromosomal short arm and 5'-terminus of this base sequence : 49927770
  Distance between 3'-terminus of neighbour sequence of sequence listing upward to telomere on chrosomal short arm and 5'-terminus of this base sequence : 407035
gtcttagatgtgctaatggcactgtagttgtacaggagaacatccttactcttcagagatgcatgtgcaagtattttataggtgaagtgttaagatatttaatactcacttttagacagttcagggaaaaaagttgattttgatctctcttggtacacacacacacacacacacacacacacacacacacacacacacacagagggagagacagaaacgcttactctaggtggtttctctaggtcaggggtccctaacccccaggccatggaccagaactggttaggaactgagccgcatggcatcaccctcagaagggaccatctagttgcaggaaaacaagctcagggttcccactgattctacattatggtaagttgtataattatttcatcacatattacaatgtaataataataatagaaataaagtgcacaataaatgtaacgcccttgaatcattctgaaaccatc

SEQ ID NO: 22106 - DNA, 195 bp, Homo sapiens
  D16S3044
  Located on chromosome 16
  Distance between a terminus base of telomere on chromosomal short arm and 5'-terminus of this base sequence : 49927871
  Distance between 3'-terminus of neighbour sequence of sequence listing upward to telomere on chrosomal short arm and 5'-terminus of this base sequence : -372
atactcacttttagacagttcagggaaaaaagttgattttgatctctcttggtacacacacacacacacacacacacacacacacacacacacacacacagagggagagacagaaacgcttactctaggtggtttctctaggtcaggggtccctaacccccaggccatggaccagaactggttaggaactgagcc

SEQ ID NO: 22107 - DNA, 316 bp, Homo sapiens
  AC007533.2_14702
  Located on chromosome 16
  Distance between a terminus base of telomere on chromosomal short arm and 5'-terminus of this base sequence : 49945320
  Distance between 3'-terminus of neighbour sequence of sequence listing upward to telomere on chrosomal short arm and 5'-terminus of this base sequence : 17254
tgtaggcagcataaagttaggtaggtcatttaaaagaatccatttagccagtctaaaaacgtatgtgtgtgtgtatatatatgtatatatacacacatatatacatacatatgcacacacacacacacacacacacacacacacacacatacatattttttttttctgagatggagtctcgttctgtcaccaggctggagagcagtggcgcgatcctggctcactgaacctctgcctcccaggttcaagcgattctcctgcctcaggctcctgagtagctgggactacaggcgcgtaccaacatgctcagctaact

SEQ ID NO: 22108 - DNA, 255 bp, Homo sapiens
  DISO7_00045204
  Located on chromosome 16
  Distance between a terminus base of telomere on chromosomal short arm and 5'-terminus of this base sequence : 50199595
  Distance between 3'-terminus of neighbour sequence of sequence listing upward to telomere on chrosomal short arm and 5'-terminus of this base sequence : 253959
agaacagctccatctgaggagtgctttttacacaccacaaatctcaaggtgccgtaggaggaacctccctcttctcccaacacacacacacacgtacacacacacacacacacactctctctctctctctctctctctctctctctgtctccatctcactcattcttgtcttctggtcctaggtttgcaaaggccgtgtgctctcacaagagaagttcaccttggaggagggggccctttcagccatggttgagt

SEQ ID NO: 22109 - DNA, 439 bp, Homo sapiens
  AC019119.3_101699
  Located on chromosome 16
  Distance between a terminus base of telomere on chromosomal short arm and 5'-terminus of this base sequence : 50296894
  Distance between 3'-terminus of neighbour sequence of sequence listing upward to telomere on chrosomal short arm and 5'-terminus of this base sequence : 97044
agctgagttcaagtcctagatatccttgttaatcttctgtctcattgatctgtctaatattgacagtggggtgttaaaatctctcattattactgtctgggagtctaagtctctttttaggtctctaaggacttgctttatgaatctgggtcctcctgtattgggtgcatatatatgtaggatagttaactcttcttgttgaattgatccttttaccattatgtagtggtcttccttgtctcttttgatcttcgttggtttaaagtctgttttatcagagactagaatcacaacccctggtttgttgttgttgttgttgttgttgttgttgctttctatttgcttggtagatcttcctgcattcctttattttgagcctatgcgtgtgtttgcatgtgagatgggtctcctgaatatagcatactgatgagtcttgact

SEQ ID NO: 22110 - DNA, 453 bp, Homo sapiens
  AC019119.3_111589
  Located on chromosome 16
  Distance between a terminus base of telomere on chromosomal short arm and 5'-terminus of this base sequence : 50328918
  Distance between 3'-terminus of neighbour sequence of sequence listing upward to telomere on chrosomal short arm and 5'-terminus of this base sequence : 31585
ggactctttattctccagtgaggctatgtagaaatgcataaaaatttcttgtcaaattattttctgaagaaacccagtatcaaaatcccagatatggtggcaaggagtggtgatagtgaggatagtcaaagcctttgggagatgggggtgagtgctgatgccttcttggcttcaagtcaagcaaggcagccatggaagaaagaacgttggttatcttagatatctcagtcataggaaggtccatgtcttatcttcctcttgtttcacttaaagattgaagattgtttgttttgttttgttttgttttgttttgttttgttttgtttttagagacagagtcttgccctgtcatccagagtggagtgcagtggcaggatgaaagctcactgcagccttgaactcctgggctcaagtgatcctcccacctcagtgtcctgagtagttaggattaca

SEQ ID NO: 22111 - DNA, 441 bp, Homo sapiens
  AC007857.2_95833
  Located on chromosome 16
  Distance between a terminus base of telomere on chromosomal short arm and 5'-terminus of this base sequence : 50530869
  Distance between 3'-terminus of neighbour sequence of sequence listing upward to telomere on chrosomal short arm and 5'-terminus of this base sequence : 201498
cattagaatcacctggtagctttttaaaattaccaatgcctgggcctggcatggtggctcacacttgtaatcccagtactttgggaggctaaggtggtggatcacttgagcccaggggtttgagaccagcctgggcaccatggtgaaaccctgtctctgcaaaaaaatatgaaaattagcagatatagtggaacatatctacagtcccagctactcaggaggctgaggtgggaggatcccttgtgctcaggaggtcgaggccacagtgagctgagattgcatcactgcactgcagcctgggtgacagagcaagacccccatctcaagaaaaataaaataaaataaaaataaaataaaataaaataaaataaaataaaataaaaacaaaaaccaattcctgagccctatgcatgatgagtctgatttaattgatctgagtgg

SEQ ID NO: 22112 - DNA, 357 bp, Homo sapiens
  DISO7_00045222
  Located on chromosome 16
  Distance between a terminus base of telomere on chromosomal short arm and 5'-terminus of this base sequence : 50666767
  Distance between 3'-terminus of neighbour sequence of sequence listing upward to telomere on chrosomal short arm and 5'-terminus of this base sequence : 135457
gcaggaaaggatagcagaaaggagagaatggcccagaggtgccagtcacccaaggatgtgttcttcctgctgtcccctccccagttcccccacatgggcatcagagagccaggcctggagaaaaggaagagggtgtttaaaagcacagagcaggtgcttctcaattgcaagcctgccccacctgacacacacacacacacacacacacacacacacacacacacacacacacagcatagccttgccacaccaagcctctgggggaaagagacctgtggcttgaatatattcaagattgaaattttcaccgcactgagctgaccattaaccaaaagagacatcagattcaattgccac

SEQ ID NO: 22113 - DNA, 262 bp, Homo sapiens
  DISO7_00045229
  Located on chromosome 16
  Distance between a terminus base of telomere on chromosomal short arm and 5'-terminus of this base sequence : 50981548
  Distance between 3'-terminus of neighbour sequence of sequence listing upward to telomere on chrosomal short arm and 5'-terminus of this base sequence : 314424
ggagtctgatcaggtatcccctcccctcccctcctcttctctctctctctctctttctctctctccccccaacacttttttttttttttgagatggtgtctagtgcactggtgtgaacacagctcactgctgccttgacctcctgggctcaagcgatcctcactcgcttggcctcccaaagtgctgggattacaggcatgagttgctgcacccagccaggtgtcctgttttctaacgggcaatgtaaacctggacatgatag

SEQ ID NO: 22114 - DNA, 418 bp, Homo sapiens
  AC023813.3_69395
  Located on chromosome 16
  Distance between a terminus base of telomere on chromosomal short arm and 5'-terminus of this base sequence : 51290746
  Distance between 3'-terminus of neighbour sequence of sequence listing upward to telomere on chrosomal short arm and 5'-terminus of this base sequence : 308936
atgaattctttccttcatgaacaaatcaattgttcaagaattcatgaaacctacctgggcaacatgaggaaaccccatctctataaaaaataaaaataaataaataaataaataaataaataaataaataaaagcccagcatggtggcacatgcctatagtcccagctactcaggaggctgaggtgggaggatcacttgagcctgggagggcaaggctgcagtgagctgagatcacaccactgcactccagcctggtgacagagccaaaccctatctcacacacacacacgcacgcacacgcatagaaaaattcatgaaaccaggtaccaggctcttctaactgaaaaggtagtaaaacagtacctggtcaacttgaaccctctgaagtcagtactgtaataggccacttctacttta

SEQ ID NO: 22115 - DNA, 450 bp, Homo sapiens
  AC023827.3_151393
  Located on chromosome 16
  Distance between a terminus base of telomere on chromosomal short arm and 5'-terminus of this base sequence : 51420053
  Distance between 3'-terminus of neighbour sequence of sequence listing upward to telomere on chrosomal short arm and 5'-terminus of this base sequence : 128889
gcaccatgcttaacactttacatttccttccttccttccttccttccttccttccttccttccttccttccttctttcctccctccctcttccttccttccttctttcctccctgcctcccttcctcctgcctttctttctttccttctttctttctctttctttctttctttctctctttctttctctctctccctcccttcctccctccctcccccttctttctctgttccttccttcctttctttccttccttccttctttctttctttctttctttctttctttctttctttctttctttctttctttccttccttccttccttccttccttccttccttccttccttccttccttccttctttctttctttttctttctttctttctttcctgacagattcttactatgttgcccaggctggccttgaattcttaagctcaggac

SEQ ID NO: 22116 - DNA, 137 bp, Homo sapiens
  D16S409
  Located on chromosome 16
  Distance between a terminus base of telomere on chromosomal short arm and 5'-terminus of this base sequence : 51448269
  Distance between 3'-terminus of neighbour sequence of sequence listing upward to telomere on chrosomal short arm and 5'-terminus of this base sequence : 27766
tgaatcttacatcccatccctcaatcacctagtacccttcccattgcagattctagagattatctgcatacataaatatgtacacacacacacacacacacacacacacacacactccacctctggacagactgact

SEQ ID NO: 22117 - DNA, 294 bp, Homo sapiens
  HUMUT745
  Located on chromosome 16
  Distance between a terminus base of telomere on chromosomal short arm and 5'-terminus of this base sequence : 51595209
  Distance between 3'-terminus of neighbour sequence of sequence listing upward to telomere on chrosomal short arm and 5'-terminus of this base sequence : 146803
tcaaaatggatggtggcatggatagtgaataatatatccagagaatcctgtttgtgccaaaagtcgatataaaataatgttacatgttttctgtggaaaagtatatgtcaatctacttgtctatctatctatctatctatctatctatctatctatctatctatcatctatctatctatcatgtatcttctggtaaaggataaaaaaagtctagaataacacatcaaattaatagcttaatagcatcagaacttcatggataaagtccctaaaatcacttgctctgcaatccca

SEQ ID NO: 22118 - DNA, 237 bp, Homo sapiens
  G07935
  Located on chromosome 16
  Distance between a terminus base of telomere on chromosomal short arm and 5'-terminus of this base sequence : 51751290
  Distance between 3'-terminus of neighbour sequence of sequence listing upward to telomere on chrosomal short arm and 5'-terminus of this base sequence : 155787
aatctccccaactcaagaccctgaatgttatcacatctcccaagaaacagaatcaattagatagataggtagataatagcaatgatagataatagacaatgatagataataggtagatgatagatagatagatagatagatagatagatagatagatagggaggcagatggatagattagatagataaatatagacagacatttattttaaggaattggctcacatgattatggagg

SEQ ID NO: 22119 - DNA, 277 bp, Homo sapiens
  AC012311.4_44322
  Located on chromosome 16
  Distance between a terminus base of telomere on chromosomal short arm and 5'-terminus of this base sequence : 52096801
  Distance between 3'-terminus of neighbour sequence of sequence listing upward to telomere on chrosomal short arm and 5'-terminus of this base sequence : 345274
tacctaatgctagatgacgagttagtaggtgcagcgcaccagcatggcacatgtatacgtaagtaactaacctgcacaatgtgcacatgtaccctaaaacttaaagtataataataaaataaataaataaataaataaataaatttaaaaaaaagaattacatcacagaattatacagcaaacaaattagagattgattattagactcccttgttcttcaaagtcctttatcccctgccaccacgagatttttccctagttacatgtctttgcagga

SEQ ID NO: 22120 - DNA, 277 bp, Homo sapiens
  D16S517
  Located on chromosome 16
  Distance between a terminus base of telomere on chromosomal short arm and 5'-terminus of this base sequence : 52335780
  Distance between 3'-terminus of neighbour sequence of sequence listing upward to telomere on chrosomal short arm and 5'-terminus of this base sequence : 238702
ggtttgaaagtatctccagggatgtgcttcataaagacttgtaaggtagaaaaaccctctctctgtctgtctccctctttccctctctctcttctacacacacacacacacacacacacacacaccacacacacacaacacacacatacacacacatacacatacacacacagacacacacatacacagacacatacacacacagacacatacacacacagacacaaaacacatgcctccctccaggttggccagggccagtcctgccacagtgaca

SEQ ID NO: 22121 - DNA, 281 bp, Homo sapiens
  D16S3080
  Located on chromosome 16
  Distance between a terminus base of telomere on chromosomal short arm and 5'-terminus of this base sequence : 52365265
  Distance between 3'-terminus of neighbour sequence of sequence listing upward to telomere on chrosomal short arm and 5'-terminus of this base sequence : 29208
ggatgcctgctctaaatatccagttttccaaagggtgtagaggtacccagcattcttaggtttctatgctcttatctgtccaatctccgtgtcaattaattactgtttaaacattaaacactaaagaaaccctttactgctttgaagtacacacacacacacacacacacacacacacagggagagagagagagagagagagaatcccttcaattgtaacatcagtactgcacctagatatctgacaggagaagtgtaaaggattaagtttgacccctggg

SEQ ID NO: 22122 - DNA, 163 bp, Homo sapiens
  DISD22_0010258
  Located on chromosome 16
  Distance between a terminus base of telomere on chromosomal short arm and 5'-terminus of this base sequence : 52445348
  Distance between 3'-terminus of neighbour sequence of sequence listing upward to telomere on chrosomal short arm and 5'-terminus of this base sequence : 79802
ggttgcaatatcacaaattccaaatgactggggtttggattactgggccccaaaatgtccaaaactgtaagattcctcttaggtctattattattattattattattattattattattattattattattattttaaaaatatctgttcctccagaggttga

SEQ ID NO: 22123 - DNA, 283 bp, Homo sapiens
  DISD22_0010263
  Located on chromosome 16
  Distance between a terminus base of telomere on chromosomal short arm and 5'-terminus of this base sequence : 52672622
  Distance between 3'-terminus of neighbour sequence of sequence listing upward to telomere on chrosomal short arm and 5'-terminus of this base sequence : 227111
aattgaccatctgtggctgctgcttgggtagaagagggtttcagtttattattttaaaatgtgtacatggggctgggcatgatggcttacacctataatcccagcaggtgagggagtctgaggcaggaggatcgctttagcacaggagttcaaggttacagtgagctatgatcaaatcactgcatttcagcctgcctcagagtgagaccctgtctctacaaatgcacacacacacacacacacacacaaagattctgcttttgtggagcaagaagggacctga

SEQ ID NO: 22124 - DNA, 127 bp, Homo sapiens
  DISO7_10004142
  Located on chromosome 16
  Distance between a terminus base of telomere on chromosomal short arm and 5'-terminus of this base sequence : 52901779
  Distance between 3'-terminus of neighbour sequence of sequence listing upward to telomere on chrosomal short arm and 5'-terminus of this base sequence : 228874
tcatctcttaaagaattgagaattgcatacacacacacacacacacacacacacacacacacaaacgtgacgtgaattaaagggatgaatacatttacaggtgtaaatgcaaaccacttccaactca

SEQ ID NO: 22125 - DNA, 274 bp, Homo sapiens
  D16S3117
  Located on chromosome 16
  Distance between a terminus base of telomere on chromosomal short arm and 5'-terminus of this base sequence : 53296761
  Distance between 3'-terminus of neighbour sequence of sequence listing upward to telomere on chrosomal short arm and 5'-terminus of this base sequence : 394855
gcttgggttaaatgcgtgtgtgcaccccggcagtgtgtgtgtgtgtgtgtgtgtgtgcgcgcgcgtgcatgcacgcacacatgcatacacatgcatgcatgcctgcgtatgcttcagccaatggggatcagagtcagtggctaaatggtccagcctctccatcctccaggacatgattctgaagtgtctttcacacagttccaccgagtcccagtgggatcaagccccagttgctcacggcagtaccagatcatggacagacctaatatggctt

SEQ ID NO: 22126 - DNA, 282 bp, Homo sapiens
  chr16.fa.O7frz.61163295
  Located on chromosome 16
  Distance between a terminus base of telomere on chromosomal short arm and 5'-terminus of this base sequence : 53424954
  Distance between 3'-terminus of neighbour sequence of sequence listing upward to telomere on chrosomal short arm and 5'-terminus of this base sequence : 127919
atcagaacatcaatggagtcttctatcaaagtttgcccagaagaaaagaagccattgtatgaaaaagatacttgcacaagcatgtttatggcagcacagttcacaattgcaaaaacatggaaccagcccaaatcgccatcaatcaatgagtggataaagaaactgtgtgtgtgtgtgtgtgtgtgtgtgtgtgtgtgtgtgtgtgtgtatcacacaatggaatactactcaaccattaaaaggaaagaattaatggcattctcagtgatctggataagattg

SEQ ID NO: 22127 - DNA, 225 bp, Homo sapiens
  chr16.fa.O7frz.61291496
  Located on chromosome 16
  Distance between a terminus base of telomere on chromosomal short arm and 5'-terminus of this base sequence : 53553152
  Distance between 3'-terminus of neighbour sequence of sequence listing upward to telomere on chrosomal short arm and 5'-terminus of this base sequence : 127916
ctcctgaaggtatcaaagagaccatcagaggaggaaggcttttgtgacactcagatatggtgagtccctgtttttgaagggtagtgttttggaaaatgagcatatatgcaaacaaacttgtgttacctttgggctttattgtgtgccgggtcactagccactagactgtgtgtgtgtgtgtgtgtgtgtgtgtgtgtgtgtgtgtttaatcagcattatctcagt

SEQ ID NO: 22128 - DNA, 325 bp, Homo sapiens
  AC007344.3_154661
  Located on chromosome 16
  Distance between a terminus base of telomere on chromosomal short arm and 5'-terminus of this base sequence : 53754982
  Distance between 3'-terminus of neighbour sequence of sequence listing upward to telomere on chrosomal short arm and 5'-terminus of this base sequence : 201605
ttgcattatgtgaaataagctttaatcaatggtaatatatgaaataacattgcttcggtcattcaataaatatttataagttaaaaaaatatatatgtgtgtatttgtttgtaagcccacaatatagaatgcctgtactcggggctggagaaaagtggtgaatggaacttaacacattgctgtctttttggcagtattagggtgtctctgtgtgtgtgtgtgtgtgtgtgtgtgtgtgtgtgtggtgaatgtggtgagtgttagagagtcagagaatcaacaaataaaaaacaatttctaatagtgatctgtgctagaaaggaaa

SEQ ID NO: 22129 - DNA, 343 bp, Homo sapiens
  AC007344.3_108941
  Located on chromosome 16
  Distance between a terminus base of telomere on chromosomal short arm and 5'-terminus of this base sequence : 53800671
  Distance between 3'-terminus of neighbour sequence of sequence listing upward to telomere on chrosomal short arm and 5'-terminus of this base sequence : 45364
tttggtacagcgttcactatttgggtgatgggtacactagaagcccaaacttcaccattatgcgatatatccctgtaacaaacctgtagatgtatcccctgaatctaaaatttgaaaaataaaggtaataatatttcattctttatagagtcattatgaagctcaaataaaagcttttaataccaaacctaccacacagtaagtactcagcaaatattggcaattatttggggtgtgcgtgtgtgtgtgtgtgtgtgtgtgtgtgtgtgtgtgtgaaataggaagcttgactaggatcaggtgatttctgtattaaatgctgtcgagcactgacaggtaatat

SEQ ID NO: 22130 - DNA, 438 bp, Homo sapiens
  AC007344.3_101148
  Located on chromosome 16
  Distance between a terminus base of telomere on chromosomal short arm and 5'-terminus of this base sequence : 53808625
  Distance between 3'-terminus of neighbour sequence of sequence listing upward to telomere on chrosomal short arm and 5'-terminus of this base sequence : 7611
taccgagtcattactattgcactgaaccaaagtaaatgaatgtctactgccattgtcatagaaaaagaggaaagaaggaaggaaggaaggaaggaaggaaggaaggaaggaaggtaggatcatctgctctatataaactcccctgatcctcccaggcgcaactgaaggatttgtgctttcacaaagctttgcgtagacctgcgcctggttgtgcattcttttcagtcagtcactgtggtaaggtagtaattgcatgcctgggtttaaataatgattcaacccttatcaattggccatgtgaatccaggcaaactatttaaactttgtaaacttctcttgctaagcccttaactttgtactggcctagccctaactactctacacatattaactcattgtttccttttgacaatgttataggatggtacttcattaacc

SEQ ID NO: 22131 - DNA, 288 bp, Homo sapiens
  AC007344.3_91980
  Located on chromosome 16
  Distance between a terminus base of telomere on chromosomal short arm and 5'-terminus of this base sequence : 53817677
  Distance between 3'-terminus of neighbour sequence of sequence listing upward to telomere on chrosomal short arm and 5'-terminus of this base sequence : 8614
ccaaggagatggctatttagacatcttaattaaaagggaatttggaaatatctcccgttttgcagcgcatgtaatcaagcatttctttttctctgcagaaggactttggttgcctcttcacaaaaggctttgaaatgtcctaaaacaatcccccgcagctcggggtgggggtagggacgagagagagagagagagagagagagagagagagagagagagagagagagagaaaaccaaagcaaaaaacaacaaacattttctgggaggtgataaaagtcttggatgcaa

SEQ ID NO: 22132 - DNA, 270 bp, Homo sapiens
  AC007344.3_86020
  Located on chromosome 16
  Distance between a terminus base of telomere on chromosomal short arm and 5'-terminus of this base sequence : 53823646
  Distance between 3'-terminus of neighbour sequence of sequence listing upward to telomere on chrosomal short arm and 5'-terminus of this base sequence : 5681
tacactaccgtgtactttggagcagttgttaaaaggtgaatgcatgcaaacacaggttaattcatgaataacaaatgagccagatggagctgtaccaaggatgccaagagatacatagctcaaagaagcagagccaagcaccaggagagagagagaagagaagagaagagaggagaggagaggagaggagaggagaggagaggagaggagaggagaggagaagagaagagaagataagggaagagaagaggagtccaagtaatcgtaaat

SEQ ID NO: 22133 - DNA, 194 bp, Homo sapiens
  AC007344.3_35077
  Located on chromosome 16
  Distance between a terminus base of telomere on chromosomal short arm and 5'-terminus of this base sequence : 53874674
  Distance between 3'-terminus of neighbour sequence of sequence listing upward to telomere on chrosomal short arm and 5'-terminus of this base sequence : 50758
agtaacctcttaatggttggactcacctccagcctggatgccttcagtctgctctctgtactgtgggtggcatgattatgtgaatggccacccctgccccctcaacatgcacacacacacacacacacacacacagctcccacaccactatacatgattaatccttcaatgtcttctaatgctctcaagctcaa

SEQ ID NO: 22134 - DNA, 328 bp, Homo sapiens
  AC007344.3_22425
  Located on chromosome 16
  Distance between a terminus base of telomere on chromosomal short arm and 5'-terminus of this base sequence : 53887224
  Distance between 3'-terminus of neighbour sequence of sequence listing upward to telomere on chrosomal short arm and 5'-terminus of this base sequence : 12356
atttacaaatttgccttgaaatagagatttatcaggggtttcagctgctcagtgatggaacaatattaatgtcttcacaaggacaaatgagttaatccaatctttctatatgcttggagactggcgatctcagtttggacagctgggtttctagatacagtaacttctctgttacatggaaaggctgggggatgggctgttttcattttgtgtgtgtgtgtgtgtgtgtgtgtgtgtttgtatgttataattgttatacagggcttgaggttgcagagaaaaaagccactgagataggctttccatttagtctgaggtgcagatattc

SEQ ID NO: 22135 - DNA, 229 bp, Homo sapiens
  D16S416
  Located on chromosome 16
  Distance between a terminus base of telomere on chromosomal short arm and 5'-terminus of this base sequence : 53918047
  Distance between 3'-terminus of neighbour sequence of sequence listing upward to telomere on chrosomal short arm and 5'-terminus of this base sequence : 30495
aaatatgccttctggaggtgttgtggtttttttaggcttcaatatagttgtgtgtgtgtgtgtgtgtgtgtgtgtgtctgtgtatgtgtgtgttattaggagagcaggggccatgggagcaattcaattagtggcttctatacatctgagggtcctatgaactatgtgataggcaacatatatgccgttcatttttgtataaacatatacaatgtttacccaaactgct

SEQ ID NO: 22136 - DNA, 315 bp, Homo sapiens
  chr16.fa.O7frz.61939841
  Located on chromosome 16
  Distance between a terminus base of telomere on chromosomal short arm and 5'-terminus of this base sequence : 54185711
  Distance between 3'-terminus of neighbour sequence of sequence listing upward to telomere on chrosomal short arm and 5'-terminus of this base sequence : 267435
gtcttagctggaagttgaaatctaaatccaattgtgtgttaaacaaaggaattttataacctatttgctttcctggaagttctctttggtgtagtgtggaggatccattttgcagaagggagaaaagaagggaaggggaaggagagagagagagagagagagagagagaagactagtgtgagaaaatactattcgagttgcactagcaatagtccagaaaatacatttcaagccaagtgcatggaaatgatagtggagctggagaaaagatggattttaaagatgcttaagaagtgtacacaataggaattggtg

SEQ ID NO: 22137 - DNA, 296 bp, Homo sapiens
  chr16.fa.O7frz.62215896
  Located on chromosome 16
  Distance between a terminus base of telomere on chromosomal short arm and 5'-terminus of this base sequence : 54313959
  Distance between 3'-terminus of neighbour sequence of sequence listing upward to telomere on chrosomal short arm and 5'-terminus of this base sequence : 127933
gctgtacacttaggctacactaagtttataaaaaatattttttcttcaatgataagttaaccttagcttactgaaagaccactgtcatatatacagtacatccttgactgaaatgtcattatgtgacacacgactgtgcagatatatatatatatatatatatatacacaaacatatatacactcacatggttaatatatatatactttcatgattacataatcttgacaacccacccatacattctaaattatgcttgcctcaggaaagaggtagattacctgtgattcttgaag

SEQ ID NO: 22138 - DNA, 155 bp, Homo sapiens
  AC009039.6_143533
  Located on chromosome 16
  Distance between a terminus base of telomere on chromosomal short arm and 5'-terminus of this base sequence : 54386176
  Distance between 3'-terminus of neighbour sequence of sequence listing upward to telomere on chrosomal short arm and 5'-terminus of this base sequence : 71921
ggccaacatgatactgagtaacagataaactgtggaacaaaaagctaaaatgtaagattatgttcggtagaagtaataaatctgtgagattccctttctgcagtgtgtgtgtgtgtgtgtgtgtgtgtgtgcgcgcgtgcgtgcatatgtactgc

SEQ ID NO: 22139 - DNA, 310 bp, Homo sapiens
  AC009039.6_130417
  Located on chromosome 16
  Distance between a terminus base of telomere on chromosomal short arm and 5'-terminus of this base sequence : 54399306
  Distance between 3'-terminus of neighbour sequence of sequence listing upward to telomere on chrosomal short arm and 5'-terminus of this base sequence : 12975
aatgtcaatggaataaactctgataatttgctgactttttatgctgaaggtagagtaataccttaaaaataaatgaccacaataacacacacacacacacacacacacacacacacaaaaccgtgcagtatgtgcacaactgtttaaccatgctaatatcacaagcctaggagcccccagggctggaagatctagaaaaatcacttaaagcccaatttctccttttgggtgagttggccagactccaaatcccagcagaaattttttattagtcactggatctactttcttaggtccactcagcctaatt

SEQ ID NO: 22140 - DNA, 215 bp, Homo sapiens
  AC009039.6_112033
  Located on chromosome 16
  Distance between a terminus base of telomere on chromosomal short arm and 5'-terminus of this base sequence : 54417610
  Distance between 3'-terminus of neighbour sequence of sequence listing upward to telomere on chrosomal short arm and 5'-terminus of this base sequence : 17994
ctttatcttgaagtcagtggtcactctgaagacttagatggtggctgtacctttagaggttttatagggggcagcaaattcaacccgtgggcaaaatctggcccgctgagtgtttttgtacagactgcaagctcacgaggttatatatacatatatatatatatatatatatatatatatatatatatatatatatacacgaggttaagcgattc

SEQ ID NO: 22141 - DNA, 219 bp, Homo sapiens
  G07937
  Located on chromosome 16
  Distance between a terminus base of telomere on chromosomal short arm and 5'-terminus of this base sequence : 54492795
  Distance between 3'-terminus of neighbour sequence of sequence listing upward to telomere on chrosomal short arm and 5'-terminus of this base sequence : 74970
ccaactctgtagtttcaaagagctggtactgtaagaagacctggtagcttttgactcagttctatctctatctctatttttatctatctctatttatctctaaatctatctatcatctatctatctatcatctatctatctatctatcatctatctatctatcatctctatcatttatctatctatgaagagagatattaccaagcaagtaggctgtga

SEQ ID NO: 22142 - DNA, 469 bp, Homo sapiens
  chr16.fa.O7frz.62546674
  Located on chromosome 16
  Distance between a terminus base of telomere on chromosomal short arm and 5'-terminus of this base sequence : 54627890
  Distance between 3'-terminus of neighbour sequence of sequence listing upward to telomere on chrosomal short arm and 5'-terminus of this base sequence : 134876
gagactcatgtcatctattggtatttcagtttcctctgattcaagtagtgtctttgaggtaattgagtctctttctgtaaacagattttggaaatgtctttgtgtaccgtgtgcgtgtgtgtgtgtgtgtgtgtgtgtgtgtgtgtgtgtgtatgcagcagatgggagtgctggattcaattcaatcaaacaattccatcaaaaaacatttcttggacctttgatgagtttgaatacaggcttaggatggtggatctaaccacataggcagcctctattgatacaggaaaagaggcacccggataaaatagcattttaggaaaatgattctagtaggattaatatgaaagagcaaaaattccagttctgtaatccaggcataggttactacagcaacgccatggtagtggtagcaagagtggacatgagacatgggtctgagaaacacttatgtggaggtcaagatgta

SEQ ID NO: 22143 - DNA, 149 bp, Homo sapiens
  D16S766
  Located on chromosome 16
  Distance between a terminus base of telomere on chromosomal short arm and 5'-terminus of this base sequence : 54698765
  Distance between 3'-terminus of neighbour sequence of sequence listing upward to telomere on chrosomal short arm and 5'-terminus of this base sequence : 70406
taccaagcctccacaattgtatgagccaattcctttaaatatctattatctagctcgctcgctctatctatctatctatctatctatctatctatctatctatctatctatctcatcttattggttctgtttctctagctaaccctaac

SEQ ID NO: 22144 - DNA, 325 bp, Homo sapiens
  AC007501.2_47715
  Located on chromosome 16
  Distance between a terminus base of telomere on chromosomal short arm and 5'-terminus of this base sequence : 54795140
  Distance between 3'-terminus of neighbour sequence of sequence listing upward to telomere on chrosomal short arm and 5'-terminus of this base sequence : 96226
ttattcaccatagagcaggaacgcttaacaaagaaagggtctactacctttacagggtccaacaacgaacaactcccccagtgttatctaaaaaggtgtgtgtggtgtgtgtgtgtgtgtgtgcacgcacacgtgtgtgtgtgcgtgcgcgcgcgtgtgtgtgtgtgtgtgtgtgtgtgtgttggccagagggggtctataggtgtcatcaaattctcaaagtgatccttgacttccgcaagtttagaatcacagctctaagaatttggataactttcactatgaagtcttacattaaatgatctggaaacaatcttcaaattgt

SEQ ID NO: 22145 - DNA, 176 bp, Homo sapiens
  AC007501.2_52106
  Located on chromosome 16
  Distance between a terminus base of telomere on chromosomal short arm and 5'-terminus of this base sequence : 54799645
  Distance between 3'-terminus of neighbour sequence of sequence listing upward to telomere on chrosomal short arm and 5'-terminus of this base sequence : 4180
aaatgtccttgacataaactcaagttttcctttgcacgtgcacacacacacacacacacacacacacgctccccttattgaataagagtatcctccaacccttggaaatttactgtatagctcatcttttctaatacctgatccttcccagagtggtccttatagttatcttgcag

SEQ ID NO: 22146 - DNA, 333 bp, Homo sapiens
  AC007501.2_105442
  Located on chromosome 16
  Distance between a terminus base of telomere on chromosomal short arm and 5'-terminus of this base sequence : 54852938
  Distance between 3'-terminus of neighbour sequence of sequence listing upward to telomere on chrosomal short arm and 5'-terminus of this base sequence : 53117
agcagtacaggttaatgcaaagagagaacatgtttagccagagtaataaaataatgtctacatggcattgggagagacaaggggtgtgtgtgtgtgtgtgtgtgtgtgtgtgtgtgtgtgagagagagagagagagagaaatggaggtggtgggggtgggggggggtgtctgtagaccacttaagagggaaggcatttaggccatttagatatgacactaatcagataccacatttctcatgtctatttttcattatcctgatttatttctgacctgtaacaaaagaaaaagcgcaccaagtacttacttaagtctcaggaatagaaaccagt

SEQ ID NO: 22147 - DNA, 364 bp, Homo sapiens
  AC007501.2_113683
  Located on chromosome 16
  Distance between a terminus base of telomere on chromosomal short arm and 5'-terminus of this base sequence : 54861143
  Distance between 3'-terminus of neighbour sequence of sequence listing upward to telomere on chrosomal short arm and 5'-terminus of this base sequence : 7872
cacctttagcgtataaattctcagctataaaatagctgctgcacaaattaggtcacataaacacaactcacataaaaaggttggtctccttggctttgatttttaaatgttagcgcatgcacacacacacacacacacacacacacacacacacacacacggatattaaaacaaaacagaaccctgccaccctcactggagcacaatttttatatttactattgcaaataagaaaaagatttctggatgcaatacagattacttgagaatcactttttcttgagaacagctgaaaacctcatgctaaggcaataaataaggtagcaagaagaataagctttgctgcaaatggcttactttagag

SEQ ID NO: 22148 - DNA, 374 bp, Homo sapiens
  chr16.fa.O7frz.62971053
  Located on chromosome 16
  Distance between a terminus base of telomere on chromosomal short arm and 5'-terminus of this base sequence : 55245141
  Distance between 3'-terminus of neighbour sequence of sequence listing upward to telomere on chrosomal short arm and 5'-terminus of this base sequence : 383634
cgcttgtcctacaagagttagttccagcctcattgagtccagggagactgccttgagtatttgtttttttgatgggatttcactcttgtcgcccaggctggaatgcaatggcactatctcagctcactgcaacctccacctcctgggccttgagctcttttagagggaaagaccaggtcttgctggttgtattaggattctctgagaaatagaagatagatagatggatgaatggatagatagatagatagatagatagatagatagatagatagataaaatgagatttatcagtggatttcaaaaggtttgtgaagatggaattaaacaataaaataaaaattatgaactttatttgtgaacataacctccat

SEQ ID NO: 22149 - DNA, 411 bp, Homo sapiens
  chr16.fa.O7frz.63100187
  Located on chromosome 16
  Distance between a terminus base of telomere on chromosomal short arm and 5'-terminus of this base sequence : 55282684
  Distance between 3'-terminus of neighbour sequence of sequence listing upward to telomere on chrosomal short arm and 5'-terminus of this base sequence : 37169
aattagctccttcagtaagcacttggatcaagggcaatgatagatgatacatgatacatagatagatagatagatagatagatagatagatagatagatagacagacagacagacagacagagtagtataaatttaaggagcacaagtgcagttttgttacatggatatattgcatagtggtgaagtatgggcttttagtgtacccataacccaaatagtacacattgtgcccattaagtaatttcttcttagcctcacctctgtcccaccctccgcccttccaggtctccagtgccgattgttccacactctatgcccatgtttacccattatttagctcccactggtaagtgagaacatgtgatatttgactttttgtttctaagttgtttcacttaagataatggcct

SEQ ID NO: 22150 - DNA, 427 bp, Homo sapiens
  chr16.fa.O7frz.63196866
  Located on chromosome 16
  Distance between a terminus base of telomere on chromosomal short arm and 5'-terminus of this base sequence : 55330237
  Distance between 3'-terminus of neighbour sequence of sequence listing upward to telomere on chrosomal short arm and 5'-terminus of this base sequence : 47142
tttgtacagcctacatggtaagaaggtttctacatttttaaggaatgtaaagcacacacacacacacacacacacacacacagagagagagagagagagagagaggtgacacagaacctaggtggcccacaaagcctaaaatacttactattttgcccttttactgactcctggtctaacgtcaaagaaatacagattgagcatttctaacccaaaaatctgaaatccaaaatgctcctaaatctgaatttttttgagcattcacgtgaaatcacaagtggaaaacttcacatctgacctcatgtgatgtatcacagtcaaaactttgtttcatgcacaaaattactgaaaatattatataaaattatcttcaagctatgtgtataaaatgtatataaaacgtatgtgaatttcgtgtttagacttg

SEQ ID NO: 22151 - DNA, 463 bp, Homo sapiens
  chr16.fa.O7frz.63271448
  Located on chromosome 16
  Distance between a terminus base of telomere on chromosomal short arm and 5'-terminus of this base sequence : 55405273
  Distance between 3'-terminus of neighbour sequence of sequence listing upward to telomere on chrosomal short arm and 5'-terminus of this base sequence : 74609
caagatcatgccactaaactccagcctgggcaacagagcgagactccatctcaaaaaaaaacaaaaaaagaaagaaaagaaagaaagaaggaaagaaagaaagaaggaaggaaggagagagagagagagagaaagaaagaaaaagaaagaaagaaagaaagaaagaaagaaagaaagaaagaaagaaagaaagaaagaaagaaaagaaagaaagaaagagagaaaaagaaagagagagagagagagaaagaaagaaagaaggaaagaaagaaagaaagattacccatcagacacaatgttcactatctgggcaatgggtacacaagaagcccagtccccaccagtgcgcaatatacccatgtaactaacaaacatgcaatgtacccctaattttaaaataaaacaagttaaaaaaaaaagaatgtggggtctagaggcaaactgcctgtattcaaataaaaca

SEQ ID NO: 22152 - DNA, 274 bp, Homo sapiens
  D16S3034
  Located on chromosome 16
  Distance between a terminus base of telomere on chromosomal short arm and 5'-terminus of this base sequence : 55519440
  Distance between 3'-terminus of neighbour sequence of sequence listing upward to telomere on chrosomal short arm and 5'-terminus of this base sequence : 113704
taatctagttaaagatgcaactgcctcagacacacatacatacacacacacacacacacacacagcgcgatgtgcatatggtgtggttatagtgcagaatctagcatcctgcttcccaaaatggcctaccctacatctattctagattttaaaaaagaaggaggaggaggaagaggaatagatcttatccttgaaaacatttagaagaggtaatgtgtatgttcattgcaaaagatacatacacaaaggaaagatggcatcaaaacttctgagc

SEQ ID NO: 22153 - DNA, 438 bp, Homo sapiens
  chr16.fa.O7frz.63695746
  Located on chromosome 16
  Distance between a terminus base of telomere on chromosomal short arm and 5'-terminus of this base sequence : 55871692
  Distance between 3'-terminus of neighbour sequence of sequence listing upward to telomere on chrosomal short arm and 5'-terminus of this base sequence : 351978
tctgaagtagctaggactacagacgtgcaacaccatgcctggctaatttatgtatatatatatatatatatatatatatatatatatatatagtagagatgaggtcttggttcttgccgtgttgcccaggctggtcctgtactcctggcctcaagcaatcctctccctcagccttccaaagctctgggattacaggcatgaaccaccacatccagctgatcatgttgttttgatatgtgctgtgaaataattgccacaatcaagcaagctaacatatccatcatctaacatagttaccgtgtgtgtgtgtgtgttaacacttaagatttactctcaacaaatttcaaatattcaatatagtattactaactgtagttattatgttgtacatttgatctcgacaacttattcatcctgtgtaacagaaactttgtaccg

SEQ ID NO: 22154 - DNA, 226 bp, Homo sapiens
  D16S415
  Located on chromosome 16
  Distance between a terminus base of telomere on chromosomal short arm and 5'-terminus of this base sequence : 56172612
  Distance between 3'-terminus of neighbour sequence of sequence listing upward to telomere on chrosomal short arm and 5'-terminus of this base sequence : 300482
ccagtaatgttatgtaagtcaatgctattcttattattttaaagttttaaaatttttattgctttgttgaaataaaactgacagacaataaactacacacaattaaactgcaatatttgacacacacacacacacacacacacacacacacacacacacacacactctttaattacttttagagacagggtcttgctatgttacccaggctggggtacagtggcta

SEQ ID NO: 22155 - DNA, 224 bp, Homo sapiens
  D16S3137
  Located on chromosome 16
  Distance between a terminus base of telomere on chromosomal short arm and 5'-terminus of this base sequence : 56184370
  Distance between 3'-terminus of neighbour sequence of sequence listing upward to telomere on chrosomal short arm and 5'-terminus of this base sequence : 11532
gcaaagaataattgcacatatacgtacgcgcgtgcgcgcgcgcgcgcacacacacacacacacacacacacacacacaaaagtgcatgtaaaaactgacgaaatctgagtaaggtatgtagcctaattaatagtattgtcccgattttgaaattattctatagttatgcaagacgttacaattaggagaaattgggttaaggttacaggggatctctttgtact

SEQ ID NO: 22156 - DNA, 313 bp, Homo sapiens
  AC007347.3_10417
  Located on chromosome 16
  Distance between a terminus base of telomere on chromosomal short arm and 5'-terminus of this base sequence : 56405791
  Distance between 3'-terminus of neighbour sequence of sequence listing upward to telomere on chrosomal short arm and 5'-terminus of this base sequence : 221197
ttctagaaagatggaccaatttacagattcatcaagagagaatgcctctcccatctcaagtttggcagcatggaatattacagtttgaaaacatcttttccaattttatggactaaaagtaacagaatttctttatcactactgtgattggatcttttttatgtttatggctgtgtgtgtgtgtgtgtgtgtgtgtgtgtgtgcgcgcgtgtgtgaatttcttgtcctctacattttccccttccttttgtggcgtacatgttaactgttaacagctgcagtgcctatgagctcattatcaaagtgttgctcc

SEQ ID NO: 22157 - DNA, 367 bp, Homo sapiens
  AC007347.3_35271
  Located on chromosome 16
  Distance between a terminus base of telomere on chromosomal short arm and 5'-terminus of this base sequence : 56430616
  Distance between 3'-terminus of neighbour sequence of sequence listing upward to telomere on chrosomal short arm and 5'-terminus of this base sequence : 24512
ttacttagcatggtacgtctttagggaaaagaccgtattatgaatttagcaagcaagttgagcatggtgacatccgcctgtaatcccagctacttgagaggcggaggggggaggatcacttgggcctgggagttccagactacagtgagttatgaagggacccactgcactgcagcctgggcaacagagcaagaccctgcaaataaataaataaataaataaataaataaatgtcgtggtttttttttaatttagcaagtaaagtagcagaatatcctatgttggattagtcagtggaaaaaaatatctttcaaatcgcatttgatgtttgctcaccattattatgaactaagctactccatggaac

SEQ ID NO: 22158 - DNA, 321 bp, Homo sapiens
  AC007347.3_95988
  Located on chromosome 16
  Distance between a terminus base of telomere on chromosomal short arm and 5'-terminus of this base sequence : 56491503
  Distance between 3'-terminus of neighbour sequence of sequence listing upward to telomere on chrosomal short arm and 5'-terminus of this base sequence : 60520
gacagctgagtgttagcataacattttattttattttattttattttattttattttattttattttattttattttatttattaatgtactgatttttgacctggggtcttgctccatcatccagtctggagtgcagtggtgcaatcatagctcactgcagcctcaaactcctaggcttgagccttcttctgcctccgccttcccagtagctgggactagggactacaggcgcacaccatcacacttagctaatttttaaactttttttaggaatggggtcttactgtgttgcccaggctggtctcgaactcctggactc

SEQ ID NO: 22159 - DNA, 208 bp, Homo sapiens
  AC007347.3_136661
  Located on chromosome 16
  Distance between a terminus base of telomere on chromosomal short arm and 5'-terminus of this base sequence : 56532125
  Distance between 3'-terminus of neighbour sequence of sequence listing upward to telomere on chrosomal short arm and 5'-terminus of this base sequence : 40301
cctcttaggagttcatttctgttatctcttcagtggcccatgcttggtaatatttctccatcaagttctagtctgtgtgtgtgtgtgtgtgtgtgtgtgtgtgtgtgtgtgtgtgtatgttacatttgcttattctgatgaatctttcagcagaaaccatttctcctgaaatctttatcatttcatcaagagtaatggaaatgttacc

SEQ ID NO: 22160 - DNA, 358 bp, Homo sapiens
  chr16.fa.O7frz.64609192
  Located on chromosome 16
  Distance between a terminus base of telomere on chromosomal short arm and 5'-terminus of this base sequence : 56806910
  Distance between 3'-terminus of neighbour sequence of sequence listing upward to telomere on chrosomal short arm and 5'-terminus of this base sequence : 274577
attcctttaaagagctgaacacctctcctcatctgtggtccttatgaagtctgccctctgactcagaaagataaaagagaaaataaaagaaagaaaaagaggaagaaagagagaaataatgtgtactcttatgctctttttactttgttcaagattctttctttctttctttctttctttcttggtagagatggggtctctctatgttgcccaggatggtctcaaactcctggactcaagctgtctgcccaccttggcctctcaaagtgcttggattacaggcataagccactgcagtctgccctgttcaaggttcttttggaattattttttcccctttaattttacatttggagcc

SEQ ID NO: 22161 - DNA, 259 bp, Homo sapiens
  D16S771
  Located on chromosome 16
  Distance between a terminus base of telomere on chromosomal short arm and 5'-terminus of this base sequence : 56903776
  Distance between 3'-terminus of neighbour sequence of sequence listing upward to telomere on chrosomal short arm and 5'-terminus of this base sequence : 96508
aagtagatcagtcatcttgctgcttctaaacaaaccaagacatgtttttgaaattttgctttaagacagaagaaaggaaggaaggaaggaagaaggaaggaaggaaggaaggaaggaaggaaggaaggaaggaaggaaggaaggaaagcaggaaagcaggaaagcaagaaggcacacttgttgtgtgccttcagtaatctattctcttgtccacgtgggattcatgaagaaaaacagaatagagggtggtgttttggac

SEQ ID NO: 22162 - DNA, 379 bp, Homo sapiens
  chr16.fa.O7frz.65018991
  Located on chromosome 16
  Distance between a terminus base of telomere on chromosomal short arm and 5'-terminus of this base sequence : 57092502
  Distance between 3'-terminus of neighbour sequence of sequence listing upward to telomere on chrosomal short arm and 5'-terminus of this base sequence : 188467
aggactaacatccagaacctacaaggaattcaaacaaatcagcaagaaaaatacagataatcccatcaaaaagtgggtaaaggatatgaaaagacatttctcaaaggaagacatacaaaagaccaacaaacatatgaaaaaatgctcaacatcactaattatcagggaaatgcaaatctatctatctgtcatctatctatctgtcatctatctatctatctatctatctatctatctaatctatctatctatcatctgtcttcccctctctctatcctctcaccaacacacacacgttttatgtctttctgcttcaatatctttttgtctctgtgttctggatttctgtttctcagtctgagtggtaagatatcaccaa

SEQ ID NO: 22163 - DNA, 217 bp, Homo sapiens
  HUMUT1936
  Located on chromosome 16
  Distance between a terminus base of telomere on chromosomal short arm and 5'-terminus of this base sequence : 57158352
  Distance between 3'-terminus of neighbour sequence of sequence listing upward to telomere on chrosomal short arm and 5'-terminus of this base sequence : 65471
gtcagtatttgacaccaggactgttgttgtcccagcctctctgctctaccttttcatattttctttccctccttccttccttccttccttccttccttccttccttccttccttccttccatcctccctccctccctcccttccttcctttctcccttctttttttccttctttccttctttcttttttgagatagggtcttactctatcccctcca

SEQ ID NO: 22164 - DNA, 276 bp, Homo sapiens
  chr16.fa.O7frz.65401997
  Located on chromosome 16
  Distance between a terminus base of telomere on chromosomal short arm and 5'-terminus of this base sequence : 57331905
  Distance between 3'-terminus of neighbour sequence of sequence listing upward to telomere on chrosomal short arm and 5'-terminus of this base sequence : 173336
gaatgaagcctaatcctcttatgaaagcccagtattggtatttctggaagttcagataatgatgatgataatgatgatgatgatgatgatgatgatgaaagcagttctcatttatcaacctcttactgtgtgccaggcaaggtgcttttcatgggtaatctcattttatcttttccgtgactccataaggcaggtgctatccttatttccattttatagacaaggaagcagggacagagagaagttaagtggcttggctgacgatacatagctggc

SEQ ID NO: 22165 - DNA, 446 bp, Homo sapiens
  chr16.fa.O7frz.65331462
  Located on chromosome 16
  Distance between a terminus base of telomere on chromosomal short arm and 5'-terminus of this base sequence : 57402847
  Distance between 3'-terminus of neighbour sequence of sequence listing upward to telomere on chrosomal short arm and 5'-terminus of this base sequence : 70666
tcctctgtcatctactcatcttcccatacatccaccaagcacctgcctactcacctcctagccatgtaaccattttatccacctgtattaatccatccatccatccatccatccatccatccatccatccatccatccactcatataactgagaactgctatgagccagatgctgggtcagacactggagataagtcatatctcatctccaacccccatccatgctgccttcccaatacaactgagaagccagctataggcaccactcactgcgtcagtctgtgaccaatggtgggagccccaaggaacatctaattatcacaattacattgtaactgagtgttggctgatgtgtaagatttgccagggaagaggaggaaggaccttcctggtggaggaaatggcatgggtaaatgctgggaggtctgaatgagaatggtagtttg

SEQ ID NO: 22166 - DNA, 212 bp, Homo sapiens
  chr16.fa.O7frz.65473536
  Located on chromosome 16
  Distance between a terminus base of telomere on chromosomal short arm and 5'-terminus of this base sequence : 57467165
  Distance between 3'-terminus of neighbour sequence of sequence listing upward to telomere on chrosomal short arm and 5'-terminus of this base sequence : 63872
cgaacaaacgtaattatagttcagagagagcttttatgtgtatttgattagtcaaggggacagcgcctcccttcttgccttaaatttgagttagcctcaatctatgcaaattcctggggttggggaagaggaaaaagggtgtgtgtgtgtgtgtgtgtgtgtgtgtgtgtgatcatgtgtgcaagggtaggggcttgtccatcagctaatgg

SEQ ID NO: 22167 - DNA, 119 bp, Homo sapiens
  D16S3032
  Located on chromosome 16
  Distance between a terminus base of telomere on chromosomal short arm and 5'-terminus of this base sequence : 57601266
  Distance between 3'-terminus of neighbour sequence of sequence listing upward to telomere on chrosomal short arm and 5'-terminus of this base sequence : 133889
ttcccagtttggaggtcaagaaaacacacacacacacacacacacacacacacacacacacacgaaacctcaagccatatgagaagaaagtttcaacagcatggaaatagatggctttg

SEQ ID NO: 22168 - DNA, 347 bp, Homo sapiens
  chr16.fa.O7frz.65697947
  Located on chromosome 16
  Distance between a terminus base of telomere on chromosomal short arm and 5'-terminus of this base sequence : 57691142
  Distance between 3'-terminus of neighbour sequence of sequence listing upward to telomere on chrosomal short arm and 5'-terminus of this base sequence : 89757
caagtatctgtggcttattgatagttaaataaattgacaaccactcctgttaggaatacccacctcaaaggttgttgtaaggggtaggtgaaatgatgtgaaagaactgtgatatagggtttggcccagagatctctctctcacacacacacacacacagaatgaatgaatgaatgaatgaatccctgtgctacttataaggaagagccttgcctttttttgcacatggcaaaccattctctctctctctctctctctctttaataaaccttaaagatcattctacttctagtttaatttcttcctctttacatggaggaaaactgagattaggcataatttactga

SEQ ID NO: 22169 - DNA, 309 bp, Homo sapiens
  chr16.fa.O7frz.65771871
  Located on chromosome 16
  Distance between a terminus base of telomere on chromosomal short arm and 5'-terminus of this base sequence : 57765207
  Distance between 3'-terminus of neighbour sequence of sequence listing upward to telomere on chrosomal short arm and 5'-terminus of this base sequence : 73718
tggtccaataactaaaggaaaccatgtttaaagagctaaaagaaagtatggagcagggtatcaccaaatggagaatatcaataaagatgcaatgcattgtgtgtgtgtgtgtgtgtgtgtgtgtgtgtgtgtgtgtgtattcactagaggggctcaacagcagactatcaaacaaaaaaagaatcagcaaacttgaaaacaggtcaactgagattatctagtttgaggaacataaaaaaagatgaagaaaaatgaacagaacctcagagacctgtggacgctatcagctttaccaacagtttcgtaatg

SEQ ID NO: 22170 - DNA, 244 bp, Homo sapiens
  D16S3053
  Located on chromosome 16
  Distance between a terminus base of telomere on chromosomal short arm and 5'-terminus of this base sequence : 57765252
  Distance between 3'-terminus of neighbour sequence of sequence listing upward to telomere on chrosomal short arm and 5'-terminus of this base sequence : -264
gtatggagcagggtatcaccaaatggagaatatcaataaagatgcaatgcattgtgtgtgtgtgtgtgtgtgtgtgtgtgtgtgtgtgtgtgtattcactagaggggctcaacagcagactatcaaacaaaaaaagaatcagcaaacttgaaaacaggtcaactgagattatctagtttgaggaacataaaaaaagatgaagaaaaatgaacagaacctcagagacctgtggacgctatcagct

SEQ ID NO: 22171 - DNA, 380 bp, Homo sapiens
  chr16.fa.O7frz.66292604
  Located on chromosome 16
  Distance between a terminus base of telomere on chromosomal short arm and 5'-terminus of this base sequence : 57890971
  Distance between 3'-terminus of neighbour sequence of sequence listing upward to telomere on chrosomal short arm and 5'-terminus of this base sequence : 125475
ttggtcacaacttcataaatagtccctttgttaaactatctccaacttattattgtgtgtgtgtgtgtgtgtgtgtgtgtgtgccatctattcccccccaccccccgcactctgactgatgcacctatcgtactaggtgaagatgcccggtgaccgtgtcggaaggctgcaacgtgcagcaagggggtcaccaactgcaaagaagtctcatgctcttttccttctgcagctgagaacttctggagaagaccctccaagaaggcatagtgtcatgttctaaaacaaaaattggccaatgcttctaggcagaaattttctccacacacacagagaaaagtatctccctaaataacacttagtcattcaactgcattatcaag

SEQ ID NO: 22172 - DNA, 264 bp, Homo sapiens
  D16S3039
  Located on chromosome 16
  Distance between a terminus base of telomere on chromosomal short arm and 5'-terminus of this base sequence : 57951617
  Distance between 3'-terminus of neighbour sequence of sequence listing upward to telomere on chrosomal short arm and 5'-terminus of this base sequence : 60266
ttcatccctcagtgacaaggcaattcaggttaatcacatagaactggcagagcagcattccactggttactgaaaggagggagaggtcctcttgtgttctgattctactcactcttttcccttaaccccttgctgtctcagggctaagcagttccaggagagcactgagcacatgcacacgtgtacacacacacacacacacacacacacacacacacacacacacacctcatgcatcccttctgaggcttactggtttgtctg

SEQ ID NO: 22173 - DNA, 327 bp, Homo sapiens
  AC020766.5_54392
  Located on chromosome 16
  Distance between a terminus base of telomere on chromosomal short arm and 5'-terminus of this base sequence : 58075761
  Distance between 3'-terminus of neighbour sequence of sequence listing upward to telomere on chrosomal short arm and 5'-terminus of this base sequence : 123880
tctaccttgacctttaggaaacagacttctctctttatcggaagataatgccataaaatatctatctatctatctgtctgtctgtctgtctgtctgtctgtctgtctgtctatctacctatctacctacctacctattatctatcatctatcaattatctatgatctatctattatctatctaatctatttatttcatttattacatttatttatgtaattgtgtttcaagctctattcacctcctgaacttttcatatgagagaacagaactctggctgataccttcggtatttttagaaggattggtacactttgattgttattt

SEQ ID NO: 22174 - DNA, 271 bp, Homo sapiens
  D16S3112
  Located on chromosome 16
  Distance between a terminus base of telomere on chromosomal short arm and 5'-terminus of this base sequence : 58096186
  Distance between 3'-terminus of neighbour sequence of sequence listing upward to telomere on chrosomal short arm and 5'-terminus of this base sequence : 20098
tactttggagcccgaggcaggagagtcacttgaactgggggggcagaggttgcagtaagccaagattgcactattgcactccagcctgggagaccctgtcaaacacacacacacacacacacacacacacacacacacacacacacacacacacaagagtggtcagacagagctcctgatgctttatgagaagccagaattgcaggggttttatgtgaaatttcctggattgcaaagcactgggtgtaccaaataaacaccactgggggct

SEQ ID NO: 22175 - DNA, 154 bp, Homo sapiens
  chr16.fa.O7frz.66406576
  Located on chromosome 16
  Distance between a terminus base of telomere on chromosomal short arm and 5'-terminus of this base sequence : 58360214
  Distance between 3'-terminus of neighbour sequence of sequence listing upward to telomere on chrosomal short arm and 5'-terminus of this base sequence : 263757
taagactgatgctggatatgagtcctgagatccgtcccacatcttcagggatctcctttagcaattacacacacacacacacacacacacacacacacacacaaattttctgtccttctggatccctctcctgtgcatattgataaactcatgc

SEQ ID NO: 22176 - DNA, 168 bp, Homo sapiens
  D16S3140
  Located on chromosome 16
  Distance between a terminus base of telomere on chromosomal short arm and 5'-terminus of this base sequence : 58502935
  Distance between 3'-terminus of neighbour sequence of sequence listing upward to telomere on chrosomal short arm and 5'-terminus of this base sequence : 142567
taagtggggagcgtgatatctgaatctcagccagatagcagacacagtacaaaaggcacaccccctacacacacacacacacacacacacacacacacacacacacacacacacacacacacacacacacacggtgtgtgagatcttccaggagcaaatgtattcatc

SEQ ID NO: 22177 - DNA, 249 bp, Homo sapiens
  D16S408
  Located on chromosome 16
  Distance between a terminus base of telomere on chromosomal short arm and 5'-terminus of this base sequence : 58511808
  Distance between 3'-terminus of neighbour sequence of sequence listing upward to telomere on chrosomal short arm and 5'-terminus of this base sequence : 8705
tgtaaccttgtgtgcatcctaggacatcaccaagcacaaggtgcatctgagcaaccaccaagtcctgcaagtctctctctctctctcagtctctttctgtctctgtcgcctctgtgtgtgtgtgtgtgtgtgtgtgtgtgtgtgtgtgtatgtgtgtatctgtctgtctgtctgtctctctctctcattgcccctccttgacccaatcaccatgaccaagggggctgaggggttcctgggataagagtg

SEQ ID NO: 22178 - DNA, 456 bp, Homo sapiens
  chr16.fa.O7frz.66785696
  Located on chromosome 16
  Distance between a terminus base of telomere on chromosomal short arm and 5'-terminus of this base sequence : 58721990
  Distance between 3'-terminus of neighbour sequence of sequence listing upward to telomere on chrosomal short arm and 5'-terminus of this base sequence : 209933
ctaatcaagcctccagatctaccattatctttctatacaggggacagaagaataatactaaacattaccacaaggataccaccagcaaaatccaaaatggcaccccacaggagaaggagagaagagactgagtgggcaagcaaaagtgtggattaaaagattaaacgatttccaaccaaatccaatgtatggactttgatctggattttgatttgagcaagccaacttaaaacacacatgtccacatttataagacaactgggaacatctaaacagatgaggtatttgtaatattaagcaattattgtaaatttttctaagtgtgatatggcattgtgatttttatacagacgtgtgtatatatgtgtgtgtgtgtgtgtgtgtgtgtatatatatgtatatatatatatatgatattgaaaggccctttgtctgaaatagttgtggctagaatta

SEQ ID NO: 22179 - DNA, 364 bp, Homo sapiens
  chr16.fa.O7frz.66881518
  Located on chromosome 16
  Distance between a terminus base of telomere on chromosomal short arm and 5'-terminus of this base sequence : 58818119
  Distance between 3'-terminus of neighbour sequence of sequence listing upward to telomere on chrosomal short arm and 5'-terminus of this base sequence : 95673
cagtaagaggatacaatgctgtgaacacaacacttttcctccaagttagttttttgctgacagttatttcaaaagctcaccatatatatatatatatatatatagcctaacaggctgagtttagaaaaggagaatgcaaggaaagtcaagccagctttgaaaaggaacaacaaagggagctcgctccaacctggtagctccactcgttcccaaagctctggaaaattgtggagggtcaggaagagatcagttggactgaagacagttcaaaaacaaacctctgtgttgctggaagtaagagatgatcaaaccagtgggaaagtacacactactcagtgaaaggtgttggaacaatttacatgtc

SEQ ID NO: 22180 - DNA, 86 bp, Homo sapiens
  D16S3071
  Located on chromosome 16
  Distance between a terminus base of telomere on chromosomal short arm and 5'-terminus of this base sequence : 58858708
  Distance between 3'-terminus of neighbour sequence of sequence listing upward to telomere on chrosomal short arm and 5'-terminus of this base sequence : 40225
tggaagatagcccccaaattaatgtgtgtgtgtgtgtgtgtgtattacacttatggattacttttgccactgcccatcagagagct

SEQ ID NO: 22181 - DNA, 299 bp, Homo sapiens
  AC012181.5_125624
  Located on chromosome 16
  Distance between a terminus base of telomere on chromosomal short arm and 5'-terminus of this base sequence : 59050860
  Distance between 3'-terminus of neighbour sequence of sequence listing upward to telomere on chrosomal short arm and 5'-terminus of this base sequence : 192066
agaaaggtcaaagatagtgaagacaatgggttcgagtccttggtttcttggagagcacattggcagagtcatcagggtggaggaacatatgcttgtgtctgttattacaggactgaatttttattagaattactgctccagttcgtgttgatgcagcagggctgagcaccagctaaacctgcatggacagataaagagttgatggggatttatttatttatttatttatttatttatttttaacgagaagaggaagaaaggaagaaagtaaatctcactcgttcatcaggtagtgacta

SEQ ID NO: 22182 - DNA, 321 bp, Homo sapiens
  chr16.fa.O7frz.67240323
  Located on chromosome 16
  Distance between a terminus base of telomere on chromosomal short arm and 5'-terminus of this base sequence : 59192477
  Distance between 3'-terminus of neighbour sequence of sequence listing upward to telomere on chrosomal short arm and 5'-terminus of this base sequence : 141318
ctccttccaaagacagtctaagtgtgtttttacaaacatggatatatacatatatatatacacgtatatatgtgtatatatatatacacacacacacacacacacatatacacatatatagacacacacacacatgtgtacttttcccttctcacaaatggcagtgtactatatgtagtgttctctaacttgggttttttttttttaaacttagtgcaatttggaaatctttctacatcaaaattttaaaatctgccctttccctctttctttttaacagctgcctagtatttcaccgtatgactgctctgtaattgatct

SEQ ID NO: 22183 - DNA, 191 bp, Homo sapiens
  chr16.fa.O7frz.67161259
  Located on chromosome 16
  Distance between a terminus base of telomere on chromosomal short arm and 5'-terminus of this base sequence : 59282424
  Distance between 3'-terminus of neighbour sequence of sequence listing upward to telomere on chrosomal short arm and 5'-terminus of this base sequence : 89626
ggttattgtgaggattaaatgagttaataagtataaagtgccaggaaaaggtctggctcatgggagtgctgtcagcagttattgtaactgttattattattattattattattattattattatcattatcattacccctggtagccctgactcactgccacggccagttcctttacatgtcttacttcag

SEQ ID NO: 22184 - DNA, 279 bp, Homo sapiens
  chr16.fa.O7frz.67359156
  Located on chromosome 16
  Distance between a terminus base of telomere on chromosomal short arm and 5'-terminus of this base sequence : 59433214
  Distance between 3'-terminus of neighbour sequence of sequence listing upward to telomere on chrosomal short arm and 5'-terminus of this base sequence : 150599
actatcctgcacatgacataaggaatatcatggcctttaaaaaatcatttaaggtttaaaaagtgccactttttgtatgtgactcactctatctatctatctatctatccatccatccatccatccatccatccatccatccatccatctatggggtctcactatattgcccaggctggtctcaaaatcctggcctcaagtgatcctcctgcttcagcttcccaagtagctgggattacaggtgtgagccgctgcacctggcaactgttactttaaaga

SEQ ID NO: 22185 - DNA, 408 bp, Homo sapiens
  chr16.fa.O7frz.67747143
  Located on chromosome 16
  Distance between a terminus base of telomere on chromosomal short arm and 5'-terminus of this base sequence : 59570439
  Distance between 3'-terminus of neighbour sequence of sequence listing upward to telomere on chrosomal short arm and 5'-terminus of this base sequence : 136946
ttctctttaacattgcactagaagtggaagctagtgcaataagtcaaggaaaagaaataaaagtcataaggatttgggggggaagcaaaattcattattattattattattattattattattattattattattattagagacggggtcttgctttgccacccaggatggagtgcagtagtgcagtcatggcttaccacagcttcaaacttctgggctcaaatgatcctcctacctcagccttcaaagtagctgggactacaggctgatcttgaactgggctcaagagttcctcccgccttggcctcccaaaatgcaagccaccacgctcaactccaaactatcattatttacatgacatgattaggtacagagaaatttccagtaagtctacagacaagctactgg

SEQ ID NO: 22186 - DNA, 330 bp, Homo sapiens
  AC004382.1_74323
  Located on chromosome 16
  Distance between a terminus base of telomere on chromosomal short arm and 5'-terminus of this base sequence : 59689534
  Distance between 3'-terminus of neighbour sequence of sequence listing upward to telomere on chrosomal short arm and 5'-terminus of this base sequence : 118687
gtccagcctaagaaatagaactttcctgctgatgaagtcctgcctctttctcccatctccctttggagccaactgtggtcctgaattatatcattccccttgagctctttattagttttgtcacacacatacatgtgtgtatacatcatgtatatgcacatatgtatgtgtatatccttaatgacaggctgatgcatctggcatgtttttgaactttatgtaaatgaaatatttctcacacacacacacacacacacacacttctgtgacttgcttttgtggcttctgttgcttcgtgattcttccatgttgaagtgcacagctatagct

SEQ ID NO: 22187 - DNA, 243 bp, Homo sapiens
  AC004382.1_83292
  Located on chromosome 16
  Distance between a terminus base of telomere on chromosomal short arm and 5'-terminus of this base sequence : 59698614
  Distance between 3'-terminus of neighbour sequence of sequence listing upward to telomere on chrosomal short arm and 5'-terminus of this base sequence : 8750
taggttagacagtcaaaaccgtacaagtgggaatgtaccagtaaatatctgttaatgtctgcatacctcacagctgggtcaattcaggcatttaaaaatagggataggaaggatgaggatggagctgtgtgtgtgtgtgtgtgtgtgtgtgcgtgcgcgtgcgtgcacgcgtgtgcttgtacacaattttctagtcagaagaaatatagttttataagtgtcttagcatcctcaaagtaagaa

SEQ ID NO: 22188 - DNA, 201 bp, Homo sapiens
  D16S3057
  Located on chromosome 16
  Distance between a terminus base of telomere on chromosomal short arm and 5'-terminus of this base sequence : 59760809
  Distance between 3'-terminus of neighbour sequence of sequence listing upward to telomere on chrosomal short arm and 5'-terminus of this base sequence : 61952
tgcccttgaactaggcaataagcaataatatccattaaatcacaggtccgatggtgctagtttgtgtgtgtgtgtgtgtgtgtgtgtgtgtgtgtgtgtatgtatatgtataaatagttttgttgaagtatacgacatgcagtaaacttcacgtatttaaaatgtacaatctgatgaattttgacatagttatacacacag

SEQ ID NO: 22189 - DNA, 228 bp, Homo sapiens
  AC004382.1_145424
  Located on chromosome 16
  Distance between a terminus base of telomere on chromosomal short arm and 5'-terminus of this base sequence : 59760813
  Distance between 3'-terminus of neighbour sequence of sequence listing upward to telomere on chrosomal short arm and 5'-terminus of this base sequence : -197
cttgaactaggcaataagcaataatatccattaaatcacaggtccgatggtgctagtttgtgtgtgtgtgtgtgtgtgtgtgtgtgtgtgtgtgtatgtatatgtataaatagttttgttgaagtatacgacatgcagtaaacttcacgtatttaaaatgtacaatctgatgaattttgacatagttatacacacaggaaactaagaacacaatcaagttagtgcata

SEQ ID NO: 22190 - DNA, 277 bp, Homo sapiens
  AC004382.1_170302
  Located on chromosome 16
  Distance between a terminus base of telomere on chromosomal short arm and 5'-terminus of this base sequence : 59785624
  Distance between 3'-terminus of neighbour sequence of sequence listing upward to telomere on chrosomal short arm and 5'-terminus of this base sequence : 24583
ttgactccttcataaattatgaatctgcctggtgactgtcggtctcccatgcccacagcccccacaaagtgagctcctgaaggcagggaccttgcctgcccagcactcagaacaactcagaaaaaataacataacataacataacataacataacataacataacataacataacataacataaataaaataaaataaataaaataaaataaaataaataaaaataaataaaattaaaataaaataaagccaggcactgtggcttacacctgtaatc

SEQ ID NO: 22191 - DNA, 441 bp, Homo sapiens
  AC018552.4_30218
  Located on chromosome 16
  Distance between a terminus base of telomere on chromosomal short arm and 5'-terminus of this base sequence : 59895007
  Distance between 3'-terminus of neighbour sequence of sequence listing upward to telomere on chrosomal short arm and 5'-terminus of this base sequence : 109106
attcatctgactatccatctgtccattgtcctccaccggtcatccatccgtccagcctccatccattcatccgtccatctatccattgtaatgtgtgcgtgtccatctgtccatctatccatccatccctccatccatccatcctttcttcctccttcatccactcatctgtccattctaatgtctgtgggctcttctcttcatccatccattcatccatccatccatccatccatccatccatccatccaatgttcaaacacctgtccatctactctctgtctatccaacatgcagtgagaccttctgttgagccaggacttgctcagctccagggtaccctatgaaggaaggagacccagttcccgtttctgccacttcactcccccacctttggctcaccatttgctggggagtggagaagtatcaggcagtgataac

SEQ ID NO: 22192 - DNA, 211 bp, Homo sapiens
  chr16.fa.O7frz.68187925
  Located on chromosome 16
  Distance between a terminus base of telomere on chromosomal short arm and 5'-terminus of this base sequence : 60011507
  Distance between 3'-terminus of neighbour sequence of sequence listing upward to telomere on chrosomal short arm and 5'-terminus of this base sequence : 116059
tcactatttctccttcatgactatcacaggcccacctctgcagcctctgcagtgctctttcctgggaatacttcttgccacttagcacacatttgtagacacgcaagcgtacacacacacacacacacacacacacacacggtttcttctccttcctggcccagcaaactgttaaagtcaacatatgaggccctccgatgacaagatctga

SEQ ID NO: 22193 - DNA, 425 bp, Homo sapiens
  chr16.fa.O7frz.68707661
  Located on chromosome 16
  Distance between a terminus base of telomere on chromosomal short arm and 5'-terminus of this base sequence : 60152577
  Distance between 3'-terminus of neighbour sequence of sequence listing upward to telomere on chrosomal short arm and 5'-terminus of this base sequence : 140859
tagattaagtccagatgccagatgaatttgtgtgtgtgtgtgtgtgtgtgtgtgtgtgtgtgtgtgtgtgtgagaccgagtctcactctgttgcccaggctggaatgcagtggcacaatctcagctcgctgcaacctctgcctccgagattcaagcaattcttgtgcctcagcctcccaagtagctggggacacaggcgcaccccaccacatctggctaatttttgtatttttgatagagatggggtttcaccatgttggccaggtgtgtcttgaaatcctgacctcaagtgatccacctgccgcagccttctaaagtactggcattacaggcgtgggccaccatgcttggcctggatgccagaagagttatttgcaaaacaatttttaaatacttttaaatactttgtaaagaagccaaagttt

SEQ ID NO: 22194 - DNA, 433 bp, Homo sapiens
  AC012182.4_109778
  Located on chromosome 16
  Distance between a terminus base of telomere on chromosomal short arm and 5'-terminus of this base sequence : 60266356
  Distance between 3'-terminus of neighbour sequence of sequence listing upward to telomere on chrosomal short arm and 5'-terminus of this base sequence : 113354
aggctggtgagtcctctaggtgccctcatcctaaattgctttagtggtcccaggaatcagctgcatatgtctcagaaggaagtagaggaccaaaagacacagagagagagctgcagcaaggaatgaatgaatgaatgaatgaatgaatgaatgaatgagtgaatgaagtgtgtgattatatatacgtgtgttcattcatgcattcatttgtcccatgtgtgctgagtcctcactctgtggcaggtgctgtgctgggcaccaagggttcagtagtgaccaggacaaaagcccctgccctcaaggagccagcagtctaatgaatgaatgagtgaaggaacgaatgaatggggtgaatggaaatgaatgcatgtctctggatttccagcagaaactacaaactgggagcttcaagcttactttggaagtctacagt

SEQ ID NO: 22195 - DNA, 169 bp, Homo sapiens
  HUMUT5103
  Located on chromosome 16
  Distance between a terminus base of telomere on chromosomal short arm and 5'-terminus of this base sequence : 60266417
  Distance between 3'-terminus of neighbour sequence of sequence listing upward to telomere on chrosomal short arm and 5'-terminus of this base sequence : -372
tgcatatgtctcagaaggaagtagaggaccaaaagacacagagagagagctgcagcaaggaatgaatgaatgaatgaatgaatgaatgaatgaatgagtgaatgaagtgtgtgattatatatacgtgtgttcattcatgcattcatttgtcccatgtgtgctgagtcct

SEQ ID NO: 22196 - DNA, 438 bp, Homo sapiens
  chr16.fa.O7frz.68520381
  Located on chromosome 16
  Distance between a terminus base of telomere on chromosomal short arm and 5'-terminus of this base sequence : 60303846
  Distance between 3'-terminus of neighbour sequence of sequence listing upward to telomere on chrosomal short arm and 5'-terminus of this base sequence : 37260
atttaggacaactacgtggaaccaaggaccatttcaaaaactctcacctatgagggactgaccacaccccttcaactatccctgaccacaggcccattctctctccgcgtgacaggatgggtggccctacaggaaccagagcccataggtgatgggggctagatgagagggccacagaaccacccaggcttgatgtccacacagcagaacttcctcactctggttctctcccagaactcacacacacacacacacacacacacacacacacaaagtcctaaatcctctgaatctcatagtgtcaaggcctgcaggaaaatgtaagaaactgccctggtctgccttggcaatgcaggatgcagcatgctaaccacagagcatttctcatcacctctctagagacaactccattcccttactccaagcctataaagttct

SEQ ID NO: 22197 - DNA, 460 bp, Homo sapiens
  chr16.fa.O7frz.68950393
  Located on chromosome 16
  Distance between a terminus base of telomere on chromosomal short arm and 5'-terminus of this base sequence : 60533789
  Distance between 3'-terminus of neighbour sequence of sequence listing upward to telomere on chrosomal short arm and 5'-terminus of this base sequence : 229505
tcatctttctgagctgtagaaggaagaggtgagtgaggcccttcacgatgttgattttcagcagttgaagatagagaacgctcaatttcttgagacaattgaagcaaggaatcaagaactgacccagctaaagctgtcatctggaaacactctgcaggttctcaatgcctacaaagtaaggccatccctgatacccagggctcccccaaggctttccacactcacctttctggccacagggaggttcttgtgcattccagtttcacacagcgtttgggtgccccctcgctgtcaagccatgtgtcctaaaattccctgaatgctcccacaaccctggctgtgcatgagaaccagagtttttctttaaaaaacaaacaaacatatagatagatgataggtagatagatagatagatagatagatagatagatagatagatagacagatgcttagtctcacc

SEQ ID NO: 22198 - DNA, 217 bp, Homo sapiens
  D16S3038
  Located on chromosome 16
  Distance between a terminus base of telomere on chromosomal short arm and 5'-terminus of this base sequence : 60656873
  Distance between 3'-terminus of neighbour sequence of sequence listing upward to telomere on chrosomal short arm and 5'-terminus of this base sequence : 122624
agccctgcctgatgaagttgaattaacaggtacctctcttataatgatgcaatcgctacttctttgcaagttaagagggacacacacacacacacacacacacacacacgcacatacacacacatgcaatatctctcaatatataagatgggttaacaattcctgttagtgctgctgaagactgtgggaagaatctaaaattggtgctacccacaca

SEQ ID NO: 22199 - DNA, 290 bp, Homo sapiens
  chr16.fa.O7frz.69254741
  Located on chromosome 16
  Distance between a terminus base of telomere on chromosomal short arm and 5'-terminus of this base sequence : 60810295
  Distance between 3'-terminus of neighbour sequence of sequence listing upward to telomere on chrosomal short arm and 5'-terminus of this base sequence : 153205
agtgagcacctgtaataccagctactcgagaaggtgatgtgggaggttcacttaagcccatgatcacatcactgcactcaagcctgacagagagagaccctgtctcttacacacacacacacacacacacacacacacacacagacacacacacacagacacacacacccctctaaagggctaccttttaaagtttcttcaaatcacatttccagaatatctttaagaaaaaaaatgaagatttccaagtttaccattcaaaactgccatgactacattctacgttggaa

SEQ ID NO: 22200 - DNA, 455 bp, Homo sapiens
  chr16.fa.O7frz.69472097
  Located on chromosome 16
  Distance between a terminus base of telomere on chromosomal short arm and 5'-terminus of this base sequence : 61135751
  Distance between 3'-terminus of neighbour sequence of sequence listing upward to telomere on chrosomal short arm and 5'-terminus of this base sequence : 325166
gagtcttccaggattacgttagccccagaaaaggcttattgtgcttattgggaccatgcccacctcacataaacatctttcagacttttataaacatctggggcctcttcagaaagactgctaaagcttcgatctttcgttccttctcagaaaaggaatctctttgcgttctttgacatggcctaccaaggctttgccagtggtgatggtgataaggatgcctgggctgtgcgccacttcatcgaacagggcattaatgtttgcctctgccaatcatatgccaagaacatgggcttatatggtaagctacagcatccagcatgacacatgctctcatgctgggagagaatgccacgagggcatagagcttgtgggtgtgtgtgtgtgtgtgtgtgtgtgtgtgtccatccatgtccatgtccctccctaccctaagatgaaagaccagtatcgta

SEQ ID NO: 22201 - DNA, 179 bp, Homo sapiens
  D16S494
  Located on chromosome 16
  Distance between a terminus base of telomere on chromosomal short arm and 5'-terminus of this base sequence : 61236422
  Distance between 3'-terminus of neighbour sequence of sequence listing upward to telomere on chrosomal short arm and 5'-terminus of this base sequence : 100216
tgctacctgattgtatgacctttggtaaaatgctcgctgagtttaagccttactacctgtaaaatgggaataatgtgtacctttaggaagattaaattaaatctatatatgtacacacacacacacacacacacacacacacacacatacataacatctgttacatggcagacactgcg

SEQ ID NO: 22202 - DNA, 204 bp, Homo sapiens
  HUMUT746
  Located on chromosome 16
  Distance between a terminus base of telomere on chromosomal short arm and 5'-terminus of this base sequence : 61343471
  Distance between 3'-terminus of neighbour sequence of sequence listing upward to telomere on chrosomal short arm and 5'-terminus of this base sequence : 106870
tttgatgggaatagaaaagccacactcagaaagatgagaaaaaaaaaaaggacctgcctttatccaccctacctgtattgagtagtttcagctatttaaccgtcattcctctctctccattttacttatctatctatctatctatctatctatctatctatctatctatctatctatttatagacagagtctctccttgttgcc

SEQ ID NO: 22203 - DNA, 147 bp, Homo sapiens
  DISO7_10006408
  Located on chromosome 16
  Distance between a terminus base of telomere on chromosomal short arm and 5'-terminus of this base sequence : 61365504
  Distance between 3'-terminus of neighbour sequence of sequence listing upward to telomere on chrosomal short arm and 5'-terminus of this base sequence : 21829
agttactgggtgaatccagagtttattttttggggatgtgggggcagaaaacagattagaagtgtgtgtgtgtgttgtgtgtgtgtgtgtgtgtgtgtgtgtgtgtgtgcgcgcgcgcgcacgcatgcacgtgttgctggcagtaaa

SEQ ID NO: 22204 - DNA, 459 bp, Homo sapiens
  AC040172.4_121943
  Located on chromosome 16
  Distance between a terminus base of telomere on chromosomal short arm and 5'-terminus of this base sequence : 61529657
  Distance between 3'-terminus of neighbour sequence of sequence listing upward to telomere on chrosomal short arm and 5'-terminus of this base sequence : 164006
cgcaggaacctaatcttgtatttcccttaggagcaatcatttagtatttgctaattcagtgtttgggtcaattttgtagaacataactactgtgaataacaagaatcaattctgtgtatgtgtgtctatgtaattttatctaatttaaatattaatacaatttacatatgcaatttagaaatacacacacacacacacacacacacaccccgttacatgtattcatttttttctctcccattctttttctctaattttcctggttcatatacaacacaatgacttatatttagttcctcaattactgaatattgaaatgtgaatataagtccttagagtggctttttttttcttctgcagaaactgcagaagaatatcctatccaaaaatttaaactcccttaagtaacaacaaaaacaatgatgataataacaatagtaaattgcaagcttttgacag

SEQ ID NO: 22205 - DNA, 344 bp, Homo sapiens
  AC040172.4_77448
  Located on chromosome 16
  Distance between a terminus base of telomere on chromosomal short arm and 5'-terminus of this base sequence : 61574259
  Distance between 3'-terminus of neighbour sequence of sequence listing upward to telomere on chrosomal short arm and 5'-terminus of this base sequence : 44143
aaactattcctcatctcctgatagtatttgtgatgtgaaaacctgggttttcatcttgcccttcttgtctgttggggtgtctgtctgtctgtctgtctgtctctctctctctctctctctctgtgtgtgtgtgtgtgtgtgtgtaatatctacaggttggcttctctgggaaacaagacaagacagagtaaggagtgcaaaaagtatactgggagtaacacctggggatctccagaacggatatgagaactggctaagcccaaggctatttaccatactgccttgccaggtcttggccagggaatgcttgagaagaaaataacttaggctgtaaagctcacata

SEQ ID NO: 22206 - DNA, 247 bp, Homo sapiens
  AC040172.4_12678
  Located on chromosome 16
  Distance between a terminus base of telomere on chromosomal short arm and 5'-terminus of this base sequence : 61639050
  Distance between 3'-terminus of neighbour sequence of sequence listing upward to telomere on chrosomal short arm and 5'-terminus of this base sequence : 64447
agcactttaatctgtaatcagcactttattttgttttatacacacacagacacacacacacacacacacacacacacacacaagttctgctataaatgtctattttaaaatgtgaatttgttccaacatcattgatatattagggaacaatttgagcaagatgtgaaatttgtgtttgcttatgttcaatttcatccctgagaaacactagttgaattcaggaaactacactgagctgacctgagtc

SEQ ID NO: 22207 - DNA, 308 bp, Homo sapiens
  AC040172.4_9836
  Located on chromosome 16
  Distance between a terminus base of telomere on chromosomal short arm and 5'-terminus of this base sequence : 61641870
  Distance between 3'-terminus of neighbour sequence of sequence listing upward to telomere on chrosomal short arm and 5'-terminus of this base sequence : 2573
gtttgccgtagaatgctattagcatataatgaaatggtgaatgccaataggatacggggtgtgtgtgtgtgtgtgtgtgtgtgtgtgtgtgtgtgtgtgtgtgtagggagcagacaccagcacctgctactcctctattgacttcattgccaaggaaaaatactgcagttatacacttctttgcagcacttaccacattggtcattttacatttatttatgatgtgctgcagttagctggcactggtttgcaaaagcccattgttctaagaatttattaacattatgttgacagcttagaataggcct

SEQ ID NO: 22208 - DNA, 386 bp, Homo sapiens
  AC040171.3_90519
  Located on chromosome 16
  Distance between a terminus base of telomere on chromosomal short arm and 5'-terminus of this base sequence : 61809896
  Distance between 3'-terminus of neighbour sequence of sequence listing upward to telomere on chrosomal short arm and 5'-terminus of this base sequence : 167718
ctcctatttagataagccagcttagtgtttatggttggctagatacttttaaggatcttacactgggtcctattatatacatgttaacatgccacccttcattcttagtgtgtgtgtgtgtgtgtgtgtttatatctatatatctatatagatagatataaataaaacatcaatatagaatatatattatatatattcttcgtgtgtgtatatataacattaatatataatatatataattaatgttactgatcacattgctttgtttataatgttcatctgcttatattaagtatttttttatccttacgcacattttgaaaaggactgtggctgaaaccatcataataaaacatatccctctttgttcaaagaccagcttatgt

SEQ ID NO: 22209 - DNA, 278 bp, Homo sapiens
  AC040171.3_53831
  Located on chromosome 16
  Distance between a terminus base of telomere on chromosomal short arm and 5'-terminus of this base sequence : 61846488
  Distance between 3'-terminus of neighbour sequence of sequence listing upward to telomere on chrosomal short arm and 5'-terminus of this base sequence : 36206
gaagaacgtggaaagactagactggcttagcctcccagcctacacctttctctggtgctggatgcttcctgcccttgaatatcagactccaagttcagctttgggactcagactggcttccttgctcctcagcttgcagacagcctattgtgggacttcaccttgtgatcatgtgagtcaatactccttaataaactcagatagatagatagatagatagatagaacctattagttctgtccctctagggaactctgactaatacagtgacctaaacc

SEQ ID NO: 22210 - DNA, 338 bp, Homo sapiens
  AC040171.3_53712
  Located on chromosome 16
  Distance between a terminus base of telomere on chromosomal short arm and 5'-terminus of this base sequence : 61846654
  Distance between 3'-terminus of neighbour sequence of sequence listing upward to telomere on chrosomal short arm and 5'-terminus of this base sequence : -112
gatcatgtgagtcaatactccttaataaactcagatagatagatagatagatagatagaacctattagttctgtccctctagggaactctgactaatacagtgacctaaacctcctgcacacaacacacagacacacacacacacacacagacacacacacacacacacacacacacagacaggtatttaaaacatactaaacctatgaaatataaattgtcccagtcagtattttagtcttgagtgaacataaagaaaagaaatttttaagaactgtcacaaaaaagaagaatgaaaagaaaaaataaaggctatcaaggtatttcacgtcttaact

SEQ ID NO: 22211 - DNA, 169 bp, Homo sapiens
  D16S3094
  Located on chromosome 16
  Distance between a terminus base of telomere on chromosomal short arm and 5'-terminus of this base sequence : 61846729
  Distance between 3'-terminus of neighbour sequence of sequence listing upward to telomere on chrosomal short arm and 5'-terminus of this base sequence : -263
cctctagggaactctgactaatacagtgacctaaacctcctgcacacaacacacagacacacacacacacacacagacacacacacacacacacacacacacagacaggtatttaaaacatactaaacctatgaaatataaattgtcccagtcagtattttagtcttga

SEQ ID NO: 22212 - DNA, 375 bp, Homo sapiens
  chr16.fa.O7frz.70089213
  Located on chromosome 16
  Distance between a terminus base of telomere on chromosomal short arm and 5'-terminus of this base sequence : 61923012
  Distance between 3'-terminus of neighbour sequence of sequence listing upward to telomere on chrosomal short arm and 5'-terminus of this base sequence : 76114
taaatgcatatgcctgagatacacacacacacacacacacacacacacacacacacatatgctctctctctcttatggacacaaacatatatgttttttatatatatatatatatgattttttccattatcagagattgcaataacaatataggtatttatgcatattcttataagcatagaggaatgtatagaaggaactttctaaaaccggattagctgtaacatctctggcatttatacatagatagttctttccagtcctagagaaaaaaaactgaatctcaaagtggttatgaacattttccaaagtaataaaatgggaaagaagaggagatggagctaaaatacagtttgaactacactgcttcctata

SEQ ID NO: 22213 - DNA, 322 bp, Homo sapiens
  chr16.fa.O7frz.69993153
  Located on chromosome 16
  Distance between a terminus base of telomere on chromosomal short arm and 5'-terminus of this base sequence : 62061916
  Distance between 3'-terminus of neighbour sequence of sequence listing upward to telomere on chrosomal short arm and 5'-terminus of this base sequence : 138529
cattatgaaagtcaagattaaggttacctataaaaatgagctggagcaatgggggagggcttttaaagtcctgggaatactttacgtctttaattggcaggagatttatgtggatatttcctttatgattattaaatactcatactttctttagtgtgtgtgtgtgtgtgtgtgtgtgtgtttcaaataatcactcctctttaggtagatgttcatgggacataatcaggaaagctgttttcattgatatttcccaaggtcagccttattatcttcccagggacttcccaccactcccctggtaaacttaccatatctcctt

SEQ ID NO: 22214 - DNA, 230 bp, Homo sapiens
  AC009069.3_72124
  Located on chromosome 16
  Distance between a terminus base of telomere on chromosomal short arm and 5'-terminus of this base sequence : 62220082
  Distance between 3'-terminus of neighbour sequence of sequence listing upward to telomere on chrosomal short arm and 5'-terminus of this base sequence : 157844
ttcttaatttagcacagaagtccttccatgatatatcactgcacagctctctgatcttactttcagctactatccagttctaaattacttttacagttgctgaaatttcaagctgatagaccatttccaactacttccttttgtgggcattagaaatatttattccatctctctttctctctctctctctctctctctctctctctctttctgctaaagcctacttatcc

SEQ ID NO: 22215 - DNA, 282 bp, Homo sapiens
  AC009069.3_78229
  Located on chromosome 16
  Distance between a terminus base of telomere on chromosomal short arm and 5'-terminus of this base sequence : 62226297
  Distance between 3'-terminus of neighbour sequence of sequence listing upward to telomere on chrosomal short arm and 5'-terminus of this base sequence : 5985
gtggaatagcaacaccaactacatccagcttctgtgtctgtctccccactggacacacagacatgcacacacacacacacacacacacacacacgcagcttgaaataaacacatattccagctcttgtttttagttacctctttgtttctatcaacttgggggctctcttttttctcataagcttagctatttattataaatgcttttcaaatagtttatccagtattttaacatacttacagtgatagtgttaaatatttcttagtctgccatcttgctac

SEQ ID NO: 22216 - DNA, 251 bp, Homo sapiens
  AC009069.3_115370
  Located on chromosome 16
  Distance between a terminus base of telomere on chromosomal short arm and 5'-terminus of this base sequence : 62263366
  Distance between 3'-terminus of neighbour sequence of sequence listing upward to telomere on chrosomal short arm and 5'-terminus of this base sequence : 36787
gagcacttaatgcctcaattagatttcatctaggaaagataatataattatgacctatatactttgaaaaaatctttgagaaaatgagcaacaaatggtggcatgttctctctctccctctctctctctctctctctcacacacacacacacacacacacacacataaataaatctacaataaaattaaatttcttggaagaaaagttttcaattacacagttcctacagtatggacaaggctgagtttag

SEQ ID NO: 22217 - DNA, 465 bp, Homo sapiens
  AC009069.3_117414
  Located on chromosome 16
  Distance between a terminus base of telomere on chromosomal short arm and 5'-terminus of this base sequence : 62265302
  Distance between 3'-terminus of neighbour sequence of sequence listing upward to telomere on chrosomal short arm and 5'-terminus of this base sequence : 1685
agtgaatcacttcaaattgcacaagaatagctctgctgtgtgaagtaatacaacagtttactcttgtgccattcaatcataatatgaaatagaacatgctattcctctctgaacatgtaacaactagtgcagtcatctgaaaaggcaggtaactccagatcaataaggctggactgtggcctctatgaaaaaagtaatagatagagagacaaagagggagaaagagagtgtgtgtgtatgtgtgcgtgtgtgtgtgtgtgtgtgtgtgtcaatcagaagagagactaattagcctggttcataggaattgatttggggtggagaaggggcaggaaagtgatggtgacagtgcccttcgaaacaacattctttgaaggttgtgaattgattcaaggacaaacctgtcaggttctagtactttcaatcactcaaaacaacaacaactaaatatcattgtcctggtgc

SEQ ID NO: 22218 - DNA, 235 bp, Homo sapiens
  D16S3132
  Located on chromosome 16
  Distance between a terminus base of telomere on chromosomal short arm and 5'-terminus of this base sequence : 62521667
  Distance between 3'-terminus of neighbour sequence of sequence listing upward to telomere on chrosomal short arm and 5'-terminus of this base sequence : 255900
atgctttgtgggctgttaatggttcattctttggatactcccttatgtacacacacacacacacacacacacacacacacacacacacacacgtatatatcatagtacacataattttgttaaaattttttccaaagatgatttttatatctttaatataattgtagattttgtctaaaaaataatacaagaatttttatctaaacattttttactccaaatacattaaccaaga

SEQ ID NO: 22219 - DNA, 348 bp, Homo sapiens
  chr16.fa.O7frz.70978687
  Located on chromosome 16
  Distance between a terminus base of telomere on chromosomal short arm and 5'-terminus of this base sequence : 62601178
  Distance between 3'-terminus of neighbour sequence of sequence listing upward to telomere on chrosomal short arm and 5'-terminus of this base sequence : 79276
agatcatgaggtcagattgagaccatcatggctaacacagtgaaacctcgtgtctaatacaaatgcaaaagattacctgggtgtggtggcatgtgcctgtagtcccagctacttgggaggctgaggcaggagaatcgcttgaaccttggaggcagaggttgcagtgagccgagatcacaccacagcactccagcctgggtggcagagcaagactccaagaaagagaaaggaagaaagagaaagaaaaaaagaaaagaaaagaaagagggagggaggaagggagggaaggagggaaggaaggaaggaaggaaggaaggaagaaaggaaataaagtcaaacctcaagact

SEQ ID NO: 22220 - DNA, 185 bp, Homo sapiens
  HUMUT7686
  Located on chromosome 16
  Distance between a terminus base of telomere on chromosomal short arm and 5'-terminus of this base sequence : 62682751
  Distance between 3'-terminus of neighbour sequence of sequence listing upward to telomere on chrosomal short arm and 5'-terminus of this base sequence : 81225
gatttgccaagtaatttgaacatccaaaggatgtttggaccctgttcttataataaggaccagtaactttattttatctatctatctatctatctatctatctatctatctatctatctatctatctatctgagaaagagagcctggagaatgtgaatgtctaatggtcaagggtggagatgaaa

SEQ ID NO: 22221 - DNA, 433 bp, Homo sapiens
  chr16.fa.O7frz.71096396
  Located on chromosome 16
  Distance between a terminus base of telomere on chromosomal short arm and 5'-terminus of this base sequence : 62718852
  Distance between 3'-terminus of neighbour sequence of sequence listing upward to telomere on chrosomal short arm and 5'-terminus of this base sequence : 35916
  misc_feature (1)...(433): n = A,T,G or C
ccactaagtctttgagataaacaggaaacaatgttctgcaacctgtatttcagtcctgatgtgcagatgtatatattgtctaccacctcagttccttaaatacatagattctcaccatataccgattgccgtcaatatggtttcccatcaaagcagcaccatgaatggtatttatgttctttgccaatgttgctctattttatttatagctgaatagtatagaatcttttaaatataagttagcttcattatatatctgtatctatatatgtgtgtatatatatgtgtgtatatatatgtgtgtgtatatatatgtgggtggganaaaatacacacacacacacacacacacacacacacacagatatctcaaaattgtgaggttcttctgacccatctgaaggctggactccaattaggtacagagtaatca

SEQ ID NO: 22222 - DNA, 463 bp, Homo sapiens
  chr16.fa.O7frz.71208162
  Located on chromosome 16
  Distance between a terminus base of telomere on chromosomal short arm and 5'-terminus of this base sequence : 62830598
  Distance between 3'-terminus of neighbour sequence of sequence listing upward to telomere on chrosomal short arm and 5'-terminus of this base sequence : 111313
caattaccttgtgctgaattaccacatcttctaaatctattagcttatctctaattgttttactctgcattttcatcttcctttaccatgattatttcagtgtcagtaattcaggtttaaaatctatattctgttttattcatatttttcaatttactagttgcataatgagaaagtttggtccctaaaatgttttcttctatctgcaatttattttatttatttatttatttatttatttatttatttatttttgagatgaagtctcgctctctcacccaggctgtagtgcagtggttcgatcttggctcactgcaacctctgcctcttgggttcaggcgatgttgctgcctcagcctcccgggtagctgggattacaggcgtaaaccactgagcccagcctactccagattattttctttctttcgccaagcaccggttgttgaagatgaggttattcctc

SEQ ID NO: 22223 - DNA, 192 bp, Homo sapiens
  D16S3089
  Located on chromosome 16
  Distance between a terminus base of telomere on chromosomal short arm and 5'-terminus of this base sequence : 62867943
  Distance between 3'-terminus of neighbour sequence of sequence listing upward to telomere on chrosomal short arm and 5'-terminus of this base sequence : 36882
tgtggtattttcaaattaacctggatatcagaatggaacaacactacacacacacacacacacacacacacacacacacacacacacacacacacccctcacaaaatacattcctccttgttactctgtattttgtgaagatatcatatgttttacttcttctttaaacaatggaaacaaacgaagcgtact

SEQ ID NO: 22224 - DNA, 241 bp, Homo sapiens
  DISD22_0010279
  Located on chromosome 16
  Distance between a terminus base of telomere on chromosomal short arm and 5'-terminus of this base sequence : 63057956
  Distance between 3'-terminus of neighbour sequence of sequence listing upward to telomere on chrosomal short arm and 5'-terminus of this base sequence : 189821
gagcaatgtgctgaaggaggacacacacacacacacacacacacacacacggcaacctaaaattctatggctagaaacaatattttcaaaaataaagataaagtaaaacattgtagacctttaaaaattaaaataattatcaccagtagttttgcagtgcaagaagaaatttaagtagaaggacaaaatacatggaaatctgaatatacacaaataagagaacattggaaatgattaccac

SEQ ID NO: 22225 - DNA, 324 bp, Homo sapiens
  chr16.fa.O7frz.71680217
  Located on chromosome 16
  Distance between a terminus base of telomere on chromosomal short arm and 5'-terminus of this base sequence : 63289910
  Distance between 3'-terminus of neighbour sequence of sequence listing upward to telomere on chrosomal short arm and 5'-terminus of this base sequence : 231713
cactggatcctattcctcttactaattaaaaataaaaattaaatatctggacaacacacaagccaaccagttgaaaatcctgaaggaggtagatttggaaaggaagtaaaaatttccagaagtagcacaaacagagagattgttcatttatttatttatttatttatttatttatttatttattatttctcacaaaactctgaccggaagttgggaaaggaatcatgctgttagaatatgtgggcatcaacatttcagggataaatctccatctttctggccagaggcccaggaaaatgggcctgtgaaagatacagagcttga

SEQ ID NO: 22226 - DNA, 349 bp, Homo sapiens
  chr16.fa.O7frz.71813273
  Located on chromosome 16
  Distance between a terminus base of telomere on chromosomal short arm and 5'-terminus of this base sequence : 63423000
  Distance between 3'-terminus of neighbour sequence of sequence listing upward to telomere on chrosomal short arm and 5'-terminus of this base sequence : 132766
ccaccttcagaacattactatagatgtctcttcatgtggcttcaagttaaaagcccagtgaaggctgtttaagtttcaaagattaaatgcaaaaccttctccattaagaaatacacacacacacacacacacacacacacacacacacacacacataaatattactgggtttccattttttcttgtcatctttctactgccatctccatccgctacttcttgtagctcccctttttaatcctaaaatttatcttgaagcttgccttggcttttttcctctgagtcttcctagagcctccaaattctctgtgacacatttttatacaatatggtacatgcatttacattt

SEQ ID NO: 22227 - DNA, 144 bp, Homo sapiens
  DISO7_10004156
  Located on chromosome 16
  Distance between a terminus base of telomere on chromosomal short arm and 5'-terminus of this base sequence : 63712766
  Distance between 3'-terminus of neighbour sequence of sequence listing upward to telomere on chrosomal short arm and 5'-terminus of this base sequence : 289417
cacattataaggcaatgaggcatacacacacacacacacacacacacacacacacacctcaccacatatatattgttatttaaaggaactgaatatatctttggaaagccaataaaatttgggctggaggcaagtgaatgtatc

SEQ ID NO: 22228 - DNA, 107 bp, Homo sapiens
  DISO7_10004163
  Located on chromosome 16
  Distance between a terminus base of telomere on chromosomal short arm and 5'-terminus of this base sequence : 63826782
  Distance between 3'-terminus of neighbour sequence of sequence listing upward to telomere on chrosomal short arm and 5'-terminus of this base sequence : 113872
tccaaatctcatcctagactatctctctagcttcatgttttatgattctaaattgaacacacacacacacacacacaaatacacacaccctcacactcttgcctatt

SEQ ID NO: 22229 - DNA, 252 bp, Homo sapiens
  chr16.fa.O7frz.72464015
  Located on chromosome 16
  Distance between a terminus base of telomere on chromosomal short arm and 5'-terminus of this base sequence : 63963928
  Distance between 3'-terminus of neighbour sequence of sequence listing upward to telomere on chrosomal short arm and 5'-terminus of this base sequence : 137039
cgtatggtgctatcctcacacatgtgttctgggagtagtgaggcaatgcggtttgtgtgtgtgtgtgtgtgtgcaccattgtcagttgtgcagtggagtccacatgcacatgtatgctgtcaaaacattgtgggtaggctgtgggcaggtgcacaccagcaaagcactgggaagtcactgcaggcaggtgtgtgccagtggggacccatctgcagaagttctctgaaggttagacatggtatgctagtgaag

SEQ ID NO: 22230 - DNA, 402 bp, Homo sapiens
  chr16.fa.O7frz.72340508
  Located on chromosome 16
  Distance between a terminus base of telomere on chromosomal short arm and 5'-terminus of this base sequence : 63973676
  Distance between 3'-terminus of neighbour sequence of sequence listing upward to telomere on chrosomal short arm and 5'-terminus of this base sequence : 9496
ggagtacaatgttatttaatggacataatacatagtggttttgtatttccatttgtagtgacattggaaaaccaagtagaaacaattagcaaactgtgtgtaacctatttaaacattcactaaaatgaggcttgtaaattttaatagcgaggttttcaaggtctatcttgggttatctattcttacagagaaatgtcctacttatattaccatatttttttttcctataaaggttagcctggcaaaagcagaaaggagaaacacaccacacacacacacacacacacacacacacacacacacacacacaatcacctttgatacttgccagtgaaatatcttgacttgtcaacagagaggtagttttccccgatggcaaagacttcatgacaataaagtttg

SEQ ID NO: 22231 - DNA, 204 bp, Homo sapiens
  chr16.fa.O7frz.72639003
  Located on chromosome 16
  Distance between a terminus base of telomere on chromosomal short arm and 5'-terminus of this base sequence : 64266466
  Distance between 3'-terminus of neighbour sequence of sequence listing upward to telomere on chrosomal short arm and 5'-terminus of this base sequence : 292388
gattcttactcatgcatcagagactaactttggcttaaagaaaagtggtctccaatgttaattaacccccttctgtaagcttccaatcattttatatatatatatatatatatatatatatatgtaattaatatataaaattaattatgggaggtgggtggaaacttatgatgtttaactctctgttaagcaagaacattagat

SEQ ID NO: 22232 - DNA, 202 bp, Homo sapiens
  Z66800
  Located on chromosome 16
  Distance between a terminus base of telomere on chromosomal short arm and 5'-terminus of this base sequence : 64349238
  Distance between 3'-terminus of neighbour sequence of sequence listing upward to telomere on chrosomal short arm and 5'-terminus of this base sequence : 82568
ttaatagagtgattgcccaggattttcttgtttaaattaactaaagttagaaaacacacacacacacacacacacacacacacacacacacccctatgtatacgcaggcattttttaatgagaaattcaaatttattatgtttaagtgcatataatctttagatgcaaattaatgaactgttgctaggatgcaccccaactt

SEQ ID NO: 22233 - DNA, 476 bp, Homo sapiens
  chr16.fa.O7frz.72812005
  Located on chromosome 16
  Distance between a terminus base of telomere on chromosomal short arm and 5'-terminus of this base sequence : 64439180
  Distance between 3'-terminus of neighbour sequence of sequence listing upward to telomere on chrosomal short arm and 5'-terminus of this base sequence : 89740
gttaactcaagtcttgaagatcagcatttaattcccctcctatttttcttttaaatcattgcatttgggaagtgaataacattggcctgattcacttctaaagcttatcaagaaaatcagtcattggcaggctcataattggaattatacctacatgaagatgtgcatcaaaattaaaaggagcttatgaacagttctgaggaataaacacgtgtagtctccaataacccagtgtgattttggaaagcaggcagcccatgtctacacaaagaacatttgtctaacctgccaacaacagcaaaacaaatgtaagtccagtctaacacacacacgcgcgcgcgcacacacacacacacacacacacacactccactaaactaaaattttgattctgtacatttgatttcacctgacaatgaatgaactagtttcctattgcaaagtttttcaaatagtacaatgcacagttaagcatc

SEQ ID NO: 22234 - DNA, 121 bp, Homo sapiens
  D16S514
  Located on chromosome 16
  Distance between a terminus base of telomere on chromosomal short arm and 5'-terminus of this base sequence : 64652769
  Distance between 3'-terminus of neighbour sequence of sequence listing upward to telomere on chrosomal short arm and 5'-terminus of this base sequence : 213113
ctatccactcactttccaggacatcaattccttgatgctaccatcttctcgaatacacacacacacacacacacacacacacacacaaaggtgaataggaaagagaagatgatcagtggga

SEQ ID NO: 22235 - DNA, 164 bp, Homo sapiens
  DISO7_10006414
  Located on chromosome 16
  Distance between a terminus base of telomere on chromosomal short arm and 5'-terminus of this base sequence : 64748733
  Distance between 3'-terminus of neighbour sequence of sequence listing upward to telomere on chrosomal short arm and 5'-terminus of this base sequence : 95843
tggcctgcattaaacatgcacaaaatgtataataaaataaaaaaatctagcaaagatatactcaccatattatttttatttccctaaagatcatgctggtgtgtgtgtgtgtgtgtgtgtgtgtgtgtgtgtgtgtgtgcatgtgttgacatattacacttcaa

SEQ ID NO: 22236 - DNA, 249 bp, Homo sapiens
  D16S3143
  Located on chromosome 16
  Distance between a terminus base of telomere on chromosomal short arm and 5'-terminus of this base sequence : 64917954
  Distance between 3'-terminus of neighbour sequence of sequence listing upward to telomere on chrosomal short arm and 5'-terminus of this base sequence : 169057
agctactgaggaaaccttatccaccagtcacataattagcaataaaaacacacttactctggaaattccaagaattttttccaaaaaacaggaatgaagaccaaatatatatttcacgcaggtgcaaggtggatgcgcgcgcacacacacacacacacacacacacacacacacacacacacttttccttcctcaaagacgtatctcccatgtacaggttttcatttcaaaagcacttcctgtaatggc

SEQ ID NO: 22237 - DNA, 478 bp, Homo sapiens
  chr16.fa.O7frz.73209801
  Located on chromosome 16
  Distance between a terminus base of telomere on chromosomal short arm and 5'-terminus of this base sequence : 65062839
  Distance between 3'-terminus of neighbour sequence of sequence listing upward to telomere on chrosomal short arm and 5'-terminus of this base sequence : 144636
tgagacacctagaacaatttctacccagctaataactactgtttcacatgtattaagttacatgggcagttataaaccaagaagccatatttcttacaactgaataatttccatttcaatattgggcaaaattgtcatcattataaaattaggcctttaactattctaagattacatagaaatttcttatgttcattcctaaaatttctttttgaaattataacatttatctttcttatttataatgttagaagttactttttctatgtacctataagaagcatgagtactatagaaaaattaaaatgatgataaactgatagtaataataataataataataataataataataataatagttcccaaatctcacctacccagagatagttgtagctatttcatttcctttcagacatttcccatgcaaataaatacatatagagataaaacttaatctaaatgatagcaggttctt

SEQ ID NO: 22238 - DNA, 237 bp, Homo sapiens
  D16S739
  Located on chromosome 16
  Distance between a terminus base of telomere on chromosomal short arm and 5'-terminus of this base sequence : 65210082
  Distance between 3'-terminus of neighbour sequence of sequence listing upward to telomere on chrosomal short arm and 5'-terminus of this base sequence : 146765
tggtgaggtgaggtttgcttaacctctatcacctttctctaatagtacattatcaatatcaggacattaatactggcaaaatactaagaactagattacaaaacgtattcaggattcaccagtttttgcatgcattcacttctgtgtgtgtgtgtgtgtgtgtgtgtgtgtgtgtgtgtgtgtctgcagttctgtgaaatttttatcacatatttagatttgtgaaaacaccacctt

SEQ ID NO: 22239 - DNA, 210 bp, Homo sapiens
  D16S3129
  Located on chromosome 16
  Distance between a terminus base of telomere on chromosomal short arm and 5'-terminus of this base sequence : 65326769
  Distance between 3'-terminus of neighbour sequence of sequence listing upward to telomere on chrosomal short arm and 5'-terminus of this base sequence : 116450
tcacagattattgatgctctatttaataggtgtttgagggtatattatgaatgtcattcatagagagtagataccgatttaaggatatgttaaggagaaacatttctgagtcataagagtgtgtgtgtgtgtgtgtgtgtgtgtgtgtactcagctttgctctttgtgtgtgtatgtgtgtgtggagggggggagtgtgtgtattcagct

SEQ ID NO: 22240 - DNA, 91 bp, Homo sapiens
  D16S508
  Located on chromosome 16
  Distance between a terminus base of telomere on chromosomal short arm and 5'-terminus of this base sequence : 65414710
  Distance between 3'-terminus of neighbour sequence of sequence listing upward to telomere on chrosomal short arm and 5'-terminus of this base sequence : 87731
cctgtgggcactgataaatacatactatagtgtgtgtgtgtgtgtgtgtgtgtttacaataatgtatatgtgtgttagatttattttcctg

SEQ ID NO: 22241 - DNA, 260 bp, Homo sapiens
  AC004514.1_112808
  Located on chromosome 16
  Distance between a terminus base of telomere on chromosomal short arm and 5'-terminus of this base sequence : 65417257
  Distance between 3'-terminus of neighbour sequence of sequence listing upward to telomere on chrosomal short arm and 5'-terminus of this base sequence : 2456
agtatgatcctatgcaaaccacaatggaatgcattaaatataaaacccatcttccttgttctgttcacacacacacacacacacacacatacacacacacacacacactctctgaagtatgtaaacaagatgtcattttcattttattaatacacatactgaggcaaaggaagtaaagtgataatcatgatgatgataacactaatgaaaatctacagccataaaacacaaggtgccttaaacgaggaaagtgacctaac

SEQ ID NO: 22242 - DNA, 191 bp, Homo sapiens
  HUMUT5021
  Located on chromosome 16
  Distance between a terminus base of telomere on chromosomal short arm and 5'-terminus of this base sequence : 65448590
  Distance between 3'-terminus of neighbour sequence of sequence listing upward to telomere on chrosomal short arm and 5'-terminus of this base sequence : 31073
cacatctaaccctgctcatgtactttgaacttcacagtatatagatagatagatagatagatagatagatagatagatagatatgtgtgtgtgtgtgtgtatgtgtgtgtgtgtgtgtgtgtatatatatataataaaatttttttttttgagatggagtttcactcttgttgcccaggctagagtgcaat

SEQ ID NO: 22243 - DNA, 366 bp, Homo sapiens
  AC004513.1_82096
  Located on chromosome 16
  Distance between a terminus base of telomere on chromosomal short arm and 5'-terminus of this base sequence : 65511122
  Distance between 3'-terminus of neighbour sequence of sequence listing upward to telomere on chrosomal short arm and 5'-terminus of this base sequence : 62341
ccactattctaggaaatatgcaagtcatcacaatctcttctctggctttctccaattgacccttcctgtccaatcttccacccaaccaaatattctcctcacattaattcagtcatatcacactctttcttaaaactctccaaacccatctttcttacattagatccccaaatccttagaattctttttcaaataatgtcagaatagtctgtagcaaactattcatcttgcagatacacacacacacacacacacacacacacacacttaagacaccagataatggaaaaaagaaggaaaagattggaggtttgtcaaactttgaaaacaagaaaatgcactgtctgataattccacttacatgct

SEQ ID NO: 22244 - DNA, 455 bp, Homo sapiens
  chr16.fa.O7frz.74653698
  Located on chromosome 16
  Distance between a terminus base of telomere on chromosomal short arm and 5'-terminus of this base sequence : 65669193
  Distance between 3'-terminus of neighbour sequence of sequence listing upward to telomere on chrosomal short arm and 5'-terminus of this base sequence : 157705
cacaatgctgtttgaaatagtattttgggccaggcacggtggctcaggcctgtaatcccagcactttgggaggccgaggtgggtggatcacctgagttcgggagttcgagaccagcctgaccaacgtggagaaaacctgtctcttctaaaaatacaaaattagacaggcgtggtggcacatgcctgtaattccagctacttggggggctgaggcaggagaatcacttgaacctgagaggtggaggttgcagtgagctgagattgcaccattgcactccagcttgggcaacaagagtgaaacttcatcaaaacaaagaaagaaggaaagaaaggaaggaaggaaggaaaaggaaggaaggaaggaaggaaggaaggaaggaaaaagagaagaaaagaaagaaagactatttttaaaagcctttatattggagtattttcctaagtactgaatggtc

SEQ ID NO: 22245 - DNA, 253 bp, Homo sapiens
  AC003977.1_57354
  Located on chromosome 16
  Distance between a terminus base of telomere on chromosomal short arm and 5'-terminus of this base sequence : 65797999
  Distance between 3'-terminus of neighbour sequence of sequence listing upward to telomere on chrosomal short arm and 5'-terminus of this base sequence : 128351
aaatcagaagccatcctaatactctctctctctctctctctcacacacacacacacacacacacatacacacttttgcatttctttttcatcagtaagatttacatgtctataaaaattcagaaaacttaagcagattcttagatatttttctatttaatgatgagatgtatgttctctctccttgaatctgggtgggcatgtcactgcttcagtcaaaaaaaagtagggttaaatgagttccactcgtaggt

SEQ ID NO: 22246 - DNA, 316 bp, Homo sapiens
  AC003977.1_30321
  Located on chromosome 16
  Distance between a terminus base of telomere on chromosomal short arm and 5'-terminus of this base sequence : 65824953
  Distance between 3'-terminus of neighbour sequence of sequence listing upward to telomere on chrosomal short arm and 5'-terminus of this base sequence : 26701
gtcattggtaaacagcaataactcacaaaatgttaagcattatggtctttattataaacagggctcgattttcatcgcatttttcatcaagaatacttatttttacatcttattattattattattattattattattattattttgaggcagagtcttactctgtccccaggccggagtccagtggtgtgatcttggctcatgttatttgggttactataaacccatgttatttgggttactataaacttgtagtataatttgaagtctttcttttggaactttcttaaacttttcagatctttgttcacgttac

SEQ ID NO: 22247 - DNA, 194 bp, Homo sapiens
  AC003977.1_4065
  Located on chromosome 16
  Distance between a terminus base of telomere on chromosomal short arm and 5'-terminus of this base sequence : 65851303
  Distance between 3'-terminus of neighbour sequence of sequence listing upward to telomere on chrosomal short arm and 5'-terminus of this base sequence : 26034
aaatgtggttacaggttgaattagagagagagagagagagagagagagagcattaatataaaatgtcctcaaaggttagaaaaaaaaatggttacagcaaattgtgtaccctctctacagcatcttcacatttctgtaaatctagacctattctgaacttgaacttagccaaaaggctgagaagcaatctagat

SEQ ID NO: 22248 - DNA, 233 bp, Homo sapiens
  D16S503
  Located on chromosome 16
  Distance between a terminus base of telomere on chromosomal short arm and 5'-terminus of this base sequence : 65988261
  Distance between 3'-terminus of neighbour sequence of sequence listing upward to telomere on chrosomal short arm and 5'-terminus of this base sequence : 136764
agtgctctggaatgatgtggaaggaaggggtcataacaatgaaatctacaaagaaataattcacttagttaataaaagggctacacaatgatcaagttcctctaatccctgtacctaaatactacacacacacacacacacacacacacacacacacacacacacacaaaccacatgggtgtgcacacatgaatgtctgtttactcaggattagggagacaactacctagcaa

SEQ ID NO: 22249 - DNA, 214 bp, Homo sapiens
  Z23950.1_139
  Located on chromosome 16
  Distance between a terminus base of telomere on chromosomal short arm and 5'-terminus of this base sequence : 65988289
  Distance between 3'-terminus of neighbour sequence of sequence listing upward to telomere on chrosomal short arm and 5'-terminus of this base sequence : -205
ggtcataacaatgaaatctacaaagaaataattcacttagttaataaaagggctacacaatgatcaagttcctctaatccctgtacctaaatactacacacacacacacacacacacacacacacacacacacacacacaaaccacatgggtgtgcacacatgaatgtctgtttactcaggattagggagacaactacctagcaaacagattct

SEQ ID NO: 22250 - DNA, 228 bp, Homo sapiens
  D16S3111
  Located on chromosome 16
  Distance between a terminus base of telomere on chromosomal short arm and 5'-terminus of this base sequence : 66070194
  Distance between 3'-terminus of neighbour sequence of sequence listing upward to telomere on chrosomal short arm and 5'-terminus of this base sequence : 81691
gatcatgggagtccttggcctccataattatgtgagcttattcctattttatatgtctatctctctctctatctctatctctctctctctctgtgtgtgtgtgtgtgtgtgtgtgtgtgtgtgtgtgtatgttttactgattctgtactgattctgtttactctaaataatacacaataaacatataaatggaaataattgagtctgtccctggagatttcaacgtga

SEQ ID NO: 22251 - DNA, 403 bp, Homo sapiens
  chr16.fa.O7frz.75235996
  Located on chromosome 16
  Distance between a terminus base of telomere on chromosomal short arm and 5'-terminus of this base sequence : 66186241
  Distance between 3'-terminus of neighbour sequence of sequence listing upward to telomere on chrosomal short arm and 5'-terminus of this base sequence : 115819
aggcacctctaatctcaactactcaggaggctgaggcgggagaatcacttgaacctgggaggcagaggttgcattgagccaagatcatgtcattgcactccagacttggcaaaaagagtaaaactctgtcaaaaaaaagaaagaagggaagaaagacaaagaaagaaagaaagaaagaaagaaagaaagaaagaaagaaagaaagaaagaaagaaagaaagaaggaaagaaagaaagaaagaaagaaagaaaggaaagaaaggaaggaagaaagaaagtctacacttggatagcagagatttaatcaatggttggggctagagctggaagctggctgcataaaagacaaatctgaatactgttgcttagaagacagttagttcaaagtttctgagttagctaa

SEQ ID NO: 22252 - DNA, 195 bp, Homo sapiens
  chr16.fa.O7frz.75473872
  Located on chromosome 16
  Distance between a terminus base of telomere on chromosomal short arm and 5'-terminus of this base sequence : 66392356
  Distance between 3'-terminus of neighbour sequence of sequence listing upward to telomere on chrosomal short arm and 5'-terminus of this base sequence : 205712
ttcgttagaagtgtctaagcactaagtgcaacaattgaatcattttacttaaatgatcaaagaaggaaaatcttatgtatattaatctgaaagagagaaagagagtgtgtgtgcgtgtgtgtgtgtgtgtgtgtgtgtgtgtgtgtctatagaggggcaggtagttggtacatgctcctggacaataactgtgac

SEQ ID NO: 22253 - DNA, 389 bp, Homo sapiens
  chr16.fa.O7frz.75586624
  Located on chromosome 16
  Distance between a terminus base of telomere on chromosomal short arm and 5'-terminus of this base sequence : 66505107
  Distance between 3'-terminus of neighbour sequence of sequence listing upward to telomere on chrosomal short arm and 5'-terminus of this base sequence : 112556
taaccatttgaagagtaccattcccattgtaacagatgacaaaaactgaggctcaaaaatgatacatgactattaagcagtaaagctatacatatttgttatatgtgtgtgtgtgtgtgtgtgtgtgtgtgtgtgtgtgtgtgtgtgtgtgtgtataattattttttttttgaggtggggtcttgctctgtcacccaggctggagtgcagtggcgcgatctcggctcactgcaagctctgcctcccgggttcacgccattctcctgcctcggcctaccgagtagctgggactacaggcgccagccaccacgcccggctaatttttttgtatttttagtaaagatggggttacaccatgttagccaggatagtctcaatctcctgacctc

SEQ ID NO: 22254 - DNA, 362 bp, Homo sapiens
  chr16.fa.O7frz.75690685
  Located on chromosome 16
  Distance between a terminus base of telomere on chromosomal short arm and 5'-terminus of this base sequence : 66601968
  Distance between 3'-terminus of neighbour sequence of sequence listing upward to telomere on chrosomal short arm and 5'-terminus of this base sequence : 96472
tggtgaaatccacatagaataccatatttttattttaaaaatagaattattttattttaaaaatacaacaccattgatgttggaaagttgtgtgtgtgtgtgtgtgtgtgtgtgtgtgtgtgtgtgtgtgttttaggtagaatcatcaaaattcctctctgtgaaagacacagctggctgcatagtagctttctgccttggatgctgctaatgttcactagcagctttcactcagagtttttaccgaaagaccatagtgcattctcctctacccagcatgcttggtttaatgcctgcattggaacggtgttccagattcatcactcaaaaatcagttctgctgtcctttagctagaaacctc

SEQ ID NO: 22255 - DNA, 234 bp, Homo sapiens
  AC009113.3_8252
  Located on chromosome 16
  Distance between a terminus base of telomere on chromosomal short arm and 5'-terminus of this base sequence : 66759433
  Distance between 3'-terminus of neighbour sequence of sequence listing upward to telomere on chrosomal short arm and 5'-terminus of this base sequence : 157103
gcttgatactggaacacttcattgattctggctatattcttcttccataaaatttctttatggccacaaatatactcagtcttgatttctaactctgtctgcattccatccttcttactgactgtttagtgactatatatatttgtatttatataattgtacgtgcacacacaaacacacacacacacacacacacacacatatatattattgtgctgatgagcaacattaatt

SEQ ID NO: 22256 - DNA, 236 bp, Homo sapiens
  AC009113.3_39810
  Located on chromosome 16
  Distance between a terminus base of telomere on chromosomal short arm and 5'-terminus of this base sequence : 66791119
  Distance between 3'-terminus of neighbour sequence of sequence listing upward to telomere on chrosomal short arm and 5'-terminus of this base sequence : 31452
ataattccgaatggctattagaaaacacacacacgtgtgcacatgcacacacacacacacacacacacacacatcccccttatatctatttctatctgtgcatgcttatatgtctatattttgccatcagactcatggtgttcaaaagcaacactggctttcattgaatgcccctatagcaatattagcaaagtgctattgctgctggctcagtgcttatttaaatggaatagcag

SEQ ID NO: 22257 - DNA, 367 bp, Homo sapiens
  AC009113.3_124164
  Located on chromosome 16
  Distance between a terminus base of telomere on chromosomal short arm and 5'-terminus of this base sequence : 66875353
  Distance between 3'-terminus of neighbour sequence of sequence listing upward to telomere on chrosomal short arm and 5'-terminus of this base sequence : 83998
tctggaatagatccaatttcaaatatcctatcttgtcccccatttgtatattaagtcaatatttgctgactttttattagagagatatgctttcctcagagagcagaaaaggaaaggaagccttttgatcatcaacacttttggccaggaattagacttggggacacacacacacacacacacacacacatatacacataagtatgtacttgtgtacatatgtatacatatgtggatacgtgtgtgtgtgtgtgtgttttgtccttatcatgctcccattacaacagtggaaaaattgaagcctacaaatttctcttggctatactgcttttaaatagctgtgatagagttccaacctgatagtctg

SEQ ID NO: 22258 - DNA, 314 bp, Homo sapiens
  AC009113.3_139530
  Located on chromosome 16
  Distance between a terminus base of telomere on chromosomal short arm and 5'-terminus of this base sequence : 66890851
  Distance between 3'-terminus of neighbour sequence of sequence listing upward to telomere on chrosomal short arm and 5'-terminus of this base sequence : 15131
gtcagtttggttatcagtggacctgaactgttgtgtgtgtgtgtgtgtgtgtgtgtgtgtgtgtgtgtgtgtgtgtaagacaagaagggaagagtagagaggagctttgctaaattgtatagagatagtatattatgaggtggattgtaagatcattttcacacattggacattaattctatagaataccattggattcttaaactttttatgtagattctttaaaatggtcatttgcagcttgtgctaagcataaaaatggattacgcatttttaggcctgtcttgcaaagaggttatgatatcaacagttcc

SEQ ID NO: 22259 - DNA, 285 bp, Homo sapiens
  AC009113.3_141822
  Located on chromosome 16
  Distance between a terminus base of telomere on chromosomal short arm and 5'-terminus of this base sequence : 66893154
  Distance between 3'-terminus of neighbour sequence of sequence listing upward to telomere on chrosomal short arm and 5'-terminus of this base sequence : 1989
gttctagccagagcaattatacacacacacacacacacacacacacacacacacacacacacacactcacacacacgaagcaataaaagaaataaagggcatccaaactggaaaggaaagtgaaattatccttggtggcagataatatgattttatatttagaaaaacctaaagagtctacctagaaactattagaactgataaacaaattcagtaaaattgtggatataaaattctaatacaaaaattagtagcatttctgtatgtcaatagcaaacagtctga

SEQ ID NO: 22260 - DNA, 451 bp, Homo sapiens
  chr16.fa.O7frz.76537292
  Located on chromosome 16
  Distance between a terminus base of telomere on chromosomal short arm and 5'-terminus of this base sequence : 67122430
  Distance between 3'-terminus of neighbour sequence of sequence listing upward to telomere on chrosomal short arm and 5'-terminus of this base sequence : 228991
aatacgatgaaacctcatctttacaaaaaatacaaaaattagctgagcacggtgtcacgtgcctgtagtccccagctactcgggagatattgcttgagccggagaggtcgaggctgcagtaagctgggattgcgccactgcactccagcttgggtgtcagatccagaccctgtcttaaaacaaacaaacaaacaaacaaacattgaatagtccaatttgtgttgagcaaatattgggcaggtgtcaggacctgggtagaagtccagtaatatagctcagtggatgaggtggcatttccaagggcagctatggcaggcagcataatagcttggcatgtggatggaaaatggtctcttgtaagggacacatccagttctgtgggaaagttttctatggactctagccaaggagccaatgcaaaaatctcaaaagctggaatacataggaactc

SEQ ID NO: 22261 - DNA, 262 bp, Homo sapiens
  chr16.fa.O7frz.76380076
  Located on chromosome 16
  Distance between a terminus base of telomere on chromosomal short arm and 5'-terminus of this base sequence : 67279705
  Distance between 3'-terminus of neighbour sequence of sequence listing upward to telomere on chrosomal short arm and 5'-terminus of this base sequence : 156824
caacctatttaaagcctaccagctattgggccatgatgctagtcataatattcatattgctataaactctgattcttaacccacaaacagaggcagaccataccagaagttcagtgtgagtgtgtgtgtgtatgtgtgtgtgtatgtgtgtatgcatgtatgtgtaatttgatggaacatattaaaaatttctactgttttataataccaatgctttcccactagaaaataaatcttagaaaattagttgaggctggtagag

SEQ ID NO: 22262 - DNA, 292 bp, Homo sapiens
  AC004533.1_87722
  Located on chromosome 16
  Distance between a terminus base of telomere on chromosomal short arm and 5'-terminus of this base sequence : 67482418
  Distance between 3'-terminus of neighbour sequence of sequence listing upward to telomere on chrosomal short arm and 5'-terminus of this base sequence : 202451
gcaatgagtgaaactccatctcaaaataataataataataataataataataataataataataataataaaccactgttgttgtaattgtttggtttttaggtctggcactctgctgcttccttgtcaacagtgaagcaagaaaacccatgcaagcccaagatgcaatgggtcaagggctggttctttctccttgtgattttggtaatctctgttttctttcctctctccccttttatacatacagtattttctcttcagtgtttaggtatagactttggattcaacaatg

SEQ ID NO: 22263 - DNA, 309 bp, Homo sapiens
  AC004533.1_59362
  Located on chromosome 16
  Distance between a terminus base of telomere on chromosomal short arm and 5'-terminus of this base sequence : 67510588
  Distance between 3'-terminus of neighbour sequence of sequence listing upward to telomere on chrosomal short arm and 5'-terminus of this base sequence : 27878
attacaaggtcaggagattgagaccatcctggctaatacagtgaaaccccatctccactaaaaatacaaaaaattagccgggcatggtggcgggcgcctgtagtcccagctactcgggagtctgaggcctgaagcaggagaatggcgtgaacccaggaggcggagcatgcagtgagccgaggtcaccccgctgcactccagcctgggcgattccgtccaaacaacaacaacaacaacaacaacaacaacaacaacaacaacctgaaagatctggaacagtgggttcctggatgacaataattcgctgga

SEQ ID NO: 22264 - DNA, 213 bp, Homo sapiens
  AC004533.1_18754
  Located on chromosome 16
  Distance between a terminus base of telomere on chromosomal short arm and 5'-terminus of this base sequence : 67551403
  Distance between 3'-terminus of neighbour sequence of sequence listing upward to telomere on chrosomal short arm and 5'-terminus of this base sequence : 40506
acagagtgccagaccttgtctcaaaaagagacatatatatatatatatatatatgtttgtgtgtgtgtgtgtgtgtatatgatgtttagatagatatatagatacatagatagatagagatatacactttaggctgagtgtggtgactcatgcctgtaatcccagcactttgggtggctgaagggggaaaagatggtttgaacctaggagttc

SEQ ID NO: 22265 - DNA, 166 bp, Homo sapiens
  D16S3021
  Located on chromosome 16
  Distance between a terminus base of telomere on chromosomal short arm and 5'-terminus of this base sequence : 67646547
  Distance between 3'-terminus of neighbour sequence of sequence listing upward to telomere on chrosomal short arm and 5'-terminus of this base sequence : 94931
cacagatatgtttcatctagggaggttaattggccatacagacaaaaccagtgtgtgtgtgtgtgtgtgtgtgtgtgtgtgtgtgtgtgtaagcggcaatgtcatctgatggagtcagcaaagtccaagggattgtcttgtctttggccttgtgatgacatccaca

SEQ ID NO: 22266 - DNA, 305 bp, Homo sapiens
  chr16.fa.O7frz.76960866
  Located on chromosome 16
  Distance between a terminus base of telomere on chromosomal short arm and 5'-terminus of this base sequence : 67713243
  Distance between 3'-terminus of neighbour sequence of sequence listing upward to telomere on chrosomal short arm and 5'-terminus of this base sequence : 66530
ctcactcctaagatcaggagacaggattggcttccagaagaagaaagacaaaatttacagtaaaagatgtcaactgctattacagggcactggactcctcccggaagaccaaaaataaataaataaataaataaataatccaaaaagaaaataactattgggtactaggcttagtgcttgggtagcaaaattatttgtacatcacacccccgtgatgtgagtttatctatataacaaaccttcataggtacccctgagcataaaagttaaaaaaaaaagaatcctgacaaatcctgcagtaaata

SEQ ID NO: 22267 - DNA, 241 bp, Homo sapiens
  chr16.fa.O7frz.76766986
  Located on chromosome 16
  Distance between a terminus base of telomere on chromosomal short arm and 5'-terminus of this base sequence : 67735083
  Distance between 3'-terminus of neighbour sequence of sequence listing upward to telomere on chrosomal short arm and 5'-terminus of this base sequence : 21535
gatggagaggtgactttagaagtcaaattggtgatgattatacacacacacacacacacacacacacacacacacacacacactctcagagtgggcaagggtcccatgagatgacactcatacattcctggtgaaaatagagattcttacaaaaaataatttagcatcaagcatcaagagccttaaaatatcgatttttaaaaattgactaatctaactatttggaatctatccaaagaat

SEQ ID NO: 22268 - DNA, 126 bp, Homo sapiens
  D16S3043
  Located on chromosome 16
  Distance between a terminus base of telomere on chromosomal short arm and 5'-terminus of this base sequence : 67986232
  Distance between 3'-terminus of neighbour sequence of sequence listing upward to telomere on chrosomal short arm and 5'-terminus of this base sequence : 250908
aaatgttgagcacttgaataaaatatccctgagaaaaggctgtacttctgctcaaggacaagacgtgtgtgtgtgtgtgtgtgtgtgtgtgtgcgcgtgtacaatctataagactccatattaatg

SEQ ID NO: 22269 - DNA, 215 bp, Homo sapiens
  chr16.fa.O7frz.77381286
  Located on chromosome 16
  Distance between a terminus base of telomere on chromosomal short arm and 5'-terminus of this base sequence : 68217804
  Distance between 3'-terminus of neighbour sequence of sequence listing upward to telomere on chrosomal short arm and 5'-terminus of this base sequence : 231446
ttaatagtttgaagttgctgagacatggaaatagaggatatttagatagccttttttctgtaccagtgtttcttaaagtacaattcctgggccagccgtatcacctggggacttacaaatacaaacatctcccctctacaaacaaacacacacacacacacacacacacacacacatacggtttaagaaccatgtattctaggcttcaagagtcc

SEQ ID NO: 22270 - DNA, 464 bp, Homo sapiens
  chr16.fa.O7frz.77472781
  Located on chromosome 16
  Distance between a terminus base of telomere on chromosomal short arm and 5'-terminus of this base sequence : 68316245
  Distance between 3'-terminus of neighbour sequence of sequence listing upward to telomere on chrosomal short arm and 5'-terminus of this base sequence : 98226
cacgtggtccagttacaagtctctgagatcaaaatgctttgaaaaaggctgagcaaaactttctttgtggccgtgggacttgagagaggttgagatgctgacatgcattaaaaatctacagaggagaaacgagtatgaagtgctacccaggctcatgtcaccatacctaacacttgccttcccaacacacacacacacacacacatacacacacacacacacagtgtttttcacctaggaggccctctgaacagctgctactggcaatccatggagcaatttaggatgggatggagattgcattataacagccaccctgagtaggtatgcacaaccgtgatcaggtgacagaatgagcttccagtctgtctcctctgatcatgctgttcttggctgattggatgctcctggagaaccaatattcaccactgcctcccaagtgcctagcactgtgcttcgttatt

SEQ ID NO: 22271 - DNA, 357 bp, Homo sapiens
  chr16.fa.O7frz.77577273
  Located on chromosome 16
  Distance between a terminus base of telomere on chromosomal short arm and 5'-terminus of this base sequence : 68427109
  Distance between 3'-terminus of neighbour sequence of sequence listing upward to telomere on chrosomal short arm and 5'-terminus of this base sequence : 110400
acagagacatacaactgtagtcctaactactctggaggctgaggtgggaggatcactggagcccaggagttcaaggctttagtgagctataatcataccaccacactccaacctgggtgacagagcaagacccaggaaagaaggaaggaaggaaggaaggaaggaaggaaggaaggaaggaaggaaggaaggaaggaaggaaggaaaggaggaaaggaggaaaggaggaagggagggatggggaggggagggggaagaggaaggatttacattaggatgagaaaaagaataaaaacaattggaataattgaaccaagtttggaaacaaccagagtattactaatatcagttgcctgg

SEQ ID NO: 22272 - DNA, 440 bp, Homo sapiens
  AC009024.6_119692
  Located on chromosome 16
  Distance between a terminus base of telomere on chromosomal short arm and 5'-terminus of this base sequence : 68583153
  Distance between 3'-terminus of neighbour sequence of sequence listing upward to telomere on chrosomal short arm and 5'-terminus of this base sequence : 155687
caaatcgtggtagaatcaagacagaaacataggccttctaattgtcactggggtgtgtatgtttccacactaagctatccacctatattctaaatttgaagaatcttacttgaagggaggaaataactgatgatcttacctggctgtatgtagaccagaagaaaccaagtgggttaggtcaggattcctggggcctctggtgtgtatatatatataactatatatataactgtgtgtgtgtgtgtgtgtgtgtgtgtgtgtgtgtgtgtgtgtgtgtatggtaccttggaggttgtctcacctaaacaccccacaataagatgggcaaatggagtttagaaagagcaagtaatttacctaaagtcacacagggaatgagttggaagacttagaactagacctccagccctggtcctcagtttaggccaatgtttaccata

SEQ ID NO: 22273 - DNA, 248 bp, Homo sapiens
  D16S3019
  Located on chromosome 16
  Distance between a terminus base of telomere on chromosomal short arm and 5'-terminus of this base sequence : 68583287
  Distance between 3'-terminus of neighbour sequence of sequence listing upward to telomere on chrosomal short arm and 5'-terminus of this base sequence : -306
cttacctggctgtatgtagaccagaagaaaccaagtgggttaggtcaggattcctggggcctctggtgtgtatatatatataactatatatataactgtgtgtgtgtgtgtgtgtgtgtgtgtgtgtgtgtgtgtgtgtgtgtatggtaccttggaggttgtctcacctaaacaccccacaataagatgggcaaatggagtttagaaagagcaagtaatttacctaaagtcacacagggaatgagttg

SEQ ID NO: 22274 - DNA, 471 bp, Homo sapiens
  chr16.fa.O7frz.77931689
  Located on chromosome 16
  Distance between a terminus base of telomere on chromosomal short arm and 5'-terminus of this base sequence : 68669195
  Distance between 3'-terminus of neighbour sequence of sequence listing upward to telomere on chrosomal short arm and 5'-terminus of this base sequence : 85660
tagtacctaacttagcactttggtttctcaattcaaaggacacttagtcaggtgttttccatgttctgggagctggggttaccttcagacaaaagaaatacagcactgagccgttataataaacaaatttccctagcatttccataagcaaaataattatggtttttatttttaaactgagcaagaaaaagagaaaaattttgatgagatgtgtgtgtgtgtgcgtttttgtgtgcgtgtgtgtgtgtgtgtgtgtgtgtgtgtgtataacataagccagacattactccttgcagcagcaattaagaatgaatagtatcctaaggccctgtcaatgggctaagcatgttatttttaagctccccaagaaattgcacccctaatttgtaccctcatcaaagcctgcactccactgctggagacagttcaggctcttgagcacacctgtaatcagattccatatgtgaagtg

SEQ ID NO: 22275 - DNA, 238 bp, Homo sapiens
  chr16.fa.O7frz.78041187
  Located on chromosome 16
  Distance between a terminus base of telomere on chromosomal short arm and 5'-terminus of this base sequence : 68778858
  Distance between 3'-terminus of neighbour sequence of sequence listing upward to telomere on chrosomal short arm and 5'-terminus of this base sequence : 109192
gcattaattgtagtgcattcacaatagccaaaatatggaatcaacctaactgtccatcaatggatggatggatggatggatggatggatggatggatgaatggatggatgaataaaatgtaattatatatatacacacacacacactatgggatattattcagccataaaaataatgaaatcctgtcatttgctgcaatgtgaatggaaatggaggtcattacggtaagtgaaatagg

SEQ ID NO: 22276 - DNA, 332 bp, Homo sapiens
  chr16.fa.O7frz.78376885
  Located on chromosome 16
  Distance between a terminus base of telomere on chromosomal short arm and 5'-terminus of this base sequence : 69113913
  Distance between 3'-terminus of neighbour sequence of sequence listing upward to telomere on chrosomal short arm and 5'-terminus of this base sequence : 334817
tttaatttgcattcctagatgtctcatgatgttgagcatctttttacacgcttattggacgttcatatatgtcttttagtgaattgtctgttcaaatctttggcccattaaaaaaaattgggttgttttcttcttatgaatgagttgcagttcacagccatccttttgtgtgtgtgtgtgtgtgtgtgtgtttttttttgttttttttttttttgagatggagtctccctctgtcacccaggctggagtgcagtggcacgatctcagctcactgcaacctcagcctcccaggttcaagcaattctcctgccttagcctcctgagtagctaga

SEQ ID NO: 22277 - DNA, 329 bp, Homo sapiens
  AC004638.1_41084
  Located on chromosome 16
  Distance between a terminus base of telomere on chromosomal short arm and 5'-terminus of this base sequence : 69363171
  Distance between 3'-terminus of neighbour sequence of sequence listing upward to telomere on chrosomal short arm and 5'-terminus of this base sequence : 248926
ccatatcagagttgccagttattttaaaaatggttctaggctgggcatggtggctcaagtgtgtaatcccagcactttgagaggctgaggtgggtggattgcttgagctcaggagaccagtctggacatcatagtgagatcccatctcactataccatgttgaaaataaccatgggttgttaatttagtatttagcttgtgaagagaaaggccaatctaaagagtgtgtgtgtgtgtgtgtgtgtgtgtgtgtgtgtgtgtggtgtgtttttaaacctctcttaggtagaggggtccctaatctgaaactatgagatgaagatttccat

SEQ ID NO: 22278 - DNA, 177 bp, Homo sapiens
  AC004638.1_15113
  Located on chromosome 16
  Distance between a terminus base of telomere on chromosomal short arm and 5'-terminus of this base sequence : 69389276
  Distance between 3'-terminus of neighbour sequence of sequence listing upward to telomere on chrosomal short arm and 5'-terminus of this base sequence : 25776
aaccagtcctttattgatggacatgtaagttatatttaaatttttaccattgcaaacaactctaaatacctgctacacatgtacccgtgtgtgtgtgtgtgtgtgtgtgtgtgtgtgtgtgtgtgtgtattctgtaacagctttaatgagatataattcacataccgtacagttcac

SEQ ID NO: 22279 - DNA, 184 bp, Homo sapiens
  D16S3086
  Located on chromosome 16
  Distance between a terminus base of telomere on chromosomal short arm and 5'-terminus of this base sequence : 69502722
  Distance between 3'-terminus of neighbour sequence of sequence listing upward to telomere on chrosomal short arm and 5'-terminus of this base sequence : 113269
cctgctgggaagtgaccccaatagggaaggggagggcctgccccagccacttcccagaacttggcttcctaccctcatccccctcttctcagcagcccatacccctgcacacacacacacacacacacacacacacacacacaccccataaccagagtcccagagcatctacatttgtccttag

SEQ ID NO: 22280 - DNA, 142 bp, Homo sapiens
  Z66903
  Located on chromosome 16
  Distance between a terminus base of telomere on chromosomal short arm and 5'-terminus of this base sequence : 69598634
  Distance between 3'-terminus of neighbour sequence of sequence listing upward to telomere on chrosomal short arm and 5'-terminus of this base sequence : 95728
ccactcacacttagcctgagagacagagtgagaccctatctaaaacacacacacacacacacacacacacacacacacacacacacacacacacagttccttttggggcctattaaatttgacgtgctgacagatgttccac

SEQ ID NO: 22281 - DNA, 189 bp, Homo sapiens
  chr16.fa.O7frz.78968380
  Located on chromosome 16
  Distance between a terminus base of telomere on chromosomal short arm and 5'-terminus of this base sequence : 69706536
  Distance between 3'-terminus of neighbour sequence of sequence listing upward to telomere on chrosomal short arm and 5'-terminus of this base sequence : 107760
gacagctgatactcaataaatgtcagctattactaaaaggaagagtttgcttctaaggcacttggctaatgtgttaaagttaaatcctctttttccaaactgtaaatatagatttgttgtggggttttttgtttgtttgtttgtttgtttgtttgtttgttttttgagatggaatctcacttatgtcgt

SEQ ID NO: 22282 - DNA, 182 bp, Homo sapiens
  DISO7_00045510
  Located on chromosome 16
  Distance between a terminus base of telomere on chromosomal short arm and 5'-terminus of this base sequence : 69784441
  Distance between 3'-terminus of neighbour sequence of sequence listing upward to telomere on chrosomal short arm and 5'-terminus of this base sequence : 77716
gtgagcaaagacaggaacagcagaggccagtggagggagtggggaacagggccaagggagctcttgggcttgactctcaaggcctgaatcagtgtgtgtgtgtgtgtgtgtgtgtgtgtgtgtgtgtgtgtgtgtgtgtgtgtgtaatgggagtggggctgggaaaattggtgccttccaag

SEQ ID NO: 22283 - DNA, 206 bp, Homo sapiens
  D16S421
  Located on chromosome 16
  Distance between a terminus base of telomere on chromosomal short arm and 5'-terminus of this base sequence : 69870273
  Distance between 3'-terminus of neighbour sequence of sequence listing upward to telomere on chrosomal short arm and 5'-terminus of this base sequence : 85650
ccgttccctatatttcctggttgttaaatctagaggcctgatcaaattcagggacattcaataggtatgctatatattttctgtggtgtcacatcaggaagtacataatgatttggtgaggtgtgtgtgtgtgtgtgtgtgtgtgtgtgtgtatgtggtgtttatgtataagattggtcaatgggttcagtccaatcggttcatgt

SEQ ID NO: 22284 - DNA, 168 bp, Homo sapiens
  Z17094.1_125
  Located on chromosome 16
  Distance between a terminus base of telomere on chromosomal short arm and 5'-terminus of this base sequence : 69870369
  Distance between 3'-terminus of neighbour sequence of sequence listing upward to telomere on chrosomal short arm and 5'-terminus of this base sequence : -110
ggaagtacataatgatttggtgaggtgtgtgtgtgtgtgtgtgtgtgtgtgtgtgtatgtggtgtttatgtataagattggtcaatgggttcagtccaatcggttcatgtgtagtctgttttttaaaaatctggaataagtttgtgtgtatcctgttaaatgtcatct

SEQ ID NO: 22285 - DNA, 168 bp, Homo sapiens
  DISO7_00045533
  Located on chromosome 16
  Distance between a terminus base of telomere on chromosomal short arm and 5'-terminus of this base sequence : 70042057
  Distance between 3'-terminus of neighbour sequence of sequence listing upward to telomere on chrosomal short arm and 5'-terminus of this base sequence : 171520
tcagaactgggaggtctgtttcccttgggaggacctgtctgctctgagggggacccggacaagtgcacatatgcatgtgtgtgtctacacacacacacacacacacacacacacacacacacacacatatgcttgcctccctctccaaggcagacttgcctgggaagt

SEQ ID NO: 22286 - DNA, 357 bp, Homo sapiens
  AC009095.5_189949
  Located on chromosome 16
  Distance between a terminus base of telomere on chromosomal short arm and 5'-terminus of this base sequence : 70181389
  Distance between 3'-terminus of neighbour sequence of sequence listing upward to telomere on chrosomal short arm and 5'-terminus of this base sequence : 139164
ggcctattctaacattttaaagactcatccttccatatcatctcctgcctagactgtaggagtttttttccttattaatgtctgctttcttcagacccctgtgaaagccttatttatttatttatttatttatttatttatttatttatttatttattttgagacggagttttgctcttgttgcccaggctggagtacaatggcatgattttggctcaccacaacctccacctcccgggttcaagcaattctcccgcctcagcctcccaagtagctgggattacaggcatgcgccaccatgcccggctaattttgtatttttagtagagacggggtttctccatgttagtcaggctg

SEQ ID NO: 22287 - DNA, 198 bp, Homo sapiens
  D16S3085
  Located on chromosome 16
  Distance between a terminus base of telomere on chromosomal short arm and 5'-terminus of this base sequence : 70275878
  Distance between 3'-terminus of neighbour sequence of sequence listing upward to telomere on chrosomal short arm and 5'-terminus of this base sequence : 94132
gctatgaccgcaccagtgcactccagcctgggtgacagaacaagaccccgcctcaaaaaaaaagaaaaagaatttccgtcttgtcccctgacacacacacacacacacacacacacacacacactctcactcactcactcttacccttcctgcccacttagagatgagcagaaccacatctccaagggtccatttccg

SEQ ID NO: 22288 - DNA, 368 bp, Homo sapiens
  DISO7_00045545
  Located on chromosome 16
  Distance between a terminus base of telomere on chromosomal short arm and 5'-terminus of this base sequence : 70359660
  Distance between 3'-terminus of neighbour sequence of sequence listing upward to telomere on chrosomal short arm and 5'-terminus of this base sequence : 83584
tagcaattgccctagcaaataaaaataataatgagggctgggtgtggtggctcacacctgttatcccagcactttgggaggccaaggcaggcagatcatctgaggtcaggagttcaagaccagcctggccaacatggtgaaaccccttctctactaaacatacaaaaattagctgggcgtggtggtacatgcctgtagtcccagctactcaggaggttgaggccagagaatcgcttgaacctgggaggcggagattgcagtgagccgagatcgcaccactgcactccagtctgggtgacagagtgagactccgtctcgatagatagatagatagatagatagagaattagacccagaccaatgattat

SEQ ID NO: 22289 - DNA, 232 bp, Homo sapiens
  DISO7_00003592
  Located on chromosome 16
  Distance between a terminus base of telomere on chromosomal short arm and 5'-terminus of this base sequence : 70557255
  Distance between 3'-terminus of neighbour sequence of sequence listing upward to telomere on chrosomal short arm and 5'-terminus of this base sequence : 197227
tcctactgtagccgaaagactgggtccttagattctgttgttcttctgctggaatcacagggcaggactctgcagctcacagtgaatgagtgagtgaatgagtgagtgagtgagagagagagagagtgtgtgtgtgtgtgtgtgtgtgtgtgtgtgtgttggagaggcactgctcagcctttgctcccactaccctttacctggagctgaaaagcatcagtttccagctcca

SEQ ID NO: 22290 - DNA, 261 bp, Homo sapiens
  chr16.fa.O7frz.82572365
  Located on chromosome 16
  Distance between a terminus base of telomere on chromosomal short arm and 5'-terminus of this base sequence : 70629233
  Distance between 3'-terminus of neighbour sequence of sequence listing upward to telomere on chrosomal short arm and 5'-terminus of this base sequence : 71746
caagagttcaaagctgcagtgagctatgattgcgccactgtactccagcctgggtgacaaagtgagactctgcctcaaaagtaaataaataaataaataaataaataaataaataaataaaaagagatgagctactcagagggaacacggaatagggtccacctcctgccaccggatccaccactgttttcatccagtgctgagcccaatcacctgggtcacctcgggctcctgtcaacagtctttccttaaacaactggt

SEQ ID NO: 22291 - DNA, 299 bp, Homo sapiens
  chr16.fa.O7frz.82349675
  Located on chromosome 16
  Distance between a terminus base of telomere on chromosomal short arm and 5'-terminus of this base sequence : 70851354
  Distance between 3'-terminus of neighbour sequence of sequence listing upward to telomere on chrosomal short arm and 5'-terminus of this base sequence : 221860
tgagcctatgtcaagttcatagaggttctttgtgctgaacaccaaatcaacctacttaaggttgatgacaagaagctagggggaatggttaggtctctgtaaaattgacagagaggggaaaccccgtaaagtggttcgttgcagttgtgtagtagttgaagtacttcaaatgcaagaaatgaacgaataaaactctggctaacccccctgccccccaacacacacacagacacacacacacacacactcacagtcacactcactctgggcatgttggctcaatcctgtagtcctagcac

SEQ ID NO: 22292 - DNA, 426 bp, Homo sapiens
  chr16.fa.O7frz.82266231
  Located on chromosome 16
  Distance between a terminus base of telomere on chromosomal short arm and 5'-terminus of this base sequence : 70940267
  Distance between 3'-terminus of neighbour sequence of sequence listing upward to telomere on chrosomal short arm and 5'-terminus of this base sequence : 88614
tccgagatcatagatgcaggaggattatgaaaccctgtgcgtttaagtgccttttctgtgccctgcccccagacatttgctgaccagacgtttggcatgttcagctggaccatccccattgctgttgccctgtcctgctttgggggcctcaatgcatccatctttgcttcatcaaggtactgtgtctctgtgtcactgataatagaccacaatatttcattctctggggcttaggcataagagttccttttttccctccttctcatgggcatatagggtgtgtgtgtgtgtgtgtgtgtgtgtgtgtgtgtgtgtttggtatgtgggcatgtacttgcctttgtgcaagtagcacatttgtatgctggtagctcatgtttccatctgaggtgaggacagattgtgtgctgatagctcatgttatgt

SEQ ID NO: 22293 - DNA, 217 bp, Homo sapiens
  DISO7_00045623
  Located on chromosome 16
  Distance between a terminus base of telomere on chromosomal short arm and 5'-terminus of this base sequence : 71102172
  Distance between 3'-terminus of neighbour sequence of sequence listing upward to telomere on chrosomal short arm and 5'-terminus of this base sequence : 161479
actcggaccctaggtcattgctgtggcttgagagttaaagatgtgactaccctgctccccacccccacaacatccaagcccatcagtaaatgagtaagtggttcatctacacacacacacacacacacacacacacacacacacagcccgaagcgcaagctctggccgtgccacacacatgaagactgaaacacacatgggtacattcatctagtca

SEQ ID NO: 22294 - DNA, 387 bp, Homo sapiens
  AC074049.1_81435
  Located on chromosome 16
  Distance between a terminus base of telomere on chromosomal short arm and 5'-terminus of this base sequence : 71236112
  Distance between 3'-terminus of neighbour sequence of sequence listing upward to telomere on chrosomal short arm and 5'-terminus of this base sequence : 133723
tcatgttctagcatgtatcagtacatcattcttttttaccattgaggaatattccattgtatggatatatcacattttgttattcatcagttgctgaaccacactggattgattttatttatttatttatttatttatttatttatttattttgagacagaatctcactctgtcacccaggttggaatgcagtggctgtgatctgaggtcactgtaacctccacctcctgggctcaagcagttctcatgcctcagcctcccaagtagctgggactacaggcacgcaccaactcgcctggctagtttttgtatttttagtagagatggggtttctactaaactgctattggccagcctggtctcaaactcctagcctaatatgttcat

SEQ ID NO: 22295 - DNA, 121 bp, Homo sapiens
  DISO7_10004168
  Located on chromosome 16
  Distance between a terminus base of telomere on chromosomal short arm and 5'-terminus of this base sequence : 71601220
  Distance between 3'-terminus of neighbour sequence of sequence listing upward to telomere on chrosomal short arm and 5'-terminus of this base sequence : 364721
tgtctaatgaaggaggcatgatttgttttgttttgttttgttttgttttgttttgttttgttttttcaaaagggcatgagctcaaaaagttgaaaaacactgccctcacccatagtgagca

SEQ ID NO: 22296 - DNA, 397 bp, Homo sapiens
  DISO7_00003587
  Located on chromosome 16
  Distance between a terminus base of telomere on chromosomal short arm and 5'-terminus of this base sequence : 71692897
  Distance between 3'-terminus of neighbour sequence of sequence listing upward to telomere on chrosomal short arm and 5'-terminus of this base sequence : 91556
gagcatgtagtttaacagatgctcattttattttatttatttatttatttatttatttatttatttatttatttatttattttaaacagagtcttgctctgtcgcccaggctggagtgctgtggcatgatctcggctaactgtaagctccacctcctgggttcacgccattctcctgcctcagcttcccgagtagctgggactacaggcgcccgccaccacgcccagataattttttgtatttttaatagagaccgggtttcgccatgttagccaggatggtctcgatctcctgacctcatgatccgccccctctgcttcccaaagtgctgggattacaggcatgagccaccgcacctggccaatggatgctcattttcaaaggagtgctggagctc

SEQ ID NO: 22297 - DNA, 144 bp, Homo sapiens
  D16S3067
  Located on chromosome 16
  Distance between a terminus base of telomere on chromosomal short arm and 5'-terminus of this base sequence : 71752285
  Distance between 3'-terminus of neighbour sequence of sequence listing upward to telomere on chrosomal short arm and 5'-terminus of this base sequence : 58991
tcactcaaaatggagtcactctggttcgaatgcctgtgtgtgtgtgtgtgtgtgtgtgtgtgtgtgtgtgtgtgtataattattattattatttttttttggaggcagaatctcgccctattgcccaggctagtgtgaggtggc

SEQ ID NO: 22298 - DNA, 297 bp, Homo sapiens
  DISO7_10006443
  Located on chromosome 16
  Distance between a terminus base of telomere on chromosomal short arm and 5'-terminus of this base sequence : 71842061
  Distance between 3'-terminus of neighbour sequence of sequence listing upward to telomere on chrosomal short arm and 5'-terminus of this base sequence : 89632
agtccacatggtctttgacttagaaatttcagttctaatcattctttatatatatatatatatatatatatatatgtatatatatatctgtatatagatatatatgcttctagctgtgcaaaaagacatttatacagagacagctttgtttgtagtagacaaagatatgaaacaagctaatgtccattaagcagagtggataagtaaatcatgatacatggacaaaatgagtggactattctgtgtttcagaatgggcatgaccgatatatatgtgtattaatgtgggtcagtctcc

SEQ ID NO: 22299 - DNA, 135 bp, Homo sapiens
  DISO7_10006439
  Located on chromosome 16
  Distance between a terminus base of telomere on chromosomal short arm and 5'-terminus of this base sequence : 72056794
  Distance between 3'-terminus of neighbour sequence of sequence listing upward to telomere on chrosomal short arm and 5'-terminus of this base sequence : 214436
atggacagaggtgggaagagtgtgtgtgtgtgtgtgtgtgtgtgtgtgtgtgtgtgtgtgtgttaataaactcataacgtgtgctcgcttcggcagcacatatactaaaaaaactcataacatggatgacagagc

SEQ ID NO: 22300 - DNA, 185 bp, Homo sapiens
  chr16.fa.O7frz.80547230
  Located on chromosome 16
  Distance between a terminus base of telomere on chromosomal short arm and 5'-terminus of this base sequence : 72170191
  Distance between 3'-terminus of neighbour sequence of sequence listing upward to telomere on chrosomal short arm and 5'-terminus of this base sequence : 113262
ggttacagtgagctatgattgtgccactgcactccaggctgggtgacagagcaaaactctaccttaaacacacacacacacacacacacacgcacacgcggggagagagagagagaacatttattatatatcacttactgtgtgctggggtgccttacatcctttatttcgtttagtctgcacta

SEQ ID NO: 22301 - DNA, 471 bp, Homo sapiens
  chr16.fa.O7frz.80677158
  Located on chromosome 16
  Distance between a terminus base of telomere on chromosomal short arm and 5'-terminus of this base sequence : 72287453
  Distance between 3'-terminus of neighbour sequence of sequence listing upward to telomere on chrosomal short arm and 5'-terminus of this base sequence : 117077
tcctatgattgtttaaagcaaaaattataacctcttactatgagatttataatttacatagatataatatataatacacattttatattttatttatttatttatttatttatttattctttctttctttctgagacagggtctcgctctgtcgcccaaggtggagtgcagtggtgcgatctcagctcactgcaacctccgcctcctgggttcaagtgattctcctgcctcagtctcttgagtagctgggattacaggcatgcaccagcacgcccagctaattttgtattttagtagacatagggtttcaccatgctggccaggctagtctcgaactcctgacctcaagtgatccgcctgccttggcttcccaaagcgctgggattataggcataagccaccgctcctggcccataatacacattttaaagtggtacaatattaattctaagtagattgtgaagcattagg

SEQ ID NO: 22302 - DNA, 158 bp, Homo sapiens
  D16S3095
  Located on chromosome 16
  Distance between a terminus base of telomere on chromosomal short arm and 5'-terminus of this base sequence : 72684772
  Distance between 3'-terminus of neighbour sequence of sequence listing upward to telomere on chrosomal short arm and 5'-terminus of this base sequence : 396848
tcagttggaagatgagttggaagtttgtgcagggagttagattcacacacacacacacacacacacacacacacacacacacacagcctcatgactgcctctgacattgagaagctgcagagagagtaggaggaccaggtcgggggacacaaactata

SEQ ID NO: 22303 - DNA, 179 bp, Homo sapiens
  DISO7_10004174
  Located on chromosome 16
  Distance between a terminus base of telomere on chromosomal short arm and 5'-terminus of this base sequence : 72873293
  Distance between 3'-terminus of neighbour sequence of sequence listing upward to telomere on chrosomal short arm and 5'-terminus of this base sequence : 188363
tggttgaatattcagatttcttgttttgagtttattttggtggtgtttgaaaacttgaaaggttctatatatatatatatatatatatatatatatatatatatatttttacatcatctcttcttttttttctcttctagcttgaaaatgaaatttcttcagattgcaatcatgtaagt

SEQ ID NO: 22304 - DNA, 462 bp, Homo sapiens
  AC027281.5_46801
  Located on chromosome 16
  Distance between a terminus base of telomere on chromosomal short arm and 5'-terminus of this base sequence : 73952387
  Distance between 3'-terminus of neighbour sequence of sequence listing upward to telomere on chrosomal short arm and 5'-terminus of this base sequence : 1078915
tgtggtattcattaataggcttagtttaaaggaaaattctatgtcatttactatataatatagtaaatgatatagtctatgtctatttcatttactataaatgaaaacacaggattatctagcatatttagaaaaatcaacacaatggaaaaaaatcaatgtaattattttcttgcctggtgaaggctctgagctgagctctggttgctcttttaagaagggaaaacactgggctggcatgatcttggctgggcttattactgtatggaaggaggatccacggtgtcccctctttacataccctattgcacagggtcttatacatgcagcccaagctcaacagatgtttggttgattgaatgaatggatggatgcatggatggatggatggatggatggatggatggatggatggatggatgggtgtgtggaatgttgaatgagaacagttgaatagcatag

SEQ ID NO: 22305 - DNA, 289 bp, Homo sapiens
  AC004626.1_95943
  Located on chromosome 16
  Distance between a terminus base of telomere on chromosomal short arm and 5'-terminus of this base sequence : 74052178
  Distance between 3'-terminus of neighbour sequence of sequence listing upward to telomere on chrosomal short arm and 5'-terminus of this base sequence : 99329
ctttcacaatttggtaaggattagaaatcacacacacacacacacacacatagacatgcacacacaataaagtatgaatctgaatctggcacctatttgtcactcattaaataattgtttaaaatacctctataaaaatacaaacatatacaatgaaggaactttcccaaaatgaagtttcaagggttatagtctgacgtaatgtaaaaaatgtgccctagatacaaatttagtgatggggagacactgaagtaacactgatcctgaataactcatgcatacatcctgt

SEQ ID NO: 22306 - DNA, 322 bp, Homo sapiens
  chr16.fa.O7frz.87255677
  Located on chromosome 16
  Distance between a terminus base of telomere on chromosomal short arm and 5'-terminus of this base sequence : 74223991
  Distance between 3'-terminus of neighbour sequence of sequence listing upward to telomere on chrosomal short arm and 5'-terminus of this base sequence : 171524
cttagttcatcttcacgatcagacaaccctgtgagggtaggttctgtcattttccccatttcccctaagaggaaactggagaagttaagtaacttgggccagatctcacttatatgctccatgaagccttgtttatctgtccatctgtctgacacacacacacacacacacacacacacacacacaccccctcctcctgcacatcaaggctgggccaggttccctctgtgtctttatgtccccccgtccactcagaccctctcctagctctaatccctctccatcgtggcctgttagctgggagttctgtgaggacagtcca

SEQ ID NO: 22307 - DNA, 333 bp, Homo sapiens
  chr16.fa.O7frz.87086695
  Located on chromosome 16
  Distance between a terminus base of telomere on chromosomal short arm and 5'-terminus of this base sequence : 74379275
  Distance between 3'-terminus of neighbour sequence of sequence listing upward to telomere on chrosomal short arm and 5'-terminus of this base sequence : 154962
agtcactttatgtcatttaatcctccctccctactatggctaccacccctcgcccaacacaaacacacacacacacacacacacacacacacacacacacacatcaattccaaagctaggaattctcactctcattttaatttattttatttttgaggcagggtctggctctgttgcccaggcctgagtgcagtggcatgatcgtggctcactgcagcctcaacctccagggctcaagtgatctttccacctcagcctcctgagtagctgggaccacaggcatgagccactgttcccggctcaccctcattttaaagataaggaaaccaaagc

SEQ ID NO: 22308 - DNA, 188 bp, Homo sapiens
  DISD22_0010323
  Located on chromosome 16
  Distance between a terminus base of telomere on chromosomal short arm and 5'-terminus of this base sequence : 74594385
  Distance between 3'-terminus of neighbour sequence of sequence listing upward to telomere on chrosomal short arm and 5'-terminus of this base sequence : 214777
agcttctctaccagctgtaggttttaacactagatctgttctctctctctctctctctctcagaaaagacaatctcatttgaaagtacttctgtaattgttttaagatgttttcatagaactatactaaaagttgttttgcaaaatgcctctcatcgacccttttcttgaacagttatcgtgatcatg

SEQ ID NO: 22309 - DNA, 234 bp, Homo sapiens
  DISO7_10008086
  Located on chromosome 16
  Distance between a terminus base of telomere on chromosomal short arm and 5'-terminus of this base sequence : 74817513
  Distance between 3'-terminus of neighbour sequence of sequence listing upward to telomere on chrosomal short arm and 5'-terminus of this base sequence : 222940
accagcggtgatatttccattttttttttgaatcagtaattttgccccaggagagattttgaattgaagtatatagtatatgttacttttttaactaaaggaaaaacagaatatatatatatatatatatatatatatatatatatatatatatatatatgcaatgataattcttttttcaaagctttagatgaattaatgttaacatttaacaaccaataaggtccaaatacc

SEQ ID NO: 22310 - DNA, 445 bp, Homo sapiens
  chr16.fa.O7frz.83783169
  Located on chromosome 16
  Distance between a terminus base of telomere on chromosomal short arm and 5'-terminus of this base sequence : 75078793
  Distance between 3'-terminus of neighbour sequence of sequence listing upward to telomere on chrosomal short arm and 5'-terminus of this base sequence : 261046
tctatagttactatgtggctccattttatttgtttttttgtttgtttgtttgtttgtttgttgagatgcgttctcactctgtcacccagactagagtcctgtggcacgatctctgctcactgcaacttctgcctcctgggctcaagcaattccccctgcctcagcctctcgagtagctgagattacacgcgtctgccactacgcccggctaatttttgtatgttttagtacagacgggctttcgccatgttggtcagactggtcttgaactcctgacctcaggtgatctgcctgccttgtcctcccaaaatgctgggattacaggcatgagccactgtgcccagccgtggcttcattttctatagaatgagagcagttgctaagtttttaatacattttcattaaaactacattttttcaacttatgaatagtggttatggagaa

SEQ ID NO: 22311 - DNA, 314 bp, Homo sapiens
  chr16.fa.O7frz.83709529
  Located on chromosome 16
  Distance between a terminus base of telomere on chromosomal short arm and 5'-terminus of this base sequence : 75141940
  Distance between 3'-terminus of neighbour sequence of sequence listing upward to telomere on chrosomal short arm and 5'-terminus of this base sequence : 62702
gatagttacctgaaaggaccagtaagacaccctccaactgaggtcattccacctatttctgcaaaattactttgaagggtcaaatatgagaccgagattcagtggcacctttctcagccaggtttttgctttgtttgttttgtttggtcttgttttttggaggtgatcttttttcttttctgtctctctgtctttctctctctctctctctctctgtgtgtgtgtgtgtgtgtgtgtgtgtgtgtgtgttgtgtgtgtgtgtcttcctccctcccttcctctctctctctctattggtacagtacttaagtggc

SEQ ID NO: 22312 - DNA, 288 bp, Homo sapiens
  HUMUT5030
  Located on chromosome 16
  Distance between a terminus base of telomere on chromosomal short arm and 5'-terminus of this base sequence : 75249668
  Distance between 3'-terminus of neighbour sequence of sequence listing upward to telomere on chrosomal short arm and 5'-terminus of this base sequence : 107414
ctactcaggccttcagatgactaaaatctcatgaaacccaagccaggaccatccctccagctaaactgctcctagatttctggcccacaaaaactatataattattaagtattaatcattttaagtcctaacttttgaggcaatttgttacagagccaacagataactaattcatctatctatctatctatctatctatctatctatctatctatctatatatctatctacctacctacctacctacctacgttttgtttttggtaccaggtacattattacttttca

SEQ ID NO: 22313 - DNA, 143 bp, Homo sapiens
  G07938
  Located on chromosome 16
  Distance between a terminus base of telomere on chromosomal short arm and 5'-terminus of this base sequence : 75249803
  Distance between 3'-terminus of neighbour sequence of sequence listing upward to telomere on chrosomal short arm and 5'-terminus of this base sequence : -153
tgaggcaatttgttacagagccaacagataactaattcatctatctatctatctatctatctatctatctatctatctatctatatatctatctacctacctacctacctacctacgttttgtttttggtaccaggtacatta

SEQ ID NO: 22314 - DNA, 382 bp, Homo sapiens
  chr16.fa.O7frz.83580651
  Located on chromosome 16
  Distance between a terminus base of telomere on chromosomal short arm and 5'-terminus of this base sequence : 75358936
  Distance between 3'-terminus of neighbour sequence of sequence listing upward to telomere on chrosomal short arm and 5'-terminus of this base sequence : 108990
attccatctcgaaaggaagaaagaaagacagagagagagagagagagagagagagagagagagagagaggaaggaaggaaagaaggaaggaagggagggagggaggaaattaaccaggtgtgttgatgcctgcctgtagtcccagctactcaggaggctgagatgggaggatcacctgagctgggggaggtaaagactgcagtgagcagtgatcaagccactgtactccagcctgggcgacagagtaagaccctgtctcaaaaaataaaaaataaaaacaaacaaaagctagttacgcaagaaaccaaaaaataataatattttggccttcttttctagcctctccagtctcacagaatcactaacatttagtccactagaa

SEQ ID NO: 22315 - DNA, 204 bp, Homo sapiens
  AC009087.4_114732
  Located on chromosome 16
  Distance between a terminus base of telomere on chromosomal short arm and 5'-terminus of this base sequence : 75541700
  Distance between 3'-terminus of neighbour sequence of sequence listing upward to telomere on chrosomal short arm and 5'-terminus of this base sequence : 182382
agatgaaatggacatctcgacagaggagtcgatgtgaataaatacacagaggtgggaaagtggaaggtattgataaagagaaagaaatacttgagtgtgtgtgtgtgtgtgtgtgtgtgtgtgtgtacatgtagggggtacttggtggaacagtagtaggaactgtaaccagaaaatgggagagtttcaaatgccagaataaag

SEQ ID NO: 22316 - DNA, 200 bp, Homo sapiens
  D16S3106
  Located on chromosome 16
  Distance between a terminus base of telomere on chromosomal short arm and 5'-terminus of this base sequence : 75693040
  Distance between 3'-terminus of neighbour sequence of sequence listing upward to telomere on chrosomal short arm and 5'-terminus of this base sequence : 151136
gagacctacagtcttttgcatttacattgcaatggtaatagaatggagaagatggacttatacacacacacacacacacacacacacacacacacacacacatgcctgcacacacactccacatattccacatgcatgaatactgcagctttcaccgagttatgccattcagtttagtttccttctgctcagcttcaaaa

SEQ ID NO: 22317 - DNA, 379 bp, Homo sapiens
  AC004682.1_82682
  Located on chromosome 16
  Distance between a terminus base of telomere on chromosomal short arm and 5'-terminus of this base sequence : 75703184
  Distance between 3'-terminus of neighbour sequence of sequence listing upward to telomere on chrosomal short arm and 5'-terminus of this base sequence : 9944
caaatcaccactaaagaacttactcatgtaacaacaacaacaacaacaacaacaacattgggttaaaaaaaaaaaggtgtgtcatcaagtcaggtaccgctgtgagcaactgggctcaggtccatggaggaagtctgtgagacagcacgcctcgggttacctctgattagggagaaaggaaggtgggagatgtaatctaccatctccccatctgacattgcttgagggttgcttctaggggcattaactcttgagaacctgagcttgtcctatgatcaggttcctgcatccagaagaaaagcttgcaggcagtgagacgcaggtgcagcaataaagaccccctgctaccccaatggacactgataccttagagcaggtg

SEQ ID NO: 22318 - DNA, 345 bp, Homo sapiens
  AC004682.1_77046
  Located on chromosome 16
  Distance between a terminus base of telomere on chromosomal short arm and 5'-terminus of this base sequence : 75708747
  Distance between 3'-terminus of neighbour sequence of sequence listing upward to telomere on chrosomal short arm and 5'-terminus of this base sequence : 5184
tacttatgtaacaaacctgcacattctgcacatgtatcccagaacttaaagtataataaaaaagatttaaaaaataaagaaaacattatgaaatgtaagaaagataaacacacacacacacacacacacagattaacaaattaaaaaagatatctgagagatccccttatcagctgtgtattcaagcacaagttatttaacttctgtgcctacatttccccatgtataatatagagataattatggctttcttaaggttgttgcaaggattaaatgcattggtaaatacaatgtacttagaacactgtctgacacatatcatggaaggctagattagtgtttgcc

SEQ ID NO: 22319 - DNA, 184 bp, Homo sapiens
  AC004682.1_50721
  Located on chromosome 16
  Distance between a terminus base of telomere on chromosomal short arm and 5'-terminus of this base sequence : 75735090
  Distance between 3'-terminus of neighbour sequence of sequence listing upward to telomere on chrosomal short arm and 5'-terminus of this base sequence : 25998
tcatgattctggactctagtaaagactgtaagtgtgttaaatctctctctctctctcagagcttacagaatgtgtgtgtgtgtgtgtgtgtgtgtgtgtgtgtgtgtgtgtgaaagagagagagagacagacagagagagagaaggagctttcaaaaactcttgaactgattcagaaactaacc

SEQ ID NO: 22320 - DNA, 203 bp, Homo sapiens
  D16S3059
  Located on chromosome 16
  Distance between a terminus base of telomere on chromosomal short arm and 5'-terminus of this base sequence : 75746799
  Distance between 3'-terminus of neighbour sequence of sequence listing upward to telomere on chrosomal short arm and 5'-terminus of this base sequence : 11525
ctcatagagcctggcaggaaaaccactggtgacatttgagagtacagtccaggttccccagagaaagagaaccagtagggcatgtgtgtgtgtgtgtgtgtgtgtgtgtgtgtgcatattgatatacacacacatatacatatataaagaaatttatcataagaaattggctcacatgaatatgaaggctaagtcccaagatc

SEQ ID NO: 22321 - DNA, 207 bp, Homo sapiens
  AC004682.1_20999
  Located on chromosome 16
  Distance between a terminus base of telomere on chromosomal short arm and 5'-terminus of this base sequence : 75764755
  Distance between 3'-terminus of neighbour sequence of sequence listing upward to telomere on chrosomal short arm and 5'-terminus of this base sequence : 17753
atgcctaaagtttcagctactcaggaggctgaggtgggaggatcacttgaacctgggagttcaaggttacagtgagctatgatcatgcccctccactccagccgggatgacagaatgagactgtttattataataataataataataataataataataataataataaagcctcacaaaatcctagaagctcttatttcgacataa

SEQ ID NO: 22322 - DNA, 292 bp, Homo sapiens
  AC009075.5_30749
  Located on chromosome 16
  Distance between a terminus base of telomere on chromosomal short arm and 5'-terminus of this base sequence : 75854187
  Distance between 3'-terminus of neighbour sequence of sequence listing upward to telomere on chrosomal short arm and 5'-terminus of this base sequence : 89225
cagttacttgacctttgtcaactcttagtgttgtctttgtcattttagtgggcatgtgttggtatttcaaagtctttactgatccagattattaaatcagtagcattcagaatcaattcacgttctcattctactcttacatctgtttttcttagcatagatttctgtttcagaatttgtgttttcagggtcttttgaggaggagataaaacaaaacaaaacaaaacaaaacaaaaggtttatttatcgtttctaacctcagcttccttcctgatggtttgtagttgacttc

SEQ ID NO: 22323 - DNA, 334 bp, Homo sapiens
  AC004158.1_20374
  Located on chromosome 16
  Distance between a terminus base of telomere on chromosomal short arm and 5'-terminus of this base sequence : 76069200
  Distance between 3'-terminus of neighbour sequence of sequence listing upward to telomere on chrosomal short arm and 5'-terminus of this base sequence : 214721
gaatttcataattgctaaatccagtagcctttcttggaactccttggcttctttgaagttccagaccctgttaactctttgcctctctcgaaattctctcctttctttgcttttatgtctgcttcatttagatacttcacatccgttttcccgagctcctcctccgcagagaaagtcactcaaaaacattgtgtccaaatatctgtcttcggtacactattttatgtgtgtgtgtgtgtgtgtgtgtgtgtgtgtgtgtgtgtgtgtgtatttcctcttcaggtcaactactatgaaatatctatctgtaattctgagtacagcttatggtagg

SEQ ID NO: 22324 - DNA, 408 bp, Homo sapiens
  chr16.fa.O7frz.84972913
  Located on chromosome 16
  Distance between a terminus base of telomere on chromosomal short arm and 5'-terminus of this base sequence : 76145709
  Distance between 3'-terminus of neighbour sequence of sequence listing upward to telomere on chrosomal short arm and 5'-terminus of this base sequence : 76175
gctaccattttcctagaaatttagaaacttttcctaaaattcatacgggaaatgaaagcaacccagaaaagccaaaactatcctgagaaacaacaaaatcgaaggattcacaccttccaatttcaaaacttacaaggatatagtaataaagtggtactagtgtaaggacagacatatagatcaagtgaataaaattgagagactgtaaataatcctttacatttatggtcaatttatatatatatatatatatataaaaacaaaagtgccaagataattcaatggggggaaaatcatcttcaacaagtagccctggagcagctgggttatctacctacggaagaatgaagttagatttcttcctcacaccgcacacaaaagttaactccaaatagattgtagacctaa

SEQ ID NO: 22325 - DNA, 201 bp, Homo sapiens
  D16S3139
  Located on chromosome 16
  Distance between a terminus base of telomere on chromosomal short arm and 5'-terminus of this base sequence : 76216916
  Distance between 3'-terminus of neighbour sequence of sequence listing upward to telomere on chrosomal short arm and 5'-terminus of this base sequence : 70799
tcctgagcaattaggtaagacaaagaaagaagtaaaactatctttattcactgatgatgtaatcatatgtaacccaaaagaatccacacacacacacacacacacacacacacacaaacactttgttagatgtaataaactaattcagcaaagttgtaggatacaaagttcatactcagaagtcagttatacagtcacgag

SEQ ID NO: 22326 - DNA, 413 bp, Homo sapiens
  chr16.fa.O7frz.85143274
  Located on chromosome 16
  Distance between a terminus base of telomere on chromosomal short arm and 5'-terminus of this base sequence : 76336432
  Distance between 3'-terminus of neighbour sequence of sequence listing upward to telomere on chrosomal short arm and 5'-terminus of this base sequence : 119315
ttaagctggaactcagcactggggatgtagaaagggaagaggaggtgctgctgctgctgtagttgcagcagggtctcagttgtcatggggaagtgaggaaggagggtggggttaaacagctgagactggatcagggcagcctgttgctgcagctcctgctgcaggtgagcttgaacttgagcctgggcctgggccagcgtttgtgcttgttgttgttgttgttgttgttgttgttgctgttgctgctgctgttgttgctgctgcctggatgcaatcatatctgccagtttcttccgattggcctctttgggctctgaaggggaagcaatgttggcaccaataggattccccaggggtggcatccctacactctcagtgggcacttggcttagtaagttagagcttggagcaat

SEQ ID NO: 22327 - DNA, 334 bp, Homo sapiens
  AC002044.1_211448
  Located on chromosome 16
  Distance between a terminus base of telomere on chromosomal short arm and 5'-terminus of this base sequence : 76443497
  Distance between 3'-terminus of neighbour sequence of sequence listing upward to telomere on chrosomal short arm and 5'-terminus of this base sequence : 106652
cctaacttagaagcaatagcgtctccaagatggctttccagaacagacactgaagtgccagtgaggctgggcagtcgctacaaaggtttcttctatgaggagtcagatttttggccttcacaccactctggggtgtgtgtgtgtgtgtgtgtgtgtgtgtgtgtgtgtgtgtgtgtgtgtgtgtgtgtgtgtgtgtagcgggtagtggggaggacacactagcatatacttaggatggactaagacaaggaatatgtaatcagaagccatcacaattacaaatgtaaatgaacaggcaattggcactgacctttgcagattgttagaggactaa

SEQ ID NO: 22328 - DNA, 343 bp, Homo sapiens
  AC002044.1_163053
  Located on chromosome 16
  Distance between a terminus base of telomere on chromosomal short arm and 5'-terminus of this base sequence : 76491819
  Distance between 3'-terminus of neighbour sequence of sequence listing upward to telomere on chrosomal short arm and 5'-terminus of this base sequence : 47988
ttcaagtatactttccagatccacttatgcatctaatcatcaggcaggtcatgagcttggtgagattttgtttctgttgcacatacttcgcacatcgtttcagatgttaaagacggtttcgcattaagttctccttctttcaaatcaagaagggaggcatttcctcccacttgttgactcagagctgtaatcagagattctgggattagccatttatttcattacacacacacacacacacacacacacacacacacacacacacacactcttcagctttcaaaagaggtcgggggaagggagaaaacaatcatgacttcagtagccaaggagattaacttcc

SEQ ID NO: 22329 - DNA, 312 bp, Homo sapiens
  AC002044.1_119897
  Located on chromosome 16
  Distance between a terminus base of telomere on chromosomal short arm and 5'-terminus of this base sequence : 76535058
  Distance between 3'-terminus of neighbour sequence of sequence listing upward to telomere on chrosomal short arm and 5'-terminus of this base sequence : 42896
atgactctgaaacaaggagtgtgttttcctctcggcaggaagaaaaccactcggtgggctcaccatcggcagcttgctctggcacgaggctccggaactggcaccatgacaaaacaaacaaggattgccctttggaggctcactgatagggcaacacacacacacacacacacacacacacacacagcctctcaccaacacgggcacagcgagttcttcagatatccctggcctgctggcataaagagcttttcaagcagtgggaagccaaagggacactcaacaaagcagtaatggccactgtaaggtaga

SEQ ID NO: 22330 - DNA, 347 bp, Homo sapiens
  AC002044.1_85559
  Located on chromosome 16
  Distance between a terminus base of telomere on chromosomal short arm and 5'-terminus of this base sequence : 76569408
  Distance between 3'-terminus of neighbour sequence of sequence listing upward to telomere on chrosomal short arm and 5'-terminus of this base sequence : 34038
tagagatggcttcaattgagtaagacttggccccaagatgattacatctgtgactaaagaaggcaggagggaaaaacaataatctctaattctgcaatctccaagttcagaagaattgagagctacaagaaaaataaagtatatacgtgtgtgtgtgtgtgtgtgtgtgtgtgtatgtgtgtatatatatgttaaaaagcttaatgaggttccaactgggctattttgaaacctaaatgtcaggaacatgaagctgaggcagtacagtagccagttccctgtatctccttacgcagcctttcccattttacaattactacatcttgtagatcttgcctgctacagac

SEQ ID NO: 22331 - DNA, 298 bp, Homo sapiens
  AC002044.1_55683
  Located on chromosome 16
  Distance between a terminus base of telomere on chromosomal short arm and 5'-terminus of this base sequence : 76599355
  Distance between 3'-terminus of neighbour sequence of sequence listing upward to telomere on chrosomal short arm and 5'-terminus of this base sequence : 29600
gaggtgcaaatgttaccacctcaagtgctagcacattaccatgctctaaaaggaaagactcttcctttttattactattattattattattattattattattgagtcgggatgtcactctgtcacccaggctggagtgcagtggcacaatcacggctcaatgcagcctctacttcctgggctcaagcaatccacccacctcagcctcccgagtagctaggaatacaggcgtgcaccaccacgcccggctaatttttgtattttttttgtagagacaaggtcttgccatgttgctaag

SEQ ID NO: 22332 - DNA, 310 bp, Homo sapiens
  AC002044.1_38779
  Located on chromosome 16
  Distance between a terminus base of telomere on chromosomal short arm and 5'-terminus of this base sequence : 76616264
  Distance between 3'-terminus of neighbour sequence of sequence listing upward to telomere on chrosomal short arm and 5'-terminus of this base sequence : 16611
taagtgcatatgcatccagactcccccagtgaagacacccacacggtgcagacgtacgcgcgcgcgcgcgcgcacacacacacacacacacacacacatacacacacacacacgtcaggactgccaggccatgggaccagctccaccccagttttcttggcccacaccactgagagcctgaactctctttgcgggccccccaaatcctcatacctacaactctacacacacacacacacacacacacacgcagagaacaccactcctccagagactttgtatgtttaaaaagtccacagatctgaatcgc

SEQ ID NO: 22333 - DNA, 213 bp, Homo sapiens
  AC002044.1_38628
  Located on chromosome 16
  Distance between a terminus base of telomere on chromosomal short arm and 5'-terminus of this base sequence : 76616463
  Distance between 3'-terminus of neighbour sequence of sequence listing upward to telomere on chrosomal short arm and 5'-terminus of this base sequence : -111
ccaaatcctcatacctacaactctacacacacacacacacacacacacacgcagagaacaccactcctccagagactttgtatgtttaaaaagtccacagatctgaatcgcctcctctctggaccggagcagggcagtttattcagagaaatcaataggaaagagcatttgcaaatatttatataagccctgtgcgtttcagcattaagtaat

SEQ ID NO: 22334 - DNA, 404 bp, Homo sapiens
  AC002044.1_36407
  Located on chromosome 16
  Distance between a terminus base of telomere on chromosomal short arm and 5'-terminus of this base sequence : 76618610
  Distance between 3'-terminus of neighbour sequence of sequence listing upward to telomere on chrosomal short arm and 5'-terminus of this base sequence : 1934
taggaacctggctaagaatctttttaagattttttttttcctttcttcttcccccccttctcttttctttcttattattttcccctttctctctctctctctctctctctctctctctctctctaagcaaacgcagcaatgtttaaattaactaggaaaagagcatctccaaagaatgggggcattagtggagggggacagcttagagtaaaggtttaagtgaaagagcagagacttcgaatagagaccactttaaattgcaaatctgagattttttaactgaaggaaaattacctccccccaaatcagaggacgaatgaagaaaatatggagaaaactttaacacataccatagactagacaaaaaatatatgttaattttgtgttctgaaataagacgcaat

SEQ ID NO: 22335 - DNA, 196 bp, Homo sapiens
  D16S3066
  Located on chromosome 16
  Distance between a terminus base of telomere on chromosomal short arm and 5'-terminus of this base sequence : 76793572
  Distance between 3'-terminus of neighbour sequence of sequence listing upward to telomere on chrosomal short arm and 5'-terminus of this base sequence : 174558
cccagttccaatggcaccagcaggaatggtgccccagccactgttggctccctggatggggtctaatggttcagccacagtccatgcatcatccccagggaaattcacagttctagccctttcattacaatcccgtgtgtgtgtgtgtgtgtgtgtgtgtgtgtgtgtctgtgtttcaaaccatcgtgtcctgact

SEQ ID NO: 22336 - DNA, 166 bp, Homo sapiens
  chr16.fa.O7frz.85874848
  Located on chromosome 16
  Distance between a terminus base of telomere on chromosomal short arm and 5'-terminus of this base sequence : 76899827
  Distance between 3'-terminus of neighbour sequence of sequence listing upward to telomere on chrosomal short arm and 5'-terminus of this base sequence : 106059
gatgtagctgtctggatataacagggccatcaaaagtgtgtggaaagagtgtgtgtgtggtgtgtggagtgtggtgtgtggtgtgtgtgtgtgtgtgtgtgtgtgtgtctagatagcagagggtacacccccagaggctgggcttaagaatgaaatggagttattg

SEQ ID NO: 22337 - DNA, 382 bp, Homo sapiens
  chr16.fa.O7frz.86085253
  Located on chromosome 16
  Distance between a terminus base of telomere on chromosomal short arm and 5'-terminus of this base sequence : 77186814
  Distance between 3'-terminus of neighbour sequence of sequence listing upward to telomere on chrosomal short arm and 5'-terminus of this base sequence : 286821
gaatagctactcagtttgtagcacatgtttctggattgaaaccttatctaggagagttataaagtttacagactaagcttaaaggaaaggagcataacacagccaagttgtttggggtgcactggtcttggttcaccctgtattcaccacccttgccagaatggaacccttttttgtacaccttccagagagacagagcttaaccggtagcaccaccatttagaaggagagagaatatatatatatttgcagctaaatatatatatatatatatatatatatatatatatatatatatatatatatatatttgcagctttaagtcttattttttattttaaaacatttccaggccagttgcagtggcttacaactgtaatcc

SEQ ID NO: 22338 - DNA, 171 bp, Homo sapiens
  Z66643
  Located on chromosome 16
  Distance between a terminus base of telomere on chromosomal short arm and 5'-terminus of this base sequence : 77228759
  Distance between 3'-terminus of neighbour sequence of sequence listing upward to telomere on chrosomal short arm and 5'-terminus of this base sequence : 41563
gtaagaattttccgtctgtatctaaaaagagccccctgcctctgcttgaaagttgtagtggtgacactgccctcgtagcacataatactttaccttaatgctaagaataaccccctacacacacacacacacacacacacacacacacacaagtgtaactgcacctaagtc

SEQ ID NO: 22339 - DNA, 392 bp, Homo sapiens
  AC024978.3_125810
  Located on chromosome 16
  Distance between a terminus base of telomere on chromosomal short arm and 5'-terminus of this base sequence : 77249845
  Distance between 3'-terminus of neighbour sequence of sequence listing upward to telomere on chrosomal short arm and 5'-terminus of this base sequence : 20915
actcacctttctaaactaccaatctttcagccttccaaatacactagatcccgccatattggaccacttcccacatgcactttgtatttttacctggccatgccctttccctaaaatgcccttattgttttgtctgcctggtgaactttccttgtccttcaagggtcagaccgaggataattcctgtgcttatcctgtttatatcactcccttcccactaccccgataatatcgcaaccaccagcaacagcaccaccaccaccaccaccacctcttccaggtaggaaccctaccttccaggcagggttccctcatctctggaactattatagacccatctcatctgtagtgctttctcataatttattacagctatttactatgcaagtctt

SEQ ID NO: 22340 - DNA, 125 bp, Homo sapiens
  D16S738
  Located on chromosome 16
  Distance between a terminus base of telomere on chromosomal short arm and 5'-terminus of this base sequence : 77339500
  Distance between 3'-terminus of neighbour sequence of sequence listing upward to telomere on chrosomal short arm and 5'-terminus of this base sequence : 89263
tctgcaagtcaactgctactgtgtgtgtgtgcgcacatgcgtgtgtgtgtctgtgtgtgtgtgtgtgtgtgtgtgtgcgtgcgcgcacgcatgtatggtgtgtaccgctaggtcaggaatgaact

SEQ ID NO: 22341 - DNA, 302 bp, Homo sapiens
  chr16.fa.O7frz.86440335
  Located on chromosome 16
  Distance between a terminus base of telomere on chromosomal short arm and 5'-terminus of this base sequence : 77433946
  Distance between 3'-terminus of neighbour sequence of sequence listing upward to telomere on chrosomal short arm and 5'-terminus of this base sequence : 94321
agaacctgactaaagctgagactgctgggtactactgagaccaagaaaaaggctccaggcagtatgtgctggaactgacacacacacatacacataaacacacacacacacacacacacacacacacacacacacacacacacacgctgccttctatagctgcctgctgttgctggacaaatgtcaatggaagctgtaaatgaaaattaaaaaaaaatttaaaaaaaagtaactcctacctatattctgtcttccagtctctccccaggatcaccaattggtaggacctaactagaagccag

SEQ ID NO: 22342 - DNA, 322 bp, Homo sapiens
  chr16.fa.O7frz.87861737
  Located on chromosome 16
  Distance between a terminus base of telomere on chromosomal short arm and 5'-terminus of this base sequence : 77525887
  Distance between 3'-terminus of neighbour sequence of sequence listing upward to telomere on chrosomal short arm and 5'-terminus of this base sequence : 91639
tcttacttgatttcttggtagaacgttaataagtcaactctatgatggggttttattactttgtgtgtgtgtgtgtgtgtgtgtgtgtgtgtgtgtagccaaatgttgtttatttgaaacccatgtgataaaagttttaaaatattaatatcctcgctattttaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggc

SEQ ID NO: 22343 - DNA, 415 bp, Homo sapiens
  chr16.fa.O7frz.86772969
  Located on chromosome 16
  Distance between a terminus base of telomere on chromosomal short arm and 5'-terminus of this base sequence : 77775075
  Distance between 3'-terminus of neighbour sequence of sequence listing upward to telomere on chrosomal short arm and 5'-terminus of this base sequence : 248866
cttaaatgtgaatggacagttaacaaccaccagaccttcaagaaagggccacaaaatgaaagagaataagattactgtgaaaaggaactcagtgggaacaggggggagagagagagagagaaagagagagagagagagagagagaggaaaattaaaaaccaatagaacaaaaacaaattgttattaatatggccaaagagagatgcttcatctatgattccgttaaaataaatagagaaaaagaaagaattatcgggaattaaacataagatcaaagaaaacaattagtagaaagaatggaagataaaattgaagaaatattctggaaaacacaacaaagagaaacaaaaaagaaaaagagtaaagataacagaattcgggagggatattcaggagcttcaacattcaactaaca

SEQ ID NO: 22344 - DNA, 296 bp, Homo sapiens
  AC004605.1_67760
  Located on chromosome 16
  Distance between a terminus base of telomere on chromosomal short arm and 5'-terminus of this base sequence : 77883396
  Distance between 3'-terminus of neighbour sequence of sequence listing upward to telomere on chrosomal short arm and 5'-terminus of this base sequence : 107906
ttactttcctaaggacttcaggtcttgtggccagagaaagctcttagacagagtcccaggcatttgcagaaagaggctgtgtgtgtgtgtgtgtgtgtgtgtgtgtgtgtgtgtgtgtatgtgagtgtacataagaggagtctgtaaactccttgagtatgagaccttgcatttgtatgtaacttctacttgtaaataatgatttacaagtaaatgcattgattttatgcatttatgaaggaaactgcccagaaaaagatgcttcctgaattgtttataggaactgtcgctctatg

SEQ ID NO: 22345 - DNA, 258 bp, Homo sapiens
  D16S3018
  Located on chromosome 16
  Distance between a terminus base of telomere on chromosomal short arm and 5'-terminus of this base sequence : 77883441
  Distance between 3'-terminus of neighbour sequence of sequence listing upward to telomere on chrosomal short arm and 5'-terminus of this base sequence : -251
agacagagtcccaggcatttgcagaaagaggctgtgtgtgtgtgtgtgtgtgtgtgtgtgtgtgtgtgtgtgtatgtgagtgtacataagaggagtctgtaaactccttgagtatgagaccttgcatttgtatgtaacttctacttgtaaataatgatttacaagtaaatgcattgattttatgcatttatgaaggaaactgcccagaaaaagatgcttcctgaattgtttataggaactgtcgctctatgtttatcc

SEQ ID NO: 22346 - DNA, 366 bp, Homo sapiens
  AC004605.1_76100
  Located on chromosome 16
  Distance between a terminus base of telomere on chromosomal short arm and 5'-terminus of this base sequence : 77891702
  Distance between 3'-terminus of neighbour sequence of sequence listing upward to telomere on chrosomal short arm and 5'-terminus of this base sequence : 8003
tatgaataagaacgtgttgaattcttccttccttcctttctctctctctctctttccttctttccttccttcctttcctcccttcctttcctcttccccttcctccctccttccctccctccctccctccctcccttccttccttccttccttccctccttcttttcttttcttttcttttttaacagagtcttgctgtgtcacctaggctggagtgcagtgatgcgatcttggctcactgcaacccccatctcctgagttcaagcaagtctcgttcctcagcctcctgagtagctgggattacaggtgtgtgccaccatgcccgactaattgttgtatttttagtacagacgaggtttcattatg

SEQ ID NO: 22347 - DNA, 209 bp, Homo sapiens
  D16S512
  Located on chromosome 16
  Distance between a terminus base of telomere on chromosomal short arm and 5'-terminus of this base sequence : 77988352
  Distance between 3'-terminus of neighbour sequence of sequence listing upward to telomere on chrosomal short arm and 5'-terminus of this base sequence : 96284
tcacgttgtgaatgcaagtttggaaatacctttgagaatttcttttgctgcctgcctgcctatttacttgcaagcattttctccatttctttttcaaagcagttagaaaatgtgagtgtgtgtgtgtgtgtgtgtgtgtgtgtgtgtttgagagagagtgtgtgtgtgtagatgattttgtgaaatgccatttatttatttggctctca

SEQ ID NO: 22348 - DNA, 408 bp, Homo sapiens
  AC004685.1_75987
  Located on chromosome 16
  Distance between a terminus base of telomere on chromosomal short arm and 5'-terminus of this base sequence : 78218468
  Distance between 3'-terminus of neighbour sequence of sequence listing upward to telomere on chrosomal short arm and 5'-terminus of this base sequence : 229907
cagaggttgtagtgacctgagatcacgccactgcactccagcctaggcaacagagcaagactctgtctcaaaaaaaaagaaagaaagaaagaaagaaagaaagaaaaacgtagatcactatatacacttaaggtgtgttactattagctctacagggatcatcgttatccaactgttctttatctgcgttcctgaagattcaagttgcaaaagacagcaaaaatcatgtagatatttatgagtcagttgtttaataaatttggcccttgctcaaatactgaccacctcctaccccaactttgccctgcccatctaggcaaagtgttctctctttgatggttagagggtgctatcatccaacaatatgcaatgtatcaaaatgcaaagtaagataaacatccatgcaga

SEQ ID NO: 22349 - DNA, 250 bp, Homo sapiens
  AC004685.1_109175
  Located on chromosome 16
  Distance between a terminus base of telomere on chromosomal short arm and 5'-terminus of this base sequence : 78251629
  Distance between 3'-terminus of neighbour sequence of sequence listing upward to telomere on chrosomal short arm and 5'-terminus of this base sequence : 32753
ccattgtagttaaactgaattccttagtttctggcttatattccctgtgtttcatcttgttatgtatttgttatgtaattatatgctaataacaagcatatttatatatatatatatatatatatatatatatatatatatatatatatacacatattcttatttcccttcctttcttacacaaaagagtggctactataaacattcttttgtacttttctttttcctccgaatgagttagattgtaagt

SEQ ID NO: 22350 - DNA, 129 bp, Homo sapiens
  DISD22_0010331
  Located on chromosome 16
  Distance between a terminus base of telomere on chromosomal short arm and 5'-terminus of this base sequence : 78593522
  Distance between 3'-terminus of neighbour sequence of sequence listing upward to telomere on chrosomal short arm and 5'-terminus of this base sequence : 341643
cttgtcatggaattgaggggcaggccacctcctcaagggtgcatgtgtttctgtatgtgtgcacgtgtgtgtgtgtgtgtgtgtgtgtgtgtgtgtgtgtgtgtaaactagaggctttacacctaaggc

SEQ ID NO: 22351 - DNA, 338 bp, Homo sapiens
  chr16.fa.O7frz.89499890
  Located on chromosome 16
  Distance between a terminus base of telomere on chromosomal short arm and 5'-terminus of this base sequence : 78866258
  Distance between 3'-terminus of neighbour sequence of sequence listing upward to telomere on chrosomal short arm and 5'-terminus of this base sequence : 272607
tctatgctgagcttaaggtttatcactatatatatatatatatatatatatatatatatatatatatatatatatatatgcacgttctgaaccacagaacataaaaccattttaaagtgtactgaattatacatcacaagggtgggcaaccaatacctctatatttacatgttttaaaatctgtacacctgggattgtatggcaggtcttttgcaatttgatttttgcatcaatgctgcttacaaggttcatctatgttgatgcgcatagctgccagcttgtgcatttcactgccaaatcgtataccattgtgtgactactttacaattgacgcattc

SEQ ID NO: 22352 - DNA, 389 bp, Homo sapiens
  chr16.fa.O7frz.89278678
  Located on chromosome 16
  Distance between a terminus base of telomere on chromosomal short arm and 5'-terminus of this base sequence : 79072784
  Distance between 3'-terminus of neighbour sequence of sequence listing upward to telomere on chrosomal short arm and 5'-terminus of this base sequence : 206188
actataagccagtgaactgtacacttttaaaatataaactttgggccggacgcagtggctcacgcatgtaatcccagcactttggattaaatgggtggatcacctgaggtcaggaaggcagagtttgcagtgagctgaaatcaagccactgcactccagcttgggtgacaagagtgaaactccgtcttaaaaaaaaaaaaaaaaaaaaaaaaaatatatatatatatatatatatatatataaaatataatatacttatatataatatatataaactttaacatacatgaattctatctcaataaagccattatttaaaaaaatacaaagtatgggagatgcacactgaagtttggtgtttatttttctatggccagtttacaggtaat

SEQ ID NO: 22353 - DNA, 375 bp, Homo sapiens
  chr16.fa.O7frz.89732451
  Located on chromosome 16
  Distance between a terminus base of telomere on chromosomal short arm and 5'-terminus of this base sequence : 79376740
  Distance between 3'-terminus of neighbour sequence of sequence listing upward to telomere on chrosomal short arm and 5'-terminus of this base sequence : 303567
ctgaatcgtatggtaactctgtttacctttttgaataatagccaaactgtttctcacagcagctgtgcaattttacctctccacctgcaatgtatgaggggttccagcttctctacatccttacaacacttgttattttccattttcaaaatgatagtcattttagtagatataaatgggtaccttattaaaaaataaataaataaataaatgggtaccttattgtggctttgatttttatttctctagtgactaaggaaggatgttgagcagtttctcaattgagtatttgctatatctatctatctatctatctatctatctatctatccatccatccatccatccatccatctaatgtccatttgaactctg

SEQ ID NO: 22354 - DNA, 370 bp, Homo sapiens
  chr16.fa.O7frz.90914354
  Located on chromosome 16
  Distance between a terminus base of telomere on chromosomal short arm and 5'-terminus of this base sequence : 79520676
  Distance between 3'-terminus of neighbour sequence of sequence listing upward to telomere on chrosomal short arm and 5'-terminus of this base sequence : 143561
ggagtaaagtaggaataactcgagctgattatagagactcaatttctcacactgaggtgagaagagtgttatttcaaattcacagtccttaaaaaaaagaacagacaaaacatgtaattattatctgccaacaatgtggagtaaaatgacgcagaggtgtttgtctgtttttaatttataaagttctacatgtttcacaagttatccaacctgtgcatttctgtttaaagtactgagaaaattcctagtcttggaaatgtctgtgttctttttctgatagacactggtaagtgccacacacatacacacacacacacacatacataaacataaaaaaattggtaaactttaggtgtatctatggatacca

SEQ ID NO: 22355 - DNA, 304 bp, Homo sapiens
  chr16.fa.O7frz.91017754
  Located on chromosome 16
  Distance between a terminus base of telomere on chromosomal short arm and 5'-terminus of this base sequence : 79630449
  Distance between 3'-terminus of neighbour sequence of sequence listing upward to telomere on chrosomal short arm and 5'-terminus of this base sequence : 109403
acagaacctcaagttgatcttaaaatggtttaaacaaaagatctctctgtctctctgtctctgtctctctgtctctctgtttctctctctgtctctctctctgtctctcgctctgtctctcgctctgtctctgtctctcactctgtctctgtctctcgctctgtgtctctgtctctgtgtctgtctctgtctctttctctctgtctctgtctctctctctctctctatatatatatacaagattactactcactgtaaaagcacaaaaaatagaagtagatggaaatactgtaaatttagatga

SEQ ID NO: 22356 - DNA, 472 bp, Homo sapiens
  chr16.fa.O7frz.91238664
  Located on chromosome 16
  Distance between a terminus base of telomere on chromosomal short arm and 5'-terminus of this base sequence : 79905660
  Distance between 3'-terminus of neighbour sequence of sequence listing upward to telomere on chrosomal short arm and 5'-terminus of this base sequence : 274907
actgcttatgttcaaagtctgtctctgctgcctgccaaaggtcagacatttaaaacctgtgccatattgcctgatttataaaatgtggacaatggctgggcacgatggctcacgcctataataatcctagcactttgggaggtcgaggtgggtggatcacttaaggtcaggagttcgagaccagcttgaccaaagtggtgaaaccctgtctctactacaaatacaaaaattagccggacgtggtggtatgtgcctgtaatcctagctacttgggtggctgagacaggagaattgcttgaacctgggaggcagagtttgcagtgagctgagattgcgccactgcactccagcctgggcaacagagcaagactccgtctctaaataaataaataaataaataaataaataaataaataaagtgaagaataacagctgccctagtagtttattgtgaaacttgaaattggtaatg

SEQ ID NO: 22357 - DNA, 175 bp, Homo sapiens
  chr16.fa.O7frz.91351157
  Located on chromosome 16
  Distance between a terminus base of telomere on chromosomal short arm and 5'-terminus of this base sequence : 80020509
  Distance between 3'-terminus of neighbour sequence of sequence listing upward to telomere on chrosomal short arm and 5'-terminus of this base sequence : 114377
aatttcactaacatctgttcaaagagatatgggattagcatctaagtgtccttgtgggtcaatatagattataaaggtaggattgtgtgtgtgtgtgtgtgtgtgtgtgtgtgtatttcaactttgggttaattgtttaatatgaattaaatagtacaactttccaaactcctac

SEQ ID NO: 22358 - DNA, 198 bp, Homo sapiens
  D16S3097
  Located on chromosome 16
  Distance between a terminus base of telomere on chromosomal short arm and 5'-terminus of this base sequence : 80020559
  Distance between 3'-terminus of neighbour sequence of sequence listing upward to telomere on chrosomal short arm and 5'-terminus of this base sequence : -125
cttgtgggtcaatatagattataaaggtaggattgtgtgtgtgtgtgtgtgtgtgtgtgtgtgtatttcaactttgggttaattgtttaatatgaattaaatagtacaactttccaaactcctacttttactaatgcaacttaaggtttctgtgttattaaaagcattttatatagctaccatcttctttggctatca

SEQ ID NO: 22359 - DNA, 440 bp, Homo sapiens
  chr16.fa.O7frz.91472231
  Located on chromosome 16
  Distance between a terminus base of telomere on chromosomal short arm and 5'-terminus of this base sequence : 80141194
  Distance between 3'-terminus of neighbour sequence of sequence listing upward to telomere on chrosomal short arm and 5'-terminus of this base sequence : 120437
ggacataatgaagatcaaagtaagaaataatgaaatagaataaaaaatggagaaaataaatgaaatcaaaagctggttttttgagatcaagttagactggccctaagaaacacaatcttacacacacacacacacacacacacacacacacaccccataatatcaggtatgagaggggtaatgttagtacagaatccacagatcttaagagcataataagaggaaaatatgaactactttagaactataaatttgacaacttttaataaaattgacaggtttaaaagatacaacctatcaaatctcactgaagaagatatagacaacctgaatagccctgtatctcttaaagaaaccaaattcttaaattttttcaaaaaaataaggctccatccccataattcataatttctctggtgaattctatcaaacatctaagg

SEQ ID NO: 22360 - DNA, 203 bp, Homo sapiens
  D16S3125
  Located on chromosome 16
  Distance between a terminus base of telomere on chromosomal short arm and 5'-terminus of this base sequence : 80248917
  Distance between 3'-terminus of neighbour sequence of sequence listing upward to telomere on chrosomal short arm and 5'-terminus of this base sequence : 107283
ctgctacagcagcattttcaaatgtgaaagcgagaaagtgtagatgggatgtgtgtgtgtgtgtgtgtgtgtgtgtgtgtgtgtgtgtgtgtgccaatatctatattgaatatatagatataggcacatatatatacatgtgccaatatctcatcctgtcacccaggctggacaggctggagtacagtgctgtgagcctgaca

SEQ ID NO: 22361 - DNA, 259 bp, Homo sapiens
  D16S3090
  Located on chromosome 16
  Distance between a terminus base of telomere on chromosomal short arm and 5'-terminus of this base sequence : 80282660
  Distance between 3'-terminus of neighbour sequence of sequence listing upward to telomere on chrosomal short arm and 5'-terminus of this base sequence : 33540
caaagttcacacagcaggtaaatacaaggtctaggaatcacacctaggaatttttaaccccagagtgtatgctccttaacacggccctgtttgcctaaccttgctatcaaaatttccaaggtcaacctcatccattcatgccattcttcaagttcattgaagaagaacttgtcttcttcaatagttcatcttattgcaaagaaagtgtgtgagtgtgtgtgtgtgtgtgtaatgtatgcgaattattttagaattactg

SEQ ID NO: 22362 - DNA, 162 bp, Homo sapiens
  D16S3101
  Located on chromosome 16
  Distance between a terminus base of telomere on chromosomal short arm and 5'-terminus of this base sequence : 80326072
  Distance between 3'-terminus of neighbour sequence of sequence listing upward to telomere on chrosomal short arm and 5'-terminus of this base sequence : 43153
tgtcatcggggcttgtagcttttgaattttacaaaaatggcattaaaaaacaaaaaaaatcattaaccatgtgcattcccctgccgtgtgtgtgtgtgtgtgtgtctgtgtatgtgtgtgtctgtgtttactatataacaccaactacatgacattcaggaa

SEQ ID NO: 22363 - DNA, 404 bp, Homo sapiens
  chr16.fa.O7frz.91977206
  Located on chromosome 16
  Distance between a terminus base of telomere on chromosomal short arm and 5'-terminus of this base sequence : 80586173
  Distance between 3'-terminus of neighbour sequence of sequence listing upward to telomere on chrosomal short arm and 5'-terminus of this base sequence : 259939
taggagcaataaactgtaccatacggcctaggtgtatggtaggctataccgtcaaggtttgtgtaagttcactctatgatgttcacacaataacaaaaccccctaaccatgcatttctcagaatgtatcctcatcattaggtgtcatatgactgtgtgtgtgtgtgtgtgtgtagtgtgtatgtgcatatatacacacacacacatacatacatacatgtagataattcatcagaagttaacacaaatatccatttcattagatcagcagtggcaaatcagctttatctcatttgccagtttcattgcctcgaagggctacctggaaatctgtttgcacaaggactctgatgccaaatcttatcttaatggtaagaagggccattactgacaggaatagcatca

SEQ ID NO: 22364 - DNA, 446 bp, Homo sapiens
  chr16.fa.O7frz.92216447
  Located on chromosome 16
  Distance between a terminus base of telomere on chromosomal short arm and 5'-terminus of this base sequence : 80841835
  Distance between 3'-terminus of neighbour sequence of sequence listing upward to telomere on chrosomal short arm and 5'-terminus of this base sequence : 255258
cctttcatacatccatacacatccatctgttcattcatctatccatccatgcatccttccttcgttgttttcttccttctatccatctattcatctacccaccccacccacctatccttcacccatctggccatccatccttctacccacaccttccttcctaccttccttccttccttccgtccttccttccttccttccttccgtcctcccttcctcccatcctcccttccttcctcctgtcttcctttcctttccttccttctctttctttcttttgttccttcctttctttcctccctccctttctttcctccctcccttcctcccttcctgtctccattattaacttgctggtattttgtttcaccattgcattgtgtttatcaatagacgattaatggaagaagagaagaaatcaggtgaagtctttgtaggatctagaa

SEQ ID NO: 22365 - DNA, 183 bp, Homo sapiens
  DISD22_0010339
  Located on chromosome 16
  Distance between a terminus base of telomere on chromosomal short arm and 5'-terminus of this base sequence : 81044211
  Distance between 3'-terminus of neighbour sequence of sequence listing upward to telomere on chrosomal short arm and 5'-terminus of this base sequence : 201930
cctaagtagttattccgagttatcctttttcaataacaataataaaatgtataagatatatatatatatatatatatatatatatatatatatatatacacacaaatacatatattattttgaactgtatggtaagtgtttattttcttgagatgacacacagaaagcatacaattcaatatt

SEQ ID NO: 22366 - DNA, 155 bp, Homo sapiens
  D16S3142
  Located on chromosome 16
  Distance between a terminus base of telomere on chromosomal short arm and 5'-terminus of this base sequence : 81086811
  Distance between 3'-terminus of neighbour sequence of sequence listing upward to telomere on chrosomal short arm and 5'-terminus of this base sequence : 42417
cgagaatgttttacttttatgccaattatcttaaaactttacttcgtatttccaccagccaatttcttgagtccgagtgtgtgtgtgtgtgtgtgtgtgtgtgtgtgtgtgtgtgtatgtacattaaacaaaaaatctggtctcttctgtaaagc

SEQ ID NO: 22367 - DNA, 189 bp, Homo sapiens
  chr16.fa.O7frz.89859564
  Located on chromosome 16
  Distance between a terminus base of telomere on chromosomal short arm and 5'-terminus of this base sequence : 81257425
  Distance between 3'-terminus of neighbour sequence of sequence listing upward to telomere on chrosomal short arm and 5'-terminus of this base sequence : 170459
tcacttacataacgtcctcaagtttcttccatgtcgtagcacatgactagattttcttctttcttacggctgaatagtattccactgtgtacatacatacatatatatgaaatacacacacacacacacacacacacaaacacacaccccacatgttctttattcattcatctatcagtaggcatttag

SEQ ID NO: 22368 - DNA, 363 bp, Homo sapiens
  chr16.fa.O7frz.89977094
  Located on chromosome 16
  Distance between a terminus base of telomere on chromosomal short arm and 5'-terminus of this base sequence : 81328216
  Distance between 3'-terminus of neighbour sequence of sequence listing upward to telomere on chrosomal short arm and 5'-terminus of this base sequence : 70602
cttagccttaagtccaaatgagagtatcatcactctttaattctgcttctgaatttccctgggcagttcattaaaatatttctgttaacacattgaataacctgcctcggaatattgctttcacatttatttaaagtcataattgggttactgcttcttcccaatgctgaatgctttttgaaaataaaataatgacatatgctgttccaagaaaacattttcatacatacatacatacatatatatatatatatatatatatatatatatatatatatatatatacctgtgtgataatttgtgacacgaacacataattgacatctgtgagacaaaaggacctgctaggtaaagttgaaacaa

SEQ ID NO: 22369 - DNA, 378 bp, Homo sapiens
  AC009046.4_101898
  Located on chromosome 16
  Distance between a terminus base of telomere on chromosomal short arm and 5'-terminus of this base sequence : 81534139
  Distance between 3'-terminus of neighbour sequence of sequence listing upward to telomere on chrosomal short arm and 5'-terminus of this base sequence : 205560
atttctaggctaatagctttgctctaaaagagtgcatgtagatttatatctttaagacttgtcttcagtattcaaagatactatgtattggtattttaaaatctgctggtcagctgacgactgaccaaggacaaaaaaggaactagattgaaagtggtctttaagggaaatgagttgctgagatagaattatcagtgtgtgtgtgtgtgtgtgtgtgtgtgtgtgtgtgtgtgtgtgtgaagataactgtgggtgggaattggaaaacagaccattttggtaggggaaatagaaagcattgcccctaggtggcacattttgaattaaatagtgatgggatgtagaataagattgcttcatatttgctatccataccag

SEQ ID NO: 22370 - DNA, 121 bp, Homo sapiens
  D16S3118
  Located on chromosome 16
  Distance between a terminus base of telomere on chromosomal short arm and 5'-terminus of this base sequence : 81546607
  Distance between 3'-terminus of neighbour sequence of sequence listing upward to telomere on chrosomal short arm and 5'-terminus of this base sequence : 12090
taccccattcattgtgtgtgcacatgtgtgtacatgtatgtgtgtgtgtgtgtgtgtgtgtgtgtgtgtgtgtgtgtgtgtgaggtaaggggctgtgctgagaagcagccagagtctcagt

SEQ ID NO: 22371 - DNA, 366 bp, Homo sapiens
  AC009046.4_149907
  Located on chromosome 16
  Distance between a terminus base of telomere on chromosomal short arm and 5'-terminus of this base sequence : 81582237
  Distance between 3'-terminus of neighbour sequence of sequence listing upward to telomere on chrosomal short arm and 5'-terminus of this base sequence : 35509
cctaacactaaatgacgagttaatggatgcagcacaccaacatggcacatgtatacatgtgtaacaaacctgcacgttgtgcacatgtaccctaaaacttaaagtataataataataataataataataataaacagcctattctttgtcatgtatagtctttgaggtttatttttttttcagcttgtgggcaggtagtgttttgacaaagatttccttagaaactagtggaaaaaaagccaaaatgaaacaaaagcccttcccagtttttgcagattgggtctgtgttggggcaccacttagccaggccatataaaactctgccttatcttcgacttgctgctcacagacataatcctgtaagtt

SEQ ID NO: 22372 - DNA, 230 bp, Homo sapiens
  D16S515
  Located on chromosome 16
  Distance between a terminus base of telomere on chromosomal short arm and 5'-terminus of this base sequence : 81709323
  Distance between 3'-terminus of neighbour sequence of sequence listing upward to telomere on chrosomal short arm and 5'-terminus of this base sequence : 126720
cattctgaaattagacagcgataggttgataaatatctctagtctttgaagttttaagaaacacacacacacacacacacacacacacacacacacacacacatccattctcattgtttgcagtcgttatgttccgtaaagtaaccaagaacactggattggaaaacactgaacaaattactcctgggggaatcacagtacaattagtttcttgcaagcctctggtcaca

SEQ ID NO: 22373 - DNA, 390 bp, Homo sapiens
  chr16.fa.O7frz.98160741
  Located on chromosome 16
  Distance between a terminus base of telomere on chromosomal short arm and 5'-terminus of this base sequence : 82016720
  Distance between 3'-terminus of neighbour sequence of sequence listing upward to telomere on chrosomal short arm and 5'-terminus of this base sequence : 307167
aaagttacagaactgtctgcattaaaaaaatacaatgctggtcaggtgtggtggttcaaatctgtaatcccagatttctattctaaaaaatagaaaaacgtaactgggcgtggtggtgcacacctgtagtcccagctattcaggaggctgaggtaggaggattgcttgaacccgggaggcagaggttgcagtgagccgtgatggcaccactgcactccagcctgggcagcagagcaaaatcatgtctcaataaataaataaataaataaataaagctaagctatttatctatatagacatagatacagatacagagtcatgcattcaacgagttttattgagcacctgccccatgcctggaactgttcttggtgctgagcaagtaacgac

SEQ ID NO: 22374 - DNA, 350 bp, Homo sapiens
  HUMUT1994
  Located on chromosome 16
  Distance between a terminus base of telomere on chromosomal short arm and 5'-terminus of this base sequence : 82155562
  Distance between 3'-terminus of neighbour sequence of sequence listing upward to telomere on chrosomal short arm and 5'-terminus of this base sequence : 138452
ctgggtactcttctgtgacatttgtttctgcacagaggtattgaggatggagataacctaagcctggagtggtcgtctttggtgacagtggcaattgttccacccaggaaagaaaggaagaaagaaagaaagaaagaaagaaagaaagaaagaaagaaagaaagaaagaaagaaagaaagagagagagagagagagaaagaaagaaagaaagaaacgaaggaaggaaggaaaagaaagaggaaagaaggaaggaaggaagaagggaaggaaggaaagaaggaaggaaggaaagaaggaaggagagagaaaggaagaaaaaaggaaaaaaggcaccatgttggggagagag

SEQ ID NO: 22375 - DNA, 345 bp, Homo sapiens
  chr16.fa.O7frz.98412745
  Located on chromosome 16
  Distance between a terminus base of telomere on chromosomal short arm and 5'-terminus of this base sequence : 82268747
  Distance between 3'-terminus of neighbour sequence of sequence listing upward to telomere on chrosomal short arm and 5'-terminus of this base sequence : 112835
cagttcgtaactgatccattattcatttatttcaaggcccagttcggtattccatattaagagagagaggagctttgcaaacttagtctaattaaacagattccacagaatctgtaatattttactttctacagaagaagagctagcagaaattattccctacgcttcttcagttagaaggaagaggacatttattcataggaaggagggaatgagaggggtgggggtgtgtgtgtgtgtgtgtgtgtgtgtgtgtgtgtgtgtgtgtgttttgaattttgtaaattaattttttcatttgattagtgccgaagtctgggatctgccagtacaatgtagtttaga

SEQ ID NO: 22376 - DNA, 465 bp, Homo sapiens
  chr16.fa.partial6.149940
  Located on chromosome 16
  Distance between a terminus base of telomere on chromosomal short arm and 5'-terminus of this base sequence : 82392207
  Distance between 3'-terminus of neighbour sequence of sequence listing upward to telomere on chrosomal short arm and 5'-terminus of this base sequence : 123115
tctatgcagatgtgagtaggatgcattttcaacaactatctcgcaaagcctgttaaagacctcaacatgcaagctccaagatctggatacttgaaactttattccagtgcctcttagctaaattaattaattaattaattaattaatttcgagatggagtcttactctgttgcccaggctggagtacagtggagtaatcttggcccactgtaacctctgcctcccaggttcaaacgattcttgtacctcaacctgccaagtagctggggttacacagtgcaccaccatgcctggctaatttttgtattttcagtagagacagggtttcaccatgttggccaggctggtttcgaactcccaacctcagatgatccgcccacctctgcctcccaaagtgctgggattccaggtgtgagtccccacacccggccaacctcttagctaagtttagaccactcatttctg

SEQ ID NO: 22377 - DNA, 205 bp, Homo sapiens
  D16S3037
  Located on chromosome 16
  Distance between a terminus base of telomere on chromosomal short arm and 5'-terminus of this base sequence : 82421935
  Distance between 3'-terminus of neighbour sequence of sequence listing upward to telomere on chrosomal short arm and 5'-terminus of this base sequence : 29263
gagccaagatgacaccactgcactccagcctgagtgacagagcgagacacacacacacacacacacacacacacacacgaaagaaatacattgggggttagggatcgttttgtgtggttacaataaggaaatgatcaaagtacgatttcacaaatcacacagtttattgctacacaaagatgttttttccttaggttcccagtgc

SEQ ID NO: 22378 - DNA, 377 bp, Homo sapiens
  chr16.fa.partial6.412675
  Located on chromosome 16
  Distance between a terminus base of telomere on chromosomal short arm and 5'-terminus of this base sequence : 82516804
  Distance between 3'-terminus of neighbour sequence of sequence listing upward to telomere on chrosomal short arm and 5'-terminus of this base sequence : 94664
gctctttccttgacagctctgtggctcccactgacagggctctgccagggagctgaggagctgcctctctgtcccttcgccctatgctggggtgactcacagatgccctggtctcgtggtggcctgactatggcctccccactctctgctcccatctcctctctcacagagcccagctgtgagtggatatctgtccaccatgtatagctggtgaccacacacacacacacacacaccacagtctgtcctggagaaacttcagaaggaagggacatcacagctttgagcctctgctcctggaactgctatttgggccaagtcccttctgactttctggcccatccagggcattttgctggatagtttggagccgtagc

SEQ ID NO: 22379 - DNA, 447 bp, Homo sapiens
  chr16.fa.partial6.337685
  Located on chromosome 16
  Distance between a terminus base of telomere on chromosomal short arm and 5'-terminus of this base sequence : 82590276
  Distance between 3'-terminus of neighbour sequence of sequence listing upward to telomere on chrosomal short arm and 5'-terminus of this base sequence : 73095
aattctaagtcaacctgtaccttccaaagcccttatgagattctgcaaacatccagtcattcttcacacatgtactgagcatctactatgcatcggttactgtgcaaggagctagaaatgaagccatgagtgagaccttatggggtgtgtgtgtgtgtgtgtgtgtgtttacgtacgtaccaggggcagggagaggggaagatagagttaatagaataaaaaaccaaacaagagcttctgcagcactaagtgctacagagacgatctgaaggtgatggtcctgagagggctgagaagtggcttctttggacggggaggttggggaggcagacctctgagctgagatggaaagagggagaaccagcattgaaaaggcttgaaggtgacccaggcagagggaacatgaagcatgcaggccctaaggtaaccactttagaaagttcaaga

SEQ ID NO: 22380 - DNA, 396 bp, Homo sapiens
  chr16.fa.partial7.16761
  Located on chromosome 16
  Distance between a terminus base of telomere on chromosomal short arm and 5'-terminus of this base sequence : 82778675
  Distance between 3'-terminus of neighbour sequence of sequence listing upward to telomere on chrosomal short arm and 5'-terminus of this base sequence : 187952
atggtccagtagcctcatttaaaaagtaaaaagaggccaggtgccatggctcacacctgtaatccagcactttgggaggccaactagaggatcgcttgaagccaggagtttgagaacagcctggacaacgtagtgagacccctatctctacaaaaaatgtaaaagccaggcatggtggcacctgtctgtggtcccagctcctcaggaggctgaggcaggaggatcgcttgaacccaggagtttgaggctgccatgagccatgatcacaccactggactctagcctgggcgacagagccagaccctgtctctaaaacaataataaataaataaataaataagaagaaccgggtgagattaattttgagatgatatgttatttaactcagcacatcca

SEQ ID NO: 22381 - DNA, 359 bp, Homo sapiens
  chr16.fa.O7frz.98954098
  Located on chromosome 16
  Distance between a terminus base of telomere on chromosomal short arm and 5'-terminus of this base sequence : 82991481
  Distance between 3'-terminus of neighbour sequence of sequence listing upward to telomere on chrosomal short arm and 5'-terminus of this base sequence : 212410
tccttaaatagctgttctgctgcctccttcactggctttgtttctgttatggggcccccagttgctgcaacactgttccttgtttgcgtgcttgtttaccgtcctggccccatctcagcatcagccccacatgggcagggacttctatcctgttccctgctgcatcctggcccagcgctgggtgtccagcaggtggtggacaaatgtttattgaatgaatggatgaatgaatgaatgaatgaatgaatgaagggatagagagaggggagcctcgggcaggctagaggggatgatgtgttgggaagcacaggaggtaaactgaggctgggtgttgcacagcatctaggatctggccaagt

SEQ ID NO: 22382 - DNA, 329 bp, Homo sapiens
  chr16.fa.partial7.133287
  Located on chromosome 16
  Distance between a terminus base of telomere on chromosomal short arm and 5'-terminus of this base sequence : 83005630
  Distance between 3'-terminus of neighbour sequence of sequence listing upward to telomere on chrosomal short arm and 5'-terminus of this base sequence : 13790
gcttgttctggaacatgagagctcagccatctctaccaccctctgccttccagattatgctctgggatttccaaattgcttgtaccttcagcagcacgcagcccaccatttcacactgccacgaagtccggggtggtgtggtagggaccaggaccccgctgcaaatccccaagcaccctgaggacagggaggggagggtcattttcctgccgtgtgtgtgtgtgtgtgtgtgtgtgtgtgtgtgtgtgtgtgtgtgtgtgtgtgtgtgtgtggtctgccatttttgctctgcttccagaagggacttgaggcagctaagtggtatttaa

SEQ ID NO: 22383 - DNA, 228 bp, Homo sapiens
  AF217490.1_13685
  Located on chromosome 16
  Distance between a terminus base of telomere on chromosomal short arm and 5'-terminus of this base sequence : 83099834
  Distance between 3'-terminus of neighbour sequence of sequence listing upward to telomere on chrosomal short arm and 5'-terminus of this base sequence : 93875
actattgttattggcttgcagtagaaattaaagattatgaatgttcagcattcagaatatactagatactcaataaccattattgctgtcattattaacattattttccccagctttactgaggtatgagtgacaaaaatttcatatatgcgcatgagtgtgtgtgtgtgtgtgtgtgtgtgtgtgtggctgggcatggtggctcttgcctataatcctaacagttga

SEQ ID NO: 22384 - DNA, 287 bp, Homo sapiens
  AF217490.1_53476
  Located on chromosome 16
  Distance between a terminus base of telomere on chromosomal short arm and 5'-terminus of this base sequence : 83139738
  Distance between 3'-terminus of neighbour sequence of sequence listing upward to telomere on chrosomal short arm and 5'-terminus of this base sequence : 39676
gaactgtttcaagaatgctatgacttttgctcagggcaagggaagtgtgtgtgtgtgtgtgtgtgtgtgtgtgtgtgtgtgtgtgtgtgtgtgcgcgcgcctgcatgtgtactgtggatgtgataagagctgtgtttgtgaaaactgtgaagacataacacatatctatgaaccttttctattaatcttcttggggctggagctttaaaataaaataaataacttttctgcagagacagaacctttccttacccaaagatttcgtaactttctcacatccttggtta

SEQ ID NO: 22385 - DNA, 174 bp, Homo sapiens
  DISO7_00045836
  Located on chromosome 16
  Distance between a terminus base of telomere on chromosomal short arm and 5'-terminus of this base sequence : 83433850
  Distance between 3'-terminus of neighbour sequence of sequence listing upward to telomere on chrosomal short arm and 5'-terminus of this base sequence : 293825
ggcagtttcttgacagacccattttgtgtgtgtgtgtgtgtgtgtgtgtgtgtgtgtgtgcgcgtgcgcacacgcatgagcctgtacgtgtccccctccccccccacacatatgcacataagatagcataaggtagttccctggcacatggcgttgttcttaaccatgaggtgc

SEQ ID NO: 22386 - DNA, 357 bp, Homo sapiens
  AF179633.1_14878
  Located on chromosome 16
  Distance between a terminus base of telomere on chromosomal short arm and 5'-terminus of this base sequence : 83527418
  Distance between 3'-terminus of neighbour sequence of sequence listing upward to telomere on chrosomal short arm and 5'-terminus of this base sequence : 93394
acatcttacctcaactggtgactcttcataatctagagctattatagtttccaattgacagatggggaatctgagactcagagaagttaaatgattttgtgtgtgtgtgtgtgtgtgtgtgtatgtgtgtgtgttttgtttttttgtgtgtgtgtttttgtttttttttaagacggagctttgctctttcacccaggctggagtgccttggtgcaatctcagttcactgcaactacaacatcccaggttcaagagagtctcccacctcagcctcacgagtagctgggatttcaggtgcctgccaccatgcctggctaattaagtcagtttcttaaagtcctacaactggtgagctgt

SEQ ID NO: 22387 - DNA, 297 bp, Homo sapiens
  D16S3029
  Located on chromosome 16
  Distance between a terminus base of telomere on chromosomal short arm and 5'-terminus of this base sequence : 83547051
  Distance between 3'-terminus of neighbour sequence of sequence listing upward to telomere on chrosomal short arm and 5'-terminus of this base sequence : 19276
cttttctgaaattggaagtgatgaagtgacagtctggctatatgtgtgtgtgtgtggtgtgtgtgtgtgtgtgtgtgtgtgtgtgtgtgtgtgtgtgtgtgtgtgtgtgtgtgtatacctagtctagggctaggtttgggaactattttctcccgtaagttaaactgaactagactgtatgtcaaaaaagagtctcaatgtcaacttaatccattgtcatgactgtaaaatgctatttcattataccagcaattcccctgtggatttctcctgactctctatgcagcccaactctat

SEQ ID NO: 22388 - DNA, 255 bp, Homo sapiens
  D16S3049
  Located on chromosome 16
  Distance between a terminus base of telomere on chromosomal short arm and 5'-terminus of this base sequence : 83547472
  Distance between 3'-terminus of neighbour sequence of sequence listing upward to telomere on chrosomal short arm and 5'-terminus of this base sequence : 124
gcaatgaaggcaacaaagtatataaaacacacacacacacacacacacacacacacacacacacacacacacacacaagaaatgactacagacacctcaacacccttccaaaacacttgaatcattttcttcgggagttgaacaagtggctgaaaatgccaaaatccatcagccaatgtgtaagtacaaaagggtcagataagatatatgtggattccataaaatagtgcatttgaattcccccaggtcttttaa

SEQ ID NO: 22389 - DNA, 283 bp, Homo sapiens
  AC009145.4_179239
  Located on chromosome 16
  Distance between a terminus base of telomere on chromosomal short arm and 5'-terminus of this base sequence : 83671017
  Distance between 3'-terminus of neighbour sequence of sequence listing upward to telomere on chrosomal short arm and 5'-terminus of this base sequence : 123290
gagtagcacgatctggcttacgatgatttctaacatctcaccatctttacttctgtatataaatatatgataagtatacctttatatatgtgacatgtatctttatatatgatatgtatggttacatatctactcactcacacatccacacacacacacacacacacacacacacttttttggaaccattgaaaagttgcagacatcatcacggctcaccctgaaattccttagcaggcatcttctgagaataaggacattcttctatgcaaccatttcacat

SEQ ID NO: 22390 - DNA, 259 bp, Homo sapiens
  AC009145.4_121549
  Located on chromosome 16
  Distance between a terminus base of telomere on chromosomal short arm and 5'-terminus of this base sequence : 83728815
  Distance between 3'-terminus of neighbour sequence of sequence listing upward to telomere on chrosomal short arm and 5'-terminus of this base sequence : 57515
tgcagcctgagctatagagccagaacttgtctcaaaaaaacccaataataataataataataataataataataataataataataaagaaagcgagagaggaggtagggaatgaatgccgaaagtggttccttgggtctgatgcccacgcttaaccgattcccagccaaacatttcacagttgtcttacgcacaggcgtaagatatgcatctatcttggtgtgcacctgagaagtagttatgtctaagtttccgactt

SEQ ID NO: 22391 - DNA, 190 bp, Homo sapiens
  AC009145.4_120106
  Located on chromosome 16
  Distance between a terminus base of telomere on chromosomal short arm and 5'-terminus of this base sequence : 83730276
  Distance between 3'-terminus of neighbour sequence of sequence listing upward to telomere on chrosomal short arm and 5'-terminus of this base sequence : 1202
tccagtttgttcttaggaatgtgtttctgatgtgtgtgtgtgtgtgtgtgtgtgtgtgtgtgtgtgtgttttccagaaaccaactgggaagggccctaagctgagattactgttgagaagtaaattgtgcttttaaagtgtcctccagcaaaatggtctcctggctgtctttggaaatgacgtatcagtc

SEQ ID NO: 22392 - DNA, 167 bp, Homo sapiens
  D16S516
  Located on chromosome 16
  Distance between a terminus base of telomere on chromosomal short arm and 5'-terminus of this base sequence : 83750288
  Distance between 3'-terminus of neighbour sequence of sequence listing upward to telomere on chrosomal short arm and 5'-terminus of this base sequence : 19822
ggtgccatcctgacagattctactgtgtgcgtgtgtgtgtgtgtgtgtgtgtgtgtgtgtgtgtgtgtgatataatgtgttgcattggtgtctaaagccatgctcagtatatagttatatatttcattcattcatccgttcattcagttatctcacgtttctggagg

SEQ ID NO: 22393 - DNA, 419 bp, Homo sapiens
  AC009145.4_90794
  Located on chromosome 16
  Distance between a terminus base of telomere on chromosomal short arm and 5'-terminus of this base sequence : 83759499
  Distance between 3'-terminus of neighbour sequence of sequence listing upward to telomere on chrosomal short arm and 5'-terminus of this base sequence : 9044
tcactttccattctagctgactgttgtcatatgaggatacacaactatgctggccagtttctttaattttttttctcttctaacagaatctagaaatgtagattgtgtgtgcgtgtgtgtgtgtgtgtttgtgagagagagagagagagagagagagaaatctttaggagttttaaatattggcaactaattcaatttatttctgtttttaacatattgcaccaaatacatgggtatgggccgaaaataacatgaactttttgcagtgtacaaatctctaatttgagacttctaatgaaaagatatttggttacagtatgagagacaagggactaaaataaggttgtggatcattcagggttaaatcagagcaacagcatgagtaggagatatatagaaacagatttattgcaaggagt

SEQ ID NO: 22394 - DNA, 259 bp, Homo sapiens
  AC009145.4_58246
  Located on chromosome 16
  Distance between a terminus base of telomere on chromosomal short arm and 5'-terminus of this base sequence : 83791991
  Distance between 3'-terminus of neighbour sequence of sequence listing upward to telomere on chrosomal short arm and 5'-terminus of this base sequence : 32073
cacgagacttattcactatcatgagaatagtacaggaaagacccacccccatgattcagttgtctccctccaggtcccttccataacacatgggaattatgggagatacaagatgagatttgggtggggacacagagtcaaaccgtatcactctcccacccaacacttgcagaaacacacacacacacacacacacacacacacacacacacaccccttcctacgtcctacatccctgtacttggaaagcaatcatatt

SEQ ID NO: 22395 - DNA, 259 bp, Homo sapiens; identical to SEQ ID NO: 22394
  Z24121.1_217
  Located on chromosome 16
  Distance between a terminus base of telomere on chromosomal short arm and 5'-terminus of this base sequence : 83791991
  Distance between 3'-terminus of neighbour sequence of sequence listing upward to telomere on chrosomal short arm and 5'-terminus of this base sequence : -259

SEQ ID NO: 22396 - DNA, 353 bp, Homo sapiens
  AC009145.4_935
  Located on chromosome 16
  Distance between a terminus base of telomere on chromosomal short arm and 5'-terminus of this base sequence : 83849264
  Distance between 3'-terminus of neighbour sequence of sequence listing upward to telomere on chrosomal short arm and 5'-terminus of this base sequence : 57014
gcatctattaggaaagcctatttcttttttttttctttttgttttttctgagacaggatctcactttgtcacccaggctggagtacagtgtcaccattgtggctcactgcagcctcgacttcccaggcttaggtgatcctcctgtctcagcctcccgagtagctgggactacaggcatgcaccaccactcccagctttgtgtgtgtgtgtgtgtgtgtgtgtgtgtgtgtgtgtgtgtgtgtgtgtgtgtgttttgtagagacagggtctcactgtgttggccaggccggtctcaaactcctagcttcaagcgatcctcctaccttggcctctcaaagtgctaggattacctg

SEQ ID NO: 22397 - DNA, 385 bp, Homo sapiens
  AC036142.2_117478
  Located on chromosome 16
  Distance between a terminus base of telomere on chromosomal short arm and 5'-terminus of this base sequence : 83852256
  Distance between 3'-terminus of neighbour sequence of sequence listing upward to telomere on chrosomal short arm and 5'-terminus of this base sequence : 2639
ctgtgagtcatttccacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggagatgtgtgtgaacaaaatctcattttcaaggagcttattgcctgctgcacattttagcctcatctcgttagtgcaagaaataatttaacaactgaaaaagatgtgaggttgtacctggtaaggtctctattggtcaaggaaaggtttagcatggagagatttctcttaaggtgcctaggtattc

SEQ ID NO: 22398 - DNA, 199 bp, Homo sapiens
  D16S3144
  Located on chromosome 16
  Distance between a terminus base of telomere on chromosomal short arm and 5'-terminus of this base sequence : 83985547
  Distance between 3'-terminus of neighbour sequence of sequence listing upward to telomere on chrosomal short arm and 5'-terminus of this base sequence : 132906
gaatgtggatgggctgtctcaggagccctggcttccttaaggcacacagacacacacacagatgcccacacacagatacccagacacaaacacacacacacacacacacacacacacacagaacacacacacacagaccttttgagtactggttaaaaactagaagaacaaagcaagatataaatgcactgtttgaggc

SEQ ID NO: 22399 - DNA, 327 bp, Homo sapiens
  chr16.fa.O7frz.93535578
  Located on chromosome 16
  Distance between a terminus base of telomere on chromosomal short arm and 5'-terminus of this base sequence : 84118238
  Distance between 3'-terminus of neighbour sequence of sequence listing upward to telomere on chrosomal short arm and 5'-terminus of this base sequence : 132492
attcattaggtctaccttggatctgaagtctttaaaggcctgtgtcataagaatgctttatatataagccaccatatagcataaatcccagacatcacatgaaaataagtccaatactggatatttgtctacaattgatcttttttctcctctgtctcctctgtagcaaactcactgctttcgtctgcaaactatctccttgtgtgtgtgtgtgcgtgtgtgtgtgtgtgtgtgtgagagagagagagagagacagagagagagagagatagagagagagagagagagagagaatagcatcgatggtataggaaggctgtttcctaa

SEQ ID NO: 22400 - DNA, 113 bp, Homo sapiens
  D16S3040
  Located on chromosome 16
  Distance between a terminus base of telomere on chromosomal short arm and 5'-terminus of this base sequence : 84188204
  Distance between 3'-terminus of neighbour sequence of sequence listing upward to telomere on chrosomal short arm and 5'-terminus of this base sequence : 69639
gctgcctagcacatggtagacaccaagtgatgcttgttgcttgtgtgtgtgtgtgtgtgtgtgtgtgtgtgtgtctgtgtgtggtgggaggccccatcgtccttgccggagta

SEQ ID NO: 22401 - DNA, 113 bp, Homo sapiens
  D16S750
  Located on chromosome 16
  Distance between a terminus base of telomere on chromosomal short arm and 5'-terminus of this base sequence : 84194856
  Distance between 3'-terminus of neighbour sequence of sequence listing upward to telomere on chrosomal short arm and 5'-terminus of this base sequence : 6539
atagcaagtactgaatgacctggtcagatggcagaatgaatgaatgaatgaatgaatgaatgaatgaatgaagagttctcatcttctcacctttaaatctcccagtgctttgc

SEQ ID NO: 22402 - DNA, 137 bp, Homo sapiens
  DISD22_0010351
  Located on chromosome 16
  Distance between a terminus base of telomere on chromosomal short arm and 5'-terminus of this base sequence : 84456338
  Distance between 3'-terminus of neighbour sequence of sequence listing upward to telomere on chrosomal short arm and 5'-terminus of this base sequence : 261369
tggaatcaggattgcatgcgtggttgattttggtgttaccagcgcggttactgtgtgtgtgtgtgtgtgtgtgtgtctgtgtgtgtgtgtgtgtgtgtgttttctgggctacagtgtccctgagccctagaggactt

SEQ ID NO: 22403 - DNA, 112 bp, Homo sapiens
  DISD22_0010358
  Located on chromosome 16
  Distance between a terminus base of telomere on chromosomal short arm and 5'-terminus of this base sequence : 84531829
  Distance between 3'-terminus of neighbour sequence of sequence listing upward to telomere on chrosomal short arm and 5'-terminus of this base sequence : 75354
aattgtatggttcagcactgacaaaactggcatttgtctctagacacacacacacaaacacacacacacacacacacaccatacatttgaaacacagcttggaagaaatgat

SEQ ID NO: 22404 - DNA, 220 bp, Homo sapiens
  DISO7_10004180
  Located on chromosome 16
  Distance between a terminus base of telomere on chromosomal short arm and 5'-terminus of this base sequence : 84678561
  Distance between 3'-terminus of neighbour sequence of sequence listing upward to telomere on chrosomal short arm and 5'-terminus of this base sequence : 146620
tcatcatgtctaaatagtgacggggtgcagaaactatcagaggggatgctgtagcttggaaggaaggaaggaaggaaagaaggaagggagggagggagagagagagaaagaaagagagagagagagagagagagaagggaaggaaggaaggaaggaaggaggaaagaaaggagagacagaaagaaagatctacaaaaaatgtacatgagccaagatgtcc

SEQ ID NO: 22405 - DNA, 230 bp, Homo sapiens
  D16S3055
  Located on chromosome 16
  Distance between a terminus base of telomere on chromosomal short arm and 5'-terminus of this base sequence : 84841507
  Distance between 3'-terminus of neighbour sequence of sequence listing upward to telomere on chrosomal short arm and 5'-terminus of this base sequence : 162726
tcccagaatgccttagaaacaagggtgtcagagtgagaagagtggtttgcctttaataggcacagccctagaaaaatggatatggctacagcgcatacacagacatacacatacatatacattcctacatgcaaagaagcacagcccaccacacacacacatacacacacacacacacacacacacacacatgcacatatacacatgctatgtctgctatgtccaggtga

SEQ ID NO: 22406 - DNA, 190 bp, Homo sapiens
  D16S507
  Located on chromosome 16
  Distance between a terminus base of telomere on chromosomal short arm and 5'-terminus of this base sequence : 84928522
  Distance between 3'-terminus of neighbour sequence of sequence listing upward to telomere on chrosomal short arm and 5'-terminus of this base sequence : 86785
gcaggggctagaaggtggacagatccccaccccatcccccacaccttctctctctctctctctctctctctctctctcacacacacacacacacacacacacacacacacacacacacacgaaacatccaccagcatgacaactaaccccttgactagaaaaagacatttaacactgcaagaggcgaaca

SEQ ID NO: 22407 - DNA, 148 bp, Homo sapiens
  chr16.fa.O7frz.93953325
  Located on chromosome 16
  Distance between a terminus base of telomere on chromosomal short arm and 5'-terminus of this base sequence : 85252669
  Distance between 3'-terminus of neighbour sequence of sequence listing upward to telomere on chrosomal short arm and 5'-terminus of this base sequence : 323957
ctggaaatcatgagctacatacagctgcccccacctccaacacacccacacacacattcacatacatgcacacacatatatacacacacatacacacacacatgcacactctgagtcagttatttcatagccagagcatactcagtta

SEQ ID NO: 22408 - DNA, 261 bp, Homo sapiens
  HUMUT6279
  Located on chromosome 16
  Distance between a terminus base of telomere on chromosomal short arm and 5'-terminus of this base sequence : 85338999
  Distance between 3'-terminus of neighbour sequence of sequence listing upward to telomere on chrosomal short arm and 5'-terminus of this base sequence : 86182
acaacaggaaaggaaggcttcccaggtatcttctagtccccaaccctcagtttccttatatttctttttctttctttctttctttctttctttctttctttctttctttctttctttattctttctttcattctttctttctttctttccttcttctttctttctttctttctttcttctttctttctttcttctttccttcttccttccttttcttttttttttgaaggtgtttcactcttgttgcccagacgggagtag

SEQ ID NO: 22409 - DNA, 407 bp, Homo sapiens
  chr16.fa.O7frz.94690327
  Located on chromosome 16
  Distance between a terminus base of telomere on chromosomal short arm and 5'-terminus of this base sequence : 85583220
  Distance between 3'-terminus of neighbour sequence of sequence listing upward to telomere on chrosomal short arm and 5'-terminus of this base sequence : 243960
aaacatctaatgctaactgctactaaaagttaaagtaagataaataacttttttgggttgttctattcctcagaatattccatttaaatacattttttaatgttagcaatacaaagaaaaactgacaaaaactgtaatttggaaaaactcaaacataccatttctgttttaggcaggtcaattagactatatatatatatatatatatatatatatatatatatatataatctagaatattaaaagtttgaaagtttaattttaaaaacaaaaactacaaagaattttgggctgggtgcagtggtcatgcctacaatcccaacattttgggaggccaaggtgggaggatcacttgaggccaacagtttgagaccagcctgggcaacatagtggcgaatcctattgta

SEQ ID NO: 22410 - DNA, 463 bp, Homo sapiens
  chr16.fa.O7frz.94771106
  Located on chromosome 16
  Distance between a terminus base of telomere on chromosomal short arm and 5'-terminus of this base sequence : 85663817
  Distance between 3'-terminus of neighbour sequence of sequence listing upward to telomere on chrosomal short arm and 5'-terminus of this base sequence : 80190
agaatgagcctaaatccattaccatgcaaactgaaaataacagcagaaatgacttgttgcctggaatttgcttcaaaattctacacaaaaaaaaaaattgctgagggctacattgacaaaacgggattggtaagatattgataactgctgaagctgggtgatgaatatttagggattcatgacattattcttctacttttgtgtatatttgaaattttcaatactgaaaattttctttgaagaaaataggtctttttcccatgctcatgggtcttatctctctgtaaatatatattttggagatgagccagccacattttctaggcctgataacctgcaaactgcaaaattatattttgaattatacatacacacacacacacacacacacacacacacacacacacacaaacaaacacacacacacatatatgcatgtataaggtaagtgtggacatacaac

SEQ ID NO: 22411 - DNA, 105 bp, Homo sapiens
  DISO7_10004185
  Located on chromosome 16
  Distance between a terminus base of telomere on chromosomal short arm and 5'-terminus of this base sequence : 85762122
  Distance between 3'-terminus of neighbour sequence of sequence listing upward to telomere on chrosomal short arm and 5'-terminus of this base sequence : 97842
tgcagtaggtccctgtactattcagtaactactaaacacacacacacacacacacacaccacagctgaagaccacaaataaagccattgcacctagttaagtatt

SEQ ID NO: 22412 - DNA, 405 bp, Homo sapiens
  AC021880.3_182704
  Located on chromosome 16
  Distance between a terminus base of telomere on chromosomal short arm and 5'-terminus of this base sequence : 86068346
  Distance between 3'-terminus of neighbour sequence of sequence listing upward to telomere on chrosomal short arm and 5'-terminus of this base sequence : 306119
catgataaagtttaagttcagcacagtaaaagattaacgacaataactgataataaaacgacgataacaatatactgtaatagttatgtgaatgtggtctctctcaaaatatcttactttactgaactcacctattttcggactgcagttgaccatgggtgataaaaccacagaaaccaaaacttcagataaggggtagctactatatacacaatatgtctttttttgatatatgttggatggatggatggatggatggatggatggatggatagatggacagatggatggacagacagataggtagatagatgattgatagacaggcaggtaggtaggtagatagtgttcatttagatttgccactttcttcgttcttccttcttaactcctcagactttccac

SEQ ID NO: 22413 - DNA, 405 bp, Homo sapiens; identical to SEQ ID NO: 22412
  AC021116.5_151994
  Located on chromosome 16
  Distance between a terminus base of telomere on chromosomal short arm and 5'-terminus of this base sequence : 86068346
  Distance between 3'-terminus of neighbour sequence of sequence listing upward to telomere on chrosomal short arm and 5'-terminus of this base sequence : -405

SEQ ID NO: 22414 - DNA, 101 bp, Homo sapiens
  DISD22_0010370
  Located on chromosome 16
  Distance between a terminus base of telomere on chromosomal short arm and 5'-terminus of this base sequence : 86279728
  Distance between 3'-terminus of neighbour sequence of sequence listing upward to telomere on chrosomal short arm and 5'-terminus of this base sequence : 210977
taagcgttcgttatgagtgcacttaactttcattcattcattcattcattcattcattcagctttcactaacttcttcagccctccagcatctgtctgtca

SEQ ID NO: 22415 - DNA, 101 bp, Homo sapiens
  DISD22_0010494
  Located on chromosome 16
  Distance between a terminus base of telomere on chromosomal short arm and 5'-terminus of this base sequence : 86801914
  Distance between 3'-terminus of neighbour sequence of sequence listing upward to telomere on chrosomal short arm and 5'-terminus of this base sequence : 522085
tgttagctgagctgccagtttttcccttgtttgtgtgtgtgtgtgtgtgtgtgtgtgtgtgtgtgtgtgtgtgtttccccattgcaagtgtgaggccaaat

SEQ ID NO: 22416 - DNA, 479 bp, Homo sapiens
  chr16.fa.O7frz.95614336
  Located on chromosome 16
  Distance between a terminus base of telomere on chromosomal short arm and 5'-terminus of this base sequence : 86876583
  Distance between 3'-terminus of neighbour sequence of sequence listing upward to telomere on chrosomal short arm and 5'-terminus of this base sequence : 74568
ctgacgaacatggtgaaaccccgtctctactaaaaatactaaaattagccaggtgtggtggtaggcgcctgtaatcccagctacatgggaggctgaggcaggagaattgcttgaactcaggaggtggaggttgcagtgagccgagattgagccactgaactccagcctgggtgacagagcgagactccatctcaaataaataaataaataaataaatgtcaggatagtagttactttgggtggaggggaatcttcactagatgaggacttgagggggcctcaagaaggctggccatgttctgtttttgttttaagtacagacgttggttacacaagcatgctcgctttgtgaaaattcattgaggcttacactatgatttgtactccaataaaaagtttataaaggagggaatcattgagcatagaatttcatggaatttaaaacttccaggtctctgtgctgacatgatagcaatagt

SEQ ID NO: 22417 - DNA, 297 bp, Homo sapiens
  chr16.fa.O7frz.95798519
  Located on chromosome 16
  Distance between a terminus base of telomere on chromosomal short arm and 5'-terminus of this base sequence : 87001621
  Distance between 3'-terminus of neighbour sequence of sequence listing upward to telomere on chrosomal short arm and 5'-terminus of this base sequence : 124559
agtgacaatgtcaaatggatacagaccctacagccaagcatcaaaatttagcactcttaagtgataaccaaatggtgagggaaatgttttttttctccctctactcgtgtgtgtgtgtgtgtgtgtgtgtgtgtgtgtgtgtgtgtagctgatggtctggtaggaaaaaaaagccactctgtcatttgtgaagtggcatggaaaataagttttctctatagggagagcttgggtgtttggaagtcagcactgaggtagagtttggtgcacaggatgtttatcagatatcagcacctg

SEQ ID NO: 22418 - DNA, 330 bp, Homo sapiens
  HUMUT532
  Located on chromosome 16
  Distance between a terminus base of telomere on chromosomal short arm and 5'-terminus of this base sequence : 87118245
  Distance between 3'-terminus of neighbour sequence of sequence listing upward to telomere on chrosomal short arm and 5'-terminus of this base sequence : 116327
catctgcggttctttcctccactgaagtcttaaaccttttaacatcatctatgagggttggaatcaactttctttctttctttctttctttctttctttctttcttgctttcttgctttcttgctttcttgctttcttgctttcttgctttcttgctttcttgctttcttgctttcttgctttcttctttctttctttctttctttctttctttctttctttctttcttttctttctttctttctttctttttctttctctctttctctttctctcttttctttcctttctctcctttctttctttttgagacagggtcttgctctgttg

SEQ ID NO: 22419 - DNA, 418 bp, Homo sapiens
  chr16.fa.O7frz.96058906
  Located on chromosome 16
  Distance between a terminus base of telomere on chromosomal short arm and 5'-terminus of this base sequence : 87249416
  Distance between 3'-terminus of neighbour sequence of sequence listing upward to telomere on chrosomal short arm and 5'-terminus of this base sequence : 130841
tcttagctcctacaggctactcatattccttgccacacaggcccctccatcttcaagccagcaattgtgggttagagccttgtgctttgaaatgctgacatcctccaaacaccgcatgttctcactcatagatgggaattgaacaatgagaacacatggacacaggaaggggaacatcacactctggggactgttgtggggtggggggaggggggagggatggcattaggagatatacctaatgctaaatgatgagttaatgggtgcagcacaccagcatggcacatgtatacatatgtaactaaccggcacattgtgcacatgtaccctaaaacttaaagtataataataataataataataataaattaaaaaaaagtaaagaaatgctgacatcctctgttgctgacctctagac

SEQ ID NO: 22420 - DNA, 461 bp, Homo sapiens
  chr16.fa.partial1.283556
  Located on chromosome 16
  Distance between a terminus base of telomere on chromosomal short arm and 5'-terminus of this base sequence : 87361181
  Distance between 3'-terminus of neighbour sequence of sequence listing upward to telomere on chrosomal short arm and 5'-terminus of this base sequence : 111347
acatctattgatggtatctttgagtgtgagatccatttatctgtccattcatctattcatccattcatccaaccatccatccatccatccatccacccatccatccatccatccatccatccatccatccatccatccatctgtccatccttatatccattcatccatctatcccattcatccatccatccatccatccatatccatccattcatccaatcatccatccagcatttctggagtacatgtctgtgcttggccctgtgctgaggcagaagatacagtgttggatttgatagagactttgctgttcaagaaattacttcagtgcatagctggagagcagggattttcaacctccagtttgtttatattttgggctggataatcttttgttgtgagggctgtcatgtgcattgtaggatgcctagcagcatgcctggattctacctgctagattc

SEQ ID NO: 22421 - DNA, 357 bp, Homo sapiens
  chr16.fa.partial1.410215
  Located on chromosome 16
  Distance between a terminus base of telomere on chromosomal short arm and 5'-terminus of this base sequence : 87487341
  Distance between 3'-terminus of neighbour sequence of sequence listing upward to telomere on chrosomal short arm and 5'-terminus of this base sequence : 125699
cattcatctggtttgaagatagacaggtggttgctgtcactgcaccagcagcttttgaagtttgctcagtgatatgattacagcccatacttaagcttctgctccaggaagtgagattgacctttgatcctactcctcatttaaaaattacagatcttggaaaatgaaccaatctagaaagatattggaagctgctgctgctgctgctgctgctgctgctgaggttggctgtcaaaccaacttaactggcctgcattacctagaattgtttttttttttttttttctggttaaaaccaatgacctttaaagcctttttatttttcctctgacaatctctagtggacctatggtcttt

SEQ ID NO: 22422 - DNA, 425 bp, Homo sapiens
  chr16.fa.partial1.413936
  Located on chromosome 16
  Distance between a terminus base of telomere on chromosomal short arm and 5'-terminus of this base sequence : 87491051
  Distance between 3'-terminus of neighbour sequence of sequence listing upward to telomere on chrosomal short arm and 5'-terminus of this base sequence : 3353
aaatcatgttgaagatagtcaaacaaaagctggcagtgtgggagtgggggcttcaagcagagaatcagtggttcaaaggcacagggtagaaggagaatggcagctggctcagtgtggctggagaaagaggctggagtgcacctggttgcatttgaatggtgtgcgtgtgtgtgtgtgtgtgtgtgtgttaatgatggtgatgagatgaggggctagagaggaagacaggttggcacctggtagcattttttaaaaagcaagtaaaccttattttttagagcaggtttaagttcacagcaaaatttggtggaaggtacagaagtttcccaagtacctcctatccccacaaatgcacagccttgtcccactatcaacatcccacatcagaatggtacatttgttacagtcaatgactctacattgac

SEQ ID NO: 22423 - DNA, 383 bp, Homo sapiens
  chr16.fa.partial2.68872
  Located on chromosome 16
  Distance between a terminus base of telomere on chromosomal short arm and 5'-terminus of this base sequence : 87649519
  Distance between 3'-terminus of neighbour sequence of sequence listing upward to telomere on chrosomal short arm and 5'-terminus of this base sequence : 158043
cacttatctgatctttcaatgatctgagttagctcaagaaattacatctagttaccataccatgtcaagactgctatttaactagaaaacaaagagacttcctccactccatgcaaacacatgttgattctcatttacctgtttaggaaaaaaaaatttagattcaggctcatatactaattttattcagtgcttaaggtatgtctgttatttgggatagaattcagtgaacaatgctaaggtttacaagggcccatgtatgactttagggccgtgtgtgtgtgtgtgtgtgtgtgtgtgtgtgtgtatacatgtgtatgtgtacatacttttccccctgtaataggatttctttagatctgatgcttaataagacagaaaga

SEQ ID NO: 22424 - DNA, 208 bp, Homo sapiens
  AC009028.3_30206
  Located on chromosome 16
  Distance between a terminus base of telomere on chromosomal short arm and 5'-terminus of this base sequence : 87703581
  Distance between 3'-terminus of neighbour sequence of sequence listing upward to telomere on chrosomal short arm and 5'-terminus of this base sequence : 53679
ttaatgaccagcaacgtgtcaggttttctgtgttcctggggctgtaaaacaccaggaacattttaaggaggtcagactcagcaggggcgtggacatgagtacatgcacatgtgtgtacgtgtgtgtgtgtgtgtgtgtgtgtgcatgcacatgtcctggaatgctccattcctccatgctttccctgtaggcagtatgcctttgtaaa

SEQ ID NO: 22425 - DNA, 200 bp, Homo sapiens
  D16S422
  Located on chromosome 16
  Distance between a terminus base of telomere on chromosomal short arm and 5'-terminus of this base sequence : 87729844
  Distance between 3'-terminus of neighbour sequence of sequence listing upward to telomere on chrosomal short arm and 5'-terminus of this base sequence : 26055
cagtgtaacctgggggccagggaagacctgaacctctaggactcaaaccctgtcatgattcttgaggagagaggaaggtggaaatacatacatacacatagacacacacacacacacacacacacacacacacacacatatacacacacacacactctatatatgtatatatattctcattctgctaaactaatcgaaag

SEQ ID NO: 22426 - DNA, 363 bp, Homo sapiens
  AC009028.3_79852
  Located on chromosome 16
  Distance between a terminus base of telomere on chromosomal short arm and 5'-terminus of this base sequence : 87753138
  Distance between 3'-terminus of neighbour sequence of sequence listing upward to telomere on chrosomal short arm and 5'-terminus of this base sequence : 23094
atgatctcctggaatctgtttagggaataaaaatgtccgtacagaagaaaaaggttgttttttgaccttctgctgacactgtcttcttgctctcatcacagcttattttctagcaatatgaggcccacaaattaggaatctccttgcaggccttcaaatatgatttacctgattaataaaatcttagtggaatagatagtattctcctgtgtgtgtgtgtgtgtgtgtgtgtgtgtgtgtgtgtgtgtgtctgatgattggggttcttggatacttagggtgcagggatgagggcaagctgaccttgtttttcatctaggagacctgacaaagatggtgggctgagatagccgtgtaaagcta

SEQ ID NO: 22427 - DNA, 235 bp, Homo sapiens
  Z67653
  Located on chromosome 16
  Distance between a terminus base of telomere on chromosomal short arm and 5'-terminus of this base sequence : 87753265
  Distance between 3'-terminus of neighbour sequence of sequence listing upward to telomere on chrosomal short arm and 5'-terminus of this base sequence : -236
caaattaggaatctccttgcaggccttcaaatatgatttacctgattaataaaatcttagtggaatagatagtattctcctgtgtgtgtgtgtgtgtgtgtgtgtgtgtgtgtgtgtgtgtgtctgatgattggggttcttggatacttagggtgcagggatgagggcaagctgaccttgtttttcatctaggagacctgacaaagatggtgggctgagatagccgtgtaaagct

SEQ ID NO: 22428 - DNA, 258 bp, Homo sapiens
  AC009028.3_87780
  Located on chromosome 16
  Distance between a terminus base of telomere on chromosomal short arm and 5'-terminus of this base sequence : 87761224
  Distance between 3'-terminus of neighbour sequence of sequence listing upward to telomere on chrosomal short arm and 5'-terminus of this base sequence : 7724
gtcaaattcacagatgtggaacccacagaaactgaggactgactgtatatgtgtgtgtgtgtgtgtgtgtgtgtgtgtgtgtgtgtgtgtagacacgtagaattttgtgatctagaagtgttaaatataagaggtaattatgtgaggtaaataaaatgtgtgcgttaaatataacaggaatactactatatgaatttttctgaaatttgtgttttaacattttaagttgtttttaactattctttggtacggacattg

SEQ ID NO: 22429 - DNA, 190 bp, Homo sapiens
  AC009028.3_125513
  Located on chromosome 16
  Distance between a terminus base of telomere on chromosomal short arm and 5'-terminus of this base sequence : 87798927
  Distance between 3'-terminus of neighbour sequence of sequence listing upward to telomere on chrosomal short arm and 5'-terminus of this base sequence : 37445
gatgccataacagattggatacatacaatcaaattgttgctaataacactaggccaaagtctttataagtgcgcacgcctgtgtgtgtgtgtgtgtgtgtgtgtgtgtgtgtgtgtgtgtgtgatgttgtaagaaagtttaaggctatctcccttccttattcctctctctgattactgtcaatgctagc

SEQ ID NO: 22430 - DNA, 119 bp, Homo sapiens
  D16S3091
  Located on chromosome 16
  Distance between a terminus base of telomere on chromosomal short arm and 5'-terminus of this base sequence : 87798961
  Distance between 3'-terminus of neighbour sequence of sequence listing upward to telomere on chrosomal short arm and 5'-terminus of this base sequence : -156
tgttgctaataacactaggccaaagtctttataagtgcgcacgcctgtgtgtgtgtgtgtgtgtgtgtgtgtgtgtgtgtgtgtgtgtgatgttgtaagaaagtttaaggctatctccc

SEQ ID NO: 22431 - DNA, 279 bp, Homo sapiens
  chr16.fa.partial2.363291
  Located on chromosome 16
  Distance between a terminus base of telomere on chromosomal short arm and 5'-terminus of this base sequence : 88050398
  Distance between 3'-terminus of neighbour sequence of sequence listing upward to telomere on chrosomal short arm and 5'-terminus of this base sequence : 251318
gcctggtagaagtactttagtctccaaagtatgtggacgctctacttctccctagtttgtggacctgaaaaggatttagatattaatatagaataacttttccaaactagttctgaaaacataagaactgagagatagccccctgcaacacacacgcacatgcacacacacacacacacacacacacataggttttgtgctgtcttgggagcatttaagatactctgcaaactacaattgcttccttaaaatgtacagtggacgtttgacatagtaaag

SEQ ID NO: 22432 - DNA, 252 bp, Homo sapiens
  HUMUT8162
  Located on chromosome 16
  Distance between a terminus base of telomere on chromosomal short arm and 5'-terminus of this base sequence : 88137388
  Distance between 3'-terminus of neighbour sequence of sequence listing upward to telomere on chrosomal short arm and 5'-terminus of this base sequence : 86711
aatggaggtggtggttagcccacggtcccagaatcaatcagctacacctgtggcagatttaggattagaatgaagacctccctacttctttctttctttctctttcttttttctttctttctttctttctttctttctttctttctttctttctttctttctttctttctttctttccttccttccttctttccatctttcttgttttctttttttcttttttttttaagagggagtttcgctttttttgcc

SEQ ID NO: 22433 - DNA, 478 bp, Homo sapiens
  chr16.fa.O7frz.96913947
  Located on chromosome 16
  Distance between a terminus base of telomere on chromosomal short arm and 5'-terminus of this base sequence : 88194046
  Distance between 3'-terminus of neighbour sequence of sequence listing upward to telomere on chrosomal short arm and 5'-terminus of this base sequence : 56406
cattactgcattgtttgaaaaccactacgttgtaaattgcataaatgtgtatcaatgggtgaatggctaataaaaactttaaaaataaatataaaactgccattcaaaggaatgaacgaaatattatataaatatataacccaataatttctataaagattatatgtgtgtgtatatagatatatgtattatatatgtgtgtgtgtatatatatatatatatatagagagagagagagagagagagagagagactgtcccagaacaaggaagccaattttagggcatattccatataatacaatttttaaacaattaataaacatatacataaaatataccatattattctcagaaacaaatatatgcctaagatgattcaaaatggacattggtattcttgcgtgaggatgagagtggttgtcattggtaaaaaggttgaaagtcatagaacaggatatgacggatcaaagatctta

SEQ ID NO: 22434 - DNA, 141 bp, Homo sapiens
  DISD22_0010500
  Located on chromosome 16
  Distance between a terminus base of telomere on chromosomal short arm and 5'-terminus of this base sequence : 88294961
  Distance between 3'-terminus of neighbour sequence of sequence listing upward to telomere on chrosomal short arm and 5'-terminus of this base sequence : 100437
cttgatagatttgatgttgatggattttatgtggggatggggtggggggagagagagagagagagagagagagagagagagagagagagagagagagtgagttacatgactgtatttctgaatttgcctatgtatatgatg

SEQ ID NO: 22435 - DNA, 343 bp, Homo sapiens
  chr16.fa.partial3.220907
  Located on chromosome 16
  Distance between a terminus base of telomere on chromosomal short arm and 5'-terminus of this base sequence : 88463208
  Distance between 3'-terminus of neighbour sequence of sequence listing upward to telomere on chrosomal short arm and 5'-terminus of this base sequence : 168106
actgtagtgcaacaataccaagagcaggaagttcatgtgggcacaatactattaaccagacctcacgaagtctccacccatttttgtgtgttttctgtgtgtgtgtgtgtgtatgtgtgtgtgtgtgtgtgtgtgtgtggtcctacgcatttgatcacacgtacagatttgtgtgaccaccaccaccatcatgatacaggacagctgcatggtcacagaagggctacctgtcttgctactccttattagttgtattaaccttccccttactcttgggcttctcccctggcaattattaacctgttctccacctgtagttttgtcacttcaaggatggtacata

SEQ ID NO: 22436 - DNA, 321 bp, Homo sapiens
  AC012320.5_144960
  Located on chromosome 16
  Distance between a terminus base of telomere on chromosomal short arm and 5'-terminus of this base sequence : 88511100
  Distance between 3'-terminus of neighbour sequence of sequence listing upward to telomere on chrosomal short arm and 5'-terminus of this base sequence : 47549
ccttccaagttgtgatgttactgctgttgtgatgattcttcagggagcaggcactggaagaagaaacttagctggaaaagaactcttccttcttctcctcctcctcctccacaaaacaggaatcaggtgtctcctgataacattttagtatctctaatatctttttcttcttcttccttgtgttgactgctgatgtgatacctctgttcttgtcttcttagtttaaaagaatttaaacaagagacacacaccaaaagaagtgcagcatagagtaatctactgcaacagaaaaagaatatgttgaaagttaggtgcagaata

SEQ ID NO: 22437 - DNA, 289 bp, Homo sapiens
  AC012320.5_177358
  Located on chromosome 16
  Distance between a terminus base of telomere on chromosomal short arm and 5'-terminus of this base sequence : 88563883
  Distance between 3'-terminus of neighbour sequence of sequence listing upward to telomere on chrosomal short arm and 5'-terminus of this base sequence : 52462
tacctaatgctaaatgacgagttaatgggtgcagcacaccagcatggcacatgtatacatatgtaactaacctgcacattgtgcacatgtaccttaaaacttaaagtataataataataataataataataataataataataataataaaaacagggattaaagcggggcaaggaagagaagttggtcagtaggaagcaggtggtcctttaggcaatcctgatggatgaggggtctggctcctcattatccagaggcagtggtctggtaagtttcagctccttgattt

SEQ ID NO: 22438 - DNA, 289 bp, Homo sapiens; identical to SEQ ID NO: 22437
  AC009036.5_103729
  Located on chromosome 16
  Distance between a terminus base of telomere on chromosomal short arm and 5'-terminus of this base sequence : 88563883
  Distance between 3'-terminus of neighbour sequence of sequence listing upward to telomere on chrosomal short arm and 5'-terminus of this base sequence : -289

SEQ ID NO: 22439 - DNA, 395 bp, Homo sapiens
  AC009036.5_189114
  Located on chromosome 16
  Distance between a terminus base of telomere on chromosomal short arm and 5'-terminus of this base sequence : 88682537
  Distance between 3'-terminus of neighbour sequence of sequence listing upward to telomere on chrosomal short arm and 5'-terminus of this base sequence : 118365
ggtgaaatagttaaagaacatgagtttgagggattccaaggagaattctgctaggatccctatatatctttgttgaccttaatggtagatttcggatttcacgaccctgatgcaaccaaataacatatttttgtcatgagaattctatttttccaggcttaatcttttatttttatttatttatttatttatttattttgagacagagtttctctcttgttgcccaagttggagtgcaatagggcaatctcatatcaccacaacctctgcctccccagttcaagagattctcgttcctcagtatgtagctggggttacaggtatgcaccaccaagcccagctaatttttatattattagtaaagacggggtttcttcattgtctgtattcgtcag

SEQ ID NO: 22440 - DNA, 402 bp, Homo sapiens
  chr16.fa.partial4.167743
  Located on chromosome 16
  Distance between a terminus base of telomere on chromosomal short arm and 5'-terminus of this base sequence : 88822546
  Distance between 3'-terminus of neighbour sequence of sequence listing upward to telomere on chrosomal short arm and 5'-terminus of this base sequence : 139614
gacaaattccagaatgcaccaagaccgcgatgcacagagaccaagcgggtgttggggccgtgcacagggcactctgtgtgtcttctgggggagtgtctgtgtttctgtatgtctgccaggagcttttcagcatccttttgcatgggaggatttggtcattcattgagcatttttgagtccctactatgtgctggacacagtgcaaggtgagctgtgtgtgtgtgtgtgtgtgtgtgtgtgtgtgtgtgtgtgtgtgtgtgtctgcctctgcctgtggctagctgtgcctgtcagggcacgcaggggtgtgtatgcacatgagtatgcacaggagaggggtgtccagggccgggagatggggccaggcccaggtcaggatcacagtttctgtcctgttacatc

SEQ ID NO: 22441 - DNA, 212 bp, Homo sapiens
  HUMUT6988
  Located on chromosome 16
  Distance between a terminus base of telomere on chromosomal short arm and 5'-terminus of this base sequence : 88822620
  Distance between 3'-terminus of neighbour sequence of sequence listing upward to telomere on chrosomal short arm and 5'-terminus of this base sequence : -328
tgtgtgtcttctgggggagtgtctgtgtttctgtatgtctgccaggagcttttcagcatccttttgcatgggaggatttggtcattcattgagcatttttgagtccctactatgtgctggacacagtgcaaggtgagctgtgtgtgtgtgtgtgtgtgtgtgtgtgtgtgtgtgtgtgtgtgtgtgtctgcctctgcctgtggctagctgtg

SEQ ID NO: 22442 - DNA, 394 bp, Homo sapiens
  chr16.fa.partial4.219439
  Located on chromosome 16
  Distance between a terminus base of telomere on chromosomal short arm and 5'-terminus of this base sequence : 88874211
  Distance between 3'-terminus of neighbour sequence of sequence listing upward to telomere on chrosomal short arm and 5'-terminus of this base sequence : 51379
agaacctagcctggatgagttcacgcggattcctgagcgggtgtccccactgttccccccaactcccaccccgcaccaagcaggaactcggctcaggcaggtggagcacgtggctcagagcatcacagctggcaagcaacaaggctgggattcaccctgagtcaggctcctttcagaggctgtaatgtcacacggcctcctgccccacaaggactctgacagtgcctgaatgagtgtgtgagagaatgaatgaatgaatgaatgaatacacaaatgccagaaaagagaggaaaggaaacgtcgtttgattgttcccctgtattacgctcctgaggctgccaacacagactcaggggcttagaacaatagaaagttattctgtcatggtcttgaa

SEQ ID NO: 22443 - DNA, 420 bp, Homo sapiens
  chr16.fa.partial4.276441
  Located on chromosome 16
  Distance between a terminus base of telomere on chromosomal short arm and 5'-terminus of this base sequence : 88932146
  Distance between 3'-terminus of neighbour sequence of sequence listing upward to telomere on chrosomal short arm and 5'-terminus of this base sequence : 57541
aatacataacatctggagtagcagaaaaggctctgaaaaagtcagacgccttaagtttacacctggttttactatgaaaattaaacttctcttcgtgtgtgtgtgtgtgtgtgtgtgtgtgtgtgtgtttgtgtgtgtgtttaatgcagcaaaacctcagaggctcttaggcctaaaatatgatagacaaagaagagtaaaattttaatttcttcttccttctgatgaaagaaatgatcgtaaataataacagaactagaaatttgttaacctgatttaagataaacagggaaaaaaaacccttttcctttggtaacacatatctttggaaaatatcatttaataaatatgcaatttactatttgagactaaactctattttgacaagcccaattgtaatgaagtaggaaagactaagcc

SEQ ID NO: 22444 - DNA, 453 bp, Homo sapiens
  chr16.fa.partial4.404913
  Located on chromosome 16
  Distance between a terminus base of telomere on chromosomal short arm and 5'-terminus of this base sequence : 89059877
  Distance between 3'-terminus of neighbour sequence of sequence listing upward to telomere on chrosomal short arm and 5'-terminus of this base sequence : 127311
gaatcatattctgcagttaacaaggtctccaggtgactcatgcaaactgaagtttgacaggcactgttctagtgtgtggttctcaagcttggctgcatgttggaatcacctgggggttccttgaaacattctgttgcttgggcagggtcctcccaagattctaatttaattaatgtaggtttgagctgcacagtagaattttccagaacccccatggataattcaaatgtggagccagggtagaaaactttgctatacatatttacacacacacacacacacacacacacacacacacacagatatgtatatttgatggatgaatggatgaatggccaaagcaacttctctgtgtaaaaggcaaggtgttgacaaccacagttttctctggattaaaatgctctgaaatggaaaaagaaattatttccagtgtccacagaaatcataaattga

SEQ ID NO: 22445 - DNA, 277 bp, Homo sapiens
  chr16.fa.partial4.428962
  Located on chromosome 16
  Distance between a terminus base of telomere on chromosomal short arm and 5'-terminus of this base sequence : 89084017
  Distance between 3'-terminus of neighbour sequence of sequence listing upward to telomere on chrosomal short arm and 5'-terminus of this base sequence : 23687
ctcagtgatacaagtcaggaagatgattcccttgggaataatgactgggagggacacaggagcgggggttgggggctgggcatgttgtttttgggggctgatgacagtgttcagtttgtacaactgatccgtgcactttagtatgtatgtcatatttcaactcaaaaggttttgtgtgtgtgtgtgtgtgtgtgtgtgtgtgtgtgtgtgtgtgtagggtcgaataagaaatatcagtgggctgattcagccttggctgcaggttatgatcaggtat

SEQ ID NO: 22446 - DNA, 436 bp, Homo sapiens
  AC009143.4_152623
  Located on chromosome 16
  Distance between a terminus base of telomere on chromosomal short arm and 5'-terminus of this base sequence : 89108647
  Distance between 3'-terminus of neighbour sequence of sequence listing upward to telomere on chrosomal short arm and 5'-terminus of this base sequence : 24353
aatccaactttctatccttcaccacccatcctttaatccatccaaacatccttctatctgcctattctttatctacccaccaatccatccatccatccatccatccatccatccatccatccatccacccatcttctcattttactcatcctgctgacaacctgttttgccatccattaaccctttaatccattaatcaattttccttccatccaccagttttccatctatccatccttccatccaaccatctacccatggttccatatttctttccatagctccatccttccatccatttttctatccacacatccttttatcttcccatccattcaccagtcttccatccatccatcatccatctgatatttgaatacctactctattgcatgttcagctctaggcactgaggaatcactagtgtacaaggtag

SEQ ID NO: 22447 - DNA, 111 bp, Homo sapiens
  DID22N_0012839
  Located on chromosome 16
  Distance between a terminus base of telomere on chromosomal short arm and 5'-terminus of this base sequence : 89157827
  Distance between 3'-terminus of neighbour sequence of sequence listing upward to telomere on chrosomal short arm and 5'-terminus of this base sequence : 48744
actgtccaccagcctcagagcctgtgtgtgtgtgcgtgtgtgtgtgtgtgtgtgtgtgtgtgtgtgtgtgtgtgtgagcttcccctcccaaatgaacgatttgaggcttcc

SEQ ID NO: 22448 - DNA, 289 bp, Homo sapiens
  DISO7_10004194
  Located on chromosome 16
  Distance between a terminus base of telomere on chromosomal short arm and 5'-terminus of this base sequence : 89561778
  Distance between 3'-terminus of neighbour sequence of sequence listing upward to telomere on chrosomal short arm and 5'-terminus of this base sequence : 403840
ttaggattggaatggttcaactgattgactcagtcaatcaagcatctgtctatttatctatcacttcatctgttcattcatttattcacatattgattcacttgtctatccattccttactcctcctttacttctttaagtatccatctgttatctatccatccatctacccattcatctgtccacttatccagttaccaacctacccatccatccgtccgtccgtccatccatccatccatccatccatccatccatccatccattcatccgtccatcttcatatcca

SEQ ID NO: 22449 - DNA, 113 bp, Homo sapiens
  Z66686
  Located on chromosome 16
  Distance between a terminus base of telomere on chromosomal short arm and 5'-terminus of this base sequence : 89620666
  Distance between 3'-terminus of neighbour sequence of sequence listing upward to telomere on chrosomal short arm and 5'-terminus of this base sequence : 58599
tgggttgtgggtacaccaggaagtgtgagtgtgagagtgtgtgtgtgtgtgtgtgtgtgtgtgtgcaggcctgcctaggggagtgtgtatcccagtccactttcctggaggag

SEQ ID NO: 22450 - DNA, 409 bp, Homo sapiens
  chr16.fa.O7frz.99970182
  Located on chromosome 16
  Distance between a terminus base of telomere on chromosomal short arm and 5'-terminus of this base sequence : 89981121
  Distance between 3'-terminus of neighbour sequence of sequence listing upward to telomere on chrosomal short arm and 5'-terminus of this base sequence : 360342
actgaacctcagttatgtacagaggtaaccctctcattaatgcactctttactagcttgtctctctttcctgattcatgtcatcactccttcatttgtgcttccaggggtcacctctcaaaggaattatgtgagctcaagtccttggctcagcctctgcctccaggggaacccaccctgagacacccactagagagaggcagcagatcaaatactggacaaagacgggagaatcagaagagttcagagatttactttttattgtattgtattgtattgtattatattgtattgtattatatttagtattgtcttatttcttttgcagacagggaagatctggtagccaaaacattttaaaacaaactgatgacagccaagaaagcacagattcaatggctacaaagttg
